United States Patent 9,782,462 (MODIFIED POLYNUCLEOTIDES FOR THE PRODUCTION OF PROTEINS ASSOCIATED WITH HUMAN DISEASE) - sequence listing, part 126

SEQ ID NO: 244055 - DNA, 4724 bp, Artificial Sequence
  Description of Artificial Sequence: Synthetic coding sequence
atacccagaaagccgatttccaagagaccagtgcggccatccctccccagatcccctcggtgtcccctgcccttcaacgccagcgaggtggtgggcggtaccatcctatgcgagaccatctccgggcctactgggtcagctatgcagcagtgtcagctgttatgtcggcagggatcttggtctgtcttcccgcctggccctctcatatgttctcttgagagcgggagatgggaatctcagcttcctcagccaagagcttgccagcgaccacagctatggcaaaccatacagacccagggccacttccagctgcagttaccaccaggaaagatgtgcagcgcggactacgcagatctgctgcagacattccaggtgtttattttggacgaactgaccgcccgtgggttttgtcagatccaggtaaagacctttgggactttagtaagcatcccagtgtgtaacaactcctcagtccaggttgggtgtttgacgcgtgagagattaggtgtgaatgtaacatggaaatctcgcttagaggatattcctgtggctagcctgcccgacctgcacgacattgaacgggcactggttggaaaggacctgcttgggcgatttacagacctcatccaaagcggaagtttccagctacatttagactcaaagacatttccagcagagaccatcagatttctgcagggagatcactttggtacttctcctcggacctggtttgggtgcagcgagggattctatcaggttctcaccagtgaggcttcacaagatggcctcggctgtgttaaatgcccggagggtagctattcccaggacgaagaatgcataccttgccccgtcggattctatcaggagcaggccggttccctcgcatgcgtgccctgccccgtcggcagaacaaccatctcagccggtgcattttcacagacacattgcgtcaccgattgtcagcgcaacgaggccggtctgcagtgcgaccaaaatgggcaataccgcgcttcacaaaaagatagaggctcaggaaaagccttctgcgtcgacggagagggacgaagactgccatggtgggaaacggaggccccactcgaggactctcagtgtctcatgatgcagaaattcgagaaagtccccgaatccaaggtaattttcgacgccaacgcccctgtggctgtccggagcaaggtgcctgacagcgaattcccagtcatgcagtgtcttacggactgcacagaggatgaggcctgcagttttttcactgtgagtacaactgagccggaaatcagctgcgacttctatgcttggacttccgacaatgtcgcctgtatgacctcagatcagaaaagagatgccctgggtaacagcaaagccaccagttttggctccctgaggtgccaggtgaaggtcaggtcacacggtcaggacagtcccgctgtatatttgaaaaaagggcaagggtctacaaccacgctccagaagcgatttgaaccgacaggctttcagaacatgttatcaggactctataatcctattgtattttctgcttcaggtgcaaatcttaccgacgctcatttattctgcctcttagcttgtgatcgggacctgtgctgcgacgggttcgtgttgacccaggtccagggcggagcaatcatctgcgggctcctcagttccccctccgtgctgctttgcaatgtgaaagattggatggacccgagcgaggcttgggcaaatgcaacctgtccaggcgtgacatatgatcaggaaagccaccaggttattctgcgcctcggggatcaagagttcatcaaatccctgacaccactggagggtacacaggataccttcacaaattttcagcaggtgtatctgtggaaagattccgatatgggatcccggcctgagtccatggggtgtagaaaagacacggttccccgtcccgcttccccaacagaggcaggactgacgaccgagctctttagccctgtagacctgaatcaggtcattgtcaacggcaatcagtctctttcaagtcagaaacactggctgtttaagcacctgttttcagcacaacaggcaaatttgtggtgccttagcaggtgtgtacaagaacactccttctgccagctggcagaaattaccgaatcagcctctctctacttcacatgtactctctacccagaggcccaagtgtgtgacgacatcatggaatccaatgcgcaggggtgtcggctcatattgcctcagatgcctaaagccctcttcagaaaaaaggtgattctggaggataaggtcaagaatttctacacaaggcttccctttcagaaactgatgggcatcagcattaggaacaaggtccccatgagtgagaagtctatttccaatggatttttcgaatgcgaacgaaggtgtgatgcagatccgtgctgtacaggattcggattccttaacgtttcccagctgaagggaggggaagtcacgtgtttgaccctgaactctctcggaattcagatgtgcagcgaagaaaacggaggagcatggagaatcttggattgcggaagccccgacatcgaggttcacacttacccctttggctggtaccagaaacccatcgcacaaaataatgccccttcgttctgtccgctcgtggttttaccctcactgacagaaaaggtctctctggacagctggcaatctctggccctgtcctcagtcgtcgtcgatccttccatccggcactttgatgtcgcccacgtttcaacagctgccaccagtaatttttcggccgttcgggatctgtgtctctcagagtgcagccagcatgaagcatgccttatcactacactccagacccagcccggagctgtgagatgcatgttctatgcagacactcagtcatgtacacactctctgcagggtcagaattgtcgactgcttctaagagaagaggctacccacatctatagaaaaccagggatttccctgttatcctacgaagcctcggtgccctctgttcccatcagcactcacggtcgccttctcggaagaagtcaggccatacaagtcggtactagctggaaacaggtggatcagttcctgggggtgccctacgccgcaccccctctggctgaaaggcgcttccaggccccagagccactaaattggactggctcctgggatgcttctaagcccagagcatcatgctggcagcctgggaccaggacgtcaacctcacctggcgtgagcgaagactgtctctatctgaatgtattcatacctcaaaatgtagcaccgaatgcaagcgtcctggtgttctttcacaatacaatggacagagaagaatctgaagggtggcccgctatcgacgggtcattcctggctgcagtggggaatttaattgtggtgaccgcctcctatagggtcggggtttttggctttttgagcagcggatctggggaggtgtcagggaactggggtctgctggaccaggtggctgctctgacctgggttcagacgcatatacgaggattcgggggagacccaagaagggtctccctagctgcggaccgtggaggggcagatgtagcgtccatccatctgctcaccgcacgggctactaattctcagttgtttaggcgcgctgtgctaatgggaggcagtgccttatcccccgcagcagtcatttctcatgagagagcacagcagcaggccatagcactggctaaggaggtctcctgtccgatgagctcttcccaggaagttgtgagctgtctcaggcagaaacccgctaacgtcctgaatgatgcccagaccaagttactggcggtgtcagggccttttcactactggggtcctgtgatcgacggtcactttttgagggagcctccagcccgtgcactgaagaggtctctgtgggtagaagtagacttgctgattggatcaagtcaggatgacgggcttattaatagagctaaggccgtgaaacagttcgaggagagtcgaggacgaaccagctcaaagaccgctttttaccaggctcttcagaatagcctgggaggagaagattccgacgcgagagtagaagcagccgctacctggtattacagcctggagcatagcactgacgactacgcctcatttagccgtgcactcgaaaacgctacccgggattactttattatctgcccaatcatcgacatggcctccgcgtgggcaaagcgcgcacgtgggaatgtatttatgtatcatgcccctgaaaattatgggcatggaagtctcgaactgttggcagatgtgcagtttgcattgggcctgcctttctatcctgcttacgaggggcagttcagtctggaggagaagtcgctatctctcaaaatcatgcagtatttctctcacttcataagatccggtaatcctaattacccctacgagtttagtcgcaaagtccccacattcgctactccttggccagattttgtgccaagggccggaggggaaaactataaagaattttccgagttgttacctaacaggcagggtctgaagaaagcggattgctccttctggtctaagtacattagctctcttaagacgagcgcagacggagcgaaaggaggacagtccgccgaatctgaagaggaggagcttaccgctggctccgggctgcgtgaagaccttctgtcactgcaggaacctgggtctaaaacttattctaagta

SEQ ID NO: 244056 - DNA, 1356 bp, Artificial Sequence
  Description of Artificial Sequence: Synthetic coding sequence
atggaacagaagccgagtaaagtcgaatgcggcagcgacccggaagagaattctgcgcgttcccctgacggaaaaagaaagagaaaaaacggtcagtgcagccttaaaaccagcatgagtggctacatcccttcatatcttgataaagacgaacagtgtgttgtctgcggagacaaagctactgggtaccactaccgctgtatcacgtgtgaaggttgcaagggctttttccggaggacaattcagaagaatcttcatcctacctattcatgcaagtatgattcctgctgtgtgattgacaaaatcacccggaaccagtgtcagttgtgtagattcaagaagtgcattgcagttgggatggctatggaccttgtgcttgatgactctaagagagtagccaaaagaaagctgatagaacaaaatcgggagaggaggaggaaggaagaaatgatccggagcctgcagcagaggcccgaacctacacccgaggaatgggatctgattcatattgcaacagaggcgcatcggagcactaatgcacagggctcacactggaaacagaggcgaaaattcctgcccgatgatatcggccaatctcctatagttagtatgcccgacggagacaaggtggacctggaagctttcagtgagtttaccaaaataattacacccgctattaccagagttgtggactttgccaaaaagctgccaatgttttccgaacttccatgtgaagatcagattattctgttaaaaggttgctgcatggagatcatgagtctccgcgctgcagtgcggtacgatcccgaatcggataccttaacccttagcggagaaatggcagttaaaagagagcagctgaaaaatggcggtctgggagtcgtgagtgatgcgatcttcgagttgggaaaatcccttagcgcttttaaccttgatgacactgaagtcgcactactacaagccgtgctccttatgtctactgatcgatccgggctgctctgtgtcgacaagattgaaaagagccaggaggcttacctccttgccttcgaacactatgtgaaccaccgtaagcataatattccacacttttggccaaagctgcttatgaaaggcccacaggtgcgccagctagagcagcagctgggagaggccggaagtctgcaggggcctgtgctgcagcaccagtctccaaagagcccccaacagcggttacttgaattactacaccggtctggaatcctgcatgccagggcagtttgcggcgaagacgactcgagtgaagccgactccccgtcctccagtgaggaagaacccgaggtctgtgaagatctggctgggaatgccgcaagcccttag

SEQ ID NO: 244057 - DNA, 5939 bp, Artificial Sequence
  Description of Artificial Sequence: Synthetic coding sequence
atgagctcatggcttggaggacttggaagcggtctgggacagtctctgggacaagtcgggggatcactggccagccttactggtcagataagtaatttcactaaggatatgctcatggagggtactgaagaagtcgaagccgaactgcccgacagtaggacgaaggagattgaggccatccatgcaatcctccgaagcgagaatgagagacttaaaaagctctgtaccgatctggaagaaaaacacgaggcatcagaaattcagattaaacaacagtccactagttacaggaaccagctccagcagaaagaagtggagatttctcaccttaaggcaagacagattgctctgcaggaccaactcttaaagcttcagtccgcagctcagtctgtgccgtctggggcaggcgttcccgcaaccactgcctctagctccttcgcctatgggatcagtcatcacccctccgcatttcatgatgacgacatggacttcggagatattatatcaagccaacaggaaatcaacagactgagcaatgaggtgtcccggcttgagtccgaggtgggccactggaggcacatcgcccagactagcaaggctcaaggcacagataatagcgaccagtcagagatctgcaagcttcaaaacattattaaggagttaaaacagaaccgctcccaagaaatcgatgaccaccagcacgagatgagtgtgctgcaaaacgcacaccaacagaaacttaccgaaatttctcgcagacatcgcgaagagctctccgattatgaagagagaatcgaagaattagagaatcttctgcagcaaggtggctctggggtgatcgagaccgacctcagtaagatatacgagatgcagaaaacgatccaagttctgcagatagagaaggtggagtccactaaaaagatggagcaactggaggacaaaataaaggatattaataaaaagttatccagcgccgagaacgatagagatatactgaggagggagcaggaacaactaaatgtggaaaagcggcagatcatggaggagtgtgagaatttgaaactggagtgtagcaaactgcagccatccgcagtgaaacagtctgacactatgaccgaaaaggaaaggatactggcgcagagtgccagtgtggaagaagtttttagactccaacaggcacttagtgacgccgagaatgagatcatgaggctttccagtctgaatcaggataactcgcttgccgaagataaccttaaactgaagatgagaatcgaggtgttggaaaaagaaaagtcacttctgagtcaggaaaaagaggaactgcagatgagccttctgaagctcaacaatgaatacgaggtgataaagagcacagccactagagatattagcctcgattccgagttgcacgacctccgcctgaatctggaggcgaaggagcaagaactaaaccagtctatttcagagaaggaaactctcatcgccgagatcgaagagctggatagacagaatcaggaagcaaccaagcacatgattctaataaaagatcagctgagtaaacagcagaacgagggcgatagcattatctctaagctgaaacaagacctaaacgatgagaagaaacgagtccaccagctggaggacgacaagatggatatcacaaaggaattagatgttcaaaaggaaaagctaatacaatcagaagtggctctcaatgacctgcacctcacgaagcagaaactcgaggacaaggtggaaaacctggtggaccagctgaacaaatcgcaagagtcgaacgtcagcattcagaaggagaatctggagcttaaagagcacatacggcagaacgaagaagaacttagccgaattagaaatgagcttatgcagagcctaaaccaagactccaattctaatttcaaggacactctgctcaaagaaagggaggctgaagtgcggaatctcaaacagaatctctccgaactcgagcaactcaatgagaacctgaagaaggtcgcctttgacgtgaaaatggagaacgagaagctagtactggcatgcgaagacgtcaggcatcagctcgaagaatgtctggcagggaataaccagctcagtctggagaagaacactatagtcgaaactctcaaaatggagaaaggagagattgaggcagaactgtgctgggccaagaaaagactgcttgaggaggccaataaatatgaaaagacaatcgaggaacttagtaacgcacggaacttgaatacaagtgccctgcagctggagcatgaacacctcatcaagttaaaccagaagaaggacatggagatcgccgaattgaaaaaaaacattgagcaaatggatacggatcacaaggagaccaaggatgttttgtcaagctccctggaggagcagaagcagttgacccagctaatcaataagaaagaaatttttatagaaaaactgaaagaaaggtcctccaagctgcaggaagagttagacaagtactcgcaggccctcaggaagaatgagattctgaggcaaaccatcgaggagaaggataggagtttgggttccatgaaagaggagaacaatcatctccaggaggagctggaacggctgcgtgaagaacagagccggaccgccccagtagccgatcccaagactcttgattccgtaactgagcttgcatcagaggtctcccaacttaacacaataaaagagcacctggaggaggagattaagcaccatcagaagattattgaagatcagaaccagagcaaaatgcagctcctgcaaagccttcaagagcaaaagaaggaaatggatgaatttcgctaccagcacgaacagatgaatgctacgcatacgcagcttttcttggagaaggacgaggagatcaagtccctgcagaagacaatcgagcagattaagacccaactccatgaggaacggcaggatatacagactgacaatagcgacattttccaggagacaaaagtccagtcactcaatattgagaacgggagcgagaagcacgatctgtccaaggcagaaaccgagagattagtcaagggtataaaagagcgtgagctcgagattaaactcctaaacgaaaagaatatttctttaacaaaacagatcgatcagcttagcaaggacgaggtgggaaaactaacacagattatacagcagaaagacctggaaattcaagctctgcacgcccgaatctcttctacgtcccacactcaggatgtagtttacctgcaacagcagctgcaagcatatgcaatggagagggagaaagtttttgctgttcttaacgagaaaacaagagaaaactcccacttgaaaactgagtaccacaagatgatggatatcgtggccgctaaggaggctgccctgatcaaacttcaggacgaaaacaagaaattgtccacaagatttgagtcatccggacaggatatgttccgtgagacaattcaaaaccttagccgcataatcagggaaaaagacatcgaaatcgatgctttgtctcagaagtgccaaaccttactggccgtactgcaaacaagctcaactgggaacgaggctggcggtgtaaactctaatcagttcgaggagctgttacaggaacgggacaagctgaagcagcaggtgaaaaagatggaggaatggaaacaacaagttatgacaacggtgcagaacatgcaacacgagtccgcacagctgcaagaggaattgcaccagctgcaggctcaggtgttagttgactccgataacaattctaagctgcaggtggattatacaggcctcatccagtcatatgagcagaatgaaactaagctcaagaacttcggccaggaactggcgcaggtgcagcatagcatcgggcaattgtgcaacactaaggatctcctgctaggaaaattggatatcatttcacctcagctgtctagcgcgtcccttctgacccctcagtccgctgaatgcctccgcgctagcaagtccgaggttctgtccgagtcctctgagctgctgcagcaagaactagaggagcttaggaagagcctccaagagaaggatgccactatcagaactctgcaagaaaataatcaccgtctgagtgactccattgcggctaccagcgagttggagcgaaaagagcatgagcagacggacagcgagattaaacaactcaaagaaaagcaggatgtgttacaaaaactcttaaaggagaaagacttgttgataaaagctaaatcagaccagcttctgtcatccaatgaaaattttacaaacaaggtgaatgaaaacgaattgttgcggcaggctgtaaccaacctgaaggaacgaattctaatattagaaatggacatcggcaagctgaagggagagaacgagaaaatcgtagagacgtatcggggtaaagagacagaatatcaagcactacaagagacaaatatgaagttttcaatgatgctgcgcgaaaaggagtttgagtgtcactcaatgaaagagaaagcactggccttcgagcagctcctgaaggaaaaagagcagggaaaaactggggaactgaatcagctgcttaacgcagtgaagagtatgcaggagaaaaccgtcgtgtttcagcaggagcgggatcaggtcatgttggcccttaagcagaagcagatggagaataccgccctccagaacgaggtgcagcgactacgagacaaggagttcaggagtaatcaagagttggaacggctgcgcaatcatctgcttgaatctgaggatagttacacgagggaagcactggcagccgaggatagagaggctaagttaaggaaaaaggtcacagtactggaagagaagctggtgagcagcagtaatgccatggagaacgcatcacatcaggcatcagtgcaggtagagtccttgcaggagcagctgaatgtcgtgtcaaaacaaagagatgagacagctctgcagctcagcgtgtcacaggaacaagtgaaacagtacgcgctctcactggctaatcttcagatggtgctagagcattttcagcaggaggagaaagccatgtacagtgcagagctggagaaacagaagcagctgatcgctgagtggaagaaaaacgcagagaacctggaggggaaggtcatctcattgcaagagtgcttggatgaagccaatgctgccttggactcagctagccgcctgacggagcagctggacgtcaaagaggagcaaattgaagaactgaaacggcagaatgagctgcggcaggaaatgctggacgacgttcaaaaaaagctgatgtctctcgctaatagctccgagggcaaagtggataaagtgctaatgcggaatctgtttattgggcacttccacacgcctaaaaaccagaggcacgaagtgttgaggctgatggggtctatcctgggtgtgcgaagagaggaaatggagcagctgtttcatgacgatcagggtggcgttacacgttggatgacagggtggcttggcggtggatctaaatcagtgcccaatacgccgttgaggccaaaccagcaaagcgtggtcaactcctctttctctgaactcttcgtcaagtttcttgagacagagagtcacccgtcaattccgccaccaaaactctcagtccacgacatgaagccgctggactcccccggaagacgcaaaagggatacaaatgcgccagagtctttcaaggacactgctgagtctagatctggaagaagaacagatgttaatccattcctggctccgcgaagtgcagccgtgcccttgattaaccctgcaggtctggggcctggagggcctggccacctactattaaaacctatatccgatgtcctgcccaccttcacacccctgcccgcactgcctgataactcagctggagtggtactgaaagatttactgaagcagta

SEQ ID NO: 244058 - DNA, 5147 bp, Artificial Sequence
  Description of Artificial Sequence: Synthetic coding sequence
atgagcgtcctccagaatgcccaccagcagaaactgaccgagatatctcggaggcaccgggaagaactatcagactacgaggagaggattgaggagctggagaacctgttgcagcagggaggcagtggagtgatcgagacagatctgtctaagatctatgagatgcaaaagaccatccaggtactgcagatagagaaagttgagagcaccaagaaaatggaacagttagaagataagattaaggacattaacaaaaaactttcctctgcagagaacgatcgagatatccttcgtagggaacaggaacagctaaatgtggagaaacggcagatcatggaggagtgtgaaaacctcaaactcgagtgctctaaattgcagccttccgctgttaagcagagtgacaccatgacagagaaagaaagaattctcgcacagtctgcatcggtggaggaggtctttaggctgcagcaggcgctgagcgatgctgagaatgagatcatgagactttcaagccttaaccaggaggaactgcaaatgagtctgctaaaattgaacaacgaatatgaagtcattaagagcactgccactcgagacattagcctcgattctgagctgcacgacttgaggcttaatttagaggcaaaggaacaggaattaaaccagagcattagcgagaaggaaacgctgatcgcagagattgaggagctggataggcagaaccaagaggcaaccaaacatatgattcttatcaaggaccagctgtcgaagcagcaaaatgagggagactccatcataagcaagctgaagcaggatctgaatgacgaaaaaaagagggtgcaccaactggaagatgataagatggacatcaccaaagagctcgacgttcaaaaagaaaagcttatccaaagtgaagtggcactgaatgatttacaccttacgaaacagaaactggaggacaaggtggaaaacctcgtggaccagttgaataaatctcaggaaagcaacgtaagcatccagaaggagaacctggagcttaaagagcacatccggcagaatgaggaagaactgtccagaattcgtaatgagttaatgcagtcactgaatcaggactcaaacagcaacttcaaggataccttactgaaggagagagaagccgaggtacgcaacctcaagcagaaccttagcgagctggaacagctgaacgaaaacctgaagaaggtggcgtttgatgtaaagatggaaaatgaaaaattagtgctggcctgcgaagacgtgcgacatcagcttgaggagtgcctggctgggaataaccagttaagcctggagaaaaacacgatcgtggaaactctcaagatggagaaaggggagatcgaggcagagttatgctgggctaagaagcgccttttggaagaagcgaataaatatgaaaaaaccattgaagaactaagtaatgcgagaaatctgaatacctccgccctgcaattggagcacgaacacctgattaagctaaaccagaagaaggatatggaaattgccgagttgaagaaaaacatcgaacagatggacactgaccataaggagactaaggacgtgttgtcaagctctcttgaagagcagaagcaactcacccaattgataaataagaaggaaatatttatcgagaagttgaaggagaggtccagcaaacttcaggaggaactggacaaatatagtcaggccttgcgcaagaacgagatacttcgccagactattgaagagaaggacagaagtctcgggagtatgaaggaggaaaacaaccaccttcaggaagagctggagcggcttagggaagaacagtctcgcactgcccctgtggctgaccctaaaacactagatagcgtgactgaactggcttctgaagtgtctcagctgaacactatcaaggagcacctagaggaggaaatcaaacaccaccagaaaattatagaggaccaaaaccagtccaaaatgcagctccttcagagcctgcaagagcagaagaaagaaatggacgagtttcggtaccagcatgagcagatgaacgctacccatactcagctatttctcgaaaaagatgaggaaattaagtctcttcagaagacaatagaacaaatcaagactcagctccacgaggaacgccaagacattcagaccgacaattccgacatatttcaggagacaaaagtccaatctttaaacatagagaacggatccgaaaagcacgatcttagtaaagccgaaactgagcggttggtcaagggtattaaggaacgcgaactagagataaaattactgaatgaaaagaacatttcccttaccaaacagatagaccagttaagcaaggatgaggtcgggaagctcacacagattatccagcagaaagaccttgaaatccaagcgctccatgctaggatcagctcgactagccatacccaggatgtggtctacctgcagcaacagcttcaggcatacgccatggaacgtgagaaggtgttcgccgtcctgaacgagaaaactcgagagaactcacacctaaaaacggagtatcataaaatgatggacatcgtagcagctaaagaggctgctcttatcaagttacaggatgaaaataaaaaactgtccacacggtttgaatcttctggacaggatatgtttcgagagactattcagaacctttctcgcataattagagagaaggatatcgaaatcgatgctttgtctcagaagtgccagactctgctcgccgttctacagacctcatccactgggaacgaagccggaggtgtcaacagcaatcagtttgaggagcttctccaagagagagataagcttaaacagcaggttaagaagatggaggagtggaaacaacaggtaatgacaactgtgcagaatatgcaacatgagagcgcacaactccaagaggagctgcatcagctgcaagctcaagtccttgtagactctgataacaacagtaaactacaggttgactacactggcttaatccaaagctacgaacaaaacgagaccaaactgaagaattttggccaggagctcgcccaggtacagcattccatcggccagttgtgcaatactaaggatctcttgttagggaagctggatatcatatctccccagttgtcttcagcatcactgctgaccccacagagcgccgaatgtctcagggcctcgaagagcgaagtgctcagcgagagcagcgaactgttacagcaagagctcgaggaattacgcaagtccctgcaagaaaaagatgctactatacgtaccctgcaggagaataatcatcgattgtctgatagcatcgctgctacatcagagctcgaacgaaaggaacatgaacaaacagactcagagatcaagcagttaaaggaaaaacaggacgtgctgcagaagctccttaaagagaaagacctgttaattaaagccaagtcagatcaattgctatccagtaacgagaactttacaaacaaagtaaatgagaatgagcttctgcgacaggccgtgacaaacctgaaagagcgcatactcattcttgagatggatattggcaagctgaaaggcgaaaatgagaaaatagtcgaaacttaccggggtaaggaaaccgaataccaggctctccaggagactaatatgaagttctccatgatgttgcgagagaaggagtttgagtgccacagtatgaaagaaaaagccctggccttcgaacagttgctgaaagagaaggagcaaggcaagaccggagagctgaatcagctgttaaacgccgtcaagtctatgcaggagaagactgtcgtctttcaacaggagcgggatcaagtgatgctggcacttaagcagaagcagatggagaacacagccctgcaaaatgaggtgcagcgattgcgagacaaagagtttcggtccaaccaggagttagaacggcttaggaatcatctgctcgagtctgaggattcttacacacgggaggccctcgcggctgaggatcgtgaagctaagttgagaaaaaaggtcaccgtcctcgaggagaagttagtcagttcaagcaacgccatggagaacgcatcccatcaagcctcagtccaagtcgagtcactgcaggagcagcttaatgtggtgagcaaacaaagagatgaaaccgccctccagctgtccgtgtcacaggaacaagtgaaacagtacgccctcagcctagctaatctccagatggtgttggaacacttccagcaggaggagaaagcaatgtactccgccgagctcgagaaacagaagcagctgattgccgagtggaaaaaaaacgccgagaacctggaaggcaaggtgatatctttgcaggagtgcctggacgaggccaatgctgctttggacagcgcaagcaggctcactgaacaactggatgttaaagaagaacagatcgaggagttgaagagacagaatgagcttagacaggagatgctggacgacgtccagaagaaactgatgagccttgcgaattcttcagagggtaaagtggacaaagttctcatgcggaacctgttcattggtcacttccacactcctaagaatcagagacacgaggtattgcgtcttatggggtccattctgggtgtgcggagggaagaaatggagcagctgtttcacgacgaccaaggaggagttacaagatggatgacaggatggctgggaggaggctccaaatcggtccccaacacccctctccgtcctaaccagcagagcgtagtgaattcttccttctccgagttatttgtcaagtttctcgagacagagtcccacccttcgattcctccaccgaagctcagcgttcacgacatgaaaccactggactcccccggtaggaggaagcgagatacaaatgcacctgagagcttcaaggacaccgctgagagtcgcagcggcagaagaaccgacgtgaatccctttttagcaccaagatctgctgccgtcccgctcataaatcccgcaggactcgggccaggaggccctggccacctcttgctgaagcccatctctgatgtcttgcctacgtttacgccactcccagcccttccagacaattcagccggagtggtgctcaaagaccttctgaagcagta

SEQ ID NO: 244059 - DNA, 5979 bp, Artificial Sequence
  Description of Artificial Sequence: Synthetic coding sequence
atgagcaaccgccctaacaataacccgggaggatccctccggaggtcgcagcgtaatacagctggagcacagccccaggacgactctataggcggaaggtcatgctcttcaagttccgcagtcatagtaccacagccggaggatcccgatcgagctaacactagtgagcggcagaagactgggcaagtgcctaagaaggataatagccggggtgtcaaacgcagcgctagtccagactataataggacaaattctcccagctccgccaagaaacctaaggccttacagcatacagagagccctagcgaaactaacaaaccgcacagtaagagtaagaaacggcatctggatcaagaacagcaactgaaaagtgcgcagagcccgagcacatcgaaggcccatacgcgtaagtctggagcaacgggtggctctcgcagccagaaacgcaagcgcaccgagagtagctgtgtgaagtcaggctcaggaagcgaatccacaggtgcagaagagcggtcagccaagccaaccaaacttgctagcaagagcgctaccagcgccaaggcgggatgttcaaccatcactgatagctctagcgctgccagtactagttcctcctcgtccgcagttgcgtccgctagctccacggtgccccctggagcacgggtgaagcagggcaaagatcagaataaagctcggcgtagccgatctgcttctagcccctctcccagaagatcttcccgagaaaaagaacaatctaaaaccggaggtagctctaaatttgactgggctgctaggttttctcctaaagtttctctgcccaaaaccaaactctcattgccaggctcgtcgaaatccgaaacttcaaaaccagggccatccggcctccaggcgaaactggcctcactgcggaagagcacgaaaaagagaagcgagagccctcctgctgagctgccttcattgaggcgatcgacccgtcagaagactaccggtagttgcgcttcaacttctaggcgaggatctggactgggtaagaggggggcagcagaggcaaggcgtcaggaaaagatggccgatccagagtcgaaccaggaggctgtgaatagctcagccgctaggactgacgaagcccctcagggcgcagccggtgcagtgggtatgacaacaagcggcgagagcgaaagcgatgactcagagatggggaggcttcaggccctgctggaagccaggggactgccccctcacctgtttggacccctggggccaagaatgtcccagctcttccaccgtacaatcggcagcggagccagttccaaggctcagcagctgctacagggcttgcaggccagcgatgaatcccagcagctgcaggccgttattgaaatgtgtcaactgcttgtaatggggaacgaagaaaccctcgggggattccctgttaaaagcgtcgtcccagcgctcatcactctgctgcagatggagcacaacttcgatattatgaaccacgcatgccgcgctttaacttatatgatggaggctctgcctcgctcttccgcggtggttgtagacgctatccccgtgttcctggaaaagctgcaggtgatccagtgcatcgacgtcgctgaacaggctctcactgcccttgagatgctcagccgacggcattcaaaagcaatcctgcaggccggagggttggccgattgcctcctgtatctcgagttcttcagcatcaatgcgcaaagaaatgctctagccattgctgctaattgctgccagtcaatcacgcctgatgaattccactttgtcgccgatagcctcccgcttcttacacagcgtctgacacatcaggataagaaaagcgtggaaagcacatgtctttgttttgcaagactggttgataacttccagcatgaggagaacctcctgcagcaggtagcttctaaagatttacttacaaacgtccaacagcttctggtggttacaccaccaattctgagttccgggatgttcataatggtggtgaggatgttctcactgatgtgcagtaactgccctaccctcgcagtgcagctcatgaagcaaaacatcgcagagacattgcatttcctactgtgcggggcttccaacgggtcctgtcaggaacagattgatctggtgcccagatctccacaggaactatacgagctcacgtctttgatatgtgagcttatgccttgtctgcctaaagaaggcattttcgcggtggatacaatgttaaaaaaaggaaatgcgcaaaatacagacggcgctatttggcagtggcgcgacgacaggggcttgtggcacccatacaacaggatcgactctcgtatcatcgagcagatcaatgaagataccggtacagcgagggctattcagagaaagcccaatcctcttgctaactccaacacatccggttattcagagagcaaaaaagatgacgccagagcgcagctgatgaaggaagatccagaattagccaagtcattcataaaaactctgttcggtgtattatacgaggtatattcttctagtgctgggccagctgtccgccacaaatgcctccgcgcaattttacgcattatatactttgccgacgccgagctcttgaaagacgtgctcaagaatcacgccgtgtccagtcatattgcctcgatgctaagtagtcaggatcttaaaatagtcgtgggggctctgcagatggcggagattttgatgcagaaattgcccgacatttttagcgtatactttcgccgagaaggagtgatgcatcaagtgaagcatctagcggagtccgagtccctactgacctcacctcccaaggcctgtactaacggatccgggtccatggggtctaccacctcagtttccagtggcacagcaacagctgcaacacacgccgcagccgacctggggtcaccatcactgcagcattcccgtgatgactccttggaccttagtccccagggtcgcctatctgatgtccttaagcgaaagcgactacccaaacggggacctaggcgcccaaaatactctccaccgagggatgatgataaggtagacaaccaggctaaaagtcccacgaccacacaaagtccaaaatcctcatttctcgcctctttaaaccccaagacctgggggaggctgtcaactcagagcaatagtaataacattgaacctgccagaactgctggagggtcgggacttgcgagggccgcttctaaggacaccatttctaacaacagagaaaagatcaagggatggatcaaggagcaagctcacaaatttgtcgaaaggtacttcagcagtgagaacatggacggttccaatccggcacttaacgtcctgcagcgtctgtgcgccgcaactgagcagctgaacctgcaggtcgatggcggagcggagtgtcttgtcgaaattcggagcatcgtgtctgagtcagatgtgagtagttttgagatacaacactctggattcgtgaagcagcttctcctgtacctcaccagcaagagtgaaaaggacgcggtgagcagggagattcgcctcaaaaggtttcttcacgtgtttttttctagcccactgcccggagaggagcccattggacgagtggagcctgtagggaacgcaccactcctggctttggtgcacaaaatgaacaactgtttgagtcaaatggaacagtttccggtcaaggtccatgacttcccatcagggaatggtactggtggcagtttcagtttaaaccgtggatcccaggctctgaagtttttcaatactcaccaacttaagtgtcagctgcagagacacccagactgcgctaatgtgaaacagtggaagggagggcctgtcaagatcgacccactcgccctggtacaggccatcgagcgataccttgtggtcaggggttatggcagagtgcgagaagatgatgaggattctgatgacgatggcagtgatgaagagatcgacgaaagcctggctgcccagttcctgaattcagggaatgtccgacatcggctgcagttttatataggcgaacatctgttgccatacaatatgaccgtgtaccaagcagtgaggcagttttccatccaggctgaggacgagcgcgagagcaccgatgacgaaagcaaccccttggggcgagccggaatctggacaaagactcacacgatttggtataagcctgtcagagaggatgaagagagcaataaggactgcgtggggggtaaaagaggcagggcacaaaccgcccctactaagacctccccgcgaaatgcaaagaagcatgatgagctgtggcatgatggcgtctgccccagtgtttctaatccgctagaggtttacctgattcccacacctcccgagaacatcacttttgaagacccttccctggacgttatcttgcttctacgcgttctgcatgctattagtcggtactggtattacctgtacgacaatgctatgtgcaaagaaatcattcccacttctgaatttattaattctaaactaacagcaaaagccaacagacagcttcaggatcccctggtgataatgaccgggaacattccgacctggctgactgagctcggaaaaacatgtcccttcttttttccttttgatactcggcagatgctgttctacgttacagccttcgatagggatagggcgatgcagcgcctgctggatactaatccggaaatcaaccagtcggacagccaggattcccgggtagctccaagactggaccgcaaaaagagaaccgtgaacagagaagagctccttaagcaggccgagtcagttatgcaggatctgggcagctcgcgtgctatgcttgaaattcagtacgagaacgaggtgggaaccggcctcggtccaaccctcgagttctatgccctggtgagccaggaattgcagagggctgacctagggctgtggcggggagaagaggttactctgtccaaccccaaaggcagccaggaagggaccaagtatattcagaacttgcaggggttgttcgccttgcccttcggacgaacggccaaacctgcccacatcgcaaaagtcaagatgaaattcagatttctgggaaaactaatggctaaggcaattatggactttagactggtggatttgccattaggcctacctttctacaagtggatgcttaggcaagagacatccctcactagccatgacctttttgacattgatccggtggtggcacggtcagtgtatcacctcgaagacatagtgcggcaaaagaaaagacttgagcaagataagagccagaccaaggagtccctgcagtatgcgctggaaaccctgaccatgaatggctgcagcgtggaagacctgggccttgatttcaccctgccaggttttccgaatatcgaactgaagaaaggaggaaaggatattccagtgacgattcacaacctcgaggaataccttagattggtgatcttttgggccttaaacgaaggagtgtccaggcaatttgactcatttcgggatggtttcgaatcagtctttcctttatcgcacctgcagtatttttaccccgaggagcttgatcaactcctgtgtgggtcgaaggccgatacatgggatgctaaaacactcatggagtgttgccggcctgatcacggttatacacatgatagccgtgccgttaaattcctatttgagattttgtcaagctttgacaacgaacagcagcgtctgttcctccaattcgtgaccggaagtccacggctgccggttggaggctttcggtcgttgaatccgccactgactatcgtgagaaagacattcgagtcaacggagaacccagatgatttcctgccttccgtcatgacctgcgtgaattacctcaagctgcccgactactcatcaattgaaatcatgcgagagaaactgttgatcgcggcaagggaagggcagcagtcgtttcatctgtcatag

SEQ ID NO: 244060 - DNA, 300 bp, Artificial Sequence
  Description of Artificial Sequence: Synthetic coding sequence
atgagtaatagacctaataacaatcctggaggcagcctaaggaggagccagagaaataccgccggagcccagccccaggatgactccatcggaggtcgatcgtgttcctcttccagtgccgtcattgtgcctcagcccgaggacccagatcgcgctaacacaagtgaaagacagaagactgggcaggtgccgaaaaaggataattcccggggtgttaagcggtcagctagccctgactataataggacaaacagcccatcatccgccaaaaagccaaaagccctgcagcacactgaatag

SEQ ID NO: 244061 - DNA, 6122 bp, Artificial Sequence
  Description of Artificial Sequence: Synthetic coding sequence
atgagcaatagacccaataacaatcctggcggtagccttagaaggtcgcagcgaaacacggctggggcacagccccaggacgattccatagggggtagaagccacttgggacaggccaaacataagggctattctcctcctgagtcacgcaaaagcaattccaaagctccaaaagtccagtcaaataccaccagtgagctgtcgagagggcatctttccaaaagaagttgctctagtagctcggcggtcattgtaccacaacccgaggacccggacagagccaacacatccgagaggcagaagaccgggcaagtcccaaagaaggacaattctagaggtgtgaaacggtcagcatcgcctgattacaatcggactaattcccctagctccgccaagaagccaaaggcacttcagcataccgaatcgccatctgaaaccaataaaccccactctaaaagtaagaagcgccacttggaccaggagcagcaactcaaaagtgcgcagtcaccttctacttccaaggcccacactcgcaaaagcggtgccactggtggctcaaggagccagaagcgcaagcgaaccgagtcttcctgtgtgaaaagcggcagtggcagtgaaagcacaggtgctgaggagcgctcagccaagcccacaaagctggcctctaaatccgcaacctcagcaaaggccggttgctccaccatcaccgattccagcagtgcggcatctacgtcctccagcagctccgccgtggcttctgcctccagcacagtgccacccggtgctcgggtgaagcagggcaaagaccagaacaaagccaggcgttcccgctccgcgagtagtccatctccccgtagatcgtccagggagaaagaacaatctaaaacaggcggatcttctaagtttgattgggccgctcggttttctcccaaggtaagtctacccaagacgaagctgtctctgccaggctcctctaaatccgagacgtccaagccgggaccctccgggctccaggccaagttagcaagcctgcggaaatccactaagaagaggtcagagagtccacccgctgagctcccctcactccgtaggtctaccagacagaagactaccgggtcttgtgcatccacgagccgtcgtgggtcgggtctcggaaaaaggggagcagctgaggcgcgtcgtcaggaaaagatggcagaccccgagtctaaccaagaggcagttaattcatccgctgctaggactgacgaagccccacagggagcggctgcctcctcgagcgtcgccggagcagtcggcatgaccacttccggagagtcagagtcagacgactccgaaatggggcgactgcaggcactcctggaagcccgaggtctcccaccacacttgttcgggccactaggacccaggatgtctcagctgttccatcggacaatcggttctggcgcaagctccaaagcccagcaactcctacagggtctgcaggctagcgatgaatctcagcaactccaagccgtgattgaaatgtgccagctgctcgttatgggcaatgaagaaaccctcggagggtttcccgtgaagtcagtagtcccggctctaatcacactgctgcagatggaacataactttgatataatgaatcacgcctgtcgggcactgacgtatatgatggaggcacttcctaggtccagcgcagtggtcgtggacgcaattccagttttccttgagaagctgcaggttatccagtgcattgacgttgctgagcaggccctgactgccctggagatgttgtccaggcgccattccaaggccattctgcaggctggaggcctcgcagactgtctgctttatctggaattttttagtatcaatgcccagcgaaatgcattggctatagccgctaattgctgtcaaagcatcacacctgacgagtttcactttgtggccgactctcttcccctgctgactcagagactgactcaccaggataaaaagagcgttgagagcacatgcttgtgtttcgccaggcttgttgacaatttccagcacgaagagaatctgctgcagcaggtcgcttcaaaagatttgcttacaaacgtccagcagttactggtggtcacacctcctatcctctcctctgggatgttcatcatggtcgtgaggatgttttccctcatgtgctcaaactgcccaactctggctgtgcagctgatgaagcagaacatcgcggagacattacattttctgctctgcggcgcaagtaacggtagctgccaggagcaaattgatctggtcccacgctctccacaggagctttacgaactgacaagtctaatttgcgaattaatgccttgcttgccaaaggaaggtatcttcgccgttgacactatgctcaaaaaaggaaacgcccagaacaccgacggcgctatatggcaatggcgagatgatagggggctgtggcacccctataacaggatcgattctcgaatcattgaacagattaacgaggataccggcacagccagggccatccagcgcaaacccaacccactggccaactctaacacttcaggctactcagagtcaaagaaagacgatgcaagagcccaacttatgaaggaggaccccgagctagccaagagttttattaagaccctgtttggagtactttacgaagtctatagcagctctgcagggcctgctgtcaggcataaatgtctcagagctattctgcgaatcatctactttgcagacgcggaactgctgaaagatgtgctcaaaaaccacgcagtctcatctcacattgctagtatgttgagcagtcaggatttgaaaatcgttgttggagctctccagatggccgaaatcttgatgcagaagcttcctgacatcttttcagtctactttcgacgcgaaggagtgatgcatcaggtgaagcacctggccgaatctgagtccctactcacgagcccaccaaaggcgtgcactaatggatcagggtcaatggggagcacgacatctgtttcctcaggcacagctaccgccgcaacccacgccgcagccgacctcggttctccgagcctacaacatagtcgcgatgactccctggacttgtccccccagggacgtttatccgatgtcctgaagcgaaagaggctcccaaaacgaggccctcgaagacctaagtacagtcccccacgggacgatgacaaggtcgataatcaagccaagtctcccacaactacacagtcccccaaatccagctttctggccagtctgaaccctaagacctggggaaggctcagcacccaatctaacagtaataacattgaaccggctagaaccgcagggggttcaggattggctcgggctgcctctaaagacacaatctcaaacaatcgtgaaaagattaaagggtggataaaagagcaggcccacaagttcgtggaaaggtatttttctagtgaaaatatggacggaagcaaccccgcactgaatgtgctccagcggctctgtgccgcaaccgagcagctgaacttacaggtcgacggaggtgccgagtgccttgtggagatccgcagcatcgttagcgagagtgacgtgtcatctttcgaaatccaacatagcggtttcgtgaaacaactgcttttgtatctgacctccaagtcagagaaagacgctgtttcccgtgagattagactaaaacgcttcttgcacgtgtttttcagttcacctctgcccggagaggagcctatcggccgagttgaacccgtggggaatgcccctctgcttgccctcgtccacaagatgaataattgcttgtcccagatggaacagttcccagttaaagtgcacgatttcccttcggggaatggtaccggaggttccttctccctgaatcgtggctcccaggctctgaaatttttcaatacccatcagctgaagtgtcagctacagcgtcatccagattgtgcaaacgtaaagcagtggaagggaggtcctgtcaaaattgaccccctagcacttgtccaggccatcgagcgctatctagtggtgaggggttacggccgagttcgagaggatgatgaggatagtgatgatgatggatccgacgaggaaatcgatgagtctctggctgcccaattcctcaactctgggaacgttcgtcaccggctccagttttatattggcgagcacctgctgccttataatatgaccgtgtatcaggcagtaaggcagttttccattcaagcggaggatgagcgcgagtctacggatgatgagtccaacccgctgggcagggctggcatatggactaagacccatacaatctggtacaagcccgtacgcgaggatgaggaatcaaacaaagactgtgtgggaggcaaacgcggacgagctcagaccgcaccaactaaaaccagtccacggaatgccaaaaagcacgacgagctgtggcatgacggcgtgtgcccctccgtgtcgaaccctttggaggtttacctcatccccaccccacccgagaacattacttttgaggaccctagtctcgatgttatcctccttctgagagtgctgcatgccatctcgcgatactggtattatttatatgacaacgccatgtgtaaggagataattccaacctccgagttcatcaattctaaacttaccgctaaggctaacagacaattacaggacccgttggtcatcatgactgggaatattcccacatggctgacggagcttgggaaaacctgcccatttttcttcccctttgacacgaggcaaatgttgttttatgttaccgcttttgacagggatcgcgctatgcaacgcctgttggatactaatcctgaaatcaatcagagtgacagtcaggattcacgcgtcgctcctagattggacaggaaaaagagaactgtgaacagggaggaactcctcaagcaagcagagagtgttatgcaggatctgggcagcagcagggcgatgttagagatccaatacgaaaatgaagtgggcaccggcctgggaccgaccctggagttctacgctctggttagtcaggaactccagcgcgcagaccttggcctgtggaggggcgaggaggttaccctaagtaaccccaagggctcccaggagggtaccaaatatatccagaacttacagggcctgtttgccctgcccttcggtcggaccgcaaagcctgcccatattgctaaggtcaaaatgaaatttcggttccttggtaagctcatggcaaaagctatcatggactttcggcttgttgatctaccactcggcctgcccttctacaagtggatgctgagacaggagaccagtcttaccagtcacgacctgtttgatatcgatcctgtcgtagctagatcggtgtatcatctggaggatattgttcgtcagaagaagcgtctggagcaggataagagtcagactaaagagagcctgcaatacgctcttgaaaccctgacaatgaacggctgcagtgtggaagatcttgggttagacttcaccctgcccggattcccaaacatcgagttaaaaaagggaggaaaagacatccctgttaccatacataacctagaagaatatcttcgcttggttatcttctgggccctcaacgaaggcgtcagccggcagtttgatagtttcagggacggcttcgagtcagtcttcccgctgagtcatttgcagtatttttatcccgaagaactggaccagctgctttgtggctctaaggctgatacttgggacgcaaaaaccctgatggaatgctgtaggccagatcatgggtatactcatgactcccgggctgtgaaatttctctttgaaatcctctcctccttcgataatgagcaacagagactatttctgcaatttgtgaccgggagtcccagactcccagttggtggtttccggtctctcaaccccccactgaccatagttaggaagaccttcgaaagtaccgagaaccctgatgatttccttccttccgttatgacttgcgtcaattacctaaagctgcctgactactcctcaatcgagataatgagagagaaactgctgattgcagccagggaaggccaacagtcgtttcacctctccta

SEQ ID NO: 244062 - DNA, 5168 bp, Artificial Sequence
  Description of Artificial Sequence: Synthetic coding sequence
atgtcgaaccggcctaacaacaacccagggggatccctgagacgctcccagaggaacacagcgggagcacagcctcaagatgactccatcgggggaagccgcaggggctccggcttggggaaacgcggagcagcagaagccagacgacaggagaaaatggctgatcccgagtcgaaccaagaggcggtaaatagcagtgctgccaggaccgacgaagcccctcaaggcgctgcagcctcttccagcgtggctggcgcagtgggaatgactacttcgggcgagtctgaaagcgatgacagtgagatggggcgactgcaggctttacttgaggctcggggtctgccgcctcatctcttcggccctcttggccctagaatgagtcagctttttcatagaaccatcggctccggtgccagctccaaagctcagcaactgctgcaaggcctccaggcctcagatgagtcccagcaactccaggctgtaattgaaatgtgccaactactggtgatgggtaatgaggagaccctcggaggtttccccgtgaaatccgtggtgccggctcttatcactctgctccagatggagcacaattttgatatcatgaaccatgcatgccgtgcactcacgtatatgatggaagcactgcccagatcgagcgccgtagtggtggacgccattcctgtgtttcttgaaaaactccaggtgattcagtgcattgatgtggctgaacaagcgctgacagcactggaaatgctctctcggagacatagtaaggctattctacaggcaggtgggttggccgactgtcttctgtacctcgagttcttctccattaatgcacagaggaacgccctggccatcgcagccaattgttgccagtcgatcacgcctgacgaatttcatttcgtcgctgattcgctcccacttttgacccaacgactcacacatcaggataaaaaatcggtcgaaagcacctgtttgtgctttgcgagactagtcgataactttcaacatgaggaaaacctgctgcagcaagtcgccagcaaagacctcctgaccaatgtgcaacaactgctcgttgtgaccccgccaattctgagcagtgggatgttcataatggtcgtgcgcatgttcagtctgatgtgctccaattgccccacgcttgctgtgcagctcatgaagcagaacatagctgagaccctccactttttgctgtgtggagctagcaatggctcctgccaggagcagattgatctagtcccacgaagtccacaagaactctatgagctgacatccctgatctgcgagttgatgccttgcttgccaaaggagggaattttcgcagtcgacaccatgctgaagaagggcaatgcacagaacaccgatggcgcaatatggcagtggagggacgaccgtgggctctggcatccttacaacagaatagactctcggataatagaggccgctcaccaggtgggcgaagatgaaataagtctatcaacgttgggcagggtgtatactattgacttcaactccatgcaacaaattaatgaggacacagggacagcacgggcaatccagcgaaagccaaaccctctcgccaacagcaatactagcggatattccgaaagtaagaaagatgacgctagggctcagctgatgaaggaagatcctgagctggccaagtcattcatcaagaccctgtttggcgtgctgtatgaagtgtacagcagctcagccggtccagctgtgcgccataagtgcctgagagcaatcctgcgcattatatacttcgctgacgctgagctgctgaaggatgtcctgaaaaaccatgccgttagtagtcatatcgcttctatgctcagtagccaggacctgaagatcgtggtaggcgctctacagatggccgagattcttatgcagaaactgccagatatcttcagcgtgtacttccgacgggaaggcgtgatgcaccaggtcaagcacctagccgagtctgagagtttgctgacctcacctccaaaggcctgcactaatggctccggcagtatgggaagcaccacgagcgtgtcatcaggcactgctactgctgccacacatgcagccgctgacctgggcagcccttccctgcagcactctcgtgatgatagcttggacttatctccacagggtaggctttcagatgtgcttaagcgcaagcgcctcccaaagcgcggacccagacgccctaaatattcaccgccacgagacgatgataaggtggataaccaagctaaatctcccacaaccacacagagtccgaaaagctcattcctggctagcttaaatccaaagacttggggcagactgtccacacagagtaattctaacaatattgagccagctaggactgctgggggatctgggctcgccagagcagcaagcaaagacacgataagcaataacagagagaaaatcaaggggtggataaaggagcaagcccataaattcgtggagcgctattttagctctgagaatatggacggttcaaatcctgccctcaacgtgttacagaggctctgcgctgccactgagcagctcaacctgcaggtggacgggggagccgagtgtttagtggaaatccgtagcattgtcagcgagagtgatgtctcaagttttgaaatacaacattcgggttttgttaagcagttgttactgtatctcacttccaagtcagagaaggacgccgtgtccagagaaatccggctaaaaagatttttgcatgtgttcttcagctccccgctgcccggtgaggaacccatcggccgtgtagagcccgtcggaaacgctcctctgctggccctcgttcataaaatgaataattgtctcagtcagatggagcagttccctgtgaaagtacacgacttcccaagtggcaacggaacaggaggctccttcagtctaaaccggggatcacaggccctgaagttctttaacacccatcagctgaagtgccagctccaacgacaccccgattgcgcaaatgttaagcagtggaaaggcggacctgtgaaaattgacccgctggctcttgtgcaggcgattgaaagataccttgttgtgagaggctatggcagagtgagagaggatgatgaagacagcgatgatgatgggtctgatgaggagattgatgaatccttagctgctcagttcctcaattcaggtaacgtaagacacaggctgcagttttacatcggcgaacacctgctgccctacaacatgacggtgtatcaagcggtcaggcaattcagcatccaggcggaagatgaacgggagagcacggacgacgaatccaatcccctagggcgagcaggcatatggactaagacccatactatttggtacaaaccagtcagggaagacgaggaatcgaataaggactgcgtgggcggtaaacgtggaagggcccagacagccccaaccaaaacttccccgagaaacgccaagaagcatgatgagctgtggcatgacggcgtgtgcccatccgtgagtaatcctctggaggtttatcttatcccaaccccgcctgaaaatataactttcgaggatccatccttagatgtcatactgctcttgcgtgtcctgcatgctatctcacgttattggtactacctttatgataatgccatgtgcaaggaaatcattcctacatccgaattcatcaacagcaagctgaccgccaaagcaaaccggcagctccaggatccactcgttattatgaccggaaatatacctacctggttgaccgagctaggcaagacttgtccctttttctttccttttgatactagacagatgctgttctacgtcactgccttcgaccgggatcgagctatgcagaggctgcttgatacaaatccagaaatcaaccagagcgactcccaggattcacgggtcgccccacggcttgatagaaaaaagcgtacagtcaaccgcgaggaactcctgaagcaggctgaatctgtgatgcaagatcttggatcttcccgagcaatgttggagatccaatacgaaaatgaagttggcaccgggttgggcccaacactcgaattctacgcccttgtgagccaagagctccagcgggcagatctggggttgtggcgcggagaggaggtgaccctcagcaacccgaaggggagtcaggagggaacgaaatacatccaaaacctgcaggggctcttcgccctacctttcggtaggacagctaaacctgcccacattgcgaaagtcaaaatgaagtttagattcttaggaaagctgatggcaaaagctataatggactttagacttgtcgacctaccactcgggctccccttttacaaatggatgcttaggcaggagacttctctcacatcacatgacttgtttgatattgaccccgtggttgcccgatccgtatatcatctggaagatattgttaggcagaaaaagcgactggagcaagataagtcccagacgaaggaatccctgcagtacgctctggaaactctgactatgaatggttgtagtgttgaggatctcggcctcgacttcacactcccaggctttccaaatattgagttgaaaaaaggtgggaaagatatccctgtgacaattcataatctggaagaataccttcggctggtcatcttttgggctctcaatgaaggggtttctcgtcagttcgactcttttagggacggattcgagagtgtcttcccattgagtcacctccagtatttctaccctgaagagctcgaccagctgctgtgcggatccaaagcagacacctgggatgccaaaactttgatggaatgttgccggcctgatcacggctatactcatgacagcagagccgtgaagtttttattcgagatactgtctagttttgacaacgaacagcagagactattcttgcagtttgtgacaggtagccctcgtctgccagtggggggattcaggtcactgaacccccctctaacaatcgtgagaaaaacatttgagagcaccgagaatccagacgacttcctcccttctgtaatgacttgtgtgaattatctaaaattacccgattattcttcgatcgagattatgcgtgagaagctccttatcgccgcacgcgaaggtcaacaaagctttcacctctccta

SEQ ID NO: 244063 - DNA, 450 bp, Artificial Sequence
  Description of Artificial Sequence: Synthetic coding sequence
atgtctaatcgacctaataacaacccaggagggagcttgcgcaggagccagaggaatactgccggagcccagccgcaggatgactccataggtggtcgatcatgttcctcatcaagcgccgttatcgtccctcagcctgaggaccccgatcgggctaacacctccgagagacagaagacaggacaggtcccaaagaaagataactcgcgtggagttaagagaagtgccagtcccgactacaatcgcaccaatagtcccagtagcgccaaaaagcccaaagcactgcaacacacagaatccccttccgaaaccaataaaccccactccaagtcaaagaagcgacacctggaccaggagcagcaactaaaatccgcccagtccccctctactagtaaggcgcacacacggaagtccggcgctacgggaggatccagaagccaaaagcggtag

SEQ ID NO: 244064 - DNA, 465 bp, Artificial Sequence
  Description of Artificial Sequence: Synthetic coding sequence
atgagtaaccgacccaataacaatcctggcggttcactgagacggagccagcggaataccgccggagctcagccgcaggacgattccataggcggaagaagctgctcatcttctagcgccgtcatcgttcctcaacccgaagatcctgaccgtgctaataccagcgaaaggcaaaaaacagggcaggtccctaaaaaagataattctcgaggcgttaagcgttcagcttctcccgactacaaccgcacaaatagtcccagttcagctaaaaagccgaaggccctccagcataccgagagcccctctgagaccaacaaaccacacagtaaatccaaaaagagacacctggatcaggaacagcagctgaagtctgcccagtcccccagtacctctaaggcccatacgcgtaaatcgggggcaaccggtggttcgagaagtcagaagagaaagaggaccgaaagctag

SEQ ID NO: 244065 - DNA, 1041 bp, Artificial Sequence
  Description of Artificial Sequence: Synthetic coding sequence
atgagcaatcggcctaacaacaaccctgggggtagtttacggcgatcccagcgaaataccgccggtgctcaaccacaggacgacagtataggcggaagatcacacctgggccaggccaaacataaaggctacagcccacccgagtcccgaaaatccaatagcaaggctcccaaggttcaatctaacacaacgtctgagctgtctcgcggacatctgagcaagagatcctgcagctcatcctccgctgtgattgtcccacagcccgaggatcccgacagggccaacaccagtgaacgacaaaaaactggacaagttcctaagaaggacaattcacgcggtgtgaaacggtcagcttctcccgattacaatcggaccaactcaccctcctctgccaagaagccaaaggccctccaacacaccgaatctccatcagagaccaacaagcctcacagtaagtccaagaaacgccatcttgaccaggagcagcagctgaagtccgctcagtcaccttccacctctaaagcacacacacgtaaatcgggcgctactggtggcagcagatcccagaaacggaaacggaccgaaagctcctgcgttaaatcggggtctgggtccgaaagcacgggcgcagaggagcggtcagccaagccaaccaagctggcgagcaagtctgcgacgtccgctaaagccggttgtagcactattacagactcttcgagtgccgcttccacctccagctcatccagcgccgtagcttctgctagttctactgtgcctccaggtgccagagttaaacaggggaaggatcagaacaaagcacgcagatccagatctgcaagctctccaagcccgaggcggagctccagggagaaggaacagtccaaaacaggcggtagttcaaaatttgattgggcagcacgattttcaccaaaggtttcactgcctaaaactaagctgtccctcccagggtcatcaaagtctgagactagcaagcctggtccaagcgggctacaggccaaagtcctgacatccaaacggtag

SEQ ID NO: 244066 - DNA, 1746 bp, Artificial Sequence
  Description of Artificial Sequence: Synthetic coding sequence
atggccgtggctggcgctgtctccggtgagcctcttgtgcattggtgcacccaacagttgcggaagacgttcgggcttgacgtctctgaggaaatcatccagtacgtgctctcaatagagtctgctgaggagatcagggagtatgtcaccgatctgttgcagggcaatgaaggaaaaaaggggcagttcatcgaggaactcatcaccaagtggcaaaagaacgaccaagagctaataagcgaccctttgcaacagtgttttaagaaggatgagatcctcgacggccagaagtcaggggatcatctgaaacgcggacggaagaagggccgaaaccgacaggaagtccccgctttcacggagcctgacacaaccgcagaagtgaagacgccctttgacctggccaaggcacaggagaacagcaacagcgtaaagaaaaaaactaaatttgttaatctgtacacgagagagggccaggatagactggctgtactgctgcccggacgccacccatgcgattgtctcgggcagaagcacaaactgataaataattgtttgatatgcggtcgcattgtctgcgaacaggagggatccgggccatgtttattttgcggaaccctggtctgcacacatgaagaacaggacattctccagcgggactctaataagtcacaaaagcttcttaagaaactgatgagcggggttgaaaacagcggtaaggtggacatctcgactaaagatctattgccccatcaggaactgaggatcaaaagtggattggaaaaagccataaagcataaggacaaattgttagagtttgataggacttcgatccgccgaacccaggtgatagatgatgagtccgattactttgcatccgatagcaaccagtggttgtcgaagctcgagcgggagacactgcagaaacgtgaggaagaactgagagagctaaggcatgcatctcgactttctaagaaagttactattgactttgccggaagaaagattctggaagaggagaattccctggctgagtatcatagcagactcgacgaaaccatacaggcaattgcgaatggaaccttgaatcagcctcttaccaagctagaccgctcatctgaggaaccacttggtgtgctagtcaaccccaacatgtaccagtctccccctcagtgggtcgaccataccggcgctgcttcccagaaaaaggcgttcagatcttccgggttcgggctcgaatttaatagttttcagcaccagttgaggatacaggatcaggaatttcaagaggggttcgatggcggttggtgtctgtctgtacaccagccatgggcgagtttgctggtgcgtgggatcaagcgagtggaaggccgatcctggtatacccctcacagagggaggctgtggatagcagcgacagccaaaaagccgtcgccccaggaggtgtcagaacttcaggccacataccggcttctgcggggtaaagacgtggagtttcccaacgactacccgagcgggtgtctgttggggtgtgtggacctgatcgactgcctgtcccaaaaacagttcaaggaacagttccccgacatttcacaggaaagtgacagtccgtttgtgttcatttgtaagaatccacaggagatggttgtgaaatttccaatcaaaggtaacccaaaaatctggaagctcgattcaaaaattcatcagggggcaaaaaaggggctcatgaagcagaacaaagccgtgtag

SEQ ID NO: 244067 - DNA, 1431 bp, Artificial Sequence
  Description of Artificial Sequence: Synthetic coding sequence
atgtccggaccaacctggcttcctcccaaacagcctgaacccgcacgcgcaccccaagggagagcaattcccaggggaacaccgggaccgcctcctgcccacggagctgctctgcaacctcatcctagggttaatttttgtcctctgccctccgagcaatgctaccaggccccagggggaccagaggaccggggtcccgcttgggtggggagccatggggtgttacaacatacccaaggtttacccgcagaccgcggagggttgcgtcctggatctctggatgcagaaatcgatctcctatcttcaaccctggcagaattgaatggaggtaggggacacgccagccgccgaccagatcgccaggcatacgaaccaccaccaccgcctgcttatcgcaccggctccctgaagcccaatcccgcaagcccattaccagcttctccctatgggggaccaactcccgcttcctacacaactgccagtacccccgcaggcccagccttccccgtgcaggtgaaggtcgcacagcccgtgcgtgggtgtggcccacccaggaggggcgcttcccaggccagtggacctctgccgggaccacactttccgctccctggcagaggggaggtatgggggcctggctatcgctcccagagagagccgggtcccggtgctaaagaagaggctgcaggcgtgagcggcccagctggcaggggcagaggtggtgagcacggcccacaggtacctctgtctcagcccccagaggatgagttggacagactaaccaaaaagctcgttcacgacatgaatcaccccccaagcggggaatattttgggcagtgtggtgggtgcggggaggacgttgttggtgatggtgccggagtagttgctttggatcgagtgttccacgtgggatgcttcgtttgctctacctgtcgcgcacaactaaggggccagcacttctacgcggttgagcgacgagcctactgcgaggggtgctatgtggcaacactggaaaaatgtgcaacctgctcgcaaccaattctcgatagaatcctccgagcaatggggaaggcataccatccaggctgttttacctgcgtcgtgtgccatcgtggactggacgggatccccttcaccgtggacgctacaagtcaaatccattgtattgaggatttccatagaaagtttgccccacggtgctcagtgtgtggcggagcaataatgcctgagcctggccaggaggagacagtcagaatcgtggctctggacagatccttccatatcggctgctacaaatgcgaagaatgtgggctgttacttagctccgaaggagagtgccaaggctgctaccccctcgacggtcatatactctgtaaagcgtgctccgcctggaggatccaggagctgagcgcgacagttacaacagactgctag

SEQ ID NO: 244068 - DNA, 1473 bp, Artificial Sequence
  Description of Artificial Sequence: Synthetic coding sequence
atggaacagaaaccgtccaaggtggagtgtggtagcgatcccgaggagaacagtgccaggtcacctgatggcaagaggaaaaggaagaacggccagtgcagccttaagacgtcaatgtcaggatacatcccttcctatctggataaggatgaacagtgcgtcgtgtgtggggataaagcaacgggctaccactaccgctgcataacctgcgaaggctgcaagggcttttttcggagaaccattcagaagaacctgcatccaacctactcgtgcaagtatgactcctgttgcgtgatcgacaagattaccagaaaccagtgtcagctgtgcagattcaagaagtgcattgcagtcggcatggccatggatctagtgttggatgacagtaagagggttgctaagcgaaaactaatagagcagaacagggagaggcgcaggaaagaagaaatgatcaggagtttgcagcagagacccgaacccactcctgaagagtgggatctgatacatatagccacagaggcacatagatcgacaaacgcacagggcagccactggaaacagcgtcgcaaatttctccccgatgacatagggcaatcgcctatcgtgtcgatgcccgatggagataaggtggaccttgaagccttcagcgagtttaccaagattatcacccctgccataactagggtggtggacttcgcaaagaaactgccaatgttcagtgaactgccttgtgaggatcaaatcatactcttaaaggggtgttgtatggagattatgtccctcagagcggcagtgcggtacgatcccgagagcgatacactgacgctctccggagagatggctgtcaagagagagcaacttaaaaatggcggtctgggagtggtgagcgatgcgatctttgagcttgggaagagcctgagcgcatttaacctggacgacaccgaagttgccctgttgcaggccgtgctcctcatgagcacggatcgttcaggactgttgtgcgtggataaaatagagaaaagccaggaagcttacctcctggccttcgaacactatgtgaaccatcggaaacataacatcccacatttctggcccaagctcctcatgaaagagcgggaagtacaatcgagcattctctacaaaggcgcagccgctgaagggaggcccggaggctcccttggcgtccaccccgaaggtcagcagttacttggcatgcacgtagtgcaaggcccacaggtgcgacagcttgagcagcagttaggagaggcaggctctttgcagggccctgtgctccagcaccagagcccaaaatccccccagcagcgcttactggagctgctgcacaggtcaggtatactccacgcccgtgccgtctgcggcgaagatgacagcagtgaggcagattcccccagcagttcagaggaggagcctgaagtgtgcgaggacttggccggaaatgctgctagcccctag

SEQ ID NO: 244069 - DNA, 1473 bp, Artificial Sequence
  Description of Artificial Sequence: Synthetic coding sequence
atggagcagaaacctagtaaggtggaatgcggctctgaccctgaggaaaactccgctaggtctcctgatggcaagagaaaacgcaagaatgggcagtgttctctcaagactagcatgagcgggtatataccatcctatctcgataaggacgagcagtgtgtcgtttgtggggacaaggcaactggctatcactaccgttgcattacatgtgagggatgcaagggattttttagacgtaccatccagaagaacctgcacccaacctattcctgcaaatatgactcctgttgtgtcattgataagatcacccggaatcaatgccaactctgcagattcaaaaagtgcatagccgtggggatggcaatggacctcgtgctcgacgattcgaagagagtagctaagcggaagttgattgaacagaatcgcgagagaagacggaaggaagagatgatccggagtctccaacagagaccggagcccacacctgaggaatgggacctgatccatatagccaccgaagctcacagaagcacgaatgctcagggctctcactggaaacagcggaggaaattcttgcctgacgacattggtcagagccccatagtctctatgcccgacggcgataaagttgatctcgaggctttcagcgagttcactaaaattatcacccccgctataacgagagtagtggatttcgccaagaaactgccaatgttttctgagctcccatgcgaagaccaaattattctgctgaaaggatgctgcatggagatcatgagcctgagagcagccgtgcgctatgaccccgagtcagatacattgacgctgagtggggaaatggccgtgaagagagagcagctgaaaaatgggggattgggcgtggtttcagatgccattttcgagctgggcaaaagccttagcgcatttaatctggatgataccgaggtagcgctcctgcaggctgtgctactcatgtcaacagatcggagcggcctgctgtgcgttgacaaaattgaaaaatcacaggaagcctatctcctggcatttgaacactacgttaaccacagaaagcacaacattccccacttttggcccaaattactgatgaaggaaagagaagtgcagtcctctatcctttacaaaggagcggcagccgagggtcggcctggtggatccctgggggttcaccccgaagggcaacagctgctgggaatgcacgtggtacagggcccacaggtgcgtcagctcgagcaacagctgggtgaagcaggttccctgcagggacccgtcctccagcaccagagtcccaaatctccccagcagagacttctcgagctgcttcatcgttcaggcatcctgcatgcccgagcagtctgcggtgaggatgacagtagcgaggccgactctccctcctcgtcagaagaagagcctgaggtgtgcgaagatctggccggaaacgcagcatcaccatag

SEQ ID NO: 244070 - DNA, 1233 bp, Artificial Sequence
  Description of Artificial Sequence: Synthetic coding sequence
atggagcaaaagccttctaaagtcgaatgcggcagcgaccctgaggagaacagtgcaagaagcccggatggtaagaggaagagaaagaatgggcagtgcagtttaaaaacatctatgagtgggtacattccatcttatctggacaaggacgagcagtgcgtggtttgtggggataaggcgaccggataccactaccgatgcatcacatgtgaggggtgtaaaggcttcttccgtcgcactattcaaaagaacctccatcctacttattcttgcaagtacgactcttgctgtgtgatcgacaagatcactcggaatcagtgccagttgtgtcgcttcaagaagtgcatagccgttggaatggctatggatttggtccttgacgatagtaagcgggtcgccaaacgcaagctgatcgaacaaaaccgcgagcgcagacgcaaggaggagatgatacggagtctgcagcagcggccagaacctactccggaagagtgggacttgatccacatcgctaccgaggcccatcgttccactaacgcacagggttctcactggaagcagagacggaaattccttccagatgatataggtcagagcccgatcgtttcgatgccagacggggataaagtcgacctcgaggctttctctgaatttaccaaaatcatcactcccgcaattaccagagtggtggatttcgcgaaaaagctgccaatgtttagcgagctcccctgtgaagaccagatcatcctgctcaaaggctgctgcatggagattatgagccttcgcgcagccgtgcgatatgatcccgaatccgatactttgacgctgtccggtgagatggccgttaagcgagagcagttgaagaatggtgggttgggtgtagtgagcgacgcgatattcgaactcgggaagtccctcagtgcttttaatctggacgatacagaagttgcactgcttcaggccgtgctgcttatgagtacagatcggtctgggctgctctgcgtggacaagatagagaaaagccaggaggcatacctgctagcgttcgaacattacgtgaaccacaggaagcataatatcccacatttctggcccaagctgctcatgaaagtgactgatcttagaatgatcggcgcatgtcacgcctcacgcttcttgcatatgaaagtcgagtgcccaacggaattattccctcccctcttccttgaagtgtttgaagaccaggaggtctag

SEQ ID NO: 244071 - DNA, 1233 bp, Artificial Sequence
  Description of Artificial Sequence: Synthetic coding sequence
atggagcagaagccttccaaagtcgagtgcgggtccgatcctgaggaaaatagtgctcgttcccctgacggaaaaagaaagaggaagaatggtcagtgttctctcaaaacctcaatgagcggctatatcccatcgtacttagacaaggatgaacagtgtgtggtatgcggcgacaaggccacaggctatcactatcgctgcattacatgcgaagggtgcaagggtttttttcggagaaccatacagaaaaatcttcatccaacatattcttgcaaatacgattcgtgctgtgtcatcgataagatcacgcgaaatcagtgccaactctgtaggtttaagaagtgcatcgccgtcggtatggcgatggacttagtgttggatgattcgaagcgcgtggccaagcgaaaactcattgaacagaatagagagaggcgtaggaaagaagaaatgattcggagcttacaacaaaggcccgaacccacgcccgaagaatgggatctgattcacatagcaactgaagcgcaccggtccactaatgctcagggcagtcactggaaacagcgcagaaaattcctgcccgatgatatcgggcagtctcctattgtgagcatgccggacggtgataaggtggacttggaagccttctctgagttcaccaagattataacaccagccattacgagggtcgtagacttcgccaagaagttgcccatgttttcagagttaccctgcgaggaccagatcattctcctaaaaggatgctgtatggagatcatgagcctgcgggcagcggtaaggtatgatcctgaatcagacacccttaccctgagcggcgaaatggctgttaaacgcgagcagctcaaaaacggtggacttggggtcgtctccgacgctatttttgagctggggaagtccttaagcgcttttaatttggacgacaccgaggttgcgctgctacaggctgttcttttgatgagtactgacagaagcggactcctgtgcgtagataagattgagaagtcccaggaggcctatttgctggccttcgagcactacgttaaccatcggaaacacaatatccctcacttctggcccaagctcctgatgaaggtcactgatctgagaatgatcggggcatgtcacgcatccaggttcctgcatatgaaagtggagtgtcccactgaattgttccccccactctttctggaagtgtttgaagaccaggaggtgtag

SEQ ID NO: 244072 - DNA, 1386 bp, Artificial Sequence
  Description of Artificial Sequence: Synthetic coding sequence
atgactcctaattccatgacagaaaatggactcaccgcatgggacaaaccaaaacattgcccagaccgggagcacgactggaaactggtcggcatgtccgaagcgtgtctgcatcgcaagagtcacagcgaaaggcggtctaccctgaaaaacgagcagtcctctccgcatctgatccaaacaacctggacgagctccatttttcacctggatcacgatgacgtcaacgaccaaagtgttagcagcgcgcagaccttccagacagaggagaaaaagtgcaaagggtatataccatcctacctggataaggatgagctgtgcgtggtgtgtggcgataaagccacaggttaccattacagatgtatcacctgtgagggatgtaagggcttctttcgcaggacaatacagaagaatctgcacccttcatattcatgtaaatacgaagggaaatgtgtaattgataaagtgacccggaaccaatgccaggagtgtaggtttaaaaagtgcatctacgtaggcatggctacggatctagtgctggacgattctaaaaggttggcaaagcgcaaattgatcgaggaaaatcgggagaaaaggaggcgcgaggagctgcaaaagtctatcggccacaagcccgagcccaccgatgaagaatgggagctgataaagaccgtaaccgaggcccacgtggcaactaacgctcagggttcacattggaagcagaagaggaaattcctgccggaagacattgggcaggcacccattgtgaacgccccagagggcggaaaagtcgatctagaggcatttagccactttaccaaaataattactcccgcaattacaagagttgtggacttcgctaagaagttacctatgttttgcgaattgccttgtgaggatcagatcattctcttaaaaggatgctgtatggaaattatgagccttagggccgctgtgcgatacgatcctgagagcgagacccttacactgaacggcgagatggccgtaacaagaggccagctcaagaatggagggctcggcgtagtctcagatgccatcttcgatctgggtatgtcactgagttcttttaacctggatgacactgaagtcgccttgctgcaggctgtacttctaatgtcctcagacagacctggactggcgtgcgttgaaaggatcgagaagtaccaggattctttcctcctggccttcgagcactatattaactataggaaacaccacgtgacacacttctggcccaaactgctcatgaaagtcaccgacctccggatgataggggcttgccatgcatcccgcttcctgcacatgaaagttgaatgcccgacagaacttttccctcctctcttcctcgaggtcttcgaggattag

SEQ ID NO: 244073 - DNA, 1386 bp, Artificial Sequence
  Description of Artificial Sequence: Synthetic coding sequence
atgactcccaacagcatgaccgaaaacggtctcacggcgtgggataagccgaagcattgcccagatcgggaacatgactggaaacttgtagggatgtccgaagcctgtctccacaggaaatcccattccgagagacggtccactctgaagaatgaacagagcagtccacacttgatccaaactacttggacatcctcaatcttccatcttgaccacgatgacgtcaacgatcagtccgtaagcagcgctcagacgttccaaaccgaggagaagaagtgcaagggctacatcccttcttacctggacaaagacgaactgtgtgtcgtctgcggggacaaagccacaggctatcactataggtgcatcacctgcgagggctgcaagggttttttcagaagaacgatacagaagaaccttcacccttcgtactcgtgcaagtatgagggcaaatgcgtgattgacaaagtcactcgtaatcagtgccaggagtgccgcttcaagaagtgtatttatgttggcatggctactgacctggtgctcgacgactcaaaacggttggcaaagcgcaaactgatagaggaaaaccgagaaaagcggagaagagaggagttacagaagtccattggccataaaccagaacctacggatgaggagtgggagctcatcaaaaccgttacggaagctcacgtggcaaccaacgctcaaggatctcattggaagcagaagagaaaatttctgccagaagacataggacaggctccaattgttaacgcgccagagggaggtaaggtagatctggaggccttctctcatttcaccaaaatcataactcctgcgattacacgggtagtcgatttcgctaagaagctgcccatgttctgtgaacttccctgtgaagaccagatcatactgttaaaaggatgttgcatggagataatgtctctgcgggctgccgtcagatatgaccctgagtccgagaccctcacacttaacggagaaatggccgttacacggggacagctgaaaaatggcggtttaggtgtggtgtctgacgccatcttcgacctggggatgtccttgtctagcttcaaccttgatgatactgaggtcgccctgctgcaggcagtgctgctgatgtcttcagatcgaccgggactggcttgcgtggagcgaatcgaaaagtaccaggattcgtttctgctggcgttcgagcattatattaattaccgaaagcaccacgtgacacacttctggccaaaactgctcatgaaagttacagatctgcgaatgatcggcgcttgtcatgcgagcaggttcctgcacatgaaggtcgagtgtcctacggaactgttcccgccactctttttagaagtgttcgaagactag

SEQ ID NO: 244074 - DNA, 1386 bp, Artificial Sequence
  Description of Artificial Sequence: Synthetic coding sequence
atgacaccgaactctatgactgagaatggactaactgcctgggataaaccgaagcactgtcctgaccgagaacacgattggaagcttgtggggatgtcagaagcatgcttgcaccgcaagtcacactccgaaagacggtctactctgaaaaatgagcaaagtagcccgcacttgattcagacgacctggacctcatctattttccacctggaccatgatgatgtcaatgatcagtctgtatcatcagcccaaacttttcagactgaggagaagaagtgcaagggttacattccttcctatcttgacaaagatgagttgtgtgttgtgtgtggggataaagctaccggataccactatcgctgtattacgtgtgaagggtgcaagggattcttccggaggacaattcagaaaaatttacacccatcatattcatgcaaatacgaggggaagtgcgtcatcgataaggtgacacgcaaccagtgccaggagtgccgatttaagaaatgtatctatgttggcatggccacagatctggttctggacgatagcaagcggctcgccaagaggaaactcatcgaagagaatcgggaaaagcgacggagagaggaacttcagaaaagcatcgggcacaaacccgagcccaccgatgaggagtgggaactgatcaagacagtgaccgaagctcacgtggcgaccaatgctcaggggtcccattggaagcagaagaggaaatttctgccagaagatattggtcaggccccaatcgtgaatgctcccgagggtgggaaggtcgacttggaagctttctcccactttactaaaattattacccccgcaataactcgcgtagtcgactttgcgaagaaacttcctatgttttgcgaactcccatgtgaagaccagatcatcctccttaagggatgttgtatggagatcatgtccctccgagcggctgtgaggtacgatcccgaaagcgaaacactgaccctgaatggggagatggctgtcacacgaggacagttgaagaacggcggtctaggagtggtctccgacgcgatttttgacctgggcatgagcttgagctcattcaatttggatgacactgaggtcgctctgctgcaggccgtgctgctcatgtctagcgaccgccctgggctggcatgtgtggaacgaattgaaaagtaccaagactcctttcttttggcattcgaacattatattaactaccgaaaacaccacgtaacacacttctggcccaaacttctaatgaaggttactgatttaagaatgatcggagcttgccatgcctctcgctttctgcatatgaaagtggaatgccctacagagctgtttccacctctgttcttggaggtcttcgaagactag

SEQ ID NO: 244075 - DNA, 87 bp, Artificial Sequence
  Description of Artificial Sequence: Synthetic coding sequence
atgacccccaactcaatgaccgagatggcacttcagccagggaccaaccgctccacagtccagactgagaatactacgggaagctag

SEQ ID NO: 244076 - DNA, 366 bp, Artificial Sequence
  Description of Artificial Sequence: Synthetic coding sequence
atgaccccaaattctatgactgagaacggactaacagcctgggacaaacccaagcactgtcccgatcgggaacatgactggaagctggtcggtatgtccgaagcttgcctgcacagaaaatcgcactctgaacgaagatctaccctgaagaacgagcagagctctcctcacctgattcagaccacatggacttcctccatatttcacctggatcatgatgatgtgaatgaccagtccgtgtcctctgcacagacatttcagactgaggagaagaaatgcaaaggctatataccatcgtacctggataaggacgaactctgcgtcgtttgcggagacaaagcgacaggctaccactacaggtgctag

SEQ ID NO: 244077 - DNA, 441 bp, Artificial Sequence
  Description of Artificial Sequence: Synthetic coding sequence
atgcaggtgcttacaaaacgctaccccaagaattgcctgctgacagtgatggatcgctacgctgccgaagttcataacatggaacaagtagtcatgatcccctctctgttaagggatgttcaattgtcgggtccgggaggccaggctcaggccgaagcgccagacctgtatacctactttacaatgctgaaagccatttgcgtggacgttgatcatggcttactgccaagggaagaatggcaggctaaggtggcgggaagcgaagagaacggcacagccgagacagaggaggtggaagatgaatcagcatccggggagctggaccttgaggctcagttccacctgcatttctcatctttacaccacatcctgatgcatctgactgagaaggctcaggaagtgacacgcaaatatcaggaaatgaccggacaagtgtggtag

SEQ ID NO: 244078 - DNA, 2802 bp, Artificial Sequence
  Description of Artificial Sequence: Synthetic coding sequence
atgcgtgcgctggctgtgctgagcgtcacattggtgatggcgtgcacagaggcgttctttccgttcattagtcgaggaaaggagctgctgtggggcaaacccgaggagtcgagggtctcgagtgtgctagaagagtcaaagcgcctagttgatactgcaatgtacgcaaccatgcagcggaacctcaaaaagcgcggaatcttgtcccctgcgcagttactgtcttttagtaaactgcctgagccaacttctggcgtgatcgccagggccgcagaaattatggagaccagcattcaggccatgaagagaaaagtaaatctcaagactcagcagtctcagcatccaacggacgccctgtctgaagatctgctgtccattattgctaatatgagtggctgcctgccctacatgcttccacccaagtgtcctaatacttgcttggcaaataagtatcgacccatcaccggtgcgtgcaacaatagagatcaccccaggtggggagcatctaacactgctctcgcaaggtggctgcctccggtgtacgaagatggcttttcacagcctagggggtggaaccccggttttttgtataacggctttccgctgccccctgtgagagaggttactcgacacgtcatacaagtgtcaaatgaagtagtcactgatgatgaccgttatagtgatctgcttatggcttggggacagtatattgaccatgatatcgcatttaccccgcagagcaccagcaaagctgcctttggcggaggagcggattgccagatgacctgcgagaaccagaatccctgcttcccaatacaactccctgaagaagccagacccgctgccggaacagcctgtttacctttttatcgatcctccgctgcttgtggtaccggcgaccagggtgcactgttcggtaacctatctactgcaaacccgagacagcaaatgaacgggctcaccagcttcttggatgcttccacggtgtatggtagctcacccgctctggagcgtcaactgcggaactggacctctgctgaaggactgctgagagtgcacgctagactgagagacagtggccgtgcctatctgcctttcgttccacccagagcccctgctgcttgtgcgccagaacctggtattcctggcgagaccagaggtccttgctttctggcgggagatgggagagcttccgaggtcccgagtctcacagccctacatacattatggctgcgcgagcataatcgacttgcagcggctctgaaagcacttaacgctcattggtcagctgatgcggtctaccaggaggctcgcaaggtagtgggtgccctgcaccaaataattacactccgcgactatattccacgtatccttggaccagaagctttccaacagtatgttggtccgtatgagggatacgattccactgcaaaccctactgtgagcaacgtgtttagtaccgcggctttccgatttggacatgccactattcatcctttagtccgtcgactcgacgcgtccttccaggagcaccccgatctgccaggcctgtggctccaccaggcattcttcagcccctggaccctcctgcgcggtggagggctggatccccttatcaggggcctgcttgctcgacctgcaaagctgcaggtccaggatcagctcatgaacgaggagctgacggagcggctgttcgtattgtccaatagcagcactctcgatctcgcgagcatcaacctgcaacgtggcagagaccacggtctccctgggtataatgagtggagggagttttgcggccttcctagactagaaactccggctgacctgtctacggctatcgccagccggtcggtcgccgacaagattttagatctgtataagcaccctgataacatcgatgtgtggctgggaggcctagcagagaatttcctgccgcgagctaggacggggcctctattcgcttgcttgattgggaaacagatgaaggcactgagagacggagattggttctggtgggagaatagccacgtcttcacagatgcccagcgccgagaacttgagaagcactcactgagtcgggtgatctgtgacaatacgggcctcacaagagtcccaatggacgcttttcaagttgggaagttcccggaagacttcgagtcctgtgactcaataacagggatgaacctggaggcatggcgggaaacattcccacaagacgacaaatgcgggttcccagagtcggtcgaaaatggcgatttcgtccactgtgaggagtccggacgacgtgtcctggtctactcgtgtagacacgggtacgagctccagggaagggagcagctgacctgtactcaggagggctgggactttcagcccccattatgcaaggacgtgaacgagtgtgctgacggcgctcaccccccatgccatgcctcggccagatgcaggaacaccaaaggcggtttccagtgtctgtgtgcagatccttatgagctgggcgacgacggtcgaacttgtgtagactccggcagactgccaagggttacctggatttcaatgtccctcgctgccctcctcatcggcggtttcgcagggctgacctctaccgtaatttgccggtggactcgaaccggtacaaaaagcaccttgcccatatccgagacaggaggcggtactcctgagctccgttgcggcaaacatcaagcagttggcacctcgccacaacgcgcagcagcccaggacagtgagcaggagagcgccggaatggaaggacgggacactcaccggctccccagagctttatag

SEQ ID NO: 244079 - DNA, 2790 bp, Artificial Sequence
  Description of Artificial Sequence: Synthetic coding sequence
atgagagcgctcgcagtgttgtcggtgacacttgtgatggcctgtaccgaggcattttttccattcatcagcagggggaaagaactactctggggaaagccggaagaatccagagtatcctcagtcctcgaggaatcaaaaagactggtggacactgcaatgtatgccactatgcagcggaacttaaagaagcgaggcattcttagcccagcacaactgctatcttttagtaaactccccgagcctacttctggtgtgatcgcaagggccgcagaaatcatggagactagcatccaggctatgaagcgaaaagtgaatttgaagactcagcagagccagcatccgaccgacgccttaagtgaggacctcctgagcattatcgccaacatgtccggctgcctcccctacatgctgccaccaaaatgcccgaacacctgtctcgccaataaatacagaccgatcactggcgcttgcaacaatagagaccacccgcgatggggcgcttcaaacactgctcttgccaggtggctgcctccagtgtatgaggatggcttttcccaaccacgaggctggaacccaggcttcctgtataatgggtttcccttgccccctgtaagggaggtaacaagacatgtgatccaagtgagtaatgaggtcgtgaccgacgacgatcgttactcagacttgctgatggcttggggacagtacatcgatcacgacatagccttcactcctcagagcacaagcaaggcagcctttggaggcggagcggattgtcagatgacgtgcgagaatcagaatccgtgtttcccaattcagttaccagaggaagctcggccagccgctggaaccgcttgtctgcctttctatcgcagctcagccgcttgtggcacaggtgaccagggagccctttttggcaacctgagcaccgcaaacccacggcagcaaatgaatggactgacctctttcttagacgctagcaccgtttatggaagctcacccgcactcgaacggcaattaagaaattggacttcagcggagggcctcctccgcgtgcacgcacgcctcagagattcaggacgggcatacttgccattcgtcccaccacgggctcccgcagcctgtgccccagaacccggaataccgggagagacaaggggtccttgtttcctcgcgggagacggaagagctagtgaggtgcctagccttaccgccctacacacattgtggcttcgggagcacaacagactcgccgctgcgctcaaagccctcaacgcgcattggagtgccgacgcagtgtatcaagaggccagaaaggtggttggagccctacatcagattatcacactccgcgattacattccacgaatccttggaccggaggccttccagcagtacgtaggtccctatgagggctacgacagcacagcgaatccaactgtaagtaatgtgttcagtacagctgcgttccgatttggacacgccacaattcaccccttagtccggagactcgacgcaagtttccaggaacatcccgacctgcctggcctgtggttacatcaagcctttttttcgccttggacacttttgcggggaggagggttagaccctcttatccggggtctcctcgcccgaccagccaagttgcaggttcaagaccaactgatgaatgaagagttgacagagcggctgttcgttttgagtaattcgagtacactggaccttgcctcaatcaatcttcaaaggggaagggaccacggactgcctggatacaatgaatggcgggagttctgcgggctgcccaggcttgagacccctgctgatttatccactgccattgcaagccggtctgtggcagacaaaatactggatctttataagcacccagataatatcgacgtgtggttaggtgggttggcagagaatttcttgcctagggcacgcactgggcctctttttgcttgtcttattggcaagcaaatgaaagccctcagagacggcgactggttctggtgggagaattcccacgtgtttaccgacgcccagaggcgggaactagagaagcacagtctgagccgagtcatttgtgataatacgggcctgaccagagtacccatggatgcattccaggtgggtaagttccccgaggattttgagtcctgtgacagcattaccggcatgaaccttgaagcatggcgggagaccttcccacaggatgacaagtgcgggtttccggagagcgtggaaaatggagacttcgtacattgtgaggagtccggccgaagggttctggtgtactcctgccggcatgggtacgaattgcaggggagagagcagctcacttgcacccaggaagggtgggattttcagccccctctgtgtaaggacgtgaatgagtgcgctgatggcgctcaccccccttgtcacgcctctgcaagatgtaggaataccaaaggtggtttccaatgcctctgcgcggacccctatgagcttggcgatgacggacgcacttgtgtggactctgggaggctgcctcgggttacctggatctctatgtcccttgcagctctgttaattggtggatttgcgggactcacatctacagtgatttgtcgctggcgggtcttgggctggaaggctggtattctcacaggatgtcgagaacctagcgagggcaaagtggccggacactgccggaccgcaagctgctctcagaaccaccgcacaaccctatttcagactcaggcaaatccgaagtccgcgggtcgtctgttcagccagcacgggtag

SEQ ID NO: 244080 - DNA, 2802 bp, Artificial Sequence
  Description of Artificial Sequence: Synthetic coding sequence
atgcgggcacttgccgtactatcagtaactcttgtgatggcatgtaccgaggccttctttcccttcattagccggggaaaagagctgctctggggaaagcctgaagaatcaagagtatcttccgtactggaggagagcaagaggctggttgataccgcgatgtatgctacaatgcagcgtaacttgaaaaaacgcggtattctgtctccagcccagctcctgtctttcagtaagcttcctgaaccaacctctggagtgatagctcgcgcagcagaaataatggaaacttctatacaagctatgaagagaaaggtgaatctgaagacccaacagtctcaacatcccaccgacgcactgagtgaggacctgctgtcaatcattgccaacatgagcggatgcctgccctatatgctgccgccaaagtgtcccaatacatgtctggccaacaagtataggccgatcacaggggcttgcaacaacagagaccatcctaggtggggcgcaagcaatacagctctggcacgatggctcccgccagtttacgaagacggatttagtcagcctcggggttggaacccgggattcttatacaacggatttcccttgcctccagttagggaagttacccgccatgtcattcaggtctctaacgaggttgtcacggatgatgatcggtattcagatttgctgatggcgtggggacagtacatagatcacgatatcgcattcacaccacaaagtacttccaaggccgctttcggcggaggcgcagattgtcagatgacctgcgaaaaccagaacccctgctttccaattcagctgcccgaagaggcaagacctgccgcaggaactgcctgcttgcccttttaccggtcttcagctgcatgtggaacgggcgaccaaggagctcttttcgggaatctgagcacagccaacccaaggcagcagatgaacggcctgacgagctttcttgatgccagcacagtgtacgggtcgagtcccgcacttgaacggcagctgcggaactggacgagtgctgaaggcctgttgcgggttcacgcacgcctgagggattcgggaagagcttatcttccctttgtgcctccacgcgctcccgctgcatgcgcgcctgagcctggtattcccggtgagaccagaggaccctgcttcctcgctggtgatggcagagcatctgaagtccccagcctgactgctttacacaccctgtggctgagggaacacaatcggctagcagctgctctgaaggctctcaacgctcactggtccgccgacgccgtttatcaggaagctagaaaagtcgtgggcgcattacaccaaattataaccttacgcgattatataccgcgaattttaggcccagaggcattccagcaatacgtcgggccttacgagggctatgactcaaccgccaatcccaccgtcagcaacgtattctccacagcagcattccgcttcgggcatgcaacaattcatccactggttagacgactagatgccagctttcaagaacaccctgatctaccaggattatggctgcatcaggccttttttagcccctggactctccttaggggagggggactagaccccctcatcagaggccttttggctaggccagcgaaactgcaagtgcaggaccagctgatgaatgaagagctgacagagaggttattcgtgctgtcaaatagcagcacactcgacttggcgagcattaatcttcagagaggccgagatcacggtctgccaggctacaatgaatggagggagttctgcgggttgccccgactagagacccctgccgacctgtccacagccatagctagtaggtccgtggccgataagatcctggacctgtacaagcacccagacaatatagatgtgtggcttggaggacttgccgaaaatttcctgccccgagccaggactggcccactgtttgcatgcctaatcggcaagcagatgaaagcgctgagggacggcgattggttttggtgggagaacagccacgtcttcacagacgcccagagaagagaactcgagaagcacagcttgtctagggtcatctgcgacaatacaggcctcactagagtcccaatggatgcctttcaggtggggaaattccctgaagacttcgagagctgcgactcgatcacaggcatgaacctggaggcttggagagagactttcccacaggacgataaatgtggatttcctgagagcgtagagaatggagactttgtgcattgcgaggaatctggtcgacgggttctcgtgtattcgtgtcgccacggttatgagttgcaggggagggagcaactgacctgtacacaggaggggtgggattttcaaccacctttgtgtaaagacgtcaacgagtgcgccgacggagcacaccctccatgtcatgccagcgctcgatgcagaaataccaagggagggtttcagtgcctttgtgcagacccatacgagttgggcgacgatggacgcacctgcgtcgattctgggagactccccagagtcacttggatttctatgtcactcgccgctctcctcatcgggggatttgccggtctcacgtcgacagtgatttgtcgatggactcggactggcaccaaatcaactttgcccatttccgaaactggagggggaacaccagaactccggtgcggcaagcaccaggccgtgggcacgtcaccccagagagccgctgctcaggacagtgaacaagaaagcgcgggtatggaaggaagagacacccaccgcctcccacgtgcactgtag

SEQ ID NO: 244081 - DNA, 2670 bp, Artificial Sequence
  Description of Artificial Sequence: Synthetic coding sequence
atgcgggcactcgcggttttgtctgtgacactcgtgatggcgtgtacggaggccttcttccctttcataagtaggggaaaagaactgttgtggggcaagccagaggagtcccgggtctcatcagtgctggaggaatccaagagacttgttgacacagcaatgtacgctaccatgcaaagaaatctgaagaagaggggaatcttgtctcctgcccaacttttgtcttttagtaaactccccgaaccaacatctggagtgatagccagggctgcggagataatggagaccagtatccaggccatgaaacggaaagtgaatctgaaaacgcagcagagccagcatccaactgatgccctctctgaagatctcctgtcaatcatagcaaatatgtcagggtgccttccgtatatgctcccacctaaatgtccgaacacttgcctagccaataaataccgccctatcaccggggcatgcaacaatagagaccaccctaggtggggggcttctaacactgcgctcgctagatggctgccacctgtttacgaggatgggttttcccagcccagaggatggaatcctggatttctgtataatggtttccccttaccgccagtccgtgaggttacccgccacgtgatccaggtgtccaacgaggtggtgacggacgatgacaggtactccgaccttcttatggcttggggacagtatattgaccacgatatcgcatttaccccacagtcgacgtctaaagcggcttttggtggtggggcagactgccagatgacctgcgagaaccagaatccatgttttccaattcagctgccagaggaggcccgacctgctgccggaaccgcctgtctcccgttctaccgcagttccgctgcctgtggtaccggcgatcaaggggctctgttcggcaacctatccactgcgaatccgaggcagcaaatgaacggcctgacaagttttctggacgctagcacagtgtatggcagctcgcctgctttggaacgccaactgagaaactggacatccgctgaaggcctgttgcgggtgcacgctcgtctacgagactccggccgagcttacctgccattcgtgcccccacgagcacctgctgcatgtgcccctgaaccagggatcccaggagagacgcgcggaccgtgttttctggctggcgatggaagggcttcagaagtgccatctttgacagctttacatacactctggcttcgggaacacaatagacttgcagcagccctgaaagccctgaatgcacattggtcagccgatgccgtgtatcaagaggctagaaaggtggttggggcattgcatcagataataaccctgcgggactacattccacgcatcctcggccctgaggccttccagcagtacgtgggtccttatgagggatatgactcgacagccaacccaacggtgtccaacgtgttttcaaccgccgctttccggtttggccacgcaacaattcatcctctggtgcgtcgtctcgacgcttcattccaggagcaccctgacctacctgggctttggctgcatcaggcattcttttccccatggacccttctacggggagggggtctggacccactcatacggggtttactcgcacggcctgcaaaactccaggtccaggaccagctcatgaacgaggagcttaccgaacgactgttcgtgctcagcaacagtagcactctggatcttgcttctattaatctgcagaggggcagagaccacggtttaccgggatacaatgagtggagagagttctgtggcctgccgaggctggaaacgccagccgacctgtcaacagcgatcgctagtaggagcgtggcagacaagattctcgatctgtacaagcaccctgataatattgatgtgtggctaggcggattggctgagaatttcctgcctcgcgcaaggaccggcccactattcgcctgtctcattggtaagcaaatgaaggcgcttcgggatggggactggttctggtgggagaatagccatgtgttcacggatgctcagcggagagagctggagaaacactccctctctagagtcatctgcgataatactggcctaaccagagtcccgatggatgcgttccaagttggcaaatttcctgaggactttgagtcatgcgattccatcaccggtatgaacctagaggcatggcgggagacatttccccaggatgataaatgtggatttcccgagagcgtggagaacggggacttcgtacactgcgaggaatctgggaggcgtgtactagtgtatagctgccgccacggctacgaattacaaggccgtgagcagctcacgtgcactcaagaagggtgggatttccaaccccctctgtgtaaggactctggcaggcttcccagggtcacctggatttccatgtccctcgcagcattattgattggcggtttcgcgggactgacatccaccgtcatatgtaggtggaccaggaccggcaccaagtctactttgcctatctctgaaactggagggggtaccccagagctgcgatgtggtaagcaccaggcagtggggacgagcccacaacgcgcagccgcacaggactccgagcaggaatcggcaggcatggagggtcgggacacccatcgcctccctagggccctatag

SEQ ID NO: 244082 - DNA, 2283 bp, Artificial Sequence
  Description of Artificial Sequence: Synthetic coding sequence
atgcgggctctggctgtgctgtcagtgacacttgtcatggcatgcaccgaggccttttttccctttatctctcgtggcaaggaactgttgtggggtaaacctgaagagtctagggtgtcttctgtgctggaggaatccaaaagactggtggacactgcaatgtacgcaacgatgcaacgcaatctcaagaagaggggcattttgtctccggctcaattgctgagcttttcaaagctgcccgagccaacaagcggagtcattgctcgcgctgccgagatcatggaaacatcaatccaagcaatgaagcggaaagtgaatctcaagacccagcagtcccagcaccccactgacgcactgtccgaggacttactgtcgatcattgctaacatgtccggctgcctcccatatatgctcccaccaaagtgtcccaacacctgcctcgccaataagtaccgccctatcacgggcgcttgtaataacagagatcaccctcggtggggagcatcaaacaccgctctggcaagatggctgccacccgtttatgaggacggattttctcagccccgagggtggaatcctggattcctttataacgggttcccattgccgccagttagggaggtgacccgccatgttattcaggtgtcaaatgaggtggtgacagacgacgacaggtacagtgacttactcatggcgtgggggcagtacatcgatcatgatatcgcattcaccccgcagtccacctcgaaagccgcattcggagggggagctgattgccagatgacttgcgaaaatcagaacccctgcttccctatccagatcattaccctccgcgattacatcccccgaatactggggcctgaggccttccaacagtacgtgggcccttacgagggctatgactctaccgcaaatccgaccgtctccaatgtgttctcaaccgccgcatttcgttttggccacgcaactatccatcctctggtgcgtagactcgacgccagcttccaagagcaccctgatcttcccggactgtggctccaccaggctttcttctcaccttggaccttgctgaggggtggcggactggatccactgatccgaggactgctggctcggcctgcaaagctgcaagtgcaggatcaacttatgaacgaggaattaactgaaaggctgttcgtgctctcaaactcgagcaccctggacctcgcctccattaacctacagcggggaagagaccacggcctaccaggatataacgaatggcgggaattctgtgggttacctcggctcgagactccggctgatctctctacagctatagccagtcgttcagttgctgacaaaatattggatctgtacaaacaccccgacaatattgacgtttggttaggcggtttggcagagaattttctccctagagccagaacaggtcctcttttcgcctgtctcataggcaaacaaatgaaggcgttgcgcgatggggactggttttggtgggagaactcacacgtctttactgacgctcagcgacgcgagctggaaaaacacagcctatcgcgagtgatctgtgataacactgggctgacccgcgtgccaatggacgcctttcaagtgggcaaattccctgaagatttcgaatcctgtgacagtatcacagggatgaacctagaggcttggcgtgagaccttcccacaggacgacaaatgtggctttccagaatcagtcgagaacggcgattttgttcactgcgaggagtctgggagaagagtcttggtatatagttgtcgccacgggtacgagctgcagggacgtgagcagctgacttgcacccaggagggatgggattttcaacctccactgtgcaaggacgtgaatgagtgcgcagacggtgctcaccccccttgccacgcgtccgcaagatgtcggaacacaaaggggggtttccagtgcctgtgtgccgacccctatgagctgggcgatgatggccgaacttgcgtggattcagggagattaccaagagttacatggatctcaatgtcgctggccgctctgttaatcggaggcttcgctggccttacaagcaccgtcatctgccgctggaccagaacagggacaaagagtactctgcctatatcagaaacagggggaggaacacccgagctacgttgcgggaagcatcaggctgtcggcacctcacctcagcgggcagccgcacaggattcagaacaggagtcagccggaatggagggccgtgacacacaccgacttccccgtgccctttag

SEQ ID NO: 244083 - DNA, 2283 bp, Artificial Sequence
  Description of Artificial Sequence: Synthetic coding sequence
atgagggcgctcgccgtcctgagtgtgaccttagtgatggcctgcacagaagccttttttcctttcatttcgagaggcaaggaacttctttggggcaaaccggaagagtcccgagtctcctctgtacttgaagagtccaaacggcttgtggataccgccatgtacgccaccatgcagaggaatctcaaaaaacgtggcattttgtcccccgcacagttgcttagcttctctaagctccctgaaccaacctccggagtgatcgcgagggcagccgaaatcatggaaacatccatacaggccatgaagagaaaggtcaacctaaagacccagcagagccagcacccaactgacgcactgagcgaagacctgctgtcaattatcgccaacatgagcgggtgcctgccttacatgctgccacctaaatgtccaaacacttgcctggctaacaaatacagaccaattacaggcgcttgcaataaccgcgaccacccgcgatggggagcctctaacaccgcgctggcccgttggctgccacctgtctatgaggatggtttctcccagccccgtggctggaatcctggcttcctgtataacgggtttcctctaccaccagtcagagaagtgactcggcacgtcatccaggtatctaatgaggtcgtgactgatgatgatcgttactctgatctgctaatggcatggggccagtatatcgaccacgacattgcctttactccacagtcaacctccaaggcagcttttggagggggagcagattgccagatgacatgcgagaatcagaatccatgtttccctatccagattatcaccctgcgcgactacattcccagaattctggggccagaggcctttcaacagtatgttggcccatacgagggttatgattcgacagccaaccccacagtcagcaatgttttttcaaccgcagcattccgtttcggccatgctacgattcatccccttgtacggcgactcgatgcctcttttcaagagcatcctgacctaccaggtctgtggctccatcaggcgttcttcagcccctggaccttgctgagaggaggtggacttgaccctttgattaggggcctgctggcacgccctgcaaaacttcaggtgcaagaccagttgatgaatgaggaactgaccgaacgcctgtttgtcctgtcaaactccagtactctcgacctggccagtatcaatctgcagagggggagggaccatggcctgcctggttacaatgagtggcgagagttttgtggcctcccaagactggaaacacctgcggatctgagcactgcaatcgcgtctagaagcgtggcagacaagattttggacttgtacaaacaccccgacaacatcgatgtctggttggggggtctggccgagaattttctgcctagagccaggactggacctcttttcgcctgtcttatcgggaaacagatgaaggccttgcgggacggtgactggttctggtgggaaaactctcacgtctttaccgatgctcaaaggcgagaacttgagaaacactccctctcccgcgttatatgcgataataccggcctgacccgagtgcccatggacgcattccaagtggggaagtttcctgaagatttcgagagctgtgactccatcactggtatgaatcttgaggcctggagagagacctttccacaggatgataaatgtggtttccccgaatctgtcgaaaatggagacttcgtgcattgcgaggagtccggccgtagggtcttggtttattcttgcagacatgggtatgagctacagggcagggagcagctgacttgcacacaggagggctgggacttccagcctcctctgtgcaaggatgttaacgaatgcgctgacggcgctcatcctccctgccacgcctcggccagatgtagaaatactaagggtggttttcaatgtctgtgcgcagacccttacgagctgggcgacgatgggcgtacctgcgtcgattctggtcgactgcccagagtgacatggatctcaatgtccttggccgcacttctaataggtggcttcgctggactcaccagcaccgtgatttgccggtggaccaggactggaaccaagtcaacccttccaatatctgaaaccggaggtgggacgcctgagttgaggtgtggtaaacaccaggctgttggcacctctccccaaagagccgcagctcaggacagcgaacaggagagcgctggaatggaagggcgagatactcaccggctcccaagggctctttag

SEQ ID NO: 244084 - DNA, 2631 bp, Artificial Sequence
  Description of Artificial Sequence: Synthetic coding sequence
atgagagcattagcggtcttgagcgttaccttggtgatggcctgcaccgaggcttttttcccattcattagccgcggtaaagagctcttgtggggaaaacccgaggagagcagagtgagttctgttttggaggagtccaaaaggcttgtggacaccgccatgtacgccactatgcagagaaatcttaagaagcgtggcatactgagccccgctcagctcctgagcttctcaaagcttccggagcctacctctggtgtgatcgccagggccgctgagattatggagacatccatacaagccatgaagaggaaagtgaaccttaagacacaacagagtcagcatcccacggacgccctgagtgaagatctgttgagcatcattgccaatatgtccggttgtctgccatacatgctcccaccgaaatgccccaacacatgcctggcaaataagtaccggccaatcaccggcgcttgcaataatagggaccaccctcgttggggcgcaagtaataccgcactagctcggtggttgccacctgtgtatgaggatggttttagccagcctaggggatggaacccaggatttctctataatgggtttcctttgccacctgtgagggaggtaacgagacacgtgatccaggtcagcaatgaggtcgtgacagatgacgataggtactcggatctgctgatggcatggggtcagtatatcgatcacgacatagccttcacacctcagagcacttccaaagcagccttcggaggcggtgcagactgccagatgacatgcgaaaaccagaatccttgctttcccatccaactcccggaggaggccagacccgctgcaggcacggcgtgtctgccgttctatagaagctccgccgcttgcggcacaggcgaccagggcgctctgtttgggaacctcagcacagcaaacccacgccaacaaatgaatggcctgacgtccttccttgacgcttctacggtatacggcagttccccggctctggagagacagctcaggaactggacctcagctgagggcttactgcgtgtgcatgctcggcttagagactcaggcagggcctatttgccatttgtcccaccgagagccccagctgcatgtgcaccggagcctgggatacccggtgaaacaaggggtccctgtttccttgcaggcgacggtcgtgcatccgaggtgcctagcctgactgcgctgcatacactctggcttagagagcacaatcgccttgccgctgcgctgaaagcactcaacgcacactggtctgctgacgccgtctaccaggaggccagaaaggtcgtgggagctctgcatcaaattattactctaagagactacatcccaaggattcttgggccagaggcctttcagcaatacgtcgggccatacgagggctacgactctaccgccaacccaaccgtgtctaatgtgttcagtacagcagcttttcgcttcgggcatgctacgatccaccccctggttagaaggctcgatgcatcctttcaagagcaccccgatctacctgggttatggctacaccaggcattcttctcaccctggacattattgcggggtgggtacaacgagtggagggaattttgcggtctcccaaggcttgaaacacccgctgacctgtcaaccgccattgccagccgttccgtggccgataagatcctggatttgtataagcaccctgataacatcgacgtttggctgggcggactggcggaaaattttctacccagagcacgtaccggtccactcttcgcatgcctgatcggcaagcagatgaaagccctcagagatggcgactggttttggtgggaaaattctcatgtatttacagacgcacagcgtcgtgagctggaaaaacactctctctccagggtaatctgtgataatacagggctgacccgagtgcccatggatgccttccaagtggggaagttccccgaagactttgagagctgtgactcaattactggcatgaacttggaggcgtggcgtgagaccttcccccaagatgacaagtgcgggtttcccgagtccgtggagaatggggactttgtccactgcgaggaaagcggcaggagggtattggtctacagctgcagacatggatatgagctgcagggaagggaacagttaacttgtacgcaagagggctgggatttccagccccctctttgtaaggacgtgaacgagtgcgccgatggggcacaccccccttgtcacgcctctgcccgatgccgcaatacaaagggaggattccaatgtctgtgtgccgatccctatgagcttggggacgacggccgtacgtgtgtcgactctggaagactgcccagggtaacttggataagtatgagtctggccgctttgctgattggagggttcgctggtcttacctcaacagtgatctgccgctggaccagaacggggaccaaaagcaccctgccgatctctgagactggtggcggtacacctgaactgcgctgcggtaagcaccaagccgtggggactagcccacagagggctgccgcacaggactccgaacaggaaagcgccggtatggaaggaagagacacacatagacttcctcgcgcactgtag

SEQ ID NO: 244085 - DNA, 519 bp, Artificial Sequence
  Description of Artificial Sequence: Synthetic coding sequence
atgcgggctctggccgtcctgtcagtgaccctggtgatggcatgcacagaggcatttttcccatttataagccgtggtaaggaattgttatggggcaagccagaggagtcccgtgtctcatcagtgctggaagagtctaagaggctggtagataccgccatgtatgcaaccatgcaaagaaaccttaagaaaagaggcatactatccccagcccagttactcagtttttccaaactgcccgaaccaacgagtggggtgatcgcccgagctgccgagataatggaaacttcaattcaggctatgaagagaaaagtgaatctgaaaacccaacagtcccagcatcctactgacgccttatctgaagatcttttgagtataattgctaatatgtctggctgcttgccctatatgctgccccctaaatgtcccaatacctgcctggctaacaaatataggccaataacaggcgcatgcaacaacagagatcacccgcgttggggcgcatccaacacggcgtag

SEQ ID NO: 244086 - DNA, 462 bp, Artificial Sequence
  Description of Artificial Sequence: Synthetic coding sequence
atgaacgggttaacttccttcctcgatgcgtccactgtctacggcagctcccctgcccttgaaagacagctgcggaactggacttctgcagaaggactccttcgagtgcacgccagactgagggactctggtcgtgcatacctgccctttgtcccaccgagggctccagccgcttgcgcccctgaaccagggatcccaggagagactcggggaccgtgctttctagccggagatccgcgacagagaggcccattgccagacggaacggctcacgcggtggcagccagagcccagccgccaggcaggggtgcgcaagggcctcaatgtgcactggaaagaggacgcagggttccgggtggagctcagggcagggggagaagcgcaccagaccatcatcccgagggcctccacccgcaggatcctggaacaagagggttgcccgctgtgagggggagcctgtag

SEQ ID NO: 244087 - DNA, 525 bp, Artificial Sequence
  Description of Artificial Sequence: Synthetic coding sequence
atgagagcattagctgtgctatccgtaacactcgtcatggcctgtaccgaagcctttttcccttttattagccgcggaaaggagctgttatggggcaagcccgaggaatccagagtgagctccgtgctagaggagtcaaagagactggtcgacaccgcaatgtacgctaccatgcagagaaacctcaaaaagcggggaatcctttcgcccgctcagctattaagcttcagcaaactgcccgagcccacctctggcgtaatcgcgagagcggctgaaataatggagacatccatccaggcaatgaagcggaaagtgaatctgaagacccaacagtcccagcatcctactgatgccttgtcagaggatctgctttcgatcatcgctaatatgtcaggatgcctcccctacatgcttcctcccaaatgcccaaacacgtgcctggccaataaatacaggccgatcacgggcgcatgtaataatagaaaaatgaagtacaaacctgaccattctgagactgctaattag

SEQ ID NO: 244088 - DNA, 2295 bp, Artificial Sequence
  Description of Artificial Sequence: Synthetic coding sequence
atgcggcctgccgacctcctacaactggtgctactgctggatctgcccagagatcttggcggtatgggatgtagctctccaccttgtgagtgccatcaagaggaagactttcgagtgacctgtaaggacattcagcggatcccatcactgccaccatcaactcagactcttaaacttatcgagacgcacttacggaccattcctagtcacgcattttcaaacctcccgaatatttctaggatttacgtttctatagatgtgaccctgcagcagctagaatcgcacagcttctacaacttgagtaaagtgacccatattgaaatccggaacaccaggaatctgacttacatcgaccctgacgccctgaaggagctgccgttacttaaattcctgggcattttcaacaccggcctaaaaatgtttccagacctgactaaggtatactctacggacattttcttcattctggagattaccgacaacccatatatgacctccatccccgtcaatgccttccagggcctgtgcaatgagaccttgacactgaaactgtacaacaacgggtttacttccgtacaggggtacgcatttaatggtactaagctcgacgccgtgtacctgaacaaaaacaagtacttaactgtcatcgataaggacgcgtttggtggtgtgtatagtggcccaagcttactggatgtttcccagacaagcgtcaccgccctgccttctaaaggactggagcatctcaaggaactgatcgctcgcaacacctggactttgaagaaactgccactgtctcttagcttcctgcatctgactagagccgacctaagctatcctagccattgctgcgccttcaagaaccaaaagaagatccggggtattctggagagcctgatgtgtaatgagagttctatgcagagcctcaggcagcgaaagtctgtgaatgccctgaacagtccactccaccaagaatatgaagagaatctcggagactctattgtgggctataaggaaaaatccaaattccaggatacacacaacaatgcccactactacgttttcttcgaagaacaggaggacgaaatcataggattcggccaggaactaaagaacccccaagaggagactcttcaagcttttgattcacactacgattacaccatctgtggtgattccgaagatatggtctgcactcctaaaagcgacgaattcaatccgtgtgaggatatcatggggtataagtttctgaggatcgtggtgtggttcgtcagcctcttggcgctgttggggaatgtgtttgttctccttatcctgctcaccagccactacaagcttaacgtcccaagatttctgatgtgtaaccttgcttttgccgatttctgcatgggcatgtacctactcctcattgcctccgttgacctatatacccactcggaatactacaaccacgccatagattggcaaacagggcctggctgcaacactgctggtttttttaccgtgtttgctagtgagctgtctgtgtacacactgacagtgattacactggagcggtggtacgccataaccttcgccatgcggctagacaggaagatccgactgaggcatgcctgcgcaatcatggtgggcggatgggtctgctgcttcctgttagccctgttgcccctggtcggcatctcatcctacgccaaagtgtctatttgtttgccaatggacacagagacccccttagcccttgcctacattgttttcgtcctgactctcaatatagtggcattcgtgattgtttgctgttgctacgtcaaaatttacatcacagtacgtaacccccagtataacccaggcgacaaagataccaaaatcgctaaacgcatggcggtgctgatctttaccgatttcatctgtatggccccaatctcattttatgccctgtccgccattctgaacaagcctctcatcacggtgtcaaattcaaagatcctgctggtactattctatcccctgaactcctgtgccaatcctttcctttatgccatctttaccaaggccttccagagagatgtatttatcctgctgagcaaatttggtatttgtaagcgccaggcccaagcgtatcgtggtcaacgcgtgccccctaaaaacagtactgatatacaggtgcaaaaagttacacacgagatgcgccaagggcttcacaacatggaggacgtgtacgagttaatagaaaattctcacctaactcctaagaaacagggtcagatctcagaggagtacatgcagacggttctctag

SEQ ID NO: 244089 - DNA, 762 bp, Artificial Sequence
  Description of Artificial Sequence: Synthetic coding sequence
atgcgacctgccgatcttctgcaactggttttgttgctcgacttacccagagacctgggcggaatgggatgctctagcccaccatgcgaatgtcaccaggaggaggacttcagagtcacatgcaaggatattcaacggataccaagtttgcccccttccactcaaaccctgaagctgatagagacgcatcttagaactattccatctcacgccttttcaaacctgcctaatatctctcggatttatgtgtcgatcgatgtgacactgcagcaactcgagtcccacagcttctataatctctccaaagtgacccatatcgagatacgcaacacgcgcaacctgacctatattgaccccgacgctctgaaggagctcccactgctgaagttcctgggaatttttaatacaggcctgaagatgttccccgaccttactaaagtgtactctacagatatcttctttatcctggaaatcaccgataatccatatatgacttcaatccctgtcaacgctttccagggtctctgcaacgagaccttaacccttaagttgtacaacaatggtttcacaagcgttcagggctatgcatttaacggcaccaaactggacgcggtctacctgaataaaaataagtatctcacggtgatcgacaaagacgcatttggcggagtgtatagcggtccttcactccttcttcccctcgggcgtaaaagcctgtcatttgagacccagaaggccccacggagcagcatgccctcatag

SEQ ID NO: 244090 - DNA, 1236 bp, Artificial Sequence
  Description of Artificial Sequence: Synthetic coding sequence
atgcgtcccgctgatctgttgcagctggttttactactggacctgccgagagatctgggagggatggggtgcagctctccaccatgtgagtgtcaccaggaagaagatttccgagttacttgcaaagatatacagagaattccaagcctgcctccttctacacagacgctgaaattaattgagacacacttgaggatagtggtctggttcgtctccttgttggccctcctaggcaacgtgtttgtgctgctcattttgctaaccagccactacaagctgaatgtccctagatttctcatgtgtaatttggcctttgcagacttctgtatggggatgtatctgctcttaatcgcgagcgtggatctttacacccacagtgagtattacaaccatgccattgactggcagacggggcctggatgtaacaccgctggatttttcactgtattcgcctcagagctgagcgtttatactctgactgttatcactctagaaagatggtacgccatcaccttcgccatgcgcctcgaccgaaagatcagactgcgacacgcttgtgccatcatggttggaggctgggtgtgctgctttcttcttgccctccttcccctggtgggcatctcttcctacgctaaggtgagcatatgcttgcctatggatactgagacacctctggccttagcttacattgtgttcgtcctgactttaaacatagtcgccttcgtcatcgtgtgttgctgctatgttaaaatctatattactgtgaggaatcctcagtacaaccccggagacaaagacacaaagatcgccaagagaatggcggtgctgatttttaccgattttatttgcatggcccctatatcgttctacgctctgtcagccattcttaacaagcccctcatcaccgtttctaattctaaaatcctcttggtgttattttaccccctgaacagctgcgcaaacccctttctgtacgcaatctttacaaaggcatttcagagagacgtgtttattcttctgtcgaagtttgggatctgcaagcggcaggctcaagcataccgcggacagcgcgtaccgccaaagaacagcactgatattcaggtccagaaagtcacacacgagatgagacagggactacacaacatggaagacgtgtacgaactgatcgaaaacagccatcttaccccaaagaagcagggacagattagcgaggagtacatgcagacagtactgtag

SEQ ID NO: 244091 - DNA, 2295 bp, Artificial Sequence
  Description of Artificial Sequence: Synthetic coding sequence
atgaggcctgccgatctcctccagcttgtcctgttgctagatctacctcgggatctggggggtatggggtgctcttctcctccatgcgaatgtcatcaggaggaggactttcgagtgacttgtaaagacatccagcgaataccctcactcccaccatctactcagacactcaaacttattgagacccacttgcgaaccattccatcccatgccttttctaatcttcccaacatttccaggatctacgtgtctatcgacgtcaccctgcagcagctggagtcacactcgttctacaatctgtcaaaagtgacgcacatcgagattagaaacacaaggaacctgacatacatcgaccctgacgcgctgaaagaactgccccttctgaagttcttaggaatctttaacacgggtctgaagatgttccctgatctaaccaaggtgtatagtacagacattttttttatcctagagattaccgacaatccctatatgacaagcattcccgtgaatgccttccagggactatgcaacgagacgcttacactcaaactgtataacaacggattcacctcggttcaggggtacgcgttcaacggcaccaaacttgacgccgtatacctcaacaaaaataaatacctaacggtcatcgataaagatgcttttggcggtgtgtactctgggcctagcctgcttgacgtgagtcagacttccgtgaccgctctgccaagcaaggggctggagcatctgaaggaactgatcgccaggaacacctggactttgaaaaagctgcctctttcactgagcttcctgcatttaacacgtgcagacctgtcatatccctcacactgttgcgccttcaagaaccagaaaaaaattagaggaatactggaatccctaatgtgtaacgagtcttctatgcagtcactgcgtcaacgaaagagcgtgaacgcacttaacagtcccctgcaccaagaatacgaggaaaaccttggtgactccatcgtgggttacaaagagaaatctaagttccaggatacccataataacgcccactactacgtgtttttcgaggaacaggaagacgagatcattggcttcggtcaggagctgaagaacccccaggaagagacccttcaagctttcgacagccattacgattacactatctgcggcgacagtgaggatatggtctgtactcccaaatcagatgaattcaacccttgtgaagatatcatggggtacaagttcctgcgtatagtagtgtggttcgtctccctactggccctgctgggtaatgtgtttgttctcctgattctgctgacttcccactacaaactgaacgtcccacggttcctaatgtgcaacctggcctttgcagatttctgcatgggtatgtacctcctgttgatcgcaagcgtggacttgtatactcattccgaatactataatcatgccattgattggcagactgggcctggatgtaatactgcaggattctttaccgtgttcgcgtcagaactcagtgtttacactcttactgtgatcactttggagcggtggtatgccataacctttgcaatgcgcctggaccgtaagataagactccgacatgcttgcgcaatcatggtgggcggttgggtgtgttgcttcctgttagccctgctgccactcgttggcatctcctcgtatgccaaggtgtcgatatgtctgcccatggacacagagactcctctcgccctcgcctacattgttttcgtgctgacccttaacatcgtcgcctttgtcattgtgtgttgctgctatgtgaagatctacataaccgtcaggaacccccaatataacccaggcgacaaagacacaaaaatcgccaagagaatggcagtactcattttcactgactttatttgcatggctccaatatccttctacgctctgtccgccatcctgaataagcccctcattactgtgtcaaatagtaagattctcctggtgctcttctaccccctgaactcctgcgccaatcccttcctttacgccatttttactaaagcatttcagagggacgtctttatcctactctctaagtttggaatctgcaagcgccaggctcaggcataccggggtcagcgagtgcccccaaaaaattccaccgacattcaggtccaaaaagtaactcacgagatgcgccagggactacataatatggaggatgtctatgagcttattgagaactcccatctgaccccaaagaaacagggacaaataagtgaagaatacatgcagacagtcctatag

SEQ ID NO: 244092 - DNA, 825 bp, Artificial Sequence
  Description of Artificial Sequence: Synthetic coding sequence
atgagacctgcggatttgttgcaactcgtgttgctgctggatctgcctcgcgatctcgggggtatgggatgctcctcaccaccttgcgaatgtcaccaggaggaagattttcgggttacctgtaaggacatacagaggatacccagccttccccctagcactcagacgctgaagctcattgaaacccacctccgaaccatccccagccatgcgttctccaacctgcccaacatctcaaggatctacgtttccattgacgtaacgctacagcagctggagtcacactcattttataacctgtcaaaagtgactcacatcgagatcaggaataccaggaatctcacctacatcgatccggacgcccttaaggagctgccattgctgaagttcctcggcatcttcaacacgggcctgaagatgttcccggacctcacaaaggtgtattctactgatattttctttatactggagatcactgataatccttatatgacgtctatacccgttaacgccttccaaggcctctgcaacgaaaccttgactcttaaactgtacaacaatggctttactagcgtccagggttacgcttttaatggtactaaattggacgctgtttatctcaataaaaataagtatctgacagtgatagacaaagatgccttcggtggcgtatattcagggccttccctgctcgtcgaaaacgtagccgtgtcaggcaaaggattttgcaagtctctgttttcttggctgtacagattacccctgggcagaaaatcactgagctttgagacacaaaaagcacctcgctcatccatgccctcgtag

SEQ ID NO: 244093 - DNA, 912 bp, Artificial Sequence
  Description of Artificial Sequence: Synthetic coding sequence
atgtccgacgccggaggcggaaagaagcctcctgttgatcctcaagcaggccctggacccggtcccggaagagctgccggagaacgcggtttaagcggatccttccccctggtcctcaagaagcttatggaaaatcctccaagggaggctagattagataaagaaaaaggaaaagagaaactcgaagaagacgaagcagctgctgccagcacaatggctgtgagcgcctctctgatgcctcccatctgggacaaaacgattccatacgatggagaatcatttcacctcgagtacatggacctggacgagttcctgcttgagaatgggatcccagccagcccgactcatctcgcgcataacttactcctgcccgttgcggaacttgagggaaaggaatctgcgagcagctcaactgcttcacctccatccagctcaacggcgatctttcagcccagtgagactgtgagttctaccgaaagcagtctggagaaggagcgggagacaccctcacctatcgatccaaattgcgtggaggtcgacgttaacttcaaccccgacccagccgatctggttctgtcctccgtccccggaggggagctgttcaatcctaggaagcataaattcgcggaagaggatctcaagccgcaacccatgatcaagaaggccaaaaaggtgttcgtgcccgatgaacagaaggatgagaaatattggacacgccgtaagaaaaacaatgtggctgctaaacgcagccgggacgcgcgaagattgaaggaaaatcagataacaattcgagctgccttcctggaaaaagaaaacactgcccttcggacagaagtagccgaactccgcaaagaagtcgggaaatgcaagactatcgtgagcaagtacgaaaccaaatacggcccactgtag

SEQ ID NO: 244094 - DNA, 555 bp, Artificial Sequence
  Description of Artificial Sequence: Synthetic coding sequence
taatttatattcctgcctcggcctggcacctcacttggcagaattcggaaagctgacaaggaaaagggcaaggagaagctggaggaggatgaggcagcggctgcttcgaccatggctgtttcagcctccctgatgccaccaatttgggacaaaactattccttatgatggagaatccttccacctagagtacatggatcttgacgaatttctgctcgaaaacgggataccagcttcccctacccacttggcacacaatctgcttctgcccgtggccgagttagaaggcaaagaaagcgcttcgtcgagtactgcttcccctcccagctcctccaccgccattttccaaccatccgagactgtaagtagcacggaatcctccctggaaaaagagcgtgagactccttccccaattgatccaaattgcgtagaagtcgatgttaacttcaatcccgatcctgccgaccttgtcctgtcgagcgtgccgggaggagaactgttcaatcctagaaaacacaagttcgcagaggaggacctcaagccgcagcccatgtag

SEQ ID NO: 244095 - DNA, 822 bp, Artificial Sequence
  Description of Artificial Sequence: Synthetic coding sequence
atggatatgccagaggttctgaaatctctgcttgaacacagcctgccttggcccgaaaagcggaccgataaggaaaaaggcaaggaaaaactggaagaggatgaagccgcagcagcctccacgatggccgtgagcgcgtcactgatgcccccaatctgggataagaccatcccctatgatggcgaatctttccatttggagtacatggatctagacgaattccttctggagaatgggatccctgcttccccaacccacttggcacacaacctcctgttaccagtggcggagttggagggtaaggagtccgcttctagcagcactgctagtccccctagcagctcaacagctatttttcagccgagtgagacagtcagcagtacagagtcaagtttagaaaaggagagagaaacccctagccccatcgaccccaattgcgtcgaggtcgacgtgaacttcaaccctgaccctgctgatcttgtcctcagtagcgttcctggtggagagctgtttaacccacgcaaacataaattcgccgaggaagatctgaagcctcagcccatgattaagaaagctaaaaaggtatttgtgcccgatgaacagaaagacgaaaaatactggactcgcagaaagaagaataacgtcgctgcgaagagaagcagagacgcgaggagactcaaggagaatcaaatcacaatccgcgctgctttcctggagaaagagaacaccgccctgagaaccgaggttgcagagctgcgaaaagaagttgggaaatgtaagaccatagtctctaaatacgaaacaaagtatgggccattatag

SEQ ID NO: 244096 - DNA, 822 bp, Artificial Sequence
  Description of Artificial Sequence: Synthetic coding sequence
atggatatgccggaggtgttgaaatcactgttggagcactccctgccgtggcctgagaaaaggacagacaaagagaagggcaaagaaaaattggaggaagacgaggccgctgccgctagcacaatggctgtgagtgcctccttaatgcctccaatttgggacaagacaattccttacgatggggaaagtttccacttagagtatatggatttggacgagtttctgcttgaaaatggaataccagcttcccccacccacttagcccacaatctgttgcttcccgtggccgagttggagggcaaagagtccgccagttcttccaccgccagcccacccagtagcagcacggctatcttccagccctccgaaacggtgagctcgacggagtccagtctagagaaggaacgggagaccccgtctcctatcgatccgaactgcgtggaagtggatgtgaatttcaacccggaccctgcggacctggtgctctcctctgtaccaggcggtgagctttttaaccccagaaaacacaagttcgcggaggaggatctgaagccccagcctatgattaagaaggcaaagaaggtgttcgttcccgatgagcaaaaggacgagaaatactggacccgtcgaaagaagaacaatgtcgctgccaagaggtctcgagatgcccgaagacttaaagaaaaccagatcacaatcagggcggctttcttggagaaggagaacaccgctttgcggactgaggttgctgagctccgcaaagaggtaggaaagtgcaagaccattgtttcaaagtacgagacgaagtatgggccactgtag

SEQ ID NO: 244097 - DNA, 729 bp, Artificial Sequence
  Description of Artificial Sequence: Synthetic coding sequence
atgccaggcccatggctcctccttgctctggcactcactcttaatttgaccggcgtgcctggcggacgcgctcaacctgaagcagcccagcaagaagcagtcacggccgcagagcaccctggtttggatgacttcttgagacaagtggaaaggttactcttcttgagggagaatatacagaggctccaaggggaccagggggagcacagcgcatcccagatttttcagagtgattggctgagcaagaggcagcatcccggtaagagagaggaagaggaggaagaaggcgtggaagaggaggaggaagaggagggaggcgctgtgggacctcacaaacggcagcatcccggtagacgagaagacgaggcttcatggagtgtggatgtgacccaacataagcgacagcacccgggtagacgatcaccttggctggcctatgcagtgcccaaacgccaacacccaggtaggaggcttgctgatcccaaagctcagaggtcctgggaagaagaagaggaggaggaggagcgcgaagaggaccttatgcctgaaaaaaggcagcacccaggtaaacgcgctctcggagggccatgcggccctcagggagcgtatgggcaggccggacttctgctgggactcctcgatgacctgagccgatctcagggggctgaggagaaaaggcagcaccctggcagacgggctgcatgggtccgtgaaccgctcgaggagtag

SEQ ID NO: 244098 - DNA, 3075 bp, Artificial Sequence
  Description of Artificial Sequence: Synthetic coding sequence
atgggcgaagatgacgctgcgctcagggctgggtcgagagggctcagcgacccgtgggctgattctgtgggcgtgcggcctcgtaccaccgaacgtcacatagcggttcacaagcgtcttgtgctagcgttcgctgtctctctggtggcattgcttgccgtaacaatgctggccgtgcttctctcactccgtttcgacgagtgtggggcttcagccactcccggagccgatgggggaccctcaggctttccagaaagggggggaaacgggtcgcttcctggctccgctcggaggaatcatcacgcaggcggagattcatggcagccagaagccggtggggtggccagcccaggaaccacctctgctcaacctcctagtgaagaggagcgggagccttgggagccctggactcagctccgacttagcggccatttgaaacccctccactacaacctaatgctcacagcattcatggaaaattttacattctctggcgaagtaaatgtggagatcgcctgccgtaatgctacaagatatgtagtgctgcacgcaagtagagttgccgttgagaaggtccaacttgccgaggatagagcttttggggcagtccccgtagccggttttttcctctatcctcagacacaagtgctggtggtcgtgctgaaccggacactggatgcccagcgtaattataacctgaaaattatctacaacgcactaattgagaatgagttacttggcttcttccgctccagctatgtgttgcacggcgagcggaggtttttgggtgtcactcaattttcccctacacacgctcgcaaagcctttccctgcttcgacgagccaatttataaagctacttttaaaatctctatcaagcaccaagctacctacctgtcccttagcaacatgccagtcgagaccagcgtctttgaggaagacgggtgggtgaccgatcattttagccagactcccctcatgtctacttactacctcgcctgggctatctgtaacttcacatatcgggaaacaacaactaaaagtggagttgtggtaagactatatgctcggccagatgccatcagaagagggtccggggactacgccctgcacattaccaagaggctgattgagttttatgaagactactttaaagtcccttatagcctgcctaagctggatctgctggcggtacccaaacacccatacgcagccatggaaaattggggacttagtattttcgttgaacagaggattctcctggacccatccgtcagtagcatctcctacttactcgatgttacgatggtgatcgtccacgaaatatgccatcaatggtttggtgatttggtgacccctgtctggtgggaagacgtgtggttgaaagaaggattcgcccactacttcgaatttgtggggactgactacctgtatccagggtggaacatggagaaacagcggttcctgactgatgtcctgcatgaagtgatgctcctagatggactggcgtcatcccaccctgttagtcaagaggttctgcaggcaacagacatcgatcgggtctttgattggattgcatataaaaaaggagcagccctgattcggatgttggcgaactttatggggcactcagtatttcagaggggcctgcaagattacctgacaatccataagtacggtaatgcggcaaggaatgacctgtggaatactctgtctgaggctctaaaaagaaacggaaaatacgtaaatattcaagaggtgatggatcagtggaccctgcaaatgggttaccccgtgatcacgatcctgggtaacactaccgctgaaaacaggattataatcacccagcagcactttatatatgacatcagcgccaagaccaaggccttgaaactgcagaacaatagctatctctggcagatacctttgactattgtggtgggtaaccgctcacatgtctcatcagaagcaatcatatgggtgagcaacaagtcggagcatcatagaataacctatcttgacaaaggttcctggctcttaggcaacattaaccaaactggctactttcgcgtgaattacgacctcaggaattggcggctcctgattgaccaacttatccgcaaccacgaggtcctctccgtgagcaacagggccggactcatagatgacgctttctccctggcacgggcaggctatttacctcagaatatcccattagagatcatccgttacctgagcgaggagaaggatttcctgccttggcacgctgccagccgcgctctctatccgctggacaagctgttggataggatggagaattataatatctttaatgaatatattctcaagcaggtggcaaccacctacatcaagcttggatggcctaagaataactttaatggatctctggtccaagccagttatcaacacgaggaactgcgtcgggaagttataatgttggcatgctccttcggtaacaaacattgtcatcagcaagcatcaaccctcatctccgattggatttctagcaacagaaatcgtataccacttaatgttcgtgacatcgtgtactgtacaggtgtcagcctcttggacgaggatgtctgggagtttatctggatgaaattccattctacaaccgctgtctcagaaaagaaaattcttctggaggcattgacctgtagcgatgaccgcaaccttcttaaccgattattaaatctctctctcaacagtgaggtggtactggaccaggatgccattgatgttattatacacgtggcaagaaacccacacgggagggatctagcgtggaagttttttagagacaagtggaaaattctcaatacgagatacggcgaggcattatttatgaactcaaaactgattagtggggtcacggagtttctgaacaccgagggggagctcaaggaactgaagaacttcatgaagaattacgatggtgttgcagcagctagttttagcagagccgtcgaaaccgtggaggctaacgtgagatggaagatgctgtatcaggacgaactgtttcaatggctaggcaaggctctccgccactag

SEQ ID NO: 244099 - DNA, 1197 bp, Artificial Sequence
  Description of Artificial Sequence: Synthetic coding sequence
atggaaaatgaaacggtgtcagaactgaaccagacccaactccagcccagggctgttgtggccctggagtaccaggtggtgactatcctgctggttctgattatctgcggactgggaattgtgggaaatatcatggtcgtcctggtggtgatgaggaccaagcacatgagaacccccaccaactgctacctcgtgtccctagccgtcgccgacctaatggtgctggtagctgcgggactcccaaacattacggactcaatttacggctcatgggtgtatggatacgtggggtgcctgtgtattacttaccttcaatatctaggaataaacgcatccagctgcagtattactgcctttaccatcgaacgctatatcgccatttgccacccaatcaaagcacaattcctctgtactttcagtcgggcaaaaaagatcatcatattcgtgtgggcctttacaagtctttattgtatgttatggtttttcctgctggatctaaacatctctacctataaagacgctattgtgatcagttgcgggtataaaatcagtaggaactactactcccctatctacctgatggattttggtgttttttacgttgtccccatgattctggctacagtattgtacggcttcatagcccgtatactgttcttgaaccctatccccagcgatcccaaggaaaatagtaaaacatggaaaaatgatagtactcatcaaaataccaacctgaacgtgaacacttctaaccgttgcttcaattcaactgtgagcagcagaaaacaggtgactaagatgctggccgttgtcgtcatactttttgcactgctctggatgccttataggaccctggtggtggtaaacagttttttatcttcacctttccaggagaattggtttttactcttttgcaggatctgcatttatttaaattcagccatcaatccagtcatttacaacctcatgtcacagaagttcagagctgcctttagaaaactgtgcaactgcaaacagaaacccacagagaaacccgctaattactccgtggcattgaattacagcgttatcaaagagtccgatcatttttcaactgaattggacgacattacagtgactgatacatacttgtcagcaacaaaggtgtcgttcgacgacacatgtctggcatctgaggtgtctttcagtcagagctag

SEQ ID NO: 244100 - DNA, 1197 bp, Artificial Sequence
  Description of Artificial Sequence: Synthetic coding sequence
atggagaacgagaccgtttcggagctcaaccagactcaactacagccacgtgcagtggttgctctggaatatcaggtggtgacaattttgctggtgttaattatttgcggacttggtatagtaggcaatataatggtggtgctggtggtaatgaggacaaagcacatgaggacccctacaaattgctatctggtaagtctggccgtggcggatctgatggtgctggtggccgctggcctacccaatattacagactcgatttacggaagttgggtgtatgggtatgtcggctgcctctgtataacttatctgcaatacctgggcattaacgctagcagctgcagcatcacagctttcacgatcgaaaggtacatagccatctgccatccaattaaggctcagtttttgtgcacattctcaagagcaaagaagattattatctttgtgtgggcatttacaagtctgtattgcatgctctggttctttctgctcgacctgaatattagcacctacaaagatgcgattgttatcagctgtggctataaaatctcaaggaattattacagcccaatctacttaatggatttcggtgtgttttatgtagtgcccatgatccttgccactgtgctctatggattcatagcaagaatccttttcttgaatcctatcccctccgaccctaaggagaattctaagacatggaaaaacgattcaactcaccagaatacaaacctaaatgtgaatactagtaaccgctgctttaattccacggtgtcttcaaggaagcaggtgactaagatgctggctgtagtcgtgatcctcttcgccctgctgtggatgccttacaggactcttgtggttgtcaattcattcctcagctcgcccttccaggaaaactggtttttgctgttttgccgcatctgcatatatctgaacagtgccatcaatcctgtgatttataatctgatgtcgcagaagttcagggccgcattccggaaattatgcaactgtaaacagaagcctactgaaaagcccgctaattactcggtcgctctcaactactccgtcatcaaagagagtgaccatttttcaaccgagctagacgacattaccgtcaccgatacatatctgtccgcaaccaaggtgtcattcgatgatacgtgcctcgccagcgaggtgagcttttcacagagttag

SEQ ID NO: 244101 - DNA, 1128 bp, Artificial Sequence
  Description of Artificial Sequence: Synthetic coding sequence
atggaagatgagatgcccaaaaccctgtacgtgggtaatctgagcagggacgttaccgaagctctgatactgcagctgttttcccagatcgggccttgcaagaactgtaagatgatcatggataccgcagggaatgacccctactgtttcgttgagtttcatgaacaccgtcacgctgctgcggctctcgctgctatgaatggccgaaagattatgggcaaagaggtaaaggtgaactgggctacaacaccaagtagccagaaaaaagatacaagcaatcacttccacgtcttcgtcggcgacctctcacctgaaatcaccactgaggacatcaaggcagctttcgccccttttggccgaatctcagacgccagggtggtcaaggatatggccacagggaagtcaaaaggatacggcttcgtgtcgttcttcaacaagtgggacgctgagaatgccatccaacagatggggggtcagtggcttgggggacgccagatacgaaccaattgggctaccaggaagccacctgctccgaagtccacttatgagtctaataccaagcaactgtcatacgatgaagtggtcaatcaatcctctccctccaactgcaccgtctactgtgggggtgtgactagcggcctgactgaacagctgatgaggcagacgttcagcccctttggtcagataatggaaatacgcgtcttccctgataagggatattctttcgtacggtttaacagtcatgagtccgctgctcacgctatagtctcagtgaacggtaccacgatcgagggccatgtcgttaaatgctattgggggaaagagacactggatatgatcaacccggtccagcagcagaatcagatcgggtatccccagccatatggccagtggggacagtggtatggaaatgcccagcaaattgggcagtatatgcccaatggatggcaggtgccagcatacggaatgtatggtcaggcctggaatcaacaagggtttaatcaaacacaaagttcggctccctggatgggacccaattacggggtccagccgcctcaggggcagaatggtagcatgcttccaaatcagcccagcgggtatagagttgccggatatgaaacacagtag

SEQ ID NO: 244102 - DNA, 1161 bp, Artificial Sequence
  Description of Artificial Sequence: Synthetic coding sequence
atggaagacgaaatgcccaaaactctgtacgtcggcaacctcagtagagacgtcacagaagcccttatactgcagctgtttagccagattggcccatgtaagaactgtaaaatgattatggatacggccggaaacgacccttattgcttcgtcgagtttcatgaacacagacacgctgcagcggcattagccgcaatgaacgggaggaagatcatgggtaaagaggtgaaagtgaactgggccactacaccctctagtcagaagaaagatacttcctcctccactgtggtcagcacacaacggtctcaggatcacttccacgtttttgtaggagacctaagtcctgaaataacaacagaagatattaaagccgcattcgccccttttggacggatcagtgacgcccgagttgtaaaggacatggctacaggaaagagtaaggggtacggctttgtaagcttcttcaacaaatgggacgcagaaaacgcaatccagcagatgggcggtcagtggcttgggggacgccagatccgcacgaactgggctacacgtaaaccaccagccccaaagagcacttacgaaagcaacaccaaacagctgagctatgacgaagtggtcaaccagtcctctccaagtaactgcaccgtgtactgcggtggagttacatccggcttgacagagcaactcatgagacagacattttcacccttcgggcagataatggagattcgagtattcccggataaggggtattcattcgtgcgctttaacagccacgagtctgccgcacacgctatcgtgtctgtgaatgggacaaccatcgaagggcatgtcgtcaaatgctactggggcaaggagactctggacatgataaacccagtgcagcaacagaatcagatcggctacccacaaccctacgggcagtggggacaatggtacggaaacgcacaacagattgggcagtacatgcccaacggttggcaggtcccagcctatggcatgtacggtcaagcttggaaccagcagggcttcaaccaaacacagagtagtgccccttggatgggacctaactatggcgtccagcctcctcagggccagaacggatcaatgctccctaatcagccatcgggctaccgcgtagccggttacgaaacacagtag

SEQ ID NO: 244103 - DNA, 1392 bp, Artificial Sequence
  Description of Artificial Sequence: Synthetic coding sequence
cccttggttagccgggaaaccccgctgagttgtagtcacaaccgcctcaacgacttggggggaagcgaaggccaaggcgctggtcccggaggcgctgctgccactgcagccgcaatggaagacgagatgccaaaaactctctacgttggtaatctgagcagggacgtgacagaggcactcatcctgcagctgttttcacagattggcccttgcaaaaattgcaaaatgatcatggatacggccggtaacgacccctactgttttgtggagtttcacgaacaccggcacgctgcagctgcgctggcagccatgaacgggagaaagattatgggcaaagaagtgaaagttaactgggctaccacaccctcctctcaaaagaaggacacgtcttccagtactgtagtgtccacccagagatctcaagaccacttccacgtgttcgtcggcgacctgagcccagaaattactacggaggatattaaagctgcgtttgcacccttcggaaggatctccgatgcaagggttgtgaaagatatggctacaggaaaaagcaagggctatggcttcgtttccttctttaacaaatgggacgctgaaaatgccattcagcaaatgggcggacagtggctgggcggtagacaaatacggacgaactgggccactaggaaacccccagctccaaagtccacctatgagtgcagatgcataggcgaggagaaagagatgtggaatttcggggaaaaatacgctcgcttttgcagtcgtaggctgatcgccgagattgatgagaaacagatcaaaacaactattcagaaaagcaatactaagcaattaagctatgacgaggtggttaaccagtcttctccatccaattgtactgtgtattgtggtggagtgacctctggccttacggagcagctgatgagacagacttttagccccttcgggcaaatcatggagatacgggtattcccagacaaaggctactcattcgtacgctttaattcccacgagagcgctgcacacgccattgtgtccgtgaacggtacaacgatcgaagggcacgttgtcaagtgctactggggcaaagaaaccctcgatatgatcaatcctgttcagcagaatcagattggatatcctcagccatacgggcagtggggtcaatggtacgggaacgcccagcagattggccaatatatgcctaacgggtggcaggtgccagcctatggcatgtatgggcaggcatggaatcagcaagggttcaaccaaacccagagcagtgcaccctggatgggaccaaattacggtgttcagcctccccaggggcagaacgggtccatgcttcccaaccagccgagcgggtacagagtggctggctacgagacccagtag

SEQ ID NO: 244104 - DNA, 258 bp, Artificial Sequence
  Description of Artificial Sequence: Synthetic coding sequence
atgattacagagcacaccagcaatgacccatattgcttcgttgagttttatgaacatcgtgatgctgctgccgctcttgcagccatgaatgggaggaaaatcctcgggaaagaggtgaaggtgaactgggcaacgacgccaagcagtcagaagaaggacacatcaaaccactttcatgtgtttgtgggggacctcagccctgagattacaacagaagacattaagtccgcctttgccccattcggaaagatttcgtag

SEQ ID NO: 244105 - DNA, 759 bp, Artificial Sequence
  Description of Artificial Sequence: Synthetic coding sequence
atggatgctagagttgtaaaggatatggccacaggtaaaagtaaggggtacgggttcgtgtcattctacaacaaactggacgccgagaatgccatcgtgcacatgggcggtcagtggttagggggacgccagattcgaacaaactgggctacgcgaaaacctcctgccccaaagagcacgcaggagaataacacaaaacagctgcgattcgaggatgtagtgaaccagtctagtccaaagaattgcacagtgtactgtggaggtattgcttcgggccttacagatcagttgatgagacaaacgttttcgccattcggccaaattatggagatacgcgtctttcccgagaaagggtactcatttgtgaggttctccacccacgaatctgctgcccatgccatcgtgtctgttaatggtacaaccattgagggacatgtcgtaaagtgttactggggcaaggaatcacccgacatgacaaagaatttccagcaggttgactattctcagtggggacaatggtcacaggtctatggaaaccctcaacagtacggccagtacatggctaatggctggcaggtgcctccttacggagtgtacggacaaccctggaaccagcaaggctttggagtggatcagagtccctcagcagcttggatgggaggttttggagctcagcccccacagggacaagctcctccgccagtgatcccgcctccaaatcaggccggatatggtatggcgtcctatcagacccagtag

SEQ ID NO: 244106 - DNA, 1179 bp, Artificial Sequence
  Description of Artificial Sequence: Synthetic coding sequence
atgatggaggatgatggccagccccgtacactgtacgtcggcaatctgtccagagacgttacggaggtcctgattcttcagttgttttctcagattggtccctgcaagagttgcaagatgatcacagagcagcctgattctaggagagttaattcaagcgtgggcttcagtgtgctgcaacacacctccaatgatccatactgtttcgttgaattctatgaacatagggatgcggcagcggctctggccgcaatgaacggcaggaagatcctgggcaaggaggtcaaagtcaactgggcgacaaccccttcatctcagaagaaagatactagcaatcatttccacgtgtttgtgggtgacctcagccctgaaatcacaacggaggatattaaaagtgcattcgctccgtttggaaaaatatctgatgctcgagttgtcaaggatatggcgactggaaagtccaaagggtatggtttcgtctcattttacaacaagcttgatgctgaaaacgccattgttcacatggggggacagtggctcggcggaagacagatccgcaccaactgggccactcggaaacctcctgctccaaaaagtacccaagaaaacaacactaagcagctacggtttgaggacgttgtaaaccagagttccccaaagaattgcacggtgtattgcggcggaattgcttcaggactgactgaccagttaatgagacagacatttagcccattcggacaaataatggagattagagtgtttcccgagaaaggttattcctttgtcagatttagcacccacgaatcagcagcacacgccattgtgtcggtcaatgggacaacaattgaaggccacgtcgtgaagtgttattggggaaaggaatctccagacatgaccaaaaattttcagcaggtcgattattcccagtgggggcagtggtcacaggtttacgggaatccccaacaatacggccaatacatggccaatggttggcaggtacctccttatggcgtgtatggacagccatggaatcagcaggggttcggggtggaccagagcccaagcgcagcttggatgggcggatttggggctcaaccccctcaggggcaggcgcctcctccagttataccacccccaaaccaagctggctacggaatggcaagctaccagacccagtag

SEQ ID NO: 244107 - DNA, 399 bp, Artificial Sequence
  Description of Artificial Sequence: Synthetic coding sequence
atgatcactgagcacacctccaatgatccctattgctttgtggagttttatgaacatcgagatgccgcagcggcactggccgctatgaatggaagaaagatcttgggcaaggaggtgaaggtgaactgggctactaccccatctagccagaagaaggacacgtcaaaccactttcacgtcttcgtcggagacctctcaccagagatcaccactgaggatatcaaaagcgcctttgccccttttggcaagataagtgacgcccgagtagtgaaggacatggctaccgggaagagcaaagggtacggctttgtgagcttctataacaagcttgatgcggagaacgcaatagttcatatgggcggacaatggcttggagggaggcaaattcggacaaattag

SEQ ID NO: 244108 - DNA, 1128 bp, Artificial Sequence
  Description of Artificial Sequence: Synthetic coding sequence
atgatggaggacgatggtcaaccccgaacactgtatgtcggaaacctgtcgcgcgatgtaacggaggtgttaatccttcagctgttcagccaaataggcccatgcaaaagttgtaaaatgattacagagcacacatctaatgacccctactgtttcgttgaattttatgaacacagggatgccgctgcagctctagctgccatgaatggcagaaagatcctgggaaaagaagtgaaagtgaactgggcaacgaccccttcttcccagaagaaggacacctctaaccattttcacgtattcgtcggagatctttcgcctgaaatcaccactgaggatatcaagagtgctttcgccccatttgggaaaattagcgatgccagagtggttaaagatatggccaccggcaagtctaagggatacggatttgtgtccttctataacaagctggatgctgaaaacgcgatcgtgcatatgggcggtcagtggctaggcggaagacagattcgcacaaattgggcaactcggaagccacctgcacccaaatccacccaagaaaacaacactaaacagctgaggttcgaagatgttgtgaaccagagctcaccaaagaattgtacggtctactgcgggggtattgcctccggcttgactgatcagctgatgagacagacattcagccctttcgggcagattatggagataagagtcttccctgagaagggctattcatttgtgcgattttctacacacgagtccgccgctcatgctattgtatctgtgaacgggacaactattgagggtcatgtggtcaaatgctattgggggaaggaatccccagacatgaccaagaactttcaacaggtggattatagccagtgggggcaatggtctcaggtttatggcaaccctcagcaatatggacagtatatggccaatggctggcaggttcccccttacggagtctatgggcagccttggaaccagcagggcttcggagttgaccagtcccccagtgcagcttggatggggggatttggcgcacagcctccccagggacaggcaccaccgcctgtgattcctcctccaaaccaggctggatatggaatggcaagttaccaaacacagtag

SEQ ID NO: 244109 - DNA, 1776 bp, Artificial Sequence
  Description of Artificial Sequence: Synthetic coding sequence
atggcatctaaatgttccagtgaaaggaagtcacgcacttcactaacgctcaatcaaaaattagagatgatcaagttgtcagaggaagggatgagcaaggccgaaatcggcagacggctcggactcctgcggcagactgtgagccaggtcgtcaatgcaaaggaaaaattcctcaaggaagtaaaaagcgcgacccctatgaatacccggatgattcggaagcgtaatagtctcatcgccgatatggagaaagtcctcgtagtctggattgaggaccaaactagtcggaacatccctctgagccaaagtctgattcaaaataaggccctcaccctgtttaactcaatgaaggccgaaaggggcgttgaagccgcagaggaaaagttcgaggcctctaggggatggttcatgcgctttaaggagcgcagccacttccacaacattaaagcacaaggagaagcagctagcgctgacgtggaagctgcagcttcttacccagaggcactggctaagatcatcgacgaaggtggctacaccaaacagcagatttttaatgttgatgagacagctttttactggaagaagatgccgagccggacatttatagcacgtgaggagaagagtgtgcccggatttaaggccagcaaggacaggttgacactgctgctcggagcaaacgccgctggcgacttcaaactgaaaccaatgctcatctatcatagtgagaatccccgagcactcaagaattatactaaaagtaccctgcccgtcttatataagtggaacagtaaagccaggatgactgctcacctgttcaccgcctggtttacagagtatttcaagcccaccgtggagacctactgcagtgagaaaaaaatcccattcaagattctgctcctgatagacaacgcgccttcccatccccgagccctgatggagatatatgaggagattaatgtcatttttatgcctgctaacactacctcgatcctgcaacccatggaccagggcgtaataagcaccttcaagtcatactacttgagaaatacctttcataaggcactggcagccatggactcagacgtctctgatgggagcggccagtcaaagctcaagactttctggaagggattcaccatcctggatgccattaaaaatatcagggactcttgggaggaggttaaactgagtacactcacgggagtatggaagaaacttatacccaccttgatcgacgactacgaaggctttaagacttccgtagaagaagtatcagcggacgtcgtcgaaatcgcaaaggaacttgagctggaggtggagcccgaagacgtgaccgagctccttcagtcccacgacaagactcttacagatgaggaactgtttttaatggatgcccagcgcaaatggtttctggagatggaaagcacccccggagaggatgccgtgaacatcgtggagatgacaaccaaagaccttgaatactatatcaatctcgtcgataaagccgctgccggttttgaacggatcgactctaacttcgagcgtagtagcacagtgggaaaaatgctgtccaattccattgcatgctacagagagatcttccacgagcgtaaaagccaacttatgcgcaaggctagcccgatgagctactttcggaagctaccacagccaccacagccaagcgctgcgacaacactgacgtcgcagcagccctcgactagcaggcaggaccctccgccagccaaaagagtgcgtcttactgagggctctgactag

SEQ ID NO: 244110 - DNA, 1578 bp, Artificial Sequence
  Description of Artificial Sequence: Synthetic coding sequence
atgcttggcaaacgtaagagagtggttctgactattaaggacaagttagatattatcaaaaagttggaagagggcatttcgtttaagaaattatcagtcgtctatggaatcggggaaagtacagtccgagacatcaagaaaaataaggagcgtattattaactatgctaatagttcagaccctacatctggcgtgagcaagagaaagtctatgaaatctagcacatacgaggaactggaccgtgtgatgattgagtggtttaaccagcagaagacggacggtatcccagtgtccggaactatctgtgccaagcaggctaaatttttctttgatgccttgggtatggagggggacttcaacgcatcctcaggatggctgacgcgctttaagcagcgccatgggattcccaaggcagccggtaagggaaccaaactcaaaggggatgaaacagctgctagagaattctgcggaagttttcaggagttcgtggagaaagagaacctgcaacccgagcagatctacggagccgaccagaccgggctattttggaagtgccttccctctcggactctaaccctagaaacagaccagtccacatcaggttgtcggagctcacgtgaacgcattatcattatgtgttgcgccaatgccactggcctgcacaaactcaatctgtgtgtcgtcggtaaagccaagaagcccagggccttcaagggcactgacctgagtaacctgcctgtgacctactatagccagaaaggggcttggatagagcagagtgtatttcgccagtggtttgagaaatattttgtgccacaggtccagaaacatttaaagtcaaagggtctgctagagaaggcggtgctgctactggacttccctccagccaggccaaatgaggagatgctgagctctgatgatggcagaattattgtgaaatatttgcctcctaatgtcacgagtctcattcagcctatgtcacagggggtcctggccactgtaaaacgatactatcgagcaggcctgctgcagaagtatatggatgagggcaatgacccaaagatcttctggaaaaacctcacggtgttggacgctatctatgaagtgtctagggcctggaatatggtgaagagctcaaccatcacgaaggcttggaagaaactgttccctggcaatgaggagaacagtggaatgaatatagacgaaggcgctatcttggctgcgaatctggccacagtgcttcaaaataccgaggaatgtgagcatgttgacattgagaatattgatcagtggttcgacagccgaagctccgactcctcctgtcaagtactcactgatagtgaaagtgctgaggatcagaccaaggccgcagaacaaaagccatcgagcaagtctcggaagaccgaactgaatccagagaaacacatctcacataaggcagctctggagtggaccgagaacctgctcgactatcttgagcaacaggatgacatgttgcttagcgacaagttagtgctgaggcgcctccggaccatcatcaggaaaaagcaaaagattcagaataacaaaaaccattag

SEQ ID NO: 244111 - DNA, 1650 bp, Artificial Sequence
  Description of Artificial Sequence: Synthetic coding sequence
atgaataaacggggaaaatacaccactctcaacctagaggaaaagatgaaggtcctgagtcgcatcgaagctggaaggtcacttaaaagcgtgatggacgaatttggcatatcaaaaagcaccttttatgacattaaaaaaaataagaagctaatcctcgattttgttctgaaacaagatatgccactggtgggcgctgagaaacgcaaaaggacgacaggcgcaaaatatggagatgtggatgacgctgtgtacatgtggtaccagcagaagcgctctgctggtgtgccagtgcgaggagtggaactgcaggccgcagccgagaggtttgcccgttgctttggtaggactgactttaaggcctcaaccggatggctgtttagattccggaaccggcatgctatcggtaacaggaagggctgcggtgaacaggtgctgagttctgttagcgagaatgtcgagcccttccgccagaaactgagcatgataatcaaagaagaaaaattgtgtttggcgcagctgtacagcggggatgaaaccgaccttttctggaagagcatgccggagaactcccaggcatcccgtaaggatatttgtttgcccggtaaaaagatcaataaggaacgattgagcgccttcctatgcgccaacgccgatggaacgcataagctgaagtctattataatcgggaaaagtaagcttcccaagtctgtgaaagaggacacctcaactctccctgtgatctataagccaagcaaggacgtgtggtttacgagggagcttttctctgagtggttttttcaaaactttgttccggaagtacggcattttcagcttaacgtgctccgcttccacgacgaggacgtgcgagccttgctgctcttggattcttgtcccgctcaccccagttccgaaagcctgacaagtgaggatggacgtataaagtgtatgttcttccctcataacacctccacccttatacaacccatgaaccagggcgtgatcctgtcttgcaagagactgtatcgatggaagcaacttgaagaatctcttgtgatttttgaggaaagtgacgacgaacaggagaagggtgacaaaggcgtgagcaaaattaagatttataatataaagagcgcgattttcaactgggcgaaaagctgggaagaggttaaacagattactatcgccaatgcttgggaaaaccttctctacaagaaagagcctgaatatgatttccaggggctggaacatggggattatcgcgagattctggagaagtgtggagaactcgagactaaactcgatgacgaccgggtttggctgaatggagatgaggagaaagggtgtttacttaagacaaaagggggtatcacgaaggaagtcgtgcagaaagggggagaggcagagaagcagaccgccgagttcaagctgagcgcagtccgcgagtcactagactatctgttggatttcgttgacgccactcccgaattccaacgatttcatttcacgctcaaagagatgcagcaagagatagtgaaaaaacagtttcaatcaaaaatccattcacgtatcggatctttcttgaagccccgtccacacaacatcaaagactcttttagtggacccagtacgagtggtagtaaccattag

SEQ ID NO: 244112 - DNA, 1650 bp, Artificial Sequence
  Description of Artificial Sequence: Synthetic coding sequence
atgaataaacggggaaagtacaccaccctcaatctcgaagagaagatgaaagtgttgtcacgtatcgaagctgggagatctctgaagagtgttatggacgaattcggaatcagtaagagcaccttttatgatatcaaaaagaacaagaagctcattctcgattttgtcctgaagcaggatatgcctctggtaggcgcagaaaagagaaagaggactacaggcgctaagtacggcgatgtggatgacgctgtctacatgtggtatcaacagaagagaagcgcaggggtacccgttcggggagtggagctgcaggccgctgccgaaagattcgcgagatgcttcggacggaccgactttaaagcctcgaccggatggttgttccggtttcgaaaccgccatgctatcggaaatcggaaaggttgcggtgagcaggttctctcttctgtgtccgagaatgtcgagccattcaggcagaaactctccatgatcataaaagaagaaaaattgtgtctggctcaactctatagcggagatgaaacagatctgttctggaaatctatgccggagaattctcaggctagtcgaaaggatatttgcttgcccggaaaaaagatcaacaaagagagactgagcgcctttctctgcgcaaacgctgatgggacgcacaaactgaaatccattattatcggaaaaagcaagcttcctaagagcgtgaaagaggatacttccactctgcccgtgatctacaagccatccaaggatgtatggtttacccgcgagctgttcagcgagtggttcttccagaacttcgttcccgaggtacggcactttcagttaaatgtgttacgcttccatgatgaagatgtgcgggctctactgttgctggattcctgccccgctcatccttcctccgagagtctgacctcagaagatgggaggattaagtgcatgtttttcccgcacaatacatcaactctcatccagccgatgaaccagggcgtaatcttatcctgcaaacgcctctataggtggaaacagctggaggaatccctggtgatttttgaggagagcgatgacgaacaggagaaaggagataagggagtatcaaaaattaagatttacaacatcaagtctgctatctttaactgggcgaaatcttgggaggaagtgaagcaaataacgatcgccaatgcctgggagaatctcttgtacaaaaaggagccagagtacgatttccagggactggagcatggcgactatcgggagatcttggagaagtgcggggaacttgaaactaaattagatgatgacagggtgtggttgaatggcgacgaagagaaagggtgccttctcaagacgaagggtggcattactaaggaagttgtccagaaaggaggcgaagctgagaaacagacagccgagtttaaactgtctgccgttcgggaaagcctcgactacttgctggacttcgtggatgccaccccggagtttcagcgctttcacttcaccctcaaggagatgcaacaggaaatagtgaagaagcagttccaaagcaagatccactcccgcattggatctttcctgaaacctcgtcctcataacatcaaagattccttctccggcccaagtacttccgggtcaaaccactag

SEQ ID NO: 244113 - DNA, 1536 bp, Artificial Sequence
  Description of Artificial Sequence: Synthetic coding sequence
atgaataagaggggaaaatacacgaccctgaacctcgaagaaaaaatgaaggttttgagcaggatagaggccggaagatcgttgaagagtgttatggatgagtttgggatttccaagagcacattctacgacatcaaaaagaacaagaagctcattctggatttcgtcctcaaacaggatatgcccctggttggcgctgagaaaaggaaaaggacaactggggctaagtatggtgacgtcgacgatgccgtttatatgtggtatcagcagaagcgcagcgcgggagtgcccgtgcgaggggtggagttgcaggcagccgctgaaagatttgccaggtgtttcgggcgtaccgatttcaaagcttctacgggatggctgtttcgcttcagaaaccggcacgccatcggcaatcggaagggatgcggagaacaagtgctctcctccgtttccgagaacgtcgagccttttcggcagaagctctccatgatcataaaggaggaaaagctctgcctggctcagctctattccggcgacgaaaccgatttattttggaagagcatgcctgagaattcccaggcgtccagaaaggacatttgtctgcccggaaaaaaaattaacaaggagcgcttatctgcgttcctgtgtgccaacgccgacggcacacacaagttgaaaagtatcattatcgggaagtctaagttgcctaagtccgtaaaagaagatacttccaccctgcccgttatttataagcccagcaaggacgtgtggtttacccgggagctcttctcggagtggttcttccagaacttcgttcccgaagtaagacacttccaactgaatgtgcttaggttccatgacgaggacgtacgagccctgctccttctggattcctgtcctgcacacccctcatccgagtccctgactagcgaagacggtcgtattaagtgcatgtttttcccacacaataccagtacgctgatccagccgatgaatcagggcgtgattttatcgtgcaagagactttatcgctggaaacaacttgaagagtccctagtgatatttgaggagtctgatgacgagcaggagaagggtgacaaaggcgtaagcaaaataaaaatatataacatcaaatcagcaatttttaactgggccaagagttgggaagaagttaagcaaattactattgccaacgcttgggaaaatttactttacaagaaagagcccgagtacgactttcaaggtctggagcatggtgattaccgcgagatcctggaaaagtgcggtgagctcgaaacgaaattagacgacgatagagtatggctgaatggggatgaagagaaggggtgcctgcttaagacaaaagggggaatcacaaaagaggtggtccaaaaagggggagaggccgagaagcagactgccgagttcaaactctccgctgtgagagagagcctggattatctccttgacttcgtggacgccaccccagaattccagcggttccattttacattgtgcgaattttctgatgactcctag

SEQ ID NO: 244114 - DNA, 1644 bp, Artificial Sequence
  Description of Artificial Sequence: Synthetic coding sequence
atgacatccgctgcgccagccaaaaagccctatcgaaaggcaccgccagaacaccgggagctgcgccttgaaatccccggaagccgccttgagcaggaagaaccgctgaccgatgcagaacgaatgaagttgcttcaggaagagaacgaggaactccggaggcgcctagcctccgcaacccgtagaaccgaggctctggagagggaactcgaaattggacaggattgtctggaactcgaattgggacagagtcgagaggagttggacaagttcaaggacaagttccgtcggctccaaaatagctataccgcatctcaacgtacaaatcaagagctcgaggacaagctccataccttgataaagaaggcagagatggacaggaagacgctggattgggaaatcgtcgagctgactaataagttgctggacgctaagaacaccatcaacaaactcgaggaactgaatgagcgttatagactcgattgtaacttggcagtccagctactgaagtgtaacaagagtcattttcggaatcacaaattcgcagacttgccttgtgaactgcaggatatggttaggaagcacctgcattctggacaagaagctgcatcacctgggccagcaccctctctcgcaccaggggcagtggtgcccacctcagtcattgcgagagtcttagagaagcctgaaagcctactactcaacagcgctcagagtgggtccgcagggagacccctagctgaggacgtatttgtgcacgtggatatgtctgaaggggtgccgggtgaccctgcttcccctccggctccagggtctcctacacctcagccgaatggcgaatgccattccctgggaaccgccagaggctcgccagaagaggaactgcctctgccagccttcgagaagctgaacccataccccaccccgagcccaccgcaccccctgtacccaggtcgtagggtgattgaattcagtgaggacaaggtgagaattccacgaaacagccccctacctaattgcacttatgcgacacgccaggcgatttcactctccctcgtcgaggaagggagcgagagagctcggccttcccccgtgccgagcacccccgcttcggctcaggcttcacctcaccaccagccgtctcccgctcctctgacattgagcgcccctgctagctctgcgagttctgaggaagatttgctagtgtcttggcagcgcgcatttgtggaccgtaccccccctcccgcagcagtggcgcaacgcacggcttttgggcgagatgcgctgccagagctacagcggcatttcgcccatagccccgctgacagggacgaagtagtccaggccccttcagctcgtcccgaagaaagcgagctcctcctccctacggagccggactccggatttccgagagaggaagaagaactgaatctacctataagtcccgaggaggaacgccagtccctccttccaatcaaccgaggtacggaggaaggcccaggtacaagccacactgagggaagggcttggcctctcccctcttcttctcggccacagcggtcgcccaagagaatgggcgttcaccacctgcacagaaaggactcccttacccaagctcaggaacaggggaatctattgaattag

SEQ ID NO: 244115 - DNA, 1644 bp, Artificial Sequence
  Description of Artificial Sequence: Synthetic coding sequence
atgaccagcgccgcacccgcaaagaaaccctatagaaaagctccccctgagcaccgcgaactgaggcttgaaataccaggctcgagactcgagcaggaggagcctctgaccgatgctgaacggatgaagctcctccaggaagagaatgaggagctaagacgtcgactggcaagcgctactagacggaccgaagctctagagcgcgagctcgagattggccaggactgcctggaactggagcttggtcagtcccgagaggagctcgacaagttcaaggataagttcaggcgcctccaaaatagttacaccgcatctcagagaacaaaccaagagctggaagataaactccacaccctcataaagaaagcggaaatggacaggaaaactctggactgggaaattgtcgaactcacaaacaaacttctggatgctaaaaacacaataaacaagctggaggaactcaacgagagataccggctcgattgcaatcttgctgttcaactgctgaaatgcaataagagccacttcaggaatcacaagttcgcagatctgccttgcgagctccaggatatggtgaggaagcatctacactccggacaagaagcagcatccccagggccagctcctagcctagcccctggtgccgtcgtgcccacttcagtcatcgcccgagtgttggaaaaaccggagtctctgcttttgaactcagctcagagcggctctgcgggacgtccattagcagaggatgtctttgtccatgtcgacatgtcagaaggggtgcccggagaccctgcatctccccctgcgccaggtagtcccacaccccagcctaacggggaatgtcacagcctagggacagccaggggatcaccagaggaggaactccccctgcctgcgtttgagaaactaaatccctatccaacaccatcaccaccccaccccctgtatcccggaagacgtgttattgaattcagtgaagacaaggttcggatacccaggaatagtccattgcctaactgtacctatgctactagacaggcgataagcctgagtctggtcgaagaaggcagcgaaagggcacgcccatcccccgtgcccagtacaccagccagtgcacaggcttctccacaccaccagccatccccagccccattgaccctctcagcgccagcatctagcgccagtagtgaagaggacttacttgtgtcatggcagagggccttcgttgatcggaccccgcctcctgctgctgttgcacagcggaccgcctttggcagggacgccctgcctgagctgcagaggcacttcgcccatagcccggcagacagagacgaggtagtgcaagccccatctgcacgtcctgaagagtccgagctgttgcttcctaccgaaccggattccgggtttcccagggaagaggaagagctcaacctccccatcagtccagaggaggagagacagagtttgttacccatcaatagggggaccgaggaaggccctgggacctcccacaccgagggcagggcctggccgctcccgtcgagctctaggcctcagcggagccctaagcggatgggagttcaccacctgcaccggaaagatagtctgactcaagctcaggaacagggcaacttactgaactag

SEQ ID NO: 244116 - DNA, 1674 bp, Artificial Sequence
  Description of Artificial Sequence: Synthetic coding sequence
atgacatcggcagcacccgctaagaagccatataggaaagctcctcctgagcatcgggaactaaggctggagataccaggctctcgcctggaacaggaagagcctcttacagacgcagaacgtatgaagttgctgcaagaggagaacgaggagctgaggcggagactcgccagcgctacccgtcggacggaagcgctagaacgtgagctagaaattggacaggattgcctggagctggaactgggacagagccgggaggagcttgacaagttcaaggacaagttccggagactgcagaattcatacactgcatcacagagaacaaaccaggagctagaagacaagctgcacactttggcgagtctgagccactcctggattttcgcgattaagaaagctgagatggaccgcaaaactttggattgggagattgtcgagctgacaaacaagttactggacgccaaaaataccattaacaagctggaagaactgaatgagaggtaccgacttgactgtaacctcgcagtccagttactgaagtgcaataagtcacactttagaaatcataagttcgccgacttgccttgtgaactccaagacatggttcggaagcacttgcacagcgggcaggaggcggctagcccaggtcccgctccttccctcgcccctggcgctgtcgtcccaacctccgtcattgctcgtgtgcttgagaagcccgaatccctcctcctcaactcggcacaatcaggctcagcaggacggcctctggctgaggacgtcttcgtgcatgtggacatgagcgaaggagtgcccggtgacccagccagccccccagcgccagggtccccaacaccacagccaaacggggagtgtcattcattagggaccgcgcgagggtctccagaagaagaattgcccctgccagccttcgaaaaactgaatccctatcctactccttccccgccacatcccctgtacccagggcgacgtgtgatcgaatttagcgaggacaaggttcgcatcccccgaaattctccgttgcctaactgtacttacgctactcggcaggccatcagcctatctcttgtcgaggagggtagcgagcgagcgaggccttcaccagtcccatctactcccgctagtgctcaggcctctccccatcaccagccatcccccgcaccgctcacactgtctgcccctgcttcctcggcctccagcgaggaggacctgctcgtctcttggcagcgggcattcgtggacaggacccctccacccgcagccgtggcgcagagaacagctttcggtagagatgcgctccccgaattacagaggcactttgctcatagtcctgccgaccgcgacgaggtggtccaggcccctagcgctaggcctgaagagtccgagctgctgctccccacagagcccgacagtggcttcccacgcgaagaagaagagctcaacttgccaatctcccccgaagaggagagacaaagcctgctgccgatcaaccgcggtacggaagaaggacctggcacctcccatactgaaggcagggcctggcctctgcctagtagtagccggcctcagcgatcacccaagaggatgggggtgcatcatctccataggaaggattctcttactcaagcccaggagcaagggaaccttctgaactag

SEQ ID NO: 244117 - DNA, 1674 bp, Artificial Sequence
  Description of Artificial Sequence: Synthetic coding sequence
atgacttccgccgctcctgccaagaaaccatatcgaaaggcgccacctgagcatagagagctgcgacttgagattcctggctctaggctcgagcaagaggaacccctgaccgatgctgagaggatgaaacttctccaggaagaaaatgaggagctgcgcagacgtctggcctctgccactagaagaacagaggccctagagcgggagctggaaattggccaggattgtctggagctcgaactgggacagagccgggaagagctagacaagttcaaggataaattcaggaggctgcagaattcgtacaccgcgagccagagaaccaaccaggaactggaggataaactccacaccttggcctctttgagccactcctggatctttgccataaagaaagccgagatggaccgtaagaccttggactgggagatagtggaactgacaaataagttgttggatgctaagaacaccattaacaagctcgaagaactaaacgaacgctaccgactggattgcaatctggcagtgcagctgctgaagtgcaataaaagccattttaggaaccacaagttcgccgatctgccctgcgagttacaggacatggtgcggaaacatttgcattccgggcaggaggctgcatcacctggacccgcacctagtctggctcctggcgctgtagtgcctacatctgtcattgcccgtgtgctcgagaaacctgagtcactgttactgaactctgcacaatccggaagtgccggaagacccctggcagaagatgtcttcgtgcatgtggatatgagcgagggcgttcccggtgacccagcatcccctcctgcaccgggttccccgactcctcaacctaatggtgaatgtcattcgctgggcacagcaaggggctctccggaggaggagctgcctttgcctgcatttgagaaactaaatccgtacccaacgccctccccgccacacccattgtatccaggccgtcgggtcatagagttttccgaagataaggtgaggatcccacgaaactcacctttgcctaactgtacttacgccactcgtcaggctatctccctgtcccttgtcgaggaggggtccgagcgcgctaggcccagtcctgtcccctctacccccgcatcagcccaggcctctccccaccaccagccgagcccggcaccgctgacattgtccgccccagccagttccgccagcagcgaggaggatttattggtgagctggcaacgcgcattcgtcgaccgaacgccacctcccgcagctgttgcccaacggacagcattcggtcgggatgccttaccggaactgcaaagacatttcgctcactcccctgccgacagagacgaggtggtccaggcaccatctgccagacctgaggaatccgaactcctcctgcctacagagcctgacagcgggtttccccgagaagaagaggaacttaatctgcctatatcaccagaggaggagcgccagagccttttgccaattaatcgtgggactgaagagggaccaggcacatcccatacagaagggagggcctggcccttgcctagcagctcaagaccacagcgttctcccaaacggatgggagtacatcatttgcatagaaaggatagcctcactcaggcccaggagcagggcaatctgctcaactag

SEQ ID NO: 244118 - DNA, 1644 bp, Artificial Sequence
  Description of Artificial Sequence: Synthetic coding sequence
atgacatcagccgcaccagcaaagaaaccctaccggaaggctccgccagaacaccgggagctgcgactggagatcccgggaagccgcctggagcaagaagaacccctgactgatgctgagcgcatgaagctcctgcaggaagaaaacgaggagttgcgtcgcaggcttgcgtcagcaactcgccgaactgaggcattagaaagggagctagagattggacaggactgtctcgagctggagctgggccaatctagggaagaactggacaagtttaaggataaattccgaagactgcagaactcatatacagcaagccagcgtaccaaccaagaactcgaggataaactgcacacactgattaagaaagctgagatggaccggaagacactggattgggaaatcgttgagctgacaaataaactcttagatgcaaagaacacaatcaataagctcgaggaactcaatgagcggtatagactggattgtaatctcgccgtgcagctgctaaagtgtaataaatcacatttcaggaatcataagttcgccgatctcccttgcgaattacaggatatggttcgcaaacacttgcactccgggcaggaagcagcttctccgggaccggctccatcacttgcccctggagccgtcgttccaacttccgtgatcgcaagagtcctcgagaaacctgagtcgttgctccttaactccgcacagagtgggtccgcaggccgtcccctggcagaggatgtcttcgttcatgtcgacatgtcagaaggtgtcccaggcgacccagcaagccctccagccccagggtcacctacacctcagcccaacggagaatgccatagcctggggactgcccgagggtctcccgaggaagagttacccttgcccgctttcgaaaagttgaacccatacccaactccctcaccaccccatcctctgtaccctggtcgaagagtgatcgaattctccgaggacaaagtcagaattccacgcaacagcccactgccaaactgcacatacgctacccgacaggccatctctctgtcactcgtggaagaagggagcgagcgcgctcgcccatcccctgtgccgtctacgccagcgtccgcacaagccagtcctcaccatcagccctccccagccccactaaccctatccgcccctgctagttctgcctctagcgaagaggatctgttggtctcttggcagcgggcttttgtggaccggacaccccctccagcggctgtggctcaaaggactgcttttggtcgggacgccctgccggaactgcagaggcattttgcccacagcccagcagacagggacgaagtggtgcaagcccctagtgcccgaccggaggagtccgagctactgctgcccactgagcctgattcaggattcccaagagaggaggaggagctcaatttgcccataagtcccgaagaggaacggcagtccctacttcctatcaaccgcggaactgaagaagggcctgggacatcacataccgaagggagagcttggcccttaccctctagcagcagacctcagaggtcgccaaagcgaatgggggtgcatcacctccataggaaggactcactgacacaagcacaggagcagggcaatttactcaattag

SEQ ID NO: 244119 - DNA, 1644 bp, Artificial Sequence
  Description of Artificial Sequence: Synthetic coding sequence
atgaccagcgcagcgccagcaaagaagccttataggaaggcccctcccgaacaccgggaactgagactcgaaatacccggtagtcggctcgaacaagaggagcccctgacggacgcagaacggatgaagttacttcaggaagagaatgaggaattaagaaggagattggcgtctgccaccagacgcaccgaagccctggaaagagagttggagatcgggcaagactgcctcgaacttgagctcggccagtcgcgcgaagaattagataaattcaaagataaattccgtagattgcaaaacagctatactgcctcccagcgcacgaatcaggaactggaggacaaattacacaccctgatcaaaaaagctgagatggataggaaaactttggattgggagatcgtcgagctgactaacaagctgctcgacgccaaaaacaccattaacaaattggaggagctgaatgagaggtaccgccttgactgcaatctggccgtccagctgctcaagtgcaacaagagccacttcaggaaccataaatttgccgatttaccatgcgagttacaggatatggttagaaagcatctccattctggccaggaagccgcaagtcctggcccagccccaagcttggcacctggcgctgtcgttcctacatccgtgatcgctcgagtgctggaaaaaccagaatcactgctgctgaactctgctcagagcgggtccgccggacgacccctcgcagaggacgtattcgttcacgtcgatatgtctgagggcgtcccgggagatcccgcttcccctcccgctcctggtagtccaacccctcagcctaacggggaatgccactcattaggaactgcacggggttcacctgaggaggagctccccctgcccgctttcgaaaagctaaatccctaccctacaccctccccccctcaccccttgtaccccggacgcagggtaatcgaattctctgaggacaaagtgaggatccccaggaattcaccccttccgaactgcacctacgctactcgacaggctatctcactgtccctggttgaagagggttctgagcgcgctcggccaagtccagtcccatctacgcctgcttctgcacaggctagcccacaccatcaaccatcccccgctcctctaacactttctgccccagctagttccgcctctagtgaggaagatttgctggtatcctggcaacgggcattcgttgaccgcaccccacccccagcagccgtggcacagagaaccgctttcggcagggacgccctgcctgaattacagagacacttcgctcactcccctgctgacagggatgaagttgtgcaagccccttccgccagacctgaagaaagtgagctcctattacctacggagcctgactctgggtttcctagggaggaagaggaactgaatttgcccattagccctgaagaagaacgccagagcctgctgccaatcaacagaggcacggaagaagggcctggcaccagtcataccgagggacgcgcttggccattgcccagctcgagtcggccacagagatcgccgaaaagaatgggtgttcatcacctacacaggaaggactcactcacacaggcccaagaacagggcaacctgctgaattag

SEQ ID NO: 244120 - DNA, 1644 bp, Artificial Sequence
  Description of Artificial Sequence: Synthetic coding sequence
atgacctctgcagccccagctaagaagccataccgtaaagcaccccctgagcatcgggagttacgcctggagattccaggctcccgactggagcaggaagagcccctcactgatgcagagcggatgaagctgctccaggaagagaatgaggaactgcgtcgacggcttgcctcagctacaaggcgaaccgaagcgctggagagggagttggaaatcggacaagactgtttggagttggaactggggcaatccagggaggagttggataagttcaaggacaagtttaggaggctgcagaatagctacactgcgagccagcgaaccaaccaggagttggaagacaagctgcataccctgataaaaaaggctgaaatggataggaagactctcgattgggaaatcgtcgaactgactaataagctgctggacgccaaaaatacgatcaacaagctcgaagagttgaacgaacgatatcgcctagactgtaaccttgctgttcagctgctgaagtgtaacaaatcacattttcgaaaccataagtttgctgacctaccgtgcgaactccaggatatggtgcgaaagcacctgcactctggccaagaggccgcttcccctggcccagcaccatcgctagccccaggggctgtggtgccaacatcggttatcgcacgcgtactcgagaagcctgaatctttattattgaattccgctcagagcggcagtgctggtagacctctcgccgaggacgtgtttgtgcacgttgacatgagcgagggggtgcccggagaccctgcttcgcccccagcgcctggaagtccgacgccccagccaaacggcgaatgccatagcctcggaaccgcccgaggtagccctgaggaagagctcccattacctgccttcgagaagctgaacccttatccaacccccagcccaccgcatcccctctatcccggtcgacgagttattgagttttcggaagacaaagttcgcatacctaggaacagtcctcttcccaactgcacatacgctacaagacaggccatatctctgagcctcgtcgaggaaggcagcgagcgggcaagacctagcccagtaccttcgactccagcttctgcgcaggctagtccccaccaccagcccagccccgcaccccttactctatcagccccagcgtccagcgctagcagcgaagaagacctgctggtgtcgtggcaacgcgctttcgtagaccgcacacccccaccagcggctgtcgctcagcgaacagcattcgggcgagacgcccttccggaacttcagaggcacttcgcacactccccagcagaccgcgatgaggtagtgcaggcaccctccgcaagacccgaggagtccgagctgctcttacctacagagcctgactcagggttccctagggaagaagaagagctgaacctgccaatcagccccgaagaggagagacagagtctcctgcccattaacagaggcacagaggagggcccaggcacgtcccacactgagggaagagcgtggccacttcctagctcttcccgccctcaacggtcccccaaaagaatgggagtgcaccaccttcaccggaaagattccttgactcaggcccaggagcaggggaatctgctgaattag

SEQ ID NO: 244121 - DNA, 1674 bp, Artificial Sequence
  Description of Artificial Sequence: Synthetic coding sequence
atgaccagcgcagctcctgctaaaaaaccttaccggaaggcgcctcccgagcatcgggagcttcggctggaaatccccggaagcaggttggagcaggaagaacctttgaccgatgccgaacggatgaagctcttgcaagaagagaacgaagagctgaggagaaggctcgctagcgccacaaggaggacggaagctctggagcgggagctggagatcgggcaagactgtcttgaactcgagctggggcagagccgagaagagttggacaagtttaaggataaatttcgaaggctgcagaattcctataccgcctcgcagcgaacaaaccaggaactagaggacaagctacatacactcgcatccctttctcactcctggattttcgctattaagaaggctgaaatggatcgaaagactctggactgggaaatcgtggaattgactaataagcttctcgatgccaagaatacgatcaacaagctagaggagttaaatgagaggtatagactggactgcaacctggctgtccagctcctcaaatgcaacaagagtcacttccggaaccataagttcgcagacctgccatgcgagttgcaggacatggtgaggaagcatctgcacagtgggcaggaagccgctagccccggaccagcgccatcgctggcgccaggcgcagtagtgcccacatctgtgattgcgcgagtgcttgagaaaccggagtccttacttctcaactctgctcagtccggaagcgcgggtcgacctctcgcagaggacgtttttgttcacgtagatatgtctgagggcgttccaggcgacccagcatctcccccagcacctgggtcgccaactccccagccaaatggagagtgccacagtctgggcactgcgaggggttcccccgaagaggagttgccactccccgcttttgagaagttgaacccttacccaaccccgtcgcctcctcatcctctctatccagggagacgcgtgattgaattctcggaggacaaggtgaggattcccaggaacagtcccctgcctaattgcacatacgctacacgtcaggcgatcagcttgtcacttgttgaggaaggcagtgagcgggcacggccttcacccgtcccaagtacaccagcttctgcacaggcaagcccccatcaccagcccagcccagccccattgactctgtccgcaccagcgagctccgcttcctccgaggaagaccttcttgtgagttggcagcgcgcattcgtcgaccgtacgccacctcccgcagccgtggcgcaacgcactgcttttggaagagatgcccttccagaactgcagagacactttgctcattctcccgctgatagagacgaagtagtgcaggcccctagtgcaaggccggaagaatcagaactgctccttcctacagagcccgattctggatttccaagggaggaggaagagctgaatctccctatttcaccagaagaagagcggcagtcattactgcctatcaaccggggaacagaggaaggaccaggaacctcccatacagaagggagggcctggcctcttccttccagttctaggcctcaaagatccccgaagagaatgggtgtgcaccaccttcatcgaaaggattcacttactcaagcccaggaacagggaaacttgttgaattag

SEQ ID NO: 244122 - DNA, 582 bp, Artificial Sequence
  Description of Artificial Sequence: Synthetic coding sequence
atgacttccgctgctccagccaaaaaaccctatagaaaggcgcctcccgaacatcgcgagctccgtctcgagatcccgggatcaaggctggagcaggaggaacccctcaccgacgccgaaagaatgaagctgttgcaggaagaaaacgaagagctgcggagacggctggcctccgcaactagacgcactgaggctctggagagggagttggaaatcgggcaggactgcttagagctcgagctcggacaaagtagggaggagctcgacaaatttaaggataagtttcggagactgcagaatagctacaccgcatcccaaaggaccaaccaggagctcgaggacaagctgcacactctggcgtctttgagtcacagttggatttttgccatcaaaaaagccgaaatggataggaagactcttgactgggagatagtggagttgacaaacaaactcctcgacgctaagaatacaatcaacaaactggaagaactgaatgagagatatagactcgattgcaacctggcggtacagctgctcaaatgtaacaaaagccacttcagaaaccacaaatttgcagattag

SEQ ID NO: 244123 - DNA, 720 bp, Artificial Sequence
  Description of Artificial Sequence: Synthetic coding sequence
tgattgttacaagaggaaaacgaggaattgagacgccgattagcatccgctacacgccgtaccgaggcactggagcgggagctggagattggccaggactgcctagagctcgaattgggtcagtctcgagaagaactggacaaattcaaggataagtttcggcgtctccagaacagttatacggcatctcagaggaccaaccaggaactcgaggacaagctgcatacactgataaaaaaagccgaaatggatcggaaaactctggactgggagatcgtggagctgaccaataaactattggatgccaagaacactataaataagctcgaagagctcaatgagagatataggttagactgtaacctcgcagtacagctacttaaatgcaataaaagtcatttccgcaatcacaagttcgccgacgtgagtcggacacatccactccctgcccatattgaccatagcggacactgccggacccctctgactcctgtgtccgcccctctatcagttcttctgtttccactctgtcccccactggcctctatgtctccactcaagcctgtgaacagtgcgactgggtggtgtccagtgtactgtcctggtcctattacctcctcaggcggacccgctctattagtgtcggtaacagagactgagcgggaggatccaggccaggaaggtgaaggttcacagagttatctgcccaaggagtactag

SEQ ID NO: 244124 - DNA, 5246 bp, Artificial Sequence
  Description of Artificial Sequence: Synthetic coding sequence
atgtcagctcgggctgctgctgctaaatctactgctatggaggagaccgcgatttgggaacaacataccgttactttgcacagagcccctgggttcgggtttggtatagctatttcgggcggacgagataatccacactttcaatccggggagacctccatcgtgatctccgatgtgctaaaagggggtcctgccgagggacagcttcaggagaacgatagagtagccatggtgaatggggtctccatggacaatgtcgagcatgccttcgcagtacaacagttgaggaaaagcggtaagaacgctaaaatcactatccgcaggaagaagaaagtgcagatccccgtcagcagaccagatcctgaaccagtgagcgataacgaagaggacagttatgatgaagagatccacgaccctagatcaggcaggagcggcgtcgtcaacagaaggtcagaaaagatatggccacgcgacaggtcagcttcacgtgaaaggagcttgagtccccgatcagataggaggagcgtggcttcttcccagccggctaagcccaccaaggtgactctggtcaaatccaggaaaaacgaagagtacggactgcgattggcatcacatatctttgtcaaggaaatttcccaggactctctcgccgctagggacggaaacatccaggagggcgacgtggtgctgaaaattaatggaacggttacagagaacatgtcactcaccgatgcaaaaactctgattgaacgatcaaagggcaagctgaaaatggttgtccagcgtgatgagcgggctaccctcttgaatgttcccgatctgagcgattcaattcacagcgccaacgcttctgaacgagatgacatctcagagattcagtcactggcatcagaccactccggcagatctcatgaccggccaccgagacggagcaggtcccgctctcctgatcagcggtcagagccttctgatcactcacgtcacagcccccagcagccttccaatggcagccttcggtctagagacgaggagaggatttctaagcccggagcagtgtctacccccgtgaaacacgccgatgaccacacgcctaagacagtcgaggaagttacagtcgaacggaatgaaaagcaaactccgtctctgcctgaacctaaacccgtgtacgctcaggtcggtcagccggacgtcgacctgcccgtgagtccatcagacggtgtactgccaaacagtactcatgaagatgggattctccgcccatccatgaagctcgtaaaatttagaaaaggggacagcgtcgggcttcgtttagccggagggaatgatgtgggtatattcgtcgctggcgttttagaagacagccccgcagctaaagagggtctggaggagggcgaccagatcctgcgggttaacaatgtggacttcacaaatattatcagagaggaggcggtgctgttcctgttagacctgcccaaaggagaggaagtcacaattttagctcagaagaagaaggatgtgtacaggcgcatcgtagagtccgacgtgggcgacagtttctatattagaactcattttgaatatgaaaaggagtcaccttacggtctgtcattcaacaaaggcgaggtgttccgagttgtggatactctctataatggaaagttgggcagttggctggcaatccggatcggaaagaatcacaaagaagtggagagagggatcattcctaacaaaaatcgcgcagagcagttggcctcggtgcagtacaccctccccaaaacagccggaggagacagagcggacttctggagattcagaggtcttcggagctccaagaggaacctgcgcaagagccgggaggacctgtccgcccaacctgtgcagacaaagtttcctgcctatgagcgtgtggttctgcgtgaagcgggatttctccgccctgtgaccatctttggacccatcgcggatgtggccagagagaagttggcaagagaagagcccgacatctatcagatagcaaaaagtgaaccacgggacgccggtactgatcaacgctcatctggaatcatccggctgcacacgatcaaacaaataattgatcaggacaagcatgccctgctcgacgtgacgcctaacgccgtagacagattgaactacgctcagtggtacccaatagtggtcttcctcaatccagactccaagcagggagtcaagaccatgcgcatgcgactctgtcctgagagcaggaaaagcgcccgaaaattgtacgaacgctctcataagcttcggaagaacaatcatcacctgtttaccaccaccatcaacctgaattccatgaacgacgggtggtacggggctctgaaagaagccatacaacaacagcagaatcagttagtatgggtgtctgaaggaaaggccgatggagcaacctctgatgacctggatttacatgacgatagactgtcctatttaagcgccccaggtagcgagtactctatgtatagtacagacagccggcatactagcgactacgaggacaccgacactgaaggaggtgcttatacggaccaggagcttgacgaaacactgaatgatgaagtgggaacgccccctgagtcagcaattacacgctcctccgagcctgtgcgagaagactctagcgggatgcaccacgagaaccaaacctatccgccatatagcccccaggcccagccgcagcccatccacagaatagacagcccagggtttaaacccgctagccagcaaaaggcggaggctagtagcccagtgccctacctgtcacctgagacaaaccctgccagttccacatcagcagtcaaccataacgtgaatctaaccaatgtgaggcttgaagaaccaacccccgctccctccacatcgtacagcccccaggcagattctctccggacaccaagtaccgaggcggcacatataatgctgcgcgatcaggagccaagcctttcttctcatgtggaccccactaaggtgtaccgtaaagacccctaccctgaggagatgatgcggcagaaccacgtgctcaaacagcccgctgtcagtcatcctggacacagacctgacaaggagcccaacctcacgtacgaaccccagttaccctatgtggagaaacaggcttcgagggacctggagcagcctacatatagatatgaaagctcctcctatactgaccagttcagtagaaactatgaacacagactccgatacgaggatagggttccaatgtacgaggaacagtggagctattacgatgacaagcaaccatatccgagcaggccaccgtttgataaccaacattcccaggatcttgactccaggcaacatcctgaagaatctagcgaaaggggatactttccacggtttgaggaacctgctcctttgagctacgacagtcgcccacggtatgagcaggcccctcgcgcttccgccctgagacacgaggagcaacccgctccaggctacgacacccacggcaggctgaggcctgaggcccaacctcacccaagcgctggcccaaagcccgctgaaagcaaacagtatttcgagcagtattcccgttcttacgagcaggtgcccccacaggggtttacgtcccgcgcaggacattttgaacctctccacggagctgccgctgtaccccctctcattccttccagtcagcacaagccggaggcactgcccagcaacactaaaccacttccaccgcctcccacacagacagaggaagaagaggaccccgcaatgaagcctcagtctgtattgaccagggtcaaaatgtttgaaaataagcgctcagcctcactggagacgaaaaaggacgtgaatgacacagggagcttcaagcctcctgaagtcgcctcaaagccctccggggctccaattatcggtcctaaacctaccagtcagaatcagttcagcgaacatgacaaaacactctacaggattcccgagccccagaagccccagctcaagcccccagaggacattgtgcggagtaaccactatgacccggaggaggacgaagaatactaccgaaagcagttatcctacttcgaccgccgatcctttgagaataaacctcccgcacatatcgcggcaagccatctctctgaacctgcaaagcccgctcactcacaaaaccaatctaatttctcctcttattcctccaagggcaagcctcctgaagccgacggcgtggataggtcctttggggagaagaggtatgagcccatacaagctacgcccccaccacctcctctgccaagtcagtatgcacagccttctcagccagtcacatccgcctccctgcacatacactccaagggcgcacatggcgaaggaaatagcgtgtctctggattttcagaattctctcgtttccaaacctgatccaccccctagccagaataaacccgcaaccttccggcctcctaatcgggaagataccgctcaagccgctttctacccccagaaatcctttcctgacaaggcacccgtgaacggaactgagcagactcagaagactgtgactcccgcatacaaccgcttcacccccaaaccatataccagctcagcaaggccattcgagcggaagtttgagagcccgaagtttaatcacaacctgctgccttctgaaacagctcataaacctgatctgtcttccaagacccccacgtctcccaagaccttggtcaaatcccatagcttggcccagccaccagagtttgactccggagtggaaacgtttagcatccatgccgagaagccgaagtatcagattaacaacatctctacagtgccgaaggccatacccgttagcccatccgcagttgaagaagacgaagatgaagacggacacacagtcgtggccactgccagagggatctttaattctaacggtggcgtgctgagctcaatcgaaacaggcgttagcatcattattccgcaaggagccatacctgagggggtggaacaagaaatctattttaaagtgtgtagggacaattccatactgccacctctggataaagaaaagggcgagactctcctgagcccactggtgatgtgtggacctcacggcttaaaattcctcaaaccagtggaactgagactgccccactgcgatccaaagacctggcaaaataagtgcttacccggtgacccaaactatctggtcggcgctaactgcgtgtccgtcctgatcgatcattttta

SEQ ID NO: 244125 - DNA, 5007 bp, Artificial Sequence
  Description of Artificial Sequence: Synthetic coding sequence
atgtccgcaagagccgcagcagcaaagagcacagctatggaggagacagccatctgggagcagcataccgtcactctgcatcgtgccccaggcttcggtttcggcatcgcaatctcaggaggaagggacaacccgcatttccagagcggggagacttctatagtcatatctgatgtgctgaagggaggcccagccgaggggcagcttcaggaaaacgatcgtgttgccatggtcaacggcgtttcaatggacaacgtggaacatgcgtttgctgtgcaacaacttcgaaaatctggaaaaaatgccaaaatcacgattaggaggaagaaaaaggtccaaatacccgtgagccgaccagaccctgaaccagtgagcgacaacgaagaggatagttacgatgaggaaattcatgacccccgtagtggtagatctggagtggtcaaccgcaggtcagaaaaaatctggcccagggaccgttcagccagcagggaaagatccctgtccccccgaagcgataggcggagcgtcgcctcgagccaacctgccaagccaactaaggtcaccctggtgaagagcagaaagaacgaggaatacggcttacgccttgcttcacatatattcgttaaagagatttcacaggactctctggcagcacgcgacggcaacatccaagagggcgacgtggtgctgaagatcaatgggaccgtaaccgaaaacatgagcctgactgacgcgaaaactctgatcgaaagatcaaaaggcaagctaaaaatggtggtgcagcgggatgaacgggcaactcttttgaatgtgcccgatcttagtgacagtattcactctgccaatgctagcgagagggacgacatttcagagattcagagcttggcgtcagaccactcgggacgctcccacgatcgaccgccacgacgctcccgatccaggagcccggatcagcggagcgagccctcggaccattctcgacactccccgcagcaaccatccaacggttcactgcgttccagagatgaagagcgaatttctaaacctggcgctgtatccacaccggtcaagcatgccgatgaccacacacccaagaccgtagaagaggtgaccgtcgagcggaacgagaagcaaacgccctcactgcccgaaccaaagccggtctacgcccaggtggggcagccagacgtggaccttccagtttctcccagcgatggggtgctgcccaactctacgcacgaggatggcattctaaggcccagtatgaagctggtgaagttccggaagggggattccgtgggcttgcgacttgcaggcggaaacgacgttgggatttttgttgcaggcgtgctcgaggattcgccagccgcaaaggaaggtttggaggaaggagaccaaatcctgagagtaaacaatgtggacttcactaacatcattcgggaagaggctgttctcttcctcctggacctccctaaaggagaagaagtgacaattttagcccagaagaagaaggatgtctatcgacgcattgtcgagtcggacgtgggcgattctttctatattcgaacacactttgagtacgaaaaagagtccccatatgggctgtcctttaataaaggagaagtatttagagtagttgataccctgtacaatggaaagctcggctcttggctggccatcaggatcggcaaaaaccataaggaggttgaaaggggtatcattcctaataagaatagggctgagcagctcgctagtgtccagtatacactgcccaagactgctggcggagaccgtgctgacttttggcggtttagaggtctgaggtcttctaagaggaatctgaggaagtcccgcgaggacctgtctgctcagcccgtgcagaccaagttccccgcttatgagcgggtcgtcctgcgggaggccggattcctgagaccggttaccatctttggcccaatagcagatgtggcccgagaaaagttagcccgagaagagccagatatttaccagattgctaaaagcgaaccgagggatgccggtacggaccagcgctcttccggcatcatccgcctacataccattaagcagatcattgaccaggataaacatgccctgcttgacgtcacaccaaacgccgtcgacaggctcaattatgcacagtggtatcccattgttgtatttctcaacccggactccaagcagggagtgaagaccatgagaatgaggttatgtccagagtcacgcaagagcgcacgcaagttgtacgagcgatcacacaagctccgcaagaacaatcaccatctgttcactacaaccatcaatttgaacagcatgaatgatggctggtacggagcactcaaggaggccatccaacaacagcagaaccagcttgtttgggtgagtgaagggaaagccgacggagcaacctctgatgatctagacttacacgatgataggctttcatacctctccgcaccagggagtgagtattctatgtactcaacagacagtcggcatacaagcgactatgaggatacggacacggagggcggagcgtacacagaccaagagcttgacgagactctcaatgacgaggtcggaactcctccagagtcagccatcacccggtcatcggagcccgtcagagaggacagtagtggaatgcatcacgagaatcaaacctacccgccttattccccacaggctcagccccaacctatccataggatcgacagtccaggatttaagcctgcgtcacagcaggtctataggaaagacccatatcccgaggaaatgatgagacagaatcacgtgctcaagcaaccagcggtgtctcacccaggacatcggcctgacaaagaacccaacttgacctatgaaccccagctcccctatgtggagaagcaggcctcaagggacttggaacagcccacctacaggtacgagagctccagttatactgatcagttttctcggaactacgagcacaggctgcgctatgaagaccgagtaccaatgtatgaagaacagtggagttactacgatgataagcaaccttatcccagtcggcctccattcgataatcaacactcgcaggacctggattcaaggcaacacccagaggagagtagtgaaagaggctactttcccaggtttgaggaacctgcccctctgagctatgactcaaggccacgttatgaacaggcgccaagggccagcgcgttaagacacgaagaacagcccgctcctgggtacgacacacatggtagattgcgacctgaggcccagcctcatccgtccgcgggtcctaaaccagcagagagcaagcagtactttgaacaatacagtcggagttatgagcaggtgcccccacaggggtttacaagtcgggctggccattttgagccactacacggcgctgctgccgtgcctcccctcatacctagtagccagcacaagccggaagccctgccatcaaacaccaagcctctcccccctccacctacgcaaacagaagaggaggaggacccagccatgaagcctcagtccgttctcacccgcgtcaaaatgttcgagaacaagcggagcgcttctcttgaaacaaagaaagacgtcaatgacacaggcagttttaaaccaccagaggttgcttctaagccatcgggagcccctatcatcgggcctaaaccaactagccagaaccagtttagcgagcatgataagactctgtatagaataccagagccccaaaagccccaactcaagccacctgaagatatcgtgcggtccaatcactacgaccccgaggaggacgaagaatactatcgaaagcagctcagttattttgataggaggagcttcgagaataaacctcccgcacacatagctgcttcccacctttccgaacccgctaaaccagcacattctcagaatcaatctaatttttctagttactctagtaaaggcaaaccccctgaagccgacggtgtggataggtcattcggcgagaaaagatacgagcctattcaggccactccaccgccacctccactccctagtcaatacgcacagcccagtcagcccgtgacaagtgcctcattgcatattcactccaagggtgcgcacggagaaggcaactctgtatccctcgattttcaaaattcgctggtatctaagcccgatcctccaccttcgcaaaataaaccggctaccttccgaccgcctaatcgggaggacaccgctcaggccgcattttatcctcagaagagcttccctgacaaggccccagtaaacgggaccgagcagacccagaaaacggtgacccctgcctataaccgatttacccccaagccatacacctcttctgcaagaccctttgagagaaagtttgagtccccaaagttcaaccataacttgctgccaagtgagactgcgcacaagccggacctctcctccaaaactcctacctcccccaagaccttagttaaatcacacagccttgcccagcctcccgaattcgactccggggtggaaaccttcagtatacatgctgaaaagccaaaatatcagattaacaatatatctacagtaccaaaggctattccggtaagtcccagcgctgtcgaagaggacgaggatgaggacgggcatactgtcgtggccaccgcccgtggaatttttaattcaaatggtggggtgctaagcagcattgaaaccggtgtctctattataattccccagggggcaatcccggagggcgtcgagcaggagatatacttcaaagtctgtcgagataacagtatcctgcctccactagacaaagagaagggtgagacactgctgtccccccttgtgatgtgcggccctcatggattgaagttcctaaaacctgtggagctgaggctgccccactgcgaccctaaaacctggcagaataagtgcttacctggggatccaaactatctggttggagccaactgcgtgtccgtgctgatagatcacttctag

SEQ ID NO: 244126 - DNA, 2982 bp, Artificial Sequence
  Description of Artificial Sequence: Synthetic coding sequence
atgccagtacgaggagatcggggatttccacctcgccgtgagttaagtggatggctcagagcacctggcatggaggaactgatctgggaacaatacaccgtcacactacagaaggacagcaaaagaggctttggaattgctgtaagcggcggtcgagacaacccgcatttcgagaacggcgagacaagcatcgtgatctccgatgtgctgcctggcggaccggcagacgggctcctgcaggagaacgatagagtagttatggtgaatggcacccccatggaagacgtgcttcacagttttgcggtgcagcagctacgaaagagcggaaaggtcgcggcaatagtcgtaaaacggccaaggaaggtccaagtggctgctctgcaggcgagccccccactggaccaggatgacagggccttcgaagtcatggacgagtttgacggcaggtccttccggtctggttattcagagcgttcacggctgaacagccacggcggtcgttccaggagttgggaggactcgcctgagcggggaaggccccacgaaagagctcgaagccgggaaagggacttgagtagggaccggagccggggtaggtctctggagcggggactggaccaggatcacgctcgcaccagggatcggtcgcgtggccgttccctggagagaggattggatcatgactttggtccctcccgcgaccgtgacagggataggtccagaggacgaagcatagaccaggattacgagagagcataccacagggcgtatgatcctgactacgaaagagcatattctcctgaataccgacggggagcaagacacgatgctcgctcccggggacctcgctctaggtcacgggagcatccgcacagccgctcaccctcccccgaaccacgaggcaggcctggcccaatcggggtgctgctgatgaaatcgagagccaacgaggaatacgggctgagactcggcagccagatctttgtcaaggagatgactcgtacaggactggccactaaggacggtaatttgcatgagggcgacatcattcttaaaatcaacgggacggtcaccgaaaacatgagccttacagacgccaggaagttgatcgaaaagagtaggggcaaacttcagctggtggttcttagagatagccagcagactctaatcaacattccgtcccttaatgatagtgattctgagatcgaagatatttcagaaatcgagtctaaccgctctttctcaccagaggagcgccgacaccagtacagcgattatgactaccattcctctagtgagaaactcaaggagagacctagcagcagagaagatacaccctccagactgtctaggatgggggctactccaacccccttcaaaagcacaggggacatagctggcactgtggtcccagaaaccaacaaagagcctcggtatcaagaagaccctccagcccctcagcctaaagccgctccccgtaccttcttacggccttctcccgaggatgaggccatttatggccctaatacaaagatggtccggtttaagaagggagatagcgtgggcctgaggctagccggaggcaacgacgtaggcatcttcgtcgcgggtattcaggaagggacatccgcggaacaggaagggttgcaagagggcgaccagatcctcaaagtgaacacccaggactttaggggattagtgcgagaggacgctgttctgtaccttcttgaaatcccgaagggcgagatggttacgattttagctcagtcaagagctgatgtatatcgagacatattagcttgcggtcgcggtgatagcttcttcatccggagtcacttcgaatgcgaaaaagagacacctcagagcctggcttttacacgtggcgaggtgtttagggtggtggacacgctatatgacggtaagcttggcaactggctggcggtgaggatcgggaacgaacttgaaaagggactcattcctaataagagcagagccgagcagatggcatcagtacagaatgcccagcgggataatgcgggagatcgggctgacttttggcgcatgcgcggacagagatcaggggtgaaaaaaaacctccgaaaatctagggaagatctgacagctgtggtcagcgtgtcaaccaagtttccagcttatgagagagtgctgttgcgcgaggcagggttcaaacgcccagtggttctgttcggaccgatcgctgacattgcaatggaaaaactcgctaacgaactccccgactggtttcagacagctaagacggagcccaaggatgccggaagtgagaaatctacaggcgttgtgagactgaatactgtgaggcaaataatagagcaggacaaacatgctctgctcgatgtcacacccaaggctgttgacctattaaactacacccagtggttcccgattgtcatcttcttcaatccagattcgcgacagggcgtgaagaccatgaggcagaggcttaacccgactagcaataaatcaagccgaaaactcttcgatcaggccaacaaactcaaaaagacctgtgctcacctgttcaccgcaactatcaacctgaattcagctaatgattcatggtttggaagcttgaaggatacaatacagcatcagcagggcgaagcagtttgggtgtcagaggggaagatggaggggatggacgatgaccccgaagatcgcatgtcatatcttacagctatgggcgctgattatcttagctgcgattctcgcctgattagcgatttcgaggacaccgacggagaaggcggtgcgtacacggacaatgagctggacgaacctgctgaagagcccctagtctctagcataacccggagtagcgagccagtgcagcatgaagaggtgcgcagaggcagaccacgcgcagggacaggggagccaggagtgtttcttgccctcagttggacagcagtatgcagtggatgttgtgggcgtcacagttag

SEQ ID NO: 244127 - DNA, 3132 bp, Artificial Sequence
  Description of Artificial Sequence: Synthetic coding sequence
atgccggtccgaggggatcgaggattccctccacgcagagagttgtcaggttggctgcgcgcacctgggatggaagagcttatctgggagcagtataccgtgacccttcaaaaagactcaaagcggggtttcggcatagctgtgtcaggcggacgcgacaacccacatttcgagaatggcgagacctcaattgttataagcgacgtgcttcccggtggaccagcggacggccttctgcaggagaacgacagagtggttatggtgaatggcaccccaatggaggacgtgctccactcctttgctgtgcagcagttacgcaaatccggcaaggtggcagcaattgtcgtaaagagaccacggaaggtccaggttgccgctctgcaggcttcacctcccttagaccaggatgatcgggctttcgaagtaatggatgaatttgatggacgcagctttcgaagtggctattctgaacgcagccgacttaatagtcacggcggtaggtccagatcctgggaagattcacccgagcggggacgccctcacgaacgtgcacgcagtagagagcgggacctgagtcgggatcgctcacggggtcgttctctcgaacgcggtctggatcaagatcatgcaagaacccgcgatagaagtcggggtagatcactcgaacggggacttgatcacgatttcggaccttcccgggaccgtgaccgagatcgcagccggggacgctccatcgatcaagattatgagagggcttatcaccgggcatacgacccagattacgagagagcatatagcccggagtatagacgcggagccagacacgatgcgagaagccgaggacccagatcccgaagtcgggagcatccccattctaggtcgcccagccctgaaccacgtggcagacctgggccaataggagtgttgctcatgaaatcccgggctaatgaggaatacgggctgaggctggggagccagatctttgtcaaggaaatgactcgcacgggactggccacaaaggacggtaacctgcacgaaggcgacataatcctcaagatcaatggaacagtgactgagaacatgagtttgaccgacgcgcgaaagctaatcgagaagtcgcgtggcaagttgcagctggtagtgttgagggactctcagcaaactctcataaatattccgtctctgaacgatagcgattctgagattgaggatatctccgaaatcgaaagtaaccgttccttttccccagaggagcgcaggcaccagtacagcgactatgactatcattcttcgagtgaaaagctgaaggagcgcccttcttcaagagaggacacaccctctcgattaagccgcatgggggctaccccaactccattcaagagtaccggcgatattgctgggaccgtagtgcccgagacaaataaagagcctaggtatcaggaagatccacccgcacctcagcccaaggcggctccaagaacgttcctacgcccttctcccgaagacgaggctatctacggtcctaacactaagatggttcggttcaagaagggcgatagtgtgggactccgcctagcagggggtaacgacgtaggtatctttgtggctggcattcaggaaggaacctccgcagagcaggaaggactccaggagggagaccagatcttgaaggtgaacacccaggatttccggggactagtccgcgaagacgctgtgttgtacttactggagatccccaaaggcgagatggtcacaattctggcacagtccagagcagatgtatatagggacatcctcgcgtgtggtcggggtgacagcttctttatacgctcccatttcgagtgtgagaaagagacccctcagagccttgcctttaccagaggcgaagtctttcgcgtggtggacactttgtatgacggcaagctcggaaactggctggccgtgcgcatcgggaatgagctggagaaaggtctgatacccaacaaatcacgcgctgaacaaatggcgagcgtccagaatgctcagagggataatgctggtgatagagcagatttctggcggatgagaggtcagcgctctggagtcaagaaaaaccttcgaaagtcaagagaggatctcaccgctgtggtaagtgtaagcacgaagttcccagcctacgagcgggtgctcctaagagaggccggatttaagcgccctgttgtgctgtttggccctattgctgatattgcaatggaaaagctcgcgaatgagctcccggactggtttcaaacggctaaaactgagcccaaagacgccggatcagagaaatccacaggtgtggtccgcctcaacacggtcaggcagattattgagcaggacaagcacgcacttctggatgtgactcctaaggcagtggatcttctgaattatacccaatggttcccaatagtgatcttttttaaccctgatagtcgacagggggtcaagaccatgcggcagaggttgaacccgacctccaataagtcgagccgaaaactctttgaccaggccaacaaactcaaaaagacctgcgcacacctcttcactgcgactattaacctgaactccgccaatgatagctggttcggttctctcaaagacacaatccaacatcaacagggggaagcggtgtgggtgagtgagggaaagatggagggcatggatgacgatccggaggatcgcatgagctacttaactgccatgggggctgactatctgtcctgcgacagtaggctcatttccgatttcgaggataccgatggagagggaggagcttataccgacaacgagctcgatgagcctgcggaagaacctttagtctcttcaattacgcggtcctctgagcccgtgcaacacgaagagatagaaattgcgcagaagcatccggatatatatgcagtgcccatcaagacacacaagccagatccaggtactcctcagcatacaagctctagacctccagagccccagaaagctcctagcagaccgtatcaggatactagaggctcctatgggtctgatgcagaagaggaagagtatcgccagcagttgtccgagcacagtaagcgaggatactacggacaaagcgccaggtatagagacacagagctgtag

SEQ ID NO: 244128 - DNA, 3573 bp, Artificial Sequence
  Description of Artificial Sequence: Synthetic coding sequence
atgccagtgaggggcgataggggtttcccaccgagacgcgaactttctggctggctacgagccccaggaatggaggaattgatttgggaacagtatacagtcacattgcaaaaagactccaagagagggttcggcatcgccgttagcgggggacgcgacaatccgcactttgaaaacggggaaacttccatcgtgatatctgacgtgctgcccggtggcccagccgatgggctgctccaggaaaacgacagagtggttatggttaacggcaccccaatggaggacgtgctgcacagcttcgctgtgcaacagttaaggaagtcaggaaaagtggccgctatcgtggtcaaacgtcccagaaaagttcaagtcgccgcactacaggctagtccgccacttgaccaggatgaccgtgccttcgaagtgatggacgaatttgacggcaggtcttttcgctccggctacagcgaaaggtcaaggttgaattcccacgggggtcggtccagaagctgggaggactctccagaaaggggccgtccccatgagagggctagaagcagagaaagagatttgagccgcgaccgctctcgaggcagatcactggaaagggggctggatcaggatcacgcacggacgcgggacaggtcgcgcggaaggtcacttgagaggggccttgaccacgacttcgggccatcccgcgacagggatcgggatcgttcgcggggtcgttcaatcgatcaggactatgaacgggcatatcatagggcctacgatcctgactacgaaagggcctatagccctgaataccggagaggtgcgaggcacgatgcgaggtcccgtggccctaggagcaggtcccgtgaacacccgcactcaaggagcccctctcccgagcccagaggaaggcccggacccattggtgtgctgctcatgaagtccagggcgaacgaggagtatggcctgaggctcgggagccaaattttcgtgaaggaaatgactcgcaccgggctcgcaacgaaggacggcaacctccacgaaggagacattatccttaaaatcaacggtactgtcaccgagaacatgagtttgaccgatgctcgtaagctcattgagaaatcacgcggaaagctgcagctagtcgtgctccgagatagtcagcaaaccctgattaacattcccagtctgaatgactccgacagtgaaatagaggatatcagcgaaattgaaagcaatcgatccttcagccctgaagagcgaagacatcagtacagcgactacgactaccactcttcttccgagaagcttaaggagagaccgagcagcagggaagataccccatccagattgtcccgcatgggggctacccctaccccctttaaatctaccggagatattgccggtacagtggtccctgagaccaacaaggaaccacgatatcaggaggacccaccagcccctcaacctaaggctgctccaagaaccttccttcgaccctccccagaagatgaagcaatttacggcccaaacacgaaaatggtgcgcttcaaaaaaggagacagcgtgggactccgattggcaggcggaaacgacgttgggatcttcgtagctggtatccaggaagggacatcagcagagcaagagggcttacaggaaggcgaccagattctgaaggtgaacactcaggattttagaggccttgttagggaagacgccgtcttgtacctgctggaaatccctaagggggaaatggtcactattctagcgcaatctcgagcggacgtgtaccgtgatattttagcttgcggaagaggggattccttcttcattcggtctcacttcgaatgcgagaaagaaactccacaatccctggcattcacgaggggagaggtattcagagttgtcgacacactgtacgacgggaaactcgggaattggttagctgttcgcattggcaacgaattggagaagggtctgattcccaacaagagtagggccgagcagatggcaagtgtccagaatgcacaacgcgataatgctggagacagagccgatttttggagaatgcgagggcagaggtctggcgtgaaaaagaacttacgtaaaagcagggaagatttgaccgctgttgtctcggtctccaccaagtttcctgcgtatgaaagagtgctcctacgcgaggctggtttcaagagaccagtggttttatttggccctatcgccgatatcgcgatggaaaaactggccaacgagcttcctgactggttccagacagcgaagactgagccaaaggacgcaggtagcgaaaaatcaacaggtgtggtaagattgaacacagtgcgccagatcattgagcaggataaacatgccctgctagacgtaacaccaaaggcggtagatttactgaactacacccaatggttcccgattgtcatattcttcaacccggactcacgccagggcgtgaagacaatgaggcagagactcaatcctacctcaaacaaatcatctcgcaagctctttgatcaagccaacaagcttaaaaaaacctgtgcacacctgttcacagccaccattaacctcaatagtgccaacgattcctggttcggctcactgaaggatacaattcagcatcagcagggagaggccgtctgggtatccgagggcaagatggagggcatggatgacgaccctgaggacagaatgtcgtacctgacagcaatgggcgctgattacctgagctgtgatagccgcctgatcagcgattttgaagatacggacggcgagggcggagcctacacagacaatgaattggacgaaccagctgaggagccgctcgtctcatccataacaagatctagcgaaccagtacagcacgaagaatcgatccgcaagccttctcccgagccaagagcacagatgcgcagagcagcctcatctgatcagttaagggacaatagcccccctcccgctttcaaacctgaacctccaaaggccaaaacacagaataaagaggagtcttatgatttctctaaatcatatgaatataagtcgaatccttcagccgtcgctggtaacgaaacgccgggagcatccactaaagggtatcctccccctgtcgctgccaagcccacattcgggcgttctatcctgaagccatctacccctattcctccccaagagggcgaagaggtgggagagtccagtgaggaacaggacaacgcccctaaatctgtgcttgggaaggtcaagattttcgagaagatggaccacaaggctaggctccagagaatgcaggagttacaggaggcccaaaacgccaggatcgagatagcccagaaacaccccgatatctatgccgttcctattaagacacacaaacccgaccctggcacgccacagcatacaagctcaaggccccctgagccgcagaaagcaccgagtcggccatatcaagacacccgaggtagctacggatcggacgccgaagaggaggaataccgtcagcagttgtccgaacactctaaacgagggtactatggccagtctgcacgttatagagacaccgaactctag

SEQ ID NO: 244129 - DNA, 306 bp, Artificial Sequence
  Description of Artificial Sequence: Synthetic coding sequence
atggaggagctgatatgggagcagtacacagttacactccagaaagactccaaacggggttttggaatcgcagtctcaggcggacgggacaatccgcactttgaaaacggcgaaacctctattgtgatttctgatgtcttgccgggtggcccagcggacggtctcctgcaggaaaacgaccgtgtagtgatggtgaatgggacacctatggaagacgtactgcattccttcgccgtgcaacaactgagaaaaagtggaaaagtcgccgctatcgtctctactggcttcgctttctctctgccatag

SEQ ID NO: 244130 - DNA, 486 bp, Artificial Sequence
  Description of Artificial Sequence: Synthetic coding sequence
atggaagagctgatctgggagcagtacacagttacgttgcagaaagacagtaaaagaggcttcggcattgctgtttccggaggtagggacaaccctcattttgaaaatggcgagacaagcattgttatctccgatgtgttgcctggtgggcctgctgacggcctcttgcaggaaaatgatagggtagttatggtgaatgggacaccgatggaggatgtcctccatagcttcgccgttcagcagctgaggaagtcaggaaaagtggcagccatcgtagtcaaacgcccaaggaaggttcaggtcgctgcgctccaagcctctccgcctttagaccaggacgatagagctttcgaggtgatggacgagtttgatggcagatccttcagatccggctactctgagcgaagccgcctgaatagccatggcggaaggtccagatcctgggaggatagcccagagagaggtagacctcacgaaagggcctag

SEQ ID NO: 244131 - DNA, 3063 bp, Artificial Sequence
  Description of Artificial Sequence: Synthetic coding sequence
atggaggagctcatatgggagcagtataccgtcactctccagaaggattccaagagggggtttggaatcgccgtctctggaggtcgggacaaccctcattttgagaacggtgagacatctattgtaatctccgatgtcctccctggcggtcctgctgatgggttgcttcaggagaatgacagggttgtgatggtgaatggaactccaatggaagacgtcctgcacagttttgccgtgcagcagttgcgcaagtctggtaaggttgctgccattgtggtcaagcgacctcgcaaggtacaggtcgcggctctgcaggcttcacctcctttggaccaagatgatcgggctttcgaggtcatggatgagtttgatggcaggtcctttaggtccggttactctgagcgatctcggctcaacagccacgggggaaggtcacgcagttgggaggactctcctgagagaggcagaccgcacgagagggcacgtagcagagaacgagacctgtcacgagatagatcccggggtcgcagtctggagcgcggtctggatcaggatcacgcccgaacgcgcgacaggtcacgaggtcgatccctggagaggggtcttgatcatgacttcggacctagccgagacagagacagagaccggtctaggggaaggtccattgaccaggactatgaaagggcgtatcaccgggcatatgaccctgactatgagcgagcttattcccccgaatatcggagaggtgcccgacatgacgctcggtcacgaggccctaggtcccgttcgcgcgaacacccccattcgcgatcccccagtccagaaccaaggggacgaccaggacccattggggtgctgttgatgaagagtcgggcaaatgaagagtacgggttgcgactcggtagtcaaatattcgttaaagagatgacgaggactggactggcgactaaggacggcaatcttcacgagggtgacatcatcttgaagattaacggcactgtaactgagaacatgagtctgaccgacgccaggaagcttattgagaagagccgaggcaaattgcaacttgtggttctgagagacagccagcagaccctgataaacattccaagcctgaacgattctgactccgagatcgaagatatatccgaaatcgagagcaacagatctttctcacccgaggaacgacgtcaccagtactctgactacgactatcactcaagttccgagaagctgaaggagaggccctccagtagagaggataccccttctcggctgagccgcatgggggctacccctaccccattcaaaagcactggcgacatcgccggaacagtggttcccgaaactaataaggaacccaggtatcaggaggacccacctgctccccagcccaaagccgctcccaggacatttctgaggcccagccccgaagatgaagccatctacggacccaacactaagatggtccggttcaagaagggagactccgtagggttgaggttggcaggtggtaatgacgtggggattttcgttgctggaattcaggagggaaccagcgccgagcaagaaggcctgcaagagggcgatcagatcttgaaagtcaacacacaggatttccgcggactggtgagggaggacgccgtgctctacctgctggagatcccaaagggggaaatggttacgattctggctcagtctagagctgacgtttaccgcgatatcctagcatgcggtcgaggcgatagcttcttcatcaggtcacactttgagtgtgagaaagagactcctcagtctctggcttttacacgcggagaagtgttccgtgtagtggacactctgtacgacgggaagctgggcaactggctggctgtcaggatcgggaatgaattagaaaagggactgatccctaacaagagtcgagcagagcaaatggcttcggtgcagaatgcccagcgggacaatgcaggcgatcgtgctgatttctggaggatgaggggacagcggagcggcgtgaagaaaaacctgagaaagagtcgcgaggacctgacagcggttgtgagcgtctcaacaaagttccccgcatatgagcgcgtactcctgcgggaggcgggattcaaacgacccgtggtccttttcggcccaatagcggacatcgcaatggaaaaactagccaatgagctccctgattggttccaaaccgctaaaacagagcctaaggacgccggttctgaaaaaagtacaggcgttgtacggctgaatacggttcgtcagataatcgaacaggacaagcacgcgttactggatgtgacacctaaagccgtggacctgctgaactacacacagtggttccctattgtgatttttttcaatcccgatagccgccaaggcgtcaaaactatgcggcaacgactaaaccctacatcaaacaagagttcccgcaagttgtttgaccaggccaataaactaaagaaaacctgtgctcatctcttcaccgctacaataaacctgaatagcgcgaacgattcatggtttggaagtttgaaagacaccatccagcaccaacagggcgaagccgtgtgggtgagcgagggcaaaatggaaggtatggatgacgatccagaggacaggatgagctatcttaccgcaatgggtgccgattacctgagctgtgacagccggctgatctccgactttgaggatactgacggggagggcggtgcttacactgataatgagctcgacgagccagccgaggaaccactggtgagtagcataacccgctcatctgagcctgtgcagcacgaagaaattgaaattgcacaaaaacatcccgatatttacgccgtgccaatcaagactcacaagcctgaccctggcacacctcagcatacgagctctcggccacccgagccacaaaaagctccgtcacgcccttatcaagatacccgcggttcttacgggagtgacgctgaggaggaggaatataggcagcaactgagcgaacactcaaagagaggctattacggccagagtgccaggtatcgggacactgaactgtag

SEQ ID NO: 244132 - DNA, 3474 bp, Artificial Sequence
  Description of Artificial Sequence: Synthetic coding sequence
atgaaaacagcgcaggcactgcaccgcatgtggattcaggcggtaaaaaaactgcggagatggaaaggcagggcacctggtatggaagagctcatctgggagcaatacactgtcacactacagaaagattcaaaaaggggattcggaatagccgtgtcagggggacgcgacaatcctcactttgaaaatggcgaaactagcattgttatctccgatgtgcttcctggagggccagcagatgggctgctgcaagagaacgaccgcgtggtgatggttaatggaacaccaatggaagacgtgctgcattcgtttgcagtgcagcagcttaggaaaagcggaaaagtggccgctatagtggtgaagcggcctagaaaagtgcaggtcgccgctctacaggccagccccccactggatcaggacgatcgcgcttttgaggtcatggatgaattcgatggaaggtccttcaggagcggctactcagagcggagtagactgaatagtcacggaggtagaagcaggtcgtgggaggactcacctgagcggggacggcctcatgagagagccaggagtcgcgaaagggacctcagcagggacaggtcgaggggacggtctctggaacggggactggaccaggaccacgctcgaacacgcgaccggtctcgaggacgctccctcgagcggggactggaccatgatttcgggccaagtcgggaccgagaccgagaccgttccagagggaggtccatcgaccaggattacgagagggcctaccatcgggcatatgatcctgattatgaaagagcgtattcccccgaatatcggaggggagcaagacacgacgcaaggtcgaggggtccacggtccagatcccgagaacatccgcacagtcgtagtcctagtcctgagccaagaggacgccctggacccattggagtcctgctaatgaagtctagggcaaacgaagaatatggtctgagactggggagccagattttcgtgaaagaaatgaccagaaccggcctggcaaccaaggatgggaatctccacgagggagatattatcttaaagatcaatggtaccgtgaccgagaacatgtcattaacggacgcacgcaaattaatcgagaagagcaggggtaaactccaactggttgtgctgcgagattcacagcagaccctgatcaacataccttctctcaacgatagcgactctgaaatcgaagacatcagcgagatagagagcaaccgtagcttctcgcccgaggagaggcggcaccagtattctgattatgattaccactcatcttctgagaagctcaaagagagaccctcatcgagggaagacaccccctcccggctgagcagaatgggtgccactccaacgccatttaaatctacaggcgacattgcaggtactgtcgtcccagagacgaacaaagagcccagatatcaggaggatccgccagcccctcagcctaaggctgcacctagaacattcctccgcccttccccagaggatgaagctatttacgggcctaacacaaagatggtccgcttcaagaagggtgactctgtgggacttcgtctggccggtggcaacgacgtaggtatattcgtggctggtattcaggaaggtactagtgcggagcaggagggcctgcaagagggcgaccaaatcttgaaggtcaacacacaggacttcaggggcctggttcgcgaagatgccgtgctgtatctgctggagatcccaaaaggtgaaatggtgaccatcctggctcaatccagggctgatgtgtatagagatattcttgcttgcgggcgaggcgactctttcttcataagatcccacttcgagtgcgagaaagagaccccacaatcactggccttcacacgcggtgaggtttttagagtcgtcgataccctgtacgatgggaaactgggaaactggctagctgtgagaatcgggaatgagctggagaagggtctgataccaaataagtctagggctgagcagatggccagcgtacagaatgcccagagagacaacgcaggtgacagagccgacttctggaggatgcgtggacaacgctccggtgtcaagaaaaacctgaggaaaagtagagaggacttgaccgccgtggtgagtgtttccaccaagtttcctgcatacgagagagtgttactccgagaagctgggtttaaaaggccagtggtgctatttggaccgattgcagacatcgcaatggagaagctggctaatgagctcccagattggtttcagactgctaaaacagagcccaaggatgctggctcagagaagagcactggggtcgtcagactcaacactgttcggcaaataattgaacaggataagcacgcgctgctcgacgttacgccaaaggccgttgaccttctgaactatactcagtggtttccgatagttatatttttcaacccagattctcggcagggagttaaaactatgaggcaacgtttaaatcccacttctaacaagtcatctcgcaaactatttgatcaggctaataaattaaagaagacctgcgctcacttattcacagctacaattaacctgaactcggcgaatgactcttggttcggcagcctgaaagatactatccagcatcagcagggcgaagccgtgtgggtgtcagagggcaaaatggaggggatggacgacgatcccgaagacagaatgtcatatctgaccgccatgggcgctgattatctatcttgcgattctcgcctgattagcgacttcgaggacacagacggagaagggggagcctataccgataatgagcttgacgagcctgctgaggagcctctagtgagttccatcacgcgttccagcgaacctgtgcaacacgaagaagcgaagacacagaacaaagaggagagttacgacttcagcaaaagctatgagtataagtcaaatccctccgccgtcgccggaaatgaaacaccaggagcatccacgaaagggtacccaccacccgtggcagcaaagccgacctttggacgttcaattttgaaaccatctacacctatccctcctcaggagggagaggaagtgggcgaatccagcgaagaacaggacaacgcccctaagtcagtattgggtaaggttaagatcttcgagaaaatggaccacaaagccaggcttcaaagaatgcaggaattgcaggaagcccagaatgcaaggatcgagatcgcacagaagcaccctgatatctacgcagtgcccattaagactcacaaaccagatccgggaacacctcagcacacatcaagtcgtcctcctgaaccccaaaaggcaccttccagaccataccaggatacccgcggatcctacggcagcgacgcagaggaggaagaatatcggcagcaactgtccgagcacagcaaacgcggatactatggacaatccgcgcgatacagagacacagagctttag

SEQ ID NO: 244133 - DNA, 3666 bp, Artificial Sequence
  Description of Artificial Sequence: Synthetic coding sequence
atgaagacagctcaggccttacaccgtatgtggattcaggcggtgaaaaaactccggcgatggaaggggcgagtctcccctagtgcttcttcccctctcgtgtttcccaacctgtccagttgggaaggagaggggtccaaaacaattcttacagcgcctggcatggaggagctcatctgggagcaatacaccgtgaccctccagaaggattccaaacgcggattcggcattgccgtgtccggaggacgcgacaatccgcactttgagaatggtgaaacttcaatcgtgattagcgatgtgctcccaggcggacctgcagacggcctgcttcaagagaacgaccgggtagttatggtgaatggcaccccgatggaggatgttctgcatagcttcgctgtccagcagctgcgtaagagcggaaaggtcgctgctatcgtggtaaagaggcctcggaaagtccaggtggcggcactgcaggcctctccccctctggatcaggacgatcgggcttttgaagtgatggacgagtttgacggacggtccttccgttccgggtactcggaaaggtctcgtttgaactcccatggcggtcggagtagaagctgggaggactcgccagaacgaggcagaccccatgaaagagccaggtcacgcgagcgtgatctctcacgtgatcgatcgcgcggtcggtcccttgagcggggtctcgatcaagaccacgcacgtaccagagatcggtcccgcggacgaagcctggagaggggtctggatcatgacttcggccctagcagggatagagatagagatagaagcaggggccgatcgatagaccaggattatgaaagggcctaccatcgagcctatgatcccgactatgagagggcttattctcccgaataccgaagaggggcaaggcacgatgccagatcccgcggacctcgctctcggtccagagagcatccccactctagatctcccagccctgagccaagggggagacctgggccaatcggtgtgctgctcatgaaaagcagggctaacgaagaatatggtcttcggctgggctcccagatattcgtcaaagaaatgacacgaaccggtctggctacaaaagacggcaatctccacgaaggagacatcatcctgaagatcaatgggactgtgaccgagaacatgagcctgacggacgccagaaagttaattgaaaagtcccgcggtaaactgcagcttgtggtgctgcgtgattcacagcagaccctcataaacatcccatccctgaacgacagtgattcagaaattgaagacatttcggagatagagtcaaaccgtagtttttcacccgaagagcggcgacatcagtatagtgactacgactaccattcctcctccgaaaagttaaaagaaagaccctcctccagagaagatacccctagccggctgtccaggatgggcgctacacccacacccttcaaatcgactggcgacatcgcgggaaccgtagtaccggaaactaataaggagccacggtaccaggaagaccctccagcaccgcagccaaaagcagctcccaggacgttcctgcgcccttcaccagaggatgaagccatctatggtcccaataccaagatggtgagattcaagaagggggattctgtaggcctgagactggcaggaggcaacgatgtgggaatctttgttgccggaatccaggagggcacgtccgcggaacaggaaggtctgcaagaaggagatcagatccttaaagtgaacacccaggattttagaggtctggtgcgggaagatgccgtcctttacctgcttgaaattccaaagggcgaaatggttaccattcttgctcaaagtcgagctgacgtttacagagatatcttggcctgcggccgtggggattcgttcttcattcggtcccatttcgagtgcgagaaggagactccacaaagtctggccttcacccgcggtgaggtgttccgcgtggttgatactttatatgatggaaagttaggcaactggctggccgtgagaatcggcaacgagctcgaaaagggtctgattcctaataagagcagggcggagcagatggcttccgtacagaacgcccagcgagataacgcaggagatcgcgctgatttttggagaatgcggggtcagaggtccggggtgaagaagaatttgagaaagtcgcgggaggacctgacggccgtcgtttctgtgtccacgaaattccccgcttatgagcgtgttctactgcgggaagcaggattcaagcgccctgtagtgctgtttggccctatcgcagatattgctatggaaaaactcgcaaatgagctcccagattggttccaaactgctaagaccgaaccaaaggatgcgggatctgaaaaatcgacaggtgtggtgagactgaacacagtcaggcaaattatcgagcaggataaacacgctttgctcgatgtaaccccgaaagctgtggacctgctgaactacactcagtggtttccaatagttattttttttaatcccgactcaagacaaggtgttaagacaatgagacagcgcctgaatcctaccagcaacaaaagctccagaaagttgtttgaccaggccaacaagctcaaaaagacatgtgcacaccttttcaccgctactattaacctcaattctgctaacgacagttggttcggcagcctcaaggacaccatacaacatcagcaaggcgaagcggtttgggtctccgaagggaagatggagggcatggatgacgatcctgaagacaggatgagctacctgaccgcaatgggcgctgactaccttagttgtgattcccgtcttattagcgacttcgaagatacggacggtgagggcggtgcttatacagacaatgagctcgacgaacctgcggaagagcctttggtttcgtctatcaccaggtcttcggagcctgttcagcacgaggagtctattcgcaagccctcccccgagcctcgtgcgcagatgaggagagctgcctcctccgaccagttacgagataactctcccccacctgcatttaagccggaacccccaaaagccaagacgcagaataaggaggaaagctatgacttctccaagagttatgagtataaatctaaccctagcgccgtggctgggaacgagactcctggggcaagcaccaagggataccccccaccggtagcagcaaaacctactttcgggagatcaatcctgaagccaagcacccccataccacctcaggagggcgaggaagtcggggagagttctgaagaacaggacaatgctcccaaatctgtattagggaaggtgaaaatattcgaaaaaatggaccataaagcaaggttgcagagaatgcaagagttgcaggaagcccagaacgcaagaattgagattgcccaaaagcatccagacatctatgctgtacccattaaaacccacaaacccgaccctggaacgcctcagcatacgtcatccaggcccccagagccgcagaaggcaccaagcagaccctaccaggacacccgcggaagttatggtagcgacgcagaagaggaggagtataggcagcagctctccgagcatagcaaaaggggctattacggacagtctgcaaggtaccgggacaccgagttatag

SEQ ID NO: 244134 - DNA, 2787 bp, Artificial Sequence
  Description of Artificial Sequence: Synthetic coding sequence
atggccgtgagattccaggtggccgacatggaagagttgaccatttgggaacagcacacggctactctcagcaaggatcctaggcggggatttggaatagccatcagcggcggaagagacagacctggaggaagtatggtggtcagcgatgtcgtgccaggagggcctgctgagggcaggctacagaccggcgatcacatagtgatggttaatggagtttcaatggaaaacgccaccagcgcttttgcgattcaaatcctgaagacgtgtactaagatggctaatatcactgttaaaagaccacggcgaattcatcttccggcaaccaaggctagtcccagcagccccggtcgacaggacagcgacgaggatgacggccctcagagggtcgaggaagttgatcaggggagagggtatgatggcgattcttctagcgggtctggaaggtcctgggatgagcggagcagaaggccaaggcctgggagaaggggccgagcagggtcccacggaaggaggagccccggaggtggatccgaggctaacggactggctctggtcagtggtttcaagcgccttcccagacaggatgtgcaaatgaagccggtgaaatccgtgctggttaaacgccgagattcagaggagtttggcgtaaagctgggaagccagatctttattaagcacattactgacagtggattagccgctaggcatagaggactacaggagggagacttaattctgcagatcaatggtgtctccagccagaatttatcactgaacgatacaaggaggctgatcgaaaaatccgagggcaaactcagcctcctggtgctgcgtgataggggccaatttctggtcaacatccctcccgcagtgagcgacagtgactccagtcccctggaggatatttccgacctcgcatcagagctgagtcaggctcctccctcacacattcctcccccacccaggcatgcacagcgtagtcctgaagccagtcagactgacagccctgtggaaagcccacggctgagaagggaatccagtgtcgacagccggacgattagcgaacctgacgagcagcgaagcgaactgccacgcgagagctcatacgacatctacagggtgcccagcagccaatcaatggaggaccggggttattcccccgacacgcgagtggttagatttctgaaggggaaaagtattgggttgagacttgccggtgggaacgatgtgggaatcttcgtgtctggcgtgcaggcgggaagccccgctgatggtcagggtatccaggaaggtgaccagatattacaggtgaatgacgtgcccttccaaaaccttacccgtgaggaagccgttcagttcctgctagggctgccacccggagaagaaatggaactggtgactcagcgcaaacaggacatcttctggaagatggttcagtctcgtgtgggagattcgttctacatccgcacacatttcgaattagaaccatctccacccagcggacttggattcactcgcggagacgtgtttcatgtgctggacaccttgcacccaggcccaggccaatcacacgctagaggagggcattggctggccgtgagaatggggagggacctgcgggaacaagaacggggtatcatacccaatcagagcagggccgaacagttggcctctctcgaagccgcacaacgcgctgtgggggtgggcccaggatcatcagccggtagtaacgctcgtgctgagttctggagacttcggggactcagacgaggggctaagaaaaccactcagcgctcacgtgaggatctgtccgcacttacacgccaggggcgatatcccccttacgagagagttgtcctgagagaagcatccttcaagcgcccagttgtgattctcggtcctgtagctgacattgcgatgcagaagctgaccgccgaaatgccagatcagttcgagatcgctgaaaccgtatcacgaactgacagcccatctaagatcatcaagttggatacagtgagggtcattgccgagaaggataaacacgccttgttggatgtaaccccgtccgccattgagcggctcaactatgtgcagtactatccaatagtcgtgttttttatccccgagagcaggcctgccctcaaggcacttcggcaatggctagctccggcttcgcggcgatctaccaggcgcctgtacgcccaagcacaaaagctgaggaagcattcaagccatctctttacagctactatccctctcaacggaaccagcgacacttggtaccaagaactcaaggccataattagagaacagcaaaccaggccaatctggactgcagaggatcaactggacggttctctcgaggacaacctggatctgcctcaccacggccttgccgatagcagcgccgacttatcatgtgacagcagagtgaacagcgactacgagactgacggcgaggggggtgcatacactgatggtgaggggtataccgacggcgaaggtggtccttacacagacgtggacgatgagccacctgctccagctctggccaggtctagcgagcccgtgcaggccgacgagagccagtcaccgagggatagaggaagaatcagcgcccatcagggcgcacaggtggattcacgacaccctcagggacagtggaggcaggacagcatgcggacgtatgaacgggaagctctgaaaaagaagtttatgagagtgcacgatgccgaatcaagtgatgaagatgggtacgactggggtcctgccaccgatctgtag

SEQ ID NO: 244135 - DNA, 2859 bp, Artificial Sequence
  Description of Artificial Sequence: Synthetic coding sequence
atgaatctgtgcggattgatgccaatatttcctgcacccttagatcaagtggcagatatggaggagttgacaatttgggagcagcatacagccaccttgagtaaggatcccaggcggggattcggcattgcaataagcggtggaagagaccgccctgggggatcaatggtcgtttcggatgtggtgcccggagggcctgcagaagggaggctgcagacaggcgaccacatcgtaatggtaaacggagtctcaatggagaacgcaacaagcgcattcgcaatccagattctgaaaacctgcaccaagatggctaacattactgtgaaaagacctcggagaatacatttacccgctaccaaagccagtccttccagcccaggaaggcaggattccgatgaggatgacggaccccaaagggtcgaggaagtggatcaaggtagaggatacgacggcgactcttcgagtggcagcggcagaagctgggacgagcgctcacgacgtcctcgcccaggacgacgcggtcgagctgggtctcacggcagaagatctcccggaggcggatcagaagccaatggcctggccctggtttctggtttcaagcgactacctcggcaggacgtccaaatgaagcccgtgaagtcagttctcgtgaaaaggcgagattccgaagagttcggcgtcaagttgggttctcagatattcatcaaacacattaccgacagtggtctggcagctagacaccgagggctacaagagggtgacctgattttacagataaacggggtgagctcacagaatctttcactcaacgatacgcggagactaattgagaaatctgagggtaaactctcgctcctagtgttgagggatcggggtcagtttctcgtgaatatcccaccggctgtaagcgactctgactccagtccgcttgaggagggtgtgacaatggccgacgagatgtcatctcctcctgctgatatttccgacttggcctcagagctcagccaagcacccccatcgcatatccctccgccaccacggcacgcccagaggagtcccgaggcgtctcagaccgactctccggttgagtcccccagattgcgcagagagagtagtgtcgactcaaggacgatatccgagccggacgagcagcgaagtgaactgcccagggagtctagctacgacatttacagggtcccctccagtcagagcatggaggacagggggtactctccagacacacgcgtggtgaggttcctcaaggggaagtcgatcggtctgagactcgctggcggaaacgacgtcgggattttcgtgtccggggtgcaggcaggatctccagctgacggacaaggaattcaggaaggggaccaaattctacaagtcaacgatgtgcctttccaaaacctcacccgcgaagaggccgtgcaattcctgttgggtctgcctcccggagaggaaatggaactcgtgactcagaggaaacaggatatcttctggaaaatggtccagtctcgggtgggagactcattctatatcagaacacattttgagctggagccttcacctccttctggcctgggattcacgagaggggatgtctttcacgtccttgacacactgcaccccggaccaggtcagtctcatgctcggggaggccactggttggctgtccgcatggggagggacctgcgggagcaagaacggggaattatccctaaccaatcaagagcggaacagctggccagtttggaggcggcacagcgggctgtcggcgttggccctggttcaagtgccggtagcaatgctcgcgctgagttctggcgtctccgcggactgaggcgcggagccaaaaaaacaacccagcgaagcagggaagatctctctgccctgaccaggcagggacgttaccccccttacgagagggtagtcctacgtgaagccagcttcaaacgtccagtcgtgattctaggtcctgttgccgatatcgccatgcaaaaactgacagcagaaatgcctgatcagttcgagatcgcagagacagtatctcgaaccgactcgccttccaagattatcaaattggacacagttcgggtgattgctgagaaagacaagcacgctctactggacgtgactccaagcgctatcgagaggctcaactacgtgcagtattaccccattgtagtgttcttcatccctgagagcaggccggctctcaaggctttacgccagtggctggcaccggcaagccgccgttcgacaaggcgtctttatgcccaggcccaaaaactccggaagcactccagtcatttgtttaccgccaccatccctttgaacggaacgtctgacacctggtaccaggagctgaaagcgattatccgcgagcagcagacaagaccaatatggacagccgaggaccagttggatggctccttggaggataatctggacctcccacaccacgggctggccgactccagtgctgatcttagttgtgatagccgtgtgaatagcgattatgaaacagatggcgagggaggcgcttataccgacggagaaggatataccgacggtgagggcggaccatacaccgacgtcgacgatgagccacccgcacctgctttagcaaggtcttctgagcctgtgcaggctgacgagagccagagtccgagggaccgcggaagaatctctgcccatcaaggggctcaagtggacagcagacatccccaaggccaatggagacaggactctatgcgtacctacgaacgcgaagccctgaagaagaagttcatgcgtgttcacgatgcggagtcctccgatgaggacggctatgactgggggcctgccactgacctatag

SEQ ID NO: 244136 - DNA, 2802 bp, Artificial Sequence
  Description of Artificial Sequence: Synthetic coding sequence
atggaggagcttaccatctgggagcagcacactgctacactgagtaaggacccacggagaggattcggaatcgccatttcagggggaagagataggcccggtgggtcaatggttgtgtccgatgtcgttcctggtggaccggctgagggccgactgcaaacaggagaccatattgtgatggttaatggcgtgtcgatggagaacgctacctccgcgttcgcaattcagatcctgaaaacttgcacgaagatggcaaatataactgtaaaacggccaagaagaattcaccttcccgctacgaaagccagcccttcatcgccaggacgtcaggattctgacgaggatgacggtccacagcgagttgaagaagtcgaccagggcagggggtacgatggggacagctcctctggtagcggacgctcatgggacgaaaggtccagaaggccgaggccgggaagaagaggcagggccggatcccacggcagacgctcaccaggcggagggtctgaagccaacgggctggctctggtgagcgggtttaagaggttaccaagacaggatgtccagatgaaacctgtgaagagtgtgctggtaaaaaggagggattccgaggagttcggggtgaagctggggagccaaatttttatcaaacacattacagatagtggtctggctgcgaggcaccgagggttacaggagggggacctgattctacagatcaatggcgtctcttcccagaacctgtcattgaatgacacaaggcgccttatcgaaaagtccgaaggaaaactttcactcctcgtgctcagggaccgtggtcagtttctggtgaacattcctccagctgtatctgactcagactctagcccgctggaagaaggcgtcacgatggcagatgagatgtctagccctcctgccgacattagtgatctcgcttctgaattgtcgcaggccccacctagccatatcccccctccaccaaggcatgcgcagcgtagtcccgaggctagtcaaaccgattcgccagtggaatctcctagactgcggcgagaatcgtccgtcgacagccgcaccatcagcgagcccgatgagcaaaggtctgagcttcccagggagtcatcttacgatatctacagggtcccttcctctcaatccatggaagatagaggatactctcctgatactcgcgtcgtcagattcctgaaaggaaagtctatcggattaagacttgctggcggtaatgacgtggggatttttgtcagtggtgtgcaggccggaagtcccgctgacgggcagggcatccaggagggagaccagatcctgcaggtcaacgacgtgcctttccaaaatctgacacgtgaggaagctgtccagtttctgcttggactgccacccggagaggaaatggagctggttacgcagcggaagcaggatattttctggaaaatggtgcaatcccgcgtgggcgactcgttctacataagaacgcacttcgagcttgaaccgtcgccaccgagcggcctgggctttaccagaggtgatgtgttccatgtgctggacacactccacccgggtcctggacagagccatgccaggggtgggcattggcttgccgtgcgaatgggtcgagatctgcgcgaacaagagcgtggtattatacccaaccaatcgcgggcagagcagcttgcatcactggaagccgctcaacgtgcagtaggcgtaggccctggaagttctgccggttccaatgccagagccgagttctggcgacttcgtggcctgcgcaggggcgcaaagaaaactacacagcgatccagagaagatcttagcgcactgactagacagggcagataccccccttacgagcgtgttgtcttacgggaggcgtctttcaaaaggcctgtggtcattttaggacctgtggcggatattgccatgcagaaattaaccgccgaaatgccagaccagttcgagatagcagagacagtgagtcgcactgactctccatcaaagattattaagcttgacacagtgcgagtgattgctgaaaaggataaacacgcgctcctagatgtgacaccaagcgccattgagagactcaactatgtccagtactatccaatcgttgttttcttcatccccgaatccagaccagcactgaaggctctgagacagtggctggcccctgcttcaagacggagcactcgacgcctgtatgcccaggcgcagaagctgcgcaagcactcatcacatttgtttacggcgacgatacccctaaacggcacctccgacacgtggtatcaggaactgaaagccatcatccgggagcagcagacaagacccatttggacggcggaagatcagctcgacggcagtcttgaagataatctggatcttcctcaccacgggctcgccgactcttcagccgacctttcttgcgatagccgcgtgaattcagattatgagaccgacggtgaaggtggggcatacacggatggcgaggggtacacggatggagaaggtgggccatatacggatgttgatgacgaacccccagctcctgctctagccagatcgtccgagccagttcaggctgatgaaagccaatcgcccagagatagaggtaggattagtgctcaccagggggcacaagtagacagtcggcacccccagggacagtggagacaggattcgatgagaacctacgagagagaggccttgaagaagaagtttatgagggtgcacgacgccgagtctagtgatgaggacggatatgactgggggccagcaaccgatctgtag

SEQ ID NO: 244137 - DNA, 2652 bp, Artificial Sequence
  Description of Artificial Sequence: Synthetic coding sequence
atggtggtttctgatgtggtgcctggaggacccgctgaaggacgccttcagacaggagatcacatcgttatggttaatggggtgagcatggagaacgctacctcagcctttgcgatccaaattctcaagacctgtaccaagatggcgaacataactgtgaaacgaccacgacggatacatctccctgccacaaaggctagcccttcttcaccaggccgacaggacagcgatgaggatgacggtcctcagcgcgtggaagaggtggaccaaggacgcggatacgacggtgacagtagctcagggtctgggaggagctgggacgagaggtctcggcgtcctaggccaggcaggaggggtagggccggatctcatggacgcaggtcgccgggtggtggcagcgaagccaacgggctcgctctggtctctgggtttaaaagactgcccaggcaggacgtgcaaatgaagcccgtcaagtccgttctggttaagcgcagagactccgaggagtttggggtcaaactgggatcccagatcttcatcaaacatatcacagactccggtttggccgctcgccaccggggattgcaggagggtgatttgatcctgcagattaatggcgtgtcctcccaaaatctgtctctcaatgatacccggagactcatagagaaatcagaagggaagcttagtctactcgttctaagagataggggccagttcctggtcaacatccctcccgctgtgtctgactccgatagctctcccttagaggatataagtgatctggcctctgagctgtctcaggcccctccctcacatatcccacccccacccagacatgctcaacggtcgccagaggctagtcagacagatagtccagtggaatcccccaggctcagaagggaatcgagtgttgattctcgaactattagtgaacccgatgagcagcgcagtgagttgcccagggagtcctcatatgatatttatagagtcccgagttcccagagtatggaggacaggggttactctcctgataccagagtagtgcgttttctaaaggggaagtcgatcggtctgcgcttggctggaggtaacgacgtgggcattttcgtgtccggggtccaggccggatctcctgctgacggccagggcatccaggaaggagaccagatactgcaggtgaatgatgtgccattccaaaatctgacacgcgaagaggctgttcagttcctgctcggcctgcccccaggagaggaaatggagttggttacccagcgcaaacaggacatcttttggaagatggtccagagccgagtcggggattctttctatattagaacccactttgaattggaaccatccccacccagtggcttaggcttcacaaggggcgacgttttccatgtgctcgacacactgcaccctggcccaggtcaatcacatgcccgtggtggacattggttggctgtgcgaatgggacgcgacctccgagagcaggaacgcggtattattccaaaccagtcccgggctgagcagctggcttcactggaggcagcacagcgcgcagtgggcgttgggcctgggagcagcgcaggcagtaacgccagagcagagttctggcggctccgaggcctgcggaggggggctaagaaaacgactcagaggtctagggaagacttaagtgcactgacaagacaagggcgatatcccccatatgagcgggtggtactgcgggaggcctcattcaagcggccagtcgtgatcctcggacccgtggccgacatcgcgatgcagaaattaaccgccgagatgcccgaccagtttgagatagcggaaaccgtttctcgaacagacagtccatctaagattatcaagctggacaccgtacgtgtgatcgctgagaaggacaagcacgccttgctggacgtgaccccctcggcgatcgagcgactgaactatgtacagtactaccctatcgtggttttcttcattcccgagtccaggcctgctttaaaggctctgcgccagtggcttgccccagcttcccgaagatctacccgcagactgtacgctcaagcgcagaaactgcgcaagcactcaagtcacctttttactgccactataccactcaatgggacttccgatacatggtatcaggagctgaaggcaatcattagagagcagcaaacaaggccgatttggacagcggaagaccaattggatggttcactcgaggacaatttagatctgcctcaccacgggctggccgattccagcgccgacctaagttgtgattcccgcgttaactccgactacgagaccgacggggaagggggtgcttacacggacggggagggctacacggatggcgaggggggaccctacacagacgtagacgatgagcctcctgccccagcactggcaagaagttcagaaccagtgcaggcggatgagtcacagagtccacgggacagaggcagaatttcagcgcaccagggcgcacaagtggattcacggcacccccaggggcaatggcggcaggattctatgaggacctacgagagagaggccctcaaaaaaaaattcatgcgggtgcacgacgccgagagcagcgatgaggatggctacgactggggccctgctactgatctatag

SEQ ID NO: 244138 - DNA, 2760 bp, Artificial Sequence
  Description of Artificial Sequence: Synthetic coding sequence
atggaggaactcacaatctgggagcagcataccgccactctcagcaaagatcctcggagaggatttgggatcgctatcagcgggggacgggacaggccaggcggttcaatggtggtgtccgacgtcgtcccgggaggcccagccgaagggaggctccagacaggtgatcacattgttatggtgaatggagtgtccatggagaacgcaaccagtgcctttgccattcagattttgaagacatgtaccaaaatggccaacattacggtgaagaggcctaggcggatccacctccccgcaaccaaagcatctccctcgagccccggaaggcaggattctgacgaagacgacgggccacaacgagtggaggaagtagaccagggtcgtgggtatgacggagacagttctagcggaagcggcaggtcgtgggatgaaagatcccgacgtccccgaccaggacgcagaggcagagctggatctcatggacgtaggtcgcctggcggtgggagtgaggcgaacggcttggccctggtctcagggtttaaacgactgccaagacaggatgtgcagatgaagccagtgaagtcagtgctcgttaaaagacgcgacagtgaagaatttggcgtgaagctgggaagccagatctttatcaaacacataacagacagcggactcgcggcacggcacagggggttgcaggagggcgatctcatacttcaaatcaatggcgtttcaagtcagaacctgagcctcaacgatacacgacgcctgatcgagaagtccgagggcaaactttctctcctcgttctccgggatcgcggacagtttctggtaaacattcccccagccgtcagcgatagcgactctagccccctcgaggacatcagcgacctggcctctgaattgagtcaagcccctccatcgcacatccccccaccacctcgccacgcccagaggagccccgaggctagccagacagattctcccgttgagtcccctagactgcggagagagtcaagcgtggattcccgaaccatttccgagcccgacgagcaaagaagcgagctcccaagagagagcagttatgacatttatcgagtgccctcctcacagtctatggaagatcggggatattcaccggacacgcgggttgtccgcttcttaaagggcaagtctataggcttgagactggcgggaggtaacgacgtggggatattcgtgtcgggcgtgcaggctgggagcccggcagatgggcaaggaatccaagagggtgaccagatattacaggtgaacgatgtgccatttcagaatttaaccagggaagaggccgtccagtttcttctcgggcttcctcccggagaagagatggaactcgtgacccaacgcaagcaggatattttctggaagatggtccagtccagggtgggcgatagtttttatatccgaacccactttgagcttgaaccatcacctccttcaggcttgggctttacgcggggtgatgtcttccatgtcctagataccctccacccaggccctggtcagtctcacgcgagggggggtcattggctcgccgtgaggatggggcgagatctcagggagcaggagcgagggatcattcccaatcaatcccgagctgagcagttagcgtctctggaagccgcacaacgggctgtaggtgtagggccaggctccagcgccggatcaaatgctagagcagagttttggcgcctgcgagggcttagacgtggggcaaagaaaactacgcaaagatcccgggaagacctgtccgccctcacacgtcaggggcgttaccctccctacgagagggtggtgctgcgggaagcatcattcaagcggcctgtcgtcattctcggtccagttgccgacatcgctatgcaaaaactgactgccgaaatgccggatcagtttgaaatcgctgaaaccgtaagtaggaccgattcaccttctaaaattatcaagctggacacggtccgggtgatcgccgagaaggacaagcacgctctgcttgatgtcacccctagcgctattgaacgtctcaattatgtgcagtattaccccattgtggtcttcttcattcctgaatcaagacccgctcttaaagccctccggcagtggctggcaccggcatcccgcagatctactaggcgcctgtatgcgcaggctcagaagctgcgtaaacatagcagccatctgtttacagctacgattcctctaaatggcacttctgatacttggtaccaagaactgaaagcgatcatacgggagcagcagacacgacccatttggacggcagaagaccaacttgatggttccttggaggacaaccttgacctgccccaccacggcctggctgattcatcagccgacctcagctgcgactccagagtaaattctgattatgaaacagatggtgagggaggggcttataccgacggcgaggggtataccgacggggaaggcggaccttatactgatgtggatgacgagcccccagcacccgcactggcccgatcgagcgagcccgtgcaagctgatgagagccagtcccccagagatcgtgggcgaatctcagcccaccaaggggctcaggttgacagtaggcacccccagggccaatggcgacaggattccatgcggacctacgagagagaggccctaaagaagaaattcatgcgcgtccacgacgctgagagtagtgacgaagacgggtacgattgggggcctgcaacagatctgtag

SEQ ID NO: 244139 - DNA, 1623 bp, Artificial Sequence
  Description of Artificial Sequence: Synthetic coding sequence
atggtgaggacagatggccacactctcagtgaaaaacgcaattaccaggtgactaattcaatgtttggcgcaagcaggaaaaagtttgtggaaggggtggatagtgactaccacgatgaaaatatgtactactcacagtcctctatgtttcctcacaggagcgaaaaagacatgctcgctagtccctcaacatctggccagctgagccagtttggtgccagcctatacggacagcagagcgcgctgggcctgcctatgagggggatgtccaacaatacaccccaactgaatcggagcttgagtcagggaacacaactgccttctcacgtaacccccacaactggggtgccaactatgagtttgcacacacctccctccccctcacgaggaattcttcctatgaatcccaggaacatgatgaatcattctcaagtaggacagggcattggcataccctcccgcaccaatagcatgtcatcaagcggcctaggcagtccaaacaggtcgtctccttctatcatttgtatgcctaagcagcagccctctaggcaaccattcacagtgaacagcatgtctggattcgggatgaaccggaatcaagctttcggcatgaataactcgttgtcaagtaatatttttaacggcacagatggatctgagaacgtaaccggactcgacctgagcgactttcctgcactcgcagaccgcaatcgtagggagggttcgggcaaccccacacctctgattaatcctttggccggaagagctccatacgtgggcatggtgacaaagccggctaacgaacagtctcaggacttcagcatccacaacgaggacttccccgcactgccagggagtagctataaagatcccactagctctaatgacgattctaaatccaacctcaacacttcaggcaaaaccacgtcctccacggatggtcccaagtttcctggcgacaagtcatctaccacgcagaacaataatcaacagaaaaaaggcattcaagtgctgcccgacgggcgagtcactaacattcctcaggggatggtcacagatcagtttgggatgatagggcttctcaccttcatacgcgcagccgagaccgatcccggaatggtgcaccttgcgttgggcagtgatctcaccaccctcgggctgaatttgaatagtccggagaacctgtatcccaagttcgcgagcccctgggcctcctctccatgtcggcctcaggatattgactttcatgtcccgtccgagtacttaacaaacatccatattcgcgacaagctagctgcaataaagcttggcagatacggagaagacctgctgttctatctctattacatgaatggcggagacgtcctccaactcctggcggctgttgagctgtttaatcgggattggaggtatcacaaggaagagagagtttggataactcgagcacccggaatggagccaactatgaagacgaacacctatgagcgcggaacttactatttcttcgattgcttaaactggcggaaagttgccaaagagtttcacctggagtacgataaattggaggagcgcccacacttaccgtccacgttcaactataaccctgctcagcaggctttttag

SEQ ID NO: 244140 - DNA, 3627 bp, Artificial Sequence
  Description of Artificial Sequence: Synthetic coding sequence
atggatctgcacatgatgaattgcgagctgctcgccacctgctcagccctggggtatctcgagggcgacacatatcataaggagcctgactgtcttgagtcagtaaaagacctgatccggtacctgaggcacgaagatgaaacaagagacgtgagacagcaactgggtgccgcacaaattctgcagtccgacctactcccaatattaacacagcaccaccaggacaagcctctgtttgatgccgtgatccggcttatggtcaatttgacccaacccgcactgttgtgctttgggaatctaccgaaggaaccatcttttcgacaccacttcctgcaggtgctgacctacctccaggcgtacaaggaagcatttgctagtgaaaaggccttcggggttttatctgagacattatacgagttacttcagttaggttgggaggagaggcaagaggaggacaaccttctgattgaacgaattctgctacttgttcgtaatattctgcatgtgcccgctgatctggatcaggaaaaaaagatagatgacgacgcgagcgcccatgatcagctactctgggctatccacttgtccggtttggacgacctgctgttattcctagcatctagttccgcagaggaacagtggagcctacacgtgctcgagatcgtgagcctgatgtttagggatcaaaaccccgagcagttggccggagtcggtcagggcagactggctcaagaaagaagtgctgactttgcagaattggaggtactgcggcaaagggagatggccgagaagaaaaccagagccctgcagaggggaaaccgacactcccgctttggcggatcatatatcgtgcagggccttaaaagtattggcgaacgcgacctcatcttccataaaggtcttcacaaccttagaaactatagttccgatctcggcaagcagccgaaaaaggttcccaagagacggcaggccgctagggaactgtccatacaacgcagaagcgcgctgaacgttcgactgtttttacgggacttctgctccgagttcctagaaaactgttacaatagattgatggggagcgtcaaggatcatctactgcgggagaaggcccagcagcacgatgaaacttattacatgtgggctctggccttttttatggcgttcaaccgagccgcatcctttagaccgggactggtctccgagaccctctccgtaaggacattccatttcatagagcaaaatttaacgaattattatgagatgatgctcacagacaggaaagaggcggcaagctgggctcgacgcatgcacttggctttgaaagcctaccaggagctgttggcaaccgtcaatgagatggacatttcacccgatgaggctgtgagagagagtagtagaataataaagaacaacatcttctacgtgatggaatatcgagaactgttcctcgccttgtttaggaagtttgacgaaagatgtcagcctaggtccttcctgagggacctggtcgagactactcacctcttcctgaagatgcttgagcggttttgtcggtcccggggtaatctggtagtgcaaaataaacagaagaagagacggaaaaaaaaaaagaaggtgctggatcaggcaatcgtgtccggtaatgtcccatccagcccagaagaggttgaagcagtgtggccagcactcgctgagcaacttcagtgctgcgctcagaacagcgaactgagcatggattcagtggtcccgtttgacgccgcatctgaggttcccgtcgaagagcaacgggcagaggccatggtgcggatccaagactgcctcttggcaggccaagcaccccaggccttgacacttctgcgctcagctcgtgaggtttggccagagggagatgtttttggctcccaggatatttcccccgaagaggaaattcagctactgaagcaaattctttctgcccctctccccagacagcagggacccgaagagcgcggagccgaggaggaggaggaggaagaggaagaggaggaagaggaactacaggtcgtccaggttagcgaaaaggaatttaactttctcgactacttgaagcggtttgcctgcagtaccgtcgtgagagcttatgtgctgttactgcgctcttatcagcaaaatagcgcacacactaatcactgtatcgtaaagatgctgcacagactcgcacacgatctaaaaatggaggccttactgttccagctctctgtcttctgtctgtttaacagactcctgtcagacccagctgccggagcctacaaggaactggtgacatttgcaaaatatatcctcggaaaattttttgccctggcagccgtaaatcagaaagcctttgtggagctgctcttttggaaaaatacagctgtagtcagagagatgacagaagggtacggaagcctggatgacaggagctcaagccgtcgcgctcctacttggagtcctgaagaagaagctcatctgcgggagttgtatctggcaaataaagatgtggagggccaggatgtggtggaagcaattctcgcgcacttgaatactgtcccaagaacccggaagcagattatccaccaccttgtgcagatgggactagcagattccgtgaaggacttccaaagaaagggaacccacatcgtgctgtggaccggcgaccaagagttggagctgcaacgtctgttcgaggagtttagagattccgacgacgtgcttggccatatcatgaagaacatcaccgcaaaacgctcacgcgcacggatagtggacaaactcctcgccctgggtttagtggccgagaggagggaactgtacaagaagcgacagaaaaagctggcctcatccattttacctaacggcgcagagtcactgaaagatttctgccaggaggacctagaggaagaggagaatctgcctgaggaggacagcgaggaagaggaggaggggggaagcgaggcagaacaggtgcaaggttccctcgttctgagtaatgagaatttgggacagtctctgcatcaggaaggattctcaatcccattactttggctccaaaattgcttgatcagagcagctgatgacagggaagaagacggttgcagccaggcagttcccttagtacccctcacggaggagaatgaggaagcaatggaaaatgaacagttccagcaactcctgcggaagctgggggtacggcctcctgcctctggtcaagagactttctggcgcatacctgcgaagttatctcccacgcagctgagaagagccgctgcctcattgagccagcccgaggaagagcagaagctgcaaccggagctgcagcccaaggtacctggagagcaggggagtgatgaggagcattgcaaagagcacagggctcaagctttgagggccctattattggctcataaaaagaaggcaggcctggcttctccagaagaggaggatgcggtcggtaaggagccacttaaggcggctcctaagaagcggcagctgttggattctgatgaagaacaggaagaggacgaggggaggaatagagccccagagttaggagcaccaggtattcagaagaaaaaacgctatcagatagaagatgatgaggatgattag

SEQ ID NO: 244141 - DNA, 906 bp, Artificial Sequence
  Description of Artificial Sequence: Synthetic coding sequence
atgctggaaccccaggagaatggcgttattgacctgcccgactatgagcatgttgaggacgagacatttcctccctttccccctcccgctagtccagagcgtcaagacggggaggggaccgaaccagatgaggaaagcgggaatggcgctcccgtgcgggtgccgcctaaacgcaccgtcaagcgaaatattcccaaactggatgctcaaagactgatctccgaaagaggactgcccgctctgagacatgtgtttgataaggcaaagttcaagggtaaagggcacgaggccgaggatctcaagatgttgatccggcacatggaacattgggcccacaggctcttccctaaacttcagttcgaggattttatcgaccgagtcgagtacctgggatccaaaaaggaggtccaaacgtgcttgaaaagaattagactagacctgcccatcttgcacgaagactttgtgtcgaataatgatgaggtagccgaaaataatgagcacgacgtgactagcaccgagttagacccattcctcactaatctcagcgagtccgagatgttcgcttcagaattgagccgttcccttaccgaggaacaacagcagaggattgagaggaataagcagctggccctggaacgacgccaagcaaagttgctgagcaattcacaaacacttggaaatgatatgctgatgaatactcctcgtgctcacaccgtggaggaggtcaacactgatgaagatcagaaggaagagagtaacgggctcaacgaagatatactggacaatccttgcaacgacgcaatcgctaatacgctgaatgaggaggaaactttgctggaccaatcattcaaaaatgtgcagcagcagctggatgctacatcccgaaacatcactgaggccagatag

SEQ ID NO: 244142 - DNA, 603 bp, Artificial Sequence
  Description of Artificial Sequence: Synthetic coding sequence
atgctcattaggcatatggagcattgggcacaccgcctgttccccaagctacagttcgaggattttatcgacagggtcgagtatctgggctccaagaaggaagtgcagacgtgcctgaaaaggatccgcctggacttgcccatcctccatgaagattttgtgtctaacaacgatgaagtagcggagaataatgagcatgacgttacttctaccgaattagaccctttcctgactaacctgagtgagtcggaaatgttcgccagtgaactgtcccgaagcctgaccgaggagcaacagcagcgtatcgaacgcaacaaacagcttgccctggagcgcagacaggctaagcttttgtctaactcccagactctgggcaacgatatgctgatgaacactcctcgggctcacacagtggaggaagtgaatactgatgaggaccagaaggaggaatctaacgggttgaacgaggacatactggataatccatgcaatgacgccattgctaacactctaaacgaagaagagacgctgcttgaccagagtttcaagaatgtgcagcagcagcttgacgccacttccaggaatatcacagaggcaagatag

SEQ ID NO: 244143 - DNA, 537 bp, Artificial Sequence
  Description of Artificial Sequence: Synthetic coding sequence
atgatgatccacgggttccagagttctcatcgggacttctgctttggtccgtggaaacttactgccagtaaaacacatatcatgaaaagcgctgatgtcgaaaagctggcagacgagttgcatatgccatccttgcctgaaatgatgttcggagacaacgttttacgtattcagcacgggagtggttttggcatcgagtttaacgcaacggatgctcttaggtgtgtcaacaactatcagggaatgctgaaagttgcttgcgcagaggagtggcaagagagccggacagagggggaacactcgaaagaggtgattaagccttacgattggacctacactacagactataaaggcaccctcctcggggagtcactaaaactgaaagttgttcctacaacggaccacattgacaccgagaaactcaaagccagagaacagattaagttcttcgaagaggtgctgcttttcgaagatgagttgcatgaccacggtgttagctctctttctgtcaagatccctgggggaggccatctgtag

SEQ ID NO: 244144 - DNA, 819 bp, Artificial Sequence
  Description of Artificial Sequence: Synthetic coding sequence
atgatgatccatggctttcagagttcccaccgcgatttttgcttcggcccatggaagctgacagcatcgaagacccacatcatgaaatctgctgacgtggagaagttagccgacgagctccacatgccatcactcccagaaatgatgttcggcgacaatgttctgagaatacaacatggctcgggcttcggaattgaatttaacgctactgatgctttgcgttgtgtgaataactaccaaggaatgctgaaggtggcgtgtgccgaggagtggcaggagagccggaccgagggggaacatagtaaggaggtgattaagccctatgattggacttacactactgactataaggggacattactgggggaatccctgaagttgaaggtcgtccctactacagatcacatcgataccgagaagctgaaagccagagaacagatcaagttctttgaggaggttctgctgtttgaagatgagctgcacgaccatggagtgagctctctttctgtgaagatcagggtgatgccttcctctttctttctgctgttacgattcttcctacgtatcgacggagttctgatacgcatgaacgatactaggctgtatcatgaagccgataagacctatatgctgcgcgagtacaccagtcgcgagagcaagatctcctcactcatgcacgtgcccccatccctgtttacggagccaaacgagatttctcaatacttgccaatcaaagaggccgtttgcgaaaaactgattttccctgagcggattgatcctaatccagccgactcccagaaaagtactcaggtggagtag

SEQ ID NO: 244145 - DNA, 1143 bp, Artificial Sequence
  Description of Artificial Sequence: Synthetic coding sequence
atgacagaagaggttattgtgatcgccaagtgggattacactgctcagcaggaccaggagctggatatcaaaaaaaatgagcgcctgtggctgctggatgattccaagacctggtggcgcgtgcggaacgccgcaaatcgcaccgggtatgttccctccaactatgtcgagcgaaagaactctttaaagaaaggcagccttgtgaaaaatctcaaagacacattggggttgggtaagacgaggaggaagacgagcgccagggacgcctcccccaccccatcgactgatgcggagtaccctgctaatggatcaggcgcagatcgcatttacgaccttaacataccagcgttcgtcaaatttgcctacgtggctgaaagggaggacgagctgtccctggtaaaggggtctcgggtcaccgtcatggaaaaatgcagcgacgggtggtggagagggagctacaatgggcaaatcggctggtttccaagcaactacgttcttgaggaggtggatgaagccgcagccgaatccccgagtttcctgtccttaaggaaaggtgcctccctatctaatggacagggatcccgagtgcttcacgttgtgcagactctgtatcccttctcttcagtgactgaggaagagttaaactttgagaaaggggagaccatggaagtgatcgagaagccggaaaacgaccccgaatggtggaaatgcaagaacgcgagaggccaggttggactagtaccaaaaaactacgtggtggtgttgtctgatggccctgctttgcatcccgcacacgcaccgcagatcagttacacgggcccatcctcctccggacggtttgccggtcgggaatggtactatggcaatgtgaccaggcaccaggcagagtgcgctttaaacgagcggggagtggagggtgactttctgatcagagatagtgaatctagcccctccgatttttccgtgtccctcaaagcgtccggaaagaacaaacacttcaaggtgcagctcgtggacaacgtttactgcatcggacagagaaggttccatacaatggatgaattagtggagcactacaaaaaagcacccatcttcactagcgagcacggcgagaagctgtatttagtcagggctctccagtag

SEQ ID NO: 244146 - DNA, 756 bp, Artificial Sequence
  Description of Artificial Sequence: Synthetic coding sequence
atgatctacacaatgaaaaaggtgcacgccctgtgggccagtgtgtgcctgctccttaacttggcgccagcccctcttaacgctgactcggaagaagacgaggaacacactatcatcaccgacaccgagctgcctcctctaaagctgatgcatagcttctgcgcctttaaggctgacgatggcccttgcaaagccataatgaagcgatttttttttaatatcttcactcggcaatgtgaagagtttatctacgggggatgtgaaggaaatcaaaaccgcttcgagtccctagaagagtgtaagaaaatgtgtacaagggacaacgcaaataggattatcaaaactacattacagcaggagaagccagatttttgtttcttggaagaagaccccggtatttgcagaggttacataacacggtatttctacaataaccagactaagcaatgtgaacgcttcaagtatgggggttgcctggggaatatgaacaattttgaaaccctcgaggagtgtaagaatatttgcgaagacggtccaaacggatttcaagtcgacaactacggcactcagctgaacgctgtgaataactcccttacaccccaatcaacgaaagtgccttctctgtttgtgacaaaggagggaaccaacgatggatggaaaaacgccgcacacatatatcaggttttcctgaatgcattttgtatccacgcctctatgttctttctagggttggactcaatcagctgtctctgttag

SEQ ID NO: 244147 - DNA, 915 bp, Artificial Sequence
  Description of Artificial Sequence: Synthetic coding sequence
atgatttacactatgaagaaggtccacgcgctctgggccagcgtgtgcctgctgttgaatttggcccctgccccactcaacgcggattctgaggaagatgaagaacacacaattatcacagatactgagttgccgccacttaaacttatgcactccttctgtgccttcaaagccgatgacggcccttgcaaagccatcatgaaaagattcttctttaacattttcacccggcagtgcgaagaattcatttacgggggatgtgaaggcaatcagaatcggtttgaatctttggaagagtgtaagaagatgtgcaccagggataacgcgaatagaatcattaaaactacactccagcaggaaaagccagatttttgttttctcgaggaagacccaggaatatgccggggatacatcacacggtatttctataataaccagacaaaacagtgcgagcgctttaaatatggcggatgcttggggaacatgaataattttgaaactcttgaggaatgcaagaatatttgcgaggatggaccaaatggttttcaggtggacaattacggcactcagcttaacgccgtaaacaattcacttacaccacagtcaaccaaggtgccatccctctttgagtttcacgggccatcatggtgtcttactccagccgatcgcggactctgtcgggctaacgagaaccggttctattacaactccgtgatcgggaaatgcagaccctttaagtattctgggtgtggagggaatgagaataattttacctcaaaacaagagtgtctgcgagcgtgcaaaaaagggttcatccagcgcatctctaagggcggactcatcaaaaccaaacgtaaacgtaagaagcaaagagtgaagatcgcttatgaagagatattcgtcaagaatatgtag

SEQ ID NO: 244148 - DNA, 756 bp, Artificial Sequence
  Description of Artificial Sequence: Synthetic coding sequence
atgatctacacaatgaagaaagtccatgcattgtgggcctcagtgtgtctgctccttaacctggcaccagcccctctaaatgcagacagtgaggaggacgaagaacacacaattattactgacaccgaattgccacctctgaagctgatgcacagcttttgtgcttttaaggctgacgatggaccatgcaaggcaattatgaaacgattcttttttaatatcttcaccaggcagtgtgaggagtttatctatggtggatgcgaggggaaccagaacaggttcgagagcctggaagagtgtaagaagatgtgcactagggataatgctaatcgcatcatcaagacaaccctgcagcaggagaagcctgacttctgtttccttgaagaggatcccggaatctgccgaggctacatcactagatacttctacaacaatcagacaaaacagtgcgagcggttcaagtatggcggttgcctcggaaatatgaataatttcgaaactttggaggagtgcaaaaacatatgtgaggacggaccgaatggattccaagtcgacaactatggcacccaactgaatgccgtgaataactccctgacaccacagagtactaaggtaccctctttgtttgtgaccaaagagggaacaaacgacggatggaaaaatgccgctcatatctaccaggttttcctgaatgcgttttgcattcacgcaagtatgttcttcctggggctggacagcatctcttgtctgtgctag

SEQ ID NO: 244149 - DNA, 231 bp, Artificial Sequence
  Description of Artificial Sequence: Synthetic coding sequence
atgatctatactatgaaaaaggttcatgccctgtgggccagcgtgtgcctcttgctgaatctggcgcctgcaccactgaacgccgactccgaggaggatgaggagcatacgatcatcactgacacggagctcccgccattgaagctgatgcattcgttctgtgcttttaaggccgacgatggcccttgcaaggcaatcatgaaaagatttttcttcaatatcttcacatag

SEQ ID NO: 244150 - DNA, 186 bp, Artificial Sequence
  Description of Artificial Sequence: Synthetic coding sequence
atgatttacactatgaagaaagtccatgccctctgggcatcggtgtgcctgctcttaaatctggcgcctgctcctctaaatgctgacagtgaagaagacgaggagcatacaatcattaccgataccgaactgccccctctgaagctaatgcattcattctgcgcgtttaaggctgatgatggctag

SEQ ID NO: 244151 - DNA, 321 bp, Artificial Sequence
  Description of Artificial Sequence: Synthetic coding sequence
atgatctacactatgaaaaaggtccacgcattatgggcatccgtgtgtttactgctgaacctcgccccagcaccactcaatgccgacagcgaagaggacgaggaacataccataattaccgatacggagctccctcccttaaaactgatgcactccttctgtgccttcaaagctgacgatggaccatgcaaagccatcatgaagcgattcttttttaacatcttcacccgtcagtgtgaagaatttatctacgggggatgtgaaggtaaccagaaccgatttgaatctctcgaggagtgtaagaagatgtgtacacggtag

SEQ ID NO: 244152 - DNA, 867 bp, Artificial Sequence
  Description of Artificial Sequence: Synthetic coding sequence
atgatatatacaatgaaaaaggtgcatgcattgtgggctagcgtctgcctgctattgaatttagcgcctgctccattaaatgcagatagcgaagaggacgaggaacacaccattatcacggacaccgaactcccacctcttaaacttatgcactccttttgtgctttcaaggcagacgatggaccctgcaaggccatcatgaagaggttctttttcaatatctttaccaggcagtgtgaggaatttatctacgggggttgtgagggcaatcagaacaggttcgagagcctcgaggagtgcaaaaaaatgtgcacccgtgacaatgcgaatcgtatcatcaagactacactgcagcaggagaagccagacttttgttttttagaggaggaccccggaatttgtcgcggttatattacccgttacttttacaacaatcaaacgaaacagtgcgaacgcttcaaatacggcggatgccttggtaacatgaataactttgagactctggaggagtgtaaaaacatctgtgaagacggcccaaacggtttccaagtggacaattacggaacacagctaaatgccgtcaacaattccttaacacctcagtcaaccaaggtgccttccctgttcgaatttcacggacctagctggtgtctcacacctgctgacagggggctctgtcgggcaaatgagaatcgcttttactataactcagttataggcaaatgcaggccttttaagtactctggctgtggaggaaacgaaaacaatttcactagtaagcaagaatgcctcagagcatgcaaaaaaggattcattcagcggatctctaaggggggtctaatcaaaacgaagcgcaagcgcaagtag

SEQ ID NO: 244153 - DNA, 321 bp, Artificial Sequence
  Description of Artificial Sequence: Synthetic coding sequence
atgatctacacaatgaagaaggtgcacgctctctgggcatcagtgtgtttactactcaatctagcccctgccccactgaacgccgactcagaggaggacgaggaacataccatcataactgacactgaactgcccccactgaaactgatgcactcattttgcgctttcaaagcggacgacggcccatgtaaggctattatgaaaagattctttttcaacatcttcactcggcagtgtgaggaattcatttatggcggatgtgaaggaaaccagaacaggttcgaatctctagaggaatgtaaaaaaatgtgcactcggtag

SEQ ID NO: 244154 - DNA, 318 bp, Artificial Sequence
  Description of Artificial Sequence: Synthetic coding sequence
atgatctacaccatgaagaaagtgcatgccctgtgggcttccgtatgtcttctcctgaacctggccccagcccctctcaatgctgactccgaggaggatgaggagcataccattattaccgatacggagctgccgccactgaagcttatgcatagcttctgtgcctttaaggcagatgatgggccttgcaaggcgatcatgaagagattctttttcaatatattcactcgacagtgtgaagagttcatttacgggggatgtgaagggaaccagaatcgatttgagtctctggaggagtgcaagaagatgtgcacctag

SEQ ID NO: 244155 - DNA, 966 bp, Artificial Sequence
  Description of Artificial Sequence: Synthetic coding sequence
atgggtgagcctcagggctccatgaggatccttgtcacgggcggaagcggcctagtgggtaaggcgattcagaaggtggtcgccgacggcgctggactaccaggcgaggattgggtgttcgtgtcatcaaaagacgccgatctaacagataccgcacagactcgggctctctttgaaaaggtgcaacccacacacgtgatccatctggcagctatggtgggaggcctctttcgcaacatcaaatataatttagacttttggcgtaagaacgtgcatatgaacgacaacgtacttcattctgcttttgaggtgggggctagaaaagtggtttcttgtttgagcacgtgcatcttcccagacaaaaccacatatcctatcgacgagaccatgattcacaatgggccaccacacaattccaactttgggtacagctatgcgaagcgaatgatcgatgtgcaaaaccgcgcatatttccaacagtacggatgtaccttcactgccgtcattccaaccaacgtgtttgggccacacgataattttaatatcgaggatggccacgtgttacccggtctgatccacaaggtgcacctcgctaagagctctggaagtgcactgactgtctggggtaccggaaaccctcggcgacagttcatctattccctagacttggcccaactcttcatttgggtgctgagggagtacaacgaggtggaaccaatcattctgtcggtgggagaggaggacgaggtgtcaattaaggaagcagctgaggctgtggttgaagctatggattttcacggtgaggtcacttttgacactaccaagagtgatggccagtttaaaaaaactgcttccaacagcaagctcaggacgtaccttcccgactttagattcacacccttcaagcaggctgtcaaggagacatgtgcttggttcacggacaactatgaacaggcgagaaagtag

SEQ ID NO: 244156 - DNA, 360 bp, Artificial Sequence
  Description of Artificial Sequence: Synthetic coding sequence
atgggcgagccacagggttctatgcgcatcctggttaccggtggatctgggctggtcgggaaagctatccagaaagtggtggccgacggggctgggcttcctggtgaggactgggtttttgttagctccaaagacgctgatttgacggatacagctcagacgcgggcactctttgaaaaagttcaacctacccacgtaattcatctcgccgctatggtcgggggactgttccgcaacattaaatacaacttggacttctggaggaaaaacgtacatatgaatgacaacgtcttgcacagtgcgtttgaggtgggcgcacgaaaggtggtttcctgcctgtcaacctgtatcttcccttag

SEQ ID NO: 244157 - DNA, 807 bp, Artificial Sequence
  Description of Artificial Sequence: Synthetic coding sequence
atgggcgaaccccaggggtctatgagaatcctggttaccggaggttccggacttgtcggaaaggcaattcagaaagtagtggccgatggggctggtctccccggagaggattgggtttttgtgtcttccaaggatgctgacctgactgacaccgcccaaactcgtgccttgtttgaaaaggtacaacctacccacgttatccatttggcggcaatggtaggtggcctgttcaggaatattaagtacaacctggacttttggcggaaaaacgtgcacatgaacgataatgtgctgcactctgccttcgaggtgggggctaggaaagttgttagttgcctgtcgacttgcatcttcccagacaagaccacataccctatcgacgagaccatgatccataatggcccacctcataatagcaattttggatatagctatgctaaaaggatgatcgatgtgcagaacagggcttatttccagcagtacggctgcacgtttacagcagtcatcccgaccaatgttttcggaccccacgataactttaacatcgaagacgggcatgtactccccggtctaattcacaaagtgcacctggcaaaatctagtggcagtgccctgacagtctggggtacaggcaatcccagacgacaattcatctattctctagacttggcccagctgtttatatgggttctgcgcgaatataatgaggtggagcctatcattctgagcgttggcgaggaggatgaagtctctattaaagaggcagcagaagcggtggttgaggcaatggattttcacggagaatag

SEQ ID NO: 244158 - DNA, 966 bp, Artificial Sequence
  Description of Artificial Sequence: Synthetic coding sequence
atgggggagccccaagggtcaatgcgtatcctggttacgggcggatccggcctcgtcggtaaggctatacagaaggtggtggcagacggtgctggtctccctggggaagattgggtgttcgttagctcaaaggacgcagacctgactgatacagcacagacacgcgctctgttcgaaaaagtgcagccaacgcacgtcatccatttggccgcaatggtcggtggactcttccgcaatattaaatataacttagacttctggcgaaagaacgtccacatgaatgacaatgtactccattccgcatttgaggtaggagctcggaaggtggtcagttgtttgagtacctgcatatttcccgataaaactacctaccccatcgacgaaacaatgatccataatggcccaccccataattctaacttcggatattcatatgccaagagaatgattgatgtgcagaatcgagcctacttccagcagtatggctgcacattcactgcagtgatccccaccaatgttttcgggcctcacgacaacttcaatatagaagacggccacgtgctgcccggactgatccacaaggtgcatttagcaaagtctagtggttctgctctcacggtttggggtactggtaatccacggaggcagtttatatactccttggacctcgcccagctattcatctgggttctccgcgagtacaatgaggtagaacctatcatcctcagcgtcggcgaagaagatgaggtgtctataaaagaagctgcagaggcggtggtcgaggccatggatttccacggcgaagtgaccttcgacacaaccaaatcagacggccagtttaaaaagactgctagtaatagcaagttacggacttacctgcctgatttcagattcaccccatttaaacaggctgtgaaagagacatgcgcatggttcactgacaattacgagcaagccagaaaatag

SEQ ID NO: 244159 - DNA, 597 bp, Artificial Sequence
  Description of Artificial Sequence: Synthetic coding sequence
atgggcgagccccagggcagtatgaggatcctagtgaccggcggatccggactcgtaggcaaagctatccagaaggtggtcgctgacggcgcaggcctgccgggagaagattgggtgtttgtgtcatcaaaggacgcagatctgacagatacggcccagacaagagctctgttcgaaaaagtacagccaacccatgtgatccacctcgcagccatggttgggggactattcagaaatatcaagtacaacctggatttttggcgcaaaaatgtacacatgaacgataacgtgctgcattccgcattcgaagtaggggcacggaaggtggtgtcatgtctgagcacatgcatcttccccgacaaaacaacataccccatagatgagaccatgattcacaatgggcctccgcataactcaaactttggctactcttacgcaaagcggatgattgatgtccagaaccgcgcttacttccagcagtacgggtgtacatttaccgcagttatacccacaaacgttttcggaccccatgataattttaatatcgaagacgggcacgtgttgcccggtctcatccataaggtccacctcgcctag

SEQ ID NO: 244160 - DNA, 2658 bp, Artificial Sequence
  Description of Artificial Sequence: Synthetic coding sequence
atggtggaaaaaagttccattgatgaaaattctatttctctggagaaggaagtacgacacgtccaagaacagaatttggatattctaaagactgatctgagcttgaaaagcttttctgaggagatctactctgagtcctgtgccttgcttcctacttcgtctgccgacattgaggagactgatctttccgaaaagtcttgccctctcgagaacgggggacgcagctccatcagccacctaaaaaaggcagcctccgaagaaaagccactcggcgtcggtgaaatggaggaagaatgtactcttgaaccagagctggcagcgtttccaaaacaggatggtggaacccaggagtacacagatgcaacactggaggaccacagaggcgacgtgcaggaagctgataccctccatcggcagctgtcactgtctcaatgctttcctttactgatgacagaggagcaacaaaaccccggagagcagatcagtacaaatatccacgcctccggcgaagaaaaatgctacgaggaagttcaggtacagaacgaggcctcctttagcaccctcgagggagagatgattgagacctcttttagtcagaatatcccaaagctcgatgaggcgcacaccacagaggcagccgagagcgagacttctctaacccaatatctgctagcggcagggaagcgtgaggttcccgagaccaaagacacgcgagaccaggctaaattggtgcagtcagaatctattacctccatggaggtcgaggaggtaacctttaacacggtctatgagtactataatcagaagcaagagagcctcgggagacccctctctccggaatctgacatctccataggcgtcggctccactacatcggaggagattagcgagctggatcagttttatacgccaccctcctctgtagagtacttcgaatccccaaaaagccctgatctgtacttcaatccaagcgatataacgaaacagtccagcatccacagcggaggcgaaacagttgaacgttacagtacacccctcggggaagtggccgagagatattctacaccaagtgagggagaggtgggagaaagatacagcacccctcccggtgaaacacttgagaggtactcaacccctcctggtgagaccctggagaggtattctactcctccaggtgaagcgcttgaacgatattccattcctacggggggtcctaaccccaccggaacgtttaagacttacccctctaaaatcgagcgggaggacggcacccctaacgaacacttctatactcccactgaagagcggggtagcgcttacgaaatatggagatccgatagctttgggacacctaatgaagctattgaaccaaaggacaacgaaatgcccccatccttcattgaacccttgaccaagcggaaggtgtacgaaaacaccacactgggattcatcgtggaagtcgaagggctcccagtgcccggtgtcaagtggtacaggaataagagcctcttggaacctgacgaaaggattaagatggaacgtgtgggtaacgtctgcagtctggaaatttctaatatccaaaagggggaggggggagagtatatgtgtcatgctgttaatataatcggtgaggccaaaagtttcgcaaacgtcgatatcatgccgcaggaggaacgggtggtagcgctacctcccccagtcacccaccagcatgtaatggagttcgatctcgaacacactacttcctctaggactccaagccctcaggagatcgtgctcgaggtggagctgtcagagaaggacgtaaaggaattcgagaagcaggtcaagattgtgacagtgcctgaatttactcccgatcataaaagcatgatcgttagtctcgatgtgctaccctttaattttgtggaccctaatatggattctcgtgagggtgaagacaaagagcttaagattgacttggaagtgttcgagatgccccctcgcttcataatgcccatttgcgatttcaagatccctgagaactctgatgccgtttttaagtgcagcgtgatcgggattcccacgcctgaggttaaatggtacaaggagtatatgtgcatcgaaccagataatataaagtacgttattagcgaggagaaaggatcccatactctcaaaattagaaacgtctgtttgtcagacagtgctacttaccgctgcagagcagtgaactgtgttggcgaagcaatttgtagaggatttctaaccatgggggattctgaaatatttgcggtgattgccaaaaaatccaaagtgaccctctccagcctgatggaagagttagtcctaaaaagcaattacaccgattcttttttcgagttccaggttgtggagggccctcctaggttcattaaaggaatttcggactgctacgcaccaataggaaccgcagcctattttcagtgcctcgtcaggggtagccctaggccaaccgtgtattggtataaggatggaaaactagtgcagggcaggaggtttaccgttgaggaaagcggtacaggcttccataacctctttatcactagtcttgttaaatctgacgagggagagtatcgctgcgttgccacaaacaagagtggaatggcagaatcgtttgcagcgctcaccctcacatag

SEQ ID NO: 244161 - DNA, 16815 bp, Artificial Sequence
  Description of Artificial Sequence: Synthetic coding sequence
atgaccacacaggcacctactttcactcaacccttacaaagcgtagtagtgttggagggatctactgccacattcgaggctcatattagcgggtttcctgtgcctgaggtgagctggttccgggacggtcaggtgatctcaacttctaccctgcctggagtccagataagtttttctgacggacgcgctaagctcactatacccgcagtgaccaaagccaattccggtcgctactccctgaaggctaccaatggcagtggtcaggcaacttctactgctgagctcctggtgaaggccgagaccgcacctccgaatttcgttcaacgcctgcagagtatgaccgttaggcaagggagccaggttcggctacaggtgcgggtaaccgggattccaacgcccgtagtgaaattttatcgggacggagctgaaattcaatcaagcctggactttcagatcagccaagagggagacctctatagtttgctgatagcggaagcctaccccgaagattctggaacgtactcagtgaacgccaccaatagtgtgggccgagccaccagtactgccgaactcctggttcaaggcgaggaggaagtgcccgctaaaaagactaagaccattgtgtccactgcacagatttcggagagtcgccagacaaggatcgagaagaagatcgaggcacattttgacgctaggtccatcgccacggttgagatggtcatcgatggcgcagccggacagcaactcccgcacaaaacacccccacgcatccccccaaaaccaaagtcccgctcccctaccccgcctagcattgccgctaaagcgcagttagctcggcagcagtcaccatcaccaatccgccactctccaagccctgttaggcacgtacgggcacctaccccgtcaccagtacgttcagtgtcgccagcagcacgaatctccacttctcctatccggagcgtgcgtagccccctactcatgcggaaaactcaggcctccacagtggccaccggccctgaagtgcccccaccctggaagcaggaaggctacgtggcaagctcctccgaagccgaaatgagagagactaccttgacaacctccacccagatccgcactgaagagcggtgggaaggcaggtacggcgtgcaggaacaggtgacaatcagtggtgcagccggagccgctgcttccgtttcagccagtgcctcttatgctgccgaagctgtggctactggagcaaaggaagttaaacaggacgccgacaaatccgcggctgtggctactgtggttgccgctgtcgacatggccagggtgcgggaaccagtgattagtgctgttgagcaaacggctcaacgcaccacaaccacggctgtccacatccagccagcgcaggagcaggtaagaaaagaagccgagaaaactgcggtcacaaaggtcgtcgtggctgcagacaaggctaaggaacaggaactaaagagcagaaccaaggaggtgattacaaccaagcaagaacagatgcacgtgacccacgagcagatacgaaaggagaccgaaaagacattcgtgccaaaggtcgtgatcagtgcagcaaaggctaaggagcaggagacgagaatctccgaggagatcaccaagaagcagaagcaagtcacccaggaggccattcgacaggagacagagattactgctgctagcatggttgtggtggcaacagcaaagtctacaaagctggagaccgtgccgggtgctcaggaggagaccaccacccagcaagatcaaatgcatctaagttatgaaaagattatgaaagaaacaaggaagacagtggtgccgaaagtcatcgttgctacccctaaagtcaaagagcaggacttggtgagcagagggagagaagggatcaccacaaagcgagaacaggtacagattactcaggagaagatgaggaaggaggccgagaaaactgctctttccacaatcgccgtggcgacagccaaggccaaggaacaagaaacaatcctgaggacccgcgaaaccatggccaccagacaggaacagatccaagtgacccatggtaaagtagacgtaggtaaaaaagctgaggccgtagccaccgtggtcgccgcagtcgatcaggccagggtgagggagcccagagagccaggacacctggaggagtcatacgcacagcagacaacgctggaatacggctacaaagagaggatatctgccgctaaggtggctgaacccccacagcgccctgctagcgagcctcacgtggtccccaaggctgtaaaacctagggtgatccaggcgccatctgaaacccatatcaaaacgacagatcagaaaggaatgcacatcagctcccagattaaaaagaccacggacctcactacagaacgcttggtccacgtggataaaagacccaggaccgcgtctccccattttactgttagcaagattagcgtgcccaaaaccgagcacggatacgaggcgagcattgcgggatccgctatcgctaccctgcaaaaggagcttagtgcaacgtcttccgcccagaagattacaaagagtgtcaaggccccaaccgtcaagccctcagagacacgagtccgcgcagagcctacgcccctccctcagttcccattcgccgatacaccagacacgtacaaaagcgaggccggtgttgaagtgaaaaaggaggtgggagtgtccattactggtacaaccgttcgcgaggagcgttttgaggtgctgcatggccgagaagccaaagtaacggagacggctagagtgccagctccagttgaaattcccgtcactccgccaaccctggtgagcggacttaagaacgtgacggtgatcgagggcgagtcagtgacgctggaatgccacattagcggttacccctctccgaccgtcacgtggtatagggaagattaccaaatcgagagttcaatcgatttccagatcacatttcagtccggcatcgccagactcatgattagagaagctttcgccgaggacagcgggagattcacctgtagtgctgttaacgaagcaggtacagtttctacctcgtgctacctggcggtgcaggtaagcgaggagtttgagaaagaaaccactgctgtgaccgagaagttcacaaccgaggagaagcgcttcgtcgaatcccgagatgtagtgatgacagatacatctttgaccgaagagcaagccggaccaggcgagcctgccgcaccctatttcatcaccaagcctgttgtgcaaaagctcgtggaagggggaagtgtcgttttcggctgccaggttggcggaaatccaaagccccacgtctactggaaaaaatccggagtaccactgaccactgggtaccgatacaaagtgtcctacaataagcagacaggcgaatgcaagctggttattagcatgaccttcgccgacgacgccggagaatatacaattgtggtccgtaacaagcacggggagacttctgcaagcgccagcctgttagaagaggccgactacgaactcttgatgaagtctcagcaggagatgctctaccaaactcaggtcactgcattcgtccaggaaccgaaggtgggagagactgctcctggatttgtatatagcgagtacgagaaggaatatgaaaaggaacaggccttgattcggaaaaagatggctaaggacacggtggtggttagaacctacgtggaggatcaagagtttcacatctcctcattcgaagaacgtctaatcaaggagattgaatacagaattatcaagaccaccctcgaagaactcctggaagaggacggagaggaaaagatggccgtggacatttccgagtcggaagcagtagaatcagggttcgacagccgaattaagaactaccgaattctcgaaggaatgggggtaacttttcactgcaaaatgagcgggtacccactcccaaaaattgcttggtacaaggatggcaagcggattaagcacggcgagcgataccagatggattttctccaggacgggagagcaagtcttagaattccggtcgtgctgcctgaggacgaaggcatctacacagccttcgccagcaacatcaaaggtaacgccatctgctccggaaagctttatgtggagccagctgctccacttggtgccccaacgtacattccaacacttgaacccgtcagtcggatccgtagcttgagtcccaggtccgtttcgcggtcacctatacgcatgtcgccagctagaatgagtccagcacgcatgagtcctgccaggatgtcccctgccagaatgtcaccaggtcgacgtttagaagagactgatgaatcacagctagaaaggttgtataagcctgtcttcgtcctgaagccagtctcctttaagtgcctggaagggcagacagccaggtttgaccttaaagtagtcggaagacctatgcctgaaacattttggtttcatgatggacaacagatagtgaacgattatacacataaggtcgtgataaaggaggacggtactcagagtctgatcatcgtccccgcaacccctagcgacagtggcgaatggacagtggtggcgcagaaccgcgcaggacggtctagtatttctgtgatcctaacagttgaagccgtcgaacatcaagttaaacctatgttcgttgagaaactgaagaacgtgaacatcaaggagggttcgcgattagagatgaaggtacgcgctacagggaaccctaaccctgacattgtctggttgaaaaactccgacataatcgtgcctcacaaatacccaaagatcagaatcgaaggcacaaagggcgaagcagctctcaaaatcgactcaactgtgtcccaggactctgcctggtataccgctactgcaatcaacaaagcgggacgggacacaactaggtgtaaggtcaatgtggaagtggagttcgccgaaccagaacccgagcgcaaactcatcattcccagaggaacttaccgggcaaaggagatcgccgctccggagctcgagccgctgcatctaagatatgggcaagaacaatgggaagaaggggacttgtacgataaggagaaacagcaaaagcccttttttaaaaaaaagctgacctctcttaggctgaagcggtttggccctgctcactttgagtgtcgattaactcccatcggtgatcctacaatggtcgtcgagtggctacacgacggcaaacccctggaggccgcaaaccggctgagaatgatcaatgaattcggttattgctcgctcgattacggggtggcctattccagagattcaggaataatcacatgccgggcaaccaataaatacggcacggatcatacctcagccacactgatcgtgaaagacgagaagagcctggtggaggaaagccaactcccagaaggccgaaaaggtctgcagcgaatagaggagcttgaaaggatggcacatgaaggcgctcttaccggagttacgactgaccagaaggagaagcagaaaccggatatcgttctgtaccctgagccagtccgcgtactcgagggcgaaaccgcccgattccgatgtcgggttacaggttacccacagcctaaggtaaactggtacctcaatggtcagctaatcagaaaaagcaagcgcttccgagtccggtatgatggcatccactaccttgacatagtcgattgcaaatcgtacgatacaggtgaagtcaaggtcactgcggagaaccctgagggcgtgatcgaacataaagttaagcttgagatacagcagagagaagatttccggtctgtgctgaggagagctcctgagccacgccctgaatttcacgttcacgagccaggtaaactgcaatttgaggtgcagaaggtggatcgcccagtggacaccacagaaaccaaagaagtcgtgaagctgaagcgcgctgagaggatcactcacgaaaaagtgcccgaagaatctgaggaactaagaagcaagttcaagcgcagaacagaggagggctattatgaagctatcacggctgtggaactgaagtctcggaagaaagacgagagttacgaagaactccttcgtaaaaccaaagatgagttgctccactggactaaggagttaaccgaggaggagaagaaggcccttgctgaggaaggcaagattacaatcccaaccttcaaaccggataaaatcgaattgtccccctctatggaagccccaaagatcttcgaaagaatacagagccagactgtcgggcaggggagcgacgcgcacttccgcgttagagtggtaggaaaacctgatcccgagtgtgaatggtataagaacggagtgaagattgaaaggtctgaccgcatctattggtactggcctgaggataacgtttgcgagctggtgatacgcgacgttactgccgaggacagcgcgagtatcatggtcaaagccatcaacatagctggtgaaaccagctctcatgcttttttgctcgtccaggccaaacagcttattactttcacgcaagaactccaggacgttgtggctaaggagaaggacaccatggccaccttcgagtgtgagacatccgaaccttttgtcaaagtgaagtggtacaaggacggaatggaggtgcacgaaggtgataagtatcggatgcatagtgacaggaaagtgcacttcctgtccatccttactattgatactagcgacgccgaagattattcttgtgtactggttgaggacgaaaatgttaaaaccacagccaaactgatcgttgagggcgctgtggtggagttcgtgaaagagctgcaggacatcgaggttccggaaagctactctggtgagctggagtgcattgtgtcccccgagaacattgagggcaagtggtatcataacgatgttgagcttaagagtaatggaaagtacacgatcacgtcaaggagaggaagacagaacctgactgtgaaagatgtcaccaaagaagatcagggcgagtatagctttgtgattgacggaaaaaaaactacctgtaaattaaagatgaagcctagacctatagccatcttgcagggcctgagcgatcaaaaggtatgtgaaggcgatattgtccaacttgaggtgaaagtgagtttagaatcagtagaaggggtctggatgaaagacggacaggaggtgcagccatctgatcgggtgcatattgtcatcgacaaacagagccacatgcttctgattgaggacatgaccaaagaagacgctggcaattactcttttactattcccgcattgggtcttagtaccagcggcagagtttcagtttactccgtggacgtgattacccctcttaaggacgtgaatgttattgaaggaacaaaagcggtgctcgaatgtaaagtttcagtccccgatgtgaccagtgtgaaatggtacctaaacgacgaacaaatcaagcctgatgatcgggtccaagctattgtgaaagggacaaagcaacgtctggtgatcaacaggacccacgcttctgacgaaggtccatacaaactcatcgtcgggcgtgtggaaaccaattgcaatttaagtgtcgagaagattaaaattatacgcggtctgcgcgatttaacttgcaccgaaacccagaacgtcgtctttgaggtggagctctcccacagtggcatcgacgtgttgtggaactttaaggacaaggaaattaagccttccagcaagtacaagatcgaggctcatggcaaaatctataaactcacagttctgaatatgatgaaagacgatgagggaaaatacacattctacgccggtgaaaatatgacaagtggcaagttaactgtggccggtggggcaatatcgaagccgctgaccgaccagactgtggccgagagccaggaagccgtatttgaatgtgaagtggctaacccagattctaagggagaatggctgagggatggtaaacacctcccactaacgaacaacatacgctccgagtccgatggccataagcgcaggctgattatagccgctaccaaattggacgacatcggtgaatacacttacaaggttgccacctcaaaaacatctgcaaaattaaaagtggaggctgtcaaaatcaagaaaacactgaagaacctgacggtgacagagacccaagacgccgtctttaccgtggaactgacgcatcctaacgtaaaaggggtccaatggatcaagaacggagtggtgctcgaaagcaatgagaagtacgccatcagtgtgaagggaactatctacagtctccgtataaaaaattgtgcaatagtggatgaaagcgtttatggcttcagattgggcagattaggtgcatcagccaggctgcacgtggagactgtgaagattataaagaagcctaaagacgtcaccgctcttgaaaacgccactgtcgctttcgaggtgagcgtatctcacgacaccgtccccgtcaagtggttccataagagcgttgagatcaagcctagcgacaaacatcgactcgtgtcagagcgcaaagtccacaagctcatgctccagaacatttcaccatcagatgcaggggagtacacggctgtagttggtcagctcgagtgtaaagccaagctcttcgtggagactttacatatcaccaagactatgaaaaacatcgaggtacctgaaaccaaaactgcgtcctttgagtgcgaggtctcgcattttaatgtgccttccatgtggttgaaaaatggggtcgaaattgagatgagcgagaagtttaagatcgtggtgcagggaaaactccaccagctcattattatgaataccagcaccgaagactccgcggaatatacctttgtgtgtgggaatgaccaagtgtctgcaactcttacagttacgcctataatgataacaagcatgttgaaagatatcaacgcagaggagaaagatacaattactttcgaagtcaccgtgaattatgagggcattagctataagtggctcaagaatggcgtggagattaaatctactgataaatgccagatgagaacaaagaaactgacccatagtttaaacatcaggaatgtccacttcggagatgctgccgactacacattcgtggccggtaaagccacaagtaccgctacgttgtatgtcgaggccaggcacatcgaatttcggaaacatataaaggacataaaagtcctggagaagaaacgcgctatgtttgaatgcgaagtctcagaacccgatatcacggttcaatggatgaaggacgaccaggagctacaaatcaccgatcgcatcaagatacaaaaggagaaatacgtgcaccgactgctcatcccttctactaggatgtctgatgcaggaaagtacactgtagtcgccggtggcaacgtatccactgcgaaactgttcgttgagggcagggatgtgaggattagaagcattaagaaggaagtccaggttatcgaaaagcaaagagctgtagtggagtttgaagtcaatgaagacgacgttgatgcacactggtataaagatggcatcgagattaacttccaggtccaggagcgccacaaatatgtggtggaacgaagaattcacagaatgttcatctcagaaacacgccagtcagatgctggcgagtatacgtttgtggctgggagaaatcggagttccgttactctgtacgttaatgctcctgagcctcctcaggtgctgcaggagctgcagcccgtaacagtccagagcggcaaaccagctagattttgtgcggttatttccggtaggccgcaaccaaaaataagctggtacaaggaggagcagttgttgtctaccgggttcaaatgcaagtttttgcatgatggacaggaatacacattactgctgatcgaggcgttccctgaggacgccgctgtgtatacttgtgaagccaagaatgattacggagtcgcaaccacaagtgcctcgctgagcgtggaagtccccgaggtggtctcccctgaccaggaaatgccagtgtaccctccagcaattatcacacctctgcaagatacagtcacttctgaaggtcaaccagcacggtttcagtgtagagtaagcgggactgacctgaaggtttcttggtactcaaaagataaaaagatcaaaccttctcgattttttagaatgacccaatttgaggatacctatcagctagaaattgccgaggcctatcccgaagatgaaggaacgtacacattcgtggccagcaacgcggtaggtcaggtgagttcaaccgctaacctgagcctcgaggcccctgaatcaatcctccacgaaaggatcgaacaggaaatcgagatggaaatgaaggagttattcagcgagggcgaaagcgaacacagcgagagagatacgcgggacgcatttagcgatagtgaagacatcgaccacaagagcatggcagctaagcgctacgcctcacgaatcagcagcacctcctcgtggcctgaatactttaagccctcttttacgcagaaactcacattcaagtacgtcctggagggtgaacccgtcgtcttcacatgccgattaattgcctgtccaacaccagagatgacttggttccacaacaaccgtcccatcccgaccggcttgcgcaggataataaaagctgaaagtgatctgcaccaccatagcagctctctggaaatcaagcgggtccaggacagggattctgggagctacaggctcctggcaatcaactctgaaggcagcgcagaaagcacagccagtctgttggtcattcagaaaggtcaggacgagaaatacctggaatttctgaagagagccgagagaacccacgagaatgttgaagccctcgtggagcggggtgaggatcggatcaaagtagacttgagattcacaggctcccctttcaacaagaaacaagatgttgagcagaagggtatgatgcgcaccattcacttcaagacaatgagctctgccaaaaagactgactatatgtatgacgaagagtacctggagagcaagtccgacatccgcggatggttaaacgtgggggagagtttcttagacaaggaaaccaaggtgaagttgcagaggctcagggaggcacgcaagaccttgatggagaagaaaaaactgtcgcttctggatacttcttctgaaatcagtagtcggacacttagatccgaagcctcagacaaggatattctgttcagccgagaagacatgaagatccggtccatgagcgatctggcagaatcctataaggtagaccactcagcagaaagcatagtccagaaccctcatgccttgtcgaaccagatggatcaaaatatagaatccgaggagctgcccaccagcttccaaacaatcgtggatgaagaaatcttccagacagagatccgaatgtcacaggaggctctagttaaggagtccctacccaaagaccacctctatggagaaatactggtgaacgaaaatactcaggctcggggtcaactcgaagagatcatggcaaatactacaattggcgagtcatctacctacataacaaatgtttgcgaaaaagaggaggtttacgaaacacccgagaatgtgagccaagcaattactccacatgcaagcgagagcttcggaaccctggtcaacgtggaggagtccgaagaaattgcttcagaaagaattaagaaagatgatttgagggaacttcagctctcagcgagcacacgtatcgacgaatttaaaacagagcaaaaggaagagaatatgcggttctttgaaaactccttccgaaagaggcctcagagatgcccaccgagtttcttgcaggagattgagtcgcaagaagtttacgaaggggactcctgtaacttcgtctgtcactttcagggttacccgcaaccgatagttacatggtataacaacgatatgccaattcctcgaaatcagaacttcattatccactctctcgagaactactccattctgactctgtcctctgtgcatcaccagaatgaaggttcaataacatgtgtgcttttcaatcagtatggaacggtgaagacaacctcaatgcttaaggtcaaggccaagcaaaagcatgacgtgaaggcccataaagtgccagtcttccacgactacctggatgaggaagaggagctggccctggtcttcgaccaggcaaagggtgcccacccctccatgtcccaggaggggcagacaaaccttcaccttcttaaaacaaaccccccagtaccacccagcggggataccgaactcctgagcttccccgttgaaattcaggttactgctgctaccccgatccctgaacaggacaaagagtcgaaagaggtttttcagaccgaggagctggagcctaaagctatgccccaggaccaggtcacccaaagccctaagcataggttcgttttcctgtctgacatcacaaacgaaccacctaagatgctgcaggagatgccgaagcatgccaggtgccgcgagggcgactctatcatcctcgagtgtttaatttccggagagcctcaaccagtggtaacctggttccaaaacggcgtgctgctgaagcaaaatcagaagttccagtttgaggaagttaactgttcacatcagctgtatatcaaggacgtaaacagtcaggactcaggaaaatacaaatgcgtggctgagaataattccggggcagtggagagtgtgtccgacctcacagtggaaccagttacttaccgagaaaattctcagtttgaaaacatcggggagatctatggaaagtattctcgagaccagcaattgcaggaccaaggcgagtcagtgcgagctcacttttacgactatcccgcaggccctttcacgccctggacgaacgttaaggaatattccgttcgggattattttcagtcactcgagaccatagaacagatcgatcagaaagagcaggtacgatgtattcctagtcgtgagaagattccgaggttcgtacatggggcaagccggaccattaagatctcaaaacctattcgcgcagagttcattcagtgccaagctgagggcaaggagcggcatgtctccgagaagtcgaagcttcaccaagccgaggggacagtgtatcctttcgtcgacgatttttctgacgtcacgatcaagaaggagatcagaaataatttcggcaaactgggacggagcgaaaaggagaatgttcaggagtgtgctcagagtgattatctcccaaatattcactccgagcggatcagcgacagctataatacaaaagactcctctgcgatcgtgtacgaggagtctctcggggaagaaatccattaccccggtaaaaaagtgaagcatcgcattatcgagtttgaaaaacttcatgtggaaaaaggggtgctggaaaagcggccaacaagaactagcatcgtaaatccccctcagaagaagatcgacgacaaggcattttcccttaaacagagagagtctcgctcttccaatctgaacgcaaacatgtatcaagccgagaaaatgagccctaacacagaaagtgatagctccaatattgccattaacctgaaattgctgtcttctcaaacacacaaggaatttgacgcccaggagcgcgaacaacaggaaaaaatctctctcatcgataagcccgctatttctaagagggctgagcacgaaagccccatcaccttcgacctgaagcagtttcatactcagattaaacatacagatgtcaaattccaagagctagattctgggcaacccgaagaagcttatttcaaaatacagcaccccgctgacacagagaacatcgtgttcgatttgaagcaaatgtacagccacatcggggacccagcactggaatttcagggtcaggagaccagggagcaacaggaaatccattacaaagagaaaatccccagccctgaaactctgcagcctgatactcacaacatctctaaatcggtccagaataatgtgttcgcgtctcaggaaatctcttcttcccaagaactatccaatagaacaatggtggaaaagtcatctatcgatgaaaattccatctctcttgagaaggaggttcgccacgtccaggaacagaaccttgacattctgaagactgatctgtctttgaagagtttcagcgaggagatctacagcgagagctgtgcgttgctgcctacttcctcagccgatatagaagagaccgacttgtcggagaaaagctgtccactagaaaatgggggacgttctagcataagccatctcaaaaaggccgcaagcgaagagaagcctctgggagttggagaaatggaggaagaatgcaccttagaacccgaactagcagcttttccaaagcaggatgggggaacgcaggaatacaccgatgcaacattagaggaccataggggggacgtgcaggaggccgacacactgcaccggcagctgtccctttcccagtgcttcccactgctgatgaccgaagagcagcagaatcccggtgagcagattagcactaacatccatgctagtggcgaggaaaagtgttacgaggaggttcaagtccagaatgaggcctcattttctaccttagagggtgaaatgattgaaacctcctttagccagaacatccctaagttggatgaggctcatacgaccgaggctgccgaatccgagacctcactgacacaataccttctcgctgctgggaagagagaggtgccagaaaccaaagatacacgggaccaggcgaaactcgtccagagcgaatccatcactagcatggaagtggaggaggtcactttcaacacagtttatgagtactacaaccagaagcaggaatcgctggggagacctctgtccccagaaagcgacatttcgataggtgtgggctcaacaaccagtgaagagatttctgagctggatcaattttatacccctcccagcagtgtggaatattttgagtcgccaaagtcaccagatctctatttcaatccctcagacatcaccaagcagtctagcatccacagcggtggagaaacggtggagcgatattccacacctctgggtgaggtcgctgaacgatattctaccccgtcagagggagaggtgggtgagagatattctacgcctccgggagagactcttgaacgctattcaactccacccggtgaaacactggagaggtacagtactccacctggggagaccctggaaaggtattccactcccccaggcgaaaccctggaacgctactctacacctcctggcgaaacactggagcgatactctacaccacccggagaggccctcgaacggtactccatcccaactgggggtcctaatccaactggtaccttcaaaacgtatccttccaaaatcgagagagaagatggcactcctaatgagcatttctacacccccactgaggagaggggctccgcatacgaaatatggcgtagcgattcttttggaacacccaacgaagctattgagcctaaggacaatgaaatgccaccttcttttatcgagcccctcactaaaaggaaagtttacgaaaataccacgctggggttcattgtggaggtggaggggctccccgttccaggtgtgaagtggtataggaataaatccctgctggaacccgacgaaagaatcaaaatggaaagggtcggaaacgtgtgctcactggaaatcagtaatatccagaaaggcgagggcggagaatacatgtgtcacgctgtgaatattatcggggaagctaagtcatttgccaacgtggacattatgccacaggaagaacgggtcgtggctctgcctcccccagtgacgcaccagcatgtcatggagttcgacctggaacatacaacctcctcacggaccccctccccgcaggaaatcgtcctggaggtggagctttctgaaaaagatgtaaaagaatttgaaaaacaggtgaagattgttacagttcccgagttcacgcccgatcataaatccatgattgtgagcctagacgtcttaccttttaactttgtggacccaaacatggactctcgggaaggggaagacaaggaattaaagatcgacctcgaggtgttcgagatgcccccaagatttatcatgcccatttgcgatttcaagatacccgaaaactcagacgctgtgttcaagtgctcagttatcggcatccccaccccagaggtgaagtggtacaaagagtatatgtgtatcgagcctgacaatattaagtacgtgatctccgaagagaagggctcccatacattaaaaatccggaacgtctgtttgagcgacagcgccacctatcgctgtagggccgttaactgtgttggagaggcaatctgtagaggatttctgacaatgggcgactcggaaatattcgcagtgatcgctaagaagtccaaggttaccctgtcaagcctgatggaagagttagtgttgaagtctaactacaccgatagttttttcgagttccaagtcgtagaaggccctcctcgatttattaaaggtatcagcgactgctacgctcccattgggacagccgcatacttccagtgcctggtcagaggctcccccaggcccacagtgtactggtacaaagatggcaagcttgttcagggcagaagattcaccgttgaagagagtggcacagggtttcacaacttattcattaccagtctggtgaaatccgacgagggcgaatacagatgtgttgctacaaataagagtggaatggctgagtccttcgcggcactaaccctgacatat

SEQ ID NO: 244162 - DNA, 1419 bp, Artificial Sequence
  Description of Artificial Sequence: Synthetic coding sequence
atgtacatctacgaagcgagtgaggaagcagtcctagaggagaaggtgcttgtcacgcaaccccagaagacgaagcccaagctggccaaggtgcccgagcctcctaagaaagtcgtcccagaggataagatctatgtgaccattcctaaaaagagggaaacccccgctacgaaggagccagacaccactaggggcattttccctgaggtggagccccctgaggccattccggagattcctgaacatccccctacagaggaattcgaagtgttcaaagaggttatccctgagggggagactcccatcgttaaacgaaggaaaaccccctctcccacagcccctgaagccatgaaggaggtggtacctgaaatgaagatcttcgaggacgtgcccgaggaacccgagaccccccgaatgaaaacgcccgaagctccccaagagatcatccctgcaaagaccgtgccaagtaaaaagcgcgaaccaccttctgtaaaggttccagaggccctgcaggagattgttcccgagaaaaaaacactagtcgtgccgctcaggaagccggaagtcttaccagacgaggtcccagaggcacttcgcgaggttgtgccagaaaaaaaggtgcaccccccacagagagccgaggtggttcccgttaaggtgcatgaggccccaaaggaaatcatacccgagaagaaggtcagtgtggtgccgccaaagaaaccagaagtgccaccggttaaagtccccgaggcaagcaaggaagttattcgtgaagaaaaggtacccttagcaccacccaaggaacccgaggtcccccctgtgaaagtaccagagccgccaaaggaggtcgtccccgagaagaaggctccggtagccccacctaaggaacccgaggttccacctgtgaaggtaccagaggcaccgaaagaagtcgtcccagaaaaaaaggtccctgtgcccccacccaaaaaacccgaagttccaccaaccaaggtcccagaggtgcctaaggctgctgtgccagagaaaaagctgccagaagccatacctcctaagcccgagtcacccccaccagaggtgcccgaggtcttacccccaaaggaggttgtgcccgagaagaaggtgcccgttcctccagcaaagaaaccagaggctcctccaccaaaggttccagaagcccctaaagaagtcgttctggagaagaaagcctcagtcgccgtgcctaaaaaacccgaagcaccacgtgcaaaggtgcccgaagcagctcaggaggtcgttcccgaaaagaagatccccaaggcccctatcaagaagcctgaagccccagccgtcacggttccagaggtgccacaggagattgtgccagagaagaagaccctggtacttcccaaaaaaccagaggtccccccagtcacctag

SEQ ID NO: 244163 - DNA, 1122 bp, Artificial Sequence
  Description of Artificial Sequence: Synthetic coding sequence
gtagtaccagaaaagaaagtcccactggtcgtgcctaagaagcccgaagcaccacctgctaaagttccagaggtaccaaaagaggtcgtgccggagaagaaggttgcggtgcccaaaaaacctgaagtgccccctgcaaaggtgcctgaggtgcccaagaagccggtgttggaagagaagcccgctgtgccagtgccagagcgggctgaaagcccaccacctgaggtgtacgaagagcccgaagagatcgctccggaagaagaaattgcacccgaagaagagaaacctgtacccgtagctgaagaagaagaacccgaagtccctccgccagccgtgcccgaagaacctaagaagatcatacccgagaagaaggtccccgtaattaagaaacccgaggccccacctcctaaagaacccgagatgcctaagaaagttgtgcccgtgaagaaggtgcctaccgtgaaaaagccagaaacccccgctgccaaagtaccagaggttcccaagaaactggtgccagtgaaaaaagaacccgtgccggtcaccaagaaacctgaagtgcttcctgaaaaggttccgaaggtgccagagaagataatacctgaaaaggaagtatctgttcccattcctgctgagccagaggtgccgcctgctgaagtggaagagacgcccgaagagattatctacgaggagaaggcctccatcaccatcggaagaaaggaaactccccctgtagaagagcgggagattgaaaagtatattaaaccagaggagccggagccggaaccacagcccgaggaaattcctgtaaaggaaccagaaccagaaaaagtcattgagaagccaaagttaaagcccagaccgccacctcccccaccggcaccaccaaaggaggatgtgaaagagaagatcttccaattaaaggcaattcccaagaaaaaggtccccgaaaagcctcaggtgccagagaaggtagagctcaccccattaaaagtgcccgagccaccacctccgaaacctgtcgaggaagtcgaggtccctaccgtgactaagcgagaacggaagataccggaacccaccaaagtgcccgagatcaaaccagcgattccactcccggcttag

SEQ ID NO: 244164 - DNA, 543 bp, Artificial Sequence
  Description of Artificial Sequence: Synthetic coding sequence
aaagtacccgaagttccaaaaaaacctgtgctggaggagaaaccagccgtgccggtgccagagcgcgcagagtccccaccccctgaggtctacgaggagccagaggaaatcgctcctgaagaggaaattgcgcctgaagaggagaagccggtgcctgtagccgaggaggaagagcccgaggtgcctcctcctgccgtaccagaagagccaaagaagatcattcctgagaagaaagtgcccgttatcaagaagcccgaggcgcctcctccgaaggagcccgagcctgagaaggtgattgaaaaacccaagctgaaacccagacctccccctccccctccagcccctcctaaagaagacgttaaggagaagatctttcaactgaaggccattcctaaaaaaaaggtcccagagaaacctcaggtacccgaaaaggtcgaactgacacccctgaaggtcccaggcggtgagaagaaggtgagaaaactgctgccagaaaggaagccagagcccaaggaagaagttgtacttaagagcggtatatag

SEQ ID NO: 244165 - DNA, 438 bp, Artificial Sequence
  Description of Artificial Sequence: Synthetic coding sequence
gaagacacatatcagttggagatcgcagaagcgtatcctgaagacgaaggaacctacacgttcgtggcctcaaacgccgttgggcaagtcagctctacagcaaacctctctctcgaagcccctgagagtattctgcatgagagaatagaacaagaaattgagatggagatgaaagaactgttttcagaaggtgagagcgaacacagcgagcgggatacccgagacgctttctcagacagcgaggatatagatcacaagtccatggccgcaaaaaggtatgcctctaggattagctcaacctcaagctggcccgaatacttcaaacctagcttcactcagaagctcacctttaaatatgtgcttgagggagagccagttgtctttacttgtcgacttattgcttgtcctacccccgagatgacctggttccacaattag

SEQ ID NO: 244166 - DNA, 546 bp, Artificial Sequence
  Description of Artificial Sequence: Synthetic coding sequence
atgttcttcgccagtcacactgaagaggaggtttccgtcacagttcctgaggtgcagaaggaaatcgtgacagaggaaaagatacatgtagccatctccaagcgcgttgagccgccacctaaggtgcctgagctgcctgagaagccagccccagaggaagttgctcccgtacctatccctaagaaggtggagccacccgcacctaaggttcctgaagttcccaagaagcccgtgcctgaggagaaaaagcctgtaccagtgcccaagaaggagccagcagcacctcccaaagtccctgaagtgcctaagaaacccgtgcccgaagagaagatccctgtccctgtagctaaaaaaaaggaagccccaccagccaaggtgccagagatacctaagaagaaggtccccgaggagcgcaaacctgtaccacgtaaggaagaggaagtgcctcccccaccaaaagtgcccgctttaccaaaaaaaccagtgccagaagagaaggttgctgtgccagtgcctgttgcaaaaaaggcccctccacccaggtag

SEQ ID NO: 244167 - DNA, 2490 bp, Artificial Sequence
  Description of Artificial Sequence: Synthetic coding sequence
gtcgaggaatttattaaactagagcagcatcgggttgaggaggaacaccgggtagaaaaagtgcaccgcgtcatcgaagtattcgaggctgaggaggtggaggtcttcgagaagccaaaagcccctccaaaggggcctgaaatctccgaaaagatcattccccctaagaaaccccctactaaagtagtccccaggaaggagcccccagctaaagtccctgaagtcccaaaaaaaatcgtggtcgaagagaaagttagagttccagaggaaccaagagtgcctccaaccaaggccccagaagtacccaagaaaatcgtgcctgaggaaaaagtccgagaagccgtgctgaagaaaccagaagtgcccccagccaaagttcccggaatgccaaagaagagtgtgcaggaggagaagtccccaatcgtgatttccgaggacacggagatgtatatctacgaagcgtctgaagaggccgtcctggaggaaaaggtgctggtaacccagcctcagaagaccaagcctaagctggcaaaggtcccagaacccccaaaaaaggtggttcccgaagacaaaatttacgtgacaatcccaaaaaaacgagagacaccagctactaaggaaccagatacaacacgcggtatctttcctgaggttgagccccctgaggctatcccagaaatccccgaacatccaccgactgaggaattcgaggtttttaaggaggtgatccccgaaggcgaaactcctatcgtgaaacggcgaaagaccccctccccaactgctcctgaagccatgaaagaggtggttccagaaatgaaaatcttcgaagacgtgcctgaagaacccgagacaccgcgaatgaaaactccagaggcccctcaggaaatcatccccgctaagacagtaccctccaagaagagggagccccctagcgtgaaagtccccgaggctctgcaggaaatcgtgcctgagaaaaagacactggtggtgccattgaggaagcctgaagtcctccctgacgaagtgccagaagcactgcgcgaggtcgtccccgagaagaaagtgcacccaccacagcgagccgaggtggttccggtgaaagtgcatgaggcaccgaaagagatcatacccgaaaagaaagtgtcagtggtgcccccaaagaaaccggaggtgccccctgtgaaagtccctgaagcttccaaggaggtaatcagggaggaaaaggttccgttggccccacctaaggaacccgaggtgccaccagtcaaggtccccgagccccctaaagaagtggtcccagagaagaaggctcctgtcgccccacccaaagaacctgaagtgccccctgtgaaagtgcccgaggctccaaaggaagtggtccccgagaaaaaggtacctgtgccgcctccaaagaagcctgaggtgccaccgacaaaggtgccggaagtccccaaggccgcagtcccagagaagaagctccccgaggcaatcccacctaaacctgagagccctcctcctgaggtgcccgaggtactccctccgaaagaggtcgtgccagagaagaaagtgcccgtcccacccgctaagaaacccgaggctccaccgcctaaggtaccagaggcaccaaaggaggtggtgcttgagaagaaagcgtccgtagctgtgcccaaaaagcctgaagctcctcgggctaaagtacccgaggctgctcaggaagtcgtgccggagaaaaagatccccaaggcgcctattaaaaaacccgaggcacccgctgttacggtgcctgaagtccctcaggaaatcgtgcccgaaaagaaaactctggtactgcctaagaagcctgaagttccccctgtcacagtgcccgaggctcccaaggaggtcgtcctggagaagaaggtgcccagcgcgccaccaaagaaacccgaagtcccccctgttaaagtcccagaggccccaaaggaggtggtgccagagaagaaagtgcccgtgccgcctccaaagaaaccagaggtacctcccacaaaggtgcccgaggtgccaaaggccgctgttccagagaagaaggtcccagaagcgattccacctaaacctgaatcacccccaccagaagtgcctgaagtcctgccccctaaagaggtggtgcccgaaaaaaaggtacctgtacctccggctaagaagccggaggcacctcctccgaaggttccagaggcgcctaaagaggtggtcctggagaagaaagcctctgtcgccgtgcctaagaagcccgaagccccacgagccaaagtcccagaagccgcacaagaggtcgtaccagaaaaaaagattcccaaggcgcctatcaaaaaacctgaggcccctgccgtcacagttcccgaggtacctcaagaggccgcagagaaggagatcccagtagctcctccaaaaaaacccgaggcgccaatcgtccctgtgcccgaagcccaggaggtggttccagagaagaaatag

SEQ ID NO: 244168 - DNA, 504 bp, Artificial Sequence
  Description of Artificial Sequence: Synthetic coding sequence
atggctacctccgaactctcctgcgaagtttcagaggagaactgtgaacggagggaggcattctgggctgagtggaaagaccttacattgtccacccgaccggaagagggctgtagtctccatgaggaggatacacagagacatgaaacctaccatcagcagggccagtgccaggtcctggttcagcgaagcccctggctcatgatgaggatgggaatcttaggtaggggcttacaggagtatcaactcccttaccagcgcgtattacccctgcctatctttactccggctaaaatgggcgctaccaaggaggaacgtgaggacactccaatacaactgcaggagttactggcactggagacagcgctgggagggcagtgcgttgaccgccaggaagtggccgagatcactaaacaactgcccccagttgtgccggtgagtaagcctggagccctgcgcagaagcctttctcggagcatgagccaggaggctcaaagaggatag

SEQ ID NO: 244169 - DNA, 744 bp, Artificial Sequence
  Description of Artificial Sequence: Synthetic coding sequence
atggctgggggagtgctgcccctcagaggactacgcgctctgtgccgcgtgctcttgtttctgtcacagttctgcattctgagcggtggagagcagtcacaggctcttgcccagagtataaaggatcctggcccaaccaggaccttcacagttgttccacgggctgcagaatccactgagatccccccttatgtgatgaaatgcccctcgaatggcttgtgtagccggctgcccgcagactgcatcgattgcacaaccaacttttcctgcacctacggaaagcccgtgacattcgattgtgccgtcaagccctctgtgacatgtgtagaccaagatttcaagagtcaaaaaaatttcataattaatatgacttgtaggttttgttggcagttgcccgagactgactacgagtgcacaaactcaacatcttgcatgacggtaagttgtccgcgtcagcgataccccgcaaactgtactgttagggaccacgtccactgtctaggaaaccggaccttcccaaagatgctgtattgcaattggacaggcggttataagtggagtacggcgttagccttaagtattacgcttgggggtttcggcgctgatagattctacctgggccaatggcgcgagggcctcggaaagctttttagcttcggcggtctgggtatatggacgttaatcgatgtgttacttataggcgtcggctatgtggggcctgccgatggctccctgtacatatag

SEQ ID NO: 244170 - DNA, 666 bp, Artificial Sequence
  Description of Artificial Sequence: Synthetic coding sequence
atggctggcggtgttctgcccctacgcggattgcgagctctctgccgcgttttgctgtttttgtcacagttctgcatcctgagcggaggcgaaagtaccgagatccccccttacgtgatgaagtgcccatccaatgggctctgctctcgcttacctgcggattgtattgactgcacaacaaatttctcatgtacgtatggcaagcccgtgacattcgattgtgcagtgaaaccttcagtgacttgtgtggaccaggacttcaaaagccagaaaaacttcatcattaatatgacttgtagattctgttggcagctgcccgaaaccgactacgagtgcacgaattccacctcttgcatgactgtctcctgtcccagacaaaggtatcctgccaactgtacagtgcgcgaccatgtccactgtctgggtaatcggaccttcccaaaaatgctgtattgtaactggaccggcggatacaaatggagtaccgctctggcattgtcgatcactctgggcggatttggcgcagaccggttctatcttgggcagtggagagaaggcctcggcaagctttttagcttcggcggactagggatctggacgttaatcgatgtattactgattggcgtcggctacgtgggaccagccgacgggtccctttacatatag

SEQ ID NO: 244171 - DNA, 1251 bp, Artificial Sequence
  Description of Artificial Sequence: Synthetic coding sequence
atggcatcaagttcagggtcttccccaagaccggctccagatgagaacgagttcccctttggttgccctcccacagtctgtcaggatcccaaggagcctagggcgctttgctgcgcaggctgtctttctgagaaccctcgtaacggggaagaccaaatatgtccgaaatgtagaggcgaagacttacagtccatcagccccggatccagacttagaacacaagaaaaggcccaccccgaggtggccgaggccggaattggatgtccttttgcaggggtgggttgttctttcaagggctcgccccagtcggtccaagaacacgaggtgacctcccagactagtcatctgaatctgctgcttggattcatgaagcagtggaaagctcgattgggatgcggcctggaatcgggcccaatggccctggaacagaatctgtccgatcttcagctgcaggctgccgtcgaagtagccggagacttggaagtggactgttaccgagctccttgctctgagtctcaggaggagctcgccttacaacacttcatgaaggaaaaactgctggccgagctcgagggcaagctgcgggtgttcgaaaatatcgttgcggttctaaataaagaggttgaagcgagtcatctggcactcgcaacgagtatccatcagtcacagctggacagagaacgaatcctgtctttggaacaacgagtggtggaactccaacagaccctcgctcagaaagaccaggcccttggcaagctggagcagagcttgcgtttgatggaggaggcaagtttcgatggaacctttctttggaaaatcaccaatgtgacgcgtagatgccacgagtcagcttgcggaaggacagtgagtctatttagcccagctttttacacagccaaatatggttacaagttgtgcctgcgcctctatctgaatggcgacggaaccggcaagcgaacccacttgtctctttttattgtgattatgaggggagaatatgatgctctgctgccttggcccttcagaaacaaggtcacgtttatgttactggaccagaacaaccgcgaacatgcgatcgatgcatttagacctgacctgtctagtgcctccttccaaaggcctcagtcagagactaatgtagcgtcaggctgcccactatttttccctctttcgaaactccagtcgccaaagcatgcgtatgtcaaagacgatactatgtttctgaaatgtatcgtcgagacaagcacatag

SEQ ID NO: 244172 - DNA, 1251 bp, Artificial Sequence
  Description of Artificial Sequence: Synthetic coding sequence
atggcatcttcatctggctcctccccccgtcctgctcctgatgaaaatgagtttcctttcggttgcccacccacagtgtgtcaggatcccaaggagcctcgagccctgtgctgcgccggatgtctgtccgaaaatcctcggaacggcgaggaccagatatgccccaagtgtcggggtgaagatctgcagtctatatctcccggtagcagactgcgaacgcaagagaaagcacacccagaggtcgcagaggcaggaatcggatgtcctttcgctggagtcggctgcagttttaaaggctcaccgcaatccgtgcaggaacacgaggtgactagccagacatcccacctgaatcttctgctgggttttatgaaacagtggaaggctaggctcgggtgtggactggagtccggcccaatggctctcgagcagaaccttagcgacctccagcttcaagcagcggtcgaggtggccggtgatctcgaggtcgattgctacagggcgccatgttccgagtcccaggaagagttagcactccagcacttcatgaaggagaagcttctggcagagctcgagggaaaactgcgcgtatttgagaatatcgtagctgtgttgaacaaggaggtggaggcctcccacctagctttagcgacttccattcaccagagtcagctggatagggagcgtatcctcagcttagaacaacgggtcgtcgagctgcagcaaaccctggcacagaaagaccaggcactcggaaagctggaacagagcctgcgcctcatggaggaagcttcattcgacggaactttcctgtggaagattacaaacgtcaccaggcggtgtcatgaatccgcatgtgggagaactgtgtccttgtttagccccgcattttataccgcaaagtatggctataagctgtgtctgcgactctatctgaacggggacggtactgggaaacgcactcatctgagcctctttatcgtaattatgcgcggtgagtatgatgctttgctgccttggccatttaggaacaaagttacctttatgctgctggaccagaacaatcgcgagcatgccatcgacgcattcaggcctgaccttagcagcgcctcctttcagaggccacagtcagagacaaacgtcgccagtggctgcccactgttcttccctctgtctaagttgcagtcccctaagcacgcatacgtcaaggacgacacgatgtttctcaaatgcattgtcgagacctcaacttag

SEQ ID NO: 244173 - DNA, 885 bp, Artificial Sequence
  Description of Artificial Sequence: Synthetic coding sequence
atgaagcagtggaaggctcgactgggatgcggactggagtccggcccaatggccctcgagcagaatctcagcgatctgcaacttcaggccgcagtggaggtggccggagatttggaagttgattgttaccgggcaccgtgttccgaatcacaggaagaattagcgctgcagcatttcatgaaagaaaaactactggccgaactggaagggaaactgagagtctttgaaaacattgtggccgtcttgaataaggaggtagaggctagccacttagctcttgccaccagcatacatcagagccagctcgaccgcgagaggatactgagcttggaacagcgggtggtcgagcttcagcagaccctggcgcagaaggaccaggctcttgggaagctagaacagtcacttaggttgatggaggaagcatcctttgacggtactttcctgtggaagatcacaaatgtgactcggagatgtcatgagagcgcctgcggtcgaacggtgtctctattctcccctgctttttatacggccaagtacggatataagctgtgcctccggttgtacttaaacggggatggcactggtaagaggacacacctgtctttgtttatcgtaatcatgagaggcgagtacgacgccctgctgccgtggccttttcggaacaaggtaacgttcatgttgctggaccaaaacaacagagagcatgcgatcgacgctttccgcccagacctctcctccgcaagtttccagaggccacagagtgagaccaacgtcgcttctggctgccctctgttcttccctctgtccaaactccagagccccaaacacgcctatgtcaaggacgacactatgttcttaaagtgtatcgtggagacatccacgtag

SEQ ID NO: 244174 - DNA, 2076 bp, Artificial Sequence
  Description of Artificial Sequence: Synthetic coding sequence
atgaacgctgccgtggtccgcagaacacaagaagccctcggaaaggtgatccgcagacccccactaacggagaagctgcttagtaaacctcctttccgatatctccacgacatcatcaccgaagtcattaggatgaccggttttatgaaggggctatatacggacgccgagatgaaatccgacaacgtgaaggacaaagatgccaaaataagcttcctgcagaaggccatcgacgttgtggttatggtgtcgggggaacccttgctagcaaagccagcacggatagtggcagggcatgaacccgaaagaactaatgaactgcttcagatcatcggcaaatgctgtctgaataagctttccagcgatgatgcagtgaggagagttctggcgggtgagaagggcgaagtcaaaggaagggcttccttaacttcacgctcccaggagctcgataacaaaaacgtgcgggaggaagaatcaagggtgcacaagaacacggaggataggggcgacgccgaaatcaaggaaagatcaacaagccgcgatagaaagcaaaaggaagagctgaaagaagacagaaagccacgcgagaaggataaagacaaggagaaggctaaggaaaacggaggcaatcgtcacagggaaggtgaacgggagcgggctaaggccagggcccgtcccgataacgagcgccaaaaagacaggggaaatagagagagagatcgtgacagcgagcgcaaaaaggagacagagagaaaaagcgagggtggtaaagaaaaggagagattgagagatcgtgatcgcgaacgcgatcgggataaagggaaagaccgagacagaaggcgcgttaaaaacggcgaacacagctgggatctcgatcgagaaaagaatcgagagcatgacaagcctgaaaaaaaatctgccagctctggcgagatgtccaaaaaactgtccgacggtacctttaaggacagtaaagcagagacagagacagaaatctctacacgcgcatcaaagtccctgactacaaagactagtaaaagacggagtaagaattcggtcgaggggaggaaagaggacaatatcagtgccaaatccctggacagtatcgtgtccgggattaacaatgagcctaaccaggagaccacaacctcagaaatcggcacaaaagaagcaaacattaactcaacgtcaatttcagatgataactcagccagtcttaggtgcgagaatattcagcccaatcctactgaaaagcagaaaggggatagcacatccgatgccgagggcgacgctggcccagccggacaggacaagtcagaagtgccagaaaccccagaaatccccaatgagctgtcttctaacatacgccgtatccccaggccagggtcagctcggcctgcccctcccagggtaaagcgtcaggattcaatggaggccctccagatggataggagcgggagcgggaaaaccgttagcaacgtcataacagaatcccataactcagacaacgaagaggacgaccaatttgtggtggaagctgccccacagctgtccgagatgagcgaaatcgagatggtcaccgctgtcgaactggaagaagaggagaagcatgggggtctcgtaaaaaagatcctcgagacaaagaaagattatgagaagctccagcagagccctaagcccggagagaaggaacgctcgctttttgaaagtgcatggaagaaagagaaggatatagtgtcaaaggaaatagaaaaactcaggacaagtatacagaccttgtgtaagagcgccctgcctctagggaaaatcatggattacattcaggaggacgtcgatgcaatgcagaacgagctccagatgtggcacagtgagaaccgtcaacacgctgaagctttgcagcaggaacagcgtattaccgattgtgcagtggagcccctgaaagccgagttggccgagctcgagcagctcatcaaagaccagcaggacaagatctgcgctgttaaggccaatattcttaaaaacgaggaaaaaatacaaaagatggtgtatagcatcaaccttacctcacgcagatag

SEQ ID NO: 244175 - DNA, 1878 bp, Artificial Sequence
  Description of Artificial Sequence: Synthetic coding sequence
atgaatgccgcagtggtgcgacggactcaggaagctctggggaaagtgatccgcaggccaccattaaccgaaaaactcctgtccaagcccccattccggtacctccacgatattatcacggaagtgatcagaatgaccggcttcatgaagggcctgtacactgatgctgagatgaaaagtgataacgtgaaggacaaagatgctaagattagctttttgcagaaggcgatcgacgtggttgttatggtctctggggagcctctgctggctaagcccgctagaatagtagctggacacgaacccgaacggactaatgaactcctccaaatcataggaaagtgttgccttaataagctttctagcgacgacgccgtccgtcgggtactcgcaggggagaaaggggaggtcaaaggcagggcttcgctcacatctaggtctcaagaattagataacaaaaacgtgcgtgaggaagagtctcgggtacacaaaaacaccgaagatcgcggtgacgcagaaattaaggagcgatctacttcaagggatcgcaagcagaaggaggaactgaaagaagaccgtaagccacgagagaaggacaaggataaggagaaagcaaaagaaaacggtggtaaccgtcaccgggagggcgaacgcgaacgcgcaaaggccagggccaggccagacaacgagcgacagaaagatcgagggaaccgggagcgggaccgcgacagcgagcggaaaaaagagacagaacgcaaaagcgagggtggcaaagaaaaggaaagattacgggacagagacagggagcgggatagagacaagggcaaagaccgggacaggaggcgggtgaagaatggcgagcactcgtgggacttagatcgggaaaagaatcgagagcatgacaagcccgaaaagaagtcggcatccagcggagagatgtctaaaaaactttccgatgggacatttaaggattcaaaggcggaaaccgagaccgagattagcacccgagcgtcaaaatctctgaccacaaaaacctcaaagcggagatctaaaaacagtgtggaaggtgattccacaagcgatgccgagggcgacgccggtccagcagggcaggacaagagtgaggtgcccgagactcccgaaataccaaatgagttatcctccaacatccggcgaatccccaggcctggtagtgcgcgtcccgcacctccaagggtgaagcgacaggacagtatggaagccctgcagatggaccggagtgggtccggcaagacagtcagtaatgtaatcaccgagtcccacaattctgataatgaggaggacgatcagtttgttgtggaggccgcaccccagctgtccgagatgtctgagatcgagatggtgacagccgtggagctggaggaggaggagaaacacggcggattggtgaaaaagatcctcgagaccaaaaaggattatgaaaagcttcagcagagtcccaaaccaggcgagaaagaacgttctttattcgaatccgcttggaagaaagagaaagacatcgtgagtaaagagattgagaagctgcgtacttctattcaaacactgtgcaaatctgcgctgcccctaggtaagattatggattatatccaggaagacgtggatgctatgcagaacgaacttcagatgtggcactcggagaacaggcagcatgctgaagcactccaacaggaacagaggatcactgattgcgcagtggagcctttaaaggccgaactcgctgagttggagcagctcatcaaagatcagcaggataagatttgcgccgtgaaggctaacattttaaagaatgaagaaaaaatccaaaaaatggtctattcaattaacttaacctcccgccgatag

SEQ ID NO: 244176 - DNA, 2076 bp, Artificial Sequence
  Description of Artificial Sequence: Synthetic coding sequence
atgaatgcagctgtggttcggcgaactcaagaagccttgggcaaggtcattcgcagaccccctctaacggagaagttacttagcaagccaccattccggtacctccacgatataattacagaggtgatcaggatgactggctttatgaaaggactatacactgacgcagagatgaaaagcgacaatgtgaaggataaggacgccaaaatttcgtttctccagaaggcaatcgatgtagtggtcatggtgtccggtgaacctctccttgctaagccagctcgaattgtagcaggccatgagcccgaacgaacgaatgaactgctgcagattatcggcaaatgctgtttgaacaaactgtcgagcgacgatgcagtgcgccgagtgcttgccggagaaaagggcgaagtgaagggaagggcatcgctgaccagccgctcccaagaactggataataagaatgtgagggaagaggaatctagggtacacaaaaataccgaggatcggggagacgcggagatcaaggaaaggagcacttccagggacagaaaacagaaagaagagttgaaggaggaccggaagccgagagaaaaagataaggacaaagagaaagcgaaagagaatggaggcaataggcaccgagaaggcgagagagaaagagctaaggccagagctaggcccgacaatgagagacagaaggaccggggtaatcgggagcgcgacagagactctgagagaaaaaaggaaactgagcgcaagtccgaagggggaaaggagaaggagcggctccgggatcgagacagggagcgcgacagagacaagggaaaggaccgagatcgccgtcgggtgaaaaacggagagcatagttgggacctggatcgcgagaagaatcgagaacacgacaagccagagaaaaagtctgcatcctccggggagatgtcaaaaaagctaagtgacggcaccttcaaagattccaaggctgagacagagactgagatcagtacccgcgctagcaagagcttgacaacgaagactagcaagagacgcagcaaaaactccgtcgagggccgtaaagaggacaacatcagcgccaaatcactggattccattgtaagcggtataaacaatgagcctaaccaggagacgacaactagcgagatcgggacaaaagaagctaatatcaacagcacctctatctccgatgacaatagcgcatctctgcgctgcgagaatatacagccaaatcctacggagaagcaaaagggtaagaacggatctgagagagaaggagacgccggacccgcaggtcaagacaaatctgaggtgcccgaaacgcctgagatcccaaacgagttatcgtctaatatccggaggattcctaggcctggctcggccagaccagcacctccccgtgtgaagagacaggatagtatggaggctcttcagatggaccgatccggcagtggaaagacggtaagcaatgttattactgagtctcacaatagcgacaatgaagaggacgatcagttcgtggtagaagctgcaccccagctaagcgagatgtccgaaatcgaaatggtcaccgctgtggagctcgaggaagaagaaaagcatggtggactggttaaaaagatcctagaaaccaagaaggattacgaaaagctacagcaaagtccaaagccaggcgagaaagagaggtccctcttcgaatctgcatggaagaaagaaaaagatatagtgagcaaggagatagagaaactcagaactagcatacagaccttgtgcaagtccgcccttcccctaggaaagatcatggattatatacaggaggacgtggacgccatgcagaatgaactccagatgtggcattctgagaacaggcagcacgcagaagctctgcagcaggagcagaggatcacagactgtgcggtggagcccctcaaggcggagcttgctgagctcgagcagcttatcaaggatcagcaagataaaatttgtgctgttaaagccaatatcttaaagaacgaagaaaagatccaaaagatggtttactccattaatctgacctcacggagatag

SEQ ID NO: 244177 - DNA, 1878 bp, Artificial Sequence
  Description of Artificial Sequence: Synthetic coding sequence
atgaacgctgcagtggtgcggagaactcaggaggctctgggtaaggttattcgacgaccacctctcacggagaagctgctctcaaaaccgccattcagatacctccacgacatcattactgaagtgattaggatgactggattcatgaagggcctgtacacagacgccgagatgaaatccgacaacgttaaagacaaggacgctaaaatttcctttctccagaaggctatcgacgtggtggtcatggtctccggagagcccctgctcgccaaacccgctaggatcgtggccggtcacgagcccgagaggaccaacgagctcctgcagattatcggcaaatgttgcctgaacaaactatcttctgatgatgcggttaggcgtgtgctcgccggtgagaagggcgaagtgaagggcagagcatccctgactagccggagccaggagctcgataacaaaaacgtgagagaagaggagagcagggttcacaagaacactgaggacaggggcgacgcagagataaaagagaggagtacatcgcgagatcgcaaacagaaggaagagctgaaagaggatagaaagccacgcgaaaaggataaagacaaggagaaggcaaaggagaacgggggaaatagacatcgggaaggggagagggagagggccaaggccagggctcggccagataacgagcggcaaaaagatcggggaaatcgtgaacgggatcgcgattcagaaaggaagaaagagaccgaacggaagtctgagggaggcaaagagaaagagagactccgcgaccgcgatagagagcgagatagagataagggtaaagaccgggatcgacggagagtcaaaaacggcgaacacagctgggaccttgatcgcgagaaaaatcgagaacatgataaacccgagaaaaaaagcgcaagcagcggtgaaatgagcaaaaagttatcggacggcacatttaaggattcgaaagccgaaactgagaccgaaatcagtacaagagctagcaaaagcctgaccacaaagacaagcaaacggaggagcaaaaacagcgtcgaaggaaccgccaaactgatcctggagggcgacgccggaccagcgggacaagataaaagcgaggtgccagaaacccccgagattcccaatgaactttccagtaatattcgccgtattcccaggccgggaagcgctagaccagctccaccacgcgtgaaacggcaagatagtatggaagcccttcaaatggaccggtcaggctccggcaagaccgtcagcaacgttatcaccgagagtcacaactccgacaacgaggaggatgatcaattcgtcgtcgaggccgcaccacagctgtctgaaatgtcagaaatcgagatggttacagccgtcgaactggaagaagaggagaaacatggcggactagtgaagaaaattctcgaaactaagaaagattacgaaaaactgcagcagtcgcctaaaccaggagagaaggagcgaagtctctttgagtccgcttggaaaaaagagaaagatatagtgagtaaagagatcgaaaaactgcgcacctcaatccaaactttgtgtaagtctgcactgccactagggaaaatcatggattatatacaagaagacgtggacgcaatgcagaacgaacttcaaatgtggcactccgagaatcggcagcatgccgaagcactgcaacaggagcaacgcatcacagattgtgctgtggaaccattgaaagccgagctggcggagctggaacagctgataaaagatcagcaggataagatatgcgccgtgaaggccaacattctgaaaaatgaggagaagattcaaaagatggtctactccatcaacctcaccagtcgccgatag

SEQ ID NO: 244178 - DNA, 1674 bp, Artificial Sequence
  Description of Artificial Sequence: Synthetic coding sequence
atggcctacagcgaagaacacaaagggatgccgtgtgggttcatacgccagaatagcggtaattccatctctctagactttgaaccatcaatcgagtatcagttcgttgagagactggaagagaggtataagtgcgctttttgtcacagcgtgttacataatccccatcaaacgggttgcggccatcgcttctgccagcattgtatcctaagcctgcgcgagctgaacacggtgccaatatgtccggtggataaggaagtgattaaaagccaagaagtgtttaaagacaactgttgtaagcgcgaagtgttaaatctgtacgtctactgcagtaatgcgcctggatgcaatgcaaaggtgatattggggagatatcaagaccacttacagcagtgcctgtttcagccggttcaatgcagcaatgagaagtgccgcgaaccagtactgagaaaggaccttaaagaacacttgagcgcatcctgtcagttcaggaaagagaagtgcctgtattgtaagaaagacgtggtggttattaatctccaaaatcacgaggagaacctgtgtcccgagtacccagtgttctgccccaacaattgtgcaaaaatcatcctaaaaaccgaagtcgatgagcatctcgctgtgtgtccagaggccgagcaagattgtcctttcaaacactacgggtgtgctgtgactgacaagcggagaaatttgcaacagcatgagcacagcgcgctgcgcgagcatatgagactggtcttggagaaaaacgtgcagctggaggagcagatttccgacttgcacaagtccctggaacagaaggagtcgaaaattcaacagctggccgaaacaataaagaagttggaaaaggaattcaaacaatttgcccaattgttcggcaagaacggatcttttttacctaatatccaagtcttcgcttctcatatagataagagcgcatggctcgaggctcaggtccaccagttgttacaaatggtcaatcagcagcagaacaagtttgacctccggccactaatggaagctgttgacactgtaaagcaaaagatcacccttttggaaaataatgaccagcggcttgctgttttagaggaggagacaaataagcacgatacacatattaatattcataaggcccaactgtctaagaatgaggagcgcttcaagctcctagaaggtacctgctacaatggaaagctaatctggaaagtaaccgattacaagatgaaaaagcgggaagccgtggatgggcacacggtgtccattttttctcaatccttttacacaagcagatgcgggtacaggctgtgcgctcgagcatacctcaatggggacggctctggtcggggaagccacctgtccctatattttgtggtaatgcgcggtgagttcgattcccttttacagtggccgttcaggcaacgtgtgacccttatgctgttagatcagtctggcaagaaaaacatcatggaaacgtttaaacctgaccccaatagctcatcattcaagcgaccggatggcgaaatgaacattgcctcaggctgcccccgatttgtagcacactctgtactggagaatgccaaaaacgcttatattaaagatgacactttgtttcttaaagtggccgtggacctgacagacctcgaagatttatag

SEQ ID NO: 244179 - DNA, 1674 bp, Artificial Sequence
  Description of Artificial Sequence: Synthetic coding sequence
atggcttacagcgaagaacataaaggcatgccctgtggatttattaggcagaacagtgggaattcaatttcactggacttcgagcctagtattgaatatcagttcgtggagaggctggaggaaagatataaatgtgctttctgtcatagtgtgctacataaccctcatcagacaggttgtggccatcggttttgccagcactgcatcctctcactgcgggagctcaacacagtccctatctgccccgtggacaaagaggtaatcaaatcacaggaagtgttcaaggataattgctgcaagcgggaggttttaaacttatacgtctactgcagcaatgctcccggttgcaatgcaaaggtgatactggggaggtaccaagaccacttgcagcaatgcctttttcaacccgtccaatgctccaatgaaaaatgtcgggagccggttcttaggaaggacttgaaagaacatctgtcagcctcttgccaattccgcaaggaaaagtgtctatactgtaaaaaagacgtcgtggtcattaatcttcagaaccatgaggagaacctgtgccccgagtacccggtgttttgtcctaacaattgcgccaagatcattctgaaaaccgaagtggacgagcatttggccgtgtgcccagaagctgaacaggattgtccattcaagcactacgggtgtgccgtcacagacaagcgcagaaatctccagcaacacgagcactctgctctccgcgaacacatgagactcgtgctcgaaaagaatgttcagctggaagagcagatcagcgacctgcataagagcctggagcagaaagagtcaaagattcagcaactcgctgagaccattaagaaactagagaaagaatttaagcagtttgcccagcttttcgggaaaaacggaagcttcctcccaaatattcaggtattcgcaagccatatagacaagtccgcatggctggaagctcaggtgcaccagctgttacagatggtgaaccagcagcagaataagtttgacctgagacctttgatggaggctgttgacactgtaaaacagaaaatcactctgctggagaataacgaccaacggctggcggtgctggaagaggagaccaacaaacatgacacccacattaacatacacaaagcccagctttccaagaacgaggagcgatttaagttactggaggggacatgctataacggcaaactcatctggaaagtaaccgattacaaaatgaaaaagcgggaggccgttgacggccacaccgttagtattttttctcaatccttctatacgagtagatgcggttaccggctgtgcgctagggcctatttgaatggggacggctccggcagaggctcccacctctctctatactttgtggtgatgcgcggagaattcgatagtctcctgcagtggccctttagacagcgggtcacacttatgctacttgaccagtccggcaagaagaacattatggaaacatttaagcccgacccaaactcctcctcttttaagcgacctgacggcgagatgaatatagcaagcgggtgccctaggttcgtggctcacagtgtcctggaaaatgccaagaatgcatacatcaaggacgacacattgttcctgaaggtggccgtggatttgactgacctggaggacctttag

SEQ ID NO: 244180 - DNA, 1674 bp, Artificial Sequence
  Description of Artificial Sequence: Synthetic coding sequence
atggcgtacagtgaagagcataaggggatgccctgcggcttcattcgacagaactcggggaacagtatatcactggacttcgagcctagtatagaatatcagttcgtcgagaggctagaggagcgctacaaatgcgcattttgtcacagcgttctgcacaatccccaccagaccgggtgtggccatagattctgccagcattgcatcctctcgttacgtgaattgaacacagtgccaatttgtccggtggataaagaagttattaagtctcaggaagtgtttaaagacaattgttgtaagcgtgaagtgttgaacttatatgtgtactgtagtaacgcaccgggatgtaacgccaaggtaattctcgggaggtatcaggaccacctgcagcagtgcctgttccagccagttcagtgctccaacgaaaagtgcagagagcctgtgcttagaaaggatctgaaggaacacctcagtgcgagctgtcagtttaggaaagaaaagtgcctgtactgtaaaaaagatgtggtagtgattaacctacagaaccatgaggagaatttgtgtcctgagtatcctgtgttttgtcctaataactgcgctaagatcatcctcaaaacagaagtggatgaacatctggctgtgtgccctgaggcagagcaggattgccctttcaaacattatggctgtgccgttacagacaaaaggaggaacctgcagcagcatgaacactcagccctgagagagcatatgagattggtactggaaaagaacgtgcagctagaggagcagatcagtgatctccataagtctctggaacagaaggagagtaagattcagcagctggctgagacgataaaaaaattggagaaagaattcaagcagttcgctcagctgttcgggaaaaatgggtcctttctacccaatatacaggtcttcgcatcccacattgacaaaagcgcatggctagaggcccaggttcaccaactgcttcagatggtcaaccaacaacaaaacaaattcgacttaagaccacttatggaagccgtggacaccgtaaaacagaaaattacacttcttgaaaataacgatcagcggctcgcagtgttggaggaggaaaccaataaacatgatacccatataaatattcataaggctcagctttcaaagaatgaagaacgatttaagctcctggaaggtacctgttacaatgggaagctgatttggaaagttaccgactataagatgaagaagagggaggccgttgacggacacacggtgagcatcttttctcagtctttttacaccagccgctgtggttacagactatgcgccagagcctacctgaacggcgacggctcgggtcgcggatcccatttaagcttgtacttcgtggtgatgagaggtgagttcgatagcctattgcagtggcctttccggcagcgtgttaccctcatgcttttggatcagtccggtaaaaaaaatataatggagaccttcaagccagacccaaatagctcctcatttaaaaggccagacggcgagatgaacatagcttccggctgcccgaggtttgttgctcacagcgtcctggaaaacgcgaagaatgcctatatcaaggacgacacgctcttcctcaaggtagctgtcgacttgacagatttggaagacctgtag

SEQ ID NO: 244181 - DNA, 1356 bp, Artificial Sequence
  Description of Artificial Sequence: Synthetic coding sequence
atggcttactctgaggaacataaaggaatgccttgcgggttcatccggcaaaattctggaaattctattagtctggacttcgagccgagtattgaataccagttcgtagaaagattggaggaacgctataagtgcgctttctgccattcagttctgcataaccctcaccaaaccggctgcgggcaccgattctgccagcactgcattttatccttgcgagaactcaatacagttcccatttgtcccgtggataaagaagttatcaagtctcaggaggtgttcaaagataattgttgcaagcgcgaagtgctcaacctgtatgtctattgcagcaacgctccaggatgtaacgcgaaagtgatactcggcagataccaagataaacgaaggaatctccagcagcacgaacacagcgcactgcgagagcatatgcggttggtgcttgaaaagaacgttcaactggaggagcagatttccgacctccacaagtctcttgaacagaaggagtccaaaatccaacagctggccgaaacaatcaaaaaactggagaaggaatttaaacagtttgcacagctgtttggcaagaacgggagcttcctgcccaatattcaagtgttcgcctctcatatcgataagagcgcctggcttgaggctcaagtacaccagctgcttcagatggtgaaccagcagcaaaacaaattcgacctgcgcccactaatggaagctgtggacaccgtcaaacagaaaattacgctgctcgaaaacaacgaccaaagactggcagtgcttgaagaagaaaccaacaagcatgatacccacattaatattcataaggctcagctttctaagaacgaggagcgttttaaactgctggagggaacctgttataatggaaaacttatttggaaggtgaccgattacaaaatgaagaagcgggaggccgtagacgggcacacagtgtccattttctctcagagcttctacacctctagatgcggatacaggctctgtgctcgtgcatacctgaacggggatggctcaggtcggggaagtcacttatccttgtactttgttgtcatgaggggggaatttgatagccttctccagtggcccttccggcagcgagtgacgctgatgcttctggaccagagcgggaaaaagaatatcatggagacctttaagcctgatcccaattcttcgtctttcaagcgtccagacggggagatgaacatcgctagcggctgccctcggtttgttgcgcattcggtcctggaaaatgcaaaaaatgcgtatatcaaggatgatacccttttcctgaaggtcgccgttgacctgactgatctggaggacctgtag

SEQ ID NO: 244182 - DNA, 1569 bp, Artificial Sequence
  Description of Artificial Sequence: Synthetic coding sequence
atgtctctgctcaactgtgagaattcttgtgggtccagtcaaagcgagtccgactgctgtgttgcgatggccagtagctgtagcgcagtgactaaggacgacagtgtgggtggaaccgcttcgaccgggaacctgagcagtagctttatggaggaaatacagggatatgacgtagaattcgatcctccactggagtccaaatacgagtgcccaatctgtctgatggctctgcgagaagccgtacagaccccctgtggccatcggttctgcaaggcatgtattatcaagtctatacgagacgccggtcataaatgccccgtggataacgaaatcctcctcgagaaccagctcttcccggacaacttcgccaagagggagattttgagcttaatggtaaaatgtcccaacgaaggatgtttgcataaaatggaattaaggcatctggaggatcaccaggcgcactgtgagttcgcactgatggattgcccacaatgtcagcgaccttttcagaagttccatattaacatccatatcttgaaagactgccccaggcgccaggtgtcttgcgacaattgcgccgcaagcatggcgtttgaagataaagagatacacgatcagaactgccctctggccaatgtgatctgtgagtactgcaatactatccttataagggagcagatgcctaaccattatgatctagactgtccaactgccccaatcccatgcactttctcaacatttggctgccacgagaaaatgcagaggaatcacttggctagacatctacaggagaatacccaatcccacatgcgtatgttggcccaggctgtgcacagcctgtctgtcattcccgattctggatacatctctgaagtgcgcaattttcaggaaacaattcaccagcttgagggaagactcgtcaggcaggatcatcagattcgcgagctaactgccaagatggagacccaatcaatgtatgtaagtgagctcaaacgtacaatcagaactctggaggacaaggttgcagaaatcgaggcacagcaatgcaacgggatctatatttggaaaattggaaattttggcatgcacttgaagtgtcaggaagaagaaaaaccggtcgtcattcatagtcctggattttatacggggaagcctggatacaaactttgtatgagattacacctgcagctcccaactgctcaaaggtgcgcaaattacattagcctatttgtccatactatgcaaggagagtacgattcccacctgccatggccttttcaggggaccatccgcctgacaatactggatcagtcggaggcgccagtgagacaaaatcatgaggagataatggatgcgaaaccagaactgctggcattccagcgtccaacaatcccccgtaatccgaagggttttggatatgtgactttcatgcacctggaggcgctgcgccaaagaacgtttataaaagatgacacacttctcgtgagatgtgaggttagtacaaggtttgacatgggatcgctccgacgagaggggttccagcctcgcagcaccgacgcgggagtctag

SEQ ID NO: 244183 - DNA, 1569 bp, Artificial Sequence
  Description of Artificial Sequence: Synthetic coding sequence
atgagcctactgaattgtgaaaatagctgcggatctagtcagtctgaatccgactgctgtgtggcaatggcttcatcgtgttcagctgtgactaaggacgactctgtcggtgggacggcttccacggggaatctctcctcttccttcatggaggagatccagggatacgacgtggaattcgacccaccactggagagcaaatatgagtgtcccatatgcttgatggctctgcgcgaggcagtgcagacgccatgtggccatcgattttgcaaagcctgcattatcaaatccatcagagatgcaggccataagtgcccagtggacaacgagatccttctggaaaatcaactgttcccagacaacttcgctaagagggagattctaagcctgatggtgaagtgccccaacgaaggctgcttgcacaagatggaactgcgacacttagaagaccaccaagctcactgtgagttcgctcttatggactgcccgcaatgtcagcgaccttttcagaagttccacattaacatccacattttaaaggattgtcccagaaggcaggtaagctgtgataactgtgccgctagcatggctttcgaagataaagaaatccatgatcaaaactgccccctggccaacgtgatttgcgagtactgtaacaccattttaataagagagcagatgccgaaccactatgatctagattgtcctacagctccaatcccttgcaccttttcaactttcggctgccatgaaaaaatgcaacggaaccacctggcccgacatctgcaggagaatacacagtcccacatgcggatgctggcccaagctgtgcacagcctgtccgtaattccagattctgggtacatttctgaggtgcgtaacttccaggagaccatccatcagcttgaggggcgacttgtgagacaagaccaccaaatacgagaactaaccgcaaagatggagactcaatcaatgtatgtgagcgagctcaaaagaactattaggaccttagaagacaaagtagcagagatagaggctcagcaatgtaacggtatatacatctggaaaatcggcaatttcggaatgcatctaaagtgtcaagaagaggagaagcccgttgtcatccactcccctgggttttacacaggcaagcctggctacaagctctgcatgcgactgcatcttcagcttccaactgcgcaacgctgtgccaactatatcagcttattcgtgcatacaatgcaaggggagtatgacagtcatctgccctggccgttccaggggactatacgtttgactatcctggaccagagcgaggcaccagttagacaaaaccacgaggagattatggacgcaaagcctgagctgctggccttccaacggcctactatacctcggaatccaaagggattcggatacgtgacctttatgcacttggaagccctaaggcaacgtacctttatcaaggatgacaccttgctggtgagatgtgaagtcagcacacggttcgatatgggaagtttgaggagggagggatttcaaccccgaagtacggacgccggagtgtag

SEQ ID NO: 244184 - DNA, 2013 bp, Artificial Sequence
  Description of Artificial Sequence: Synthetic coding sequence
atgtcatcagggaaaagcgccaggtataatcggttttccggtggcccatccaacctccccacgcctgacgtgacaaccggaactagaatggagactacattcggacctgccttctcagctgtgaccacgatcacaaaagctgacggcaccagcacgtacaaacagcactgtcgcacccctagctcctctagcacgcttgcctatagccctcgggatgaggaggattcaatgccccctatttccactcctcgaaggtccgatagcgccatctctgttaggtcactgcactcggaatccagtatgtcgctccgatcaaccttttctctcccagaggaggaggaggagccggaacctctcgtctttgccgagcaacctagcgtaaagttatgctgccagctgtgttgtagtgtgtttaaagatcctgtgatcacaacctgtggccacaccttctgccgcagatgcgccctgaagtcggaaaaatgccccgtagacaatgtgaagctgacagtggtggtcaacaacatagcagtcgccgagcaaattggcgagctgttcatacactgcagacatggatgtagagtcgctgggtcaggtaagccacctatttttgaggtggacccgcgtggctgcccattcacgataaagttgtccgcgaggaaggaccacgaggggagctgtgactaccggccagttcggtgtccaaacaatccgtcttgcccgccattactacgcatgaacctggaggctcacctgaaggagtgcgagcacatcaagtgcccccattctaaatatggatgcacattcattggaaaccaagatacgtacgagactcatctggagacatgccgcttcgagggtctgaaggaattcctgcagcagaccgatgatcgatttcacgagatgcacgtggctctggcacagaaagatcaggagatcgcttttctccgctccatgttggggaagctgagcgagaaaatagatcaattggaaaaaagcctggagctaaagttcgatgtgctcgacgagaatcaatctaaactgtccgaggacctgatggaatttaggagagatgcgtccatgctgaatgacgagctcagtcacattaatgctcgcctgaacatgggcatcctgggctcctacgatccccagcagatttttaagtgcaagggtacatttgtcggtcatcagggtcccgtgtggtgtctatgcgtgtattctatgggcgatttactgttcagcgggagtagtgataaaactattaaggtctgggacacttgcactacatacaaatgtcaaaaaaccctcgagggccacgatggaattgtgttagcactttgcatccaggggtgcaaactgtacagcggaagcgccgactgcaccattatcgtgtgggatattcaaaatttgcagaaagtcaatacaatcagggcacacgacaatcctgtatgtactctcgtgtcctcccataacgtgctgttctccggcagtttaaaagcaataaaagtgtgggacatcgtgggcactgagctaaagctgaagaaagagcttacagggttgaatcactgggtgcgggcacttgtcgctgcacagtcctacctgtatagtgggagttatcagactatcaagatatgggacatcaggaccctggactgtatacacgtgctgcagacgtccgggggatctgtctacagcatcgccgtgactaatcaccacatcgtatgtgggacttatgagaatttaattcacgtatgggacattgaaagtaaagagcaggtgcgaacgctgaccggccacgtgggaactgtttacgctttggccgtaataagtacacctgaccagaccaaggtctttagtgcaagctatgacaggtccttgagagtctggtccatggacaacatgatttgcacgcaaactctgctgcgtcaccagggcagtgttactgcgttagctgtttcaaggggccgtttattttcaggggcagttgactccacagtgaaggtgtggacctgttag

SEQ ID NO: 244185 - DNA, 2115 bp, Artificial Sequence
  Description of Artificial Sequence: Synthetic coding sequence
atggcccgtgagcttcgagccctccttctttgggggcgtagattgaggcctttgctgcgcgcacctgcactagccgcagtgcccggtgggaagcctatcctctgtcctagacgcacaaccgctcagctggggcctcgcaggaaccccgcatggtctcttcaggcaggaagactgttttcgacgcagacagcagaggataaggaggagcccctgcattcaattatcagcagtaccgagtctgttcagggatctacatcaaagcatgagtttcaagctgagaccaaaaagctgctggatatcgttgctaggtcactatatagtgagaaggaagtcttcatcagagagcttatttctaacgccagtgacgccctcgagaaactcaggcacaagctggtgagtgacgggcaggccttaccagagatggagatacacttgcagaccaatgccgaaaagggtacgatcaccattcaagacacaggcatcggcatgactcaggaggagctagtgagtaacctcgggaccattgccaggagcgggtctaaagccttcctggatgcattacagaaccaggccgaagccagctctaagattattgggcagtttggcgttgggttttactcggccttcatggtagctgatcgtgtcgaagtgtattcgcgcagcgcagcgcctgggtccctgggatatcagtggctttcggatggctctggtgtcttcgagatcgcagaggcatcaggagtgaggaccggaactaagatcataatccatctgaagtccgactgcaaggagttctccagcgaggcccgtgtgagagatgtggttaccaagtattcgaacttcgtttcattccctctttacctgaatggtagacgcatgaataccctgcaggccatctggatgatggaccccaaggatgttcgggagtggcaacatgaagaattctaccggtatgtggctcaagcccacgacaagcccagatacacgttacattacaagaccgacgcacccctcaatatacggagcattttctatgtgcctgatatgaagccctcaatgttcgatgttagccgcgagttgggaagtagcgtggccctatacagccgaaaagttctcatccagaccaaagctaccgatattctgcccaaatggttacggttcattcggggagtcgtcgattccgaagacatccctctcaatctatcccgggaactcctccaagagtccgctctgatccgtaagttacgggacgtgctgcaacagagattaatcaagttcttcattgaccagagtaaaaaagacgccgaaaaatacgcgaaattcttcgaagactacggtctcttcatgcgtgaaggaatagtgactgcaactgagcaggaagtaaaggaagatattgccaagctgcttaggtatgagtcgtccgccctgccttctggccagcttacctcactgagtgagtatgcatcccgcatgcgtgctgggactcgaaatatttactacctgtgcgccccaaatcggcacttggccgaacacagtccctactatgaggcaatgaaaaagaaagacactgaggtcctgttctgtttcgaacagtttgatgaactgaccttgctgcacctacgggagtttgataagaaaaaactcatatccgtggagaccgacattgtggtagatcactataaggaggagaagtttgaggaccgctcccctgcggcagaatgcctcagcgagaaggagacggaggagcttatggcatggatgaggaacgtgctcggaagcagggtcacaaatgtgaaggtgaccctgcggcttgatacgcaccccgctatggttacggttctggagatgggggctgccagacacttcctgcgcatgcaacaactggccaaaacgcaagaggagagggcacaactgctgcaacctactcttgagattaacccaaggcacgccctgataaagaaattaaatcaactgagggctagtgaacctggcctggcccagcttctggtcgatcaaatctatgagaatgcaatgattgccgctggtctcgtggacgacccacgtgcgatggtcgggaggctgaacgaactccttgtgaaagccctggagcgccactag

SEQ ID NO: 244186 - DNA, 1956 bp, Artificial Sequence
  Description of Artificial Sequence: Synthetic coding sequence
atggcccgagagctgcgggctctcctattgtggggacggaggctgcggcctttgttacgcgcaccggcactagcagcggtgccgggaggttctacttctaaacatgagttccaagcggagacaaagaagttgctcgatattgtggctcgcagtctgtattccgaaaaggaggtcttcattagagagcttatctctaatgctagtgacgctctggagaagctgcgtcataaactggtcagcgatggtcaggcactgcccgagatggagattcacctacaaaccaacgctgaaaaaggaacaatcaccatccaagatactgggatcgggatgacacaggaggaacttgtgtccaacctcggcactattgcacgttcaggctccaaggccttccttgatgccctccagaaccaggccgaggcgtcatctaagatcatcggacaatttggcgtgggcttctactcagcttttatggtggccgatcgcgtggaagtttatagcagaagcgcagccccagggtcactgggataccagtggttatctgatggatcaggggtgtttgagatagcggaggcctcaggtgtgagaacgggaacgaagatcatcatacacctgaagtcagactgtaaagagttttccagtgaggccagagtgcgggatgtggtgaccaaatattctaatttcgtgagttttcccttatatctgaacggcaggcgaatgaatacactgcaggccatctggatgatggatcctaaggacgtcagagaatggcaacacgaggagttctaccggtatgtggcgcaagctcatgataagcctagatacactttgcattacaagaccgacgctcctctgaatattcggtccatcttttacgtgcccgatatgaaaccttcaatgtttgatgtcagccgagagctgggctcctccgtggctctgtactccaggaaagttctcatccagacgaaagctactgatattctgcctaaatggctccgattcatcagaggcgtcgtagactccgaggatattcccctgaacctctctcgtgagctcctgcaagagtcggccctgatacggaagctccgagatgttttgcagcagaggcttatcaagttctttatagatcagtccaagaaagacgcagagaaatacgccaaattctttgaggactatggactctttatgcgtgaaggtatcgttactgccacagaacaggaagtgaaagaggacatagccaagctactgaggtacgagtcatctgcacttccctctggccagctgaccagcctgagtgagtacgctagtcgcatgagagccggaacaaggaatatttactatctgtgcgctccaaaccgacatttggctgaacactctccgtattacgaggccatgaaaaaaaaggataccgaggtgctgttctgctttgagcagtttgacgaactaaccctgctccatctgagggagttcgataaaaagaaactcatttctgtcgaaactgacatcgttgtggatcactacaaggaggagaaatttgaggacagaagcccagccgcagaatgcttgagtgagaaagaaaccgaagagctaatggcttggatgaggaacgtattggggtcacgggttaccaatgtaaaggtgaccctcagactcgatacccatccagccatggtaacagtccttgagatgggcgcagctaggcactttctcagaatgcagcaacttgcaaaaacacaggaagaacgggcacagctactgcagcccaccctggaaataaatcctaggcatgcgctgatcaaaaagctgaatcagctgagagcgtctgagcccggactggcccaactcctggtggatcaaatctacgagaacgcaatgattgcagcagggctggttgatgatccgcgtgccatggttgggagactcaacgaactgcttgtgaaggccttggagcgccattag

SEQ ID NO: 244187 - DNA, 1911 bp, Artificial Sequence
  Description of Artificial Sequence: Synthetic coding sequence
atggagggacgcggtccatacagaatctacgacccaggtggttccgtgccatctggggaggcctcagccgcattcgagcgactcgtaaaggagaactctagactgaaggaaaaaatgcagggcataaaaatgctgggcgagttactcgaggagagtcagatggaagccacccggctgagacaaaaggctgaagagcttgtcaaggacaacgaacttctgcccccaccttctccgtcacttggcagttttgaccccctcgctgagctcactgggaaagatagcaacgtgacagcctcacccactgcacccgcttgcccatccgataagccagccccagtgcagaaaccacccagctcaggcacatcttccgaatttgaagttgtgacacctgaggaacagaactcccccgagtccagctcacacgccaatgctatggctctcggcccattgccccgagaggacggcaacctgatgcttcacctgcaacggctcgagaccacgctctccgtgtgcgccgaggagccagaccacggtcagctcttcactcacctcgggagaatggccttggagtttaataggctggctagcaaggtacataagaacgagcagcggacatccattttgcagaccctttgtgagcagttgcgaaaggaaaacgaggccctcaaagccaaacttgataagggacttgaacaacgcgaccaagctgccgaaagacttcgagaggaaaacctcgagctcaagaagctgttgatgtctaatggaaataaggagggggcttctggcaggccaggctcccctaaaatggaaggcaccgggaagaaagcagtggccggacaacagcaggctagcgtgactgccggtaaagtgcctgaggtcgtggcccttggcgcagccgagaaaaaagtgaagatgctcgagcaacagcgctctgaattgcttgaagttaataaacaatgggaccaacacttcaggtctatgaaacagcagtacgagcagaaaattacagagctacgacagaaactggctgacctgcagaaacaagtgacagacctggaggcagaaagggaacaaaaacagcgagattttgaccgaaaactactactagctaagtcaaagatcgagatggaagagacagacaaagaacaactgactgccgaagctaaagaactgaggcagaaggtcaagtacctccaggaccagttaagccctctgacgagacagagagaataccaggagaaagaaattcagaggcttaataaggcacttgaggaggcattatccatccagactcccccaagcagccctcctaccgcttttgggagtccggagggggcaggcgcacttttgcgaaagcaagaactggtcactcagaacgagctactgaagcagcaagtcaagatcttcgaagaggactttcagcgagaacgctcggaccgagaaagaatgaacgaagaaaaggaggagctgaaaaaacaagtggaaaaacttcaggcccaggtgactctctcgaacgcccagttaaaggccttcaaggacgaagagaaggctcgggaagcattgagacaacagaagagaaaagctaaggcttccggggaacggtatcacgtggagccacatccagagcatctgtgcggagcctacccctacgcctatcccccaatgccggctatggtcccccaccatggattcgaggactggagccaaattagatacccccctccacctatggctatggagcaccctcctcccctccccaacagtcgcctctttcacctaccagagtatacctggcgcctgccttgtggcggagttcggaatccaaaccagtcctcccaggtgatggaccctccaaccgcacggcctaccgaacccgaatctcctaagaatgaccgtgaaggccctcagtag

SEQ ID NO: 244188 - DNA, 1911 bp, Artificial Sequence
  Description of Artificial Sequence: Synthetic coding sequence
atggagggaaggggtccttacagaatctacgaccctgggggatccgtgccttcaggggaggcttccgccgcttttgaacgcttggttaaagaaaacagccggctgaaagaaaagatgcagggtattaagatgttgggcgagcttctagaagaatctcaaatggaagccacccgccttcgtcagaaggccgaagagctggtgaaggataatgaactgctacctccacccagcccttcattgggttcgtttgaccccttggcagagttaactggcaaggattccaacgtgacagcttctccaacagccccagcctgtcccagcgataagccagctccggtccaaaagccaccttccagcggaacttcatccgagttcgaagtggtaacaccagaagagcaaaacagccctgagagttcctcccacgcgaatgctatggccttgggaccgctcccacgtgaggatgggaaccttatgttgcacctgcagcgcttggagacgacattgagcgtctgtgctgaggagcctgaccatggccagctgtttacccatttggggagaatggcgctggaatttaaccgattagcaagcaaagtgcacaaaaatgaacagcgcacttccatcctacaaacattgtgtgaacagctgagaaaagagaacgaggctctcaaggccaaactggacaaagggctcgaacagcgagaccaggctgccgaacgcttaagagaggagaacttggaactcaaaaaattgctcatgtctaacggtaacaaggaaggcgcttccgggagacctggatctccaaagatggaaggaaccggtaaaaaggccgtcgcagggcagcaacaggctagtgttacggccggaaaggtgcccgaggtcgttgcgctgggtgcggctgaaaagaaggtgaagatgttggaacagcaaagaagtgaactgctcgaggtcaacaaacagtgggaccagcactttcgctccatgaaacaacagtacgaacagaaaattacggaattgcggcagaaacttgccgatcttcagaagcaggtcaccgatctcgaagctgagcgagaacagaagcagagagactttgatagaaaattactgctcgccaagagtaaaatagagatggaggaaaccgacaaggagcaactcaccgcagaggctaaggagttgcgccaaaaagttaaatacctccaggatcagctttcacccctcacacgacagagggagtaccaggaaaaggagattcaacggctgaataaggcactggaagaggcactaagcatacagacccccccttcgagcccacccaccgcgttcggcagtcctgagggagcaggtgcccttttacggaagcaggagttggtcacccagaacgaattactgaaacagcaggtgaaaatctttgaggaagacttccagagggagcgcagcgaccgggagagaatgaacgaagaaaaagaagagctgaagaaacaggttgagaagctgcaggctcaggtaacgttgtctaacgcacagcttaaggctttcaaggacgaggagaaagcacgggaagccctgcggcaacagaaacgcaaggctaaagcaagcggcgaaagataccacgttgagccacacccggaacacctgtgtggagcgtatccctatgcctacccccctatgccagcaatggtgccccatcatggcttcgaggactggagccagataagataccctcctcccccaatggccatggaacacccacctcctttaccaaattctcgactatttcacctgccagagtacacctggcggttgccctgcggtggagtgcggaaccctaaccagtcatcccaagttatggacccaccaactgcacgacccacagagcctgagagcccaaaaaatgatagagagggaccacaatag

SEQ ID NO: 244189 - DNA, 1590 bp, Artificial Sequence
  Description of Artificial Sequence: Synthetic coding sequence
atgttgggagaactgctcgaagagagccaaatggaggctacgcgactgaggcagaaggctgaggagctggtgaaggataatgaattacttccccctccatccccgtcactgggctccttcgatcccctggccgaactaaccgggaaagactccaatgtgaccgcctcacccacggctcccgcttgtcccagcgacaagcccgcacccgtgcagaaaccaccaagttccggaacctcctccgagttcgaagtagtgactccggaggagcaaaacagtcccgagtctagctctcacgccaacgccatggcactggggcctctgccaagggaagatggaaatttgatgctccatcttcaacgcctggaaactactttaagcgtttgtgctgaggaacccgatcacgggcagctgtttacgcacctgggcaggatggctttggaatttaaccgcctggcttccaaggttcataagaacgaacagcgcacctctatcctacagaccctgtgcgagcagcttaggaaggaaaatgaggcccttaaggctaagctcgataaaggcctggagcagagagaccaggccgcagagcgattaagggaggagaatctcgagctgaagaagctgcttatgtccaacggaaacaaggagggcgcttcaggtcggcctggcagccctaagatggagggaacgggcaaaaaagccgttgccggtcaacagcaggcttccgtaacagctggcaaagtcccggaggttgtggcactcggtgctgcagagaagaaagtgaagatgctcgagcagcaacggtccgaactccttgaagtaaataagcagtgggatcagcactttcggagtatgaagcaacaatatgaacagaaaatcacagagcttcggcaaaagctagcagacctgcagaaacaggtcacagatctggaggcagaaagagagcagaaacagcgggattttgataggaaattgctcttagctaaatctaagattgagatggaggaaacagataaagagcagctgaccgctgaggcaaaagaacttagacagaaagtgaaatacctacaggaccaactgtcaccgctgacacggcagagagagtatcaggaaaaagagatccaaagactcaataaggccctggaagaagccctgagcattcaaacacctccgagcagcccccctaccgcattcggaagccccgaaggcgctggggctctgcttcggaaacaggagctagtgacccagaacgagttgctcaagcaacaggtcaagattttcgaagaggactttcaaagggagcggtctgatcgagaacggatgaacgaagaaaaggaggagctgaagaagcaggtggagaagttacaggctcaggtgaccttgagcaatgcacagcttaaagctttcaaagatgaggagaaggcacgggaggctctgagacagcagaaacggaaggcaaaacctgagtacacgtggcggctgccttgtgggggtgtgagaaacccgaaccagtcatcacaggtcatggacccgccaaccgcccgtcccaccgagcccgagtcacccaagaacgatagggagggtccgcagtag

SEQ ID NO: 244190 - DNA, 1908 bp, Artificial Sequence
  Description of Artificial Sequence: Synthetic coding sequence
atggaaggccgtggcccataccggatttacgatccaggaggatctgtgcccagtggagaggcctcagccgcttttgagcgtctcgttaaagaaaattcccgcctgaaagagaagatgcagggaatcaagatgctaggcgagcttctggaggaatcacagatggaagcaacacgactgagacaaaaggcagaagagctcgtgaaggataatgagctgttaccacctccttcgccttcgctgggcagctttgatcctctggccgagctgaccggcaaggatagcaacgtgaccgcttctcccacagccccagcctgtccttctgacaagcctgcacccgtgcaaaagcctcctagctctggaaccagctcagaattcgaggtggtgactccagaggaacagaacagccccgagtcttctagtcacgccaatgcaatggctctgggcccactgccacgagaagacgggaacttgatgctgcacctgcagcggttggagaccaccttgtctgtctgcgccgaggagcccgatcacggacagctgtttacgcacctgggtcggatggctctcgaattcaataggctggcttccaaagtgcataaaaatgaacagcggacaagcatactgcagacactatgtgagcagctcagaaaagaaaacgaggccctgaaagccaagctggataaaggcctggaacaacgagaccaggctgcagaaaggttgcgagaagaaaacttagaactgaagaaattgttgatgagtaacggcaacaaagagggcgcttcaggtcgccctggctctccaaagatggaagggactggaaagaaggctgttgcaggccaacagcaggcctccgtgactgcaggaaaagtaccagaagtcgtggccctcggcgctgccgaaaagaaggtgaaaatgctggagcaacaaagatctgagttgcttgaggtgaacaagcagtgggaccagcactttcggtcaatgaagcagcagtacgagcagaagataaccgagctgagacaaaagcttgcagatctgcagaagcaggtcaccgacctggaggcggaacgggaacaaaaacagagggacttcgacagaaagctgctactcgccaaatcaaagatcgagatggaggaaactgacaaggaacagctgactgctgaagctaaagagcttaggcagaaggtcaagtatctccaggaccagctcagtcctctgactcgtcagcgggaataccaggagaaagagattcaacgcttgaacaaagcactggaggaggcgttgtcaatacagacgcccccaagctcaccgccaaccgcctttggctcccctgaaggcgctggtgcactgctgaggaagcaagaacttgtgactcaaaacgaactgttgaaacagcaggtcaaaattttcgaggaggattttcagagggagcgatccgatcgtgaacgaatgaacgaggaaaaggaagagctgaagaaacaagttgagaagctgcaggcgcaggtgacattatcaaatgcgcagcttaaggcgtttaaagacgaagagaaggctagggaggccctacgtcagcagaagagaaaagctaaggcctctggtgagcgctatcatgtcgagccacaccccgaacacctctgtggggcttatccttatgcctatcctcctatgccagcaatggtgcctcaccatgggttcgaggattggtctcagataaggtatccgcctcctccaatggcaatggaacatcccccacccctaccgaactctcggctcttccacctgcccgagtatacctggaggctgccgtgcggaggcgttcggaaccctaaccagtcatctcaggtgatggacccgcctacagccagacctacggaaccagaacccgctgatttacggctgccacggaattag

SEQ ID NO: 244191 - DNA, 1479 bp, Artificial Sequence
  Description of Artificial Sequence: Synthetic coding sequence
atggaggccacacgcctgcggcagaaggccgaagagctggtgaaagataatgagctcctaccccctccttcaccctccctgggaagcttcgaccccctcgccgagctgaccggcaaagatagtaacgtaaccgcaagtcctacagccccagcttgtcccagcgataagcctgctcccgtgcagaagcccccaagttcaggcacctcttcagaatttgaagtcgtcacccccgaggagcagaatagcccagaatcctcgagccacgcgaatgccatggcgcttggaccactgcccagggaggatggcaacctgatgttacacctgcagcgtttggaaacaactctctcggtatgtgcagaagagccagatcacggccagctgtttactcatctgggaaggatggcactggaattcaaccggctggctagcaaagttcataaaaacgagcaacggacaagcatcctgcagaccttatgcgaacaactgcgtaaggaaaacgaagccctgaaggcaaagctggataagggactggaacaaagagatcaggcagctgaaagattacgggaagagaacctggaactcaagaaactcttgatgtcaaatgggaacaaggagggagcgtccggcaggccgggtagccctaagatggaaggaaccggtaagaaagcagtggcaggacagcaacaggcaagcgtgacggccggaaaagtgcccgaagttgtcgctcttggcgctgccgagaagaaagtgaaaatgctggaacagcaaagatctgagttattggaggtcaacaaacagtgggatcagcatttccgttctatgaagcagcaatacgagcagaagatcaccgaactgcggcaaaagctggcggatctccagaaacaggtgacggatctggaagccgaaagagaacaaaaacaaagagacttcgatcggaagctcctgctggcaaaatcaaagatcgaaatggaggaaactgataaagaacaactcaccgcggaggcaaaggaactccggcagaaggtcaaatatctacaggatcaactgagccctctgactagacaaagggaataccaggagaaagagatacagaggttaaataaggcgttggaggaggcattgagtatccaaaccccacctagctccccacctacagctttcggttctcccgagggtgctggggctctcctgcgtaagcaggaactggtaacacagaacgaactcttgaaacagcaggtcaagattttcgaggaggattttcagcgagagcggtccgatagggagcgtatgaatgaggaaaaagaagaactgaaaaaacaagtggagaagctccaggctcaagttacactctccaacgcccagcttaaggcatttaaagacgaagagaaagcccgtgaagctttacggcaacaaaagcgtaaggccaaaggaacccatagaggctgcccccgtcatctgcccgagcggaaagttaaatag

SEQ ID NO: 244192 - DNA, 435 bp, Artificial Sequence
  Description of Artificial Sequence: Synthetic coding sequence
atggaaggtcggggaccctatagaatctatgatcccggtgggtctgttccctccggggaggccagtgcggcttttgaacgattggtcaaagaaaatagccgattgaaagagaaaatgcaggggattaaaatgttgggtgaacttttggaagaaagtcaaatggaggccactagactgaggcagaaggctgaagagctcgtgaaggacaacgagctcctgccccctccatcaccttctctaggctcattcgacccacttgctgaattgaccggtaaggatagtaacgtgactgccagtcctaccgctccagcctgtccatctgacaagcctgctccagtgcagaagcccccaagcagtggcacctcctctgaattcgaagtggtgacaccggaggagcaaaattcaccagagtcgtcttctcacgcgaacgcctag

SEQ ID NO: 244193 - DNA, 1752 bp, Artificial Sequence
  Description of Artificial Sequence: Synthetic coding sequence
atggaagccaccagactcaggcaaaaagcggaagaattagtgaaggataatgaactgttgccaccaccttctccttccctgggcagtttcgatcccctggcagagctaaccggcaaagactcgaatgtaacagctagccccactgcacccgcttgtcccagtgacaagcccgcacctgtgcaaaaacctccttcatctggaacctcaagcgaattcgaagtcgtaaccccagaagagcagaacagcccggaaagctctagtcacgccaacgctatggccttaggacccctgcctcgtgaagatggtaacctgatgttgcacttacagcgccttgaaacgactctctccgtgtgtgcagaggaacctgaccatggacagctgtttacccacctgggacggatggcactcgagtttaatcgtttagcaagcaaggtacataaaaacgaacaaagaaccagcatcctacagacactatgcgaacagttgcgcaaagaaaacgaagctttgaaagcaaaacttgataagggcctggaacagagagatcaggccgctgagcggctacgcgaagaaaacctggagcttaaaaaactgctaatgtcaaacggcaacaaagaaggagctagcggtcggccaggaagtcccaagatggaaggcaccggaaagaaggcggtggcaggacagcagcaggccagtgtgaccgctggaaaagttcccgaggtggtggcgcttggcgctgccgagaagaaagtgaagatgttagaacagcagcgtagtgagctgctggaggtcaataagcagtgggatcagcacttcaggtcaatgaagcaacaatatgagcagaagatcacagagctgcgccaaaagttggctgacttacagaagcaggtcacagatctagaagccgagagagagcagaaacagcgcgattttgaccggaaattgctgctcgccaaatctaagatcgagatggaagaaacagacaaggaacagctgacagccgaggcaaaggaattgcgtcagaaagtgaagtatcttcaggatcagctatctcctctaaccagacaacgcgagtatcaagagaaagagatccagcggttgaacaaagcgctcgaagaggctctgtcaatccaaacacctccatctagcccccctacagcattcggctccccggagggcgcaggagccctgcttagaaaacaagaactggtcactcaaaatgagttgctcaagcagcaagtaaagattttcgaggaggacttccagcgcgagaggtcggaccgggaacgaatgaatgaggaaaaagaagaactgaaaaaacaggtggaaaagctgcaggcacaggtgacccttagcaatgcccaattgaaagcttttaaggacgaagagaaggctagggaagccctgagacagcagaaaagaaaggccaaagcttccggcgaaagatatcatgtcgaaccccatcctgaacacctgtgcggtgcctatccctacgcataccctccaatgccggctatggtcccccaccacggcttcgaggattggagccagatccgttatccgccacccccaatggctatggaacatcctcccccattgcccaatagcaggctcttccatttacctgagtacacatggcggctgccctgtggtggcgttaggaatccaaaccagagttcacaagtcatggacccgcctactgccagaccaaccgagcccgagtccccaaagaacgatagagaaggcccacagtag

SEQ ID NO: 244194 - DNA, 402 bp, Artificial Sequence
  Description of Artificial Sequence: Synthetic coding sequence
atggagggtcgcggtccatacagaatttacgatcccggagggtctgttccttccggggaggcgtccgcagcattcgagcgcctggtgaaagaaaattctcgactgaaagagaagatgcaaggaattaagatgctcggcgaactgttagaggaatctcagatggaggccacccgcctgcgccaaaaagccgaggaacttgtaaaggataatgaactcttgccacccccttccccttccctgggctcatttgatcccctagcagagctgaccgggaaagatagtaatgtcaccgccagccccactgccccagcttgtcctagtgacaaaccggctcccgtccaaaagcctccttctagtggcacatcgagcgaattcgaagtggtgacacccgaagaacagtag

SEQ ID NO: 244195 - DNA, 1911 bp, Artificial Sequence
  Description of Artificial Sequence: Synthetic coding sequence
atggagggcaggggaccctacaggatctatgaccctggcggaagcgtgcccagcggggaggcgtctgctgcatttgaaaggttagtcaaggaaaactctagactaaaagagaagatgcagggcattaagatgctcggagagctacttgaagagtcccagatggaggcaacacgtctgcgccagaaagctgaggagctcgtgaaggataacgaactcttgccgccaccctctccgagccttgggagtttcgatcccctggcagaactaaccggcaaggactccaatgtcactgcatcaccgactgctcctgcttgcccatcagataagcccgctcccgtgcagaagccccctagctcaggtacttccagcgaattcgaagtcgtaactcctgaggaacagaactctccggagtcatcaagccacgcgaatgccatggccctgggtcctctacccagagaggacggcaacctgatgctccatcttcagcggctggagactacactgtccgtgtgcgccgaggagccagatcatggtcagttgtttacacatctgggacgaatggcactggaatttaacagacttgcttcaaaagttcataaaaacgagcaaaggacatctatcctacaaaccctgtgtgagcaactcagaaaggagaacgaggccctgaaggccaagctcgataagggcctagagcagagggaccaggcagccgagagactgcgagaggaaaatcttgagttgaagaagcttcttatgtccaacggaaacaaggagggagcctccgggaggccagggtcccctaagatggagggcacaggcaagaaagcagtcgctgggcagcagcaggcttctgttacagccggaaaggtgcctgaggtcgtcgcccttggtgccgcagagaaaaaggtgaaaatgttggagcagcagagatctgagctactggaggtaaacaaacagtgggatcaacacttcagatccatgaagcagcagtacgaacaaaagattaccgagctgcgccaaaagttggccgacttgcagaaacaggtgacagacctggaggctgagcgcgaacagaagcaacgggatttcgatcgcaagttacttctcgcaaaaagtaagatagagatggaggagactgataaggaacagcttactgctgaagctaaagaactgaggcagaaagttaaataccttcaggaccagctttctccgctgactcggcagagagagtatcaagaaaaggagattcagcgcctcaataaagcactggaagaggcgctgagcatccagactcccccttcgagtcctccaaccgcttttggaagtccggaaggcgctggcgcacttctgcgaaaacaagagctggtcactcagaacgaactattgaaacagcaggttaaaatctttgaagaggacttccagcgagagcggtctgacagagagaggatgaatgaagaaaaagaggaacttaaaaagcaagtggaaaagttacaggctcaagttaccctgagcaatgcacagctgaaagcatttaaagatgaggaaaaggcaagggaggcattaaggcagcagaagcgaaaagcaaaggctagcggggagagataccacgtggagccacacccagagcacttgtgtggggcatatccttacgcatatccacctatgccagccatggttcctcaccacggctttgaggattggagtcaaatccggtaccctccccctccaatggctatggagcacccgcctccgttacctaactctagactgtttcatctccccgagtacacttggaggctcccttgtggcggagttcgaaacccaaatcaaagttcccaagtgatggatccacccactgcgaggcctaccgagcctgaatcccccaaaaatgaccgtgaggggcctcaatag

SEQ ID NO: 244196 - DNA, 774 bp, Artificial Sequence
  Description of Artificial Sequence: Synthetic coding sequence
atggaagctacccgcctgaggcagaaggcagaagagttggtcaaggataatgagctgcttcctcctccatcccccagtctgggatctttcgacccactggctgaattgaccgggaaagatagcaacgtgaccgcgagccccactgcgcctgcctgtcctagtgacaagcccgctcctgtgcagaagccaccgtcttcaggcacatcctcagaattcgaagttgtcacccctgaagagcagaactctcccgagagctccagtcatgccaacgctatggcactcggtccacttccccgtgaagacggcaatctcatgctgcaccttcagcgcctcgagacaaccctcagcgtttgcgccgaagaacctgatcacggacagctattcactcacctgggacgcatggctttagagtttaaccggctggcaagtaaggtccacaagaatgagcaacgcaccagcatcctgcagaccctgtgcgaacagctcaggaaggaaaacgaagctctcaaggctaagctcgataagggcctcgaacaacgtgaccaggctgctgagcggctccgtgaggaaaatctggagctcaaaaaattgcttatgtccaatggaaacaaagagggggcatccgggagacctggtagccctaaaatggagggcaccgggaaaaaagccgtagcagggcagcagcaggccagcgttacagctggcaaagtcccggaggtcgttgcactgggcgcagctgagaaaaaggtgaaaatgctcgagcagcagcgctag

SEQ ID NO: 244197 - DNA, 1911 bp, Artificial Sequence
  Description of Artificial Sequence: Synthetic coding sequence
atggaggggagaggtccctatcgcatatatgaccccggaggatccgtgccatcaggtgaagcgagcgctgcctttgaacgcttggtcaaggaaaatagccggctaaaagagaaaatgcaaggaattaaaatgcttggagagctgctcgaagagtcacagatggaagccacccgactccgccagaaagccgaagaactagtcaaggataatgagctgctccctcccccatcaccgtctttgggaagctttgatccgttggcagaattgacaggcaaggacagcaatgtgaccgcgtcccctaccgcaccagcttgcccgagtgataagcccgctcctgtccagaaaccaccatcatctggcacgtctagtgagttcgaggttgtgacgcccgaagaacagaattcccccgagtcctctagccacgctaatgctatggcactcggccctcttccccgagaggatggaaacctgatgttacacctacaacgcctggaaaccacattgagtgtctgtgcagaggagcccgatcatggacagttattcactcacctgggaagaatggcgctcgagtttaatagactggcttccaaagtacacaagaacgaacagagaaccagtattttacagacattgtgcgagcagctacgcaaagaaaacgaagctttaaaagctaagttggataaaggcttggaacagcgtgaccaggcggctgagcgcctgagggaagagaatttagaactgaagaaactactgatgagcaatggcaacaaggaaggcgcttctggtcgccctggaagccctaaaatggagggcacagggaaaaaagcggtcgctggacagcagcaagcgagcgtcactgcgggaaaggtgcctgaagtggtggccctgggagccgctgagaagaaggtgaagatgctggagcaacagagatctgaacttttggaagtgaataagcaatgggaccagcatttcaggtctatgaaacagcagtatgaacagaaaattacagagctccgtcagaagctggccgacttacagaaacaggtgacagacctggaagcagaacgcgaacagaagcagcgtgacttcgaccgtaaattgttactcgctaagtctaagattgaaatggaagagaccgacaaggaacagctgaccgctgaagccaaagagctaagacagaaggtcaaatacctccaggatcagctctcccccctgacaagacagagggagtaccaggagaaagagatccagagattgaataaggcacttgaggaggccctgagcatccagactccgccttcatccccacctacggcattcggctctcccgagggcgcaggagcattgctgcgaaagcaggagctagtcacccagaatgaacttctcaagcagcaagtgaagatctttgaagaggattttcagcgcgaaaggtccgatcgcgagaggatgaatgaagagaaagaggagcttaagaaacaagtggagaagcttcaagcccaggtgaccttgtctaatgcacagttgaaggcatttaaagacgaggagaaagccagggaagcactaaggcagcaaaaaagaaaagcgaaagcctctggggagcggtatcatgtggaaccccatcccgagcacctctgcggcgcttacccttacgcctacccgcctatgcctgccatggttcctcaccacggattcgaagactggtcccagattcggtatcctccgccacccatggctatggagcacccccctccgttacccaattcacggttgtttcatcttccggagtacacatggagattaccgtgcggaggtgtcagaaatccaaaccagtcttcccaggtgatggatccaccaaccgcccgtcccacggagcctgagtcacccaaaaacgacagagaaggccctcaatag

SEQ ID NO: 244198 - DNA, 1719 bp, Artificial Sequence
  Description of Artificial Sequence: Synthetic coding sequence
atggagggcagggggccatatcggatttacgatccaggtgggagtgtaccaagcggagaggcctctgcggcttttgagcgtctagtgaaggagaacagtcgactgaaggagaagatgcaggggatcaagatgcttggggaacttctagaggagtcccagatggaagccactcgtttgcggcagaaagctgaggaactggtgaaagacaacgaattgctgcctcccccttctccatccctcggctccttcgacccactggccgaacttaccggaaaggatagtaatgttaccgcatctccaacggcaccggcttgcccaagcgacaagcctgcccctgtgcaaaagcctccatccagtggcacctcaagcgagttcgaggtcgtcactccagaagagcagaactcacctgaatcttcctctcatgccaatgctatggctctcggacccctgcccagggaagatggaaacctgatgttacatctgcaacgcttggagaccaccctgtctgtatgtgctgaggagcccgatcacggacagctgtttacccatctgggaaggatggccctcgaattcaaccggcttgcgtcaaaggtgcacaagaatgaacaaagaaccagcattctccagactctgtgtgaacagctgagaaaggagaatgaggccctgaaggccaagcttgataagggacttgaacagcgcgatcaggccgctgaacgtcttagagaagaaaatctcgaactgaaaaaattactaatgagtaatggcaacaaggagggtgcaagcggcaggccaggtagcccaaagatggaagggactggtaagaaggctgtggccggacagcaacaggcctcggtgaccgccggtaaagtgcccgaagtcgtcgcccttggggctgccgagaagaaagtgaagatgcttgagcagcagaggtccgaactcttggaggtgaacaagcagtgggatcaacatttccgtagtatgaaacagcagtacgaacaaaagatcactgagctcaggcaaaagcttgcagacctgcagaaacaggtaacggacctggaggctgaaagagagcaaaagcaaagagacttcgatcgaaagcttctacttgcaaagtccaaaattgagatggaggagacagataaggagcagctgacggcggaggctaaagaactccggcagaaagtgaagtatctgcaagatcagctatctcctctgacccggcagcgggaataccaggagaaagagatccagcgccttaacaaggcactcgaagaggcactgagtattcagaccccgcctagctccccccctacggcattcggatccccagaaggtgctggtgctctgttgcgaaaacaagaattagttacccagaacgagctgctgaaacagcaggtgaaaattttcgaagaggattttcagagggagaggtctgaccgtgagagaatgaatgaggaaaaggaagagctgaaaaagcaggtcgagaaactgcaggcacaggtgaccctgtccaatgcacagcttaaggcatttaaagatgaagaaaaagcacgagaggcactgaggcagcagaaacgcaaggcaaaaccggagtatacatggcggctgccttgcggaggggtgcgaaaccccaatcagtcgagccaggtaatggatcctccgactgccaggcccacagaacctgaatcgcctaaaaacgaccgggaagggccacagtag

SEQ ID NO: 244199 - DNA, 1908 bp, Artificial Sequence
  Description of Artificial Sequence: Synthetic coding sequence
atggagggccgtggaccttacaggatttatgacccgggtggcagcgttccatccggagaggcaagcgcggcattcgaacgcctcgtcaaagaaaattcgcggctcaaggagaagatgcagggtattaaaatgctgggcgagctgctggaggaatcacagatggaagcgacgcgactcaggcagaaggccgaggagctggtcaaagacaacgagctgctgcctccacccagtccctcactgggcagtttcgacccgcttgccgagctgactggtaaggatagcaacgtgactgcttcacccactgctccggcttgcccctcagacaagccggctcccgtccagaagcctccttcttccggtacatctagtgagtttgaggtggtcacaccagaagaacagaactcacccgaatcatcctctcatgctaacgcaatggccctgggccctctgcctagagaggacggcaatctcatgctgcacttacagaggctagagaccactctctcagtctgtgcggaggaacctgaccacggacagctgtttacacacctaggtcgtatggccctggagtttaatcggcttgcgagtaaagtccataagaacgagcagagaaccagcattctgcagactctgtgcgagcaactgaggaaggaaaatgaagctctcaaggccaagctggataagggacttgagcaacgcgatcaagcagcagagcgtctccgcgaagaaaacttagaacttaagaagctcctcatgagtaatgggaacaaggaaggggcaagcggcagaccaggctctcctaaaatggaaggaacaggcaagaaagcagttgccggtcaacagcaggcatccgtcaccgcaggaaaagtgcccgaagtcgtcgccttgggtgctgccgaaaaaaaagtgaaaatgttagaacagcagcggtcagagctcctcgaggtcaacaaacagtgggaccagcactttcggagcatgaaacagcagtatgagcagaaaattacagaactacggcagaaacttgcagacctccagaaacaggttactgatctggaggctgaaagggaacagaaacagcgcgacttcgatcgtaagctcttgctggcaaaaagcaaaatcgagatggaggagacagataaggagcagttgacagccgaagccaaagaattgcggcagaaggtgaaataccttcaagatcagctttcccctctaacccgccagagagaatatcaggagaaagaaatccaacgactcaacaaggcattggaagaagcgctatccatacaaacaccacctagcagccctcccaccgccttcgggagtcccgaaggtgccggagcactactcagaaaacaggaacttgtcacccaaaatgaactgttaaaacagcaagtgaaaatattcgaggaggatttccagagagagaggagcgatagggagagaatgaacgaggagaaagaagaactgaaaaaacaggtcgaaaaacttcaagctcaggtcaccttgtctaacgctcagcttaaggccttcaaggatgaggagaaggcgagagaagcacttcggcagcagaaacgcaaagctaaagctagcggggaaagatatcatgtggagcctcatcccgagcacttgtgtggcgcttacccctatgcttatccgcctatgccggctatggtgcctcatcacggctttgaggattggtcccaaattcggtaccccccaccacccatggccatggaacatccgcctccgctgccgaacagtaggctattccatctgccagaatatacctggcggctgccctgcggcggtgtcagaaaccccaatcagtccagccaggtgatggatccccctacagctcggccaactgagcccgagcccgcagatcttcgcctgccaaggaactag

SEQ ID NO: 244200 - DNA, 1671 bp, Artificial Sequence
  Description of Artificial Sequence: Synthetic coding sequence
atggaaggcaggggtccctaccgaatctacgaccctggcggaagcgtccctagcggagaggccagcgctgcctttgagcgtcttgtgaaggaaaactccagattgaaggaaaagatgcagggcatcaaaatgctaggagaactgctggaggagagtcagatggaggccacccgactgaggcagaaagctgaggaactcgtaaaggataatgagcttctccccccaccctctcctagcttgggctccttcgatcccctggctgagctgacaggaaaagactccaacgtcactgccagtcctacagcgcctgcctgtccttccgacaaaccagccccagtgcagaaacctcccagtagcggcacatcttcagagtttgaagtcgttactccagaggaacaaaactccccagaatcctctagccacgccaacgctatggccctagggccacttcccagagaagatgggaacctgatgttgcatctgcagaggctcgagaccactctctcagtgtgcgccgaggagcctgatcacggccagctgttcactcatctgggtagaatggccttggaatttaaccggcttgcatcgaaagttcacaaaaacgaacagcgaacttccattcttcagaccctttgcgagcagctgcgcaaagagaacgaggccctgaaggccaagctggataaaggcctggagcagagggatcaggctgcagaacgcctgagggaagagaatctcgagctgaagaagctgctgatgtccaatggtaataaggagggcgcttcaggccgacccggaagtccaaagatggagggcactggcaaaaaagctgtggccggtcagcagcaagcatccgttaccgcaggaaaagttcccgaagtagtggccctcggagccgctgagaaaaaagtgaaaatgcttgagcaacagcgtagcgaattgctggaggtgaataagcagtgggatcaacacttccgatctatgaagcagcagtatgagcagaaaatcaccgaactgagacagaagctagccgacctgcagaagcaggtcacggatctagaggctgagcgagagcagaaacagcgagactttgaccgcaagttgttgcttgccaagtcaaagatcgaaatggaagaaaccgacaaagaacagctaacagccgaggctaaggagttgcgacagaaggtgaagtacctccaggatcagctgagccccctgactaggcagcgcgaataccaggaaaaagagatacaaaggctgaacaaggctctggaggaagcgctgtcaattcagacacccccttccagtcctcctaccgccttcggttctcccgagggggcaggtgcactcctgcggaagcaagaattggtcactcagaacgaacttcttaaacagcaggtgaagatctttgaagaagacttccagagggagcgtagcgatcgagagcgaatgaatgaggagaaagaggagctgaagaagcaggttgagaagctgcaggcccaggtaaccctcagtaacgcacagctgaaggcctttaaggacgaggagaaggcgagggaagcgctgaggcagcagaaaaggaaggctaagtcgctgcaaaagatgaccgttaggggtctctccgagacaaggctgtgtcacctcgcccctccgtcgtcatgcagggcctcctag

SEQ ID NO: 244201 - DNA, 1797 bp, Artificial Sequence
  Description of Artificial Sequence: Synthetic coding sequence
atgcaagggattaaaatgctgggagaactcctcgaggaatcacagatggaagcaactcggctgagacagaaagctgaagaactggttaaagataacgaattgctcccacctcccagtcctagtctcggatcttttgatccccttgctgaattaaccgggaaggattccaacgtgaccgcaagccctaccgcacctgcttgcccttctgacaagcctgcaccggtacagaagccaccaagtagtggcactagcagtgaatttgaggttgtcacgccagaagaacagaacagccccgagtccagcagccacgccaacgcaatggccttagggccactgcccagagaggatggtaacctgatgctgcacctgcagcggctagaaactacactgagtgtgtgcgctgaggaacccgatcacggtcaactcttcacgcacttaggacgaatggctcttgagttcaaccgcctggcctcaaaggtacacaagaacgaacagcgcacatcaatactccagactctctgtgaacagctgcgcaaggagaacgaggcacttaaggccaagcttgacaagggcctcgagcaaagagaccaggccgcagaacgcctgcgcgaggaaaatctggaactcaaaaagctcttgatgagcaacggcaataaggagggagccagcggacgaccgggatcccctaagatggagggaaccggaaaaaaggccgtggccggacagcagcaggccagtgtgacggcagggaaagtcccagaagtcgtggccttgggggcagcagaaaagaaggttaagatgttggaacagcagaggagcgagctgttagaggtgaacaagcagtgggaccagcattttagaagcatgaagcagcaatacgaacaaaaaatcaccgagctgcggcaaaagcttgcagacctccagaagcaggtgaccgatctggaagcagagcgtgagcaaaagcagcgtgatttcgaccgcaagctgctcctcgcaaagtctaaaatcgagatggaggagacagataaggagcagctgacagctgaggccaaggaattacgacaaaaggttaaatacctccaggaccagcttagtcctctgacacgccagagggagtaccaggagaaggagatacagcgactgaacaaagctttggaggaggccctgtcaattcagacacccccatccagccctcccactgcattcgggagtcctgaaggtgcgggagccctgctgcgcaaacaggaactagtgactcagaatgagcttctcaaacaacaagttaaaatctttgaggaagatttccagcgagaacggtcagaccgtgagaggatgaatgaagagaaagaggagctgaagaaacaggtggagaagcttcaagcgcaggttacacttagcaacgcgcagctgaaagcatttaaagacgaagagaaggctcgagaggccctgagacagcagaaacggaaggctaaagcatcgggcgagcggtaccacgtagagccacacccggaacacctctgcggcgcatatccatacgcttatcccccaatgcccgctatggtacctcaccacggcttcgaagattggagccaaattaggtatccaccccctcccatggcaatggagcacccgccaccgttgccaaacagtaggctatttcacctgcccgaatacacttggaggttaccttgtggtggggtgcggaaccccaatcagtcttctcaggtcatggaccctccaactgcaaggcctacggaacccgagtccccaaaaaatgaccgggaaggaccacagtag

SEQ ID NO: 244202 - DNA, 1542 bp, Artificial Sequence
  Description of Artificial Sequence: Synthetic coding sequence
atgctcggggaactcctggaagagtctcagatggaggcaacaaggctgcgtcagaaagccgaagaattggtgaaggataatgagttgcttccacccccaagccctagcctgggctccttcgacccactcgcagaacttacaggaaaagatagcaatgtgacagcatcccctacggcccctgcctgtccttccgacaaaccggctccggtgcagaaaccgccttccagcggcacctcctccgaatttgaagttgtaacccccgaagagcagaactcccccgagtcttctagtcacgccaatgctatggcgttaggccctctgccccgtgaggacggcaatctgatgttgcacctgcagcggctggagacaaccctaagcgtttgcgcagaagagccagatcatggccaactgttcacccatcttgggcgtatggccctggaatttaatcgtctggcatccaaggttcacaagaatgaacagcgcacctccatattgcagaccctgtgcgaacaactcaggaaggaaaacgaggccctcaaagcaaagctggacaaagggctcgaacagagagaccaggccgctgagcgacttagagaggagaatcttgagctgaaaaagctgctgatgtctaacggtaataaggagggagcatcaggcaggcccggtagtcctaaaatggagggaactggaaaaaaagcagtggcaggacagcaacaggcctcggtcacagctggaaaagtcccagaagttgtggctctcggggcagcggagaagaaggtcaagatgctggaacagcagaggagcgaactcctggaagttaacaaacagtgggatcagcatttcaggtccatgaaacagcaatatgaacagaagatcacggagctaagacagaaacttgccgatttacagaagcaggtgacagacctagaagctgagagagagcagaagcagcgcgatttcgaccgaaagctgctcctagccaagagtaagatcgagatggaagagaccgacaaggaacaactgacggccgaggccaaagagctgagacagaaggtgaagtatttacaagaccagctaagccctctcacgaggcagcgggagtatcaggagaaggagatccagcgattaaacaaggcactagaggaggctctgagtatccagacacctccttccagcccgccaacagcttttgggtcacctgaaggggctggcgcactgctgcgtaaacaggagctggtgacacagaatgagctcctgaaacagcaggtgaagatttttgaggaggactttcagcgcgaacgctcagaccgggaacgtatgaatgaggagaaggaggaactgaaaaagcaggtcgaaaagttgcaggcccaagtaacccttagcaacgcccaactaaaagccttcaaagacgaggagaaagctcgtgaagccctaagacagcagaagaggaaggccaagtcgcttcagaagatgactgtccgaggtctaagtgagacccgactttgtcacctagctccaccaagttcctgtagggcctcatag

SEQ ID NO: 244203 - DNA, 1509 bp, Artificial Sequence
  Description of Artificial Sequence: Synthetic coding sequence
atgctgggagaactgttggaagaaagtcagatggaggccacaagattacggcaaaaggcggaggaactcgtcaaggataatgagctcctgccccctccctcaccaagcctgggatcgttcgatcctttagccgaattgacaggcaaggatagtaacgttaccgcatccccaacagccccagcttgccccagcgataagccagccccagtgcagaagcctccttcaagtggaacaagttcggagtttgaggtcgtgactcccgaagaacagaactctccagaatccagcagccacgctaatgcgatggccctagggcctctacctagagaagacggaaatctgatgctgcatttgcagcgcctggaaactacgctgagtgtgtgcgccgaggagccagatcacgggcagctgtttacgcacctgggtagaatggccctggagtttaaccgtcttgcctccaaggtgcacaagaatgaacagaggacatccatcttacaaacactctgtgagcagctgcgcaaagaaaatgaggcccttaaggccaagcttgataaggggttggaacagagagatcaagccgctgaaagattgcgcgaagagaatcttgaactgaagaaactcttgatgtcaaacgggaataaggaaggagcgagcggcaggccagggagcccaaagatggaaggaacgggaaagaaagctgtggcaggacagcaacaggcgtctgttacggcagggaaggtgccagaagtagttgctttgggggcagccgaaaaaaaagtgaagatgctagaacagcagagaagcgagttgctggaggtgaataagcaatgggaccaacacttccgcagtatgaagcaacagtacgagcagaaaataactgagctgaggcaaaaattagcggacctccaaaagcaagtgaccgatttagaggcggagagggagcagaagcagagagactttgacagaaaactgcttctagctaagagtaagattgaaatggaagagacagataaagagcagctcactgccgaggcaaaggagctcagacagaaggtcaaatatctccaggatcagctcagccctctgacccgccagagggaataccaggaaaaagagattcagagattgaacaaggccctggaagaggcactgtctattcagacccctccaagtagccctccaacagccttcggctcccctgagggcgctggcgctctgctgagaaagcaggagctggtcacgcagaacgagctcctcaaacaacaggtcaagatcttcgaggaggactttcagcgcgaacgtagcgatcgagagcgcatgaacgaggagaaggaggaactgaagaagcaggtggagaagctacaggcccaggttacactgtcgaacgcacagcttaaggctttcaaggatgaggagaaggctcgggaggctctaaggcagcagaagagaaaagctaaagggacccaccgcggttgccctcgacacctgccagagcgcaaggtcaagtag

SEQ ID NO: 244204 - DNA, 1290 bp, Artificial Sequence
  Description of Artificial Sequence: Synthetic coding sequence
atgtcgcgagaccctggaagcggcggatgggaagaagccccacgcgcagccgctgcgctatgtactctataccacgaggccggtcagagacttaggaggcttcaggatcaacttgctgctcgtgacgcccttattgccaggctgcgggcacgactggccgctctggaaggagacgccgctcctagcctcgtggatgcactgctcgagcaggtcgcacgttttagggagcagctccgccgacaagagggcggagctgccgaggctcagatgaggcaggagattgagaggttaacagagagactcgaggaaaaagaacgcgagatgcagcagctcctcagccagccccaacatgagcgtgagaaggaggtggtgttgctgcggcgttccatggctgagggggaaagggctagggctgccagcgacgtgctgtgtcgctctctcgcaaacgaaactcaccagctcagacggactctcaccgctacagcccatatgtgtcagcacctggccaaatgtcttgacgaacgccagcatgcccaacgtaatgtaggggagcgcagtccggatcagtctgagcacaccgatggacacacctcggtgcaatcagtcatcgaaaagctccaagaggagaataggttgctcaagcagaaggtgacccacgttgaggacctaaatgccaagtggcagcgctataatgcttcgagggacgagtacgtgagggggctgcatgcacaattgcggggtttgcagattccacacgaacctgagcttatgcggaaggaaataagccggctgaacagacagctcgaagagaagattaatgactgcgccgaggtgaaacaagagctggcagcttctagaaccgccagagatgccgcactcgaacgggtccagatgttggaacagcagatacttgcttacaaagatgattttatgagcgagagagctgatagggagagggcccagtcgcgaatacaggagttagaggaaaaggtggcttccctgttacatcaggtaagctggcgccaggattctagagagccagatgcgggacggatccatgcaggatccaaaaccgccaagtacctggccgctgatgcactcgaactgatggtaccagggggatggagacctggcactggcagtcaacagcccgaaccccctgctgaggggggtcacccaggggctgcgcagagagggcagggagatcttcagtgcccacactgtctgcagtgtttttctgacgagcaaggcgaagaacttctcaggcacgtggcggagtgttgtcagtag

SEQ ID NO: 244205 - DNA, 969 bp, Artificial Sequence
  Description of Artificial Sequence: Synthetic coding sequence
atgcaacaattactctctcaaccgcagcacgaaagggagaaagaggtcgtgctcctgcgcagatccatggctgagggagaaagagccagggccgcatcggatgtcttgtgtcgttctctcgccaacgaaacacaccagctcagaagaacacttactgctactgcacatatgtgtcagcatctggctaaatgtttagatgagagacagcacgcccagaggaatgtgggagagagatctcccgatcagtctgaacacactgatggacatacatcagttcagtcggtgattgagaagttgcaggaggaaaaccgtttgctgaagcagaaggtcactcatgtggaagatcttaacgctaagtggcagcggtataacgcaagccgagatgagtacgtacggggattacacgcacagttgcggggtctgcagattccccacgagcccgaactgatgcggaaggaaatctccaggctgaatcgacagctggaagagaaaatcaatgattgcgctgaggtgaagcaggagctcgccgcaagcaggaccgcccgagatgctgccctcgagagagtccaaatgctcgagcagcagatactcgcatataaggatgatttcatgtctgagcgcgcagatagggaaagggcccaatcccggatacaggaactggaagagaaagtcgcgtctctattacaccaagtcagctggcgccaagatagtagggagccagacgccggtagaatacatgcagggtctaaaacagctaagtatctggcagctgatgctcttgagctgatggtgcctggcggttggcggccaggcaccggcagtcagcagccagagccccctgctgaaggcggacaccctggagctgctcagcgagggcagggagatctgcagtgtccacattgcttacaatgttttagcgacgagcagggcgaggaacttctgaggcacgtggccgagtgctgtcaatag

SEQ ID NO: 244206 - DNA, 837 bp, Artificial Sequence
  Description of Artificial Sequence: Synthetic coding sequence
atggccgaggcccgatctcagccttctgcgggaccccagctcaacgcactccctgatcacagcccgctgctgcagcctggccttgcagcccttcggagaagagcaagagaagcgggagtcccactggcccctctacctctgaccgattcatttctactgaggtttctcagagcgagggatttcgatcttgacttggcctggagactcctgaaaaactattacaagtggagagctgagtgcccagaaatctctgcagacttgcacccacggagcataataggactcctaaaagccggataccacggtgtgttaagaagcagagacccaactggttcaaaggtgctcatttaccggattgctcattgggacccaaaggtgttcacagcttacgacgtgttcagggtctccttgatcacaagcgagctgatcgtgcaggaagtggaaacacaacggaacgggatcaaggcaatttttgatttggaggggtggcagttctcccatgcattccaaataactccttccgtcgccaagaagatcgcggcagtactgaccgacagttttccgctgaaggtcagggggatccatcttatcaacgagccagtcatctttcatgccgtcttttctatgatcaaaccgtttttgactgagaagattaaggagcggatacacatgcacgggaataactacaaacagtccctgctgcagcattttcccgatatattacctctggagtacggaggggaagagttcagtatggaggacatttgtcaggagtggaccaatttcataatgaagagtgaagactacttgagttcaatatctgagagcatacagtag

SEQ ID NO: 244207 - DNA, 2361 bp, Artificial Sequence
  Description of Artificial Sequence: Synthetic coding sequence
atgaccagcatcttccatttcgctattatattcatgctgattctgcagatcagaatccagctgtccgaggaaagcgagtttctcgtagacagatctaagaatgggctgattcatgttccaaaggacttgtcacaaaaaactaccattctgaacatttctcagaactacatcagtgagctttggacctcagatatattgtctctcagcaagttgcgcattctgattatctctcacaatcgtatccagtatttagatatctctgtgttcaagttcaaccaggagctggaatacctggatctttcccataataaactggtaaaaatctcgtgccatcccaccgtgaacttgaaacatctcgatctgtccttcaacgccttcgacgcccttcctatctgcaaggagttcgggaacatgtcccaactgaagttcctgggactgagtaccacccatcttgaaaagagctcagtcttgcccatcgcacatcttaacatctcaaaggtccttcttgtcctcggcgagacgtacggcgaaaaggaagatccggaagggctgcaggacttcaacaccgagtccctgcacatcgtattcccaacaaataaggaattccattttattctggacgtgagtgtgaagaccgtagccaacctggagctttcaaacatcaaatgtgtcctcgaggacaacaagtgtagttattttctgtctattctggcaaaactacagacaaatcctaagttgagcaatctgaccctgaacaatatcgaaaccacttggaattcattcattcgcatcctacagctggtctggcacacaacagtctggtatttctctattagcaacgtgaagctgcagggccagctcgacttccgcgactttgattactcgggaacgtctttgaaagcgctgtctatccaccaggtggtatctgacgtattcggtttcccacagtcgtacatctacgaaattttctcaaatatgaatatcaagaactttacagttagtgggactcggatggtgcacatgttgtgcccttctaagatttcacccttcctacacctcgacttttctaataacttgctcaccgatactgtgttcgagaactgcggccatctcaccgagctggagactttgattctccagatgaatcagttaaaggaactcagcaaaatcgctgagatgactacccagatgaaatctctgcagcagttggatatctctcagaactcagtttcgtatgacgagaaaaagggcgattgcagttggaccaagtctcttctgtctctcaatatgtcctcaaacatcttaacagatacgatttttcgatgtttgcccccaagaataaaggtgttagacctccatagtaataaaatcaaaagcattcctaagcaagtggttaagctcgaagctctccaggagttgaatgtggcctttaatagcctcaccgacctgccaggatgcggctctttcagtagcttaagcgtgctcatcattgatcacaactcagtcagtcaccccagcgcagatttttttcagtcatgtcagaagatgcggtctatcaaagcgggtgacaatcctttccaatgtacttgtgagctcggggaattcgttaaaaacatcgaccaggttagctcagaggtgctggaagggtggccggattcgtacaagtgtgactaccccgagtcctaccgtggaacgttactaaaggactttcatatgagcgagctctcctgcaatatcacgctcctcattgtgactatcgtagccaccatgctagtgttggctgtcaccgtcacctccctgtgcagttacctcgatctcccatggtacctcagaatggtttgccagtggactcagacgaggcgtcgtgccagaaatatcccgctggaggaactccagagaaaccttcaattccacgcattcatcagttacagtgggcatgatagcttctgggtgaagaatgagcttttgccaaacctcgaaaaggaaggaatgcagatttgtttacacgaaaggaacttcgtccctggaaagtccatcgtggagaatattatcacctgcattgagaaatcatacaagtcaatatttgtgctatcacccaactttgttcagtctgaatggtgtcattatgaactgtactttgctcatcacaatcttttccacgaaggttctaacagccttatcctaatactccttgaacctatccctcagtatagcatacctagtagttaccacaagctgaagagccttatggctaggaggacctatctggagtggcctaaagagaaatcaaagaggggcctattttgggctaacctcagggcggcaattaatattaaattgactgaacaagccaagaagtag

SEQ ID NO: 244208 - DNA, 2361 bp, Artificial Sequence
  Description of Artificial Sequence: Synthetic coding sequence
atgactagtatcttccatttcgcaatcatttttatgctcatccttcaaattcggatccaactcagtgaggaatccgagtttttagtggaccgctccaaaaatggcctgatacatgtgccaaaggatctcagtcagaagaccaccatacttaatataagtcagaattacattagcgaactttggacatcagatattctgagcctgtcgaagttacggatccttattatctcacacaaccgcattcaatatctggacattagcgtctttaagttcaaccaggaactcgagtacttagatttgtcccataacaaactcgttaagatctcatgccaccccactgttaacctgaaacatttagatttaagcttcaacgcctttgacgccctccccatctgtaaggaattcgggaatatgtcccagctgaagttcttgggactgagcaccacgcatttggagaagtcatccgtgctccccatagcgcacttgaacataagcaaagtcctgctggtcctcggagaaacctatggagagaaggaggaccccgaggggttacaagacttcaatacggagtcgctgcatatagtgttccctaccaacaaggaattccactttatactcgatgttagcgtgaagactgtggcgaacctagaactctcaaacataaagtgcgtgctggaagacaataagtgctcttacttcctgtcaattctggctaagctgcagacaaaccccaagctgagcaatcttacacttaataatatcgagactacctggaacagttttatcaggatcctccagctcgtttggcacactaccgtctggtatttttcaatctccaatgtaaagttacagggccagctggactttagggacttcgattactcaggaacatctctgaaagcactgagcatccaccaggtggtgagtgatgtgttcggctttccacaatcctacatttatgagatcttctccaatatgaacattaagaacttcaccgtttcgggaactcggatggttcatatgctatgtccctcaaagatttctccatttctgcatctcgatttctctaacaaccttttgacagacaccgtgttcgagaattgtgggcatctgacagaactggagactctcatcctgcagatgaatcagctgaaggaactgtccaagatcgccgaaatgaccacgcagatgaagagcctacagcagttggacatcagccaaaacagcgtgtcctacgatgaaaaaaagggtgactgctcctggacaaaatctttgctgtcactgaacatgagctccaatattctgacagacactattttcagatgtctcccacccagaataaaggtactagatttgcacagcaataaaatcaaatctataccaaagcaggtggttaaattagaagctttgcaggaactgaatgtcgcattcaactctctgactgatctgccagggtgcggaagtttttcgtccctgtctgtcttaattatcgaccataattccgtgagtcatcccagtgcggacttttttcaatcctgtcaaaagatgagaagcataaaggcaggggacaaccctttccaatgcacctgcgagctgggcgagtttgtgaagaacatcgaccaggttagtagcgaagttttggaaggctggccagatagttacaaatgcgattaccctgaatcctatcgcggtacattactgaaagactttcacatgagtgaactgtcatgtaacattaccctgctaattgtcacaattgtagcgaccatgctcgtactggccgtgactgtgacatctctgtgtagttaccttgatctgccctggtacctgaggatggtatgccagtggacccagactcgtcggcgtgcaagaaatattccactagaggaacttcaaaggaatctgcaattccacgccttcataagttactccggccacgatagtttctgggtcaagaacgagctgctgcccaatctcgagaaggaaggcatgcaaatttgtttgcacgagcggaactttgtccccggaaaatcgattgtggagaacattatcacctgtatcgaaaaatcctataagtcaatctttgtgttgagtcctaatttcgtgcagtcagagtggtgtcactacgaattatactttgcccaccacaatctcttccatgaaggcagcaacagtcttatattgatattactcgagccaattccccagtatagcattccctcctcttaccacaagttgaagtcactcatggcacgtaggacttatctggagtggccgaaggagaaatctaaaagaggcttattctgggctaatctccgcgctgccattaacattaagctgactgagcaagccaaaaagtag

SEQ ID NO: 244209 - DNA, 486 bp, Artificial Sequence
  Description of Artificial Sequence: Synthetic coding sequence
atgacaagcatcttccattttgccataatcttcatgctcatcttgcagatccgtattcaactttctgaggaatccgagtttctggtggatagaagtaaaaatgggctcatccacgtgccaaaagacctgtcacaaaagacaactattctaaatatctcccaaaactatatttccgagctctggaccagtgatatactatctctaagtaaactgcgtatcctgatcatctcccacaatcggatacagtacctagacatcagtgtcttcaagtttaatcaggagttggaatatctggatctgtctcataacaaattagttaaaatcagttgccaccccactgtgaatctgaagcacctggatctgtcattcaatgcctttgacgcgctgccaatctgtaaggagtttggaaacatgtctcagttaaagttcctaggactgtctaccacgcatctggaaaaatctagcgtccttcccatcgcgcactag

SEQ ID NO: 244210 - DNA, 147 bp, Artificial Sequence
  Description of Artificial Sequence: Synthetic coding sequence
atgaccagtatattccacttcgctatcatcttcatgttaattttgcagatcagaatccagctttccgaagaaagcgagtttctggtggaccgcagcaaaaatgggctcatacacgttcccaaggacctaagccagaagactacctag

SEQ ID NO: 244211 - DNA, 72 bp, Artificial Sequence
  Description of Artificial Sequence: Synthetic coding sequence
atgacatcaatcttccacttcgcgatcattttcatgctcatactgcaaatcaggatccaactctccgagtag

SEQ ID NO: 244212 - DNA, 273 bp, Artificial Sequence
  Description of Artificial Sequence: Synthetic coding sequence
atgaccagtatattccatttcgccatcatatttatgctgatcctccaaatccgcatacagctctcggaagagtcagagtttttggtggacaggtcaaagaatggcctcattcatgttcccaaagacctctcccagaagacgacgatcctcaacatttctcagaattatattagcgaactgtggacatcagacattctcagtctgtcaaaactgcggatactcatcatctcccataatcggatccaatacctggatatttctgttttcaagtag

SEQ ID NO: 244213 - DNA, 2355 bp, Artificial Sequence
  Description of Artificial Sequence: Synthetic coding sequence
atgccccacacactgtggatggtgtgggttcttggagtgataatcagcctctccaaggaggaatcgtctaatcaggccagcctgtcttgcgaccgaaacggcatctgtaaaggcagttctggctccctcaatagcatacctagcgggctaactgaagctgtgaagtcactcgacctctccaataaccgcatcacatatatcagcaactcagacctccagagatgtgtgaatcttcaggctctcgtgcttacaagcaacggcattaatactatagaggaggatagcttttcgagcttaggaagcctcgaacatctggatctgtcatacaactacctaagtaacctttcctcatcatggtttaaacctctctccagtctgacattcctgaacctgctgggcaatccctataaaactctgggcgagacttcgttgttctcccatttgacgaagctacaaattcttagggttgggaacatggacacattcactaagattcagcgcaaggactttgccggtctaacatttctggaagagctggaaatcgatgccagcgacctgcagtcttatgagcccaaatcactgaaatctattcagaatgtttcccacctgatccttcacatgaaacagcatatcctgctcttggaaatttttgtggatgtgacgtcatccgtcgagtgtctcgagctgagagacactgatctggatacgttccacttctcagaattgagcaccggagaaactaactccctgataaagaagtttacgttccgcaatgtgaaaatcactgacgaaagtttgttccaggtaatgaagctgctcaatcaaatttctggcctacttgaactggagttcgatgattgcacgcttaacggggtgggcaatttccgtgccagcgacaacgacagagtgattgatcctggcaaggtggagactttaaccatcagaagattacatatcccgaggttttacttgttctatgatctgagcacactgtattcattgaccgaacgagtgaagcgtattactgtcgagaacagcaaagtgttccttgtcccatgtctgctgtcccaacacttaaaaagtcttgaatacctggacttatctgagaacttgatggtggaggagtacctaaagaattctgcatgtgaagatgcctggccaagccttcagacactaatcctgcggcagaatcatttggctagcctcgagaagactggggagacccttctcacactgaagaatttaaccaacattgacatctctaaaaattccttccattcaatgcccgagacctgccagtggcccgagaaaatgaaatatctgaacctgtcttccactaggatccattccgttaccggatgcattccaaaaaccctggaaattcttgacgtgtcaaataacaatctcaatttgtttagccttaacctgcctcagctgaaagagttgtacatttctcggaacaagctcatgaccctccctgatgcgagcctgcttcctatgctcctggttttgaaaattagcaggaacgctattacaacattctctaaagagcaactggattcctttcataccttgaaaaccttggaggcgggaggaaacaattttatttgcagctgcgaattcttatctttcacacaggaacaacaggcccttgccaaggtgttgatagactggcccgctaactacctatgcgattcaccgtcacacgttcgagggcaacaggtccaagatgttcggttgagtgtgtccgagtgccacaggacggctctagtgtctgggatgtgctgtgccctgtttctcctcatcttgcttaccggagtgttgtgccaccgctttcacggcctttggtacatgaaaatgatgtgggcttggcttcaagccaagcggaagccaaggaaggccccttcccgaaacatttgctatgacgcatttgtctcctattccgaacgggacgcatactgggtggaaaatctgatggttcaggaactcgagaattttaatcctccattcaaactctgcttacacaaacgggacttcattccaggtaagtggataatagacaacattattgattctattgaaaagtctcacaagaccgtgttcgttctttcagaaaacttcgtcaaatccgagtggtgcaaatatgagctggactttagccacttccggctcttcgatgagaataacgatgctgctatcctgattctcttagaacccatcgaaaagaaggccatacctcagaggttttgtaagcttcggaaaattatgaacaccaaaacttatctcgagtggccgatggatgaagcccagagggaaggattctgggtaaacctgagggctgccatcaagtcttag

SEQ ID NO: 244214 - DNA, 2715 bp, Artificial Sequence
  Description of Artificial Sequence: Synthetic coding sequence
atgaggcagaccctcccatgcatctatttctggggtggactgctgcccttcggaatgctctgcgcctcgtctactaccaagtgtaccgtgtcacacgaagtggcagattgtagtcatctgaaactgacccaggtgccggatgatctccccaccaacattaccgtgctaaacttgactcacaatcaactgaggaggctccctgccgctaattttaccagatactcacagttaacctcccttgatgtagggtttaatacaatcagcaaactggagcctgaactgtgtcagaagctgcctatgttgaaggttctgaatctgcagcacaacgagctctcccaactctctgataagacattcgcattttgcacaaatcttactgagctccacctcatgtcaaacagcatccagaaaatcaaaaacaatccttttgttaaacagaaaaatttgatcacactagacctttcccataacggcctgtcaagcaccaagttaggaactcaggtgcagttggagaacctccaagagctgctcctttctaacaataagatccaagccctcaaatctgaagaactggacattttcgcaaacagcagtctaaaaaaactggagctctcaagcaaccagatcaaggaattttctcccggatgctttcacgcaatcggaaggctctttggactgtttttgaacaacgttcagctcggtccttctttaactgaaaaactgtgtttggagctggccaatacttccattagaaacctgagcctgagcaactcccagctctcaactacatcgaatactacgttcctcgggctgaagtggacaaatctgaccatgctggatctgtcctataataaccttaacgtcgttgggaatgattcattcgcatggttgccacagctcgaatatttctttctggaatataacaacatccagcatctgttcagtcactccctccacgggttatttaatgtcaggtacctcaacctaaagcggtcttttactaagcaaagtatctctcttgcgagtttgcctaagattgatgacttttctttccagtggcttaagtgcctggagcacttgaacatggaggacaatgatatcccgggaattaagagcaatatgttcacgggcctgattaatctgaaatatctgtccctgtcaaattctttcactagtctaaggacactgaccaatgaaacctttgtaagtctggctcactcccccctccacatcttgaacttaactaagaacaagatttccaagatcgagagtgacgcattttcctggctcggtcacctggaagttctcgacctagggcttaatgaaatcggtcaggaactcactggtcaggagtggaggggattagaaaatatctttgagatttacctgtcttacaacaaatacctgcagctcaccagaaattccttcgctttggtcccatcactgcagaggctgatgctgcgccgagtagctttgaaaaatgttgattcctcccctagccccttccagcccctccggaatcttacaatccttgatctatcaaacaacaatatagccaacatcaatgatgacatgcttgaggggctagaaaaacttgaaattttggacctacagcataataacctggcccgactctggaagcacgccaaccccggtggcccaatctacttcctgaagggcctcagccatctccatattcttaacctagagagcaacgggtttgacgagatccccgtcgaagtgttcaaagacctgtttgaactgaagatcattgacctcggtctgaacaatctaaacacattgcccgcatctgtttttaataatcaggtcagtttgaagtctctgaacttacagaagaaccttatcacctctgttgaaaaaaaagtgttcggccctgcattccgcaatctcacggagctggatatgagatttaacccgtttgattgcacttgtgaaagcattgcctggttcgtgaattggattaacgaaacccataccaacatacccgaactctctagtcactacctgtgtaatacacctcctcattaccatggcttccccgttagactcttcgacacgtccagctgcaaggatagtgcaccctttgagctgttttttatgatcaacacctctatcctgctgatatttatttttatagtacttctgattcacttcgaagggtggagaattagcttctactggaacgtgagcgtgcaccgtgtcctggggttcaaggaaatcgatcggcaaacagagcaatttgaatacgcagcatatatcatacacgcctataaggataaggattgggtctgggaacacttctcttctatggagaaggaagaccaaagtctcaagttctgtctggaagagcgcgatttcgaggccggtgttttcgagctggaggccattgtgaacagtataaaacgatcaaggaaaattattttcgttatcactcatcaccttctgaaggatccactttgtaaacgcttcaaggtgcaccacgcagttcagcaggctatcgaacagaacctggattcaatcattcttgtctttctcgaagagatccctgactacaagctgaatcacgcgttatgccttcgtaggggcatgttcaagagtcactgcatccttaactggcccgttcagaaggagaggatcggggctttccggcataaactgcaggtggctttggggtccaaaaactcggtccattag

SEQ ID NO: 244215 - DNA, 1884 bp, Artificial Sequence
  Description of Artificial Sequence: Synthetic coding sequence
atgcttgatttgtcctacaacaatctaaacgttgtgggcaacgatagttttgcctggctgccacaactggagtatttctttcttgaatacaacaacatacagcatctgtttagccacagtctacacggcctgtttaacgttcggtacctaaatctgaaaaggtccttcaccaaacagagcatatctttggcgtcactacctaagatagacgatttttccttccaatggctgaaatgtttggaacatttgaatatggaagataatgatattccaggtattaagagcaatatgtttaccgggcttatcaacctcaagtatctgtcactttcaaatagtttcaccagcttgcgcactttgactaatgagacatttgtctccctggcacactcaccactccacatcctcaaccttaccaaaaataagattagtaaaattgagtccgacgccttctcatggctgggccatctggaggtgcttgacctaggattgaacgaaattggtcaggaactaactggccaggaatggcggggattagagaatatcttcgagatttatctgtcgtacaataagtatctgcagctaacacgcaacagttttgcgttggtgccatccttacagcggctcatgctgaggagggtcgcactgaaaaacgtcgattcgtccccatcgccatttcaacctctcaggaacctgaccattttggatctctccaataataacatcgctaacatcaatgacgacatgctggaaggccttgaaaagcttgaaatactagacctgcagcacaacaacttggctcgtctatggaagcatgcaaatccaggaggccctatatacttcttgaagggtctgtcacacctacatattttaaatcttgagtccaatggcttcgatgagatcccagtggaagtgttcaaagatctttttgagctcaaaattattgacctcggacttaataacctgaataccctccccgcaagcgtctttaataaccaggtttccttaaaaagcctgaacctgcagaagaacctcattaccagcgtcgagaaaaaggtgttcggcccagcgttccgcaatctcacggagctggatatgagattcaatccctttgactgcacctgcgaaagcattgcttggttcgtgaactggatcaatgagacacacacaaacattccggaattatcaagccactacttgtgtaatacaccaccacactaccacggctttccagtgcgcttatttgatacaagctcttgtaaagacagcgctcccttcgagctgttttttatgattaatactagcattctattaatttttatctttatcgtgctgctcatccactttgaaggttggaggatatcattctattggaacgtatctgttcacagggtgttgggtttcaaggaaattgataggcaaacagaacagtttgaatatgccgcttacatcatccacgcttataaggacaaggactgggtatgggaacattttagtagcatggagaaggaagaccagagtctgaagttttgcctggaggaacgggactttgaggctggcgtgttcgagctagaagctatcgttaactctatcaagagatctcggaaaattattttcgtgataacccatcatctcctgaaagacccactctgcaagcgcttcaaagtgcaccacgccgtgcaacaggctatcgagcagaacctcgattctataatcctagtgttcctggaggaaatccctgattataagctcaatcatgccctgtgtttacggagggggatgtttaaatctcactgcatcctgaactggccagtccaaaaggaacgcattggtgcttttcgccataagctgcaagtggcattaggctctaaaaacagcgtgcattag

SEQ ID NO: 244216 - DNA, 2613 bp, Artificial Sequence
  Description of Artificial Sequence: Synthetic coding sequence
atgcggcaaactctgccgtgtatttacttctggggcggtttgttgccctttggcatgctatgcgccagctctacaaccaaatgtacagttagccatgaagtcgccgactgctctcacctgaaacttactcaggtgcctgatgacctgcctactaatattacggtcctgaaccttacgcataatcagcttcggcgattaccagcagctaactttacacggtatagtcagctgacttctctggacgtgggatttaacaccatctccaagctcgaaccagagctgtgccagaaacttccaatgctgaaggttctgaatctccagcataacgagctcagccagctgtccgataaaaccttcgccttttgcaccaaccttaccgaacttcacctcatgtcgaattcaattcagaagataaaaaataatccctttgtgaaacaaaagaatctgatcactctggatctgtcacacaatggtctgtccagtactaaattagggacgcaggtgcagttggagaacctgcaagagcttttactgtctaataacaagattcaggcattaaaatcagaggaacttgacatcttcgcaaattccagccttaagaaactcgagcttagctcaaatcagattaaagagttctctccaggatgcttccatgctatcggtcgattgtttggtttgtttctgaataacgtgcagttaggcccatccctcactgaaaagctgtgcctggaattggctaacaccagcatacggaacttatcattatcaaacagccagttgtcaaccacttctaacaccacctttcttggcctcaagtggaccaacctgaccatgctcgatctatcctataacaaccttaatgtggtgggtaacgattcttttgcctggctaccccagctcgaatacttttttctcgaatataacaacatacagcacctcttctcccacagcctgcatgggctgttcaacgtgcgatatctgaacctgaaacgttcctttaccaagcagtctatcagccttgcatctcttcccaagatagacgatttttctttccaatggctgaagtgcctcgaacacttaaacatggaagataatgatatccctggtatcaaatcaaacatgtttaccggcctgataaatctgaagtatctatccctgagtaactcattcacttcgctccgaacgctgacaaatgaaacattcgtgtccctggcacattctcccttgcatatattaaatctaaccaaaaacaagatcagtaagattgagtcagatgctttttcctggctgggccaccttgaggtgctcgaccttggcctgaatgagattggacaagagttgaccggccaggagtggcgcggacttgagaatatctttgaaatttacctctcttacaacaagtacttacagctcacaaggaacagtttcgcactggtcccaagcctccagcgcctcatgctaaggagagttgccctgaaaaacgtggacagctccccttcaccttttcagcctcttcggaacctcacaattttggacttgtctaataacaacatcgcaaacattaatgatgatatgctcgagggcctagagaaactggaaatcttagacctgcaacataataacctggcccgactttggaagcacgccaatcccggaggcccaatctacttcctgaaggggctgtctcatttacacatactaaacctggagtcgaatggattcgatgagatccctgtggaagttttcaaggatttattcgaattgaagattatcgacctcggattaaacaatcttaacactctaccggcttctgtctttaacaaccaggttagtctaaagagtcttaatctccagaagaacctaatcacgtcggtcgaaaaaaaagtgtttggacctgccttccggaatttgacagaactggatatgcggttcaacccgtttgactgcacttgtgagagtatcgcctggtttgtaaactggatcaatgaaacccacaccaatatacctgagctctccagccactatctgtgcaacacaccaccgcactatcacggcttcccagttagactgtttgacacctcctcatgtaaagatagcgccccttttgagctgttcttcatgatcaacacttcaatcctgttgatctttatttttattgtactccttatacactttgaaggttggcgtatctcgttctactggaacgtttccgtgcacagggttctgggcttcaaagaaatcgaccgacaaactgagcagtttgaatatgcggcttacatcattcacgcctataaagataaggattgggtgtgggagcatttttcatccatggagaaagaggaccagagcttgaagttttgtttagaagaacgggattttgaggcgggagtgtttgagttggaggccattgtaaatagtattaagcgctctcgcaaaattatctttgtgatcacacaccacctgttgaaagatccgctgtgtaaacgcttcaaagtgcatcacgcagtccaacaggccatcgaacaaaacctggattccatcatcctcgtctttctcgaagagataccagattataagctgaaccacgcactctgcctacgtcgagcgaaatag

SEQ ID NO: 244217 - DNA, 2391 bp, Artificial Sequence
  Description of Artificial Sequence: Synthetic coding sequence
atgactaaggataaggagcctatcgtcaagtccttccatttcgtgtgcttgatgattatcatcgttggtacccggatacagttcagtgacggaaacgagttcgccgtagataagtcaaagagaggactcatacatgtccccaaggacctaccccttaaaaccaaagttttggatatgtctcagaattacatcgccgagctgcaggtctccgacatgagtttcctgtccgagttaaccgtcctgaggctctcccataacagaatacagttgctggatctttctgtgtttaaattcaaccaggatctggagtatctggatctgtcccacaaccagctgcagaagatatcctgccatccaatcgtcagctttcggcacctggacctctcatttaacgattttaaagccttaccaatctgcaaagagtttggcaatctgtcccagctgaactttctgggtttgtccgccatgaagctgcaaaagcttgacttactccctattgcccatctgcacctttcatatatactactggacctcaggaattattacatcaaggaaaatgagaccgaatccctccaaatcctgaatgccaaaacactgcacctcgtcttccatccaaccagccttttcgcaatccaggttaacatatcggtgaacacgctgggctgtttacaactgacaaacattaagttgaatgacgacaactgccaggtgtttattaaattcctttccgaacttacgcggggatcaaccttgctgaacttcaccttgaaccatatcgaaaccacttggaagtgtctcgtccgtgtgttccagtttctgtggccaaaacccgtggagtacctgaatatttataatttgaccatcatcgagtccatcagggaggaggatttcacgtactcgaaaacaacattgaaggccctgactatcgaacacattacaaatcaggtgtttctgttctcccagactgctctgtataccgtttttagcgaaatgaacattatgatgctgactatctcagataccccgtttatccatatgctttgcccacacgccccatccacctttaaattcctgaacttcacgcaaaacgttttcactgattcgatcttcgaaaagtgttccaccctggtgaaactggagacattgattctgcagaaaaacggactcaaagacctgtttaaggtgggactgatgaccaaggatatgccatccctcgagatcctggatgtcagttggaactctctagagagcggaagacacaaggaaaattgcacatgggtcgagtctatcgtggtcctgaacctgagcagcaacatgctcaccgactccgtattcaggtgtttaccaccaagaattaaggtcctagatctccattctaacaaaattaaaagcgtgcccaaacaggtcgttaagctagaggctcttcaggaattgaatgtggcgtttaattcactcacggatctgcctggctgtggaagcttctcttctctttccgtgctgattatagaccataactccgtgtcacatccaagtgcagactttttccagagctgccaaaaaatgaggagcatcaaggcaggcgataatccttttcagtgcacctgcgaactgcgggagttcgtcaagaatatcgaccaggtgtcatccgaagtgctcgagggctggcccgatagctataagtgcgattaccctgagagttaccgcggaagcccgctaaaggactttcatatgagcgagcttagctgcaatataacactgctcatcgtgacaattggcgctaccatgctagttttggccgtcaccgtgacaagtctgtgcatctacttggatttgccatggtacctgaggatggtatgccagtggactcagacacgcaggcgagcgcgtaatattcccctggaagaactccagcggaacctgcagttccatgcctttatctcttactccgagcacgatagtgcatgggtgaagtctgaactggtgccttacttggagaaggaagacattcagatctgtttgcatgagagaaatttcgtccccggaaaatcaattgttgaaaacatcattaactgcatcgagaaatcatacaaatccatttttgtgttatctccaaacttcgtgcagagtgagtggtgtcattacgaactgtactttgcccatcacaacctgtttcatgagggctctaataacttgattctgattctgctcgagcctatcccccagaactccattcctaacaagtaccacaaactcaaggcacttatgacccagagaacctatctgcagtggcccaaagaaaaaagcaaacggggtctgttctgggccaatatccgcgctgccttcaatatgaaactgaccctcgttacggagaataatgatgttaagagctag

SEQ ID NO: 244218 - DNA, 2391 bp, Artificial Sequence
  Description of Artificial Sequence: Synthetic coding sequence
atgaccaaggataaggagcctatcgtgaagagctttcatttcgtctgcctgatgatcatcatcgttgggacaagaattcagttttctgatgggaacgagttcgcagtagacaaatccaagcgcggattgatccacgtgccaaaggatctgcccctgaaaacaaaagtgctggacatgagtcaaaattacattgccgagcttcaagtgtccgatatgtcattcctctctgagctgacggttctgcgattgtcgcataatcgcattcaactgctcgatctgagcgtgttcaagttcaaccaggatttggagtatcttgacttgtcacataaccaattgcagaaaatctcctgtcatcctattgtgagctttcggcatttagacctgtctttcaacgacttcaaggcgttacccatttgcaaggagtttggcaatctgtcgcagttaaactttctgggactatcagcaatgaaactgcagaagctggacctgcttcctatcgcccatctgcatctctcatacattctactcgatctaaggaattattacatcaaggaaaacgaaacagagtccttacaaatcttgaacgccaaaacactacacctagtattccaccccaccagcctattcgccattcaggtcaacatcagcgtgaatacactggggtgcctgcagctgactaacatcaaactgaatgatgataattgccaggtgttcataaagtttctgtctgaactgacacggggtagcaccctactcaacttcacattgaaccatatagagacaacttggaagtgtttagtcagagtgtttcagtttctgtggccgaagcctgtggagtacctcaacatctacaatctcacgattatagagagtatcagggaggaggactttacctatagtaaaaccacattgaaggccctaaccattgagcatataaccaaccaagtgttcctcttctcacagacagcattgtacaccgtcttttcggaaatgaacattatgatgctgaccatctctgacactccctttatccatatgctgtgtccccatgccccatccacttttaagtttctgaatttcacgcaaaatgtcttcaccgactcaattttcgaaaagtgctctactctggttaagttggaaacactcattctgcagaagaatggactcaaagacctgttcaaggtgggcctgatgaccaaggacatgcccagcctggaaatacttgatgttagctggaacagcctggagtccggtcgacacaaggaaaattgtacttgggtggagagcatcgtggtcttgaatctgtctagcaatatgctgaccgattccgtgttccggtgtttaccccctaggattaaggttctggatcttcatagtaataaaatcaagtcagtgccgaaacaggttgtgaagttagaggcacttcaggagttgaatgtagcctttaactcactgactgacctgcctggatgtggatcattctcctccctcagtgtcctgattattgaccataattctgtttcacatccaagtgcagattttttccagtcttgccagaagatgaggtctattaaggctggagacaatccattccagtgtacttgcgaactgcgtgagtttgtgaaaaatattgatcaagtgtcatctgaagtccttgaaggctggccagatagctacaagtgcgactatcccgagtcttaccgcggatctccattaaaagacttccacatgtctgaactgtcctgcaatattacacttctgatagttacgatcggcgcaactatgctggtgttggctgtgacggtgacaagcctctgtatctatcttgatctgccctggtatctgcggatggtatgccagtggacacagacccggagaagggcacgaaatattcctttggaggagttacaacgaaaccttcagtttcacgcatttatctcatactctgagcacgacagcgcttgggtgaagtcagagttggttccttatctggaaaaggaagatattcagatttgtctgcatgagagaaattttgttccaggtaagtcgatcgttgagaatatcatcaattgcattgagaaatcctacaaatcaattttcgtcctgtccccgaattttgtgcagtccgaatggtgtcactatgaattgtacttcgcccaccataacctatttcacgaaggatcaaacaacctgattctgatcttgctggagccaatccctcagaattccattcccaataaataccacaaactgaaagcactgatgactcagagaacttatctgcagtggccgaaagagaagtctaagcgaggcctgttttgggcaaatatccgagccgcttttaatatgaagctgactctggtcaccgaaaataacgacgtgaagtcctag

SEQ ID NO: 244219 - DNA, 453 bp, Artificial Sequence
  Description of Artificial Sequence: Synthetic coding sequence
atgactaaagacaaggagccgatcgtaaagtctttccattttgtttgtctcatgattattattgtaggaacaagaattcaattttcagacggcaatgaattcgccgtcgacaaaagcaagcggggattgatccacgtgcctaaggaccttccactcaagaccaaggtgttggacatgtcccagaactacatcgctgaacttcaggtttccgatatgagtttcctgtccgagctcacggtgttacggctgtcacataaccggattcagttgctggacctgtctgtattcaaattcaaccaggatctcgagtatctggatctctctcacaaccagctgcagaagatatcttgccacccaatcgtcagtttccgccatctggatctgagcttcaacgacttcaaggctcttcccatttgtaaagagttcggtaatctgagccagcttaacttctag

SEQ ID NO: 244220 - DNA, 1443 bp, Artificial Sequence
  Description of Artificial Sequence: Synthetic coding sequence
atgaccaaagataaggaaccaatcgtgaagtcattccattttgtgtgtttgatgataatcattgtggggacccgcatacagttttcggacggaaacgagttcgctgtggataagagcaagaggggcctgatccatgtgccaaaagacttgccattgaaaaccaaagttttagacatgtcccagaattatattgccgaattgcaggtgagcgacatgtcattcctctctgagctgaccgtactgagactctcacacaataggatccaactattggatctaagtgtgttcaagttcaatcaggacttagaatacctagatctgagtcacaaccagctacaaaagattagttgccacccgatagtcagttttcgacatttagacctttcattcaatgatttcaaagccctgccgatctgtaaggagttcggaaatttgagtcagctgaattttctgggactctctgcaatgaagctacagaaactggaccttcttccaatcgcacatctacacctcagctacatattgttggatctacgcaactattatatcaaggaaaacgaaacagaaagtttgcagattctgaacgcaaaaactttgcacttagttttccacccaacctcattattcgccattcaagtcaatattagcgtcaatactctcgggtgtttgcagctcacaaacatcaagctgaatgacgacaactgccaggtcttcataaaattcctgagtgaactcactagaggcagcacgctgcttaattttaccttaaaccatatcgagactacgtggaagtgcctggttagagtattccaattcctgtggccaaaaccggtggagtatctcaacatctacaacctaacgattatcgagtccatccgagaggaagactttacatatagcaagaccaccctcaaagctctgacaattgagcacatcaccaaccaggtcttcttgttcagccagacggctctgtataccgtcttctcagaaatgaatatcatgatgctcacaataagcgatacaccctttatacacatgctgtgtccccacgctccaagcaccttcaaatttctgaactttacccaaaatgtgtttacagatagcattttcgaaaagtgtagtactcttgtcaagctggagacattaatatttgtcctgagccccaattttgtgcaatccgagtggtgtcattacgagttgtattttgcacatcataatctgtttcacgaagggtcgaacaatcttatcctcattctcttagaacctatccctcagaactctatacccaacaagtatcacaaactgaaagccctgatgacccagaggacttacctgcaatggccaaaggaaaaaagtaaaagaggcctgttctgggccaacatacgggctgctttcaatatgaaacttactctggtaaccgaaaacaatgacgttaaatcatag

SEQ ID NO: 244221 - DNA, 276 bp, Artificial Sequence
  Description of Artificial Sequence: Synthetic coding sequence
atgactaaagataaggagccaatagtcaagtctttccacttcgtgtgcctcatgattattatcgtcggaacaagaatacagtttagcgatggtaatgagttcgcagtggacaagagcaaacgcggtctgatacatgttcccaaagacttgcccctcaaaacaaaagtcctggatatgtcgcagaactatattgccgagttacaggtgtccgatatgtcattcctctccgagctcaccgtgttgcgactgtcccataatcgtatacaactcctttag

SEQ ID NO: 244222 - DNA, 3150 bp, Artificial Sequence
  Description of Artificial Sequence: Synthetic coding sequence
atggttttccctatgtggactttgaagaggcagatcttgatactcttcaatatcatcttgattagtaagctcttgggtgcccgatggttcccaaagactttgccctgcgacgtgacgctcgacgtgccaaagaatcacgtgattgttgactgcacggataaacacttgaccgagatccccggagggatcccgaccaatacaacgaacctcacactgacaattaatcatatacccgacatctcgccagcctccttccatagactggatcacttagtggagatcgactttaggtgcaactgcgtacccatcccgttgggctcaaagaacaacatgtgtattaaacgcctccagattaaaccccgaagtttctcaggtcttacttatctgaaaagcctgtatctcgatggcaaccagctgctggagataccccaaggccttccgccatccctccagttgctaagtctggaagctaataatatcttcagtatccggaaagagaatctcaccgagttggccaatattgaaatcctttacctcggccagaactgttattacagaaatccctgctacgttagttactccatcgagaaggatgctttcctgaacttgacaaaacttaaggttctcagtctcaaagataacaacgtcactgccgttcccacagtccttccctctaccctcaccgagctgtacctgtataacaacatgatagcgaagatacaagaggacgatttcaataatttgaaccagctgcagatcctggatctgtctggcaactgccctcgatgttataacgcgccattcccctgtgcaccctgtaagaataactccccactgcaaatccccgtgaacgcgttcgacgcattaaccgaattaaaagtccttcggttgcactctaactccctccagcatgtaccacccagatggtttaagaacatcaataagcttcaggagctggacctttctcagaacttcctcgctaaagaaattggagatgcaaagttcctgcacttccttccgtcacttatacagctggatctctccttcaacttcgagctgcaggtgtatcgagcttccatgaacctgtcgcaagcgtttagttccctgaagagcctgaaaatcctccgaatccgcggttacgtcttcaaagagctgaagagctttaacctgtcacctctacacaacctgcagaacctggaagttcttgacctggggaccaactttataaaaatcgctaacctatctatgtttaaacaatttaaaaggttgaaggtgattgacctcagtgtcaataaaatttccccatccggtgacagttccgaagtaggcttttgcagcaacgcgagaacctctgtcgagtcctacgagcctcaggtacttgaacagctccattacttcagatatgacaaatatgcgaggagctgtaggtttaaaaataaggaagcttcctttatgtctgtgaatgagtcatgctacaagtatgggcagacgctggacctgtccaagaatagtatcttctttgttaaaagctcagacttccagcacttgtcatttctgaagtgtctgaacctcagcgggaatctgatctcccagacactaaatgggtccgagtttcagcctttagccgagttgcgttatttggatttttcgaacaacagactggatttgcttcactccaccgcatttgaggaactgcacaaactagaggtgttagacatcagcagtaactcgcactattttcaaagcgagggtattacacacatgttgaactttactaaaaatctaaaggttctgcaaaagctaatgatgaacgacaacgacatcagctcatcgaccagccgcaccatggagtccgagtctctgcggacactggagtttagaggcaaccatctggatgtattatggcgcgagggtgataatcggtacctacaattgttcaagaaccttctaaaattggaggagctggacatctcgaagaattccttgagctttttgccctccggggtcttcgatggtatgccgcctaatctcaagaacctctcactggcaaaaaacgggctcaaatcctttagctggaagaaactgcagtgcctaaagaacttggagaccctggacctgtctcacaatcagctgactactgtgcccgaacgcttgagcaattgctctagatcactgaagaatttgatcctgaaaaataaccagatcaggtctctgaccaagtatttcttgcaggatgcattccagcttcgctacttggatttatcttcaaacaaaattcaaatgattcaaaaaaccagttttccagagaatgtgttaaataaccttaaaatgttgttgctgcaccacaaccgcttcctgtgtacttgcgacgccgtttggtttgtttggtgggtgaatcacactgaagttaccattccctacctggcgaccgacgtcacttgcgttggaccaggcgcacataaaggacagagtgtgatatcacttgacttgtatacttgtgagctggacttaactaacctcatactcttcagtctcagtatttccgtgagcctgttccttatggtaatgatgaccgcatcacacctgtacttttgggatgtgtggtatatatatcatttttgtaaggcgaagatcaaggggtaccagcggctgattagccctgactgttgctatgatgcattcattgtgtacgataccaaagatcctgcagtaactgagtgggtcctggccgaattggtagccaagctggaggacccgagagagaagcattttaatctttgcttagaagagagggactggttacccggacaacccgtcctggagaatctttcccagagtattcaattaagtaagaagacagtgttcgttatgaccgataaatacgctaaaaccgagaactttaagatagccttctatttaagtcatcaacggctgatggacgagaaggtggacgtcatcatccttatctttctagagaagccctttcagaagagcaagttcctgcagctgcgtaaaagactgtgcggtagctctgtcttggagtggcccacgaaccctcaggcacatccctacttttggcagtgtcttaaaaacgctcttgctactgacaaccacgtggcctactctcaggttttcaaagagacagtgtag

SEQ ID NO: 244223 - DNA, 1074 bp, Artificial Sequence
  Description of Artificial Sequence: Synthetic coding sequence
atgcggagacaactccgcagtcggagggctccttcattcccatatagctaccgttaccgactcgatgatcccgatgaggctaatcaaaactatctagccgacgaagaagaggaggctgaggaggaagctcgcgtgaccgttgtccccaagtctgaggaggaagaagaagaagaagagaaggaggaagaagaagaggaggaaaaggaagaagaggagggacaaggccagccaacaggaaacgcctggtggcagaaattacaaatcatgtccgaatacctgtgggatccagaacggcgtatgttcttggccaggaccggccagagctggagcttgatattgcttatttatttcttcttctatgccagcctcgcagcggtgatcactctgtgcatgtacacactttttttgacaattagcccatacatccctaccttcacggaacgcgtaaagcctccaggggtgatgatcaggccttttgcccacagtttaaactttaattttaatgtgagcgaaccagatacctggcagcattacgtaatttcattaaacggcttcctgcaaggctacaacgatagcctacaggaagaaatgaacgtcgattgtccacctggccagtattttattcaggacggcaacgaggacgaggataagaaggcctgtcagtttaaacgctccttcctgaagaactgcagcggcctggaagatccaacgttcggctactcaactggccagccttgcatcttgctgaaaatgaacagaatcgtagggtttaggcccgaactcggggaccctgtgaaggtgtcatgcaaagtgcaaaggggagatgaaaatgatatcaggagtatttcctactacccagaaagcgcctcctttgatctgagatactacccatattatggaaaactgactcacgtcaattacacaagtcctttggttgcaatgcatttcacagacgtggtgaagaaccaggctgtgcctgtgcagtgtcaactaaagggcaaaggagtcatcaacgacgtgataaatgacaggttcgtaggaagagtgatattcacactaaacattgaaacatag

SEQ ID NO: 244224 - DNA, 3180 bp, Artificial Sequence
  Description of Artificial Sequence: Synthetic coding sequence
atgaaagagagcagcctgcaaaattcgagttgctcactcggcaaagaaacgaagaaggaaaatatgtttcttcagagtagcatgttaacatgcatctttctattaatctctggctcctgcgagctctgtgctgaagagaatttttcaagaagctatccttgcgacgagaaaaaacaaaacgactcggtcatcgctgaatgcagtaaccgcaggttgcaggaagtgcctcaaaccgtgggaaagtacgttacagaattggatttaagcgataattttatcacacacatcactaatgaatcattccagggtcttcagaatttaactaagatcaacctgaaccacaatccgaatgtgcagcaccagaacgggaatccaggaattcaatcaaacgggttaaacattacagacggcgctttccttaacctgaagaacttgcgtgagctgctgctcgaggataaccagctaccccagatccccagcggcctgcccgaatctttaacagaactgtcactgatccaaaacaacatatataacataacaaaggaaggaatctcccgccttatcaatttgaagaatctttacttagcctggaactgttattttaacaaagtctgtgaaaagaccaatatcgaggacggagtttttgagactctcacgaacctggagctcttatcactttctttcaatagtctgtctcacgtgccaccgaagcttccatcttcactacgcaaactcttcctgagtaacacacagatcaaatacatatctgaagaagattttaaaggactgattaatcttaccctgctggacttatcagggaactgtcctaggtgttttaacgccccttttccctgtgtgccatgcgacggtggagcgtcaattaacatcgaccgcttcgccttccagaacttaacccagttgcgctacctaaacctttcctctacctcactgagaaaaattaatgcagcttggtttaaaaacatgcctcatctcaaagtgttagaccttgagtttaactacctggtgggagaaattgcctctggcgcttttctcactatgctgcctcgcctggaaatcttggacttatcgttcaactatatcaagggtagttatccacaacacatcaatatcagtcgcaacttcagcaaactgctgtcccttagggctcttcacctacggggttacgtgttccaggaactgagggaagatgactttcagcctttaatgcagctacccaacttgagcactatcaacctggggataaatttcataaagcagattgacttcaagctgttccagaatttttccaatttggaaatcatttacttgagtgaaaaccgtatcagccccctggttaaagatacccggcagagttacgctaacagttctagcttccagaggcacattcgcaaaaggcgatctaccgattttgaattcgacccccactcaaatttctatcatttcacccggcctttgattaagccacagtgtgcagcctatgggaaggcgttagacttaagcctgaactctatcttctttatcggacccaatcagtttgaaaacctgccagacattgcatgccttaatttgtccgcaaacagtaatgcgcaggtgctctccggtacggaatttagtgctatccctcacgtaaagtacctggatctcacaaacaatcgcttggattttgataacgcttcagctctgactgagctctccgacctcgaggtactggacctgtcttataatagtcactattttcgaatcgccggtgtcacccaccacttagaattcatccaaaatttcacgaacctgaaggtgctcaatctctctcataataatatctacaccttgactgataagtacaatctggagagcaaatctcttgtcgaactggtgttctcaggaaataggctggatatcctatggaatgacgacgataaccggtacatctcaatattcaaaggcctgaaaaacctgactaggctggatctgagcctcaatcgtctgaaacacattcctaatgaagcattcctgaatctgcctgccagccttactgaactacatatcaatgacaatatgctaaaatttttcaactggactctgctgcagcaattccctcgcctcgagttgctggacttgaggggcaataagcttctattcttgaccgactctctgagtgactttaccagttccctccgtactttactgctttcccataacagaatctcccaccttccatctgggtttttatcggaggtatcatccctgaagcatcttgacctgagcagcaatttgttgaaaacaatcaacaaaagtgccctggaaacaaagactacaaccaagctgtcgatgctcgaactccacggcaatccattcgagtgcacctgcgacatcggtgacttccgcaggtggatggacgagcacctgaacgttaagatccctcgcttagtcgacgtgatatgcgccagtccgggtgaccagcgagggaagagcattgtttctctggagcttactacttgcgtaagtgacgtcacagctgtcatcctgttctttttcacgttcttcattacaacaatggttatgctcgcagccctggcccatcatctgttttactgggatgtctggttcatctataatgtgtgtctggcaaaagtcaagggttatcggagtttgtcaacatcccagacattttacgatgcatatattagttacgataccaaagacgcgtctgtcacggattgggtgatcaatgagctccgttatcacctggaagaatcccgagacaaaaatgtgctcctgtgcctcgaggaaagagattgggacccgggactggccataatcgacaacctgatgcagtccatcaatcagtcgaaaaaaaccgtatttgtgcttacaaagaaatatgcgaagtcctggaatttcaaaaccgcattttacttagccctccaacgtcttatggacgagaacatggacgtcataattttcatcctgctggagcccgtcctgcagcatagccagtatctccggctgaggcagcgaatatgcaagtcatccattttgcagtggcctgacaaccccaaggcagaaggactcttttggcaaacgcttcgtaacgtggtactaacagaaaacgactctcgatataataacatgtacgtggatagtattaaacagtactag

SEQ ID NO: 244225 - DNA, 3099 bp, Artificial Sequence
  Description of Artificial Sequence: Synthetic coding sequence
atgggcttctgccggtctgcacttcatcccctgtctctgctggtacaggctattatgctggctatgaccctagctctggggacccttcccgcattcctcccctgtgagcttcagccccacgggctggtgaattgtaactggctttttttgaagtccgtgccccacttttctatggcggcacctcggggaaatgtcacatccctatccttgagctcgaaccgcatacaccacttgcacgactcggacttcgctcatcttccatctctgcgccacctgaacctgaaatggaattgtcctcctgtgggcttgtcccccatgcactttccttgtcatatgaccattgagccgtctacatttcttgcggtccccactctcgaagaactgaatttgtcatacaacaatatcatgaccgtgcctgctttacccaaatccttaatttccttatctctgagtcacacaaatatccttatgctagattctgcgagcctagccggtctccacgccctaagatttctgttcatggatggtaattgctattacaagaatccatgccgtcaggcactcgaggtggccccaggggctctcctgggactaggaaacctgactcacctttccctgaagtataacaatctgaccgtcgttcctcggaatctcccttcgagtctggagtacctcctgctgagctacaatcggatcgttaagctggccccagaagatctggctaatctgaccgctttgcgcgtgctggatgtgggaggcaactgccgcagatgcgatcatgcacctaatccttgtatggagtgcccaaggcactttccccagttgcaccctgacacattcagccatttaagccggctggagggcctggtactcaaggattcttcactctcgtggctgaacgctagctggttcaggggcttaggaaacttgcgagtgctggacctgagtgagaattttttgtacaaatgtattaccaagacgaaagcattccaggggttgacacagctgagaaaactgaatttatcctttaattaccaaaaaagagtttctttcgcccacctcagtctagctcctagtttcggcagcttggtggctctgaaggagttggacatgcacggtattttctttcgttcgttggatgagaccactcttcggcctctggcccgacttccaatgctgcagacgttgcgtctccagatgaacttcataaatcaggctcagctggggattttcagggcctttcctgggttacgctacgtggacctctcagataatcggatttctggggcaagcgaactgacggccactatgggagaggcagatggcggagagaaagtttggctgcaacccggtgacctagccccagccccagtggatacccccagctccgaggactttaggccgaattgctcaaccctgaatttcaccctggacctaagcagaaacaatctggttaccgtgcagcccgaaatgtttgcgcagctctctcacctccaatgcctgagattatcccacaactgtatttcccaggcagtcaacggcagtcagtttctccccctaacgggtttgcaggttctcgacctgagtcataataaactggatctgtaccacgaacactcattcacggagctgccgcgactagaggcactagacctgagttataactctcagcccttcgggatgcagggagtgggccacaactttagttttgtcgcccatctccggaccttgaggcacctgtcccttgcccacaacaacatccacagtcaggtgagccagcagctgtgtagcacatctctgcgtgctctagatttcagtggaaatgcccttggccacatgtgggcggaaggggacttatacttacacttttttcaagggctctctggtctcatttggctggatctgtcgcagaatagactgcacactctgttgccacaaacactgagaaatctccccaagagtttgcaagtcttaaggctgcgagataactacctggctttcttcaaatggtggtccctgcatttcctgcctaaactcgaggtattagacctcgccggtaaccagctaaaggcgctgaccaacggctctctccctgcaggtactcgccttcgccgactggatgtgtcttgtaattccatctctttcgtcgcgcctggcttcttcagcaaagccaaggaactgcgggaactgaacctgtccgcaaacgctctgaaaacagtcgatcattcatggttcggccctctggcctcagccctgcaaatcctcgacgtaagcgccaaccctctgcattgtgcatgcggagccgcttttatggactttctcctcgaggtccaggcagccgtgcccggacttcctagcagagttaagtgtggttccccaggacaactgcaagggctcagtatttttgcacaggatctgcgcctgtgtttggatgaagccctgagctgggattgcttcgccctgagtctgttggccgtggccttagggttgggggtaccaatgctgcatcatttgtgtggatgggacttgtggtattgtttccatctgtgcctggcgtggctgccatggcgaggcagacagtccggacgggacgaggacgctctcccatacgacgcattcgttgtgtttgataagacacaaagcgctgtcgcagattgggtgtacaatgaacttcggggacagcttgaggagtgtaggggacgctgggctctgcgcctctgcctggaggaacgcgactggttacctggtaaaaccctctttgaaaacctgtgggcgtcggtatacgggagcagaaagacactctttgtgctggctcatacggatcgcgtgtctgggctactgcgggcaagttttttactcgcacagcaaagactgttagaagaccggaaagatgtggtggtactggtaattctctcccctgatggcagacgttctaggtacgtgcggcttagacaacgcttgtgtcggcagagtgtgctcctgtggccccaccagcccagcggccaacgatcattctgggcacaactgggcatggccctcactagagacaaccatcacttttacaaccgcaacttttgccagggccctaccgccgagtag

SEQ ID NO: 244226 - DNA, 2139 bp, Artificial Sequence
  Description of Artificial Sequence: Synthetic coding sequence
atggcatgcactggaccttcattgcccagtgccttcgatattttgggggcagcgggtcaggataagctgctctacctcaaacataagttaaagaccccacgacccggatgtcagggacaggacctgctgcacgctatggtgcttttaaagctggggcaagagactgaggcaaggatttccctcgaggcgctgaaggctgatgcggtcgctaggctcgtggcgcgacagtgggcgggagtggactctacggaagatccagaggaaccaccagacgtttcatgggctgtggcacggctctatcacctgctggcagaagagaagctctgtcccgcatcgctccgggacgtagcgtaccaggaggccgtgcggactctgagctctagagacgaccatagactgggggagctgcaggatgaggccaggaatcgctgcggctgggatatcgcgggagaccccggatccatcagaaccttacaaagtaacttgggctgtctccccccaagcagcgccctgccttcaggcacacggtctttacccagacctatcgatggtgtgtccgactggagccagggctgcagtttgaggtctacaggatctcccgctagcctcgcatcaaacttggaaatttcccagagtcccaccatgccgtttttgtcgttacaccggagcccccatgggccttctaaattatgtgatgaccctcaggcttccctggtccccgagcccgtgccaggtggttgccaagaaccggaagaaatgtcctggccaccctccggggaaattgcatcgccccctgagctcccctccagtccaccaccagggttgcccgaagtggcgcctgacgccacttccacaggactaccggacacccctgcggctcccgagactagcactaactatcctgtcgaatgcaccgagggctctgccggaccacaaagtctgcccctcccaattctagaaccagttaagaatccatgtagcgtgaaggatcagactcccctccagctgtctgtcgaagacacaacatcaccaaacaccaagccttgccctccaactcctacgaccccagagacttctccacctcctccaccaccccctcctagcagcaccccttgcagtgcgcatctcactcctagctcactgttccccagctctctggaatccagtagcgagcagaaattttataattttgtgattttgcatgcccgagctgacgagcatattgcccttagggtgcgcgagaagctggaggctctcggtgtccctgatggagctacgttttgcgaagatttccaggtccctgggaggggagagctcagctgcctgcaggacgccattgaccactccgcttttataatactgctactcacttccaacttcgactgccgcctgagcttacatcaggtgaatcaggccatgatgagcaatcttacaagacagggctcgcctgactgcgtgattcccttcttacctctagagagtagtcctgctcagctcagcagcgacactgcatcactgctatctggcttagtgagactggacgaacactcacagatctttgccaggaaggtggcgaatacatttaaacctcaccggctgcaggctcgcaaggcaatgtggcgtaaagaacaggatacacgggctcttcgggaacaatcccagcacctggatggcgagcgaatgcaggcggcagctctgaacgcagcctattctgcgtatctgcagtcttatctgtcctatcaggcccagatggagcagctgcaggtggccttcggctcacatatgtcctttggcaccggagccccttacggggctcgaatgcctttcgggggacaggtacccctgggggcacccccaccatttcccacctggcctggctgcccccagcccccacctctgcatgcatggcaagcgggtaccccaccccctccttccccacagcctgccgctttcccacagtctctcccatttccacagagtcccgcattcccaacagcaagccccgctccccctcagagccctggactgcagcccctcatcatacatcatgcccaaatggtccagctcggcctgaacaatcacatgtggaatcagcggggatctcaggctcctgaagacaagacccaggaagccgaatag

SEQ ID NO: 244227 - DNA, 3042 bp, Artificial Sequence
  Description of Artificial Sequence: Synthetic coding sequence
atggggctgggaaccctgtcgcctcgaatgctggtgtggctggtcgcatccggcatagtgttctacggcgaactttgggtgtgcgctggtttagactatgattatacattcgatggcaatgaggaagataagaccgagactatcgactacaaggacccgtgtaaagcagcggtcttctggggagacattgctctcgacgatgaagatctgaacatattccagattgacaggacaattgatctgacacagaaccctttcggcaatcttggccatacaaccggtggactgggcgaccacgcaatgtcaaagaagcggggagcgctgtatcagctgattgacagaatccgacggatcggattcggccttgagcagaataacaccgttaaaggaaaagtgccattgcaattctcaggtcagaacgagaagaatagggttcctcgagctgccacatcacgtacagaacgaatctggcccggtggcgtcattccttacgtgatagggggaaattttacgggtagtcagagagcaatgttcaaacaagcaatgcgacactgggagaagcatacttgcgtaaccttcattgagcggtccgatgaagaaagttacatcgtgttcacctatcgcccttgcggttgctgttcatacgtggggagaagaggtaacggaccccaggctatttcaatcgggaaaaactgtgacaagttcggaatcgttgtccacgagttagggcacgtcatcgggttctggcacgaacacacaagaccggaccgggacaaccacgttacaattattcgggagaatatccagccagggcaagagtataattttctgaagatggagcctggcgaagttaacagcctgggagagaggtatgattttgacagcatcatgcattacgcacggaatacttttagtagaggtatgtttttggataccatcctgccctctagagacgacaacggcattagaccggctattggccaaagaacgcgcctcagtaaaggtgacattgcccaggcacggaagctctaccgatgtcccgcatgtggagagaccctgcaggagtcgaacggaaatctatctagccccggattccccaatggctaccctagctatactcactgcatatggagggtatccgttactccgggtgaaaagattgtccttaacttcactaccatggatctttacaagtcctctctttgctggtacgattacatcgaggtgagggatggctattggcgaaagtccccactgctaggcaggttttgtggagataagttaccagaagtcctgacctccacagacagtcggatgtggatcgagtttaggagctcgtccaactgggtgggcaagggatttgcggcagtgtacgaagcaatctgcggtggcgagattcggaagaatgaggggcaaattcaatcaccaaattatcctgacgattaccgtccgatgaaggagtgcgtttggaaaattactgtctctgaaagctatcacgtgggtttaaccttccagagttttgagatcgagcggcatgacaactgtgcatacgattatctcgaggtgagggatggaaccagtgagaattctcccctgatcggtcgcttctgtgggtacgacaagcccgaggatattaggagcaccagcaatacactatggatgaaattcgtcagcgacggaacagttaacaaggcagggtttgccgcaaatttctttaaggaagaagatgagtgcgccaagcccgatagaggtggctgcgagcagcgctgcctaaacactcttggaagttaccaatgtgcctgtgaaccaggctatgaactcgggcctgaccgtcgcagctgtgaagcagcctgtggcggtctcctgacaaagcttaatggtacaatcactacaccgggatggccaaaagagtaccccccaaataagaattgtgtgtggcaggtcgtagcaccgacacaatataggatttcggtaaaatttgaattttttgagcttgagggcaatgaggtatgtaaatacgattacgtggaaatctggtcaggcctgtcgtcagagtcaaaactgcacggcaaattctgcggcgctgaggtccctgaagtcatcacctctcagtttaacaacatgagaattgaatttaaaagtgacaacactgtgagtaaaaaaggattcaaggcacacttcttctctgacaaggacgagtgcagtaaagataatggaggatgccaacatgaatgcgtaaacaccatgggctcatacatgtgccagtgtcggaacggattcgtactccatgataataaacacgattgcaaagaggctgaatgcgagcagaaaatacacagcccatctggactgattaccagccccaactggcctgacaagtacccctctcggaaagagtgcacctgggagatctctgcaacccctggacaccggattaaactggcgttcagcgaattcgagatcgagcagcaccaggagtgcgcgtacgatcacttagaggtctttgacggcgaaaccgagaagtcgccaatcctcggacggttatgcggaaacaagataccggacccactggtggcaacgggcaacaagatgttcgtccgattcgtaagcgacgcctccgtccaacggaagggtttccaggcaactcactcaacggagtgcgggggtcggttgaaggccgagtctaagcctcgtgatctatactcacacgcccagttcggagacaataactacccaggccaggtggactgcgagtggctattggttagtgaaagagggtccaggctcgaactgagcttccagaccttcgaagtggaagaggaggccgactgcgggtacgactatgtcgagctgttcgatggacttgatagcactgcagtgggtctcggcaggttctgcggttctggtccacctgaggaaatatattccattggcgattcagtcctcatccacttccatactgacgataccatcaataagaaaggatttcatattcgctacaagtctatcagatatcccgatacgactcacacaaaaaaatag

SEQ ID NO: 244228 - DNA, 1179 bp, Artificial Sequence
  Description of Artificial Sequence: Synthetic coding sequence
atgggccttggcacactgagccctcgcatgctggtgtggcttgtggcaagtggcattgtattttacggcgagttatgggtttgtgccggacttgattacgactacaccttcgacggcaatgaagaggacaagaccgagacaattgactataaggatccttgcaaggcagctgtcttttggggcgatattgcattagacgacgaggacctaaacatttttcaaattgatcgcactatcgaccttacacagaatccttttggtaacctggggcacaccacaggcggactgggcgatcacgctatgagcaagaagcgaggggctctatatcagctgatagataggattcggagaatcggtttcggcttggagcagaataacaccgtcaaaggcaaggttccactgcaattctctggtcagaacgagaagaatcgagtccccagggctgccacatcccgcactgagaggatctggcccggaggggtcatcccatacgtaattggcggtaatttcaccggaagccagagggccatgttcaaacaggccatgcggcattgggagaagcatacgtgcgttacattcattgagaggagtgacgaagaatcgtatatcgttttcacttacaggccatgtggctgctgtagctacgtcggtaggaggggaaacggtccgcaagccatttcaataggaaagaactgtgataagttcggcattgtagttcacgaattagggcacgtcattggattctggcacgaacatacacgacccgacagggacaaccacgtgacgattattagggaaaacattcagcctggccaggagtacaacttcctgaaaatggagccgggtgaagttaatagccttggtgaacgctacgacttcgatagcatcatgcactacgcacgaaatacttttagcagaggtatgtttcttgacactatactcccgagcagagatgataacgggattaggccagcaattggacagaggacccggttgagtaagggagacattgcccaggcaagaaaactgtacaggtgccctgcctgtggagagactctacaggagagcaatggtaacctatcttccccaggcttcccaaatggatacccaagctatacccattgtatatggagggtgtcagtcactcccggagagaaagtagtcttctcactctgctag

SEQ ID NO: 244229 - DNA, 3048 bp, Artificial Sequence
  Description of Artificial Sequence: Synthetic coding sequence
atgcccagggctaccgccttgggggctcttgtgtctcttctattactgctgccgctgcccagaggtgccggtgggctgggagaacgcccagatgccaccgccgattactctgagttagacggtgaagaaggcacagaacagcagctggaacactaccacgacccatgtaaggcagcggtgttctggggcgatatcgcgttagatgaagacgatcttaagttattccacatagataaggccagggactggaccaagcagacagtaggggctacaggacatagcacaggcggtttagaagaacaggcatccgagagctcccccgacaccactgccatggacaccgggactaaagaagcaggaaaagatgggcgagagaataccacactgctgcattcacctggaactttacacgctgcggctaaaaccttttctcccagagttagacgggcaacaaccagtcgcaccgaacggatctggcccggaggtgtgattccctacgtgataggtggcaactttactgggtcacaaagggccatattcaaacaggcgatgcgccattgggagaaacacacgtgcgtgacattcatcgaacggacagacgaagaatcctttattgtcttttcataccggacctgtgggtgttgctcctacgtgggaaggagaggaggcggaccacaagcgatcagcatcggcaagaactgcgacaagtttggcattgtggctcacgagctcggacacgtggtcggcttttggcatgaacacactcgcccagatcgcgatcaacatgtgacaatcattcgggaaaacatccagccaggtcaggaatataattttctgaaaatggaagctggtgaggttagctcactcggggaaacctatgactttgactcaattatgcattatgcgcgaaacactttctcccgtggggtgttcctagacacaatcttgcctcgccaagatgataatggcgttcgcccaacaataggtcagcgtgtccgcttgtcccagggtgacattgcccaggctcggaaactgtacaaatgccctgcctgtggggaaacccttcaggacacaactggtaattttagtgcccctggattccccaatggctatccaagttacagccactgcgtatggcgtattagtgtgacacctggagagaaaatcgtgttaaactttacgtctatggacctcttcaaatctcggttatgctggtacgactatgttgaagtgagggacggatattggcgaaaagcacctctcctcggtagattctgtggcgataaaatccctgagccccttgtttccacggactcacgcttgtgggtcgagtttaggagttcctccaacatactgggaaaaggcttttttgcagcatacgaagctacgtgtggaggagatatgaacaaggatgcgggacagatccagagccctaattacccagatgattaccgaccatccaaggagtgtgtgtggcgaattaccgtgtccgagggttttcatgtgggccttactttccaagcgttcgagattgagagacatgatagttgcgcttacgactatctggaagttcgagatggccctacagaggagtccgcgctgatcgggcatttctgcggctatgagaagcccgaagacgtgaaaagctcaagcaaccggctgtggatgaagttcgtatcagacggtagcatcaataaggccggattcgcagctaacttttttaaagaggtcgacgagtgttcctggcctgaccatggaggatgcgaacataggtgcgtgaataccctcggttcatataaatgcgcatgcgatccgggttatgagcttgctgctgacaagaaaatgtgtgaggtggcctgcgggggattcatcaccaagctcaatggcactattacctctcctggctggcctaaggagtatcccaccaacaagaattgtgtttggcaggttgtagcccctgcacagtaccgaatcagcctccagttcgaggtgttcgagcttgaaggcaacgacgtctgcaaatatgactttgtggaggtgaggagcggcctctcccctgatgccaaactgcatggccgattctgcggtagcgaaaccccggaggtgattacttcccagtcaaataacatgagggtggagtttaaatccgataacactgtctccaaaagaggattccgggcacattttttttctgacaaggacgaatgtgccaaggataacggcggatgccaacacgagtgtgtgaacactttcggtagttacctgtgccggtgcagaaacggatactggctgcatgagaatggccatgattgtaaagaggccggatgcgctcataagatctcctcagttgagggcaccttggccagtcctaactggcccgataagtatccatcccgaagagagtgtacgtggaatatatcatccacagctggtcaccgggttaaactgacgttcaatgaattcgagattgagcagcaccaggaatgtgcctacgatcacctggaaatgtacgacggaccagacagtcttgcaccgatcttgggaaggttttgcggtagcaagaagccagacccaaccgtcgccagtggttcatcgatgtttctcagattctactccgacgccagcgtgcagcggaaagggttccaggccgtccattcaacagagtgcggtggcagactgaaagccgaggtccaaaccaaggaactgtactctcacgcacaattcggggacaacaactacccatccgaggcaaggtgtgactgggtgatcgtggcagaagacggatatggcgttgagctgactttccgaacttttgaggtggaggaggaggccgattgtgggtacgattatatggaagcgtacgatggttatgatagctctgccccacggctgggtagattctgtgggtcaggtccactggaggagatttactcagccggtgacagtctaatgattcgcttcagaacagatgacactatcaataagaagggcttccacgcaaggtatacttcaacgaaatttcaggacgctttacacatgaagaagtag

SEQ ID NO: 244230 - DNA, 2298 bp, Artificial Sequence
  Description of Artificial Sequence: Synthetic coding sequence
atgtcaggcgaccatctccacaatgactctcagatcgaggctgattttagattaaatgatagccacaagcacaaggacaagcataaagacagggagcaccgtcataaagaacataagaaagagaaggatcgagagaagtcgaagcatagcaactcagagcataaagactccgaaaagaagcataaggaaaaagagaagacaaagcataaagacggctcttccgaaaagcataaagacaaacacaaagaccgcgataaagaaaaaagaaaagaagagaaagtccgggcaagcggagatgcgaaaattaaaaaagagaaagaaaacggtttctccagtcccccacagatcaaagacgagcctgaagatgatggatacttcgtacctcctaaggaggacatcaagccgctgaaacggccacgggatgaagatgacgccgactacaagcccaagaaaatcaaaactgaagacaccaagaaggagaagaaacggaagctagaggaggaggaggatggcaaacttaagaagccgaaaaacaaagacaaagacaaaaaagtgcctgaacccgataataagaagaagaagcctaaaaaggaggaagagcagaagtggaagtggtgggaagaggaaagataccccgagggaattaagtggaagttccttgaacacaaggggcctgtgtttgctcctccttacgaacctttgcccgagaatgtgaagttctactacgatggcaaggtcatgaaactgagtcccaaggccgaggaagtcgctacgttcttcgcaaaaatgctggatcatgaatataccacaaaagagatattcagaaagaactttttcaaagactggaggaaggaaatgaccaatgaggaaaaaaacatcattactaacctttcaaaatgtgatttcactcagatgtcccagtacttcaaggctcagactgaggccagaaaacagatgagcaaagaggaaaaactcaaaatcaaagaggaaaacgagaaactcctcaaagagtatggtttttgtattatggataatcacaaggaacggatcgcgaatttcaagatagagccaccaggactattcagaggcagaggcaatcacccaaaaatgggtatgctgaagaggcgcatcatgcccgaagatatcataatcaattgtagtaaggatgccaaagtgccatctccccctcccggtcacaaatggaaggaagtgcggcatgacaacaaggttacatggcttgtgagctggacagagaacatccagggttccatcaagtacatcatgttgaaccctagttctcgtattaaaggagagaaagactggcagaaatatgagactgcccgacgactaaaaaagtgtgtcgacaaaatcagaaatcagtatcgcgaagattggaagtctaaagaaatgaaggtgcggcagcgtgccgtggccctttactttatcgacaagctggccctcagagccggtaatgagaaggaagaaggtgaaaccgcagatacagttggctgctgctcgcttcgggtcgaacatatcaacttgcacccggaattagacgggcaggagtacgttgtggagttcgactttcttggcaaagattccatccgatattataataaggtgcctgtggagaaacgagtcttcaaaaatctgcagctcttcatggagaataagcaacctgaagatgatttatttgaccggctgaacactgggattctcaataagcacctgcaagacctgatggagggactgaccgccaaggtgtttagaacttacaatgccagtattaccctccagcaacaattaaaagagttaaccgccccagacgagaatatccctgctaagattctgagttataatagggccaaccgcgcagtggctatcctgtgcaaccatcaacgcgctccccctaagactttcgagaagtcgatgatgaacctgcagactaagatcgacgccaagaaggagcaacttgccgatgctagacgcgatctgaaatcagccaaagcggacgccaaggtaatgaaggatgccaaaaccaaaaaggtggtggagtctaagaagaaggccgtacagcgactggaagaacagctgatgaagctggaggtccaggctactgatcgtgaagagaataagcaaatcgccctagggacgtcaaaactaaactatctggatcccaggattactgtcgcctggtgcaaaaagtggggggtccccattgaaaaaatctacaataaaacacagcgggaaaaatttgcctgggcaatagacatggccgacgaagactatgagttctag

SEQ ID NO: 244231 - DNA, 1806 bp, Artificial Sequence
  Description of Artificial Sequence: Synthetic coding sequence
atgcgcgtggtgcggctcctgaggcttcgagcggcactgaccctgctcggggaagttcccagacgaccggctagccgtggtgtgccaggaagccgaaggacacaaaaaggaagcggcgcacgctgggagaaagaaaagcacgaggatggcgtaaagtggcgccagctcgagcacaagggtccatacttcgcgcctccctacgaacccctgcccgatggagtccgattcttctacgagggccgaccagtacggctgagcgtcgccgcagaagaagttgccaccttctatggacggatgttagaccatgaatatacaacgaaagaggtattccggaaaaatttcttcaacgactggaggaaggaaatggcggtcgaagaacgggaggtgatcaagagcctggataaatgtgacttcactgaaattcaccgctattttgttgataaggcagctgccaggaaggtcctttctcgggaggagaaacagaagctcaaagaagaagctgagaaattgcagcaggagttcggttattgtatactggatggtcatcaggaaaagatcggaaattttaagatcgagcctcccggactctttcgtgggaggggagaccaccccaagatggggatgcttaagagaagaatcaccccggaggacgttgtgatcaattgctctcgtgatagtaaaatcccagaacctcctgccggacaccaatggaaagaggtccgctctgacaacaccgtcacgtggttggctgcctggacagagtccgtacagaacagtattaaatatatcatgcttaacccatgttccaagctgaaaggcgaaacggcctggcagaaattcgagacggccaggcgattgagaggatttgtggacgaaattcggagtcaataccgcgctgattggaaatccagagaaatgaaaacacgccagcgcgctgtcgctctgtactttatagacaagctggctttaagggctggaaatgagaaagaagatggcgaagccgctgacaccgtgggatgctgtagccttagagtcgagcatgtgcagctacacccagaggcagacggttgccagcatgtggtagaatttgatttccttggcaaggattgcattagatactacaatagggtgccagtggaaaagcccgtctacaagaatctgcaactcttcatggagaataaagatcctcgcgacgacctgttcgatagactaacaaccacttcgctgaataagcatctgcaggagttgatggatggcctcaccgccaaggtttttcgcacgtataacgcctcaattactctgcaggagcagctcagagcattgactcgcgcagaggattctatagcagctaaaattcttagctacaatagggctaatcgcgtagtggcaattctatgtaaccaccaaagagccacaccaagcacatttgagaagagtatgcagaatctgcagaccaagatccaggccaagaaggaacaggtcgccgaagccagagccgaattgaggcgtgcacgcgctgagcacaaggcccagggcgatgggaaatctagaagcgtcttggagaagaagcgcagactgctggagaaactgcaggagcaactagctcagctgagtgtgcaggcaacagataaggaagagaacaagcaggtcgccttgggcacctccaagctgaactatctggaccctcggatttctatcgcatggtgcaagagatttcgcgtaccggtagagaagatttactccaaaacccagcgagaacggttcgcgtgggccttggcaatggccggagaggacttcgagttttag

SEQ ID NO: 244232 - DNA, 1512 bp, Artificial Sequence
  Description of Artificial Sequence: Synthetic coding sequence
atgctggaccacgagtacaccacaaaggaggttttccggaagaatttcttcaacgactggcgcaaagagatggcggtggaagagagagaggtgattaaatctctggataagtgcgactttacggaaatacatcggtactttgtcgataaggcggcagccaggaaagtgctgagccgggaagagaaacagaagctaaaggaggaagcagaaaaactgcagcaggaatttggctactgtattttggatggtcaccaggagaaaatcggcaactttaagatagagccacccggactgtttagaggtcgcggagaccatcccaagatgggtatgctcaaacgacggatcacgcctgaggacgtggtgattaactgcagtagagactccaaaattccggagccccctgctggtcaccagtggaaagaagttcgttccgacaacacggttacgtggctggctgcatggacagaaagtgtgcagaattcaatcaaatacattatgttgaacccctgctccaaactgaagggagaaactgcctggcagaaatttgaaaccgctaggcgccttcgcggattcgtcgatgagataaggtctcaatatagggcagattggaagtctagagagatgaagacacgacaaagggctgtcgcactgtacttcatcgataaactggctctgcgggctggtaacgagaaagaggacggagaggccgcagataccgtcggatgctgctcacttagagttgaacacgttcagctccatccagaggctgatgggtgccagcacgtggttgagttcgacttcctgggcaaggactgtatcagatactataatagagtacccgtcgagaagcctgtgtacaaaaacctgcaactgtttatggagaataaggaccccagagacgatctgtttgatagactgactacgacctctctcaacaaacacctccaggagttaatggatggattaacagcgaaagtattccgaacctataacgcaagtataaccctgcaagagcagctgagagccttaacaagggccgaagatagcattgcggctaagatcctgtcctataaccgtgccaatagggtcgtagccatcctatgtaaccaccagcgcgctactcctagcactttcgagaagagtatgcagaacctacaaacaaaaatccaggccaaaaaagagcaagtggccgaggcgagagccgagctaagacgtgccagagctgaacataaggctcagggcgatggtaagtcccgcagcgttctggagaaaaagcgtcggctgcttgagaaacttcaggagcagctcgcccagctcagcgtgcaagccaccgataaagaggagaataaacaggtagctctgggtacatcaaagttgaactacctggatcccagaatcagtattgcatggtgtaagcgcttccgggtcccagttgaaaaaatttatagtaagacacagcgggagaggtttgcatgggcgttggccatggccggagaggacttcgagttttag

SEQ ID NO: 244233 - DNA, 1512 bp, Artificial Sequence
  Description of Artificial Sequence: Synthetic coding sequence
atgctagatcacgaatatactacaaaggaggtgtttcgtaagaatttctttaatgattggaggaaggagatggctgttgaagagcgggaggtcatcaaatcccttgacaaatgtgatttcaccgagatccaccggtacttcgtcgataaagccgctgctcggaaggttttgtccagggaggaaaaacaaaagctgaaggaggaggccgagaaattgcagcaagaattcggatattgcattctggatggtcaccaggaaaaaataggaaacttcaagatcgaacccccaggtttattcagaggcaggggtgaccatccaaagatgggcatgctgaaacgcaggataacgcccgaggacgtcgtgatcaactgttccagagattcaaaaatacctgagccacctgcaggacaccaatggaaggaggttcggtcggacaataccgtgacatggctggcagcttggaccgagtcagtgcaaaacagcatcaagtatataatgctgaacccatgttcaaaactcaaaggcgagaccgcttggcagaagtttgaaaccgcacggcgactgcgcggattcgttgatgagatacggagccaatacagagccgactggaagagccgagagatgaagacacgacagagggctgtcgcattatattttatcgacaagttggcactaagagccggtaatgaaaaagaggacggggaggccgcagacaccgtaggatgttgctcactgcgggtcgagcatgtccagttgcacccagaggccgacggctgccaacacgtggtagaattcgacttcttggggaaggattgcatcagatactataacagggtcccggtggagaaaccagtctataagaacctgcagctgttcatggagaacaaggatcctcgggacgatctcttcgaccgcctcacgacgacaagcctgaacaagcacctgcaggaacttatggatggacttaccgcaaaagtgtttagaacttataacgcaagtattacgctccaggagcagctgcgcgctcttactcgtgcggaggacagcatagccgctaagatcctatcctataaccgggcaaatagagtggtggctatcctgtgtaatcatcagcgagccacaccatcaacgttcgaaaagtcgatgcagaatctgcagacgaaaatacaggcgaagaaggagcaggtggctgaggcgagggccgagcttaggagagccagggcagagcataaggcccagggtgacggcaagtcccgaagtgtgttagagaaaaaaagaaggttgcttgagaagcttcaggaacaactggctcagctctctgtgcaggccacagataaagaggagaataagcaggtcgccctgggcacgtccaagctcaactacctggaccctcggatctccatcgcctggtgcaaaagatttagggtgcctgtagaaaagatctatagtaaaactcagagggaacgcttcgcgtgggcactagccatggctggcgaggactttgagttctag

SEQ ID NO: 244234 - DNA, 1512 bp, Artificial Sequence
  Description of Artificial Sequence: Synthetic coding sequence
atgttggaccatgagtacacgactaaagaagtgttccggaagaacttttttaatgactggcgcaaggaaatggccgtagaggaaagggaggtgattaaatctctggacaaatgcgattttacggagatccatagatacttcgttgacaaggccgctgccagaaaagttctgtcacgcgaggaaaagcagaagctcaaagaagaggcggaaaaactccaacaggagtttggttactgtattcttgacggacatcaggagaagatcggcaacttcaagattgaacccccaggtctcttcaggggacggggtgaccatcctaagatgggaatgctcaagcgccgtattactcccgaggacgtggtgatcaattgttcccgcgactcaaaaattccggagccacccgctggtcatcaatggaaagaggtgcggtctgacaatacagtcacatggttagccgcttggactgaatccgtgcagaattcaattaagtatatcatgcttaacccgtgctctaaactaaagggcgagaccgcatggcagaagttcgagaccgcccgaagactcagagggttcgtagatgagatccggagtcagtatagggccgattggaagtctagggaaatgaaaacccgtcagcgagccgtcgccctctatttcatcgacaagctcgctctaagggcaggaaatgagaaagaagacggtgaggccgctgatacagtgggatgttgttcactgcgggtggagcacgtgcagctacatcctgaggccgacgggtgccaacatgtcgtcgaatttgacttcctggggaaggactgtataagatattacaatagagttccggtcgaaaagcctgtctataaaaaccttcagctgttcatggaaaacaaggatcccagggacgacctgttcgataggttaaccacgacctctctaaataagcatctgcaggagctgatggatggactgaccgccaaagtgttccgtacgtataatgcatcgatcacccttcaggagcagctaagagcacttacccgagctgaggatagcatcgccgctaaaatactctcctataatcgggcaaacagggtcgtcgccatcctgtgcaaccaccagagagccaccccctctacctttgagaagtcgatgcagaatctccagacaaagatccaggcgaagaaggaacaggtcgccgaggcccgagccgagcttcgtcgcgctcgggcagagcacaaggctcagggtgatggaaaaagtcgcagcgtgctggagaagaaacggagactacttgagaagctacaggagcagttagctcaattgagtgtacaggcaacggacaaagaggaaaataagcaggtggctctcggcacatccaagctgaattatttggaccctcgcatatcaattgcctggtgcaaacggtttcgggtcccagttgaaaagatctatagcaaaacccagcgcgaacgcttcgcatgggcactcgctatggcaggggaggacttcgagttctag

SEQ ID NO: 244235 - DNA, 4569 bp, Artificial Sequence
  Description of Artificial Sequence: Synthetic coding sequence
atgagtcgcaacgacaaagaacctttttttgtgaagtttctaaagtcctccgacaacagcaagtgtttctttaaggcattggagtctattaaagaattccaaagcgaagagtacttgcagataataacggaagaggaggctctcaaaataaaggaaaacgacagaagtctttacatttgtgatccattctcaggggtggtttttgatcatctgaagaaactaggctgccgtatcgttggaccccaggttgttatcttctgtatgcaccatcaacgctgtgttccccgtgctgagcatcccgtctataatatggttatgtcagatgtcaccatctcctgcacatccttagagaaggaaaaacgcgaagaagtgcacaaatacgttcaaatgatgggcggacgggtgtatcgcgacctaaatgtgagcgtgacacacctcattgccggtgaagtgggtagtaagaaatacctggtggccgcaaatctgaagaaacctatactactgccatcatggatcaaaactctgtgggagaagagccaggagaagaaaattacccgttacacagatattaatatggaagacttcaagtgcccaattttccttggatgcattatttgcgttacggggctttgcggcctcgatagaaaggaagtacagcagctcaccgtgaagcatggaggccaatatatgggccagttgaaaatgaatgagtgcacccacctaatcgtgcaggagcctaagggccagaaatacgaatgcgccaaacgctggaatgtgcattgcgtaacgacacagtggttttttgactccatagaaaaggggttttgccaggacgaatccatttacaaaacagaaccaagacctgaggcgaagactatgcctaacagttccacccctactagccagattaataccatcgattctaggaccctgtccgacgtgtcaaacatctctaatatcaatgcgtcatgcgtatctgagtctatttgtaattctctgaactctaagctggagccaaccctagaaaacctggagaatctggatgtcagcgcgtttcaggccccagaggacctgcttgacggatgtcgcatctatctctgtggtttctcgggacgcaagctggacaaacttcggagactcatcaatagtggtgggggagtgagattcaatcagctgaacgaggatgtgacacatgtgatcgtgggtgactatgatgacgaactgaagcagttttggaacaagtccgcccatcgaccacacgtggtgggtgctaaatggctgctcgaatgttttagcaagggttacatgctgtccgaggaaccatacatccacgcgaactaccaaccagtggaaataccagtaagccataagcctgaatctaaagctgcattgctcaaaaagaagaactccagcttttctaaaaaagattttgcgccttcggagaagcacgaacaggccgatgaggatcttctgtctcagtacgagaatggctcttcaacagtggtcgaggccaagaccagcgaggccagaccatttaacgattccacccatgcggaacctttgaatgattccacacacatttccctccaggaggagaaccaatcaagcgtgtcccattgcgtgcccgacgtctcgaccatcaccgaggaaggcctgttttcccagaaatcttttctcgtactgggattttctaacgagaatgagtctaatatcgctaacataatcaaggaaaacgctggaaagatcatgagcctcctgtctagaactgtagcagactatgcagtcgtaccactgctcgggtgtgaagtggaggccaccgtaggagaagtcgttaccaacacgtggttagtcacatgtattgactatcagacactgtttgatcctaagtccaaccctctgttcacccccgtgcctgttatgacaggcatgacccccctcgaggactgcgtgatatcattcagccagtgtgcgggtgccgaaaaagaatcactcacattcctggctaatctcctgggcgcaagcgtgcaggaatatttcgtgagaaaatcgaacgcaaagaagggaatgttcgcaagcacgcatctaatacttaaggagaggggcggttctaagtatgaggccgcaaaaaaatggaaccttccagctgtgaccatcgcctggctgctcgagaccgctcgcacaggaaagcgggcagacgagagtcacttcctgattgaaaatagcacaaaagaagaaagatctttggagacagaaatcacaaacggtatcaacctcaattccgatactgccgagcaccctggcacacgtctgcagacccataggaagacagtggtgacccctctggacatgaacaggtttcaatcaaaggctttcagagctgtggtgtctcagcacgccagacaggtcgcagcaagccccgctgtgggacagccactccagaaggaaccttccttacacctcgataccccaagcaagtttctctctaaggataaacttttcaagccaagtttcgatgtcaaggacgccctggctgccctggagactcccggaagacctagccaacaaaaacggaaaccttccaccccgctgtccgaggttatagttaaaaatctccaactagccctcgccaattcttccaggaatgctgtggctctctccgccagcccccaactcaaagaggcgcagtcagagaaagaagaagcgcctaagccactgcataaggtagtggtttgcgtctcaaagaaactctcaaagaaacagagcgaattgaacgggatcgctgcctccctgggtgctgactaccggtggtccttcgatgaaaccgtcacccatttcatctaccagggacgacccaatgacaccaatcgcgagtataaaagcgtgaaagagagaggggtccacatcgtgagtgagcactggctgctcgattgtgcgcaagagtgcaagcacttgccggagagtctgtaccctcatacatataacccaaaaatgtcattagatatcagcgccgtgcaggacggcagactgtgtaattccagactgctgagtgccgttagttctacgaaggacgacgaaccagatcccttaattctcgaggagaacgatgtcgataacatggccacaaacaacaaagaaagcgccccatctaatgggtctggcaaaaacgattccaaaggtgtgctgacacaaactctcgaaatgcgcgaaaactttcagaaacaactgcaagaaatcatgagtgcaacgagcattgtgaagccccaaggccagcggaccagcctgtccaggagcggctgtaatagcgcgtccagtaccccggattctacaagatccgcgaggtccggcaggtcacgtgtgctggaggctcttagacaatctaggcaaacagtccctgatgttaacacggagccttctcagaatgagcagattatatgggacgatcctacagcacgtgaggaacgggctcggctagcctctaatctccaatggccctcttgtcctactcagtactccgagctacaggtggatatccagaatctcgaagactcccccttccaaaagccattgcatgacagtgagattgcaaaacaggctgtgtgcgaccccggaaacatccgggtcaccgaggctcccaagcaccccattagtgaggaacttgagacacccatcaaggatagtcaccttattccgaccccacaggctccatccatcgcgtttcctctggccaacccaccagtggcgccacatccacgggaaaaaataattacaatagaagaaactcacgaagaactcaaaaaacagtacatatttcagttaagcagcctgaaccctcaagaacggattgactactgccatttgatcgaaaagcttggcggtctagttattgaaaagcaatgctttgaccctacctgtacacacattgtcgttggtcaccctctgcgcaacgaaaaatacctggcttccgtggcagcaggcaaatgggtcttgcatcgtagctacttagaggcgtgccgaacagccggtcatttcgtgcaggaggaggactatgagtgggggagtagttctatcctcgacgtcctcaccggtataaacgtccagcagcgcagactagcactggccgcaatgcgctggaggaaaaagattcagcagaggcaagagagcgggatcgtggaaggtgccttctccgggtggaaagtgattctgcacgtcgatcaatctagagaggctggttttaagcgcttgcttcaatccggcggtgccaaggtcctgcccggacattcagttccactgtttaaagaggcaacgcaccttttctccgatctcaataagttgaagcccgatgactctggcgtgaacatcgcagaagccgcagcccagaatgtgtattgcttaagaacagaatacatagcagactacctcatgcaggagagtccaccacacgtggagaattactgtttaccagaagctatctcatttatacaaaacaataaggaactggggaccggactctcccaaaagcgtaaggcacccactgagaaaaacaagattaagcgaccacgagttcattag

SEQ ID NO: 244236 - DNA, 3138 bp, Artificial Sequence
  Description of Artificial Sequence: Synthetic coding sequence
atgggatcccagccgccacttggcagccccctatctcgcgaggagggggaagccccacctcctgcaccagcttccgaagggagaagacgatcccgccgagttcggcttcgtgggagttgccgtcatagaccaagtttcctggggtgtcgggagcttgcggcaagcgcaccggctcgacctgctccagcttcatcagagataatggccagtgccgcaaaggaattcaaaatggacaatttctcacccaaggccggaactagcaaactacagcagactgtgcctgcagacgcttcccctgattcaaagtgcccaatttgtctggaccgattcgataacgtgagctaccttgaccggtgcctccacaaattctgttttcgctgcgtgcaggagtggtctaaaaacaaagcagagtgtccactgtgtaaacagccctttgactccatcttccactctgtgcgagcagaggacgacttcaaagagtacgttcttcggccatcttataacggctcctttgtgacgccagatcgcagattccgctaccgcacaacccttacccgcgaaagaaacgccagcgtgtacagtccctccggaccagtaaacaggcgcacaacaaccccgcctgatagcggcgtcctgtttgaggggcttggtattagtacccggccaagagacgtggagatcccccagttcatgcgacaaattgcagttcgccgtcccaccaccgctgatgaaaggtctctccggaaaattcaggagcaggatatcatcaatttccggagaactctgtaccgggcaggagcaagagtccggaatatcgaagatggtggccgataccgagatatctcagctgaattctttcgcagaaaccccgcatgtcttcacaggcttgtgccttggttgaagcgagaactgaccgtccttttcggcgctcacggttcactagtcaacatcgtgcaacatatcatcatgtctaacgtgactcgatatgatcttgagtcacaggctttcgtttcagacttgcgaccttttcttctcaatagaaccgaacatttcatacatgaattcatctcttttgcacggtctccattcaatatggccgcattcgatcagcatgccaattatgattgccccgctcctagctacgaagagggatcgcactctgactcatctgtaattactatttcccctgatgaagccgagacccaagaacttgacattaacgttgccactgtcagccaagccccttgggacgatgagacccctggaccaagctactcctccagtgagcaagtgcatgttaccatgtcttcactccttaacaccagcgatagttccgacgaagagctggtcactggcggtgccaccagtcaaattcagggcgtgcagacgaatgatgatctgaataatgattctgatgattcttccgataattgcgttatcgtggggtttgtcaaaccactggctgaacgcaccccggagctcgtcgaattgagttctgattcggaagatctgggttcatatgagaagatggagaccgtgaaaacccaggagcaggaacagagctacagttccggtgactcggacgtgagtagatgcagttcaccccactcagtgctgggaaaagacgagcagatcaacaagggtcactgcgactcatccacgaggatcaagagtaagaaagaagaaaagcgttcaacatctctcagtagcccacgcaatctgaatagtagtgtcaggggggaccgcgtgtactctccatataatcaccggcatcgcaaacgcggtagaagtaggagcagcgacagtcgctcccagagtaggagtggccacgatcagaagaatcaccgaaaacaccatggcaaaaaaagaatgaagtcaaagaggtcccgcagcagggaaagctcccggcctcgcggtaggcgagataagaagcggagccgtacccgggactcttcttggagtcgccgatcacagacactgtctttgagctctgagagcacatcgcgctcacggtcccgatcaagcgatcacgggaagcgacgaagtcgaagcaggaaccgggacagatattacctcagaaacaactacggctcacggtacaagtgggagtatacatactatagtcgcaacaaggaccgagatgggtacgaatctagctataggcgtcgtaccctgtcccgcgctcactactctcgacaatcgtcaagtcccgaattccgggtgcaatcttttagtgagaggacaaacgcgcgaaagaagaacaatcatagtgaacgcaagtattactattacgagcggcacagatcaagaagcctgagctctaaccggtctagaaccgcctctactggtaccgatcgtgtgcgcaatgagaaacctggaggcaagcgcaaatacaagacccgtcaccttgaggggactaatgaagtggcccagccctcaagggaattcgcttccaaggcaaaggactcacactaccaaaaaagctcttcaaaattggatggcaattataagaacgaatccgacacattctccgatagcagaagcagcgatcgcgaaacgaagcacaaacgacgtaagcgcaaaacgcggtcactgagcgtagagattgtgtacgaggggaaggcaacagacactaccaagcaccacaagaaaaagaagaagaagcacaagaaaaaacataagaagcaccatggcgacaacgcgagcagaagccctgtggtgattactatcgactctgacagtgacaaagatagcgaggtcaaggaagataccgagtgtgataattcagggcctcaggatccactccaaaacgagttccttgccccttctttggagccctttgaaacaaaggatgtggtgaccatcgaggctgagttcggcgttcttgacaaagaatgcgacatagctaccttgagcaacaatctgaataacgcaaataaaaccgtggataacattcctccattggctgccagcgtggagcagacattggacgtgcgagaagagtccaccttcgtaagcgacttagagaatcagccctcaaacatcgtctccttgcaaactgagccgagccgacaactgccaagccctaggactagccttatgagcgtctgcctcggcagagactgtgacatgagttag

SEQ ID NO: 244237 - DNA, 2943 bp, Artificial Sequence
  Description of Artificial Sequence: Synthetic coding sequence
atgataatggcctccgccgcaaaggaattcaaaatggacaatttcagccccaaggcaggaacatccaagttacagcaaaccgtgccagcggacgcatcacctgacagtaagtgccccatatgtctggatcgtttcgacaatgtctcttacttggaccgctgtctccataaattctgtttccgatgcgtgcaagaatggagcaagaacaaagccgaatgtccactctgtaagcagcctttcgactctatattccactcagtgagagccgaggatgactttaaagagtacgtcctgagacccagttacaacggatcctttgtcacacccgacagaaggttcagataccgcacgactctcacaagggaaaggaacgcctctgtatacagtccctcaggacctgtgaataggcggaccacaaccccccctgattctggggttctgttcgagggactggggatctccacaagacccagggatgttgaaatcccacagttcatgagacagatagccgtgcgacgtcccaccactgctgacgagcggagtctgagaaaaatccaggaacaggatatcatcaactttaggagaaccctctatcgagctggcgcaagagtcaggaacatcgaggatggtggacgctatcgagacatttccgccgagttcttccgcaggaacccggcatgtctgcaccggctggtgccttggttaaaacgcgagctgactgtgctgttcggcgcacacggatcactcgtgaatatcgtccagcatataattatgtctaatgtgactagatatgacctagagagccaggccttcgtgagtgatcttcggccttttctgttaaaccgaactgagcactttatccacgagttcataagctttgccagatcccccttcaatatggctgcctttgaccagcacgcgaattacgattgcccggcaccttcttacgaggaaggttcgcacagtgatagcagcgttattacaatttcccccgacgaggccgaaactcaggagctggatattaatgttgccacagtgtcacaggctccttgggatgatgagacccccggaccaagctacagctctagcgagcaggttcatgttactatgagttctttgttaaatacgtccgactcatctgatgaggagctcgtcacaggaggggctacatctcaaatccagggagtgcagactaatgatgacctgaataatgacagcgatgattctagtgataactgtgtgattgtgggtttcgtgaagcccttggctgagaggactccagaactcgtggagttgagttctgattccgaggacttaggctcatacgagaaaatggaaacagttaagactcaggaacaagaacagagttacagctcaggtgacagcgacgtgtcacggtgcagctcccctcactccgtgctgggaaaggatgaacagattaataagggccattgcgattcaagtacacgaattaagtcgaaaaaggaggaaaaaaggtccacctccctcagctcgccgagaaatctgaatagctccgttcgcggtgaccgggtgtattcaccctacaatcaccgccatagaaagcgtggacgcagtaggtcctccgacagtcgaagtcagtcccggtcggggcacgaccagaagaatcaccgcaaacatcatggcaaaaagcggatgaagtccaagagatctagaagtcgcgaatcttcccgcccacggggtaggcgggataaaaagagatcccggacacgcgactccagctggagtcggcgatcccagacactgtcactgtcctccgaatcgacaagcagatccagatccagatccagtgaccacggcaagaggagaagtagatcgagaaatagagatagatattatctccgcaacaactatggcagtcgctacaaatgggagtatacctattactccaggaataaagatcgcgatggatatgaaagctcatatcgacgccgaactctttcacgggcacactactcaaggcagtcctccagccctgaatttcgggtgcaatcattcagcgaaagaaccaacgcacgcaaaaagaacaatcattcggagcggaaatattactactatgaaagacatcgatctaggtcgctttctagcaaccgaagtcgcaccgcctccacgggaactgatagagtgcgaaatgaaaagcctggtggaaaaaggaagtataagacccggcatctagaaggtacaaacgaagtcgcccaaccatcaagggagttcgcatcaaaagcgaaggattcccactatcagaaaagttcttccaaacttgacggcaactacaaaaacgaaagcgacacctttagtgactctcgttccagtgaccgggaaacaaagcataaacgacggaaaaggaagacccggtccctgagcgtggaaatcgtctatgaaggcaaagccaccgatacaaccaagcatcacaaaaaaaaaaagaagaagcataaaaaaaagcataaaaaacaccatggtgacaacgcttcacggtctcccgtcgtgatcactatcgactctgacagtgacaaggattccgaggttaaagaagatactgaatgtgataactcaggtccccaggatccattgcaaaatgaatttttagcaccttcactcgaaccttttgaaactaaagatgttgttaccatcgaagccgaattcggagtgctcgacaaagaatgtgacatcgcaaccctaagcaacaacctaaataacgcaaataagacagtggacaacattcctcccttagctgcctcagtcgaacagacgttggacgtgcgagaagagtctacattcgtgtcggacctggagaaccagccttcaaacatcgttagcttgcagaccgagccgtctagacaattgccttctcctaggacctccctgatgtcagtgtgcctgggacgtgactgcgacatgagttag

SEQ ID NO: 244238 - DNA, 999 bp, Artificial Sequence
  Description of Artificial Sequence: Synthetic coding sequence
atgaaactggggagggcagtgcttggccttctcctgctggctccttcagtcgtccaagctgttgagcccatttccttgggactcgcccttgcgggagtgctgaccgggtacatttatcccagactgtattgcttgtttgccgaatgttgcggacaaaagaggtccctcagcagagaagcactccaaaaggacctggatgataacctcttcgggcagcacttggcgaaaaagataatcttgaacgctgtattcggctttatcaacaatccaaaacccaagaagccccttacactttcgctgcatggctggacgggaacgggaaagaacttcgtgagtaagattatcgcagaaaatatttatgagggtgggctcaattccgattacgtgcatctgttcgtagccacgttgcactttccgcatgccagcaacatcaccctttataaagatcagttacaactctggatccgaggaaatgtgagtgcttgcgccagatcaatctttatcttcgatgaaatggataaaatgcatgccggtctgatagacgctataaagccattcttagactactatgacctagtggacggcgtcagctatcagaaggctatgttcattttcctgtcgaacgcaggggcagagaggatcacagatgtcgccctggacttttggcgcagcgggaagcagagagaggacattaagcttaaggatattgaacatgcccttagcgtgtccgttttcaataacaagaacagcggtttttggcattcttcactcatcgatcgcaatttgatcgactacttcgtgccgtttcttccactggagtataagcatctcaagatgtgtattcgggtggaaatgcagtctaggggttacgaaatagatgaggacatcgtctcacgcgtggccgaggagatgaccttctttcctaaggaggagcgggtatttagcgataagggttgcaagacagtctttaccaagctggactactactatgacgattag

SEQ ID NO: 244239 - DNA, 906 bp, Artificial Sequence
  Description of Artificial Sequence: Synthetic coding sequence
atgaagctgggtcgggcagttctgggtctgctactgctggcgcctagtgttgtccaggcggtagagcctatcagtctcgggctggccctcgctggtgtgctgacgggttacatttatcctaggttgtattgcctctttgcagagtgttgcgggcagaagagatccctatctagggaggctctgcagaaagaccttgatgacaatctgttcgggcaacatttggccaaaaagatcatcctaaacgccgttttcggctttatcaataacccgaaacccaagaagccacttacactcagtctgttcgtggcaacactgcactttccccatgcctcaaacatcacattatataaagaccagctccagctctggataaggggaaacgtgtctgcctgcgcgagaagcatcttcattttcgacgagatggacaagatgcacgccggactgatcgatgctatcaagccttttctcgattactacgacctcgtagatggagtgtcataccaaaaggcaatgtttatctttctgtctaacgcaggcgctgaacgtatcacggatgtggccctggatttctggcgaagtggaaaacagagagaggacattaaattgaaggacatcgaacacgccctgtccgtatccgtatttaataataagaattctggcttttggcatagttcactgattgacagaaatctgatcgactatttcgtgccctttcttcccctggagtacaagcacctgaaaatgtgtatccgcgttgagatgcagagccggggttacgagattgacgaagatatcgtaagccgggtggccgaggagatgactttctttcctaaggaagaacgtgtcttttctgataagggctgcaagaccgtgtttacgaagctggactactactacgatgactag

SEQ ID NO: 244240 - DNA, 1011 bp, Artificial Sequence
  Description of Artificial Sequence: Synthetic coding sequence
atgttacgagccggatggctgagaggggcagcagctctggccctactgttagccgctagagtcgtggccgcattcgaacctattaccgtaggcctcgcaattggagcggcttcagctatcaccggttacctgagctataacgatatctactgccggtttgctgagtgctgcagagaggagaggccactgaacgcttctgctctgaaactcgatctggaagagaaactctttggccagcatttggctactgaagtaatcttcaaggctttgacaggcttcaggaacaacaaaaatcctaaaaaaccgcttaccctctctttacatgggtgggccggtacaggcaaaaatttcgtgagccagatcgttgccgagaacttgcacccaaaagggctcaaatcgaacttcgtgcacctgttcgtgagcacgctccatttccctcacgaacagaagatcaagctttatcaggaccagcttcagaaatggatccgcggaaacgttagcgcttgtgcaaatagtgtgtttatctttgacgagatggataagctgcaccccggaattatcgatgccatcaagcccttcttggactattacgaacaagttgacggtgtttcctacagaaaagcgatctttatcttcctctcaaatgcgggtggggacttgatcacgaagacggcccttgatttctggcgggctggcaggaaacgtgaggacattcagctcaaagacctcgaacctgtcctgtcagttggcgtgtttaacaataagcattcaggcctgtggcattcagggctgatcgataagaatctgattgactattttatcccgttcctgccactggagtatcggcacgtcaaaatgtgtgtcagggcagaaatgcgcgcacggggatccgccatcgatgaggacatcgtgacccgcgtagcagaagagatgacattctttcctagagacgagaagatatattcagacaagggctgcaagactgtccaatctagactagacttccactag

SEQ ID NO: 244241 - DNA, 426 bp, Artificial Sequence
  Description of Artificial Sequence: Synthetic coding sequence
tagcgcgtcgtagcagccttcgaacctatcaccgtgggtctggcgatcggggcagcatccgcaattacaggctacctgtcatataatgacatctactgcagattcgcggagtgctgcagagaagagcgcccactcaacgcatccgctttgaagcttgacctggaagagaagctctttggacaacatttggccactgaagtgatatttaaggcactcacagggttcagaaacaacaaaaaccctaagaagcccctgaccctttcattgcacggatgggccggtactgggaagaacttcgtatcacagatcgtcgcggaaaatctgcacccaaagggacttaagagcaactttgtgcacctattcgtttctaccctgcatttcccccatgaacagaagatcaaactgtaccaaagcagtttgacctag

SEQ ID NO: 244242 - DNA, 918 bp, Artificial Sequence
  Description of Artificial Sequence: Synthetic coding sequence
atgctgcgagccggatggttgcggggagccgctgccttggccctgctgctagctgctcgcgttgtggccgcatttgaacctatcaccgtgggactggccatcggcgctgcatcggcaatcaccggctacttatcatacaacgatatctattgccgattcgccgaatgttgtagggaagaaagaccacttaacgctagtgccttgaagcttgatctggaggagaaactcttcggccagcacctggctacagaagtgatcttcaaagccctaacagggttccggaataataaaaacccaaagaagcccctaacgctgtcacttttcgtatctacactgcatttcccgcacgagcagaaaattaaactgtaccaggaccagctgcaaaaatggattcggggaaacgtatccgcgtgcgctaatagtgtgtttattttcgatgagatggacaaattgcaccctggcatcattgacgcgattaaaccatttctcgactactacgagcaggtggacggggtctcctataggaaagctatctttatatttttaagtaacgcagggggtgatttgatcaccaaaactgccctggacttctggagggcgggacggaagagagaagacatccaactgaaagacttagaaccggtgttatcagtcggcgtgttcaataataagcatagcggcctctggcactccgggctgatagataagaacttgattgactacttcattccttttctcccactggagtaccgccacgtgaaaatgtgtgtgagggccgaaatgcgagccaggggaagcgccatcgacgaggacattgtgacacgcgtcgccgaggaaatgacctttttcccccgtgacgaaaaaatttattccgataagggttgtaagaccgtccaatcccgcctggatttccattag

SEQ ID NO: 244243 - DNA, 1011 bp, Artificial Sequence
  Description of Artificial Sequence: Synthetic coding sequence
atgcttcgaggtccctggcgacagctgtggctcttcttcttgctcctgcttcccggagctcccgaacctcggggtgcgtcgcgaccctgggagggaactgatgagcccggttccgcttgggcgtggccaggatttcaaagacttcaggagcagctccgtgccgcaggcgctctcagcaagcgatattggacattgttttcttgccaagtgtggcccgacgattgtgacgaggacgaagaggccgctactggtcccttgggctggagactgccattgcttggacaaagataccttgatctgctgaccacgtggtattgttcctttaaagattgttgtccacgtggcgattgtagaatttccaacaatttcaccggcttagaatgggacctgaacgtgcggttgcatggccagcaccttgtgcaacagcttgtgctaaggaccgtgagaggttacttagagactccacagccagaaaaagccctggccctatccttccatgggtggagcggcacaggaaaaaattttgtggccaggatgttggtcgaaaacctatacagagacggactgatgagcgattgcgtccggatgttcatagctaccttccattttcctcatccaaaatatgtcgacttgtacaaagaacaattaatgtcccaaattcgtgaaacccagcagctgtgtcatcaaaccctgttcattttcgacgaggcggaaaaattgcatccaggtctgttggaagtgctgggaccccacctcgaaagaagggctccagagggacatcgggcagagagtccgtggactatcttcctctttctgagcaacctgcgaggcgatattattaacgaagttgtactgaagctcctcaaagcaggttggtcgagagaggagatcacgatggagcatcttgagcctcacttacaagccgagatcgttgagacaatcggattcagttttctcactactcgatggccacatttggatctccccactagttcagtggccccaacctag

SEQ ID NO: 244244 - DNA, 462 bp, Artificial Sequence
  Description of Artificial Sequence: Synthetic coding sequence
atgcttcggggtccctggagacagctgtggctgttctttctgctgctgctacctggagcacccgagcctaggggtgcgagccgcccatgggaggggactgatgagcccggaagcgcatgggcctggcccggatttcagaggctgcaggaacaattacgagctgccggagccttgagcaagaggtactggaccctctttagttgccaggtttggccagacgactgcgatgaagacgaggaggctgccaccgggcctctcggatggaggctgcccctgcttggccaaagatatctcgacctgctgacaacctggtactgttctttcaaagactgctgtccccgtggggattgtcggattagtaacaatttcaccggtaaaaattttgttgccaggatgctcgtggagaatctatatcgcgatggcttaatgtcagattgtgtgcgtatgttcattgcgacgtag

SEQ ID NO: 244245 - DNA, 1194 bp, Artificial Sequence
  Description of Artificial Sequence: Synthetic coding sequence
atgctgcggggtccatggcgccaactctggctgtttttcttgttactgctgcctggcgctccagagcccagaggggcatctcgtccatgggaggggactgacgaacccggttcagcatgggcgtggccgggatttcagaggctgcaggaacaactccgcgcagcaggcgcactatccaagaggtattggactctgttcagttgtcaggtctggcctgatgattgcgacgaggacgaagaagcggctaccggcccactaggctggcggttgccattgctaggacagcggtaccttgatcttcttactacttggtactgctcttttaaagattgttgtcccaggggcgattgtaggataagcaataatttcacaggacttgagtgggacctgaacgttagactgcatggacagcacctcgtccaacagttggtcctgcggactgtgcgagggtacctcgaaacaccccagcccgaaaaggccctggcgctgtcctttcatggatggtcaggaaccgggaaaaattttgttgcccgaatgcttgtggagaatttatatagggacggactgatgagcgactgtgtgcggatgttcatcgcaaccttccactttccgcatcctaagtacgtggacctctataaagagcaattaatgagtcagattcgcgagacgcaacagctttgccaccaaaccctgtttatattcgatgaagctgagaagctgcaccctgggcttctggaggtgctggggcctcacctcgagcggcgagccccagagggacacagggccgagtccccttggaccatcttcctgttcctctcaaaccttcgcggtgatatcataaatgaagtggttctcaaacttctaaaagccggatggtccagggaggagatcacaatggagcacctggagccccacctccaggctgaaatagtagagacaatagataatggattcggacatagtaggcttgtgaaggaaaacctgattgactatttcataccttttctgcctctcgaatatcgacatgtgaggttatgcgctagggacgcgtttttgtctcaggaattactctataaggaagaaaccctcgacgagattgctcagatgatggtgtatgtcccgaaggaggagcagctgttctcatcccaaggatgcaaatcaattagtcagagaatcaattacttcctttcttag

SEQ ID NO: 244246 - DNA, 525 bp, Artificial Sequence
  Description of Artificial Sequence: Synthetic coding sequence
atgggtctctgcgtgccttttgctgtgactacctcattcctcagcttgggtctggagtgggacctgaatgttaggctgcacggtcagcatcttgtacagcagcttgtgctccggacggtgcgcggatacctggaaacgccacagcctgagaaggcacttgcactgtcattccatggatggtcagggacaggaaaaaattttgtcgccagaatgctggtagagaacttgtacagagatggcctgatgagcgactgtgttcggatgtttatcgccacctttcacttcccccatccaaaatacgtggatctgtacaaggagcagctaatgagccagattcgcgagacacagcagctatgtcatcagactttgttcatctttgacgaagccgagaagcttcatcccggtctgctggaggtactgggacctcacctggaacggcgagcgccagagggtcaccgggctgagagcccatggacgattttcctgtttctgtccaatctcaggggtgatattatcaacgaatag

SEQ ID NO: 244247 - DNA, 1866 bp, Artificial Sequence
  Description of Artificial Sequence: Synthetic coding sequence
atggaatttcccggtggcaatgacaactatctcacgatcactggcccatctcatcctttcctctccggcgcagaaactttccataccccctcccttggtgatgaggagtttgagatcccacccatatcccttgactcggatccctctttagcggtctccgacgttgttggccactttgatgacttggcggatccctcctcgagccaagatggatcgttttccgcgcaatatggcgtgcaaaccttagacatgcccgtgggaatgacccacggattgatggaacagggcggtgggctgttaagcgggggtttgaccatggatttagaccactccattggaacacaatatagcgcaaaccccccagtgacaatcgacgtgcccatgactgatatgaccagtgggcttatggggcacagccagctgacgaccattgatcaatccgaactgtcctctcaactgggtctgtctctggggggagggaccatcctgccgcctgctcaatctcctgaggacaggctctccaccactccaagtccgacctcttctctgcacgaggatggcgtggaagacttccggcgacaattaccaagtcaaaaaacggtcgttgtcgaggccggtaaaaaacaaaaagcccctaaaaagcgcaagaagaaagacccaaatgagccccagaagcccgtctcagcttacgccctgttttttcgtgatacgcaagcagcgataaaggggcagaaccctaacgcgacctttggtgaagtgtctaaaattgtggccagtatgtgggattctttaggtgaggaacagaagcaggtgtataaacggaaaactgaggcagccaagaaggagtatctaaaggcactggcggcatataaagataatcaggaatgccaggccaccgttgaaacggtagagctggacccagccccaccaagccaaacccccagcccccctcccatggctaccgtcgaccctgcctccccagcccctgctagcattgagccgcctgctcttagccccagcatcgtcgtgaacagcacgctctcctcttacgtcgccaaccaggcctcatcaggcgctgggggacagcctaacattactaaattaatcattacaaagcagatgttgccctcatctataaccatgtcacaggggggtatggtgacagtgattccagctacggttgttacctcacgaggcctacagctgggccaaacgtcgaccgcaaccattcagccctcccagcaagcccagatcgtgaccagatctgtactccaggccgctgcagccgctgctgctgcagcctccatgcagctgccacccccacggcttcagccgcctcctctgcagcagatgcctcagccacccacccaacagcaggtgaccattctccaacagccaccgccacttcaggccatgcagcagccccctccccagaaggtgaggataaatctgcaacagcagcctccccctcttcagatcaagtcagtccctctccccacgctcaaaatgcagacaaccctggtaccgcctaccgtcgagagcagcccagaacgcccaatgaacaattctcctgaagctcatacagtggaggccccttcacctgagaccatctgcgagatgatcactgacgtggtgccagaggtggaatccccatctcaaatggatgttgagctggtgagcggatccccagtggcactttctccgcaacctagatgcgtgcggagtggctgcgaaaatccgccaattgtgagcaaagattgggataacgagtactgctctaacgagtgtgtagtgaagcattgccgggacgtgttcctggcatgggtcgcatctcgaaatagcaacacagtagtttttgttaaatag

SEQ ID NO: 244248 - DNA, 1866 bp, Artificial Sequence
  Description of Artificial Sequence: Synthetic coding sequence
atggaatttcccggtggaaacgataattacctcacaataactgggccatcccatccctttctgagcggggctgagacctttcataccccttccctgggagatgaggagtttgaaattccccctatcagcttagacagtgaccccagtttggcagtaagcgacgttgttgggcatttcgatgatctcgcggatccatcttcgtctcaagatgggtccttttcagctcagtacggcgtgcaaacactggacatgcccgtgggaatgacccatggcctgatggagcaaggagggggactcctctctgggggactcacaatggatctcgaccattccattgggactcagtattccgctaatcccccagtgaccatagacgtgcccatgacagatatgactagcggattaatgggccacagtcagctgaccacgattgaccagtccgagctctcttcccagctggggctcagcctaggagggggtacgattttacccccagctcagtcaccagaagatcggcttagcacgaccccctctcccactagttcactgcacgaagatggcgtagaggatttcagacggcagctcccgtctcaaaaaactgtggtagtggaggccggaaaaaaacagaaggctccaaagaaaaggaagaaaaaggaccccaacgagccccaaaaacctgtatccgcttatgcactgttttttagagatacacaggctgccatcaaaggacagaacccaaacgcaacctttggggaggtgtccaagatcgttgctagcatgtgggatagtttgggggaggagcaaaagcaggtgtacaagaggaagactgaggccgctaagaaagagtatctgaaggcgctcgcagcttacaaagacaatcaggaatgccaagccacagtagaaaccgtagagctggacccggctccgcctagccagactccctcccctcctcctatggccaccgtggaccctgcttcccccgctcccgcttccattgagccccctgccctcagtccgagtatcgtcgtaaactccactctgtccagttatgttgccaatcaagcttcaagcggtgccggagggcaacctaacataaccaagttgattatcaccaaacagatgctgccttcctcaatcactatgtctcagggtgggatggtgactgtcattccagctacggtagttacgagtagagggctgcaacttggccaaacctccactgccaccatccagccctctcaacaagcccagattgtgacaaggtctgtgttgcaggccgcagccgcagcagcggctgcagcctccatgcagctccctccacctcgcctccagcctcccccactgcagcagatgccccaacccccaacacagcagcaggtcaccatcctgcagcaaccgcctccactgcaggccatgcaacagccacccccacaaaaggtcagaattaaccttcagcaacaaccccctccactgcagattaagagcgtgccgcttccaacacttaaaatgcagacaactctggtccctccaacagtggagtcgagccccgaaaggccaatgaacaatagccccgaagcacacactgtagaggctccaagtccggaaaccatctgcgagatgatcaccgatgtggtgccagaagtcgagtcaccatctcagatggacgtagagcttgtgtctgggagccctgtagccctgagccctcagcctaggtgtgtgaggtctggctgtgagaatccccctattgtaagtaaggactgggacaacgagtattgctcgaatgagtgcgtggtgaagcattgtagggacgtctttttagcgtgggtcgcctcccggaattcgaatacggttgtgtttgtcaaatag

SEQ ID NO: 244249 - DNA, 1797 bp, Artificial Sequence
  Description of Artificial Sequence: Synthetic coding sequence
atggaaaccttccacaccccctccctgggtgacgaggagttcgaaatcccgcctatttcccttgattctgatccgtcactggcagtgtccgatgtcgtgggacattttgacgatctggcggacccttcctcctcacaggatggcagtttcagcgcccagtacggggtgcaaacactggacatgcccgttggaatgacacatgggcttatggaacagggaggcggactgctgtcaggcggactcacaatggacctggatcactccatcggtacgcagtattctgccaatcccccagtaacaatcgatgtgcccatgactgacatgacatccggactcatgggccattctcagttgacaacaatcgaccagtcagagctgtcatcacagctgggcctttctcttggaggcggtacaattcttcctccagctcagtcaccagaagatcggctgagtaccacgcctagtccaacatcttcgctgcatgaagacggcgtcgaagactttcggaggcaactgcccagccagaaaactgtcgtggtagaggctggaaaaaagcagaaggcacccaagaaaaggaagaaaaaagatcctaatgaaccccagaaacctgtatctgcgtacgcacttttcttccgggatacccaagcagctattaaaggccaaaatcctaacgctacattcggtgaagtgagcaagattgtagcaagtatgtgggactcactgggggaggagcaaaagcaggtctataagaggaaaaccgaggcagccaagaaggagtatctaaaagcgctcgctgcatataaggacaaccaggagtgccaagccacagtcgagactgtagaactggaccctgctcctccttcccaaactccttcaccgccaccaatggctactgtcgaccctgctagtcctgccccagccagcatcgagccccctgcgctttctcctagcatagtggtaaatagtacgctgtcctcttacgtggccaaccaggcatcttcaggcgcaggcggtcagccaaacatcacaaagctaattataaccaagcagatgttgcctagcagcatcacgatgtcccaggggggaatggttactgttattcccgctacagtggtcaccagcaggggacttcagcttggtcagacttctaccgccaccattcagccttcccagcaagcgcagattgttactcggtctgttctccaagccgcagcagcggcagcggctgctgcctcaatgcagctccctcctccccgactccagcccccaccgttgcagcaaatgccacagcccccaacacaacagcaagtgaccatcctgcagcaacccccacccctccaagcaatgcaacagccccctccccagaaggtgcgcatcaacctgcagcagcagcctccgcctcttcaaatcaaaagcgtccccttgccaacactcaagatgcagacaacgctcgtcccacctacggtggagagttcacccgagcggcctatgaacaactccccggaggcccacaccgtcgaagcaccttctcccgagactatttgtgagatgatcaccgacgtggtgcccgaggtggagagcccgtcccagatggacgtggagctagtttccggttcgccagttgctctttcaccccagcctcggtgcgtgagaagcggatgcgaaaacccaccaatcgtgtcgaaggactgggacaacgagtactgctcaaatgagtgtgtggtcaagcattgtcgtgacgtcttcctcgcctgggtggccagtcggaactctaacaccgtcgtgtttgtgaaatag

SEQ ID NO: 244250 - DNA, 1650 bp, Artificial Sequence
  Description of Artificial Sequence: Synthetic coding sequence
atgaggaacttgaagtcacatctgtctccctggatcctaataccccactggctgagtcagatgtggctggcaactcttatgacctggcagttcttttcgccagacctagatcacagcattggcacacagtacagtgcaaatcctccggtgacaattgacgtgccaatgaccgacatgacatcagggcttatgggccattcccagctgaccacaattgatcagagtgagctctcctcccaactgggcctgagcctaggaggcggaactatcttaccccctgctcaaagcccagaagatcgactgtccacaactccttcacccacaagcagccttcatgaggacggtgtagaggattttagaagacagctgcctagtcagaagaccgtcgtggttgaggctggcaagaaacaaaaagcgccaaagaagcgcaaaaaaaaggatcccaatgagccccagaaaccagtctcagcttacgctctgttcttccgcgacacccaagccgctatcaagggccagaatcctaatgcaaccttcggtgaggtgtccaaaatcgtggcttccatgtgggactcgctcggggaggagcagaagcaggtctacaaacgtaagactgaagcagccaaaaaggagtacctaaaagccctcgcagcctataaagataaccaggaatgtcaggctacggtcgagacagttgaattggaccccgctccgccttctcaaacccctagccctcctccgatggccacggtagatccagcaagcccagcgccagcttccattgagccccctgccctatccccctccatcgtagttaacagcacattgtcttcatacgttgccaaccaggccagctctggcgctggtgggcagcctaacattaccaagttaattatcacgaagcagatgctgccttcttcaattacaatgagtcagggcggaatggttacagtcattccagcaaccgtagtgacctccaggggactgcaacttggtcaaacatccacggctacaatccagccatctcagcaggcacagatcgttactagatctgtgctgcaggccgctgctgccgcagctgctgctgccagcatgcagctgcctcctccgagacttcagcctccaccgctgcagcagatgccgcagcccccaacacagcagcaggtaaccatcctccagcagccccctcctcttcaggctatgcagcagcctccaccccaaaaggtgcggattaacctgcagcagcagcccccaccactacagatcaagtctgtgcccttgccaacattaaaaatgcaaacaactctggtgccaccaaccgttgaaagctcacctgaacggcctatgaataacagtcctgaggcacatacagtcgaggccccttcaccggaaaccatttgcgaaatgatcacagacgtggttcccgaggtcgagagcccgtcacagatggatgtagaattggtgtccggaagtccagtcgccctcagtccccagccacgctgcgtccgctcggggtgtgagaatcctccaattgtatccaaagattgggacaatgagtattgttccaacgagtgtgttgtcaagcactgccgcgacgtgtttctcgcctgggtggccagtcgtaattcgaacaccgtggtgttcgtcaaatag

SEQ ID NO: 244251 - DNA, 1020 bp, Artificial Sequence
  Description of Artificial Sequence: Synthetic coding sequence
atgatgccgttctgccacaatattataaatataagctgcgtaaagaacaactggtcaaacgacgtgagagcgtccctgtactccctaatggttttgatcatcctaaccacccttgtggggaacctgattgttattgtgagtatttctcactttaagcagcttcatactccaaccaactggctgattcactctatggctactgtggacttcctgctaggttgtctcgtaatgccctactctatggtgcgaagcgctgagcactgttggtactttggcgaagtgttttgtaagatacacacatcgactgatattatgctatctagcgcctccatattccacctgagcttcatttcaatcgatcggtattacgcagtttgtgacccactgaggtataaagccaaaatgaacattctcgtgatctgtgtgatgatctttataagctggtccgtgcctgcagtcttcgcatttgggatgattttcctggagttaaactttaaaggagcagaagaaatctattacaaacatgtccactgccgaggcggatgttcggtgttttttagcaaaattagcggggtgcttacctttatgacctctttttacatccctggatctatcatgttatgcgtttactaccgcatttatctgattgccaaggagcaggcgagactgatctctgacgctaatcagaagctgcagattgggctggagatgaagaatgggatctctcagtcaaaggaaagaaaagctgtgaaaacattgggcatagttatgggcgtgtttcttatctgttggtgtcccttctttatttgcactgtgatggaccccttcctccactacatcatccctcctacgctgaatgatgttctgatctggtttggatacctcaattcaacgtttaaccctatggtctacgccttcttttacccttggttccgaaaggccttgaagatgatgctcttcggcaaaatattccagaaggacagttcaaggtgtaagctttttctcgagttgagctcatag

SEQ ID NO: 244252 - DNA, 921 bp, Artificial Sequence
  Description of Artificial Sequence: Synthetic coding sequence
atgtattcctttatggcaggctcgattttcattacaatatttggcaatttagccatgattatatctattagctatttcaagcaactgcacacacctacaaattttttgattttatccatggcaattacggacttcctgctgggcttcactatcatgccgtactccatgatcaggagtgttgagaattgttggtatttcgggctgaccttctgcaagatctattactcatttgatttgatgctgtctatcactagcatcttccacctgtgcagcgtggccatcgaccggttttacgcgatctgctacccccttctgtattcgacaaagattaccatcccagtgatcaagagactgttattgctgtgctggtccgtgccaggggcattcgcgttcggagtggttttcagcgaagcatacgcggacggcatcgaggggtacgatattttagtggcttgctcttcttcatgtccggttatgtttaacaaactgtggggaacgaccttgtttatggcaggtttctttacacctgggtccatgatggtgggtatatacgggaaaatttttgcagtcagtcgaaaacacgcccacgccataaacaatctccgagaaaaccagaataaccaggtgaaaaaggataagaaggccgctaaaacactgggcatcgttataggggtgtttctgctctgttggttcccctgcttcttcacaatattgttagaccctttcttaaacttctctacacctgtggttctctttgacgcactgacatggtttggttattttaactcgacatgtaatccgttgatttatggtttcttttatccatggtttcgcagagcacttaaatacattctgctgggcaagatcttcagcagctgttttcataacaccattctctgtatgcaaaaagaaagcgaatag

SEQ ID NO: 244253 - DNA, 1056 bp, Artificial Sequence
  Description of Artificial Sequence: Synthetic coding sequence
atggccgtttcctcagaacagcatgaactgtcccacttcaagaggacacaaacaaagaaggagaagtttaactgcagcgagtatggcaaccgcagctgtcccgaaaatgaaagatccctgggcgtgagagtggcaatgtattcctttatggccggtagcatattcatcactattttcgggaatctagctatgatcatctctatcagttactttaaacagcttcacactccaacaaacttcctcatactgagcatggccatcacggacttccttctgggctttactattatgccatattctatgatcaggagcgtggagaattgctggtattttggtttgactttctgtaagatatattactcttttgacctgatgctctctattacatctatctttcatctctgtagtgtggcaattgatcggttttacgctatctgctaccctttgctgtattccacaaagatcactattcccgtgatcaagcggctgcttctgctgtgttggtctgttccaggtgcttttgcattcggcgtggtatttagtgaagcttatgcagatggaattgaagggtatgatatcctggtggcctgttcctcctcctgtcccgtgatgtttaacaaattgtggggtactacactttttatggccggatttttcaccccaggctctatgatggtcgggatttacggcaaaatttttgccgtgagccggaaacatgcacatgctattaacaacctgagggagaaccagaacaatcaagtgaaaaaagataagaaagccgcaaaaacgttagggatcgtgattggtgtgttcctgctatgctggttcccctgcttcttcaccattctcctcgacccttttttgaacttttcaacgccagtggtgctgttcgacgcactgacctggttcggatattttaactcgacttgtaaccctcttatttacgggttcttctacccctggttcagacgggctctgaagtacattctgctgggaaagattttttcttcgtgctttcataatacgatactctgcatgcagaaagagtctgagtag

SEQ ID NO: 244254 - DNA, 921 bp, Artificial Sequence
  Description of Artificial Sequence: Synthetic coding sequence
atgtatagcttcatggcaggttccattttcatcaccatctttgggaacctcgccatgattataagcattagttattttaagcaattgcacacacctacaaattttctgatcctaagcatggctattactgacttcctgctgggtttcacgatcatgccttacagtatgatcagaagtgtggaaaattgctggtacttcgggctgaccttctgcaagatttattactcgttcgacctcatgctgtctattacttcaatatttcacctctgctccgtggctattgatcgcttttatgcgatttgctaccccctactgtactccacaaagataactatccctgtgatcaagagactgttgctgctttgctggtcagtaccgggagcattcgctttcggtgtcgtcttctcagaggcctatgcagacggtatcgagggttatgacatcctggtggcctgctcaagttcctgtcctgtgatgttcaataagctgtgggggaccaccctcttcatggccggattttttaccccaggatccatgatggtaggaatctatgggaagattttcgccgtgtctcggaaacatgcacacgcaatcaacaaccttagagagaaccagaacaatcaagtgaagaaggataaaaaggccgctaaaacgctggggatcgtcataggcgtgttccttctatgttggttcccatgtttcttcacgattcttctggaccctttcttgaatttttccacgccagtggtgctgtttgacgccttaacatggttcggatatttcaatagcacctgcaatcccctcatttacggattcttttacccttggtttcggcgagctcttaaatatattctgctggggaagatcttctcctcatgcttccataatacaatcctgtgcatgcagaaggagtctgagtag

SEQ ID NO: 244255 - DNA, 1038 bp, Artificial Sequence
  Description of Artificial Sequence: Synthetic coding sequence
atgagcagcaactcctccctgcttgtagccgtgcaactatgttatgccaatgtgaacgggtcgtgcgtgaaaatcccgttctcccctggtagtagagtgatcttatacatcgtcttcggcttcggcgcagtcctggcagtctttggcaacctgttggtcatgatttccatcctgcatttcaaacaactgcacagcccaacaaactttttagtggcgtcactggcctgtgccgactttctggtgggtgtcactgtaatgcctttctcaatggtgcgtactgtggagtcctgttggtattttgggcgttccttctgtacctttcatacgtgttgtgatgtggccttttgttacagtagtctgtttcacctctgcttcatctcaatagatcggtatattgccgtaactgatcccctggtgtatcccactaagtttactgtaagtgtctcggggatctgtatctcagtgtcgtggatcctgcctctaatgtactcaggcgctgtgttctacacaggagtgtacgatgatggacttgaagaactgtctgatgcactcaattgtattggaggctgccagactgtcgtcaaccagaactgggtgctcacggatttcctatcatttttcatcccgacctttattatgattatcctgtatggcaatatctttctggtcgctcgcagacaggcaaagaaaattgaaaacacgggtagcaaaactgagagcagcagcgagagctacaaggcccgagtggctcgtcgcgagaggaaggcagcaaaaaccctgggggtgacggtagtggcttttatgatatcttggctgccttattccatcgacagtctgatcgatgctttcatgggcttcattacccctgcatgcatctacgaaatttgctgttggtgcgcctactacaattcagcaatgaatcctctcatctacgctctgttttatccttggtttaggaaggcaatcaaggtgatcgttactggtcaggttctaaaaaacagttctgctacaatgaacctgttttccgagcacatctag

SEQ ID NO: 244256 - DNA, 957 bp, Artificial Sequence
  Description of Artificial Sequence: Synthetic coding sequence
gttaacggcagctgcgtgaagatcccattctccccaggtagccgtgtgatcctctacattgtatttgggtttggtgcggttctcgcagtctttggtaatctcctggtaatgatcagtatcctccactttaaacagttgcactcaccaacaaatttcctggtcgcatccctggcttgcgccgacttcctcgttggtgtgaccgttatgcccttttccatggtgcggaccgtggaatcctgctggtactttggacggtcattctgcacgttccatacttgctgtgacgtggcattctgctattccagcctctttcatctttgctttatctcaatcgacaggtacatcgccgtgaccgatccacttgtttatccgaccaaattcacggtgagcgtcagtgggatttgtatctccgtttcgtggattttacccctgatgtactcaggtgcggtgttctacaccggcgtctatgacgatgggctggaggaactgtctgatgccctcaattgcatcggcggatgtcaaaccgtggttaatcaaaactgggtgttgaccgattttctcagtttttttattcctacgttcattatgattattttatatggtaacatttttctggtggctcgacggcaggccaagaaaattgagaataccgaatcctataaggccagggtggcacgacgtgagaggaaggccgctaaaaccttgggcgtcactgtggtggccttcatgatctcctggttaccttattctatcgactctctgattgacgcatttatgggcttcattacccccgcatgcatctacgaaatatgttgctggtgtgcctactacaattctgctatgaatccactgatatacgcccttttttacccgtggttcaggaaggccataaaggtgattgtcacaggccaagtgcttaaaaacagttccgcgacaatgaacttgttttcagaatag

SEQ ID NO: 244257 - DNA, 1410 bp, Artificial Sequence
  Description of Artificial Sequence: Synthetic coding sequence
atgcccattcgggctctctgtactatctgttccgatttctttgaccactctcgcgacgttgctgccatacactgtggacataccttccacctccaatgcctgattcagtggttcgaaactgctccaagtcgaacatgcccccagtgtaggattcaagtcggaaaacgcaccatcattaataaactgttttttgatttagctcaagaagaggagaatgtcctcgacgccgagttcctgaagaatgaacttgataacgttcgggcacaattaagccaaaaagacaaggagaagagagactcacaagttattatcgacaccctacgcgacacgctagaggaacggaatgccaccgtggtgagcctgcagcaagcactgggcaaagctgagatgctgtgcagcaccctgaaaaagcaaatgaagtacctggaacagcagcaggacgaaactaagcaggcgcaagaggaggctagaagactcaggtccaagatgaagactatggaacagatcgaacttctcctgcagtctcaaagaccggaggtggaggagatgattagggacatgggagtcgggcagagtgcagtggaacagctggcagtgtactgcgtgtctctcaagaaggagtacgaaaatcttaaggaggccaggaaggcttccggtgaagttgcggacaagttacgtaaagacctgttctcctcccgcagtaaactgcagacagtctattccgaactcgatcaggctaaactggaattaaagtcagcacagaaagaccttcagtctgccgacaaggagatcatgtccctgaagaaaaagcttacaatgctgcaggaaactctaaacctgccaccagtggccagcgagacggttgaccgcctggtcttggagagccccgcaccagtggaggtgaacctcaagcttcgcaggccgtcctttcgcgatgatatcgatctgaacgcaaccttcgatgtggacaccccgccagccaggcctagttcttcccagcacggctattatgaaaaattatgcctcgagaagagccactctcctatacaggacgtgcctaagaagatttgcaaaggaccacgtaaagagtcccagctgtccttgggtgggcaatcatgcgcaggtgagccagatgaggaactcgtcggcgcttttccaatctttgtcagaaacgccattctggggcagaagcagcctaagaggcccaggtctgaatctagttgttccaaggacgtggttagaacggggttcgacggactgggaggtcgaaccaagttcattcaacctacagatactgtgatgattcggcctttgccagtgaagccaaagaccaaggtgaagcagcgggttcgtgtcaagacagtcccctctttgtttcaggccaagctggataccttcctgtggtcatag

SEQ ID NO: 244258 - DNA, 4059 bp, Artificial Sequence
  Description of Artificial Sequence: Synthetic coding sequence
atggccagcgactccccagctaggtccctcgacgagattgacctgtcagccctgcgggatccagcaggtatcttcgaattagtcgaactggtgggcaacggcacttatggccaggtgtataaaggccgacacgtcaagactggacaacttgccgctattaaggtgatggatgtgaccggggatgaggaagaagagatcaaacaggagatcaatatgctaaagaagtatagtcaccaccgcaatattgccacctattatggtgcattcattaagaaaaaccccccaggaatggatgaccaactgtggctggtgatggaattctgcggtgcaggatcagtgactgacctgatcaagaataccaaaggaaataccctgaaggaggagtggatcgcctatatatgcagagagatcctgcgcggactatcccatctgcaccagcataaagtgatacacagggatatcaagggccaaaacgtactgctgaccgaaaacgccgaggtcaaactcgttgacttcggagtgtctgcccaacttgataggaccgtcggacggcgtaatacatttatcggtacaccgtattggatggcaccggaggtcatagcctgtgacgagaaccctgacgccacctacgacttcaagtctgatctctggagtctgggcatcactgccatcgagatggcagaaggcgctccaccactatgcgacatgcatcccatgcgcgctctgttcctcattcctagaaacccggcacccagactgaagtcgaaaaagtggtcaaagaaattccagtccttcattgagagctgtctcgtgaaaaaccattcgcaacgccctgcaactgaacagttgatgaagcatccattcatcagggaccaaccaaacgaaaggcaggtgcggatccagcttaaggaccatatcgatcgaacaaagaagaagaggggcgaaaaggacgagactgaatatgagtacagcggaagcgaagaggaggaagaggagaatgatagcggtgagccatccagtatcctcaatttgccaggcgagagcacgttgcggagagatttccttcgcttgcaattggctaacaaggagaggtccgaagcacttcggaggcagcagctcgagcaacaacagcgagagaacgaggaacacaagagacaactgctagccgaacgacagaaaaggatcgaggaacagaaagagcagcgcagacgcctggaggagcagcagaggcgcgaaaaagaacttcgcaagcagcaggaacgcgagcagaggagacactacgaagaacagatgcggcgagaggaagaaaggaggagagccgaacacgagcaggaatacatccgcagacaactggaggaggagcaacggcagcttgagatacttcaacagcagctgcttcatgaacaggctctgctgctcgagtataagcgaaaacagctcgaagaacagagacaggcagagcggctccagcgtcagctgaagcaggagcgcgactatttggtgagcctgcagcaccaacggcaggagcagaggcccgtggaaaaaaagccattatatcactacaaagagggtatgtccccctctgagaaacctgcatgggctaaagaggtcgaggaacgaagcagactgaataggcagtcatccccagccatgcctcataaagtagcaaacagaatctctgatcccaacttgcccccaagatcagagagtttctctatctcaggcgttcagcctgcgcgtaccccccctatgctgagacctgtggatcctcagatccctcacctcgtggccgtcaagtcgcagggcccagcactgacagcctcccagagcgtccacgagcaaccaacaaagggactgtccggctttcaggaagccctgaatgtgacctcccaccgtgtggagatgcccaggcagaattctgatcccactagcgagaaccccccattacccacacgcatcgagaaatttgaccgctcctcgtggctgcggcaagaagaagatattccccctaaagtgccccaacggaccactagcatttccccagccctcgccagaaaaaacagcccaggaaacggcagtgcgctgggaccacgactgggcagtcagcctatccgggcttccaacccagatctgcgcaggactgagcccatcctggaatccccattacaacgaacttcaagcgggagcagcagttcctcctctaccccgtcttcccaaccgtcatcacaagggggatctcagccagggtctcaggccggttcatccgagaggactcgcgtgcgagccaactccaagtccgagggtagccccgtactcccacatgaaccagcgaaagttaagcctgaggagtctcgggacatcaccaggcctagccggcctgcagatctgacagcattagcaaaggagctgagggagctgcggatcgaggaaaccaatcgtcctatgaagaaagttactgactacagctcttctagcgaagaatccgagagctctgaagaggaagaggaagatggagagtcagagactcacgacgggacagtggctgtgtccgacatacccaggctaatacctacaggcgcacctggcagcaatgagcagtacaacgtggggatggtcggtacccacggtctggaaaccagtcacgctgattccttttctggaagcatctcaagagaggggacgctcatgattagggagaccagcggggagaagaagcgaagtggccactcagattccaatggtttcgccggacacatcaacctaccggacctcgtccagcagtcccatagcccagctgggacccccacagaagggctcgggcgtgtgagcacccatagtcaggagatggacagtggaacagaatatggtatggggtcttccactaaagcttcctttactcctttcgttgatcctcgggtctatcagacatccccaacggatgaggatgaagaggatgaagaaagctccgccgcagcgttgtttacatctgagttactgcgacaggagcaggctaaactgaacgaggcacgcaagatttcagtggtgaacgtgaaccctaccaatatcaggcctcattctgacacgccagagataaggaagtacaagaaacgctttaattccgagattttgtgtgcggcactttggggcgtgaatcttttggttgggactgagaacggcctgatgctattggaccgaagcgggcaagggaaggtgtataacctgatcaaccgccgtagatttcaacagatggacgtgctcgaaggtcttaacgtgcttgtgaccataagcggcaaaaagaataagctcagagtgtactacctgtcctggcttcgcaatagaattcttcacaacgaccccgaagttgagaagaaacagggatggattaccgtcggggaccttgaaggctgcatacactataaggtcgtgaagtatgagcgcatcaaattcctcgtgatcgccctcaaaaatgcagttgagatctacgcatgggcccctaaaccctatcacaaattcatggctttcaaaagcttcgccgatctgcagcacaagcccctgctcgtagaccttaccgtggaggagggtcagcggctcaaagtgatattcggctctcataccggtttccatgtgatagacgtggatagcggcaactcctatgacatctacataccctctcacatccagggaaacatcaccccccacgccatagtgattttaccaaaaactgatgggatggaaatgctcgtctgttacgaggatgagggcgtttacgtgaacacctacggaaggatcactaaggacgttgtgctgcagtggggtgagatgcccaccagtgtagcctacatacactccaatcagattatgggctggggggagaaagccatcgaaattcgctccgtggaaaccggacatttagatggggttttcatgcacaagagagcccagagactgaagttcctatgcgagcgtaacgacaaggtattcttcgcaagtgtgcggtcaggtggttccagccaggtgtttttcatgaccctcaatagaaacagcatgatgaactggtag

SEQ ID NO: 244259 - DNA, 3831 bp, Artificial Sequence
  Description of Artificial Sequence: Synthetic coding sequence
atggcctcagactctccggctcggtcactggatgagatcgatttgagcgccctgcgggaccccgctggtatctttgagttagttgagctggttggcaacgggacgtacgggcaggtgtataagggaagacacgtgaagacaggacagctagccgcaataaaggtaatggacgtaactggtgacgaggaggaagagatcaagcaggagataaatatgctgaaaaagtactcgcatcaccgcaacatcgccacatattacggcgcttttattaagaagaaccccccaggaatggacgaccagctgtggctggtgatggaattctgtggagctggcagcgtcactgacctaattaaaaatactaaaggtaatacactcaaggaggaatggatcgcttacatttgtcgggagatcctgcggggtctatcgcacttgcatcagcataaggttattcaccgggacattaaaggacagaacgtcctgttgacagaaaacgccgaagtgaagctggttgactttggagtcagtgcccagcttgacagaaccgtggggaggcgcaacactttcattggcaccccctattggatggctccagaggtgatcgcttgtgacgagaacccggacgctacctacgacttcaagtcagacctctggagtctgggaatcacagctatcgagatggcagaaggcgctcctcctctttgcgatatgcatcctatgcgcgcactattcctgatcccgagaaacccggctcctagactgaaaagcaagaagtggtctaagaaattccagtcttttatcgaatcctgtctggtcaagaaccattcgcaacggccagccacagagcaactcatgaagcatcccttcattagggaccaacctaacgaacgacaggtgagaattcagttgaaagaccatatcgacaggacgaagaaaaagcgcggtgagaaagacgagaccgagtacgaatatagcgggtccgaagaggaggaagaagagaacgattccggggaacctagctccatcctcaacttacctggagaatctaccttacggcgtgatttcctgcggttgcagttggctaataaggaacgcagcgaggccctccgcagacagcagctggagcagcagcaaagggaaaacgaggaacataagagacaactgcttgccgagaggcagaagcggattgaagaacaaaaagagcagaggcggagattggaggagcagcaaagacgggagaaggagctgagaaaacagcaggaaagggagcaacgacgacattacgaagagcaaatgagacgtgaggaagaacgcagaagggctgagcacgaacaggaatataaacggaaacagctcgaggaacagcgacaggctgaaagactgcaacgccaactgaaacaggagcgcgactacctcgtctcactacagcatcagcgccaggagcagcggccagtggagaagaagccactttaccactacaaggaggggatgtctccctccgagaagccggcttgggcaaaagagattccgcacctcgtggctgtgaaaagccaaggaccagctctgactgcatcccagtcggtgcatgaacaaccgacaaaaggcctgtctggcttccaagaggctctgaatgtgacttcacaccgagtggagatgccaaggcagaattctgatcctacttccgagaatccacccctacccacacgaattgagaagttcgacaggtcttcttggttacgtcaggaagaagatattccacccaaggtgccccaaaggacaacaagtatctccccagctctagccaggaaaaattctccagggaatggttctgctctgggacccagacttggctcacagcccatacgcgcaagcaaccctgacctccgcagaacagagcctatcctggaatccccgctgcagcggaccagcagtgggagttctagttcatcttctacaccttcgtcccagccctcctctcagggaggcagtcagccgggttcacaagcagggagcagtgaacgtacacgggtccgagctaattcgaagtcggaggggtccccggtactgcctcatgagcctgccaaagtgaagccggaagaatcaagagatataacccgtccaagtaggcccgcaagctataagaaggccatcgacgaggacctcaccgccctggctaaagagctgagagagctgcgtatcgaagaaacaaaccgaccaatgaagaaggtgaccgactatagctcctcttcagaggaatcggagtcttcggaggaagaagaggaggacggagagtccgaaacccacgacggcacagtcgctgtatcagacattccacgcttaattcccacaggcgctccgggatcaaacgaacagtataatgtaggcatggtaggcacgcacggcctggagacctcacatgctgattcattttcagggtccataagccgcgaaggaacactgatgattcgcgagactagcggtgaaaaaaaacggtccggacactcagattcaaacgggttcgccggacacatcaacttacccgaccttgtgcagcagagccacagtcctgcgggaacaccaacagaaggactggggagggtgagtacacactctcaggaaatggattccggtaccgagtacggcatggggtcatctactaaggcctcgttcacaccctttgtggaccctcgtgtgtatcagacatcccctaccgacgaggacgaagaggatgaagagtcttctgccgctgcattattcacctctgaactcctcaggcaagagcaggctaaacttaatgaggcgcgaaaaatcagtgtggttaacgttaatcccaccaatataaggccccacagcgatactcccgagatccgaaagtataagaaaagattcaatagcgaaatcctatgtgctgcactgtggggtgtgaatttactggtcggcaccgagaacggcctgatgcttctggaccgttctggccaaggcaaggtttataacctcatcaacagacgaagatttcaacagatggacgtgctggaaggcctgaatgtgctcgtaaccatctccggtaaaaaaaataagttgcgcgtttattacctcagctggttgcgtaatcgcattctgcataacgacccagaggtggaaaaaaaacagggatggatcaccgttggagatctcgagggttgtattcactacaaggttgtaaaatatgagcgcataaagttcttagtaatcgcactgaaaaatgccgtggaaatatacgcatgggctccaaagccttaccataagtttatggcttttaagagctttgcagatctgcagcataagccccttcttgtggatctcactgtcgaagagggacaacgcctgaaagtcattttcggcagccatacgggtttccacgtgatagacgtggatagtggcaatagttacgacatttacataccttcccatatccaaggtaacatcacgccccacgcaatagtgattctcccaaaaactgatgggatggagatgttagtctgttacgaggacgaaggcgtttacgtcaatacctatggaaggatcacaaaagacgtggtgcttcagtggggggaaatgcccacgagtgtcgcttatatccacagtaatcagatcatgggatggggcgagaaggccatcgagatacgctccgttgagactggccatctggatggagtgtttatgcacaagagggctcagcgattaaagttcctctgcgagagaaatgataaggtgttcttcgcaagcgtgcgtagtggtggcagctcacaagtgttctttatgaccctgaacagaaactctatgatgaattggtag

SEQ ID NO: 244260 - DNA, 3996 bp, Artificial Sequence
  Description of Artificial Sequence: Synthetic coding sequence
atggcatcagattcgccagccagatccttggacgagatagatctaagcgcactgcgcgatccagcagggattttcgagcttgttgagctggtcgggaatggcacatatggccaggtctacaagggcagacacgtgaaaacaggccaattggccgcaatcaaggtcatggacgtgaccggcgacgaagaggaagaaattaagcaagagattaacatgcttaaaaagtattcgcaccaccggaacatagctacgtactacggagccttcataaagaaaaacccccctgggatggacgatcaactgtggcttgtcatggaattttgcggagccggatccgtgactgacctaataaagaatacgaaggggaacaccctgaaggaggaatggattgcttatatctgccgtgaaattctgagagggctcagtcacctgcaccagcacaaagtaattcaccgggacattaaagggcaaaatgttctgcttactgagaacgccgaggtcaaactggtagacttcggtgtctccgcacagctggacaggacagtgggccgacgcaacaccttcatcgggactccctattggatggctcccgaggtgattgcgtgcgacgagaatcctgacgccacatacgattttaaaagcgacttatggagcctaggcatcacagcaattgagatggccgagggagctcccccactgtgcgatatgcaccctatgcgcgctctgttcttaatccctcgcaaccccgcacctcgcttaaagtccaaaaagtggagcaagaagtttcagtctttcattgagtcctgtctggttaagaaccattctcagcgaccagccaccgagcagctgatgaaacaccccttcatcagggatcagccgaacgagagacaagtacgcatacagctcaaagatcacatcgacaggacaaagaagaaacggggtgaaaaggatgagacagaatacgagtactcaggtagtgaggaggaggaagaggaaaacgacagcggagagccttcatccatactgaatctgccaggtgagagcaccctgaggagagacttcctcagactacagctggcaaacaaagagcgcagcgaagctcttaggcgacagcagttagagcagcagcagcgcgaaaacgaagagcataaacggcagttactggcagagcgacagaagcgaattgaagaacagaaggagcagaggcgacgcctcgaggaacagcaacgacgcgagaaggagttacggaagcagcaggagagggaacagcggaggcactacgaagaacagatgcggagggaagaggaacgtagaagggccgaacacgaacaggagtacaaaaggaaacagctggaagagcagcgacaggccgaacggctgcagcggcagctgaagcaggagagagattacctcgtttcactacagcaccagcgccaggaacaacgcccagtcgaaaagaagcctctgtaccactacaaggagggcatgtcaccaagtgagaaacccgcatgggctaaagaagtggaggagagatcacggctgaaccgccagtcctcccccgcaatgccccataaggttgccaaccgcatatccgatcctaatcttcctcctcggtcagaatccttctctatatctggggtgcagcctgcgcgaaccccgcctatgctcagacctgtggaccctcaaattcctcacctggtcgctgtgaaatcacaggggccagcattaactgcctcacagtctgtgcacgagcaaccaacaaaaggactgagcggcttccaagaggcactgaatgtcaccagccatagggtggagatgcccagacagaacagcgacccaacaagcgagaatccgcctctgcccaccaggattgaaaagttcgacagatccagctggctgcgccaggaagaggacattccacccaaagtgcctcagagaaccactagcatctctccggctttggccaggaagaacagtccagggaatggctccgccctagggccaagacttgggagccagcccatccgggcaagcaacccggacctgcggagaaccgagccgattctggagagcccactacagaggacctcttcagggtcatctagctcatctagcacgccctcttcccagccgagttctcagggcggaagtcagccagggagccaagctgggagctccgaaaggacccgtgtcagggccaattccaagtccgagggaagtccagtgctaccccacgagcccgcaaaagtaaaaccagaagagagtcgggacatcaccagaccaagcaggccagcctcctacaaaaaagccatagatgaagatctgaccgcactggccaaggaactacgggaactgaggattgaagagactaataggcccatgaaaaaagtcacagattattcctcatcatcagaagagtcagaatcaagtgaggaagaagaggaagatggcgagagcgagactcacgacggcacagttgccgtctccgatatcccaagactgatccctacgggcgctcctggatccaatgagcaatacaacgtggggatggtgggaactcatggcctcgaaaccagccacgccgacagcttcagcggcagcatctctcgggagggcactcttatgatccgggagacctccggtgagaaaaagaggtccggccatagtgactctaacgggttcgctggtcacattaacctcccagacctggtgcaacagtcccactcacccgctggaacgcccaccgaggggcttgggagagtgagtactcatagccaggaaatggattctgggacagaatacgggatggggagctctaccaaagccagctttacaccattcgtggacccccgagtgtaccagacttcaccaacggatgaggatgaggaggatgaggagagtagcgcggcagctttgtttacttcagagctgctgcggcaggagcaggctaaactgaatgaagctagaaagataagcgtagttaatgtaaatccaactaatataaggccgcatagcgacacccccgagatcagaaaatataaaaaaaggtttaactcggaaatcttgtgcgcagctctgtggggggtcaatctgttggtggggacagagaatggcctgatgctgttagatcgctcaggccagggcaaagtgtataatctcattaatcgcaggcgctttcagcagatggatgtgcttgagggtctgaacgttctggtgaccataagtggaaagaaaaataagctgagggtttattatctcagctggttgagaaaccgcattctccataatgatcctgaggtggagaagaaacaaggctggatcacggtgggggatctggaggggtgcattcactataaagtagtcaaatacgagcgcatcaaatttctggtgattgccctaaaaaacgcagtggagatctacgcgtgggctcccaagccctaccacaagttcatggccttcaaatccttcgctgacctccagcacaagcctttgttggttgatctgactgtcgaggagggccagaggctgaaagtcatcttcgggtctcatactggcttccatgtaatagatgtcgactcaggaaattcttacgatatatatatcccgtctcacattcagggcaatatcacacctcatgctattgtgattctcccaaaaacagatggcatggaaatgctcgtttgctacgaagacgagggcgtttacgtgaacacatatggacgtatcaccaaagacgtcgtgcttcagtggggtgagatgcctacatccgtggcctacattcacagcaaccaaataatgggttggggcgagaaggcaatcgagatcaggtccgtcgagactggacacttggacggggtctttatgcacaagagagcccagcgacttaagttcctgtgtgagcgcaacgacaaggtatttttcgcatccgtccgctctgggggttcgtcccaggtgttctttatgacactgaatagaaatagcatgatgaactggtag

SEQ ID NO: 244261 - DNA, 4017 bp, Artificial Sequence
  Description of Artificial Sequence: Synthetic coding sequence
atggccagtgactctcctgccaggtccctggatgaaattgacttatcagctctccgggaccccgctgggatctttgaactggtggagctggtcgggaatggcacatatgggcaggtgtacaagggcaggcatgtcaagacaggacagcttgctgcgataaaggttatggatgtaaccggtgatgaagaggaggagattaagcaggagattaacatgcttaaaaaatactcccaccacagaaatatcgcaacctactatggcgctttcataaagaaaaatccacctggaatggatgatcagctgtggctcgttatggagttctgtggagctgggagcgttactgacctgatcaagaacaccaagggcaacacactgaaggaagaatggatcgcctacatctgcagggaaatcctgagggggctgtcacacttgcatcagcataaagtgatccacagggacattaaaggccagaatgtgctgctgacagaaaatgccgaggttaaaatagttgactttggcgtctctgctcagctggaccgaactgtggggagaaggaacacatttatcggcactccatattggatggcccctgaggtcatcgcctgcgacgaaaatcctgacgcgacctatgatttcaagtcagacctgtggagcctgggcatcacagctatcgagatggcagagggcgcacccccactttgtgatatgcatcccatgcgcgcactgtttctgattcctaggaaccctgcgcctagactcaagagcaagaaatggtctaagaaattccagagttttatcgaatcttgcctagtcaagaaccactcccaaagacctgccaccgagcagctgatgaagcacccatttattagagaccaaccgaacgagagacaggtccggatacagctgaaagaccacatcgacagaaccaagaagaagagaggagagaaggacgaaacagagtatgagtattcaggttcagaggaggaagaagaggaaaatgacagcggagaaccctccagcatcctgaacctccctggcgagtccacccttcgaagagatttcctgcgcctccagttggctaataaggagaggtccgaggcactgcgccgacaacagctcgaacagcagcagagagaaaacgaagagcacaagcggcagctactggcggagcgccagaaacggattgaggagcagaaggagcaacggagacgactagaggagcagcagcgccgagagaaggagctgcgaaaacaacaggaacgcgagcaacggcgacactacgaagagcaaatgcgacgggaggaggagaggagacgcgctgaacacgaacaggagtacaagaggaagcaactggaagagcagcgccaagcggaacgcctgcagcgacagctgaagcaggagcgcgactatttggtgtcactgcagcaccagagacaggagcagcggcctgtggaaaagaaaccactataccactacaaggaggggatgtccccatctgaaaagcccgcttgggctaaggaggtggaggagcgtagccgccttaacagacaaagttctcccgcaatgcctcataaggtcgccaaccgtatttctgacccaaacctgcccccacggagcgaaagtttcagtattagtggggtgcagccagcaaggacaccaccgatgctgcgcccagttgatccacagatccctcacttagtggcagtgaaatcacagggcccagccctgaccgcctcccagtctgttcatgagcagccaacaaaggggctgagcggattccaggaagcactaaacgttacaagccatagggtggaaatgcctcgccagaacagcgatcctacctcagagaacccccctctgcccacaaggatcgagaaattcgataggtcatcttggctcaggcaggaggaggatattccccctaaggtcccccagcggaccaccagcatttctcctgctctcgccagaaaaaacagtcctggaaacggctcggccttgggccctcgcctcgggtcacaacctatcagagccagtaatcctgatctgcgccgtaccgagcccatattggagagcccactgcagcggacctctagtggtagttcctcttcatcctccactccgtcctcccagcctagttcccagggcggaagccagcccggaagccaggctggcagctcagagaggacccgcgttagggccaattcaaagtcagaggggtctccagtactgcctcacgagccggctaaggtgaaacccgaggaaagcagggatatcacgcgaccttcaaggcccgctgtaagtgcatttctgagcaagagtttcgaactgctgatctatcaggacttaacagcgcttgccaaagaactgcgcgaactaaggatcgaagaaacaaacaggccgatgaagaaagtgaccgactactctagctcgtcagaggagagcgagtcctccgaagaagaagaagaggatggagagtccgaaacccacgatgggaccgtagccgtgagcgacatacctagactgattcccaccggcgcacccggatcaaatgagcagtacaatgtggggatggtgggtacccacggactcgagacctcacatgcagatagcttctccggctcgatcagtcgtgaaggcactcttatgatccgagaaaccagcggagaaaaaaagaggagcgggcatagcgactctaatggatttgcaggccacattaatttgcccgatctggtgcagcaatctcactcacctgcaggcacgcccacagagggtttagggagagtgagtacacactcccaggagatggacagtggtactgagtatggaatgggaagctccactaaagcgagtttcacgccgtttgtcgacccacgggtgtatcagactagcccaaccgatgaggatgaagaagacgaggagagctccgcggcagccctgtttacaagcgaactgttacgccaggaacaggccaagcttaatgaagcaaggaagatctctgtggtgaacgtgaatccgaccaatattcggccacatagcgacaccccggaaattcgcaaatataagaagcgcttcaactctgagatcctgtgcgctgcattatggggtgtcaatctcctcgtgggaacagagaacggcctgatgttattggataggagtggacagggaaaagtgtacaacctaatcaaccgtagaaggttccagcagatggatgtcctggaaggccttaacgtcttggtgacaatttccggcaaaaaaaacaaactgcgcgtgtactatctgtcatggctccgcaaccggatattacacaacgatcctgaagtggaaaaaaagcaagggtggataacagtcggagatttggagggttgcatccactacaaagtcgtcaagtacgagagaattaaattcctcgtgatagccctgaagaacgccgtggagatatatgcctgggctccaaagccttaccataagtttatggcttttaagagtttcgcagatctccagcacaaacctcttctcgtagatctaaccgtggaggagggccagcggctcaaagttattttcggttcccacactggttttcacgtgatcgacgtggatagtggcaatagttacgacatttatatcccctctcatatccagggcaacataacaccccatgcaattgtcatccttcccaagaccgacggtatggaaatgttggtctgttacgaggatgaaggcgtgtacgttaacacctacggacggatcacaaaggacgttgtgcttcagtggggggaaatgcctacaagcgtggcttacattcattctaaccaaattatgggctggggggaaaaagcaatcgaaatcaggtctgtggagacaggtcatctggatggtgttttcatgcacaagagagcacagcgactgaaatttctgtgcgaaaggaatgacaaagtgtttttcgccagtgtccggagcggcggatcctcccaggtatttttcatgactcttaaccgtaactctatgatgaactggtag

SEQ ID NO: 244262 - DNA, 4083 bp, Artificial Sequence
  Description of Artificial Sequence: Synthetic coding sequence
atggcatcggatagccctgcacggagcttagacgaaatcgatctgtccgccttaagggacccagccggaatcttcgagctcgtcgaactggttggcaacgggacgtatggacaggtttacaaggggcgacacgtgaagacagggcagctcgcagccataaaagtcatggacgtaaccggcgatgaggaagaggagattaagcaggagattaatatgcttaaaaaatacagccatcaccggaacatagcaacgtactacggagcttttataaagaaaaacccccctggtatggatgaccagctctggttggttatggagttctgtggggctggcagcgttaccgacctcattaagaataccaagggaaacactctgaaagaggaatggatagcctacatatgcagggagattctgagggggctgagccacctccaccaacacaaagtgattcatagagatattaaaggacagaacgtcctgcttacagaaaacgctgaggtcaagcttgtcgattttggcgtgagcgcgcagcttgaccggacagtgggacgccgtaacacctttattggcaccccttattggatggccccagaggtgattgcatgcgacgagaaccctgacgctacatatgatttcaaatcggatctctggtcactgggaataactgccattgaaatggccgagggagcgcctcctctttgcgatatgcatcccatgcgggctctgttcctgatccctcggaacccggctccacggctgaaaagtaaaaaatggtcaaagaaattccagtcattcattgaatcctgtctcgttaagaatcacagtcaacgccctgccaccgaacagctcatgaaacacccctttatcagggatcagccaaacgagcgccaggtgagaatacagctcaaggatcatattgatagaacaaaaaagaaaagaggagaaaaggacgagactgagtacgagtacagtggatccgaagaagaggaggaggaaaacgatagcggagagccttcttccattcttaatctgcctggggagagtacattaagacgcgacttcttaaggctgcagttggcaaacaaagagagaagcgaggctctgaggcgtcagcaactagagcaacagcaacgcgagaacgaggagcacaaaaggcagcttttggcggagagacagaaaagaatcgaagaacagaaggaacagaggagacgcctcgaggaacagcagaggagagagaaagagttgcgcaagcagcaggagcgcgagcagagaagacactatgaggaacagatgcgtagggaagaagaacggaggcgcgctgagcacgaacaagagtacataaggcggcagctggaggaagagcagcggcagcttgagatacttcagcaacagctcttacacgagcaagcgctccttctggaatacaagaggaaacagctggaagagcagcgacaggctgagagattgcaacgccaattaaagcaggaacgggattacctcgtgtccttgcagcatcaaagacaggagcaacggccagtggagaagaagccactttatcattacaaggaaggcatgagcccaagtgagaaaccagcctgggcgaaggaagttgaagagcgaagccggctcaatcgccagagtagccccgcaatgccacacaaagtagcaaatcggatatcagatccaaatttgcctcccagaagcgagagtttcagcatcagcggcgttcagccggcacgaacacccccaatgctgaggccggtggacccacagattccccatttagtcgcggttaaatcacagggaccagccctgactgcttcacagagcgtccacgagcaacccacaaaaggcctgtctgggtttcaagaagcactgaacgtcaccagccatagagtggagatgccacgtcagaactcagatcccacaagcgagaacccacctctccccacgcggatcgagaaatttgatcgctcatcatggctgcggcaggaggaagatatcccccctaaggttccacagaggactacctccatttccccagccctcgcaagaaaaaacagtcccggaaatggtagcgccctgggaccacggctgggatctcaaccaataagagcctctaaccccgacctgcggagaacagagcctatcctggagtctcccttgcagcggacaagcagcggaagctccagctcgtctagcacgccttcaagccagccctcatctcagggcggttcacagccaggaagccaggcaggaagctccgagcgcacacgagtgcgggcaaactccaaatctgagggaagtcccgtgttaccccatgaacccgcaaaggtgaagcctgaggagtcacgcgatatcactcggccttccaggccagcgtcttacaagaaggcaatagatgaagacctcactgcgttggcaaaggaactgcgggagcttcggattgaagagaccaataggcccatgaaaaaggtcactgactactcttcctcttcagaggagagcgagtctagcgaggaagaagaggaagatggagagtccgagacacacgatgggactgtagcagtgagtgacattccaaggctgataccgacaggagccccagggtccaacgagcagtataatgttggtatggttgggacacacggtctagagactagtcatgccgattccttttcaggctccatctcccgggaaggaaccctgatgattagggagactagtggcgagaagaaaaggagcggtcactctgacagcaacggatttgcaggccacatcaatctgccagatctggtgcagcagtctcactccccagcaggcacacccaccgaagggttaggtcgggtaagcacacacagccaagaaatggattccgggacagagtatggcatggggtcctcgaccaaagcctctttcacaccttttgtggacccaagggtgtaccagacatccccaaccgatgaggacgaagaggatgaagagtctagtgctgcagcgctctttacatccgagttgcttaggcaagagcaggccaagctgaatgaagcgcgtaagatctccgtcgtgaatgtgaatcccaccaacataaggcctcacagcgatactcctgaaatccgcaaatataaaaagcggttcaatagtgagattctctgcgccgctctctggggggttaatctgctagtcggtacagagaatgggctgatgctgctggatcgcagcggacaggggaaggtgtacaatctgattaacagaaggcgatttcagcagatggatgttctggaaggactgaatgtcctcgtgactattagcggaaaaaagaataagctgagagtgtactacctgagctggttgagaaatcggatccttcacaatgatccggaggtcgaaaaaaagcaggggtggattaccgtgggagatctggaggggtgtattcactataaagtcgtgaagtacgagcggatcaagttcttagtgattgctctgaaaaatgcggtcgaaatttacgcatgggctcccaagccttaccacaaatttatggccttcaagtcgttcgcagaccttcagcacaaacctctcctcgtggacctgacggtcgaggagggtcagcgactgaaggttatcttcgggagtcacacgggattccatgtgatcgacgtggattccggcaacagctacgacatctatatccctagtcatatccaaggtaacatcacaccacatgccatagtgattctgcccaaaaccgacgggatggagatgttagtgtgttatgaggacgagggggtgtacgtgaacacttatgggaggatcactaaggacgtggtgctgcagtggggcgagatgccaacaagtgtagcatatattcatagtaatcaaatcatggggtggggagaaaaagccattgaaatccggtccgtggagaccggtcacctcgatggggtgtttatgcataagcgtgctcagcgactcaagttcctgtgcgaaaggaatgataaggtctttttcgcatccgtgaggagcggcggtagttcccaggtcttcttcatgacgcttaaccgtaatagcatgatgaattggtag

SEQ ID NO: 244263 - DNA, 3894 bp, Artificial Sequence
  Description of Artificial Sequence: Synthetic coding sequence
atggcgtccgactccccggcacgaagtctggacgaaattgacctcagcgccctgcgtgatcccgcaggaattttcgagctcgtcgagctggtgggaaacggtacctatggacaggtgtacaagggcaggcacgtgaaaacaggccagctagctgctatcaaggttatggacgtgaccggggacgaagaggaggaaatcaaacaggaaatcaatatgctgaagaagtatagccatcatcgcaacatagcaacttattacggggcatttattaagaagaaccctccaggaatggacgaccaactctggctagtgatggagttctgtggcgctggctctgtcacggacctgatcaagaacacaaagggcaacaccctgaaagaggagtggattgcttacatctgcagggaaattcttcgaggcctgagccacttgcaccagcacaaggtaattcatcgcgatataaaaggccagaacgtgctccttaccgaaaacgccgaagtgaagctggtggactttggcgtgagcgcacagttagaccgaactgtgggaaggagaaacaccttcatcggcacaccgtattggatggcgccagaagtcatcgcctgcgacgagaatcccgacgccacatacgactttaaatcagacctttggagcctgggaattacagccatcgagatggctgaaggagcacctcccctgtgtgatatgcatccaatgcgcgctctgttcctgatcccaagaaatcccgctcccagattgaagtccaaaaagtggtccaaaaagtttcaatcctttatcgagagttgtttggtgaagaatcactctcaacgacctgccaccgaacagctgatgaagcatcccttcattcgagaccagccaaacgaacgccaggtaagaattcagttgaaagatcatattgaccgtaccaaaaagaagcggggagagaaggatgagaccgagtacgagtatagcgggagtgaggaagaagaagaagaaaacgacagcggagaacccagctcaattctgaacctccctggcgaatcgacactgcgtcgtgacttccttagactccaactggccaacaaggaaaggtccgaggccctgagacgccaacagttggagcaacagcaaagggagaacgaggagcataaaaggcagctactcgcagaaaggcagaaacgaatagaagagcagaaggagcagaggaggcgactggaagagcagcagcgcagagagaaagaactgagaaaacagcaggagcgagagcagcggaggcactatgaagaacagatgcggcgtgaagaggagcggagaagggctgaacatgaacaagagtacattaggcgacagctggaggaggagcagagacaactggaaatcctgcagcaacagctgctccacgaacaggccctgctccttgagtacaaacggaagcaactcgaggagcagcggcaagctgagcgactgcagcggcaactgaagcaagagcgtgactatttagtgtcactgcagcaccagagacaggagcaaaggcccgtggagaagaagcctctctatcactataaggaggggatgagcccctcggaaaagccagcctgggccaaggagattccgcacctggtggcagtgaagagccagggcccagctctgaccgcctcccaaagcgtgcatgagcagccgactaaggggctgtcagggttccaagaagctctaaatgttactagtcacagagtggagatgccgaggcagaattcagaccctacctccgaaaatcctcccctcccgacccggatagaaaagttcgatcgctcttcctggctgcgtcaggaggaggacatcccaccgaaggtgccacagagaaccacctctatttcacccgctcttgctaggaagaactccccaggcaacgggagcgcacttggcccaagactcggatcccagcctatccgagcatcaaacccggacttacggaggactgagccaatcctcgagtctccacttcagaggactagctccgggtcaagctcatccagttcaacaccctcatcccaaccttcttcgcaaggaggtagccagccaggaagccaggccggaagttcagaacgcactcgtgttagggcaaattcaaagtctgaggggagtccggtcctgcctcatgaacccgcaaaggtgaaaccagaggaatcgcgagacatcacccgacccagcaggcccgcagatttaaccgcactggccaaggaactcagggaactgcggattgaggagactaaccggccaatgaaaaaggtgacagactactcatcttcaagtgaggagtcagaatcatctgaggaggaagaagaggatggagaaagcgagacccatgatggcaccgtcgcggtctctgacatacctagacttatccccacaggggcacccggaagtaacgagcagtacaatgtagggatggtaggaactcatggactggagacgtctcacgctgatagctttagcgggtccatctccagagagggcaccctgatgataagagagacttctggcgaaaagaagcgctcaggacattcagatagcaatggattcgctggacatattaatttaccagatctggtccagcaaagccacagtccagccggtacaccgactgagggactcggcagggtgtcgacccacagccaggaaatggattctgggacagaatacggtatggggtcctccaccaaggccagttttaccccttttgttgatccgcgtgtctatcagacatccccaacagacgaggacgaggaagatgaggagtccagcgcggcagccctcttcacatccgagctgctcagacaggagcaagccaaactgaatgaagccagaaagatttcagtggttaacgtgaaccctactaatattaggccacactctgacactcctgagatacgcaagtataagaagcgatttaacagtgagatcctatgtgctgccctgtggggggtgaacctcctagtcggcacagaaaatggacttatgttgttggacagatccgggcagggtaaggtgtacaacttgatcaatagacgccgattccagcagatggatgtccttgagggtctcaacgtgctggtgaccatttctggaaaaaaaaacaaactgagagtgtactatttgtcatggctgcgcaataggatcctgcacaatgaccctgaggtggagaaaaagcagggttggataactgttggcgacctcgaggggtgtatccattacaaagtggtcaagtacgagcggattaaattcttggtgattgccctgaaaaatgctgttgaaatttatgcctgggccccaaaaccttaccacaagtttatggcgttcaagagctttgcagacctgcagcacaagcccctgctagttgacctgaccgtggaggagggccaacgtctaaaggtgatcttcggcagtcacaccggctttcacgtcatcgacgtggactcgggaaattcttatgatatctatatcccctcacatattcaaggaaacatcaccccacacgctatcgtgatcctgcctaagactgacggaatggaaatgcttgtatgttacgaagatgaaggcgtgtatgtcaatacgtacgggaggataacaaaggatgtagttttgcaatggggcgagatgcccacaagcgtggcgtatattcacagcaaccagataatgggatggggcgagaaagccatcgaaatacggtccgtagaaactgggcatttggacggggttttcatgcacaaaagagcccagagattgaagtttttgtgcgaaagaaatgacaaagtcttctttgccagcgtgaggagcggaggaagctcccaggtgttcttcatgacattaaaccgcaactcaatgatgaattggtag

SEQ ID NO: 244264 - DNA, 3972 bp, Artificial Sequence
  Description of Artificial Sequence: Synthetic coding sequence
atggcttccgattcaccagctcggagcctcgacgagattgacctgtcagccttgcgcgaccccgcaggaattttcgagctggtggaactcgttgggaatggcacatatggccaggtctacaaaggcaggcatgttaaaactggccagctcgccgctattaaggtaatggatgttaccggagatgaagaggaggaaattaagcaggaaataaacatgctcaaaaaatattctcaccaccgcaatatagctacgtactacggcgcatttatcaaaaaaaacccccctggaatggatgatcagctatggctggttatggaattttgtggcgcagggagcgtgaccgatcttatcaagaatacaaaaggcaatactttgaaagaagaatggattgcgtatatctgcagggagattcttagagggctaagtcatctccaccagcataaagttatccacagggatattaagggtcaaaacgtgctgttgactgagaacgccgaggtaaagctggtagactttggagtgtccgcacagctcgaccgcaccgtgggcaggcggaatacatttatcggaacgccctattggatggcaccagaagttatagcatgcgatgagaatcctgatgcaacctatgactttaaatctgacctgtggtccttaggcatcactgccatcgaaatggccgagggagcacctccattatgcgatatgcatcctatgagagcactcttcctgatccctcgaaaccctgctcccaggttgaagagcaaaaagtggtctaagaagttccagagttttatcgaatcttgtctggttaagaatcactctcagcgtccggctaccgagcaactgatgaagcatcccttcatcagagaccagcccaacgagcggcaggtgcggatccagctgaaagatcacatcgatcggacgaaaaagaagaggggcgaaaaggacgaaactgaatatgagtactcgggctcggaggaagaggaggaggagaacgatagcggcgaacccagctccattctcaacctgcccggtgaatctacattgcgcagagatttcctcaggctgcagctggctaataaggagcgatcagaggctctgcggagacagcagctggagcagcagcagagagaaaatgaggagcacaagcgccagctactcgcagaacggcaaaagcggatcgaagagcagaaggagcagaggcgcaggcttgaggagcagcaaaggcgagaaaaagagcttcggaagcaacaagaaagagagcaaaggcggcactacgaggagcagatgcggagagaggaggagagacggagagcggagcatgaacaggagtataagagaaaacagctggaggagcaacgtcaggcagagcgcctccagcggcagctgaagcaggagagagattatctggtctcactgcagcatcagagacaagagcaaagacccgttgaaaaaaagcccctgtatcactataaagaggggatgtccccctctgagaaaccggcttgggctaaggaggtggaagaacgctcaagactgaaccgccagagctcacctgcaatgccgcacaaggtcgctaacagaataagtgacccgaacctgcccccacgcagtgagagcttttctatctccggtgtccagcccgcacggacccccccaatgttacgccctgtcgacccacagataccgcatctggtcgcggtcaagagtcagggacctgcgctcactgcgagccagagcgtgcatgagcagccaacaaaggggctctccgggttccaggaagcattaaacgtaacaagccatcgtgtggaaatgccacgccagaactccgatcccacatccgaaaacccaccgctgccaactagaattgagaagttcgacagaagcagttggcttaggcaggaagaggatatacctcctaaagtcccacagcggacaacatccatcagccccgcactcgcaagaaagaactcgccaggaaacgggagcgcactcggaccgcgtcttggatcccagcccattcgcgcatccaatcctgatctgaggaggaccgagcccatcctggaatcccctctgcagagaacttcatcgggcagctcctcttcctcttctaccccctctagtcaaccaagcagccaggggggatctcagcctggctctcaggccggttcatcggagagaacacgcgtccgagcaaatagcaaatccgagggtagcccagttttgccccacgaaccagcaaaagtgaaacccgaggagtctagggacattacgcgcccttccaggcctgcagatctgactgcactcgccaaggagctgcgggaattaagaatcgaagagaccaaccgtcccatgaagaaagtaactgactacagctcctcatcagaagaaagtgagtcctccgaggaagaggaggaagacggagagtccgaaacccatgacggcacagtagctgtaagcgatattcccagactaatccctacaggggcaccgggttcgaatgaacagtacaatgtcggcatggtgggcacccatggactggagacctcacacgccgattcattcagtggtagcatctctagggaagggactctgatgattagagagacatcaggagaaaaaaagagatcaggtcatagtgattctaacgggtttgcaggtcacataaatctgcctgatctggtgcagcaatctcattcccccgctggaacccctacagagggattagggagggtttccactcatagccaagagatggatagcggcacggaatatggcatgggatcctctaccaaagcctcatttacgcccttcgtggatccgcgagtctatcagacatcacctacagacgaggatgaggaagacgaggagagttctgccgctgctctttttaccagtgagttacttaggcaagaacaagccaaactcaatgaggctaggaagatcagtgttgtgaatgtcaatccaacaaacattcgcccacactctgatacccccgagattcgaaaatacaagaagagattcaacagcgagatcttgtgtgctgccctctggggggtgaatctgctcgtaggaaccgagaacggccttatgctccttgaccggagcgggcagggaaaggtgtacaatttaattaaccggcgacgcttccagcaaatggacgtgttagagggattgaatgttctcgttaccattagcgggaagaaaaataaactgagagtctattacttgtcttggctgaggaataggatcctgcacaatgaccctgaagtagaaaagaagcaaggttggatcacagtcggtgatcttgagggatgcatccactataaggtagtgaagtacgaacgcattaagttcttagtgatagccctgaagaacgcggtggagatctatgcatgggcgccaaagccttatcataagttcatggcattcaaaagctttgcggacctgcaacataagcctcttctcgttgatttgactgtcgaggagggccagaggttgaaagttatcttcgggtcccataccggcttccacgtaattgacgtagatagcggcaacagctacgacatttatatccccagtcacatccagggcaatattacgccccacgctattgttattcttcctaaaactgacggaatggagatgttagtttgctacgaggacgaaggagtttacgtgaatacctatgggaggattaccaaggatgtcgtacttcaatggggcgaaatgcccactagcgtcgcctatattcacagtaatcagatcatgggttggggagagaaggctatagagattagaagcgtcgaaaccggccatttggatggtgtgttcatgcataagagggcccagaggctaaagttcctatgcgaacgcaacgataaggtcttctttgccagtgtgcgctcagggggtagtagccaggtcttcttcatgaccctgaacaggaactcaatgatgaactggtag

SEQ ID NO: 244265 - DNA, 3807 bp, Artificial Sequence
  Description of Artificial Sequence: Synthetic coding sequence
atggccagtgatagcccggcaaggtccctggacgaaatcgatctgagcgctctccgcgatccggctgggatttttgaactggtggagctggttgggaacggtacatacgggcaggtatacaagggtcgacacgtgaaaactggccaacttgcagcaatcaaagtgatggacgttacgggagacgaggaagaggagattaagcaagaaatcaatatgctgaaaaaatactcacatcaccgcaatatcgctacatactacggcgcttttatcaaaaagaatccacctgggatggacgaccagctgtggttagtgatggaattttgtggcgcaggtagtgtgacggatctaatcaagaacactaaaggaaacaccctgaaagaagaatggatcgcctatatatgcagggagatactccggggtctctctcatctgcaccaacacaaggtgatacatcgggatattaagggacagaatgtgctgctgacggagaacgccgaggtcaagctcgtcgatttcggtgtctctgcccaactcgataggaccgtgggacgccgtaatacattcatcggcactccctactggatggctcctgaggtcattgcctgtgatgagaatcctgacgctacttatgatttcaaatccgatctatggagcctggggattactgcaattgaaatggccgaaggagctcccccattgtgtgacatgcaccccatgagagcactgtttctgatccccagaaacccagcccctcggcttaagagtaagaagtggtctaagaagttccaatcgttcatcgaatcttgtctggttaagaatcacagtcaaagaccagctaccgagcagcttatgaaacaccctttcatccgggaccaacccaatgagcggcaggtgagaattcagcttaaggaccatatcgatcgtacaaagaagaagaggggagaaaaagacgaaacagagtatgaatattctggatccgaggaagaggaagaggagaacgatagtggcgagccttcttcgatcctgaatcttcctggggaaagcactctcagacgcgactttttgcggttgcagctggccaacaaggagcgctccgaggctctgagacgccagcagctggagcaacagcagagggaaaatgaggaacacaagcgccagctgctcgctgagagacagaaaagaattgaagagcagaaagagcagcgaagaaggctggaggaacagcaacgccgagaaaaagagctgcgaaagcagcaagagcgcgagcagagacggcattatgaagaacagatgagaagagaagaggagcgaaggagagctgagcacgaacaggagtataagagaaagcagctggaagaacagaggcaggccgagcgccttcagcgccagctcaagcaggagcgggattacctggttagcctgcagcaccagcgccaagaacagcggcctgtagagaaaaaacccctataccactacaaagaaggcatgtccccatcggagaagcctgcatgggccaaggaaatcccccaccttgtcgcagtcaagtctcaggggcctgcactgaccgctagtcagtccgttcatgaacagccaacgaaagggctgtctgggtttcaggaggctctgaacgtgacctctcacagggtggagatgcccagacagaactctgatccaacaagtgagaaccctccactccccacaaggatagagaaatttgacaggtccagctggctgaggcaggaggaggatatccccccaaaggttcctcagcgaaccactagtattagtcctgccctcgccagaaagaattcaccgggaaacgggagtgcgctcggcccaagacttggatcccagccaatacgcgcatctaatccagatctacgccgaaccgagcccattctggaatcaccgctgcagcggacaagtagcggctcaagctcaagctcctcgaccccctcaagccagccctcttcgcagggcggaagtcaaccgggatcacaggccggaagcagtgaaagaacaagggtccgggcaaattccaaatcggaagggtcaccagtgttaccacacgaaccagctaaggtgaagccggaagaatcacgagacattacgagaccttcccggccagctgacctcactgcactggccaaagagctgagggagttgagaatcgaggagaccaacagacctatgaagaaggtaaccgattattcctcctctagcgaagagagcgaaagcagtgaagaggaagaagaagatggggaatccgaaacgcacgacggtacagtggcggtgagcgacatcccacgcttgattcctaccggcgctcccggaagcaatgagcagtacaatgtggggatggtgggaacgcatgggttagagacctctcacgcagattcattcagtggctcgatttccagagagggaaccctgatgatcagggaaacctccggggaaaaaaagcggagtggccactctgacagcaacggatttgcgggtcacattaatcttcctgatctggtgcaacagtcccattcccctgccggaacgcctactgagggccttggcagagtctcaacgcacagtcaggaaatggactccggcacagagtacggcatgggcagctctacgaaggcatcttttaccccgttcgtggatccgagggtctatcagacatcacccacggacgaggacgaagaagacgaggaatcttccgccgctgccctgtttaccagtgagttactgaggcaggaacaggctaaactcaatgaagcgagaaaaatcagtgtggtcaacgttaatccgacgaacattcgcccacattctgacacgccagagatacgaaagtacaaaaagagatttaatagcgagatactatgtgcggctttgtggggagtgaacctccttgtgggcaccgagaatggtctgatgctcctggaccggagtgggcaaggcaaagtctataatctcatcaatagacgcagattccagcaaatggatgtgctggaggggctaaatgtgctggtaacaatcagcggcaagaagaataaacttagagtgtactatttgtcgtggctgagaaaccgcatactgcataacgatccagaggtggaaaagaagcaggggtggataacggtgggcgacctagagggatgtatccactacaaggttgtgaaatacgaaaggattaagtttctcgtaatcgctttgaaaaacgcggtagagatctacgcatgggcccctaaaccctaccataaattcatggcattcaagagcttcgccgatcttcagcacaagccccttttggtagatctgacagtggaggaggggcagcgtctaaaagtgatattcggcagtcatacgggcttccatgttatagacgtcgacagcggaaactcatatgatatctacatcccatctcatatacagggaaacataactccccatgcaatagtcatccttccaaaaactgatggtatggagatgctggtgtgctatgaagacgagggagtgtatgtgaacacctatggtagaataacaaaagacgtggtgctgcagtggggcgaaatgccgaccagcgtggcctacatacacagtaatcagattatgggctggggtgagaaagctattgaaattaggtccgtggaaacagggcaccttgacggggtctttatgcataagagggctcagaggctgaaatttttgtgcgagcgcaacgataaagtgttctttgcatctgtgagaagcggcggaagtagccaagttttcttcatgaccttaaacagaaattctatgatgaactggtag

SEQ ID NO: 244266 - DNA, 3918 bp, Artificial Sequence
  Description of Artificial Sequence: Synthetic coding sequence
atggcctcagactctcctgccaggagtttggatgaaatagatcttagtgctcttagggatcccgctggaatttttgaactggttgagttagtgggaaacggcacttacggccaggtgtacaaaggcaggcatgtgaaaactggtcaattggctgcaatcaaggttatggatgtcactggagacgaggaagaggaaatcaagcaagagattaacatgttgaaaaaatacagtcaccatagaaacatcgccacctattacggtgcattcattaagaaaaaccctccaggcatggatgatcagttgtggttggtgatggagttctgtggcgctgggagcgtgacagacctcatcaagaacacaaagggaaatacactgaaagaggagtggatcgcttatatttgcagggaaatccttcgaggtctcagccatttacatcagcacaaagtgattcatagagacataaagggacagaacgtcttactaaccgaaaatgcggaagtaaagctcgtggattttggagtgagcgctcagctcgaccgtactgtcgggagacgcaacaccttcatcggcacaccatattggatggccccagaggtcatagcctgcgatgagaaccctgacgctacgtacgactttaagtctgatttgtggagtctaggcatcacagccatcgagatggcagagggcgcacctcccttgtgcgacatgcaccctatgagagccctattcctgatccctcggaaccctgcccctcgcctgaagtctaaaaagtggtctaaaaagttccaatcctttatagaatcttgtttagtcaaaaaccacagtcagaggccggctaccgaacagctgatgaagcaccccttcatcagagaccaacccaatgaacgccaggtgcgcattcagctcaaggaccacattgatagaaccaagaaaaagcgaggggagaaagatgagactgagtatgaatatagcggcagtgaggaagaggaagaagaaaacgactcgggagagccgagcagcattctgaacctgcctggagaatctactctgaggcgcgatttcctccgcctgcagctggcaaacaaggagaggagcgaggcgctcaggagacagcagcttgagcagcagcagagagaaaacgaagagcacaagcggcagctcctcgccgagaggcagaagaggattgaggaacagaaagagcagagacggagactcgaggaacagcagaggagggagaaggaactgagaaaacaacaagaacgtgagcagcgcagacactacgaggaacaaatgcgaagagaggaagagagaagaagagccgagcacgaacaggaatatatcagacggcagctggaggaagagcagcgtcaactagaaatcctgcagcagcaactgctacatgagcaggccctcttgctcgagtacaagcgtaaacaactggaagagcagaggcaggcagaacggctccaaaggcagctaaaacaggagagagactacctcgtctctctgcagcaccagcgtcaagaacaacgacccgtggagaagaagccattgtatcactacaaagaaggaatgagtccgagcgagaaacctgcctgggctaaggagatcccacatctggtagccgtgaaatcccaagggccagccttgaccgctagccagagtgtccatgaacagcccaccaaggggctgtctggtttccaggaggcgctcaatgtgacatcacacagagtcgagatgccaagacagaactcagacccaaccagcgagaatccgccactgccaaccaggattgaaaagtttgataggagttcatggctcaggcaagaagaggacattccgccaaaagttcctcagcggaccaccagcatcagccctgcccttgccaggaagaacagcccaggaaatggatccgcgctgggcccacgcctagggagccagcccatccgggctagtaatcctgacttgcggaggactgagcctattctggaaagccccctccagcgcacatcatctggcagtagtagttcctcctccacgccgtcatcccaaccatcaagccagggaggatctcagccagggtcacaagccggttccagtgagcggacccgggtaagagccaacagcaagtccgaaggaagcccggttttgccccacgagcccgcaaaggtcaagcctgaagaatcgcgtgacataactcggcctagtagacccgcaagctataaaaaggctatagatgaggatctgactgcactggctaaagagctgcgcgagctgaggatagaggaaacgaaccgtcccatgaaaaaagtcacggactactcgagttcatccgaggaatccgaatccagtgaggaagaggaggaggatggagagtccgaaacccacgacggcaccgttgcggtctcagacatccctaggctgatccccaccggagcacctggctctaatgaacaatacaatgtcggcatggtcggcacacatggactagaaacctcccatgctgatagcttctctggatcaattagcagggaggggaccttgatgataagggaaacatctggagagaagaagaggagcgggcacagcgattcaaacgggttcgccggacacataaacctccctgatcttgtacagcagtcacatagccccgctggcactccgaccgagggattaggcagagtgagcacccatagccaggagatggactccgggactgagtatgggatgggctcaagcactaaggcctcatttaccccttttgtggaccccagagtgtatcagacaagccctacagacgaggacgaagaagatgaagaatcttctgcagctgccctgtttacaagcgagctgctccgacaggagcaggctaagctgaacgaggctagaaagatctccgtcgttaacgttaacccaacgaacatcagacctcactcagatacccctgagattcgcaagtacaagaagaggttcaactctgaaatcctctgcgctgccctgtggggagttaacctgctggtgggaactgaaaatggtttgatgctgcttgaccggagcggacagggaaaggtgtataatctgatcaacagacgccgtttccagcagatggatgtgcttgaaggattaaacgtgcttgtgaccattagcggtaagaagaacaaactgcgagtgtactacctgtcatggctgcgcaacagaattctgcacaatgaccctgaggtggagaagaagcaggggtggatcaccgtcggtgatcttgaagggtgtattcactataaagttgtcaagtatgaaaggatcaagtttttggttatcgcactgaaaaacgccgtggagatatatgcctgggccccaaaaccgtatcacaagttcatggctttcaaaagttttgccgacctccagcacaaaccgctcctggtcgacctgactgtagaagaggggcagaggctgaaggtgatcttcgggtcacacaccgggttccacgtgatagatgttgactcgggaaattcatacgacatttatattccctcccacatccagggcaacatcaccccacacgccatcgttattctccccaaaacagacggaatggagatgctggtttgttatgaggacgaaggcgtctacgtgaatacgtacgggagaatcactaaagatgtggtgctccagtggggcgaaatgcctacctcagtcgcctatatccattcaaatcagattatggggtggggcgaaaaggctattgagattcggtccgtcgagaccggacatttagatggagtattcatgcacaaacgcgcacagaggctgaagttcctttgtgagcgaaatgataaagtcttctttgcgagtgtgagaagcggcggatcatcgcaggtctttttcatgacccttaaccggaattcaatgatgaattggtag

SEQ ID NO: 244267 - DNA, 3939 bp, Artificial Sequence
  Description of Artificial Sequence: Synthetic coding sequence
atggcctccgattcccccgctagatctctggacgagattgatctctctgcactacgcgaccctgctgggattttcgagctggtcgagcttgttggaaatgggacatatggccaagtgtataaaggacggcatgtgaagacaggacagcttgctgccataaaggtgatggacgtgaccggggatgaggaagaggagataaaacaggagattaacatgctgaaaaaatatagccatcatcgcaacatcgctacctactacggagccttcattaagaaaaatcccccaggcatggatgaccaactgtggctggttatggaattttgtggagcagggtctgtgactgatttaattaaaaacacaaagggtaatactttaaaggaagagtggattgcatacatttgtcgggagatactgaggggcctgtctcacttgcatcagcataaggtgatccacagagacattaaaggacagaacgttctattaacggagaatgctgaggtgaagatagtggactttggcgtgagtgcccaactggaccgtaccgtcggtaggcgcaacactttcatcgggacaccatactggatggccccagaagtgattgcatgtgacgaaaaccccgacgccacgtacgatttcaaatccgatctgtggtccctggggatcactgctatagagatggccgaaggcgctccccctctgtgtgacatgcacccgatgagggccttatttcttatcccccgaaatccagcccctcggctgaaaagcaagaaatggagcaaaaaatttcagtcatttattgagagctgtcttgtcaaaaatcattcccaaaggcctgctacggagcaactgatgaagcacccttttatccgtgaccagcccaatgagcgtcaggtgagaattcagctcaaggatcacatcgatcgtaccaagaaaaaacggggtgagaaggacgagacagagtacgagtactccggatctgaagaagaagaagaggagaacgactccggggagccctccagcattttgaacctgcctggggaatcaaccctccggagggactttttacgtctgcagttggccaataaggaaagaagcgaggccctacgtcggcagcaactcgaacagcagcaacgggagaatgaagaacataaaagacagctacttgcagagcgccagaagcggattgaggaacaaaaggagcagcgacgccgtctcgaggaacagcagagacgggaaaaagaactcagaaaacagcaggagcgtgagcagcggagacattatgaggagcagatgaggcgcgaagaggagaggcggagagctgaacatgaacaggagtatattcggcgacagctcgaggaggagcagcgccagctagaaatccttcaacagcaattacttcacgagcaggccctcctccttgagtataagcgcaagcagcttgaagagcagcgtcaggctgagcgccttcagagacagctcaaacaggagcgggactaccttgtaagcctccaacaccagcggcaggaacagagacccgtcgagaaaaaacccctctaccattataaggagggaatgtccccatccgaaaaaccggcttgggcgaaggagatcccccatttggtggcagttaagagtcagggacccgcactgaccgcatctcaatcagtgcacgaacagccgacaaagggcttatcagggttccaagaggctctgaacgtcaccagccacagagtggaaatgccccgtcagaattctgatcccacatcggagaaccctccacttcccacccgtattgagaagttcgaccgttcctcctggctgaggcaggaagaagatattccacccaaggtgcctcagcggacaactagcatctcccccgcactcgcgagaaaaaatagtcccggaaatggcagcgccctcggccctcgcttgggctcgcaaccgattagagcatccaatcccgatctgcgcaggacagaacctattctcgaatcaccattgcagcggacgagcagcggcagcagttcttcgagttctacgcctagtagccagccctcgtcccagggcggatcacagccaggtagccaagccggttcaagtgaacgtacaagagtaagggccaacagcaagtcagaagggagcccagttctccctcatgagccggctaaggtcaagccggaggagtcgcgcgacatcacacgaccttctcgaccagccgtatccgcattcctgtcgaaaagctttgaattactgatctaccaggacctgactgcgttggcgaaggagttgcgggagctgcgcatagaagagacgaatagacctatgaaaaaagtaaccgattacagcagctcttcagaggaatccgagtctagtgaagaggaggaggaggacggagagtctgaaacccacgatggcacagtcgctgtctccgatattccaagactgataccaaccggagctcccggtagtaatgagcaatacaacgtgggaatggtaggaacacacgggctggagacttctcacgcagatagctttagcgggtccatctcgcgcgaaggcaccctcatgatccgcgaaacctccggggaaaaaaaacgcagcggacattcagactctaatgggtttgcgggacacatcaacctccccgaccttgtgcagcaatcacattcaccagcaggaaccccgaccgagggtctgggtcgggtttcaactcactcccaagaaatggattcaggcactgaatacggaatgggctcttcaacaaaagccagctttactcctttcgtagacccacgtgtgtatcagacttctccaaccgacgaggatgaagaagatgaggagtccagcgccgcagcgctttttacgtctgagcttctgcggcaggagcaagcaaaattgaatgaggccaggaagatcagcgttgttaatgttaacccaaccaatattagacctcattcagatacccctgaaattcggaagtacaaaaagagatttaatagcgaaatcctgtgcgctgccttgtggggagtgaacctactcgtcgggactgaaaacggcctgatgctcctggaccgcagcggccagggcaaggtgtacaaccttatcaaccggaggagattccagcagatggatgtgttagaggggttgaacgtcctggttacaatttcaggaaagaagaacaaactccgggtctattacctgtcctggttgcggaataggattctgcacaatgacccggaagtcgaaaaaaagcaaggctggatcactgttggtgatttggagggctgcattcattacaaagtggtcaaatacgaacggatcaagttcctagtgatcgccctgaagaatgcagtggagatatacgcctgggctcccaaaccttaccataagtttatggcctttaagtccttcgctgatctgcagcacaagccactgttggtcgatttgacagttgaagaagggcagcgactcaaagtgatcttcgggagccataccgggttccatgtaatcgacgtggactccggtaacagttacgacatctatatccccagccacatccagggtaacatcaccccccacgccatagtgatcctgcctaaaaccgacggaatggagatgctcgtctgctatgaggatgaaggggtctatgttaacacatatggccgtataacaaaggacgtggtcctgcagtggggggagatgccgacctcagtcgcatatatccactccaatcagattatggggtggggcgagaaagccatcgaaatcagatcagtagaaaccgggcatctggatggagtgttcatgcataagcgcgctcagcgcctgaagttcctctgtgaacgcaatgataaggttttcttcgcatccgtccgaagcggtggttccagccaggtgttttttatgaccctcaatagaaactcaatgatgaattggtag

SEQ ID NO: 244268 - DNA, 1725 bp, Artificial Sequence
  Description of Artificial Sequence: Synthetic coding sequence
atgccccctcagctgcaggaaaccagaatgaataggagcatccccgtggaagtcgatgagagtgagccttaccctagccaactcctgaaacctatccccgagtattcacctgaggaagaatctgagccccctgcacccaatatcaggaacatggccccaaacagtttgagtgcccctacgatgctccataacagcagtggagatttctcccaggcccattccaccttgaagttggctaatcaccaaagacctgttagccgacaagttacgtgcctacgtacccaagtcctggaggactccgaagactccttctgtagacgccatcccggtctgggcaaagccttcccctcggggtgtagcgctgtcagcgaacctgcttccgagagcgtggttggagcattgcccgcagagcatcagttcagcttcatggagaaacggaatcaatggttggtcagtcagctctcagcagccagccctgatactggtcacgattctgacaaatctgaccagagcctccccaatgcatcggcagattcactcgggggatcacaggagatggttcagcgtcctcagccacaccggaatagggcaggcctcgacttaccaactatagatacagggtatgatagtcagccccaagacgtgctgggtatcaggcagctggaacgccctctgcctttgacatctgtctgttacccacaggatttgccacggcctttgcgttctagagagttcccacaatttgagcctcagcgttaccccgcttgcgcccagatgcttccccctaacctgagcccacatgcaccctggaactatcactatcactgccctgggagccccgaccatcaggtcccgtacggacacgactacccccgagccgcatatcagcaagttattcagcctgctttgcctggacaacccctaccaggtgcaagtgtgcggggacttcatcctgtccagaaggtgatcctgaattacccttctccgtgggatcacgaagagcgcccagctcaacgcgattgctcattccccggacttccaaggcaccaggaccagcctcaccaccagccccctaacagagcgggtgcccctggggaaagcctcgagtgccccgctgagctcagacctcaagtccctcaacccccttcacccgctgcagtccctaggccaccgagcaatcctcctgcacggggaacgctcaaaaccagtaacttaccagaggagctaagaaaagttttcatcacatatagcatggacaccgctatggaggtcgtcaagtttgtgaacttcctgttggttaatggctttcaaactgccatcgatatcttcgaagaccgcattaggggcatcgatatcattaaatggatggagcgctatttgagagataaaacagtgatgataatcgtggccatatcacccaaatataagcaggatgtggagggagcagaatcacagctggatgaagatgagcatggtctccacaccaaatacattcaccggatgatgcaaatcgagtttatcaaacagggctcaatgaacttcaggtttatcccagtgttgttcccgaatgccaaaaaggagcacgtgcctacatggcttcagaatactcatgtgtattcctggcccaaaaacaagaaaaacatcctgcttagactgctgcgggaagaagagtatgttgctcctcccaggggacctctgcctacccttcaagtagtgccactgtag

SEQ ID NO: 244269 - DNA, 1695 bp, Artificial Sequence
  Description of Artificial Sequence: Synthetic coding sequence
atgaatcgatctattcccgtggaggtggacgagagcgagccttacccttcccagcttctgaaacccattccagaatactcacctgaagaggagagtgagcccccagcgcctaacattcgaaatatggcgcctaatagcctttccgcaccgaccatgcttcataactcttctggagatttttcccaggcacattcgacccttaagctcgccaaccatcagagacccgtatccaggcaggtcacatgcctccggactcaagtactggaggattctgaagattctttctgtcggaggcaccctgggttaggcaaggcattcccgtctgggtgtagcgccgtaagtgagcccgctagcgaatcagtggtgggagccctgcccgctgagcatcaattctctttcatggaaaaaagaaatcagtggcttgtgagtcagctctctgcagcttcgcccgataccggtcacgatagcgataagtccgaccagagcctgcccaacgcctccgccgatagcctcggaggctcacaggaaatggttcagcgacctcagccacatcgcaaccgtgcgggattggatcttcccaccatcgataccggctatgattcccaaccacaagacgtccttgggatacgacagctagagaggccactgcccctcacgagtgtttgctacccccaggacctaccccgacccctgagatccagagagtttccacagttcgaaccccagcgatatcccgcttgcgctcagatgctgccacctaaccttagtccccacgcaccgtggaattatcattatcactgccccggaagtcccgatcaccaggttccatacggacacgattaccccagggcggcttatcagcaggtgatacaacctgccttgcctgggcagcctctccccggagcctctgtccgaggccttcatcccgtacaaaaggtgatcttaaactaccccagcccctgggaccatgaggagcgtccagcacagagagactgttccttcccaggattgcccagacatcaggaccagccacatcaccagcctccgaaccgagctggcgctcctggcgagagcctcgaatgtcctgccgaattgcgaccacaggtgcctcagcccccatcacctgctgcagtgcctagacccccaagcaacccccctgccaggggtaccctcaagaccagtaacctgccagaggagttacggaaggtattcatcacttattccatggatactgctatggaggtagtgaagttcgtaaatttcctgttggttaatggatttcagactgcaatcgacatctttgaagaccgtatcaggggcattgacattataaaatggatggagcgctatctgcgggacacagttatgatcatagtggcaatcagtcccaagtataagcaggacgtcgaaggcgcagagtcccagctcgacgaggatgaacatggcctccatactaaatatattcaccgcatgatgcagatcgaatttattaaacaggggtccatgaacttccgcttcatccccgtgctcttccccaatgccaagaaggaacatgtgcctacctggctgcaaaacactcacgtttactcgtggcccaagaacaaaaaaaatatactcctgcgtctgctccgggaggaggaatatgtcgcccctccacgaggccctcttcctacactacaagtggtccccttatag

SEQ ID NO: 244270 - DNA, 1698 bp, Artificial Sequence
  Description of Artificial Sequence: Synthetic coding sequence
atgaatcggtccatccccgtggaagtggatgaaagcgagccatacccaagccagctgcttaaaccgataccagagtacagtcctgaggaggagtctgaaccgcctgccccaaatatccgcaacatggctcctaactccctgtccgctcctacaatgctccataattctagtggggatttctcacaggctcattcaactttaaagcttgcaaatcatcagagacccgtcagcagacaagtcacttgccttagaacacaagtcctcgaggacagcgaggactccttttgccggcgtcaccccggtctcgggaaggcttttccatcggggtgctctgcagtaagtgagcccgcatctgagagcgttgtaggggcactgcctgccgaacatcagttttcattcatggagaaaagaaatcagtggctggtatctcaactgtcagcggcatccccagacaccgggcacgactcagacaagtccgatcagtcactgccgaatgcatcagccgatagcctggggggttctcaggagatggttcaacgccctcaaccgcataggaaccgagctggtttggacctgcccacgattgacacgggatacgactctcaacctcaagacgtgctcggaattagacagctggagcggccattgcccctcacctcagtgtgctatccacaggacctgcccaggcccttgcgctcaagagaattcccacagtttgagccacagagatatccagcctgtgcccaaatgctacccccaaatctatcccctcatgccccttggaattaccactatcactgtcctggatctcccgatcatcaggtcccttacgggcacgattatccacgagccgcataccaacaggttattcagcctgctctgccgggacagcccctgcctggcgcatccgtccggggtttacaccctgtccagaaagtgatcctgaattacccaagcccctgggaccacgaggaacggccagcccagagggactgcagttttcccggactgcctcggcatcaggaccagccacaccatcaacctcccaaccgggctggagctccaggagagtctctggagtgcccggcagaattgcgtcctcaagtaccgcagcccccatcaccagccgctgtgccaaggcccccttctaatcccccagcccgaggcaccctcaaaacctcaaatctaccagaggagctgaggaaagtgttcattacatactccatggatacagctatggaagttgttaaatttgtgaattttttgcttgtcaacggctttcaaaccgctattgacattttcgaggaccgcatcagaggtatcgatatcataaagtggatggagaggtacctgcgcgataaaactgttatgatcatcgtggctatcagccccaagtacaaacaggatgtggaaggggctgaatcccaactggatgaggacgaacacgggctccacacaaaatacattcatcggatgatgcagatcgagttcattaaacagggcagcatgaacttccgctttattcctgtgctgttcccaaatgctaagaaagaacatgtgccaacctggttgcagaacacccacgtctatagctggcccaagaataagaaaaacatcctactgagactcctgcgtgaagaggagtatgtggcccctccaagagggcctctgcccacactgcaggtggtgcctctgtag

SEQ ID NO: 244271 - DNA, 1725 bp, Artificial Sequence
  Description of Artificial Sequence: Synthetic coding sequence
atggcccctcaattggaggagacacgcatgaatcgctccatacccgtcgaggtcgatgaaagtgagccatacccttcccaacttctgaagccaatccctgagtactctcccgaagaagagagcgagccgccagccccaaatataaggaacatggctcccaattcactatccgctcctacaatgctccataatagctctggcgatttctcgcaagcacactccacattaaaactggccaaccatcagcgtcctgtctccaggcaggtaacgtgcctccgcacacaggtgttggaggattccgaggactccttctgtaggcgccaccctggcttgggcaaggcctttccttcaggatgctcggccgtaagcgagcccgcatcagagtctgtcgtgggcgctcttccagctgaacaccagttcagcttcatggaaaagcggaatcagtggttggtaagtcagctgtccgccgctagtcccgataccgggcacgactctgataagagtgaccaatcactgcctaatgcgtcggctgattcattagggggaagccaggaaatggtgcaacggccacagccccaccgcaacagggccggtctggacctgcccactattgacaccgggtatgacagccagccccaagacgtgctggggattagacaacttgagcggcctctgccactgacttcagtgtgctatccccaggatctcccacggccacttagatctcgggaatttccgcagttcgaacctcaaagatacccggcatgtgcccaaatgctgccacccaatcttagtccccacgcaccgtggaattaccactatcattgtcccggatcgccggaccatcaagtcccttacggccatgattaccctagagccgcatatcaacaggttatccaacccgctctcccaggccagccactgcccggagctagcgtaagagggctgcatcccgtccagaaggtgatactgaactatcccagtccatgggatcacgaggaacggccagcccagagagactgttcttttcccggactgccgagacaccaggatcagccccaccaccagccgcctaacagagctggcgctcccggagaaagcctggagtgtccagccgagctgaggcctcaggtcccacagcctccaagccccgcagccgtccctcgcccaccctccaacccccctgccaggggcacgctcaagacttccaacctgcccgaggagttacggaaggtgttcattacatactccatggacacagccatggaggtcgtgaagtttgtgaattttttacttgttaacggctttcagacagccatcgacatatttgaggacaggattaggggcatcgatattataaaatggatggagcgctacctccgggacaagacagtgatgattattgtcgcaatatccccaaaatacaaacaggatgttgaaggagctgaatcccaactggatgaggatgagcatggcctccataccaagtacatccacagaatgatgcagattgaattcatcaagcagggatccatgaatttcaggttcatacccgttctcttccccaacgctaaaaaagaacacgtcccaacatggcttcaaaatacccatgtgtatagctggccaaagaacaagaagaacatactccttcgactacttagagaggaggaatatgtggcacccccacggggtccgctgcctacactgcaggtggtgcccctttag

SEQ ID NO: 244272 - DNA, 462 bp, Artificial Sequence
  Description of Artificial Sequence: Synthetic coding sequence
atggaggtggttaaatttgtgaatttcctgctagttaacgggtttcagacagctatcgatatttttgaagacagaattagggggatcgacattattaagtggatggagcggtacctgcgagataaaacggtgatgataatagtagcaatcagtccaaagtataagcaggatgttgagggtgcggagtcccagctggatgaagacgaacatggactgcataccaaatacattcaccggatgatgcaaattgagttcatcaaacaggggtcgatgaacttcaggtttatccccgtgctgttccctaacgcaaagaaagagcatgtgcccacgtggctgcaaaatacccacgtttattcttggccgaagaacaagaagaacatcctgctgagactgctgagggaggaggagtatgtggcaccaccccgagggcctttacccaccttacaggtagtgcccctgtag

SEQ ID NO: 244273 - DNA, 330 bp, Artificial Sequence
  Description of Artificial Sequence: Synthetic coding sequence
atgattattgtggctatttcccccaagtacaaacaggatgtggaaggcgcagagagccagctggatgaagacgagcacggcttgcacactaagtatatccatcggatgatgcagatcgagtttatcaaacagggatccatgaattttcgcttcatccctgtgctgtttccaaacgctaaaaaggagcacgtccccacctggcttcagaatactcacgtgtattcatggcctaagaacaaaaaaaatattctcctacggctgctccgagaagaagagtacgtggcccctccaaggggccctctgccaacgcttcaagtggtccccctttag

SEQ ID NO: 244274 - DNA, 1596 bp, Artificial Sequence
  Description of Artificial Sequence: Synthetic coding sequence
atgatatcacccgacccccgtccaagcccagggctggcccgatgggccgagtcttatgaagccaaatgtgagcgccgtcaggaaattcgcgaaagccggagatgccgccctaacgtgactacttgcagacaggttggaaagactctccggatccagcaacgcgagcaactgcagagagccagactgcagcaatttttcagaaggcgaaacctagagctggaggagaaggggaaggcccagcatccccaggccagggaacagggacccagcagacggccaggacaagtcactgggacttccagtgaggtgtttcccgcacagcacccaccgccaagcggaatctgccgtgacctgtcagaccatctgtcatcccaggcagggggactcccgccacaggacacaccgataaagaaaccaccgaaacatcaccgcggaacacagacgaaggcggagggacccacaatcaaaaacgacgcttcccaacagacgaattatggcgttgccgtgctggacaaagagatcatccagctgtcagactatctcaaggaggccctgcagcgggagctggtgctgaagcagaagatggtaattctgcaggatttgttgagcacactgatccaagcctccgattcgagctggaagggccaactgaatgaagacaagctgaaggggaagttacgatctctggagaatcagctctacacgtgcacccaaaaatactccccctggggtatgaaaaaagtgctgctagagatggaagaccagaaaaattcctatgagcaaaaagctaaagaatcccttcaaaaggtgctggaagagaagatgaacgccgagcagcaactgcaaagcacccagagatcccttgctttggctgagcagaaatgcgaggagtggagatcccaatatgaagcactcaaagaggactggaggacgctgggtacccagcatagagagctggagagccagctgcacgttttgcaatccaaactgcagggggctgattcccgggatctgcaaatgaatcaggctctgcggtttttggaaaacgagcatcagcagctgcaggcaaaaatcgagtgtctccagggtgaccgtgacctttgctcactggatactcaggacctccaggatcagctgaagcgaagcgaagctgagaaattgactctggtgacgcgggtgcagcagcttcaagggctgcttcagaaccaaagcttacaattgcaagaacaggaaaaacttctgaccaagaaagatcaggcgctcccagtgtggtctccaaaaagcttcccaaatgaagttgaaccagaaggcaccggaaaggaaaaggactgggacctgcgcgaccagctgcaaaaaaaaacacttcagctgcaggctaaggagaaagagtgtcgcgagctacacagtgaactggataacttgagtgacgaatacttgtcatgcctccgcaaactgcagcactgccgtgaagagctcaatcaaagtcagcaactgcccccacgcaggcagtgcggtagatggctgcctgtgctaatggtcgtgattgctgctgcccttgccgttttcctggcgaataaggacaatctcatgatctag

SEQ ID NO: 244275 - DNA, 549 bp, Artificial Sequence
  Description of Artificial Sequence: Synthetic coding sequence
atgaaaaaagttcttctagagatggaagaccagaagaatagctatgagcagaaggctaaagaatcccttcagaaggtcctagaagagaagatgaacgccgaacagcagcttcaaagcactcagcgatctttggcccttgctgagcaaaagtgcgaggagtggcgaagtcagtatgaggccctcaaagaagactggaggactctcggaactcagcatcgagagttggagtcccagctccacgtgctccagtctaagctccagggggcagactctcgagacctccagatgaatcaggccctgaggtttcttgagaacgagcatcaacagctccaggcaaaaattgagtgcctgcagggcgatagggacctttgcagcctcgatacacaggatcttcaggaccagctgaagcgaagcgaggccgaaaaattaaccctggtgacccgtgtacagcagctgcagggcctgctgcagaaccaaagtctccagctgcaggagcaggagaagcttctcacaaaaaagggccagcagatatactatcacaagttctag

SEQ ID NO: 244276 - DNA, 1656 bp, Artificial Sequence
  Description of Artificial Sequence: Synthetic coding sequence
atgatatcaccagatcccagacccagccccggtctcgccagatgggcagaaagctatgaagcaaaatgcgaaaggaggcaggagatcagagagtcgaggagatgccggcctaatgttacaacatgccgccaggtcggcaagacgctccgcatccagcagcgggagcagcttcaaagagccagactccagcagttttttaggcgaaggaatctcgagttagaagaaaaagggaaggcacaacatccacaagctagagagcaaggaccctcccgacgaccaggacaggtaactgtcctcaaagaacctctctcctgcgctagaagaatctcatccccaagagagcaggtaaccggcacgtcctccgaggtcttcccagcccagcacccgcctcccagcggtatctgtagagatttatccgatcatttgagctcccaagcaggcggactgccgccacaggacacccctataaagaagccgcctaaacatcaccgcggaacacagactaaggctgaaggtccgacgataaagaatgacgcaagccagcagacgaattacggggtggccgtcctagataaggagatcattcagttgagcgattacttgaaagaggccctgcagagggagctagtcctgaaacaaaagatggtgatcctgcaggatcttctctcaacgttaattcaggcaagtgactcaagttggaaggggcagctgaatgaggacaagctgaaaggtaaactgaggtccttggagaaccagttgtacacatgtactcagaaatattccccttggggaatgaaaaaggtgctgctggagatggaggaccagaaaaattcctatgagcagaaagcaaaagagagcctgcagaaggtcttggaagaaaaaatgaacgctgagcagcagctgcaatccacccagaggtccctggcattggctgagcagaagtgcgaggagtggagatctcaatatgaggcactgaaagaggactggaggacgctgggcacccagcatagggagctggaatctcagctccacgttctgcagtctaagctacagggggctgatagccgcgacctacagatgaatcaggcacttcgatttcttgagaacgaacaccagcaattgcaggccaagattgaatgccttcaaggggaccgagacctgtgtagcttggatactcaggacctgcaagaccagttgaaacgttccgaagccgaaaagctgactttggttacccgcgtccaacagctgcagggccttctgcaaaatcagagtctgcaactccaggagcaagagaagctcctcaccaagaaagaccaggccctgccagtctggagcccgaagtcgtttcctaatgaggtagagcccgaagggacaggtaaagaaaaggattgggatctgcgggatcagttgcagaagaaaaccctgcaactccaggcaaaggaaaaagagtgcagggagcttcactcggagctggataatctgagcgatgaatatctttcatgtctgcgcaagctccagcactgtagggaagagctgaaccagagtcagcagctgcccccaaggaggcagtgtggccgttggcttcctgtattaatggtggtcatcgccgctgcactggctgtgttcctcgccaataaagacaacctcatgatctag

SEQ ID NO: 244277 - DNA, 1656 bp, Artificial Sequence
  Description of Artificial Sequence: Synthetic coding sequence
atgattagcccagacccacgccctagtcctgggctggccaggtgggctgagagctacgaagccaagtgcgagcggcgacaggaaatccgggagagtcggagatgccggccaaatgtaactacctgccggcaagtgggtaagacactgcgtattcaacagcgggagcaactacaacgtgccagactacaacaattctttcgcagaagaaacctggagcttgaagagaagggtaaagcacagcaccctcaggctagggagcagggaccttctagacggccaggacaagtgacagtgctgaaggagcccctttcatgtgcccgaaggattagcagcccccgagaacaggtgactggaacgagctccgaggtgttccctgcccagcaccctcccccaagcggaatctgtcgggatctttccgaccatttatcatcacaggccggtggcttacctccccaggacacacccattaaaaagccaccaaagcaccaccgcggtacgcagaccaaggcagagggcccaactatcaagaatgacgcttcccagcagacaaattatggagtggcagtactggataaagaaattatacagctgagcgattacctgaaggaggccttgcagcgtgagttggttctgaagcagaaaatggtgatactgcaagacctgttgtcaaccctcattcaagcctctgacagcagctggaaaggccagcttaacgaggacaaactgaagggcaaactccggtcacttgaaaaccagttatacacctgtacacagaagtacagcccctggggcatgaagaaggtgctcctggaaatggaggatcagaagaatagctacgagcagaaggctaaggagtctctgcagaaggtactggaagaaaagatgaatgcggagcagcaattgcagtcgacccagagatccctggccctggcggagcagaagtgtgaggagtggagaagtcaatatgaagctttgaaggaggactggcggacgttgggcacccagcatagggagctggaatcccagttgcacgtcctgcagtcaaagctccagggcgctgacagtcgagacctccagatgaaccaggccctgaggtttttggagaacgaacaccaacagctgcaggccaaaatcgaatgtcttcaaggcgaccgtgatctgtgttccctggacactcaggacctgcaggaccagctaaagcgatcagaggctgaaaaactgactctggtgactcgagtgcaacagttgcagggtctcctccagaaccagtcgctacaattgcaagaacaggagaaacttctcaccaagaaggatcaagcactgcccgtctggtcacctaagtcattccctaatgaagttgagccagaagggactgggaaagagaaagattgggacctcagagatcagcttcagaaaaaaacactgcaattgcaggctaaagaaaaagagtgccgggagctccacagcgagctggataatctctctgacgagtacctgtcctgcctccgtaagctgcagcactgcagagaggaactcaaccagtcacagcagctcccccctaggagacagtgcggtaggtggctgcccgttctgatggtggtgatagcagcagcattagcagtgtttttagcaaacaaggataatctgatgatctag

SEQ ID NO: 244278 - DNA, 1596 bp, Artificial Sequence
  Description of Artificial Sequence: Synthetic coding sequence
atgatcagccccgaccccagaccgagtcccggtttggcaagatgggcggagtcctatgaagcgaagtgtgagcgccgacaggagatccgagagtcccgtagatgcagacctaatgtgactacctgtagacaggtcggtaaaacactgcggatccaacaacgagaacagcttcagcgtgccagactgcaacaattttttcggcgtaggaatctggagctcgaggagaaagggaaggcccagcatcctcaagccagagagcagggaccttctaggcgtccaggacaggtcacaggtaccagctctgaagtcttccctgctcagcacccaccccctagtggtatatgcagggacctgagcgaccatttgtcttcacaggccggaggattgcctccacaggacactcccattaagaaacctcccaaacaccaccgtggaacccagacgaaggccgagggcccaacaatcaaaaacgatgcctcccaacagaccaactacggagtggccgtccttgacaaagaaatcatacagctgtccgattacctgaaggaagcactgcagagagagctggtgctgaaacagaaaatggtaatcctgcaagaccttctgagcactcttattcaggcatctgactccagctggaaggggcagcttaacgaggataagctgaagggaaaactacggtcacttgagaatcagttatatacctgcacccagaagtattccccatggggcatgaagaaagttctcctggagatggaggatcaaaaaaactcctacgagcaaaaggccaaagagtctctgcagaaagtcctggaggagaagatgaatgccgaacagcagctccaaagcacccagcgtagcctagcactggccgaacagaaatgtgaagaatggcggtcccagtacgaagcactcaaggaagactggcgcacactgggcacacagcaccgggaacttgagtcccaactccatgtgttacagagcaagctccagggcgctgactctcgagaccttcagatgaatcaggctctgagatttcttgagaacgaacatcagcagcttcaggccaaaattgagtgcctgcagggcgatcgagatctctgcagcttggacactcaagacttacaggatcagctaaaaaggagcgaggcagaaaagttgacactcgtgacaagagtgcaacagctgcagggcttactgcagaatcaaagcctccaactgcaggagcaagagaagctgctgactaagaaagaccaggccctgccagtctggagtcctaaatcttttcccaacgaggtcgaacctgagggtacaggtaaggagaaagattgggacctccgtgatcagttgcagaagaagactctgcagctgcaggctaaagaaaaggagtgccgagaacttcactcagagctggacaatttatcagatgaatacctctcatgccttagaaagctacagcattgtcgcgaggagctcaaccaaagtcagcagttgcccccacggcgacagtgtgggagatggctcccggtcttgatggttgtgattgcagctgccctcgctgtgttcttggcaaataaggataatttgatgatttag

SEQ ID NO: 244279 - DNA, 1215 bp, Artificial Sequence
  Description of Artificial Sequence: Synthetic coding sequence
atgatctctcccgaccctagaccctcacccggtttggccaggtgggcggagagctacgaagctaagtgtgagcggagacaagagatccgggaatcaagacggtgccgcccaaacgtcactacttgccgacaagtggggaagaccctgcgcatccaacagagggagcagctccaaagggccaggctccagcagttcttccgaaggaggaatctcgagctggaggaaaagggcaaagcacagcacccacaggctcgggaacaaggtccaagccggaggcccggtcaagttaccggtacctctagtgaggtgtttcctgcccagcaccctccccctagcggcatttgtcgggacctgtccgatcacctttccagtcaggccggaggcctgccaccccaagacacccctattaagaagcctcctaagcatcaccgaggcactcagactaaagccgagggcccaactatcaagaacgatgcctcccaacaaacaaattacggtgtcgcggtcctggataaggaaattattcagcttagcgattacctcaaagaagcactgcaacgggagttagttttgaaacagaagatggtcattctacaagatttgctgagcaccctgatacaagccagcgacagctcatggaaagggcaactgaacgaagacaaattgaaggggaagctgcggtccttagaaaatcagttatacacctgtacccagaagtacagcccatggggtatgaagaaggtgcttctggagatggaagatcagaaaaactcatatgagcaaaaagcaaaggagtcactccagaaagtgctggaggagaaaatgaatgctgagcaacagctccagtctacacagcggagcctcgccctggccgaacaaaagtgtgaagagtggcgctctcagtacgaggcgctgaaggaagactggagaactctcggtacccagcaccgggaactggaatctcaactgcatgtgttacagtcgaagctgcagggagctgacagtagagatctgcagatgaaccaggctctgagatttctggaaaatgaacatcaacagttgcaggctaaaatcgagtgcctccagggcgatcgcgacttgtgttcattggatacccaggacctgcaggaccaattgaaacgatctgaagcagagaagctgaccttggtgacacgggtccaacaactgcaagaagctgcaggctggactacatag

SEQ ID NO: 244280 - DNA, 963 bp, Artificial Sequence
  Description of Artificial Sequence: Synthetic coding sequence
atgataagtcctgatcctagaccctcaccaggactcgcaaggtgggcagaaagctacgaggctaaatgcgaaagacgtcaggagatacgtgagtctcggcgatgtaggccaaacgtcacaacgtgtcgccaggtggggaagactttgaggatccagcagcgggagcttgaagagaaaggaaaggcccagcatcctcaagccagggaacagggaccatcaaggcgccctggccaggtgacagtgcttaaagagccgttgagctgtgcgagacgcatatcaagtcccagagagcaggtgacaggtactagctccgaggtctttcctgcccagcaccccccaccttccggcatctgccgggacctgtccgaccacctgagttcccaggcagggggtctgcctccacaagacacacccattaaaaaacctccgaagcatcaccgcggaacccaaacaaaggccgagggtccaacaataaagaatgatgccagtcagcaaacaaactacggcgttgccgtgctggacaaggaaatcatccagttgagtgattacctgaaagaggccctgcagcgggagcttgttttgaagcagaagatggtgattctgcaggatctgttgagcaccctgattcaggcatctgactcctcttggaagggccagctcaatgaggataaacttaagggcaagttgaggtccttggagaatcaattatatacctgtacccaaaaatatagcccatgggggatgaaaaaggtacttctcgagatggaggaccagaagaacagctatgaacagaaggcaaaagagagcctgcagaaagtgctggaagagaaaatgaacgcagaacaacaactacaatccacccaggtgtgggggtgccatatcgatatgggactcggaacaccaggtagcctgggcaacaagggcagtcagttacataattccctggagccatcacccctttag

SEQ ID NO: 244281 - DNA, 81 bp, Artificial Sequence
  Description of Artificial Sequence: Synthetic coding sequence
atgatttcccccgaccccagaccaagccccggactggcccgatgggccgaaagctatgaagccaagtgcgagcgcagatag

SEQ ID NO: 244282 - DNA, 1671 bp, Artificial Sequence
  Description of Artificial Sequence: Synthetic coding sequence
atgcaaaagttcatcgaggcggattattatgagctggactggtactatgaggaatgctctgatgtgctctgcgccgaacgcgtagggcagatgactaaaacttataatgatattgacgctgtcacccgactgctggaggagaaggagagagatctggagctagccgctcgaattggccagtcactgctgaagaaaaacaaaactctgactgagaggaacgagcttctggaggagcaggtggaacacatccgcgaggaggttagccagcttcgccacgagttgtcaatgaaagacgaactgctgcagttctacacttctgcggcagaagaatcggagccagaaagtgtctgcagcacccccttaaagagaaatgagtcttcctcaagtgtacagaactactttcacctagatagtctccagaagaagttgaaggatctggaagaggagaatgttgttctccgctctgaagctagccaactaaaaactgagaccattacgtacgaggaaaaggagcagcagctcgtgaatgactgtgtaaaggagctgagggatgctaatgtgcaaatcgccagcatctctgaggagttagccaaaaagacagaggatgctgccaggcagcaggaggagattactcacctgctgtcccagatcgtggatctccagaaaaaggcaaaggcttgcgcggtggaaaacgaagaactcgttcagcacctgggagcggcaaaggatgctcagaggcaacttaccgctgagctcagagaactggaggacaaatatgccgaatgtatggaaatgctacacgaagcccaggaagaactcaaaaacctgcgcaacaagaccatgcccaacacaaccagtcggagataccactctctgggactctttcctatggattcactcgccgctgaaatcgaaggtacaatgaggaaggagcttcagttagaagaagctgagtcccctgacatcactcatcagaaacgtgtatttgagacagtaaggaacattaaccaggtggtgaagcaacgctcgctgactccaagcccaatgaacattcccggaagtaaccaatcctccgccatgaacagcttgctgtctagttgcgtatctacgcctagatcatccttttatggatcagatatcggcaatgtggtactggacaataaaacaaatagcatcatcttagaaaccgaggcagctgatttgggtaacgacgagaggagtaagaaacccggaacacccggtacccccggtagccacgatctagagacagcgctaagacgcctgagcctgcgcagagagaactatttgtcagagcgacggttttttgaggaggagcaggaacgaaaactccaggagctggccgagaaaggagagctgcgtagcggctcgctgacacccacagagtcaataatgtccctgggaacacatagcaggttcagcgaatttacggggttctctgggatgtcattctcatctcgctcctacctgccagaaaaactgcaaattgtgaaacccctagaaggtgaccacgcgggacctaggccactaagcgtgttgctcggcgactcactctggtcccttatacaccttcgcaaagccggtcacctgtgtcacgcctattcctttttcttccgtgacagtcacccacggtgctggttcgagtttctgtag

SEQ ID NO: 244283 - DNA, 438 bp, Artificial Sequence
  Description of Artificial Sequence: Synthetic coding sequence
atgactgtacataacctctatttgttcgaccgcaatggagtgtgtctccattactccgaatggcaccggaaaaagcaggcgggtatcccgaaagaggaagagtataaactgatgtacggtatgctgttttcaatcaggagcttcgtatctaagatgtccccactggatatgaaagatggattcttggccttccagacttccagatacaagttacactactatgagacccctactggcatcaaggtcgtgatgaacacagaccttggtgtgggacctatcagggacgtgctgcaccatatctactctgccctgtatgttgaactcgtcgtgaagaatcccctctgcccactcggacagactgtccagtcggaattatttcgttcccgtcttgatagctacgttcgatctctcccctttttttctgctagagccggttag

SEQ ID NO: 244284 - DNA, 438 bp, Artificial Sequence
  Description of Artificial Sequence: Synthetic coding sequence
atgaccgttcacaacctgtacttatttgaccgcaacggcgtgtgcttacattactccgaatggcataggaagaaacaggcaggaataccgaaagaggaagagtataagctgatgtacgggatgctcttctccattagaagcttcgtatccaagatgtcaccactcgacatgaaagacggtttccttgcttttcagacctcgcgctacaagctgcactattacgaaacacccacaggaattaaggttgttatgaacacagatctgggcgtggggcctatccgcgacgtcctgcatcatatctacagcgcactgtatgtggagttagtcgttaagaaccctctgtgcccacttggccagactgtgcagtcagaactgttcaggtccagactggactcatacgttagaagtctgccatttttcagtgcaagagcgggatag

SEQ ID NO: 244285 - DNA, 3402 bp, Artificial Sequence
  Description of Artificial Sequence: Synthetic coding sequence
atgtctccgactcagtgggactttcccgtggagctctgctgtcgccctatggcttttgtaaccctgaccgggcttgacgtggtctacaacgctgtgcatagagcggtatgggatgccttttgcgcgaaccgtcgggcagatagggtgccaatcagctttaaggtactgcctggcgatcacgaatatcccaagtgtaggcctaagagaacttcttacgagtggtacatccccaagggtattctgaagacaggatggatgaacaagcacctgaatctcgttcctgccctggtcgtagttttctacgagttggactgggacgagccacagtggaaggagaagcagtcagagtgtgctacccgggtcgagattgtgcgacagtctttgcagggcagaaacacaaaagtggcagtggtcctgatccagaagaagactcccctccccccaggtgaagacgtgatcgcctccgagcgggcagccgcactatgtaacgcttgcgagttatctgggaagtccttatttgtattgccacacaccgaccacctcgtggggtatatcattaggctggagaacgcattctacgagcacgcccaaacgtattattacaccgaaattaggcgagtcaagagccataaagagtttctgaacaagaccactcaccagctcctttttgtgaggcaccagtttaagatcgcattcttttcagaactcaagcaggacactcaaaacgccttaaaaaattacaggactgcatacaatttggttcacgaactgcgtgcccacgagactaatatcctcgaaatcaagacaatggcaggcttcatcaattacaagatctgtcggctctgttttcagcacaatacaccattggatgccattgcacagttcagaaagcacatcgacctctgtaagaaaaaaattggttcggctgagctgtctttcgaacacgatgcttggatgtccaaacagtttcaggccttcggagatttgtttgacgaggcgattaagctgggcctgaccgctattcaaactcagaacccagggttttactaccaacaggccgcttactacgcccaagaaagaaagcagctggctaaaaccctgtgtaatcacgaggcatcggtgatgtatccaaatcccgatcctcttgagacacagaccggcgtgctcgatttctacggccagcgttcatggcggcagggcatcttgtcttttgacctctcagatcctgagaaggaaaaagtgggaatcctcgctatccagttgaaggagcggaatgtcgttcacagtgaaattattattactttgctgagcaacgccgtagcccagtttaaaaaatacaagtgtcctcgcatgaaatctcatctgatggtacagatgggagaggagtattattatgctaaggactatactaaagctttgaagctgctggactacgtgatgtgtgattacagatcggaaggctggtggaccctactcacgtctgtgctcactactgctctgaagtgttcttacttaatggctcaactgaaagattacatcacctactccctcgagttgctgggaagggcttcaactttaaaagacgaccaaaaaagcagaatagagaagaacttgatcaacgtgctaatgaacgaaagtcctgaccctgaacctgattgcgatatcctggccgtaaagacagcccaaaaactctgggctgacagaatatcgctcgccggatccaatatcttcacaattggtgtgcaggactttgtcccttttgtccaatgtaaggcaaaatttcatgcacctagcttccatgtggacgtacccgtgcagttcgatatttatctgaaagccgattgtccccaccctatacggttttccaagctttgtgtgagcttcaacaatcaggagtataaccaattttgtgtgatagaggaggccagcaaggctaatgaggtcctggaaaacctgactcaaggcaaaatgtgtctagtacctggcaagacgcgaaaattactcttcaagttcgttgccaaaactgaggatgtgggaaagaaaatagagattacttctgttgatctggccttaggaaacgaaacgggaaggtgtgtggttcttaactggcagggcggaggcggtgacgcagcatcctcacaggaagcacttcaagcagcaaggtcttttaagcggagacctaaacttccagataatgaagtccactgggattccatcataattcaggcttcgacaatgattatctcccgcgtccctaacatctctgtgcacctgctgcacgaaccccctgccctgaccaatgagatgtattgcttagtcgtaaccgtgcaatcccacgagaagactcaaatacgagacgtcaaactcactgccggtctcaagcccggacaggatgctaacctgacccagaaaactcatgtgaccctgcatgggacggagctttgcgatgagtcctaccccgctcttttaacagatatacctgtgggtgacctccacccgggtgaacaacttgaaaagatgctttatgtgaggtgtggcacagttggctctcgcatgtttctcgtttatgtgtcatacttgattaacacaacagtcgaagaaaaagagattgtttgtaaatgtcataaggacgaaaccgttactattgagacagtctttcccttcgacgtcgccgtcaagtttgttagcacaaagtttgagcaccttgagcgggtgtacgccgacatccctttcttactgatgacggatctgctgtccgcatctccttgggctttgactatcgtctcctcagaacttcagctggcaccctctatgactactgtggatcagcttgaaagtcaagtggataatgtcatccttcaaactggtgagtccgcatcggaatgtttttgtctgcagtgcccatccctgggtaacattgaaggcggtgtagcgaccggtcactacattatctcttggaagagaacaagcgccatggagaacattccaatcatcaccaccgtgatcactttaccacacgtgattgtggagaatatccccctacatgttaatgccgacctcccgtccttcggcagagtccgggaaagcctccctgtgaagtaccatctgcagaataagaccgacttagttcaggacgtcgaaatctcggtggaaccctccgatgcgtttatgtttagcggtctaaaacagatcaggcttagaatcctgcccggaaccgaacaagaaatgctctataatttttatcctctcatggccggatatcaacaactgcctagcttgaacatcaaccttctgcgctttccaaacttcactaatcagctcttgagaagattcataccaacaagtatctttgtaaaacctcagggacggctcatggacgacaccagcatcgctgcagcgtag

SEQ ID NO: 244286 - DNA, 3261 bp, Artificial Sequence
  Description of Artificial Sequence: Synthetic coding sequence
atgtcccccactcaatgggatttccccgtggagctgtgctgccggcctatggcgttcgtcacccttacaggccttgatgtagtgtacaacgccgtgcatagagccgtgtgggatgccttctgcgcaaaccgtcgtgccgaccgcgtccctattagctttaaagtgctccccggtgaccatgaatatcccaagtgtcgcccaaaacgtacctcctacgaatggtatatccccaaagggatactgaaaactggttggatgaataagcacctgaacctggtacctgccttagtagtcgtattttatgaactggactgggatgagccacagtggaaggagaaacaaagcgaatgtgccacccgcgtggaaatagtgcggcaaagcttgcaggggaggaacactaaagtggctgtagttttaatccagaaaaaaactcctctgcccccaggggaagatgtgattgcatccgagagggcagcggcactgtgtaatgcttgtgagctgagtggtaagagccttttcgtcctgcctcatactgaccatcttgtcggctacattatcagattagaaaatgccttctacgaacatgcgcagacctactattacaccgagatcaggagggtgaagagccacaaggagttcttgaacaagactacccaccaattgctttttgtaagacaccagttcaagatcgcctttttttccgagttgaaacaggacacccaaaatgcgctcaagaactaccgaacagcttataatttagtacacgagctccgcgctcacgagaccaacattctcgagatcaagacaatggcgggattcatcaactataaaatctgtcgcctctgtttccaacacaacacccccttagacgctatcgcacagtttaggaagcatatagacctctgtaagaagaaaattgggtcggccgagcttagctttgagcatgatgcttggatgagcaaacaatttcaggctttcggtgacctgttcgacgaggccataaaactggggctgactgctatccagacacagaacccagggttctattaccagcaggccgcatattacgctcaggagcgcaagcagctcgccaaaacactttgtaatcatgaggcatctgtcatgtaccctaaccctgaccctttggagactcagaccggggtgctggatttctacggacaacggtcttggcggcagggtattctctcctttgatcttagcgatccagaaaaggaaaaggtggggattctagccatacagctgaaagaaagaaatgtagtgcattcggagattatcatcaccctcctctcaaatgcagtggctcagttcaagaaatataagtgccctagaatgaaatcgcacctgatggtgcagatgggggaggagtactattacgcaaaagactatacaaaggccttgaagctactggactacgttatgtgtgattaccgctccgaaggatggtggacactgctaacatccgtcctcaccaccgcccttaaatgttcctatttgatggcacagctgaaagactacatcacatactcgctcgagttgctgggccgagcctccacgttaaaagatgaccagaagagtcgcatagaaaaaaatctaatcaatgtgctgatgaatgagtctcccgaccccgagcccgactgtgacatcctggccgtcaagacggcgcagaagctttgggcagatcggattagcctcgccggtagcaacatttttaccatcggagtgcaggattttgtgccatttgtgcagtgtaaggctaagttccacgctccttctttccacgtagatgtccctgtgcagtttgatatctatctgaaggccgactgcccgcaccccattcgcttttcaaagctttgtgtaagtttcaataatcaagagtataaccaattctgtgtgatcgaggaagcatccaaggcaaacgaagtcctcgagaatctcacccagggcaaaatgtgtttggtaccaggcaaaactcgcaaactgttatttaagttcgtggctaaaactgaagatgtaggcaaaaaaatcgagataacttcagtggaccttgccttagggaacgaaaccgggagatgcgtggtgctaaactggcagggtgggggaggagacgctgcatccagtcaggaggctctgcaggctgccagaagcttcaaacgacgccctaagctccctgataatgaagtccactgggattccattataatccaggcctcaactatgattatttctagagtcccaaacatctccgtgcaccttttacacgagccacctgctttaaccaatgaaatgtactgcctcgtggtgactgtgcaaagccacgaaaagacgcagatcagggacgtcaaactgaccgccggactcaagccaggccaggatgccaatctgacacagaaaacacacgtgacccttcatggaaccgagctttgcgacgaatcctaccccgctcttcttacagatataccagtcggtgatttacacccaggcgaacagctggaaaaaatgctatacgtccggtgtggcacggttgggtccagaatgttcctggtctacgtctcttacctgataaatacgacagtggaggagaaagagatcgtgtgcaaatgccacaaagatgagaccgtgaccatcgaaaccgtgtttccattcgacgtcgcagtgaagtttgtgagcactaagttcgagcacttagagagagtgtatgcggatattccattcctccttatgacagacctgctgagcgcgtccccttgggctcttactatagtttctagcgaactgcagctggccccaagtatgacaacggtggatcagctggaatctcaggtggataatgtgattctacagaccggagagtctgcctctgagtgtttctgcctgcaatgccctagcctcggaaatattgaagggggagtagcgaccgggcactatatcatcagctggaagcggacttcagccatggagaacataccaatcattacaacggtgatcactttgccacacgtgattgtggagaatatccctctccacgtgaatgcagatctgcccagtttcggccgagtgcgggagagtctaccagttaagtaccatctgcagaacaagactgatctggttcaggatgtggagatttccgttgagcccagtgacgccttcatgtttagcggactgaaacaaatccgactgcccgcacaggcattctatacctaccagtacttttgtcaggcgaccggctccacacacggatag

SEQ ID NO: 244287 - DNA, 3057 bp, Artificial Sequence
  Description of Artificial Sequence: Synthetic coding sequence
atgagcccgactcaatgggattttcccgtggaactctgctgccgcccaatggcatttgtgaccctgaccggactcgacgtcgtgtataacgccgtgcaccgggcagtttgggacgccttttgcgctaaccgacgcgcagatagggtccccatttccttcaaggttctgcctggggaccacgaatatccgaaatgtcggcctaaacggacctcatacgagtggtacatcccgaaggggattcttaagactggttggatgaacaagcacctaaatcttgtgcctgccttggttgtggtgttttatgaactggactgggatgagccccagtggaaggagaaacagtctgaatgtgctacaagagtcgaaatcgtgagacagagcctgcagggcaggaacactaaggtggccgtggtgctaatccagaaaaagactcccctcccccctggagaagatgtgatcgccagcgaacgagccgctgccctatgtaacgcatgcgagctgagcgggaagtcattgttcgtgctaccacatactgatcatctcgtgggatacatcattaggctggagaacgccttctatgagcacgctcaaacctactattataccgagattaggcgcgttaagtctcataaagagttcctcaacaaaaccactcaccagttgctattcgtcagacaccaattcaaaatcgctttcttttctgaattaaagcaggatacacaaaatgcgcttaaaaattataggacggcctataatctggtgcacgagctcagagcgcacgagaccaacattctggagatcaagaccatggccggatttatcaattacaaaatctgtagactgtgttttcaacacaatacccctttagatgccattgcccagttcaggaagcacattgatctgtgtaaaaaaaagatcggcagcgccgaactgtcctttgagcatgatgcgtggatgtccaagcagtttcaggccttcggggacctgtttgatgaggccattaaactgggactgacagcgattcagacgcaaaaccctggcttttactatcagcaggcagcgtattacgcccaggagaggaaacagcttgccaagaccctgtgcaatcatgaggctagtgttatgtatcccaatcccgatcccctggagactcagaccggcgtgctggacttttacggccagaggtcttggcgccaggggattctcagcttcgacctgagcgacccagagaaggagaaagtgggtatactggccatccaactgaaggagcggaatgttgttcattctgagataattatcaccctgctatccaacgccgtggcccaattcaagaaatacaaatgtcctagaatgaagtcgcatcttatggtccagatgggagaggaatactattatgctaaagactacacgaaggctctgaagttgctcgactacgttatgtgcgactatcggtccgagggctggtggacgctacttacaagcgtcctgactactgcactgaaatgctcttaccttatggctcaactcaaggattacatcacatattctctggagttattaggccgtgcctcaacactgaaggacgaccagaaatccagaattgaaaaaaaccttataaatgtgctgatgaacgagtcccccgatccggaaccagattgcgacatcctggctgtgaaaactgcacagaaactgtgggcagatagaattagtttagcgggttccaatatcttcaccattggggtccaggattttgttccgttcgttcagtgtaaggcgaaatttcacgcgccatccttccacgtggatgtgccagtgcagttcgacatttacctgaaagctgattgcccgcatcctattagattcagcaagctgtgcgtgtcctttaacaaccaggagtacaatcagttttgcgttattgaagaggctagcaaggcgaacgaggtcctggaaaacctgacacagggcaagatgtgcttagtccccggtaagacgaggaaacttctgttcaaatttgttgcaaaaaccgaggatgtgggcaaaaagatagaaatcacctctgtagatctcgccctgggcaatgaaacggggagatgcgtggtgcttaattggcaaggcggaggcggagatgccgcaagtagccaggaggccctgcaggcagcgagatctttcaagaggcgtcctaaattacccgataacgaggtccattgggactctataatcattcaggcctctacaatgattatcagccgcgtgcccaacatcagtgtacacctgctgcatgagcctcccgcactgaccaacgagatgtactgcctggtggttaccgtgcagagtcacgagaagactcagattcgtgacgtgaaacttacggccggactcaagcccggacaggatgcaaatctcacccagaaaacacacgtaacgctccatgggactgagttatgcgatgagagttaccccgcactgctgacagacatcccggtaggcgacctgcatcctggcgaacagcttgaaaagatgctgtatgttcgctgcggaacagtcgggtcaagaatgtttctggtttatgtcagctacctcataaacactaccgtcgaggaaaaggagattgtgtgtaagtgtcacaaagatgaaacggtaaccatcgagaccgtgttcccctttgatgtggccgtcaagttcgtgagtaccaaatttgaacacctcgagcgagtgtatgcagacatacctttcctgctgatgaccgacctgctgtccgccagcccctgggctttgaccatcgtaagcagcgaactgcagctcgcccctagcatgacgaccgttgaccagctggaatctcaggtggataacgtcatcctgcagaccggcgagagtgcaagtgctctctattatctgcttgaaaaagatctctcaaacggggagtatccccatcatcataattgccaccactccgctgcaagggattgcggagagtacccgagtccatgcgaatgccgttcagcggtcatctgggcatgccagagagtagtcacgtgccaggtttctcctacagaatag

SEQ ID NO: 244288 - DNA, 2091 bp, Artificial Sequence
  Description of Artificial Sequence: Synthetic coding sequence
atggaagacgccggaggtggcgaggaacaggggctgctattccaggaagagacaattgacttgggaggtgacgagtttggctctgaggagaacgaaacagcgtccgaagggagttccccgcttgccgataaactgaatgagcatatgatggaaagcgtattgatcagcgacagtcctaacagcgaaggcgacgcgggagacttggggcgagttagggacgaagccgagcccggtggggaaggggatcctggcccagagccggcagggacccctagtccctctggtgaggccgacggtgactgcgccccagaagacgcagctccaagctccgggggagccccacgccaggacgctgccagagaggttcccggttcagaggcagccagaccagagcaagaaccccctgtggctgagccggtccctgtgtgcacaatcttctctcaaagggccccacctgcctccggcgatggattcgagccccagatggttaagtctcccagtttcggaggcgctagcgaggctagcgccaggacaccccctcaggtagttcaaccttctccatcccttagcactttttttggagacaccgcggcatcccactctctcgcatctgatttctttgatagctttactacatccgcttttatttcagtttccaatcccggagctggatcgcccgctccggcatctcccccacccctggccgttcctggcacagagggccgacctgagcccgttgccatgcggggacctcaagctgccgcaccacctgcctcacccgagccatttgcacacattcaggcggtgtttgccggatcggatgatccattcgccaccgctctgtctatgtcagaaatggatcgacgtaatgacgcatggctgcctggagaggcaacacgaggcgttttgcgggctgtggctactcagcagaggggagccgtgtttgtggataaggagaacctgacaatgccaggcctgcgctttgacaacatccagggcgatgcagtgaaagacctgatgttgcgctttctcggagagaaagctgcagcaaagaggcaggtgttgaacgctgattcagtggaacaaagctttgtcggacttaagcagctgatcagttgccgtaattggcgagctgcagtggacttgtgcggccgtctcctcacggctcatggccaaggctacgggaagagtgggctcctgactagccacaccacagattccctgcagctgtggttcgtgaggcttgcactgctagtcaagctgggactgtttcagaatgcagagatggagttcgagccctttggaaacctagaccagccagacctgtactacgaatactacccgcatgtctatccgggaaggcgagggtccatggtccctttctccatgcgcatcctacacgccgagcttcaacagtatttgggcaatccccaggagtcgctcgaccgacttcacaaagttaagacagtttgtagcaagattctcgcaaatcttgaacagggtctggcagaagatgggggaatgtcctccgtgacacaggaaggtcgccaaggttgttcatacctggtggcttcaatcagactttggagaagtagattggggagagtcatgtactctatggcaaattgccttctgttgatgaaggactacgtgctcgcagtggaagcttatcacagtgtaataaaatactaccccgaacaggaacctcaactgctgtcgggcatagggcgaatcagtctacagattggcgatatcaaaaccgccgagaagtacttccaggacgtggagaaggtgacgcagaaattggacggactacagggtaaaattatggtgctaatgaactccgccttccttcatcttggtcagaataatttcgcggaagcccatcggttcttcaccgaaattctgcggatggatccccgtaacgctgtgcaaatgctaagtgcttcacaccctactgggaaagaaccctcgcccaaggatgccgaggaacaccccgaaggacatcgagattctgcagagcccggtccggctaggcctatggttccgcagcgggctcctccgggacctgccctgtgcgcacagccttag

SEQ ID NO: 244289 - DNA, 2208 bp, Artificial Sequence
  Description of Artificial Sequence: Synthetic coding sequence
atggaggatgctggcggtggtgaagagacccctgcaccggaggcaccacatccgccacagctagcccctcctgaagagcagggcctcttgtttcaggaagagactattgatctgggaggagacgaattcggcagcgaggagaatgagacggccagcgaaggaagctctcccctggcggacaagcttaatgagcatatgatggaaagtgtactcatctctgactcccctaattctgagggggacgcaggggacctagggagagtccgcgacgaagcagaacccggaggagagggagatcccggaccagaacccgcagggacccctagccccagtggtgaggccgacggtgactgtgctcctgaggacgcggctccatctagcggaggcgctccaagacaggacgccgctagggaggtgcctgggtccgaggcggcaagacctgagcaggagcccccagttgcagagccagtcccggtctgcaccattttttctcagagggcccctccggctagcggggatggcttcgaaccccagatggtgaaaagccccagctttggcggagcaagcgaggcatcagctcggacgccccctcaagtggtgcagccgtccccatcattgtccactttcttcggggatactgcagcatctcactctcttgcatccgattttttcgattcctttaccacgtcagcctttatctctgtatcaaaccccggtgctggctctcctgctccagcctcaccgcctcctttagccgtcccgggaacagaggggaggccagagcccgtggcaatgcggggaccccaggcggctgctcctcctgcaagtccagaaccattcgctcacatccaggccgtgttcgcgggtagcgatgacccgtttgccaccgccctgtctatgtctgagatggacagacgaaatgatgcttggctccctggagaagccacccggggtgtgctacgcgcagtggcaacgcagcaaagaggcgcagtctttgtggacaaagaaaatcttacaatgcctggtctgcgctttgacaatattcaaggagatgccgtgaaagacctcatgctgagattccttggtgaaaaagctgcggctaaaagacaggtgctgaatgccgacagcgtggagcagagttttgtgggactgaaacaattgatctcatgccgcaactggagggccgctgtggatttgtgtggccgtctgctcaccgcccatggccagggctacggcaaatctggcctacttacttcgcacacaacagatagcctgcaattgtggtttgtgaggctcgccctgctggtcaagctgggactttttcaaaacgcggagatggaattcgagcccttcgggaacctcgaccaacccgatctctattacgaatactacccccacgtctatccgggacgaagagggagcatggtgccgttttctatgcgaatcctgcatgccgagctgcagcagtacctcggaaatccacaagaatctctggaccgcttacataaagtcaagacagtctgttcgaagatactcgccaacctggaacaaggattggcagaggatgggggtatgtcctccgtcacccaggaaggaagacaggccagtatccggctgtggcgatctcgtctgggccgagttatgtattcgatggctaattgtttacttctaatgaaggactatgttctggccgtcgaggcctatcatagtgtaatcaaatattaccccgagcaggagcctcagttgctctccggtattggacgcatctccctgcagattggcgacatcaagaccgccgagaagtatttccaggatgtggagaaagttacacaaaagctggatgggcttcagggtaagatcatggtgctcatgaattctgctttcctgcacttgggacagaacaacttcgcggaggcgcaccggttcttcaccgaaatattgcggatggatccgcgaaatgccgtcgccaataacaacgctgccgtttgcctcctgtatctgggaaaactcaaggattctttacgccagcttgaagccatggtccagcaggaccccaggcattacttacacgaatctgttcttttcaacctgaccacaatgtacgagctcgaaagctcacgaagcatgcagaagaagcaggcccttctggaagccgtcgctggcaaagagggtgacagctttaatacacagtgtctgaagctggcatag

SEQ ID NO: 244290 - DNA, 2208 bp, Artificial Sequence
  Description of Artificial Sequence: Synthetic coding sequence
atggaggatgctggtggaggagaggaaacccctgcccctgaggccccacatccccctcaactagccccaccagaggaacaaggactgcttttccaggaagaaaccatagatttgggcggtgacgagtttgggagcgaagagaatgaaaccgcttctgagggtagctcacctcttgctgacaaattgaatgagcacatgatggagagcgtgcttatcagcgactcaccaaacagcgagggagatgccggagatctaggacgtgtaagagatgaggccgaacccggtggagagggcgaccctggtcccgagcctgccggaacccctagtccctccggggaagccgatggcgactgcgcgccagaagacgcagccccttcatctggcggtgcgccaaggcaggacgccgcacgggaggtaccagggtcagaggcggcaagacctgagcaggaaccacctgtcgccgaacctgtgcccgtgtgcacaatattctcccagcgggcacctccggcttcaggggatggctttgaaccccagatggtgaagtctccctctttcggcggagcgtctgaagcaagcgcaagaacacctccccaggtggtccaaccctcaccttccctgtctactttttttggggataccgctgctagccactcacttgcatccgactttttcgattcgttcacaacgtccgcgttcatctctgtgagtaatccgggtgcaggcagccctgccccagcaagcccacctcccctggctgtacccggaactgaaggaaggcccgagcctgtcgccatgcgcggtcctcaggctgcagcaccaccggcatccccagaaccctttgcacacattcaggctgtattcgcgggatccgatgacccctttgcaacagcattgtctatgtcagagatggaccgcaggaacgatgcctggttgccaggcgaggccacccgcggtgtcctcagagccgtagcaacacagcagaggggagctgtgttcgtcgataaagagaatctgactatgccagggctgcgctttgataacattcagggcgacgccgtgaaggacctgatgctgagattcttaggtgaaaaggccgctgccaagcggcaagtgttaaatgctgatagcgtcgagcagtcctttgtcggcctcaaacaactaatttcatgtagaaactggagagctgcggtggacctctgcggcaggcttctgacagcacacggccagggctatgggaagagtggacttttaacctctcacacaaccgacagcctgcagctgtggtttgtgagacttgcccttctggttaagctgggacttttccagaatgctgagatggagtttgagccattcgggaacttggaccagccagacttatactacgagtactaccctcatgtgtaccctggtagacgcggatcaatggtgccattctccatgcggatccttcatgctgagctgcaacaatacctgggaaacccgcaggaaagcctcgatcggctgcacaaggtcaaaactgtctgtagtaaaatcctggctaacttagagcaagggctcgcagaggatggaggcatgtcctccgtgacccaggaagggagacaggcatctattcggctgtggcggagccgcttgggacgcgtgatgtacagcatggcgaattgcctgttacttatgaaggattatgtcttggctgtggaagcataccattcagtgataaaatactatccagagcaggagccacagctgctcagtggcattggccgtatatctctgcagatcggcgacatcaaaaccgccgagaagtattttcaagacgtggaaaaggtcacccaaaaactggacggtctgcagggcaagatcatggtcttgatgaacagtgcctttttacatctggggcagaataacttcgctgaagctcatcgcttttttacagaaatcctacggatggatcccagaaatgccgtggcaaacaataatgcggcagtctgtctactgtatctgggaaagctgaaggactcactccggcaactagaggccatggtccagcaggacccacgccattatcttcatgagagtgtattgtttaatcttactactatgtatgagctggagtcttccaggagtatgcagaaaaagcaggcccttctagaggcagtcgccggtaaggagggagatagttttaacactcagtgtctgaaattagcctag

SEQ ID NO: 244291 - DNA, 423 bp, Artificial Sequence
  Description of Artificial Sequence: Synthetic coding sequence
atgtcaggcagtttctacttcgtgatcgtgggtcatcacgataatcccgttttcgagatggaattccttcctgccggaaaggccgaaagcaaagacgatcaccgacaccttaaccaatttatcgcccacgctgccttagatctggtggatgagaacatgtggctgagtaacaatatgtatttaaaaacggtcgataagttcaacgaatggttcgtgtctgctttcgtaaccgctggacacatgcggttcattatgctccacgatatcaggcaagaagacggcattaaaaacttcttcacggatgtctatgacttgtacataaaattctcaatgaacccattttatgagccgaacagcccgattaggagctctgcattcgacaggaaagtgcagtttctaggaaagaagcacctcttaagctag

SEQ ID NO: 244292 - DNA, 423 bp, Artificial Sequence
  Description of Artificial Sequence: Synthetic coding sequence
atgagtggaagcttttactttgtaatcgtcggccatcacgataatccagtcttcgagatggagttcctgccggcaggtaaggccgagtctaaggacgaccacaggcacctcaatcagtttatagctcacgccgcactcgaccttgtagacgaaaacatgtggctaagtaataacatgtaccttaagacagtggacaagttcaatgagtggtttgttagtgcattcgtgacagctggtcatatgcgcttcatcatgttacacgacatccgccaggaggacggcatcaagaactttttcacagacgtatatgatctttacatcaagtttagtatgaaccccttctacgaacctaatagccctatacgatccagcgccttcgacaggaaagtgcaatttctaggaaaaaaacacctcttgagttag

SEQ ID NO: 244293 - DNA, 423 bp, Artificial Sequence
  Description of Artificial Sequence: Synthetic coding sequence
atgagcggctccttttacttcgtcatagtcgggcaccacgataacccagtctttgagatggagttcctccccgctggaaaggctgaaagcaaggacgaccaccgccaccttaaccagtttatcgctcacgccgcattggatctggtggacgaaaatatgtggctaagtaacaatatgtacctgaaaacagttgataaattcaatgaatggttcgtgtcagcgttcgtcaccgctggacacatgaggtttatcatgctccacgacattcgccaggaagatggcatcaagaacttttttaccgacgtttacgatctgtatatcaagttctcgatgaaccccttctatgagcctaattcccccatcagaagcagcgctttcgatagaaaggtgcaattcctgggcaaaaaacacctcctttcctag

SEQ ID NO: 244294 - DNA, 423 bp, Artificial Sequence
  Description of Artificial Sequence: Synthetic coding sequence
atgtccgggtccttttacttcgttattgttggtcatcatgacaaccctgtgttcgagatggagtttctgcccgcaggcaaggctgagtcaaaggacgaccacagacacctgaaccaattcattgcgcatgccgcactcgacttagtggacgagaacatgtggttgtccaacaacatgtatctaaaaactgttgataagtttaacgaatggtttgtgtccgccttcgtcacagctggacatatgcggtttattatgctgcacgatatccgccaggaagacgggatcaagaatttctttactgacgtgtacgacctgtacattaaattctccatgaaccctttttacgaacccaacagccccattcggagctccgcgttcgatagaaaagtgcagttcttagggaagaagcacctgctgtcctag

SEQ ID NO: 244295 - DNA, 444 bp, Artificial Sequence
  Description of Artificial Sequence: Synthetic coding sequence
atgtctggcagcttttacttcgtgatcgttgggcatcacgataacccggtgtttgagatggagttcctgcctgctggaaaggcagaatcaaaggacgatcaccggcatctgaatcagttcatcgcccacgccgctcttgatctggtggacgaaaatatgtggctgtcaaataacatgtacctgaagactgtcgataagttcaatgaatggtttgtgtctgcatttgtgacggcgggacacattcttacatttttagtgaagatgagatttataatgctccacgatatcaggcaggaggacgggatcaaaaatttctttacagatgtgtatgatctttacatcaagtttagcatgaaccctttttatgagccgaacagcccaatacggtcaagcgctttcgatcgcaaagtgcagttcctgggaaaaaaacatttgttgtcctag

SEQ ID NO: 244296 - DNA, 525 bp, Artificial Sequence
  Description of Artificial Sequence: Synthetic coding sequence
atgagctcttggaaacaggaccgctccggcctgcgcagtacggagctgaatgtgcttgaatatcagccattgtgtgccgttcgaagtcatattcttaaaacaatgtctggatctttctatttcgtgatcgtcgggcatcacgataatccagttttcgagatggagttcctgcccgctggcaaggccgagtccaaagacgaccaccggcatctgaaccagttcatcgctcacgctgcactggacttagtggacgagaacatgtggctgagcaacaacatgtacctcaaaacagttgataaattcaatgagtggttcgtctccgcatttgtgacagccggacacatgcgattcattatgctgcatgacatcagacaggaagacggaatcaaaaatttctttactgatgtatacgacctttacatcaagttttcaatgaatccgttttatgagcccaactcgccgattaggtcaagtgccttcgaccggaaggtgcagtttctgggaaagaaacatctgctgtcttag

SEQ ID NO: 244297 - DNA, 225 bp, Artificial Sequence
  Description of Artificial Sequence: Synthetic coding sequence
atgagcggatccttctactttgtaattgtgggccaccacgataacccggtgtttgaaatggaatttctccctgcaggcaaggccgaatccaaggatgatcataggcatttaaaccagtttatcgcacatgctgctctggacctggtggatgagaatatgtggctttcaaacaatatgtacctgaagactgttgataagttcaacgagtggttcgtttcagcctag

SEQ ID NO: 244298 - DNA, 423 bp, Artificial Sequence
  Description of Artificial Sequence: Synthetic coding sequence
atggccgtttgtattgctgtgattgccaaggagaattacccgctgtacatcagatccactcctaccgaaaacgaattaaaattccactacatggtccatacgagtctggatgttgtggacgagaagattagcgcaatggggaaagcactcgtggatcagagggaattgtatctggggctcctgtatccaaccgaagattataaggtgtacggatacgtcaccaactccaaggtaaagttcgttatggttgttgatagttcaaatacagcactcagagacaatgagatccggtcgatgttcaggaagctacataactcatatacagacgttatgtgtaatcccttttataacccaggcgaccgaatccagagctcacgagcctttgacaatatggttacttccatgatgatccaggtatgctag

SEQ ID NO: 244299 - DNA, 357 bp, Artificial Sequence
  Description of Artificial Sequence: Synthetic coding sequence
atgtctagacaagccaataggggtactgagtctaaaaaaatgagcagcgagctgtttaccctgacttatggggctctggtcacgcagttatgcaaagactatgagaatgacgaagatgtaaataaacagctggacaaaatgggtttcaatatcggcgtgaggctcatagaggatttcctggccagaagtaatgtgggcaggtgtcacgactttcgcgagaccgccgacgtcatcgcaaaagagcggaaaatgtttctgggaaaacagaataaaaccaagagacaggcaaagctttacgatgccgtgaaggaaaggggggcagccagctgcaccgacgcctcgcctctccttagctag

SEQ ID NO: 244300 - DNA, 405 bp, Artificial Sequence
  Description of Artificial Sequence: Synthetic coding sequence
atggggtttaacataggagttagactaatcgaagatttccttgctcgcagtaacgtgggaaggtgtcacgactttagggaaaccgccgatgtgatagcaaaggtggcatttaaaatgtacttgggaatcaccccctcaataacaaattggagccccgctggtgatgagttcagcctgatcctcgagaacaatcccctggtcgatttcgtggaactgccggacaaccattcgagcctgatatacagtaatcttctttgtggcgtgctccgcggtgctctagaaatggtgcagatggcagtggaggccaaatttgtccaggatacactgaagggtgacggagtgactgagatccgcatgaggtttattcggcgaattgaagataaccttcctgcaggggaagaatag

SEQ ID NO: 244301 - DNA, 405 bp, Artificial Sequence
  Description of Artificial Sequence: Synthetic coding sequence
atgggtttcaacataggggtgagactcatcgaagacttcctagctcggagcaatgtggggaggtgccacgattttcgggagacagctgacgtcatcgcaaaagtggcttttaagatgtatcttggtatcactccctcgatcacaaactggtcacctgcaggcgacgagtttagtctgatactggagaataaccctctggtagattttgtagaacttcctgacaatcactctagcctgatctattcgaatctgctgtgcggcgtgctgcggggtgccctggagatggtgcaaatggccgtggaggctaaatttgtccaggacacactgaagggggatggcgttactgaaataaggatgagatttatcaggagaatcgaagacaacctgcccgctggagaagagtag

SEQ ID NO: 244302 - DNA, 543 bp, Artificial Sequence
  Description of Artificial Sequence: Synthetic coding sequence
atgagtaggcaggctaacagaggaactgagagcaagaaaatgtcctcggagctctttactctgacttatggtgcccttgtcacccaactctgcaaggactacgaaaacgatgaggacgtgaataaacagttagataaaatgggattcaatattggggtgcggctcattgaggactttctcgcaaggagcaacgttgggagatgccatgactttcgggaaacagctgatgtaatcgccaaggtggctttcaaaatgtatctgggcattacacctagcattactaactggtctccggctggtgacgaatttagcctcatattggagaataatccacttgtggacttcgtagagctacctgataatcatagcagccttatttactctaatttgctttgtggggtcttgaggggggctcttgagatggtccagatggcagtggaggctaaattcgtacaggataccctgaaaggcgatggcgtgactgaaatcagaatgagatttatcaggcgcattgaggacaacctccccgcaggggaggaatag

SEQ ID NO: 244303 - DNA, 498 bp, Artificial Sequence
  Description of Artificial Sequence: Synthetic coding sequence
atggctattttctcagtctacgtggtgaataaagcgggaggtctgatttatcagctggacagctacgctccacgggcagaagccgaaaaaactttttcttatccactggacctgcttttgaagttgcacgatgagcgcgttctggtagctttcggtcagagagacgggattcgggttggacatgcggtcctcgcaatcaacgggatggacgtgaacggcagatatacagccgacggaaaggagatgttagagacagatacattcaagttgcactgttatcagacactgaccggcatcaagttcgtcgtgctcgccgaccctcgccaggctggcatagactcgctcctaaggaagatctacgaaatttactcagacttcgccctgaagaatcccttttatagcttggagatgccaattagatgcgagttatttgatcagaacctgaagctggcgctagaagtcgccgaaaaggccggtacctttggacctggaagttag

SEQ ID NO: 244304 - DNA, 660 bp, Artificial Sequence
  Description of Artificial Sequence: Synthetic coding sequence
atggccatatttagcgtgtacgtggtgaataaagccggtggcctcatttatcagctggatagttacgcccctcgggcagaggccgagaaaaccttctcttatcctctcgacctcctgctgaagctgcacgacgaaagagtattggttgccttcgggcaacgcgatgggattcgagtggggcacgcggtgcttgccatcaatgggatggacgtcaatggcagatacacagcagatgggaaagaagtgctggagtacttaggtaaccctgccaattacccggtgagcattaggttcgggaggcctcggctcacatccaatgagaagctgatgctcgcttctatgttccacagtctcttcgcaatcggcagtcagctcagccctgagcagggctcgagcggcatcgaaatgctcgagaccgacacttttaaactgcactgttaccagactctcacgggaatcaaatttgtggtcctcgccgatccacgccaggctgggatagatagtctcctcagaaagatttacgagatctactctgactttgccctgaaaaaccctttctattctctggagatgcctatacgctgcgagctcttcgatcagaacctgaagctggcactggaggttgcagagaaggccggtacatttgggccagggagttag

SEQ ID NO: 244305 - DNA, 4308 bp, Artificial Sequence
  Description of Artificial Sequence: Synthetic coding sequence
atggcccagtgcgttcagtccgtccaagagttgatacccgattcatttgttccctgcgtggccgctctgtgctccgacgaggctgaacggctcactcgcttaaaccatctcagtttcgccgagctgctgaaacctttttcccgtctcacaagcgaggtacatatgagggatcccaataatcagctgcacgtgattaaaaatctgaagatcgccgtttcaaatatcgttacgcagccaccccagcccggtgccataagaaaactgctgaacgatgtagtctccggaagccagcctgctgagggactagtagcgaatgtaatcaccgcgggagactatgacctcaacatctccgcaacaacgccgtggtttgagtcttatcgagagaccttccttcagagcatgcccgcattggaccatgagtttcttaatcactatctggcatgtatgctggtagcaagcagcagcgaagccgaacccgttgagcagttctctaagcttagtcaagagcagcacagaatccagcacaattctgattattcttaccctaaatggttcatacccaataccttgaaatattatgtgctccttcatgacgtcagcgctggtgatgagcagcgggcagaaagcatttacgaagaaatgaagcaaaagtacggcacgcagggctgttatctgttgaagattaactctcgaacgagtaacagagcgtcagatgagcaaatcccagatccatggagtcagtatctgcaaaagaactctattcagaaccaggagtcctacgaggatggaccatgtaccatcacaagcaataagaattctgacaataacctactgagcctggatgggctcgataatgaggtcaaggatggattacccaataacttcagggctcatcctttgcagctggaacaaagttcagatccatctaatagtattgatggcccagatcacctgcgttcagccagctccctacacgagacaaagaagggcaacacgggaatcatccacggcgcttgcctcaccttgacggaccacgatagaatccgccagttcatccaggagttcactttcagaggccttctgccccatattgagaaaactatcagacagctgaacgaccagcttatttccagaaaagggctgtctagaagcctgttctcagcaacaaaaaagtggttttctggtagcaaagtgcctgagaaaagcatcaacgatctgaaaaacacatccggacttctctacccccctgaggctcctgaactacagatacgtaagatggccgacctgtgtttcctagtacagcactacgatctcgcttattcctgctatcacacagcaaagaaggacttcctcaacgatcaagctatgctgtatgccgctggcgctttggaaatggctgctgtttccgcttttttgcagcccggagctcctcgtccctatcccgcacactacatggataccgcgatccaaacatacagggatatctgcaagaacatggtgttggctgagcgttgtgtcctgttgtctgcggagttgcttaagtctcaatccaaatacagcgaagcagcggcactcctgattaggctgacatccgaggatagcgacctgaggtcagctttgttgcttgagcaggcggcacattgcttcataaacatgaaatcgcctatggtgaggaaatatgccttccacatgattttggcgggtcatagattttctaaggccggtcagaagaagcatgcactgcgttgctattgtcaagccatgcaagtatacaaaggcaagggctggtcgctggccgaagatcacattaattttacgattgggcgacagtcttacacccttcgacagctcgacaacgccgtcagtgcgtttcgacacattctgattaacgagtcgaaacagtcggccgcacagcagggcgcattcttgcgggaatatctgtacgtctataaaaacgtgtcccagctctctccagacggacccctgccgcagcttcccctgccatatatcaattcaagcgctactcgggtgtttttcggtcacgaccgacgacctgcggacggtgaaaaacaggcagccacacacgtctcacttgatcaggaatacgatagcgagagcagccagcaatggagggagctggaagaacaggtcgtgagtgtggttaacaagggagttatcccatccaacttccaccccacccagtattgcctgaattcttattccgacaatagcagattccctctggccgtggtggaggagcccatcacggtagaagtcgcatttcggaatccactcaaagtgctcctcctccttaccgatctatcactgctttggaagtttcaccctaaggatttcagcgggaaggacaacgaggaggtgaagcagcttgtcacttccgaaccagaaatgataggagcagaagtgatttctgagtttctaatcaacggcgaagagtccaaagtggccagactgaaacttttcccccaccatattggcgaactgcacattttaggggtggtctacaatctcgggactattcagggctctatgacagttgacggcattggagctttaccgggttgccatactggcaagtactcattgagtatgtcagttagggggaagcaggacctggaaatacagggtcctcgactcaacaatactaaggaagagaagacctctgtgaagtatgggccagaccggcgactagaccctatcatcacggaggagatgcctttgctcgaagtgttcttcattcactttcccacagggctgttgtgcggggaaatccggaaagcatacgtcgagtttgtgaatgtctctaaatgtccactgacagggctgaaggtagtctctaagagacctgagttcttcacattcggtgggaacaccgctgtgctaacgccacttagcccgtcggccagcgagaactgttcagcctacaaaacggtggtaaccgacgcgacgagtgtgtgtaccgccttgatcagctctgcctcctccgtggattttggtatcggtaccggaagtcaacccgaggtgattcctgtgccactcccagatactgtgttactgcccggagcctccgtgcagctgccaatgtggcttcgcggacctgatgaagaaggtgtacatgaaataaacttcctgttttactatgagtctgtaaaaaaacaacctaagatccgccatcgcatcctcaggcacactgctataatatgtacatcccgcagccttaatgtacgggcaacggtgtgcagaagcaattcccttgagaacgaagagggcaggggcggtaacatgttagtgtttgttgacgtagaaaacacaaatacctctgaagccggagtaaaagaattccatattgtccaggttagcagttcttccaagcactggaaactgcagaagagtgtgaacttgagcgagaacaaggacacaaagctggcttctagagagaaaggaaagttctgttttaaagcgatccgctgtgaaaaagaagaggccgcaactcaatccagcgagaagtatactttcgccgatattattttcggaaatgaacagattatctcctctgcttcgccatgcgccgactttttctatcgaagtctgagcagcgaattgaagaaaccacaggcccacctgccggtgcacactgagaaacaatccactgaagatgctgtccggctcattcaaaagtgctctgaggtcgatttgaatatcgtgattctctggaaagcatacgtcgtggaggatagtaaacagctgatcttggagggacagcaccacgtcattcttaggacgattggcaaggaggcattcagctaccctcagaaacaggagccaccagagatggaattgttaaagttcttccgacctgagaatataaccgtatcaagccgccctagcgtggagcagctgtcctccctgattaagacctcactgcactatcccgagtctttcaatcatccttttcatcagaagtcgctgtgtctggttcctgtgacattgttgttgtcgaattgcagtaaagctgacgtggacgttatagtcgacttgcgacacaaaacaacttcacccgaagccctggaaattcacgggagctttacatggttaggccaaactcagtacaaactgcagttgaaatcacaggaaatccacagtcttcagctgaaggcatgttttgtacacacaggcgtgtacaatttaggtacaccaagggtcttcgcaaaactttctgatcaagtgaccgtgtttgagacgtctcagcagaatagcatgcctgccttgatcatcatctcaaatgtgtag

SEQ ID NO: 244306 - DNA, 3420 bp, Artificial Sequence
  Description of Artificial Sequence: Synthetic coding sequence
atgagcgtgcctgattatatgcagtgtgccgaggaccaccagaccctcctggtggtcgtgcagccagtgggcatcgtctctgaggaaaatttctttagaatttataagagaatttgttcagtgtcgcagatctctgttagagattctcagcgggtgttgtatatccgataccggcaccattaccctcccgaaaacaacgagtggggcgactttcagacacatcggaaggtagttggacttatcaccattactgactgtttctctgcaaaggattggccccagacttttgagaaatttcatgttcagaaggagatttacgggtcaaccctgtatgacagccgactgtttgtcttcggcctccagggggagatcgttgagcagcccagaacagacgtggccttttacccgaactacgaagattgtcaaacggtggagaagcggatagaagattttattgaatctctgtttatcgtcctggaaagtaaacgtctggatcgcgctacagacaagtcaggcgacaaaattccccttctgtgtgttcctttcgagaagaaagactttgttggcttagacaccgacagcaggcactacaagaaaaggtgccagggcaggatgcggaaacatgtaggcgatctgtgcttacaggccggaatgctgcaggattccctggtccactatcatatgagtgtcgaattgctaaggagtgttaatgacttcctgtggctgggagctgcgctcgaaggattatgttccgcgagcgtaatctatcattatccgggaggaaccgggggaaaaagcggagctcggcgttttcagggatcgacactgcccgcagaggccgctaatcgacacagacccggtgccttgactacgaacggtatcaatccagatacgagcactgagattggcagggccaaaaattgcttgtcacctgaagacatcatcgacaagtacaaggaagcaatttcctattatagcaaatataaaaacgcgggagtcatagagctggaagcatgtataaaggccgtgcgagtactggccatccagaagaggagtatggaagcaagcgaattcctccagaacgctgtgtacatcaatctgagacagttgtcagaggaggagaagattcagcgttacagcatcctatcagagctatacgaactgattggctttcacagaaaaagtgcattcttcaagcgcgtagcagccatgcagtgcgtggctccgtccatcgccgagccaggatggagagcctgctacaagctcctccttgaaaccctgcccggatactctctgtccctggatcctaaggatttctccagaggtacacataggggctgggctgctgtccaaatgcggttgcttcacgagttggtgtatgcgtcaaggagaatgggaaatccagctctctcagtgcgtcacctgtcttttttattgcaaactatgcttgacttcctcagcgaccaagaaaagaaggacgtcgctcagagcttggaaaattataccagtaagtgtccaggaacaatggagccaatcgccctccccggaggactaacgctccccccagtgcctttcactaaattgcccattgtccgacatgtgaagcttttaaatttgcccgcttcccttaggccacataaaatgaaaagcctcctgggccagaatgtgagcacaaagagccccttcatctacagtccaatcattgcccataaccgtggtgaggagcgaaacaagaaaattgatttccagtgggtgcaaggggacgtttgtgaagtgcaactcatggtatacaatcctatgcccttcgagctgcgggtggaaaacatgggcctgctgacctctggggtggaatttgagtcactgccagctgctttgtcccttcccgcagagtccggcctttaccctgtgactctggtgggcgtgccccaaacaaccggaacaatcacggtgaacggataccatacaaccgtgtttggagtgttctccgactgcctgcttgacaatttgccaggcatcaagacgagcggcagcacagttgaagttatacctgctctgccgagacttcagataagcacgtcactgccaagatcggcccattcactccagccaagctctggcgacgagatcagcacaaacgtcagcgtacaactttataacggcgagagccagcagcttatcatcaaactcgaaaatatagggatggaacctttggagaagctcgaagtcacatccaaggtccttaccacaaaagaaaagctttatggtgactttttatcatggaagctcgaggagacgcttgcccagttccctctgcagccaggaaaggtggcaaccttcacaattaatattaaggttaaactggacttcagctgtcaggaaaatctccttcaggatttatccgatgatggaatatctgtgtctggatttccactttcttcaccctttagacaggtagtacgtcccagagtagagggcaaaccagtcaacccccctgagtcaaacaaggccggagattattcgcacgtaaaaacgttggaggccgtgctgaactttaagtatagtgggggtccgggacacactgagggatattataggaacctctctctgggcctccatgtcgaagtagaaccaagcgtcttctttacgcgcgtgagtacgctgcctgcgacttccacacggcagtgccacctattactggacgtctttaattcaaccgagcatgaattgacggtgtctacccgctcctctgaagcccttattctacacgcaggggaatgtcagaggatggctattcaagtggataaattcaatttcgagagctttcctgaatctcccggtgagaagggtcagttcgctaatcccaaacaactcgaagaagaaagaagagaggctcggggactggaaattcattctaagctaggtatatgctggcgtataccttcactgaaaagatcaggagaggcgagtgtggaaggactgctgaaccagctggtgctggaacatctgcagctggccccattgcagtgggacgtgctcgtcgacggccagccgtgcgaccgtgaggcagtagccgcatgtcaggtgggggacccggttagactggaggtcaggctgaccaaccggagcccgaggtctgtggggccttttgctttgaccgtggttcctttccaggaccaccagaacggcgtacacaactacgacttgcacgataccgtgtcctttgttggatcgtctacgttctatcttgatgccgtgcagcccagtggccaatctgcctgtctgggggctctactgttcttgtataccggtgatttcttcctgcacatccgatttcacgaagattctacttccaaggaattaccaccaagctggttctgtctcccgtccgtacacgtgtgtgctctcgaagcccaggcttag

SEQ ID NO: 244307 - DNA, 3741 bp, Artificial Sequence
  Description of Artificial Sequence: Synthetic coding sequence
atggtgccagccggtgatcaggacagggcaccccacaggggcaagccagcccaagccggtgctaggaccagtcgtgcctcacgagcgctgagaagctggaggaggtcgcaggctgccagggccacggtcacacatcccagggggggacatgaccgaggcagccacggcggatacagggaaggccatcgcggatgcagacgcgaccctcagtgggccagtgctggaccgccacctttgtctttcacggaagaagtgaaattcgagcttcgcgcacttaaggattgggactttaaaatgtccgtaccggactacatgcagtgtgctgaggaccaccaaacgctgctggttgtggtgcagccagttgggattgtgtcagaagagaactttttccgaatttataagcgcatttgttccgtgtctcaaatatcagtccgcgatagtcagagagtcttgtacatccggtatcgccatcactaccctccggaaaataatgaatggggggattttcagacacaccgtaaagtggtcgggttgattaccattacggactgtttttcggccaaggattggcctcaaaccttcgaaaagttccatgttcaaaaggagatctatggatctaccctgtacgattccagacttttcgtatttgggcttcagggggagattgtggaacaaccacggaccgacgtcgccttttatccaaactacgaggactgccagactgtggagaagcggatcgaggacttcattgaaagtctgttcattgttctggaatccaaacgtcttgatcgggcaaccgataaaagcggggacaaaatccctctgttgtgcgtgcccttcgagaaaaaggatttcgtgggcttggataccgattcccggcactataaaaaacggtgccagggaaggatgcggaaacacgtgggtgatctgtgcctgcaggctggcatgctccaggactccttagtgcattaccacatgtcagtagagctcctgcgctcagtgaatgactttctctggttaggggctgccctggaggggttgtgctccgcctcggtcatttatcactacccaggaggaacaggtggaaaatccggagctcgcaggttccaagggtctactctgccggcagaagccgctaacagacaccggcctggcgctcaggaagttctcattgatccaggggcactcaccacaaatggtattaatcccgacacaagcacagagataggcagagctaaaaactgtttatctccggaggacataatcgacaagtacaaggaagccatcagctactactcgaagtataaaaacgcaggagtaattgagctcgaagcttgcatcaaggcagtgagggtcctagctatacagaaacgctccatggaagccagtgaattcttgcagaacgcagtgtacattaatctacgacagcttagcgaggaggaaaaaatacagcgctattcgattctgtcagaactatatgagctgatcggatttcaccgtaaatcagccttctttaaacgtgttgccgctatgcagtgcgtagcccctagcattgccgaaccagggtggagagcctgctacaagctcctactcgagaccctccctggttatagtctcagtctggaccctaaagatttctccagggggacccaccggggttgggcagctgtgcaaatgaggctgctccatgaactagtgtacgcctcccgtaggatgggcaatcctgctctgtctgtccgccacttgtcgttcctgttgcagactatgctggacttccttagcgatcaggagaagaaggatgtggcccagtcgctcgaaaattacacctcgaagtgccctggaacaatggagcctatagctctaccaggaggactgactcttcctcccgtgccgttcacaaagttaccaatagtcagacatgtaaaacttctgaatctgcccgctagtctgagacctcataagatgaaatccctgctgggccagaacgtttccaccaaaagccctttcatctattcacccatcatcgctcacaaccggggagaagagagaaataaaaagatcgactttcagtgggtgcagggagacgtgtgcgaggtgcaactcatggtctataacccaatgccttttgaacttagggtggaaaatatgggcctcttaacttcaggcgtggaattcgagagcctgcccgctgccttgtccctcccggcagagtcagggctgtatcccgtcacgttagttggtgttccccaaaccacaggcacaatcacagtgaatggctatcatactaccgtgtttggggttttttccgactgccttttggacaacctgcctggaataaaaactagcgggtctaccgtcgaggtcatccccgctttacctagactgcagatctcaacaagcctacctaggagcgcccattctctgcagccttcttctggtgatgaaatctcaacaaatgtgtccgtgcagctttacaacggagaatcacagcagctgataatcaagcttgaaaacatcggaatggagccattggagaagctggaggtgacctccaaagtgctgaccactaaagagaaactgtatggtgattttttgtcctggaagctggaggaaaccttggctcagttccccttacagccgggtaaagtggccaccttcacgattaatatcaaggtcaaacttgatttttcatgtcaggaaaaccttcttcaagacctgagcgacgacggcattagcgtttccggatttccattatcgtctccattcaggcaggtggtgcgcccaagggtcgaaggaaaacccgtcaatccccctgagtcaaataaggctggagattattctcacgtgaaaaccctagaggccgtccttaatttcaagtattcaggtggaccaggtcacaccgagggctattacagaaacctgtcacttggtctacatgtggaggtcgagccaagtgtgtttttcaccagggtgagcacacttccggcaactagcacccgccaatgccacctgcttctggacgtcttcaattcaacagaacacgagttgaccgtgtcaacgcgctccagcgaggcactgatattacacgcaggagaatgccagaggatggccattcaggtcgacaaattcaacttcgagagctttcctgagagccctggcgagaaggggcagtttgccaatcctaagcaactggaggaggaaagacgggaggccaggggcctggaaatccacagcaaactgggaatttgctggagaatccctagcctgaagcgttctggcgaggcctcagtggagggactgcttaatcagcttgtcctagaacatctgcagctcgccccattgcagtgggatgttctggtcgatggccagccttgtgaccgcgaggccgtcgcggcatgtcaggtcggcgacccagtgagactcgaggttcggctaactaacaggtcacctagatcagtgggaccgttcgccctgaccgttgtgcccttccaggatcaccagaatggcgtgcataattatgacctgcacgataccgtgagtttcgtgggatctagcacgttctacctggatgccgtacaacccagtggccaatctgcgtgcctgggcgctctcctgttcttgtatacaggggatttttttttgcatatccgcttccatgaagactctactagtaaggaactcccaccctcttggttctgcctgcctagtgttcacgtttgtgctttagaagcacaggcctag

SEQ ID NO: 244308 - DNA, 3447 bp, Artificial Sequence
  Description of Artificial Sequence: Synthetic coding sequence
atgtcagtaccagattatatgcagtgcgccgaggatcaccagacactacttgtggtggtgcagcctgtaggaatagtgtctgaggagaacttttttcgtatctataagcgcatttgctcagtgagccaaatctctgtgagagactcacagcgcgttctgtatattaggtacagacatcattacccaccagaaaacaatgagtggggagatttccagacccatcgcaaagttgtcggcctcatcacgattactgattgcttctccgctaaagactggccacagacattcgaaaaatttcacgtgcagaaggaaatctatggttccacactctatgactcgcgtctgtttgtctttggactccaaggcgagattgtcgaacagccacgcactgacgttgccttttatccaaattacgaggattgccagaccgtggaaaagaggatagaggacttcattgagtccctctttatcgtactggaatccaagcgcctggacagagccaccgacaaatccggcgataaaataccactgctgtgcgtcccattcgaaaaaaaagacttcgtgggccttgatacggacagtcgacattacaaaaagcgttgtcaggggagaatgagaaagcacgtgggagacttgtgcctgcaggctggtatgttgcaggattccctcgtgcattatcacatgtcggtggagctgctgcgttcagtcaatgacttcttatggttaggagcagccctggagggtctctgcagcgcaagcgtaatctaccattacccaggcggaactggaggtaaaagcggcgcacggcgattccagggcagcacgctacccgctgaagccgctaaccgccacaggcccggagctcaggaagtccttattgaccctggtgcactgactaccaatggcatcaatcctgatacctccactgagatcggtcgggctaagaactgtctaagcccagaagacatcatagataagtacaaggaagccatttcatattattccaaatacaagaacgcaggcgtcattgagctagaagcttgtataaaagccgtccgagttttggccatccagaagaggtcgatggaggcttcggagtttttgcaaaatgccgtgtacataaatctgcgccaacttagtgaagaagagaagatacaacggtatagcattcttagcgaactttatgagttgataggatttcaccgcaagtcagccttctttaagcgggtcgctgcaatgcagtgtgtcgccccaagcatcgctgaacctggctggcgggcatgttacaaattgctcttagaaacactcccagggtattctctaagcctcgaccccaaggacttcagtagagggacacatagaggttgggctgccgtgcagatgaggctgctccacgagcttgtttacgcaagccggagaatggggaatccagcgttgtccgttcggcatttgagctttttactgcagactatgctcgattttttgagtgaccaggaaaaaaaggatgtggcacagtcgctggagaactatacctctaagtgtccgggaactatggagcccatcgcccttcctggcggactgactctccctccagtcccctttactaaactgcccatagttcggcatgtgaagcttctgaacctccctgccagtcttcgtccacataagatgaaatctctgttaggccagaacgtgtcaaccaagtccccattcatatatagtcccattattgcacacaatagaggggaggagcgcaacaaaaagatcgacttccaatgggtacagggggacgtgtgtgaggtgcagctgatggtgtataatcccatgcctttcgagctcagggtcgaaaatatgggtctacttacgtcaggcgtggaatttgagtctctgcccgcagccctctccttgccagcagagagtggactctaccccgtcacactagttggcgtcccgcagaccaccggcaccatcacagtgaacggataccacactactgtgttcggagtttttagcgattgcctgctcgataacttacctggcataaaaacttccggcagcaccgtcgaagtaatacccgctctgcctcggctgcaaatatcaacttcgttaccccgatcagcacactccctgcaaccttcctccggcgacgaaattagtaccaatgtctctgtgcaactttacaacggcgaaagccagcagctcatcattaaactagaaaatattgggatggaacccctcgagaaattggaggtaacctctaaggtcttgactacgaaggagaaactctatggtgattttttgtcctggaagctggaggagaccttggcacaattcccgctccagccagggaaagtggctaccttcactatcaatattaaggtgaagttggattttagctgtcaagaaaacctcctgcaggatcttagtgacgatggtatttctgtgagtggatttcccctctcttcaccgttcagacaagtcgtcaggccgcgtgtggagggcaagccagtcaaccctccggagagtaataaggctggggattatagccatgtaaaaactttagaagctgtgctgaattttaaatattccgggggtcccggacatacggagggctattatcgtaatctcagcttaggtctgcacgtagaggtggagccatcagtgttttttaccagagtgagcactttgccagccacatctactcgtcagtgccaccttttgctggacgtgttcaattccacggaacatgaactgactgtgtctacacggtccagcgaggccctaatacttcatgccggtgaatgccagagaatggccatccaagtcgacaagttcaattttgagagtttccctgaaagtcccggtgaaaagggtcagttcgccaacccaaagcagcttgaagaggagcggcgagaagcaagggggttagagatccactcaaaactcggaatctgttggcgcataccctcccttaaaagatctggagaagcatccgtggaagggcttctaaatcaactggtgctcgagcacctacagctggcccctctgcagtgggatgttctcgtggacggacagccctgcgatcgcgaagccgtcgccgcatgtcaggtgggcgaccccgtccggctggaggttcgtctcaccaatcggtccccgcgaagcgtaggtccatttgcgttgactgtggtcccttttcaggaccaccagaacggcgttcacaattacgacctgcacgacacagtcagtttcgttgggagttcaacgttttacttggatgcggtccagccctctggacagagcgcatgccttggggcattgctgtttctttataccggggatttcttcttgcatataaggtttcacgaggatagcacctcgaaggagctgccaccatcatggttctgccttcccagcgtccatgtgtgtgcgctggaggctcaagcctag

SEQ ID NO: 244309 - DNA, 2862 bp, Artificial Sequence
  Description of Artificial Sequence: Synthetic coding sequence
atggcattggtgtttcagtttggacagcccgtgcgggctcaaccattgcccggtctctgtcacgggaagttaatccgcactaacgcttgcgacgtgtgtaacagcacggatttgcccgaagtggaaattatcagcctcctggaggagcaattgccacactacaaactgcgtgctgacactatttatgggtatgatcatgatgactggttacacactccgcttattagcccagacgcgaatattgatcttaccacggaacagattgaggaaacactgaaatatttcttgctctgtgctgaacgggtgggtcagatgaccaagacctacaacgacatcgatgcagtgacgcgcctgctcgaggagaaggagagggatctagagctggccgcaagaattgggcaatcgcttctcaagaaaaataaaactttgactgaaaggaacgagcttctcgaagagcaggtggagcacatcagggaggaagtgagtcagctccggcatgagcttagtatgaaagacgagctgctgcagttctacacgtctgccgcagaggaatcagagcccgaaagcgtgtgcagtaccccactgaagcgcaacgaaagcagcagtagtgtgcagaactactttcacctagattccctgcaaaaaaagcttaaggacttagaagaagaaaatgtcgtactgcgatccgaagccagccagcttaaaaccgagaccatcacatacgaggagaaggaacagcagctagtaaacgattgcgtgaaggaactacgggacgcaaatgttcagatcgcctctatctctgaagagcttgccaaaaaaacagaggacgccgcacggcaacaggaggagataacccatctgctatcacagattgtggacctacaaaagaaggccaaggcgtgtgctgttgaaaacgaggaattggtgcagcatcttggcgcagctaaggacgcccaacggcagctgacagccgagcttagggagctagaggataagtatgctgagtgcatggagatgttgcacgaagctcaggaagagcttaagaatcttagaaacaaaacaatgcccaataccacttctcgcagatatcactcgctagggctttttccgatggatagcctcgccgcagagattgagggcacaatgaggaaggaacttcagttggaagaggccgaatctccggacatcacccaccagaaacgtgttttcgaaaccgtccggaacatcaatcaggtggtgaagcagaggtctttgacaccatcccccatgaatattccaggatcaaaccaatctagcgccatgaactctctgcttagctcctgtgtttcaacccctcgctcaagcttttatggatcagatatcgggaacgtggtgctggataataaaaccaattctattatcctggaaaccgaggccgcagacctggggaacgacgagcgtagcaagaaacccggtacccccggtactcccggatctcacgatttggagaccgctctccggagactgtccctgagaagagaaaactacctcagcgagagaaggttttttgaagaagaacaagaacggaaattacaagaacttgccgagaagggcgagctgcgcagcggctcactgacgccaactgagagcattatgtccttggggactcacagccgtttcagcgagttcaccggctttagcggtatgtctttttcctcacggagttacctgcccgagaagctgcaaatagtgaaaccattggagggctccgctacacttcatcattggcagcaactcgcccagcctcaccttggtggtatcctcgaccccaggcccggagtggtgaccaaaggcttcaggaccctggatgtagatcttgatgaagtttactgcctgaacgacttcgaggaggatgatacgggcgatcacatctccctcccgagattggccaccagtaccccagtgcagcaccccgagacatccgcgcatcacccgggaaaatgtatgagtcagaccaactctaccttcacattcacgacctgtcggatcctgcacccctcagacgagttgaccagagtgacaccatcgctgaatagcgcaccaactcccgcatgcggatctacaagtcacctgaagagtacacctgtggccaccccttgtactccacgtcgcctgtctctggccgagtcttttaccaatacacgagagtctaccaccaccatgtcaacatccttaggcctggtctggctcctgaaggaacggggtatttccgctgccgtttatgacccccagtcctgggatcgcgcaggccgaggatcgctgctgcattcgtatacgcccaagatggccgttatcccgagtacaccccctaacagccctatgcagaccccaacctcaagccccccttcctttgaatttaagtgtacgagtcctccatatgacaatttcttggcaagcaagccagcctctagtatccttagggaagtgcgcgaaaagaatgtgaggagcagcgagtctcagaccgacgtgtccgtttccaatctcaacctggtggacaaagtccggcgatttggggtcgccaaggtggtcaactctggcagggcccatgtgcccacgttgacggaagaacaggggcctttgctctgtggacccccaggcccagcgcctgctctggtgccccgtggcttggtgccagagggccttccactgagatgcccaaccgtgacgtctgcaatcggcggattgcagctgaactcagggatccgcaggaatcggagctttccgacgatggtgggctcctccatgcaaatgaaggccccagtcactctgacctctgggattcttatgggcgcaaagctaagcaagcagacctccctccgttag

SEQ ID NO: 244310 - DNA, 2061 bp, Artificial Sequence
  Description of Artificial Sequence: Synthetic coding sequence
atgagcctgagagataagggcggagaagaggagtgtttcgagtacgactgtcaagatgaggaacggaaaccaacccaccggcaacatgacactcaggatctcctggaggaggttctctgcgcggagcgagtcggccagatgaccaagacctacaacgatattgacgccgtgaccaggctgctggaggagaaagaacgtgacctggagctcgctgctcggataggacagagcctgttgaagaagaacaagaccctcacggagcggaatgaactgttagaggagcaggttgaacacatccgagaggaggtctcgcaactccgccatgagctgtctatgaaagatgagctgctccaattttacacgtccgccgcagaagagtccgagccagagagtgtatgttcgacccccctgaaaaggaacgaatcttcgtctagcgtccagaactatttccacctggattccctgcaaaagaagctcaaagaccttgaagaagaaaacgtggtactaagatcagaagcatcccaactcaagactgagacgatcacttacgaggaaaaagaacaacagcttgtcaatgactgtgtaaaggagttgcgcgatgccaacgtccagatcgcaagtatttccgaggaactggcaaagaaaactgaggacgcagctcggcagcaggaagaaatcactcacctactttcccagatagtcgatctgcagaagaaggcaaaggcttgtgccgtcgaaaatgaggagttggttcaacatctgggtgccgcaaaggacgcccagagacagttgaccgctgagctcagagagctggaagataaatacgcggaatgtatggagatgttgcacgaggcccaggaggagctgaagaacctgagaaacaagaccatgcccaatacaacaagcagaaggtatcactccctgggactgtttcccatggactctctggcggcagagatcgaggggacgatgaggaaggagttacagttggaggaagccgagagtcctgacattacacaccaaaagagggtgtttgagactgtcagaaacatcaatcaggtcgttaagcaaaggtcattaaccccgtccccaatgaatatccccggttcgaatcagagctctgccatgaactcattactgagctcctgtgttagcacaccgagaagttccttctatgggagtgatatcgggaacgtagtgttggacaataaaaccaatagcatcatacttgaaacagaggctgctgacctgggcaatgacgagaggtccaaaaaaccaggcacgcccggaactcctggatcccatgacctggagacagcactccggaggctatcactcaggagggaaaactacctcagcgaaagacgcttctttgaggaagagcaggagagaaagctccaggagctggccgaaaaaggcgagctgcggtccggttctctaactcctaccgaaagcattatgagcttagggactcacagcagattctcagagtttacagggtttagcggtatgtcattttccagtcggtcataccttccggagaaactacagatagtcaagcctcttgaaggcagcgccacacttcatcactggcaacagcttgctcagccccatttgggcggtattctcgaccccagacctggagtggtgactaagggatttcgcaccctggatgttgatctcgatgaggtgtattgcctgaatgatttcgaggaggatgacaccggcgaccatatttcccttcctcgcctcgcaactagtacacccgttcaacaccctgaaacctctggtgaacggagccaggccagggtgaccgtgtcaggatcacgttcctacccaagcagaccccaagcgagtcccgaggaaatgcaggaacccccagcagcgactgaagaagaagaagaggaggaagaggaagagggttctggagagggaacgacaatcagccctgtgaacctagcacccttccctgaagctgagttctgggcgattctcactagcgttccagggactatccggagtggatctctgtctgtggcaagtgcccgtttgtgtggatag

SEQ ID NO: 244311 - DNA, 2688 bp, Artificial Sequence
  Description of Artificial Sequence: Synthetic coding sequence
atgagcctacgcgacaaggggggagaagaagaatgcttcgagtacgactgtcaggacgaagagagaaaacctacacaccggcagcacgacacccaagacctcctcgaagaagtactctgtgccgagcgtgtcggacagatgactaagacttacaacgacattgatgcagttacgcgcttgctggaagaaaaagagcgcgacctcgaattagccgctcgaattgggcagtccctgctgaagaagaataagactctgaccgagaggaatgaactccttgaagaacaggtggaacacattagggaggaagtgagccagctgcgtcacgagctgtccatgaaagatgagcttctgcaattctacacatcagctgctgaggaaagtgagccagagtcagtgtgcagcactcccttgaaacgtaacgagtcaagcagctccgtccaaaactatttccacctggactccctgcaaaagaagctcaaagacctcgaggaggagaatgtagtgctgcgaagcgaggcaagtcagttaaagacagagaccatcacatatgaggagaaggagcagcaactagtgaacgactgcgtaaaggagctgcgcgacgctaatgtgcaaatcgcatctatatccgaagagctggccaaaaaaactgaggatgccgctcgtcagcaggaggagattactcacttgttgtcacagatcgtggaccttcagaaaaaggctaaagcttgcgcagttgaaaatgaagagttggtacaacatctcggcgctgccaaagacgctcagagacagttgaccgcggagctcagagagctcgaagacaagtacgcagagtgcatggaaatgctacatgaggctcaggaagaattaaagaatttgcggaacaagacgatgcccaacacaacgtccaggcggtaccacagcctaggcctatttccaatggattctcttgctgctgaaatcgaaggaacaatgagaaaagagctccaactggaagaggcagaaagtcctgacataacacaccagaaaagggttttcgaaaccgtgagaaacataaatcaggtcgttaagcaaaggtctctgacccctagtcccatgaacataccaggctcgaaccaatcctccgccatgaactccctgctttcaagctgtgtctcaacccctcggtcaagcttttatggaagcgacatcggcaacgtggtgctagataataaaaccaatagcataattctcgagaccgaagccgctgacctaggaaacgatgaaaggtctaaaaaaccaggaacgccgggaacaccaggctctcatgatctggaaacagccctgagacggctgagtctgcggcgtgaaaactatctgtctgagcgcagattctttgaagaggagcaggaacggaaactgcaagaactggctgagaaaggagagcttcggtcaggcagtctgacccccacagagtctatcatgtctctggggactcacagcagatttagtgaattcaccgggttctccgggatgtctttctctagcaggtcatacttgccagagaaactccagatcgtgaagccactggaggggtcggccacattacatcattggcagcaactggctcaacctcatctgggcggaatccttgatccacgacctggcgtagtcaccaaaggctttcgcaccctggacgtggaccttgacgaagtgtactgtttaaatgattttgaagaggacgatacgggggaccacatctcattaccacggttggccacgagtactccggtgcagcaccccgagaccagcgctcaccatccgggtaagtgcatgtctcaaacgaatagcactttcaccttcaccacctgtcgcatcctgcacccatccgacgagctgaccagagtgacaccaagcctgaattcagccccaaccccagcatgcgggtcgacttctcatctgaaaagcacaccagtggccactccctgcacaccacgacgactgagcttggcggagtcttttactaacaccagagaatctacgacaaccatgtccactagcctcggactagtatggttgctgaaggaaagaggaatatctgccgctgtgtacgatccccaatcctgggaccgagcaggtagaggttccttacttcacagctacacccctaaaatggccgttatcccgtccacccctcctaattctccaatgcagactcctacgtcgtcgccaccttctttcgaatttaagtgcacatccccgccatatgataacttcttagcatcaaagccggctagcagcatcttaagggaggtgagagagaaaaatgtgcgtagcagcgagtcccagaccgacgtgagcgtgtcaaacttaaacctggttgacaaggtgaggaggtttggcgttgcgaaggtggtgaattcaggtcgcgctcacgtccctacactgactgaagaacagggaccattactgtgcggacccccaggtcctgcacctgccttggtaccacgcggactggttcccgagggcctgcctttaagatgcccaaccgtgaccagtgctatcggcggtctgcaactgaacagcgggattcggcgtaaccgatcattccctacaatggtgggctcctctatgcagatgaaggcgcctgtgactctgaccagcggtatcctaatgggggcaaagctttccaagcagaccagcttgcggtag

SEQ ID NO: 244312 - DNA, 2361 bp, Artificial Sequence
  Description of Artificial Sequence: Synthetic coding sequence
atggcactggtattccagtttggacagcccgtgagagcccagccgctgcccggattgtgtcacggtaaactgatccgcaccaatgcatgcgatgtttgcaattcaaccgacctgcccgaagtggagattattagcctgctggaagagcagttaccccactacaagctcagggccgacacaatctatggttatgatcacgacgattggcttcacacgcccctgatttcgccagatgccaatatcgacttaacgaccgagcagattgaagaaacgctcaagtatttcctgctgtgtgcagaacgcgtgggccagatgaccaaaacatataatgatatagacgccgtgacccggctcctggaagaaaaagaaagagacctggaattagctgcgcgtataggtcaatctttgttgaaaaagaataagacactcacagaacgtaatgagctgctggaggaacaggttgagcatatccgagaagaggtttcccagctgcggcatgaactgtcaatgaaagatgagctacttcagttttatacatcggccgcagaggagtcggagccggagtctgtatgcagtacaccattgaagcggaacgaatcctcctccagcgttcagaattacttccacttagacagtctgcagaagaaattgaaagacctcgaggaagagaatgttgtcttaaggagcgaggcgagccaactgaagacagagactataacatacgaagagaaagagcagcagctcgttaatgactgcgtcaaggaattaagagatgctaacgtacagatcgctagtatcagtgaggagttagcaaagaagactgaagatgccgcacgtcagcaggaagagatcactcacctactgtcccagatcgtggatctgcagaaaaaggcaaaagcgtgtgctgttgaaaacgaagaactggtccagcacctaggagccgctaaggatgcacagaggcaactcacagcggagttgagggaactcgaggataaatacgcagaatgtatggagatgttgcatgaggcccaggaagaacttaagaacctacgaaacaagacgatgcctaacacaaccagccgccgttatcacagtctgggcctattccccatggactcgcttgcagccgaaatcgagggaactatgaggaaggaactccagctggaagaagctgagtctccagatatcacgcatcagaagcgggtgtttgagaccgtccgaaatattaatcaagtggtgaagcagagaagcctgaccccttcccccatgaacattccaggatctaaccagtcaagcgctatgaattctctcctgtcctcctgcgtatccacgccgagatcgagcttttacggcagcgatatcgggaacgtagtgctggataacaaaacaaactcgataatccttgaaacggaggctgccgaccttggcaacgatgaaaggagtaagaaaccgggaacccccggaacccccggaagccacgacctcgaaacggctcttaggcggttgagcctgagaagggagaattacctttccgaaaggagatttttcgaagaggaacaggagcggaagctccaggagctagccgagaaaggcgaactccgctccggatcgttaactccaaccgaatcaattatgtccctggggacacattcaaggttttccgagtttaccggcttcagcggcatgagctttagcagccgctcttacctgcctgaaaaactgcagatcgtgaaacccctcgaaggctctgccactctccaccactggcagcagttggcccagccccacctgggcggaatcctggatcctcgcccaggagtcgtaacaaaaggctttaggactttagatgttgatctggacgaagtgtactgtctaaacgactttgaagaggatgatacggctcatcaccccggtaaatgcatgtcccagacgaattcaacgttcactttcacgacctgcagaattctccaccctagtgacgagctgacccgggtgacacccagtctcaatagtgcccctacacccgcttgtgggtccacatctcatctgaagtctacacctgtggcgactccatgtacgcccagaaggctgtctctcgccgagtcgtttacaaatacccgggagtctaccacaaccatgagcacaagcctcggcctggtctggcttttaaaagagcgagggatttctgccgctgtttacgatcctcagtcctgggacagggccggacggggttctctcctccattcacacgaggatgtgacttgtgctaatttgggtgaaggtggtgtgctgagcagcttcttgctacggagcaccgaaaccccaaaatgcgtccttatcccatggatcggtaaccagtag

SEQ ID NO: 244313 - DNA, 2745 bp, Artificial Sequence
  Description of Artificial Sequence: Synthetic coding sequence
atgtctcagtcccagaacgcgatctttaccagccctaccggggaggagaatctgatgaacagtaaccacagggatagcgagtccatcaccgacgtttgtagtaatgaggatctcccagaggtggaactggtcagtctgttggaggagcagcttccccagtaccgtctcaaggtggatacgttgttcctgtacgaaaaccaggactggacacagtctccacaccagcgtcagcacgcctccgacgccctcagccctgttctggctgaggaaaccttcagatatatgattctgggaacagacagggtggagcagatgaccaagacctataacgatatagatatggtcacccatctgctggctgagagagaccgggatctggaactcgcggcacggatcgggcaagctctcctgaagcgcaatcatgtcctcagtgagcagaacgaaagcttggaagagcagctgggacaagcattcgaccaggtcaatcagctccagcacgaactgtgtaaaaaggatgagcttctgaggatagtgagcatcgctagcgaagagtccgagaccgactcctcatgctccacacccctaaggttcaatgagtcatttagtttaagtcaaggcttgctgcagctggaaatgctccaggaaaagctaaaagagttggaagaggagaatatggcgttgagatctaaggcatgccacatcaaaactgaaactgtgacctacgaggaaaaggaacagcagttggtgtcagattgtgtgaaagagctaagggagacgaatgctcaaatgagccgtatgactgaggagttatcaggcaaatccgatgaacttatccgatatcaggaggaactcagctctctgctttcacagatcgtcgatcttcagcataaactgaaggagcacgtaatcgaaaaggaagagctgaaactgcatctccaggccagcaaggacgcacagcggcagctcaccatggaactccacgagcttcaggatagaaacatggagtgcctgggcatgctgcacgaatcccaggaggagataaaggaattaaggtctcggtctggacctacagcacacctgtacttttctcagtcttatggcgcttttaccggtgagtctttagccgcagagattgagggcactatgcgaaagaagctgagtcttgacgaagaaagctccctgtttaagcagaaggctcaacaaaaacgggtctttgatactgtaagaatagcaaatgacacaagaggcagatccataagcttccctgcgctcctaccgattcccggatctaatagaagcagtgttataatgactgccaaaccattcgaatccggcttgcagcagactgaggacaagagccttctgaatcagggatccagctcagaggaagtggccggaagctcacagaagatggggcagccgggtcccagcggagacagtgatttagcaaccgcccttcaccggctgtccttgagacgacagaactatttgagcgagaagcaatttttcgctgaggagtggcagcgaaagatccaggtgcttgcggaccagaaagagggagtttcagggtgcgtcactcctacagagtcattagcaagtctgtgcactacccaatctgagatcacggatctttcttcagcaagctgtctccggggatttatgcccgagaaactgcagatcgtaaaaccgctggagggatcacagactttgtatcattggcaacagctggcccagcccaatctgggtaccatcctggatcctaggccaggcgtgattacaaaaggatttactcagctgcctggagatgctatataccacatctctgacttagaggaggatgaggaggagggaattaccttccaggtgcaacagcccctcgaagtcgaggaaaagcttagcacaagtaagccggtcaccgggatctttctccctccgatcacatcggctggcggaccagttactgtggccaccgcaaaccctggcaagtgcctgtcctgtacaaattccaccttcacatttacaacttgtcgaatactgcaccctagcgacattactcaagtcacgcccagctcgggctttccctctctgagctgtggatctagcggaagctcctcttcaaacacagccgttaacagccccgctttatcttatagactgagcattggagaatctatcaccaacaggcgtgacagcaccactaccttctccagcaccatgtcactcgctaagctgttgcaagaacgcggaatcagcgccaaagtatatcatagccctataagtgaaaatcccctgcaacccctgcccaagtctctggcaattccgtcaactcctccgaactctccttctcacagcccctgcccttctccactgcccttcgaaccgcgagtgcacctctctgaaaacttcctggcttcacgcccagcggagaccttcctgcaggaaatgtacggtctgcgcccttccagaaatccccctgatgttggtcaactgaagatgaatctcgtagatcgactgaagaggctgggcattgccagagttgtgaagaatcccggagcacaggaaaacggtcggtgtcaggaggccgagattggaccacaaaaaccagacagtgctgtctacctgaactctggttcttccctcttgggcggtcttcgcagaaaccagagtctccccgtgatcatgggtagcttcgctgcccctgtatgtacttcatctccaaaaatgggcgtcttgaaagaggactag

SEQ ID NO: 244314 - DNA, 936 bp, Artificial Sequence
  Description of Artificial Sequence: Synthetic coding sequence
atgagccagtcacagaacgccatcttcacctctcccaccggagaggaaaatctgatgaatagcaaccaccgggactccgagtcgattacggatgtctgctccaatgaagacctccctgaagtggagttggtcagcctccttgaggaacagctgccgcagtatcggctgaaagtcgatacactctttctttatgagaaccaggattggacacagtcccctcatcagcggcaacatgcgagtgatgcactgtcccctgtcctagccgaagagacctttagatatatgattcttggcactgatcgcgtggagcagatgactaaaacctacaacgacatcgacatggtcacacacctcctcgccgagagagacagggacctggagctggcagctcgcatcggccaggctctccttaaacggaaccatgtgctgtctgaacagaacgagagcctggaagagcagctcgggcaggctttcgaccaggttaatcagttgcagcatgagctgtgcaagaaggacgagctcctgaggatcgttagtatcgcctctgaagagagtgagaccgactcttcttgttccacacctctgcggtttaatgagagctttagtctttcccagggtcttttgcagctggaaatgcttcaggaaaagctgaaagagctggaagaggagaatatggcgcttcgctccaaggcctgtcacatcaagaccgagaccgtgacctacgaggagaaggagcaacagctggtcagtgactgcgtaaaggaactgcgcgaaacgaacgcccagatgtctcgcatgacagaagaactgtcaggcaagtctgatgaactgattagataccaggaagagctctcttccctgctgtcccaaattgtggacctgcagcataagctgaaggaggtaggcttgtttatccactcaactgacatttgctag

SEQ ID NO: 244315 - DNA, 93 bp, Artificial Sequence
  Description of Artificial Sequence: Synthetic coding sequence
atgagccagagccagaatgctatatttaccagccctactggggaggagaacctcatgaacagcaaccacagagatagtgagagcataacctag

SEQ ID NO: 244316 - DNA, 2340 bp, Artificial Sequence
  Description of Artificial Sequence: Synthetic coding sequence
atgattctgggtaccgaccgtgtggagcagatgaccaaaacttacaatgacatcgatatggttactcacctgctagcagagcgtgacagggatctcgaactcgcagccagaatcggacaggcccttctcaagcgcaaccacgttttgtcagaacagaatgagtctttggaagagcagctgggacaggcatttgatcaggtgaaccagctgcaacatgagctatgtaaaaaagatgagcttctgcggatagtatccattgcatcagaggaatccgagacagacagctcatgtagtaccccgctgaggttcaatgagtctttctctctctctcaaggcctcctgcagctcgagatgctccaagaaaagctcaaagagttagaggaggagaatatggcactgaggtctaaggcctgccatataaagaccgagaccgtaacctacgaggagaaagagcagcagctggtatctgattgcgtcaaagagctgcgcgagacgaacgcgcagatgtctcgcatgacagaagagctctctggcaagtcagatgagctgattcggtatcaagaggaattgtcttccctactgtcccagattgttgatcttcagcacaagttgaaggaacacgttatcgaaaaggaggagctcaaactgcacctacaggcctcgaaagatgcccaacgccagctcacaatggagctgcacgagctccaggacagaaacatggagtgcctggggatgcttcacgagtcacaggaagagattaaagaacttagatctcgatcaggcccaactgctcatctatacttttcacagagttacggcgcattcaccggcgaatcgctggcagcggaaatcgaaggaactatgaggaaaaagttaagcctggacgaagagtcaagcctttttaagcagaaggcccagcagaagagagtgttcgataccgtgcgcattgccaatgatacccgtggaagaagtatcagttttcccgcactgttacctattcctggcagcaataggagctctgtgattatgaccgccaaacccttcgagtcggggctgcaacaaaccgaagataaatccttgctcaatcagggatcttcttctgaagaggtggcaggcagcagccagaagatgggccaacccggtcctagtggggactcagatcttgctacagccctgcaccgacttagtctgaggcgtcagaactatctcagcgaaaagcaattttttgctgaggaatggcagagaaagatccaggtattggccgatcagaaggagggagtctcagggtgtgtcacacccaccgaatcattagcttcactctgcaccacacagtccgagattaccgacctgagcagcgcctcctgcctccgagggttcatgccagagaagctgcaaattgtgaagcccttagaagggtcgcagacgctctaccactggcagcagttagcccaaccgaatttagggacgattctggatcctagaccaggggtgattaccaagggctttacgcagctaccaggagatgcgatctaccacatctcagacctagaagaggatgaggaggagggtatcacctttcaagtgcagcagccactcgaggtcgaggaaaaactcagcaccagcaaaccagtgactggaatcttcctaccacctatcacttctgcaggaggtcccgtgacagtcgcgacagccaaccccggtaaatgtctgagctgtaccaatagcacgtttacctttactacgtgtcggattcttcatccctccgacattacccaggtcacaccaagctccggctttccttccctgtcctgcggatcttctggctcctccagcagcaatacagccgttaattctcccgctctcagttacaggttgtccatcggtgaatcaatcaccaacagacgtgatagcaccaccacattttcctctactatgtctctggcaaagctgttgcaagagaggggaattagcgcgaaagtttaccattcaccaatttccgaaaaccccctgcagccactgccgaagtccctcgcaattcccagtaccccgcctaacagcccctcacattccccctgtcccagccccctcccatttgagccccgtgtacatttgtcggagaattttctagcctcaaggcccgcagaaacatttcttcaagaaatgtatggccttcggccaagtagaaaccctccggacgtgggccaactaaagatgaatcttgtggatagactgaaaagactggggatcgcacgagtcgtcaagaacccagtgcccaagcgtatggaagacgcgaggcgacagaaactcgtgctcaaaaaccagatcctccttttcatctag

SEQ ID NO: 244317 - DNA, 486 bp, Artificial Sequence
  Description of Artificial Sequence: Synthetic coding sequence
atggaaaaaccgctgaccgtgctgagagtttccctctaccatccaacacttgggccatctgcgttcgccaacgtcccccctcggctgcagcacgatacctcccctcttctgctgggcagaggccaggacgcccatttgcagctgcagctgccgagactcagcagacggcacttatctttagaaccctatctagagaagggttctgctctgctagcattctgtctgaaagccctgagccgaaagggctgcgtctgggtgaacgggctaacactccgctatctcgagcaagtacccctgtccaccgtgaatcgggtctcctttagcggaatacaaatgcttgttcgtgtcgaggagggaacgagcttggaggcctttgtctgttactttcatgtgagtccctctccacttatataccggccagaagccgaggagactgatgagtgggagggcattagtcagggccagccccctcccggaagtggatag

SEQ ID NO: 244318 - DNA, 1749 bp, Artificial Sequence
  Description of Artificial Sequence: Synthetic coding sequence
atggcagagtttctggatgaccaggagacccgactttgcgataattgcaagaaagaaatcccagtcttcaatttcacgatccacgagatacattgtcagagaaatatcggtatgtgccccacttgtaaggagccttttcctaaatcggacatggaaacacatatggccgctgagcattgtcaagtgacgtgcaaatgtaacaaaaaactcgagaaaagactgctgaaaaagcacgaagagaccgaatgcccactacgactggctgtatgtcagcactgtgacctcgagttgtcaatacttaaacttaaagagcacgaggactattgcggggcacggacagaactatgcggcaattgcggaagaaatgtgctggtgaaagacctaaaaacccatcccgaagtgtgcgggcgtgaaggagaggagaaaagaaacgaagtggccatacctccgaacgcctacgatgagtcctgggggcaggacggcatctggatcgcaagtcagctcctgaggcagattgaagcattagatccacctatgcgattgcctaggcgtccactacgagccttcgagtcagatgtcttccacaaccgtaccactaatcaaaggaacattactgcccaggtgagcatacagaataatctgtttgaagaacaggagagacaagagcgaaatagaggccagcagccgccaaaggaggggggtgaggagtctgccaacctcgacttcatgttagcgctttctctgcagaatgaggggcaggcctcgtcagtggccgaacaggacttctggcgcgcagtgtgcgaggccgaccagagccacggagggcctagatcactgtccgacatcaagggggctgccgatgagattatgcttccctgcgaattttgtgaagagctgtaccctgaagagctgctgatagatcaccagacctcttgtaatccatcacgcgctctaccttccttgaacacaggaagcagctcgccgcgtggagtggaggagccagacgtgatctttcaaaacttcctgcagcaggccgctagcaatcagctggatagtctgatgggactgtcaaatagccaccctgttgaggagtctatcatcatcccatgcgagttttgcggcgtccagttggaagaggaggtccttttccaccatcaagaccagtgcgaccagcgccctgccacagcaactaaccacgttactgaggggattccgaggctcgatagtcagccccaggagacatctccagaattgccacgcagaagagtccgccaccagggagacctttcctccggataccttgacgacaccaaacaagaaacggccaatgggccaacgtcttgcttacctccatcaaggcccatcaataacatgactgccacttacaaccagctctccaggagcacctccggccctaggccgggttgtcagccaagtagcccatgtgtacctaagctgagcaactccgattcccaagatatccaagggagaaaccgggattctcagaacggcgcaatcgcacccggtcatgtgagcgtgataagacctccccagaatctgtaccccgagaacatagtgccaagcttttcccctggcccttccggcaggtatggagcatctggaagaagtgaaggcggacgaaactcccgcgtgactcctgctgccgcaaactataggtcccgaaccgccaaggcgaaaccctcgaaacagcagggcgctggtgatgcagaagaagaggaagaggaatag

SEQ ID NO: 244319 - DNA, 1749 bp, Artificial Sequence
  Description of Artificial Sequence: Synthetic coding sequence
atggccgaatttctggacgaccaagagactcggctgtgcgataactgtaagaaggagattccagtttttaactttaccattcacgagatccattgtcagcgaaacataggtatgtgcccaacatgcaaagagccctttcctaagagcgacatggaaacacatatggcggcagaacactgccaggtgacttgtaagtgtaacaagaaactagagaagcgcttacttaaaaagcacgaggaaactgagtgccctctccggctcgccgtttgccaacattgtgacctggaactgtcaattctgaaactgaaagagcacgaggactattgtggcgcacggacagagctgtgtggtaattgtgggagaaatgtgctagtcaaagatctgaaaacccacccagaagtgtgcggcagagagggagaggagaagcgaaacgaggtggccatcccccctaacgcctacgatgagagctggggtcaggatgggatctggatcgcatcgcagttgctgcgacaaatagaggcactggatccacccatgagacttccccgtcggccactccgggcatttgagagcgatgttttccacaaccggactacgaatcagcggaacattactgcacaggtctccatacaaaataatttgtttgaagaacaggagcgccaagagcgcaatcgcggtcagcagccgcctaaggagggaggcgaggagagcgctaacttggatttcatgcttgccctatcactgcaaaatgaggggcaagcctcttctgtcgctgagcaggacttttggcgcgcagtatgtgaggctgatcaaagtcatggtggccctagatcactgtctgacatcaaaggcgcagccgatgagattatgctaccttgcgagttttgtgaggagctctacccagaggagctcttgatcgatcaccaaacatcctgtaacccttctcgcgctctccctagtcttaatactggctcatcaagccctcggggtgtggaagaacctgacgtgattttccaaaacttcttgcagcaggctgcaagcaaccagctggactcgctgatgggactgtccaactctcacccagtggaagagagcatcattataccttgtgagttttgcggagttcagctcgaggaagaagtgcttttccatcaccaggatcagtgtgaccagcggccagcgaccgcaaccaatcacgtgaccgagggcatacctcggctcgattcccagcctcaggaaaccagtcctgagctcccaagaaggagagtaagacaccagggcgatctgtcttctggttacctcgacgacaccaaacaggagaccgccaacggccctactagctgtttgccccctagtcggccaatcaacaatatgaccgcaacttataaccaactgtccaggagtacaagcggccctaggccgggttgtcagcccagttccccctgcgttcctaagctgagcaactccgatagccaggatattcaggggcgaaaccgtgattcccaaaacggtgccattgccccaggacatgtatctgtcattcgtcctccccaaaatctgtacccggagaacatagtgccaagcttctcccccggtccaagcggccgttatggggcttctgggagatctgagggtggcaggaattctagagtaacccctgcagcagccaattatagatctagaaccgcaaaagctaagccaagtaaacagcagggggctggcgatgccgaggaggaggaggaagaatag

SEQ ID NO: 244320 - DNA, 408 bp, Artificial Sequence
  Description of Artificial Sequence: Synthetic coding sequence
atggccgagttcttggatgatcaagaaaccagactgtgtgacaattgcaagaaggaaattcccgtgtttaattttaccatccacgagattcactgtcagagaaacataggtatgtgtccgacctgtaaggagcccttccccaaatctgacatggagacgcatatggccgcagagcactgtcaggtgacctgtaaatgtaacaagaaactcgaaaaaaggctgttaaaaaagcacgaagaaaccgaatgccccttgaggctggctgtgtgccagcactgtgacctcgagctctccattcttaagctcaaggaacacgaggactattgcggcgcaaggactgaactttgcggcaattgtgggaggaatgtgctggtgaaagatttgaagacccaccccgaagtgtgctag

SEQ ID NO: 244321 - DNA, 495 bp, Artificial Sequence
  Description of Artificial Sequence: Synthetic coding sequence
atggcagagttcttggatgaccaagagacacggctttgcgataactgtaagaaagagattcccgtgttcaattttactatccacgaaatccactgccagaggaatatcggtatgtgtcctacatgcaaagagcctttccccaagtctgacatggaaacccatatggcagccgagcactgtcaggtgacgtgcaagtgtaataagaagctagagaagcggctgctgaaaaaacacgaagagacggagtgtccccttcggcttgcagtctgtcagcactgcgatttagaactgagcatactcaagctgaaggaacacgaagactattgtggtgctcgcaccgaactttgtggaaattgcggcagaaatgtattagtgaaggatcttaagacccacccagagctgaagaataagcgcggaaggaagggaattgaagccaatagtcccccaaaacgggtcgtaaaacgcgtccagacctggacatcgtgctggccctag

SEQ ID NO: 244322 - DNA, 852 bp, Artificial Sequence
  Description of Artificial Sequence: Synthetic coding sequence
atggcagaattcctggatgaccaagagactcggctgtgcgacaactgcaaaaaagaaatccctgttttcaatttcaccatccatgagattcattgccagagaaacatcgggatgtgccctacatgcaaggagccttttccaaagtctgacatggagacacacatggctgcagagcattgtcaggttacctgcaaatgtaataaaaaactggagaagcgccttttgaaaaaacatgaggaaaccgagtgccccctcagactcgctgtttgccaacactgtgatctcgaattgtccatcctgaaactgaaggagcatgaagattattgtggagctcgtacagagctctgcggcaattgtggccgaaatgtgctcgtaaaggatttgaaaacgcacccagaagtttgcggtagagagggagaggagaaacgcaacgaggtagctattccaccaaacgcctacgacgaatcctgggggcaggatgggatctggatcgcgtcccagctgctgcgtcagatcgaggctttggacccccctatgaggctccccaggagaccactccgcgcttttgagtctgatgtgtttcacaatcgcacgacaaaccaacgtaatataacagcacaggtttcgatccagaataatctgttcgaggagcaagagcggcaggagagaaaccgcggtcagcagcctcctaaggaggggggtgaagagtccgccaatctcgactttatgttggcgttgtccctgcagaacgaaggccaggcctcttcggtggctgaacaggacttctggcgagctgtgtgtgaagctgatcagagtcacggaggacctaggtctttgtcagacattaagtag

SEQ ID NO: 244323 - DNA, 414 bp, Artificial Sequence
  Description of Artificial Sequence: Synthetic coding sequence
atgggggcacatctggtgagaaggtacctgggggatgcatcggtggagcccgatccactccaaatgcccacattccctccggactacggcttcccggaaaggaaggagagggagatggtcgccacccagcaggagatgatggacgctcagctgcgcctccaattgagggactactgcgcccatcacctgatcaggctcctaaagtgcaagagggacagtttcccaaactttttggcctgtaaacaagaaagacacgactgggattactgtgaacacagggactatgtgatgcgcatgaaagagtttgaaagggaacgccgactgctgcagcgtaagaagcggagggaaaaaaaggccgctgagctggcgaaggggcagggtcctggcgaggtggatccgaaggtggccctgtag

SEQ ID NO: 244324 - DNA, 972 bp, Artificial Sequence
  Description of Artificial Sequence: Synthetic coding sequence
atgattcttcaggaaactaaggctgcttgtggcatccctgccatcccgcactgcagtagggttgagatcctggatgctaagactcgcgagaagctttgtttcttggacaaagtcgaaccacatgctactatcgcagagataaagaacttgtttacaaaaacccacccccagtggtaccccgcacgtcaatcactgagactggaccctaaggggaagtctctgaaagatgaagacgtgctgcaaaaactacctgttggtactactgctactttatactttcgagacctcggggcacagataagctgggttacagtgttcttgaccgaatacgccggacctctgttcatttatctgctgttctatttcagagtgccatttatctatggccacaaatacgattttactagctcccgccatactgtggtccatctggcttgtatatgccattctttccattacatcaaaagactcctggagactctattcgtccaccgtttcagtcatggcaccatgccactcagaaatatcttcaaaaactgcacctactactggggttttgctgcctggatggcttactacatcaatcatccactgtacacaccacctacctatggagcccagcaggtcaaactggccctggctatctttgtaatatgccagctgggcaatttttctatccacatggctcttcgggatcttcgccctgcagggtccaagacacggaaaattccatacccaaccaaaaaccccttcacgtggctatttctgctggtcagttgcccgaattatacctacgaagtaggctcatggattgggttcgcaatcatgacacagtgtctacccgttgcactgtttagtctggtggggttcacacagatgacaatttgggccaagggtaagcaccggtcctacctgaaggagtttcgcgattaccccccactccgaatgccaataattcccttcctgctatag

SEQ ID NO: 244325 - DNA, 1014 bp, Artificial Sequence
  Description of Artificial Sequence: Synthetic coding sequence
atgtcatcttctcctgttaagcgacaacgtatggagagcgccctagatcagctgaaacaatttactaccgtggtggccgacacgggggattttcacgccatcgacgagtacaagccccaggatgcaactactaacccatcacttattttggctgcggcacagatgccagcttaccaggaattggttgaagaggcaatagcctacggaagaaaactaggcggaagtcaggaggaccaaattaagaacgctatcgataagcttttcgttctcttcggcgcagaaatactcaaaaagattccgggaagagtgtccacagaagtggatgcacggctgtctttcgataaagatgcaatggtggctcgggcacgcaggctcatcgagttatataaggaggccggtatttctaaggatcgcatattaatcaaactctcttccacctgggagggtatccaagcgggtaaggagctcgaggaacagcatggcattcattgtaacatgaccctccttttttcatttgcccaggcggttgcctgtgctgaagctggagttacccttatcagcccattcgttggtcgaatcctcgattggcacgtggccaatactgataagaagtcctacgaaccacttgaggaccccggtgtcaaatccgtaacaaagatctataactactacaagaagttcagttataagaccatagttatgggagcaagcttcaggaataccggcgagatcaaagcacttgccggatgcgacttcctcaccatttcgcctaaactgctgggcgagttgctgcaagacaacgctaagctagtgccagtgctgtccgccaaagctgcacaggcatctgatctcgaaaagatccatttggatgaaaagtcttttcggtggctccacaatgaagaccaaatggcagttgaaaaactctccgacggaatacggaaattcgcggctgacgcagtgaagctggaaaggatgctgactgagaggatgtttaacgccgaaaatgggaagtag

SEQ ID NO: 244326 - DNA, 957 bp, Artificial Sequence
  Description of Artificial Sequence: Synthetic coding sequence
atgtcctcaagccctgtaaagaggcagagaatggaaagtgcgttggatcagctgaagcagtttaccaccgtggtcgcagatacaggagacttccacgccatagatgagtataaacctcaagacgccaccaccaatccttcgcttatcttagctgcggcacagatgccagcctaccaggagctcgtggaagaggctatcgcctatggcagaaaattgggcggatcccaggaggatcagataaaaaatgcaatcgacaaattgtttgtcttgtttggggctgaaattttgaagaagatcccgggtagagtgagcacagaagtggacgcgaggctgagcttcgacaaagacgcgatggtagcgcgtgcgagaaggcttattgaattatacaaagaagctggaatatcaaaagatcgaattctgatcaagctctcttccacctgggaaggaattcaggccggaaaagagctagaggaacagcacggtatacactgcaatatgacgctcctgtttagcttcgcccaggcggtcgcatgtgccgaggcaggcgtgactctgatcagcccctttgtaggaagaatccttgattggcacgtcgcaaataccgacaaaaagtcctatgagccactcgaagatccaggtgttaagtccgtaaccaagatatacaactattacaaaaaattctcatacaagactatcgttatgggagcatccttccgcaatacaggggaaataaaagcgctcgctggatgcgacttcctgacaatttccccaaagttacttggtgagctcctgcaggacaatgctaaattggttcccgtcctgtcagccaagccaaaacccgtgacctggaaaaagagtacgtggatgcgatccttgagtgtgggctgcacaactaggactagatggctgtggagatcatctcttaccgggagcgcctcgttacctctcatgcagtag

SEQ ID NO: 244327 - DNA, 1302 bp, Artificial Sequence
  Description of Artificial Sequence: Synthetic coding sequence
atgcgtcaatctcatcagctccccctcgttggtttactgctgttttctttcattcccagtcagctgtgtgagatctgtgaggtttctgaagaaaactacatccgcctcaagcccctcctgaacaccatgatccaaagcaattataacaggggaacctctgctgttaatgtagtcctcagcctgaaattggtgggaatccagatccaaacccttatgcagaagatgatccagcagattaagtacaatgttaagtctcggctgagcgacgtctctagtggggaattggcactcatcattctcgcccttggggtgtgccgcaacgctgaagagaatttgatctatgactaccacctgatagacaagctggaaaataagttccaggccgaaatagaaaacatggaggcacataatggaactcccctaacaaactactaccagttgtcacttgacgtgctggctctgtgcctgtttaacggcaattattccacggcggaggtagtgaaccacttcacccccgaaaataagaattactacttcgggagccagttctctgtagacacaggggcaatggcagtccttgcactgacctgcgtgaaaaaatctctgatcaacggacagatcaaagccgacgaaggttcgctgaaaaatattagcatctacactaaatccctggtcgagaaaatcctttcagaaaaaaaggagaacggtttgataggtaacaccttcagtacaggggaagccatgcaggctctatttgtgtcatctgactattataatgagaatgattggaactgtcaacagaccctcaatacggttcttacagagatctcccaaggggcattcagcaatccaaacgccgctgcccaggtactgcctgccctcatggggaaaactttcttagacatcaacaaagattctagctgtgtttctgcctctgggaacttcaacatctcagccgacgagccaatcactgtcactcctccagacagtcaatcctatatatccgttaactattctgtgcgcattaacgagacctacttcacaaatgtgaccgtgctcaacggatcagtgtttctgagcgtgatggaaaaggctcagaagatgaacgacacaatctttggctttacaatggaagagaggtcctggggcccatatattacgtgcatccaaggcttatgcgccaacaataatgaccggacttactgggaactgctaagcggaggggaacctttgagccagggcgctgggagctatgtggtccgaaatggcgaaaacctcgaggttaggtggtccaagtactag

SEQ ID NO: 244328 - DNA, 1083 bp, Artificial Sequence
  Description of Artificial Sequence: Synthetic coding sequence
atggctgctgccgcagccgcaggtgcaggtccagagatggtgcgtggacaagtgtttgatgtggggccaaggtacacaaacctgagctatattggcgagggggcatatggaatggtatgctccgcctatgataacgttaataaggtgcgggttgcaatcaaaaaaatttccccatttgaacaccagacgtactgtcagagaacgcttcgagaaattaagattctgcttcgcttccggcacgaaaacatcattggcatcaatgacatcatccgcgctcccactatcgagcagatgaaggacgtgtacattgttcaagatctgatggaaacagacctgtataaacttcttaaaacgcagcacctctctaacgaccacatctgctacttcctgtatcagattctcagggggctgaaatatatccactcagctaatgtgctgcaccgggacctgaagccctccaatctcctccttaataccacttgcgacctgaagatctgcgatttcggcctggccagggtggcagacccagaccacgatcacactggattcctcactgagtatgtcgccacaagatggtacagggcgccagaaatcatgttgaacagcaaggggtataccaaatctatcgatatttggtctgtggggtgtatcctggccgaaatgctgtctaacagaccgatcttcccagggaagcattacctagatcagcttaaccacattctcggcattctgggatcacccagtcaggaagatcttaattgcattatcaacttgaaggccagaaactacctgttgtcgctgccccataaaaataaggtcccctggaatcgtcttttccccaacgcggatagtaaggccctcgatttgctggataagatgctaacctttaatccgcataaacggatcgaagtggagcaggcgctggctcatccttacctagaacagtactacgatcctagcgacgagccaatcgcagaggccccatttaagtttgatatggaacttgatgaccttcccaaggagaagctcaaagaactcatctttgaagaaaccgcgcgattccagcccggataccgatcttag

SEQ ID NO: 244329 - DNA, 1203 bp, Artificial Sequence
  Description of Artificial Sequence: Synthetic coding sequence
atgagacatctcggcgcatttctcttccttctgggcgtgctcggagctttgaccgaaatgtgtgagatacccgagatggactctcacctggttgagaagctcggacagcaccttctcccttggatggatagactgagtttagagcatttaaatccctctatctacgtgggtctgagactgtcatctttgcaggcaggaaccaaggaggacctgtacctgcacagcttgaagctggggtatcagcagtgcctgcttgggagcgccttctcagaagacgatggagactgccagggcaagcctagtatgggtcaactggctttatatctgctggcattacgggcaaattggcatgatcacaagggacacccgcacacatcatactaccagtacgggctgggaattctcgccctgtgcctacaccagaagcgagttcatgattccgtggtcgacaaactactgtatgcagtggaaccattccatcaggggcatcattcggtggatactgccgcaatggccggactggcttttacctgcttgaaacgctccaactttaatccgggacgacgtcagcggattaccatggccatcaggactgtgcgtgaggaaatcctcaaggcacagacaccagagggccacttcggcaacgtgtattcaacgcccttggcattacagtttctgatgacatctccaatgcgaggagccgaattgggaactgcgtgcctgaaagcaagggtggcgctgctggccagcctgcaggacggtgctttccaaaatgccctaatgatctctcagctgctgcctgttcttaaccacaaaacgtatatagatctgatttttcccgattgtctggcccctcgagtcatgttagaaccggctgccgagacaattcctcaaacgcaagagatcataagcgtgactctgcaggtattgtcgctcctcccaccctataggcagtctatatctgtgcttgccggatcaacagttgaggatgtcctcaagaaagcccacgagctgggtggttttacatatgaaacacaagctagtctaagcgggccatatcttacctccgtgatgggcaaggccgctggggaaagggagttttggcagcttcttagagaccctaacactccgctcctgcaggggatagccgattacagaccaaaggatggtgaaaccattgaattgagattggtgtcctggtag

SEQ ID NO: 244330 - DNA, 843 bp, Artificial Sequence
  Description of Artificial Sequence: Synthetic coding sequence
atggaggatgaagtggtgcgtttcgcaaagaagatggataagatggttcagaagaagaatgccagtactagaattggaatgtccgtgaatgcaattcggaaacaaagcacggacgaagaggtgacgagtctggcaaagagtcttattaaatcctggaaaaagttactggatggtcccagcactgagaaggatttggatgagaaaaagaaagagcccgctatcacaagccaaaattctcccgaggcgcgagaggaatccacttcctctggcaatgtgtctaatcgcaaagatgaaactaatgctcgcgatacctatgtgagcagtttcccaagggcaccttcaaccagtgactcggtcaggctcaaatgcagggagatgctagcggctgccctgcgcaccggcgacgattacatcgctatcggcgcagacgaagaggagctcggcagccaaatcgaagaagcaatctatcaagaaatacggaataccgacatgaagtacaagaatcgggtcagaagtagaataagcaacttaaaagatgctaagaaccctaatcttaggaagaacgtgttatgtggcaacattcctccggatcttttcgcacgaatgaccgccgaagagatggcaagtgacgaactcaaagaaatgcggaagaatctcaccaaggaggcaattagggagcaccaaatggcgaaaacgggcggaacccaaacggatttgttcacgtgcggaaagtgcaagaagaaaaattgtacctatactcaagtgcagactcgcagcgctgatgagcccatgacaacttttgtggtctgcaacgaatgtggcaaccggtggaaattttgctag

SEQ ID NO: 244331 - DNA, 906 bp, Artificial Sequence
  Description of Artificial Sequence: Synthetic coding sequence
atggaggatgaggttgttagattcgccaagaagatggacaaaatggtccagaagaagaatgctgcgggagcactggaccttcttaaggaattaaagaatatccccatgacactcgaattactccagtctacccgtattgggatgtcagtaaacgccatccgaaagcagtccacagatgaggaggtaacctccttagcgaagagtctgattaagtcatggaaaaaactgctggatggcccttcaactgagaaagatctagatgaaaaaaaaaaggagccagctattacgtcacagaattcccccgaagcacgcgaggaaagcactagtagcggaaatgtttctaatcggaaagacgagacaaatgcgagagacacctacgttagcagctttccccgagccccaagcacttccgactcggtgagacttaagtgccgggaaatgctggcggcagctctccgtactggagatgattatattgcaatcggagccgacgaggaagaacttggttcccagatagaggaagccatatatcaagagattcggaatacagacatgaagtataagaatcgtgtgcggagccggatcagtaacttgaaggatgcaaagaatccaaacctcaggaagaatgtactgtgcggtaatatccctccagatttgttcgccagaatgactgctgaggagatggcctctgacgaacttaaggagatgagaaaaaacttaaccaaggaggccattagagagcaccagatggccaagaccggaggaactcagacagatttgtttacttgcggtaagtgcaagaaaaaaaattgcacatacacacaggtgcagactcgctcggcagacgagccaatgaccaccttcgtggtgtgcaacgaatgcggcaaccgatggaaattctgctag

SEQ ID NO: 244332 - DNA, 354 bp, Artificial Sequence
  Description of Artificial Sequence: Synthetic coding sequence
atggaggatgaggtcgtgcggttcgcaaagaagatggacaaaatggtgcagaaaaaaaatgccgctggggctcttgacctgctcaaagaactgaagaacataccaatgacactcgaactgcttcaggaaatggcctcggacgaactcaaggaaatgaggaagaacctgacaaaagaggcaattcgggagcatcagatggcaaaaactgggggtactcaaaccgatcttttcacttgcggcaaatgcaaaaagaaaaactgtacatatacacaggtccagacacgcagtgctgacgagcccatgactacattcgtggtgtgtaatgagtgtggtaataggtggaagttttgctag

SEQ ID NO: 244333 - DNA, 480 bp, Artificial Sequence
  Description of Artificial Sequence: Synthetic coding sequence
atggacaagccgaggaaggagaacgaagaagaaccacagtccgccccaaagaccgatgaggaaagacctccagtggagcattctccggaaaagcagtcccctgaggagcagtcctccgaagagcaatcatccgaagaggagttttttccggaggaactgctccccgagctgctgccagaaatgttgctgtccgaagaaagaccaccccaagaggggctgagccgcaaagatcttttcgagggacgcccacctatggagcagcccccatgtggggtaggcaaacataagctggaagaaggctcctttaaggagcgtctggccagatctaggccacaattccgcggtgacattcacgggaggaatctgagcaacgaggagatgatccaggctgctgatgaactggaggagatgaaacgcgtaagaaacaagcttatgattatgcactggaaagcaaagcgcagtagaccttatcctatatag

SEQ ID NO: 244334 - DNA, 480 bp, Artificial Sequence
  Description of Artificial Sequence: Synthetic coding sequence
atggacaaacctcggaaggaaaacgaagaggaaccccagtcagctcctaagacagatgaggaacggccaccagtggaacacagtcctgaaaaacagagtcccgaggaacaaagctctgaggaacaatctagcgaagaggagtttttccccgaagaattgttacctgaactcctccctgaaatgctcctgagcgaggaaagacctccccaggaaggcctaagtcgcaaggaccttttcgaggggagaccccctatggagcaacctccgtgtggtgtcggcaaacataaactggaggaagggtcatttaaagaacgactagcgagatctcggccacagtttagaggagatattcatggtcgaaacctgtcgaacgaggagatgattcaagcggcagacgagctggaagagatgaaacgagtccgtaacaagttaatgattatgcattggaaagccaaacgctctaggccatacccaatttag

SEQ ID NO: 244335 - DNA, 480 bp, Artificial Sequence
  Description of Artificial Sequence: Synthetic coding sequence
atggataagccgagaaaggagaacgaagaagagccccaatctgccccaaaaactgacgaggagcgcccaccagtcgaacatagccccgagaaacagtcccctgaggagcagtcatccgaagagcagtcttcggaggaagaatttttccctgaggagttattgcccgagctcctgcccgagatgcttctcagcgaggagcgcccaccacaagaaggactttcccggaaggacttattcgaaggcaggcctccgatggagcagcctccatgtggcgtagggaagcacaaactggaggaaggatcttttaaagaaaggctggcacgctcgcgaccccagttcagaggggacatccatggcagaaacctgtcaaacgaagaaatgatacaggctgctgatgaactagaggaaatgaagagggtgaggaataaattaatgatcatgcactggaaggcgaaacgatccaggccttatccgatctag

SEQ ID NO: 244336 - DNA, 471 bp, Artificial Sequence
  Description of Artificial Sequence: Synthetic coding sequence
atggataaaccaagaaaagaaaacgaggaagagccccaacgccctagaccgatgaggcgaggattaagatggagcaccttaccaaaaagcagccccccaaggagttccctccggaggtctagccccagacgaagaagtagttttctgcggtcctcctgcctctcctcctgtctgcgttgctccagcagaaggtccccacaggaaggattaagcaggaaggaccttttcgaggggagacctccaatggagcagccgccttgcggggtggggaaacacaagctcgaggagggctcctttaaggaacgcctcgccaggagccgtcctcagtttcgaggagacattcacggacggaatttgagcaacgaggaaatgatccaagctgctgatgaacttgaggagatgaaaagagtgcgaaacaagctcatgataatgcactggaaggctaagcgcagcaggccttaccccatttag

SEQ ID NO: 244337 - DNA, 303 bp, Artificial Sequence
  Description of Artificial Sequence: Synthetic coding sequence
atgcagaaaccctgcaaggagaatgagggaaaaccaaagtgttcggtgccaaagagggaggagaaaaggccttatggggagttcgaaagacagcagactgagggcaacttcaggcagcgcctgctccagagcctcgaagagttcaaagaggacattgactatcgccatttcaaggacgaggagatgaccagagaaggagatgagatggaacgctgccttgaagagattcgtggtttgaggaagaaattcagggctctacacagtaatcaccgccatagtagagatcggccataccccatttag

SEQ ID NO: 244338 - DNA, 303 bp, Artificial Sequence
  Description of Artificial Sequence: Synthetic coding sequence
atgcagaaaccgtgcaaagagaacgagggcaaacccaaatgctccgtgcccaagcgggaagagaaacggccttacggtgaattcgagcgacagcagaccgaaggcaactttaggcagaggcttctgcagtctctggaggaattcaaggaagatatagattaccgacatttcaaagacgaagagatgacaagggagggcgatgaaatggaacggtgtttggaggagatacgcggtctgcggaaaaagttcagagctctccacagcaaccaccgccacagcagggaccgaccctatcctatctag

SEQ ID NO: 244339 - DNA, 291 bp, Artificial Sequence
  Description of Artificial Sequence: Synthetic coding sequence
atgtacgtgaagttgatatcatcagatggacacgaattcatcgtgaagagagagcatgcactgacctccggtaccatcaaggctatgctgagtggtccgggacagtttgcagagaacgaaacgaacgaggtcaacttcagagaaatccccagtcacgttttaagtaaagtgtgtatgtactttacctataaggtcagatacactaattccagtactgagatcccagaattccctatcgcaccggagattgcgttagaactgctgatggccgctaacttcctggattgctag

SEQ ID NO: 244340 - DNA, 339 bp, Artificial Sequence
  Description of Artificial Sequence: Synthetic coding sequence
atggatggtgaggaaaaaacgtacggagggtgcgagggccctgacgctatgtatgtgaagcttatatcaagcgacggccacgaattcattgtgaagcgtgagcacgcgttgaccagcgggacgatcaaggccatgctgagcgggccagggcagttcgcagaaaacgagaccaacgaggtgaatttcagggagattcctagtcacgttctgtccaaagtctgcatgtactttacctacaaggtgcggtatacgaactcttccactgagattcccgaattcccgattgcgcctgaaatcgccctggaacttctcatggccgctaactttcttgactgctag

SEQ ID NO: 244341 - DNA, 339 bp, Artificial Sequence
  Description of Artificial Sequence: Synthetic coding sequence
atggacggggaagagaagacctacggaggttgcgaaggcccagatgcgatgtacgtcaaacttattagctcagacggacacgaattcattgtcaagcgcgagcacgcactgacgtcaggcaccatcaaggcaatgcttagcggtccaggtcaattcgccgaaaacgagaccaacgaggtcaattttcgggaaattcctagccacgtactttctaaagtgtgtatgtatttcacttacaaagtccgatacacaaattcctccacggaaatccccgagtttcctattgcccctgaaattgccctggagctactgatggccgcaaacttcttagactgttag

SEQ ID NO: 244342 - DNA, 339 bp, Artificial Sequence
  Description of Artificial Sequence: Synthetic coding sequence
atggacggtgaggagaagacctacgggggttgtgaaggcccagatgcaatgtacgtaaagctgattagcagtgacggacacgaattcattgtgaagagggagcatgcacttacctcagggaccattaaagctatgctcagtggcccagggcagtttgccgaaaacgagaccaatgaagtcaattttagagaaattccttctcacgtactctccaaggtttgtatgtatttcacgtacaaggttcgatataccaactcatccaccgagatccccgaattcccaattgctccagaaatcgccctggagctgctaatggcagcaaacttcctcgactgttag

SEQ ID NO: 244343 - DNA, 339 bp, Artificial Sequence
  Description of Artificial Sequence: Synthetic coding sequence
atggacggagaagagaagacgtacgggggttgcgagggacccgatgccatgtatgtaaagctgatatcctcagacggtcatgaatttattgtcaaaagagagcatgccttgacctctgggaccattaaagcaatgctgtctggaccaggacagttcgctgagaacgaaacaaatgaggttaatttccgggaaattcctagtcatgtcctatcaaaagtgtgcatgtactttacatacaaagtgcggtacaccaattcctccacagagatccctgagttccccatcgctccagaaatagccctcgaattgctaatggcggctaatttcctggattgctag

SEQ ID NO: 244344 - DNA, 339 bp, Artificial Sequence
  Description of Artificial Sequence: Synthetic coding sequence
atggacggcgaagagaaaacctacggcggatgcgagggcccagacgcaatgtatgtgaagctgatctccagcgatgggcatgagtttattgtcaagcgcgagcacgcattgacatctggcacaataaaggcaatgctgtcggggcctgggcagttcgccgaaaatgagacaaacgaggtgaacttcagggagatcccgtcacacgtgcttagcaaggtgtgtatgtattttacatataaggtgcgatatacgaactccagtaccgaaatcccagagtttcctatcgcccctgagatagcgctggagttgctcatggctgcgaattttctggattgctag

SEQ ID NO: 244345 - DNA, 339 bp, Artificial Sequence
  Description of Artificial Sequence: Synthetic coding sequence
atggatggggaggagaaaacctatgggggttgcgagggtcccgacgccatgtatgtgaagttaatcagctccgacggacatgagtttatcgtcaagagggagcacgccctgacctctggaaccatcaaggctatgctgagtggcccaggtcagtttgccgagaatgagaccaacgaagttaattttcgggagatccccagtcatgtgctgtccaaggtgtgcatgtattttacttacaaagtgcgctacacgaatagtagtacggaaatccccgagttcccaattgctcctgaaatcgcactagagcttctaatggctgcgaacttcttggattgttag

SEQ ID NO: 244346 - DNA, 2397 bp, Artificial Sequence
  Description of Artificial Sequence: Synthetic coding sequence
atgcacgggggacggtcctgcggtccgaggacccggagggaaccaagttcaggggaggaagccgcacctgttacagccatggctgccgagagcgctctgcaggtggtagaaaaactgcaggcaagactcgccgctaatccggacccaaagaaattgctcaaatatctgaagaagttatcaacactgcccattacagtggacatcctcgccgaaacgggcgtgggcaaaaccgtcaactctctcaggaaacacgagcatgttggatccttcgcaagggacttagtagctcagtggaaaaaattagtcccagtcgaaagaaacgccgagcccgacgagcaggacttcgagaaatccaactcacgcaaacgcccaagggatgccctacaaaaagaggaggagatggaaggtgactaccaggagacctggaaggcgaccggtagtcggtcatactccccagaccataggcaaaagaagcatcgaaagctgagcgagcttgaaaggccccacaaggtctctcatgggcatgaacgcagagatgagagaaagcgctgccaccgaatgtcccctacgtactctagtgaccccgagagtagcgactatgggcatgtgcagtctcccccttcatgtacgtcccctcatcagatgtacgttgatcattatagaagcctggaggaggaccaagagcccatcgtaagccatcagaaacctggtaagggccacagcaatgccttccaggaccgcctcggcgcatcacaggagagacaccttggagagccacacggtaaaggtgtggtttcccagaacaaggagcataagtcatctcataaggataaaaggcccgtcgatgcaaagtcagacgagaaggctagcgttgtttcgagggaaaaatcacacaaggccctttcaaaagaggagaacaggcgtccccctagcggagataacgcacgggagaagcctccgagcagcggagtgaagaaggagaaagatcgcgaggggagctctttgaaaaaaaagtgtctgcctcctagcgaagccgcttcagacaaccacctcaagaagcctaagcatcgagatcctgagaaagcaaagttagacaaatctaaacagggcctcgatagttttgataccggaaaaggggcaggtgatctgctccccaaggtgaaggaaaagggttcaaacaacctgaagacacctgaaggaaaggtaaagaccaaccttgaccgtaaaagccttggtagtctgccaaaagttgaggaaaccgatatggaagatgagtttgaacagccaacaatgagctttgaaagttacctctcatatgatcagcctcgcaagaagaagaagaagatagtaaaaacgtctgctaccgccctcggagacaagggtcttaagaaaaacgattctaagtccaccggcaagaaccttgattctgtgcagaaacttcccaaagtcaacaaaacaaaatctgaaaagccggcaggggcagacctcgccaaactgcgcaaagtcccagacgtgcttcccgttttacctgatctccctctgcccgctatccaggcaaattaccggccactgccctctctcgagctcatctccagcttccagcccaagcgcaaggccttctcatctccgcaggaggaagaagaggccggtttcactgggagacgcatgaatagtaaaatgcaagtgtatagcggaagcaaatgcgcatacttgccaaagatgatgacattacaccaacagtgtatcagagtcttaaaaaacaacatagactctatcttcgaagtcggcggtgtaccttactcggtactggagcctgtgctagaacggtgcactccggaccaactgtaccgaatcgaggagtataaccatgtgcttatagaggaaacagaccagctatggaaggtacactgccatagagatttcaaggaggagagaccagaggagtacgagagctggagagagatgtacctgcgactgcaggacgcacgcgaacagcggctgcgtgttctgaccaagaatattcagtttgcccacgcaaataagccgaaagggagacaggcgaaaatggcgtttgtcaacagcgtagcaaaacccccaagagacgttcgcagacgacaagagaagtttggaaccggaggtgccgcagtccctgagaaaattaagatcaaacccgcaccatatcctatggggtcctctcacgccagcgcttccagcatcagctttaaccccagccccgaagagccagcgtatgatggaccatccacgtcctctgcccacctcgcccctgtggtgtcatccacagtcagttatgaccctagaaagcctaccgtcaaaaagatcgcacccatgatggccaaaaccatcaaggcttttaaaaataggttctctcgccgttag

SEQ ID NO: 244347 - DNA, 3297 bp, Artificial Sequence
  Description of Artificial Sequence: Synthetic coding sequence
atggcagagcgcggtggggacggcggtgagtctgagagattcaatcccggagaactgcgaatggcccagcagcaggcccttcgcttccggggtcctgcccctccccctaacgccgttatgagagggccacccccattaatgagaccacctccccctttcggaatgatgagaggacctcctccacctccgaggccccctttcggccgtcctccatttgatccgaacatgccccctatgccaccaccaggcggaatcccccctcctatggggccaccacacctccaacgcccacccttcatgccaccccctatgagctccatgcccccaccccctgggatgatgtttccacctgggatgcccccagtgactgccccagggactcctgccttgccgccaaccgaagagatctgggtggagaacaagacccccgatggcaaagtttactactacaacgcccgtactcgcgagtctgcctggacaaagccagatggagttaaggttatccagcagagcgagctgacccccatgctggccgctcaggcacaggtgcaggcacaggcccaggcacaagcgcaggcgcaggcccaggcacaggcccaagcacaggcccaggcccaggctcaggcccaagcccaagcccaggcccaggcgcaggcacaggcccaggcacaagcccaggcccaggcacaagcacaggcacaggcccaggcccaggcacaggctcaagtacaagcgcaagtgcaggctcaggtgcaagcccaggcagtaggagcgtcaactcctactacatcaagtcccgcacccgctgtgagcacaagtacaagcagttctactccctccagcacaacatccactacaacgacagctacatcagtcgcccaaactgtgagcaccccaaccacccaggatcagaccccttcttccgctgttagtgtagccactccgactgtttctgtgtctacccccgctccaactgccactccagtgcaaaccgtgcctcagccgcatccccagaccctgcccccagccgtgccccactctgtcccacagcctactacggccatcccagcgttcccgccagtcatggttccgccattccgcgtgcccttgcctgggatgcctattccattgccaggcgtagccatgatgcagatcgtgagttgcccctacgtcaagactgtggcgacgacgaagactggcgtgctgcctggtatggctccccctattgtgcccatgatccatcctcaggtcgccatcgctgcatctcccgctaccctcgccggagcaacagctgtcagcgagtggaccgagtacaagacagccgatggtaaaacatattactataacaaccggacactcgaatcgacatgggagaagcctcaggaattgaaagagaaggaaaaactcgaggagaaaatcaaagagccgattaaggaaccatcagaggaacctctgcctatggaaaccgaggaggaagacccaaaggaggaacctataaaagaaataaaggaggaacccaaggaagaggagatgaccgaagaagagaaggccgctcagaaagccaagcctgtcgcaaccgcccctatcccgggaaccccgtggtgtgtggtatggaccggcgacgagagggtgtttttctacaaccctactacgcgcctttccatgtgggacaggccagacgacctgattggcagggcagatgtggataaaattatccaggaacctccccacaagaagggcatggaggaactcaagaagttacgtcaccccacaccaacaatgctgtccattcaaaagtggcaatttagcatgagcgcgattaaggaggagcaggagctaatggaggaaatcaacgaagacgaacccgtaaaggcgaaaaaaagaaagcgagacgacaataaggatatcgacagtgagaaagaggctgcaatggaagccgaaatcaaagctgcccgtgaacgcgctattgttccactcgaagcaagaatgaaacagtttaaggacatgctgctggaaagaggtgtgtcggctttttccacatgggagaaggagctgcacaagatagtgtttgacccccgttacctgctgctaaatcccaaagagagaaagcaggtgtttgatcaatacgtaaagaccagggcagaggaagagcgtcgggagaaaaaaaataagattatgcaggcgaaggaagactttaaaaagatgatggaggaggccaagttcaatccgagagccacattctctgagttcgcggctaagcatgctaaggattctcgttttaaagctatcgaaaaaatgaaagacagggaagcgttgttcaatgaattcgtcgcagctgctcgaaaaaaagaaaaggaggatagcaaaacgcgcggtgaaaagattaagtccgacttcttcgagctgctgtccaaccaccacctggattcgcagtctagatggagcaaggtcaaagacaaggtcgagtcggatccgcgatacaaagccgtggactcttcgtctatgcgcgaggacctctttaagcagtatatagagaagattgcaaagaaccttgactcagagaaggagaaggaactggaaagacaggccagaatcgaagcatcattgcgagaaagagagcgtgaggttcagaaggctcggtccgaacagacaaaggagatagatagagagcgggagcaacataaaagagaggaggccatccagaacttcaaggctctgcttagtgacatggtgcgttcgagcgatgtttcgtggagtgacactcgcaggactttgcgtaaagatcaccgctgggaatctgggagcctgctggagagagaggaaaaagaaaaactgtttaatgagcacatcgaggctctcaccaaaaagaaacgcgaacacttcagacagcttctggatgagacgtccgccatcaccctgacgagcacttggaaggaagtcaagaagatcatcaaggaggatccgcgatgcatcaaattctcttccagtgataggaagaagcagagggagtttgaggagtatattagggacaaatatattactgccaaggccgatttcagaacgttactgaaggagacgaagtttataacctaccggtctaaaaagctgatccaggagtctgaccaacatctgaaggatgtggagaagattctccagaatgacaaacggtatctggtgctcgactgcgtgccagaggagcgcaggaagctgattgtagcttatgtagacgatctcgacaggcgcggacccccaccacctccaaccgcctcagagcctacacggaggtcaaccaagtag

SEQ ID NO: 244348 - DNA, 3234 bp, Artificial Sequence
  Description of Artificial Sequence: Synthetic coding sequence
atggctgagcggggtggcgatgggggagaatcagagaggttcaatcctggagagcttaggatggcgcagcagcaagctcttcggttccgtggacctgcaccgccacccaacgcggtaatgcgaggcccaccaccacttatgcggccaccgccaccctttggcatgatgaggggaccccctccacccccacgccctcccttcgggaggccccctttcgatcccaacatgccacctatgccaccccctggcggaatccctcccccaatggggcctccccatcttcagcgccctccatttatgcctcctcctatgtcatcgatgcctcccccaccgggtatgatgtttccacctggcatgccaccggtgaccgcgcctgggacccctgccctgccccctaccgaggagatttgggtcgaaaacaaaacaccagacgggaaggtgtattattacaatgctcgaacccgcgaaagcgcttggaccaagcctgacggagtcaaggtcattcagcagtctgagctgactccgatgctcgcagcgcaggcccaggtgcaggcccaggctcaagcccaggcccaagcccaggcccaagcccaagctcaagcccaagcccaagcccaagcacaggcacaggcccaggcccaagctcaggcacaggcacaggctcaggcacaggctcaggctcaggctcaggctcaggcccaggctcaggcccaggcccaggctcaggttcaggcgcaggttcaggcacaggtccaggcccaggcagtgggagcctcaacaccgacaacctcttcacctgcccctgccgtgagtacctctacctccagctcaacgccatcttcaactacatctactaccaccaccgccactagcgtggctcaaacggtgagcactccaaccacccaggaccagaccccatcgtccgcagtgtccgtagcgacaccaactgtctcagtgtccactccagccccaactgccactccagtacagacggtcccgcaacctcatccacagaccctgcctcccgcagttcctcattcagtgccgcagcctacaacggccattcccgcttttcctcccgttatggtgcccccatttagggtccccctcccaggtatgccaattcctttacctggtgtcctccccggaatggcccctcccattgtaccaatgatccatccccaagtggccatcgcagccagccccgcaacgttagccggagccaccgctgtctcggagtggaccgagtacaagaccgcagatggtaaaacttactattataacaaccgtaccctggagtccacctgggaaaaacctcaggaactgaaggagaaagagaaattggaggagaagatcaaagaacctatcaaggagcccagcgaagagcctctgccaatggaaactgaggaagaggaccccaaggaagagcccattaaggaaattaaagaagagcccaaggaggaggagatgaccgaggaggagaaagctgcccagaaggctaagcccgtggctaccgcacccattccagggactccctggtgtgtggtttggacaggtgatgagagagtatttttttacaacccaaccacaaggctatcaatgtgggatcgacctgacgacctgattggtagagccgacgtggataaaataattcaggaacccccacataagaagggaatggaagaattgaaaaaattgcggcaccccacacctactatgttaagtatccagaagtggcagttctctatgagcgccattaaggaagaacaggagctcatggaggagataaacgaagatgagcctgttaaggctaaaaaaagaaagcgtgacgacaataaggacatcgacagcgaaaaggaggctgcaatggaggccgagataaaggccgcacgggagcgcgctatagttccgcttgaagctagaatgaagcagttcaaagatatgctgctggaaagaggggtttctgcattttctacatgggagaaagagttgcataaaattgtctttgaccccagatacctgctgttgaacccgaaagaaaggaagcaggttttcgaccagtacgtgaaaacacgcgctgaggaagagcgaagggaaaagaaaaataaaatcatgcaggcaaaagaagacttcaagaagatgatggaggaagctaaatttaacccgagggcaaccttctcagaattcgccgcaaagcacgccaaagacagtcgtttcaaggccattgagaaaatgaaagacagagaggctctgtttaatgaatttgttgccgcagccagaaagaaagaaaaagaagactcaaaaactagaggagagaaaatcaagagtgacttctttgagcttttgtctaaccaccatcttgactcccagagtaggtggagcaaggtaaaggacaaggtggagtctgacccgcgttacaaagcagtcgattccagctctatgagagaagacttattcaagcagtatattgagaaaatcgccaagaatctggacagcgagaaggagaaggagctcgagcgtcaagctcgcatcgaagcatcgttgagggaacgcgagagggaggtgcaaaaggccaggtccgaacagactaaagaaatcgatagggaaagagagcagcataagcgagaggaggctatccagaacttcaaggctctgttgagcgacatggtgcggtcgtctgacgtctcatggtctgacacaaggcggaccctccgaaaagaccaccgctgggaaagtggttcgctccttgagagggaggagaaggaaaagttgtttaatgagcatattgaggcgttgactaaaaaaaagcgagagcacttccgtcaactgttggacgagacctcagccattactctcacatccacttggaaggaggtgaagaagattatcaaggaggatccacgatgcatcaaatttagctcaagcgacagaaagaagcagagggagttcgaagagtacatcagagataagtacatcaccgctaaggctgacttcagaactctgctgaaggagactaaattcatcacttatcggtccaaaaagctgattcaggaaagcgaccagcatctcaaagacgttgagaaaattctgcaaaacgacaagagatacctcgtgctggactgtgtaccggaggaaaggcgcaagctcattgttgcctacgtcgatgacctcgacaggcggggtcctccacctccgcctacagcctccgagcctactaggcggtcaacaaagtag

SEQ ID NO: 244349 - DNA, 2049 bp, Artificial Sequence
  Description of Artificial Sequence: Synthetic coding sequence
atgaatccacagcagcagcgaatggcagctataggtaccgataaagagctttccgacctgctggacttttccgccatgtttagtccgcctgtcaattctggaaagactagaccgacaaccttgggctccagccagttctctgggagtggcatcgatgaacggggagggacaacctcctggggtacgagtggtcagcctagcccgagctacgattcttccagaggtttcaccgattccccccattacagcgaccatctcaatgactcacgactgggggctcatgaaggcctaagcccaaccccctttatgaacagcaatctaatggggaagacttccgagcggggatccttcagcctgtattctagagatactgggcttcccggatgccaaagctccctgctgcgccaggatctgggtctgggcagtcctgcccagttaagctccagcgggaagcccggaactgcttactatagcttctcagccacctcatctaggagacgccctttgcacgactccgctgccctcgatcctcttcaggccaagaaagttcgaaaggtgcccccaggcctgccctcgagcgtctacgcgccatcacctaattccgacgatttcaacagagagtccccatcctatccatctcctaagcctccaaccagcatgttcgcctccaccttctttatgcaggatggaacccataactcttcagacttgtggtcaagttcaaacggaatgtcacaacccggatttggcggaattctcggcacatccactagtcacatgtcccagtcttcaagctatggcaacttgcattcccacgataggctatcatacccgccacattctgtatcacccactgatattaacacaagtcttcctcctatgagcagcttccaccgtggttctacgtcttcctccccttacgtggccgcttctcatacccctccaattaacggtagcgattcaatcttgggcacacggggaaacgctgcagggtcaagtcagaccggagatgcattagggaaggccctcgccagcatttactcacccgatcatacctcctcaagcttcccctcaaaccctagtacaccagtcgggagtcctagcccactgacaggtacgagccagtggccaagaccgggagggcaagccccttcttccccctcttatgagaacagcctacactccctgcaatcacgcatggaagatcgactggatagactggatgacgcaattcacgtcctgaggaaccatgctgtgggcccaagcacaagtcttcctgctggccactccgacattcactcgctgcttggcccttcccataatgcgcctatcgggagcctcaactccaactatgggggttcaagtctggtcgccagcagtcggagcgcgtcgatggtggggacccatagagaggactccgtttctcttaacggaaatcactctgtcttaagctccacagtgactacaagtagtaccgatctcaaccataaaacccaggaaaactatagaggaggcctgcagtctcaaagcggcacggtggtgacgaccgagattaaaactgagaataaggaaaaagatgagaaccttcacgagccgccaagttctgatgacatgaaatcagatgatgagagtagccagaaggacatcaaggtgtctagtcggggtaggaccagctcaacaaacgaggacgaggatctgaatcctgagcagaagatagaacgggaaaaagagcgaaggatggctaataacgctagagagcgactgagggttcgagacatcaacgaggcgtttaaagaactcgggaggatgtgtcagctgcacttaaagtcagagaaaccacagaccaagttgctgattcttcatcaagctgttgcggtgattcttagcctggagcaacaggtcagggaaagaaacctgaatcccaaggccgcatgtctcaagcggagagaggaggagaaggtatccgccgtctctgcggaaccccctacaactctccctggcacgcaccctggcctgtctgaaacaacaaaccctatgggtcatatgtag

SEQ ID NO: 244350 - DNA, 2121 bp, Artificial Sequence
  Description of Artificial Sequence: Synthetic coding sequence
atgaacccacaacagcagagaatggccgctataggtactgacaaggagctcagcgatctgctcgatttctcagccatgttctcacctcctgtgaactccggcaagacacggccaacaacactcggatcgtctcaattttcggggagcggtattgatgaacgtggcggaactacatcttgggggacttccggacaaccgtcaccatcctatgacagcagtaggggtttcactgatagtccccactatagcgaccacctgaatgacagtcggctgggcgcacacgagggtctgtcccccacgcccttcatgaattccaacttgatgggcaaaacatccgaaaggggctcattttcactgtactcccgcgacacaggtctgccgggttgccaaagcagtctactgagacaggacctcggccttggaagtcctgcccagttgagctcctctggcaagcccggaaccgcttactacagtttttcagcaacctcttccaggagacgaccactgcacgattccgccgcactcgatccattgcaggcaaagaaagtgcgcaaagtgcctccagggttgccgagcagtgtgtatgctcccagcccgaatagcgatgattttaacagggagtccccctcatatcccagtcccaagccccctacctctatgtttgctagtaccttttttatgcaggatggaacccataattcctctgacctatggtcaagttctaatggcatgtctcagcccggttttggagggatcctgggcaccagcacttcacatatgtctcagagctccagctatggcaatctgcacagtcacgataggctttcctacccccctcacagcgtatcaccaactgacatcaacacaagtctgcctcccatgagctccttccatagaggttcaacctcatcatcaccatatgtcgctgcctcccacactcctccaattaatgggtccgacagcattcttggtacgagaggcaatgctgcaggcagttcccaaaccggcgatgctcttggaaaggctctcgcgtctatttactccccagatcacaccagttcaagcttccctagcaatccctctactccagtaggatcgccatctcccctgactggcacgagccagtggccaaggccagggggtcaggctccaagttcaccaagttacgagaacagcttgcactctcttaagaatcgggtcgagcagcagctgcacgagcatctccaggatgctatgtcttttttaaaggacgtgtgtgagcagagcaggatggaagatcggcttgacaggcttgacgacgccattcatgttctgcgaaaccatgccgtcgggcctagcactagcttgccagctggccacagtgatattcattccttactgggaccatcccataatgcacccatcgggtcactcaactccaactatggtggcagtagtctcgtggcttcatcccgtagtgctagcatggtaggaactcatcgcgaagattctgtgtcactcaatgggaatcacagcgttctctcgagtaccgtgacaacctcctctaccgaccttaatcataaaacacaagaaaattatcgcggtgggctgcagtctcagtccgggaccgtcgttactacggagattaagaccgagaacaaggagaaagatgagaacctgcacgagccaccttccagtgatgatatgaagagcgatgatgagagctctcaaaaggatattaaggtgtcatctcgcggtcgtacatcctccactaacgaggacgaggatctgaatccagagcagaagattgaacgcgagaaggagaggagaatggccaacaacgccagggagcgactccgtgtgcgggacataaatgaggctttcaaggagctgggcagaatgtgccagctgcacctcaaaagtgaaaagccccagaccaagttactaattctgcaccaagccgtggcagtaatcctcagtctggaacagcaagtcagggagcgaaacttgaatcccaaggcagcatgtctcaagaggcgggaagaggagaaggtgtctgccgtgtcagccgaaccccctacaacgctcccgggtacccatcctgggctatccgaaaccaccaaccccatgggccacatgtag

SEQ ID NO: 244351 - DNA, 2109 bp, Artificial Sequence
  Description of Artificial Sequence: Synthetic coding sequence
atgaatcctcagcagcaaaggatggctgcaattggcacagacaaggagctgagtgatctgttagacttttctgccatgttcagcccacccgtcaattcaggaaagacacgcccaaccaccctggggtcctcacaattctccggatctggaacaatccacgaaatgaagcagttaaattcgaaggccaggcaaaagggacagagaatcaaagggttcacagattcaccacattattcggaccacctcaacgacagcagacttggagctcatgaagggctcagtcccacaccctttatgaattctaatctcatggggaaaacctcggaacgaggaagtttctcactgtactctcgcgacaccggcctgcccggatgtcagtcaagcctgcttcgtcaggatctgggcctgggatcgcctgcccagctctcttcttcaggcaaacctggcaccgcatactactcattttcagcaacctctagccgtcggaggccattgcatgactccgcagctctggacccgttgcaggcaaagaaagtccgtaaggttcctcccggtctcccctccagcgtgtatgctccctcccccaattccgatgacttcaatcgcgaatctccctcctatcctagtcctaagcctcctacctcgatgttcgcttctactttttttatgcaggatggcacccacaatagctccgatttatggtcatccagcaatgggatgagccagccagggtttggcggtatcctcgggacgtctacatctcacatgtcccagagctcatcctacggcaatctccactctcacgataggcttagctatccaccacacagtgtctctccgactgatatcaatacttcactgcctccaatgtcatctttccaccgagggagcaccagctcttctccttatgtagccgcaagtcacacaccccctatcaacggctcagatagcatcctcggcactcgagggaacgcggcaggctcttcgcaaaccggagatgctctgggcaaggctttagccagcatctactcgcctgatcacaccagcagcagcttcccttccaaccccagcacgccagttggctctcctagtcctttgacggggacttctcagtggcctcggcctgggggacaggcccctagctctccaagttatgaaaacagccttcacagtttgaaaaaccgcgtggagcagcaactgcatgaacatctgcaggacgccatgtctttcctgaaagacgtctgcgagcagtcccgaatggaggataggctggacaggctagacgatgcaatccatgtattgaggaaccatgccgttgggcctagtacctcccttcctgctggacacagcgatatccattccttactggggcctagccataatgcacccattgggagcctgaattctaactacggaggcagttcacttgtggcaagttctaggagtgcttcaatggtgggcacccatcgggaggacagtgtttccttgaacggcaatcactctgtgctgtcctcaactgttaccacaagctctaccgatctgaaccataaaacacaggagaactatagaggagggctgcagtcgcagtcaggtactgtggtgaccaccgagatcaagactgagaataaggaaaaggatgagaacctccacgagcccccatcatcagatgatatgaagagcgacgacgagtcctctcagaaggatatcaaggtgtcttcaagggggagaacaagcagcaccaatgaagacgaagatcttaatccggagcagaaaatagagagggaaaaagagcgacgcatggccaacaacgccagggaaagactaagagttagggacattaatgaggccttcaaggagctgggacggatgtgccaactgcacctcaagtcagaaaaaccacagactaaattgctaatcctccatcaggccgtggcggtcatcttaagcctggaacagcaggttagagaaagaaatctgaaccccaaggcagcgtgtctcaagcgccgtgaagaagaaaaggtatccgcagtcagcgccgagcctccgaccactctgcccggtacccatcccggactttctgagactaccaatccgatgggacatatgtag

SEQ ID NO: 244352 - DNA, 1341 bp, Artificial Sequence
  Description of Artificial Sequence: Synthetic coding sequence
atgggaaaaaggtatatgcaccatcctcagattcagatgattagcactgtgaacctgttggtcatccaccttctttcccaccagccagtctgcagcttagctctgtccttgtgcaagtcatatccccctcattctgttagcccaacggacatcaacaccagtctgccacccatgagctcctttcaccgaggatccacttcttcctcaccatatgtagcagcttcacacactccccctattaatggctcagatagcattctgggaactcggggtaatgccgctggcagctcccaaacgggggatgcactgggcaaagcgttagccagcatctactcacctgaccacacgagctcttcttttccctctaatccatctactccagtgggaagcccctcacccctgactggcactagtcagtggccccgtcctgggggacaggccccatcttccccctcttacgaaaacagtctgcactctctgcaatctcgaatggaggacaggctggatcgacttgatgatgctatccacgtccttagaaatcatgccgtggggcctagcactagtctgccagcaggccattccgatatacactctttactcgggccaagccacaatgccccaataggctccctgaattcaaactacggaggctcttctctcgtcgcctctagcaggagtgctagtatggttggtacccaccgtgaagattctgttagtttgaatggtaaccacagtgtgctgtcatccaccgtcacaaccagcagtactgacctgaaccataaaacgcaggagaactaccgtggaggactgcagtcgcaaagcggcacggtggtcacaacggaaatcaaaacggagaataaggagaaagacgagaacctccatgaacccccatcttctgacgatatgaagagtgacgacgaatccagccagaaggatattaaggtttcaagccggggaagaactagctcaactaacgaagacgaggatctgaaccccgaacagaagattgagcgcgagaaggagagaagaatggctaacaacgctagagagagactccgcgtgagagacataaatgaggcattcaaagagctcggccgtatgtgccagctccatctgaagtctgagaagccacaaacaaagttgctgatcctgcaccaagccgtggctgttatactgagcctggaacagcaggttagggaacgtaatctgaacccgaaagccgcatgcctcaaacgaagagaagaggaaaaagtgtctgccgtaagtgccgagccaccaaccactctgccaggcacccatcccggtctgagtgaaacaacaaaccccatggggcatatgtag

SEQ ID NO: 244353 - DNA, 2046 bp, Artificial Sequence
  Description of Artificial Sequence: Synthetic coding sequence
atggccgcattcagcgtgctgcgccctcgagtgcccggaagctctggaacctgggcggcagaccccgatgcctccacagcagtcagccctagcctgagatttggtgggagggagcctgcaagacctacacggggtggagccaccaaatggcccaagatgaatccccagcagcagcggatggcggctatcgggacagacaaagagctgtctgacctactggatttcagcgccatgttctcacctcccgtgaacagcggaaagacgcgacctaccactttagggagctctcagttctctggttctggaattgacgaacgtgggggtactacttcctggggtacctccgggcaacccagtccgtcctatgacagttctcgcggatttaccgattctccccactattcagaccatttgaacgacagtaggttaggagctcacgaggggctatcccccaccccttttatgaatagtaacctgatggggaaaacttccgagcgtggatcattcagcctgtactccagggataccggtctccccggatgtcagagtagcttactgaggcaggacctaggattgggttcgccagcccaacttagcagctctggcaaaccaggaactgcttactactccttctcagcaaccagctccagacgccgaccactgcacgatagtgccgctctggatcccctccaagccaagaaggtccgtaaagtaccgcctggactccctagctctgtttacgccccatctccgaattctgacgactttaaccgagagtcaccaagctatcctagcccgaagccacctacctccatgttcgcatccacatttttcatgcaggatggaactcataattcctccgacctatggagctcaagcaacggcatgtcccagcccggattcggcggtatcttgggtacctcaaccagtcacatgtcgcagagctctagctacggcaacctgcatagccatgaccgcctctcctaccccccacacagtgtgtcacctacagacattaacacttcactgccaccaatgagctccttccacagaggcagcacatccagcagtccgtatgtcgccgctagccacactccacctatcaacgggagcgatagcatacttggcactcgcggaaacgccgctgggtcatcccagactggggatgccctgggaaaagcactcgccagtatatattcaccagatcataccagtagtagctttccctccaatccctccacaccagttggatcgccctctccactcactggaacatcccagtggccaaggccaggcggacaagcccctagttcaccctcctacgagaattcattgcattcattgcagtccaggatggaggatagactggaccgcctggacgatgccatccacgttttgagaaaccatgcggtaggaccaagtacaagtctgcccgcaggtcacagcgacatccacagcctgctcgggccatcccacaatgccccaataggctccttgaattccaactatggaggcagctcacttgtggcctcgtctaggtccgcaagcatggtggggactcatagagaggacagtgtgtctttgaatggaaatcactcagtcctgtcctcgactgttacgacttcctccaccgacctaaaccataagacacaggaaaattaccggggaggtctacagtcccagtcagggacggtggtcactacagagatcaagacagagaacaaggagaaagatgagaacctgcatgaacctccttccagtgatgatatgaaatcagatgacgagtccagccaaaaagacatcaaagtgtctagtcgcggtcgcacaagttcaaccaatgaggatgaagacctaaaccccgaacagaagatcgagcgggaaaaagagaggcgaatggcaaataacgcacgggagcgccttcgcgtgcgagatatcaacgaggccttcaaggagcttggtcggatgtgtcaattgcacctgaaaagtgaaaaaccacagaccaaattactgatcctgcaccaggcagtgacaaccatcggcccttag

SEQ ID NO: 244354 - DNA, 885 bp, Artificial Sequence
  Description of Artificial Sequence: Synthetic coding sequence
atgtcctttctgaaggacgtgtgtgagcagtccaggatggaagatagacttgataggctggacgatgccatccatgtacttcgcaaccatgcggtggggccttctacgtccctacccgcagggcactccgacattcactctctgctgggtccttctcacaatgcacctattggttccctcaactcaaattacggcggaagcagcctggtggcctcttcccggtccgcgagcatggtcggaacgcatcgagaggactccgtgtccctcaacggcaatcattccgtgctaagctcgactgtgactaccagttccacagatctgaaccacaaaacccaggaaaattacaggggcggtctgcagagccagagtggcaccgtggtcactactgaaattaagactgagaacaaggagaaagatgaaaatctgcatgaaccaccttcaagcgatgatatgaagtcagatgatgaaagcagtcagaaggatattaaagttagttcaagaggtcgcacctctacaaacgaggacgaagatctcaacccggaacagaagatcgaacgcgagaaggagcggagaatggcaaataacgctcgtgagcggctgcgggtcagagacattaatgaggcattcaaagagctggggagaatgtgtcagttgcacctgaagagtgagaaaccccagaccaagctgctgattctgcatcaggccgtggccgtgatcctgtctctagagcaacaggttagggagcggaacctcaacccgaaagcagcatgcctcaaacgcagggaagaagaaaaggtgtctgctgtaagcgccgaaccacctaccaccctgccaggtactcaccccggtctctccgaaactactaacccaatggggcatatgtag

SEQ ID NO: 244355 - DNA, 1611 bp, Artificial Sequence
  Description of Artificial Sequence: Synthetic coding sequence
atgtattgcgcctacccagtcccaggtatgggaagcaactccctgatgtactactataacggaaagactgtttatgcaccgagcccaaattccgatgattttaacagagagtcccctagctatccctcacccaaaccgccaacgtcaatgttcgcctccacattcttcatgcaagacggcacacacaattcgtccgatctttggtcctcttcaaatggcatgtctcagcccggatttggcggaatcctcggcaccagcactagccatatgtcccaatcctcatcgtatggaaacctccactcacatgaccgcctgagctatccaccccactccgtgagccctaccgatattaatacctcactacctcccatgagcagtttccacaggggatcgacaagcagctcaccctacgtggcagcatcccacaccccaccgattaacgggtctgactcaattctagggactcgcggaaatgctgcgggttccagccagaccggggacgctctcggcaaagcgctggcgagcatctatagtcctgatcacaccagcagctctttcccatctaatccatctactcccgtgggatctccatctccgctgacaggcactagtcaatggccccgtcctggaggacaggcaccaagttcgccaagctacgagaactcactacattcacttaagaacagagtcgaacagcagcttcacgaacaccttcaagacgccatgtcttttctcaaggacgtctgtgaacagtcccgaatggaggaccgcctcgacaggcttgatgatgctattcacgttctgaggaaccatgctgtgggcccatctacaagtctgccagcaggccactcggatattcatagtcttcttggcccaagccacaacgcccctatcgggtctctcaactcaaactatggagggtcctcactcgtcgcctcttctcggtcagcctcaatggtgggaacacacagggaggacagtgtctctcttaacggcaatcatagcgtactgtcatccaccgtgactacgtccagtaccgatctcaatcacaagactcaggagaactacagaggcggactgcagagccagtcaggaactgttgtcactaccgagataaagactgagaataaagaaaaggacgagaacctgcatgagcccccttcttccgacgatatgaaatccgatgatgaatcctcccagaaagatatcaaggtgagttccaggggtcgtacctcatccactaacgaagatgaagatctcaacccggaacagaaaattgaacgcgagaaggaacggagaatggccaataatgcccgtgagcgtcttagagtgcgagatatcaatgaagcttttaaagaactggggagaatgtgtcaactccatctgaaatctgaaaagccgcagactaagctgctcattttgcaccaggccgttgcagtgattttgagcctggagcagcaggtccgggaacgcaacctgaatccgaaagccgcttgcttgaagcgcagagaggaggagaaggttagcgccgtgagcgctgagccacccacgactctgcctggcactcaccccggtctcagcgagacaactaacccaatgggtcacatgtag

SEQ ID NO: 244356 - DNA, 2049 bp, Artificial Sequence
  Description of Artificial Sequence: Synthetic coding sequence
atgaaccctcagcaacagcgaatggctgcaattggaactgataaggaactctcagacctgcttgacttttccgctatgtttagtccccctgttaactcaggcaaaaccaggcctactaccctaggatcttcacagttcagcggtagcggcatagacgaacggggaggcactaccagctggggcacctcggggcaacctagtccttcctacgactctagtcgcggattcacagatagtcctcactattccgatcatttgaacgatagtcgactgggcgcacacgaagggctgtctccaacgccctttatgaattcaaacctgatgggcaagacctcggagagaggatcattcagtctgtacagtagggacactgggctcccaggatgtcagtcctctctattgagacaagacttagggctcggctcccctgcacagctgagcagcagtgggaagcccggaactgcatactatagcttttcggctacgagttcccgcagaagacccttgcacgattccgctgctctggatccactgcaggcaaagaaggtgcgcaaggtgccacccggtttgccttcttctgtgtatgcgccttctcccaacagtgatgattttaaccgcgagagccccagttacccttcgcctaaaccccctacttccatgttcgcctccacatttttcatgcaggatggcacccacaactccagtgacctgtggtcttcttccaatggcatgagccagcctggattcgggggtatcttagggacgtccactagccacatgtcccagtctagcagttacgggaacctgcactctcacgatcggctgagctacccccctcattctgtctctccaactgacattaatacttccctgccccctatgagttctttccataggggcagcacatcttcatctccatatgttgccgcaagtcatacgcctccaatcaacgggtcagactccattttgggcacgcggggaaatgctgcaggctcttcgcagactggcgatgccctcggcaaagccttggccagcatctattcacccgaccatacatcgtcttcattccccagtaacccttcaaccccggtgggcagcccgtcaccccttactggcacatcacagtggcccagaccaggcggacaggcgccaagctcaccttcttacgagaacagcctccactctcttcaatcccggatggaggatcgcctagatcgactggatgatgcaattcacgtgttgcgcaaccatgcggttggaccatccacttctcttcctgctggccactcagacatccacagcctgctgggcccaagccacaatgcacccatcggctcactcaacagcaattatggtggttcaagtctggtggcttcctcacggtcagcctccatggtgggcactcatcgagaggactccgtgtcattgaacggcaatcattctgtgctgtcttccactgttactacatcaagtacagacttaaatcacaagacccaagagaattataggggtggcttacagagccaaagcggaacggttgtcacaactgagattaagacagaaaacaaagagaaggacgagaatctgcatgaaccaccctcctcggacgatatgaaaagtgacgatgaaagttctcagaaggacatcaaagtcagcagccggggaagaactagctccacaaatgaggacgaggatctgaacccggagcaaaagatcgagcgggaaaaagaacgcaggatggcgaataatgccagggagaggctgcgagtgagagacatcaacgaagcttttaaagagctgggacggatgtgtcagttgcatcttaaatcagaaaagccgcagaccaaacttttgatcctgcaccaggctgtggctgtgattctgtcccttgaacaacaggttagggagagaaatcttaatccaaaggcggcttgtctgaaacgtcgagaagaagaaaaggtcagtgcagtgagcgcggaaccacccaccaccctccctggcacacaccctggactgagtgaaactacaaacccgatgggccatatgtag

SEQ ID NO: 244357 - DNA, 1020 bp, Artificial Sequence
  Description of Artificial Sequence: Synthetic coding sequence
atgagctccaattcctctacatcgcaatggccgcgaccgggtggccaggctccgtcatcgccctcttatgaaaattcactacacagtttaaaaaaccgggtggaacaacaactgcacgagcacctccaggatgcaatgtccttccttaaagatgtgtgcgaacagtcacgtatggaagatagactcgatagactcgatgatgctattcatgtgctgcggaaccatgctgtaggtccgtccacctcgttgccagcagggcatagcgacatccactccctgctggggccttctcataacgccccaataggttcgctcaactccaactacgggggatcttctttggttgcttcatctcgatccgccagtatggtcgggactcatcgcgaggatagtgtgagcttgaacgggaaccacagcgtcctctcctccactgtcacaacctcatctaccgacttgaaccataagactcaagaaaattaccggggtggactacagtcccagagtggaacagtggtaactacagaaataaagactgagaataaggagaaagatgaaaacttgcacgagcccccttccagcgacgacatgaaatctgacgatgaaagctcgcagaaagacattaaggtcagctctcggggaaggacatccacaaacgaggacgaagacctgaatccggagcagaagattgagcgggagaaagagcgacgcatggctaacaatgccagagaaaggctccgggtccgcgatattaatgaggcttttaaggagctcggacgaatgtgtcagctgcatttgaagtcagagaaaccacagacaaaactgctgatactccaccaggctgtggccgtcatcctctcattagaacagcaggtgcgggaacgcaatctcaacccaaaagcagcctgcctcaagcgccgtgaggaagagaaggttagcgctgtcagtgcagaacccccaaccactctgccaggcacacatcccggactgtccgaaacaacaaatcccatggggcacatgtag

SEQ ID NO: 244358 - DNA, 1341 bp, Artificial Sequence
  Description of Artificial Sequence: Synthetic coding sequence
atgggcaagagatatatgcaccatccacagattcagatgatctctacagtgaatctgttagtgattcacctgttatcccatcagccagtttgctctctcgccctgagcctgtgtaaatcgtatcccccacactcagtgagccccaccgatatcaatacctccctcccccctatgtccagcttccaccgcggatcaacctcgagcagtccttatgtggccgcaagtcatacacctcccataaatgggagtgactccatcctgggaacaagggggaacgctgccggatcttctcaaaccggcgatgcgctgggcaaagcattggcgtccatttatagcccggatcatacatctagctcatttccatcaaacccaagtaccccagtgggcagtcctagtccacttaccggtacgtctcaatggcccagaccgggtggacaggctccgtcctccccatcctatgagaatagcctgcatagcctgcaaagcagaatggaggatagactagaccggctggatgacgccattcatgtgttgaggaatcacgccgtaggtccaagcacaagcctgcctgccggtcacagtgacattcactccttacttggccctagtcacaacgcaccgatcggtagcctcaacagtaactatggcggaagctcacttgtggcctcatccagaagcgcatcgatggtagggacccatcgcgaggattcagttagcctgaacgggaatcactccgtgctatcttccactgtcacaacctcgtctactgaccttaaccataaaacccaggaaaattatcggggaggccttcaaagccagtctggtacagtagtcactactgaaatcaagacggaaaacaaagaaaaagacgaaaatctgcacgaaccaccatccagcgacgacatgaaatccgacgatgagagctctcagaaggatattaaagtcagcagcagagggcgtacctcttctacaaacgaggatgaggacctgaatcccgagcagaagatcgaacgggagaaagagcgaagaatggcgaataacgcgagggagaggttgcgcgtacgcgatattaatgaagcgttcaaggaactgggcaggatgtgccagctgcatctgaaaagcgagaagccgcaaacaaagctattgatcctccatcaggcagtggctgtgattcttagcttagagcagcaggtccgcgagaggaatttgaatcccaaggctgcctgtctgaaacgtagagaggaagaaaaagtgtcagctgtctccgctgagcctcccaccactctgcccggtacgcaccccggactaagcgagacgacaaatccgatgggccacatgtag

SEQ ID NO: 244359 - DNA, 1539 bp, Artificial Sequence
  Description of Artificial Sequence: Synthetic coding sequence
atgtattgtgcatacccagtgcctggcatggggagcaattctcttatgtactattacaatggaaaaactgtgtatgctccaagtccaaattcagatgatttcaacagagagtctccctcctaccccagtcccaaaccacccacctctatgttcgcatctacctttttcatgcaggacgggacccacaacagctcagatttgtggtcatcctctaacggaatgagccaaccaggttttgggggtatcctgggcacttctaccagtcacatgagtcagagctccagctatggaaatcttcattcgcatgataggttatcctaccccccacactccgtgtcccctaccgacataaacacaagtctgccccctatgtcctcgttccacaggggtagtacaagcagctcaccttacgtggccgcttcacatacgcccccaattaatggctctgatagcatcctggggactcggggtaacgccgcaggttcatctcaaacgggagacgcgctcgggaaagcacttgcatccatttatagtcccgatcatacgtccagcagcttcccgagcaacccctctacacctgtggggtccccgagccctttaactgggacttctcagtggcccagacccggaggccaggctccatcttccccttcttacgagaatagccttcacagcctgcagtccagaatggaagatcgtcttgatcgtttggatgatgctatccatgtcctgagaaaccatgcagtgggcccatctacatcactccctgctggccactcggatatacactcacttctcggaccctcccataacgccccaatcggcagcctgaatagcaattacgggggttcctcccttgttgcaagtagtagatctgcctccatggtgggcacacatcgggaagactcagtctcacttaatggtaaccatagtgtcttatcctccactgtaacaacttcaagcactgatttaaaccataagacgcaggagaactacaggggtggcctgcagtcacaatctggcaccgtggtgaccaccgagattaagaccgagaacaaggagaaggatgagaatctgcacgagccgccatctagtgacgacatgaaatccgacgacgagagctcccagaaggacataaaggtttcctcgagggggagaacctcatctacgaatgaggacgaagatctcaatcccgaacagaagatcgagagggagaaagagcggaggatggctaataatgcacgtgagcgtctgcgggtgagggatatcaacgaagcgtttaaggagttgggcagaatgtgccagctccatcttaaaagcgaaaaaccacaaaccaaattgttaattttgcaccaggctgtcgccgtcattctttcactggaacagcaggttcgagaacggaacctaaacccaaaggccgcatgtctgaagcgtagagaggaggagaaagtcagcgctgtctctgccgaacccccaacaaccttgcctggaacacaccccggactctctgagacaacgaaccccatgggccacatgtag

SEQ ID NO: 244360 - DNA, 600 bp, Artificial Sequence
  Description of Artificial Sequence: Synthetic coding sequence
atggcctttgccttactgagacccgtgggtgcccatgtgttgtatcctgatgtccggctgctctcagaagacgaagaaaacaggagtgaaagcgacgcatctgaccagtctttcggctgttgtgagggccctgaagctgccaggcgcggtcctggccctgggggtggccgtcgagccggagggggtggtggtgccggtcctgtcgtggtcgtgcggcaacggcaggcggctaacgcaagagagcgggatcgcactcaatcagtgaatacagcgttcacagccctgcggacgctaatcccgacggagcccgtggatcgcaagctgagtaaaattgagacagttcggttagcaagctcttatatcgctcacctcgctaatgttctcttgctcggggattccgcagacgacgggcagccctgtttcagagccgcaggttcggccaagggcgctgtgcccgcagccgcagatggagggcgtcagccgagatcaatttgcaccttctgtctgtctaatcagcgcaagggtggcggacgccgtgatctgggcggatcctgcctgaaagtaaggggcgtggccccactcaggggccctcgcagatag

SEQ ID NO: 244361 - DNA, 1038 bp, Artificial Sequence
  Description of Artificial Sequence: Synthetic coding sequence
atgcttccttgtttccaactcctcagaatcgggggtggacggggaggcgatctgtacacattccatccccctgcaggggctgggtgtacctaccgactcgggcacagagccgacctgtgcgacgtggccctcaggccccagcaagaacctggactgatcagtggcatccatgccgagctccacgccgagccacggggagacgattggagggtgtcactcgaagaccactcatcccaaggtacactcgtgaataacgtgaggctgcccagaggtcaccgcctcgagctttccgacggcgatttactgaccttcggccctgaaggcccacccggaaccagtcctagtgaattctactttatgttccagcaggttagggtcaagccccaggactttgcggctataaccatcccgagatccagaggagaagcacgggtcggagccggatttcgcccaatgctgcccagccagggagctcctcagcgcccactgagcacttttagcccggcaccaaaagcgactctgatactcaattcaattgggtctctgtctaagctcaggccccagccgctgaccttcagcccatcttgggggggtcctaaatctctgcccgttccagctccccctggcgagatgggaacgaccccatctgcaccacctcagcggaacaggcgcaagtcagtccatagggtgcttgccgaacttgacgatgaatctgaaccacctgaaaatccgcctcccgtgctgatggagccgagaaaaaagctgagagtggataaagccccacttacacccaccgggaataggcggggacggccacgaaaataccccgtttcggcccctatggcgcctcccgcagtgggaggcggagagccttgcgcagccccttgctgctgtctacctcaagaggaaaccgtcgcctgggtgcagtgcgacggatgtgatgtgtggttccatgtggcatgcgtgggctgttccatccaggctgctcgggaggcagattttcgctgcccaggatgcagagctggaattcagacatag

SEQ ID NO: 244362 - DNA, 1038 bp, Artificial Sequence
  Description of Artificial Sequence: Synthetic coding sequence
atgctcccttgctttcagctcctgagaatcgggggtgggagggggggagatctctacaccttccatccgcctgccggagccggatgtacgtaccgccttgggcatcgcgctgacctgtgcgatgtggcactacggcctcaacaagaacctggcctgatttcaggtattcacgcagaactgcatgcagagccacggggagacgactggcgggtctccctagaagatcattcctcacagggcactctcgtaaacaatgtacggctcccaaggggccaccgcctggagctgagtgatggtgatctcctgacctttggaccagagggtccacctgggaccagtccatccgaattctactttatgttccaacaggtgcgggtgaagccacaggattttgcagcaattacaatccctcggagtaggggtgaggctagggtaggcgcaggatttagacctatgctaccctcccagggagcaccacagaggccactgtccacattctcacctgccccaaaggcgactttaatcctgaactccatcgggtccctgtctaagctgagacctcagccactgacattttccccctcctggggaggtccgaagagcctgcctgtacctgcaccaccaggcgaaatgggaaccacccctagcgcacccccacagagaaatcgcagaaaatccgtccaccgcgtattggcggagttggatgacgaaagtgagcctccagagaatcctccacccgtcctcatggagccgcgaaaaaagcttcgggtagataaagccccactgacacctaccggcaatcgccgaggcagacctcggaaataccctgtctccgctcccatggctccacctgctgtgggcggtggtgagccatgcgccgcaccctgttgttgcctgccccaggaagaaaccgtcgcatgggttcagtgtgacggatgcgacgtgtggtttcacgtggcgtgcgtcggttgttcaatccaggccgcacgggaggcagactttagatgccctggctgtagggccggaatccagacatag

SEQ ID NO: 244363 - DNA, 1038 bp, Artificial Sequence
  Description of Artificial Sequence: Synthetic coding sequence
atgctgccgtgcttccagctgctccgcatcggcggaggacggggaggcgatctttacacctttcatccgccagcaggtgccggatgcacgtatcgattgggccacagggctgacctgtgcgacgtggccctccgccctcagcaggaaccaggcctgatctccggcatccatgcggagttgcatgcggagcccaggggagatgattggcgtgtgtccttggaggatcactccagtcagggcaccctggtcaacaacgttagattacccagagggcaccgactggaactgagcgatggggatctgctgactttcgggccagaggggccaccaggaacatcaccctctgaattctatttcatgtttcagcaggtgagggtgaaaccgcaggatttcgcagcgatcacaattccgagaagcaggggtgaagccagagttggggcaggctttaggcctatgcttcctagccaaggagctcctcagcgccctctctcaactttctcacctgcgcctaaggccaccctaattcttaatagcattggaagtttgagtaagctacggccacagcccctcacattctcccccagttggggaggtcccaaatcactgcccgtccctgcgccaccaggtgaggtgggtacaacaccttccgcccctcctcaaaggaacaggagaaagagtgtacatcgtgttttggcggagttagacgatgaaagcgaaccccctgaaaatccaccgcctgtgcttatggaaccccgaaagaagcttagagtggacaaagctccactgacacccactgggaaccgtcggggtagaccacggaagtatcccgtatctgccccaatggcaccccctgcagttggcggaggcgaaccttgcgccgcaccctgttgttgcctgcctcaggaggagactgtcgcatgggtccagtgtgatgggtgtgatgtgtggtttcacgtagcctgcgtgggctgcagcatccaggcagccagggaggctgatttccgctgtccaggatgccgcgcaggtatccagacttag

SEQ ID NO: 244364 - DNA, 1038 bp, Artificial Sequence
  Description of Artificial Sequence: Synthetic coding sequence
atgctgccatgcttccagctcttgcgtatcggcggaggcagaggcggagatctgtatactttccatccccctgccggtgcgggatgcacgtatcgccttggccatcgagctgacctgtgcgatgtcgcactgcgacctcagcaggagccaggactcatttcaggaatacatgctgaactccatgcagagcccaggggtgatgactggcgcgtgtcactagaggatcattcaagccaggggacattggtcaacaatgtgcggttaccgagggggcacaggctggagctttcggacggtgaccttctcactttcggacccgaggggccacctggaacttcaccgtccgagttttactttatgtttcagcaggtacgagtgaagccccaggacttcgcagctattactatacctcgcagccgcggagaggccagagtcggggctggatttagacccatgctacccagccagggagcgccacaacgccctctaagcacgttctctcctgccccaaaagcgactttgatccttaatagcatcggttctctgagtaaactgaggccacagcccctcacttttagcccaagttggggcggacccaagtcactgcccgtgccagcgcctcctggcgaggttggtactaccccttccgcacctccacagaggaaccgtagaaaaagcgttcacagagtgcttgccgagttggacgatgaatccgaaccacccgagaaccctccccctgtgctgatggaaccacgaaaaaaacttagagtggacaaagcccctctgactcctaccggaaaccggcgtggccgacccaggaaataccccgtgtctgcccctatggcgcctcctgctgtgggtggaggggaaccttgtgctgctccttgttgttgcctaccacaggaagagacagtcgcttgggtgcagtgcgatggatgtgacgtgtggtttcacgttgcatgtgtgggatgcagtatacaggctgcacgagaagcagacttccgctgccctgggtgcagggccggaattcagacctag

SEQ ID NO: 244365 - DNA, 1038 bp, Artificial Sequence
  Description of Artificial Sequence: Synthetic coding sequence
atgctaccgtgcttccagctgctccgcataggcggagggagaggcggtgacctgtacacgtttcatcccccagccggagcaggatgtacctatcgattgggccatagagctgatctttgcgatgtagctctacgtccacagcaggagcccggtctgatctctggaattcatgcagagctgcacgccgagcccagaggcgacgactggcgcgtcagcctagaggaccactcctcacaggggacattggtcaacaacgtccgactgccgcgaggccaccggctagagctgtctgacggagatctcctcactttcgggcctgagggtccccctggcacatcaccctccgaattttactttatgtttcagcaggtgcgcgtgaaaccccaggacttcgctgccatcacaatcccgcgttcaagaggggaagccagagtgggcgcaggcttccgcccaatgttgccctcacagggggctccccagagacccctctccactttctccccggctcctaaagcaaccttgatcctcaactccatcggatccctcagcaagttaagaccccagcctctaacattctctccatcttgggggggacctaagagtctgccagtcccagcacctccaggagaagtcgggacaaccccatctgcgccaccacagcgcaacaggcggaagtctgtgcaccgcgtcttggctgagctggatgacgaatccgagccaccggaaaaccctccaccagttcttatggaaccccgaaagaagttgcgtgtagacaaagcgccactgactcctacggggaatcgcaggggcagacctcgaaaatatcctgtgtcggcaccgatggccccacctgccgtcggcggaggcgagccatgtgcggctccatgttgctgcctcccccaggaggagaccgtagcttgggtgcagtgcgatggctgcgacgtctggtttcatgttgcgtgtgtcgggtgctccatccaggcagctcgcgaggcagacttcagatgccccggttgcagggctggcattcagacctag

SEQ ID NO: 244366 - DNA, 1038 bp, Artificial Sequence
  Description of Artificial Sequence: Synthetic coding sequence
atgttaccatgtttccaactgctgcggatcggagggggtagaggcggtgatctctatacgtttcatcctcccgctggagccggttgtacctatcggcttggccaccgtgctgatttatgcgatgtggccctcaggcctcagcaggagcccggtttaatcagtggtatccacgcagagctgcatgctgagccacgaggtgatgactggcgcgtatccctggaagatcactcgtcacaggggacgctggtaaataacgtcagactgcccaggggccacagactagaactctcagacggtgacctattaactttcggccctgagggccctcccggtacctctccctccgagttctactttatgttccagcaagtgcgggtgaaaccccaggactttgccgcaattacaataccacgatcaaggggtgaggcaagagtgggcgcaggtttcagacctatgctgccaagtcagggcgcaccacagcggccactgtctacattcagcccagctcccaaggccacgctgattttaaattcaatcggcagtttgtctaaacttcgaccccaacctctcacattctctccgagctggggaggacccaaatcactgcctgtaccagctccaccaggcgaggttggaactaccccctccgctcctcctcaacgtaaccggcgaaagtcagtccacagggtgctagctgaactggatgacgaatccgaacctccagagaatcctcccccagtgctaatggagcccagaaagaagttacgtgtcgacaaggcccctcttacacctactgggaatcggaggggcaggccacgaaaataccctgtctctgctcccatggctccgcctgccgtcgggggtggggaaccttgcgccgctccctgctgttgtttgcctcaggaagaaactgtggcgtgggtacagtgcgacgggtgtgatgtttggttccatgtcgcgtgtgttggttgctctattcaagcagctagagaggctgatttcagatgtcccggatgcagggcgggaatccagacttag

SEQ ID NO: 244367 - DNA, 1038 bp, Artificial Sequence
  Description of Artificial Sequence: Synthetic coding sequence
atgctgccatgcttccagcttcttcggatcggcggaggaagaggtggagacttgtacacatttcatcccccagcgggtgccggatgtacctacagactcggacatagagctgatctgtgtgacgtggcactaaggccccagcaggaacctggcctgattagtggcatccacgctgagctgcacgccgagccccgaggcgatgattggagggtgagtctggaggatcactcaagccaaggaacgctagttaataatgtccgcctaccacgcggtcatagactcgagctatctgacggagacctcctaaccttcggtcccgaagggcctccaggaacttctccgagcgagttctattttatgttccagcaagtgagagtgaaaccccaggattttgctgccatcacaatcccacggtccagaggtgaagctagggtgggagctggctttcgtcctatgctgccaagccagggcgcacctcaacgacccctctcgaccttcagtccagctccaaaggctaccctcattttgaatagtatcggaagcctcagtaagttaaggccgcagcccctgactttctccccctcttggggcggtcctaaatcccttcccgtgccagcaccacctggagaggtgggaaccacaccgagcgcaccaccccaacgcaaccggaggaagtccgttcacagggtgctggccgagttagacgatgaatcagagccgccagagaatcctcctcccgtgcttatggagccccgaaaaaagcttcgcgtcgataaagccccactgacacccacagggaaccgcagggggagacccaggaagtatcccgtgtccgccccaatggctcccccagccgtgggcggtggcgaaccctgcgcagcaccgtgttgttgcctcccccaggaagagacagtcgcctgggttcaatgcgatggctgcgatgtatggtttcacgttgcctgcgtcggttgtagcatacaggcagcacgggaagccgatttcaggtgtccaggctgccgtgcaggcatccagacttag

SEQ ID NO: 244368 - DNA, 1038 bp, Artificial Sequence
  Description of Artificial Sequence: Synthetic coding sequence
atgctaccatgcttccagcttcttcgcatcggaggagggcgaggaggagatctctatacttttcatccgcctgccggtgcgggatgtacctacagactgggccacagagccgacctgtgtgacgtcgccttgagaccccagcaggagccaggcctcattagcggcatccatgccgagctccacgccgaacctcgtggtgatgactggcgcgtttcacttgaagaccactcgtcccagggcactttggtcaacaacgtcagactccctcgtgggcatcgcctggaattgagcgatggagatttgcttactttcggcccagaaggctctccgggaaccagtcctagcgaattttatttcatgtttcagcaggtgagggtgaaaccccaagacttcgctgctatcaccatacctagatccaggggggaagctcgggtgggcgcaggctttagacccatgctaccatcccagggtgccccacagaggcctctgtctactttctctccggcacctaaggccacactgatattaaactcgataggatctctctccaagctccgccctcaaccgctaacttttagtccatcgtggggcggacctaaatcattaccagtcccagctccacctggggaggtcgggacaacaccaagcgctcctcctcaaaggaatcgccgaaaatccgtccaccgcgtcctcgccgagttggacgacgagtcagagcccccagaaaaccctcctccggtgttgatggaacctcgaaagaagttgcgtgtggacaaggcccctcttacacctacaggcaaccgtcggggacgccctaggaagtatccggtttcagcccctatggctccgcctgctgtgggaggcggtgagccctgtgcagctccctgttgctgtctgccacaggaggagactgttgcgtgggttcagtgtgacggctgcgatgtgtggtttcatgtggcttgtgtgggctgtagcatccaggctgcaagagaggctgacttccgatgcccagggtgcagggcagggatccagacgtag

SEQ ID NO: 244369 - DNA, 1038 bp, Artificial Sequence
  Description of Artificial Sequence: Synthetic coding sequence
atgcttccttgctttcagctgctgcgtatcgggggtggccgtggaggcgatctttatacttttcatcccccagctggggctgggtgcacttacagactagggcatagagccgacctttgtgatgtagcccttaggcctcagcaggaaccaggcttaatttcaggcatccacgcggaattacatgctgagcccaggggagacgattggagagtgagtctggaagaccacagttcacaggggacattggtaaacaacgtccggctgcctcggggtcacagactcgaactgtccgacggcgacctcctgacgtttggccctgaggggcctccaggcactagccccagcgagttttactttatgttccagcaggtgagagtgaagccacaagactttgcagcaataactatcccccgaagtagaggggaggcgagggtaggcgctggcttcaggcctatgttaccttcccagggcgcaccccagcgacctttgagtacattctcccctgcgcctaaagctacactgatactcaactcaataggtagcctgtccaaactgcgcccacaaccgttgactttcagcccgagctggggaggccctaaatctctgccagttcctgctccacccggtgaagtcggaactacaccttccgctccaccacagagaaataggagaaaaagcgtgcaccgagtgctagccgagttagacgacgagtctgaacctcctgaaaatccacccccagtgctgatggagcctcgcaagaaactacgggttgacaaggcacccctgacgcccactggaaataggagagggcgacccagaaaataccctgtgagcgcaccgatggcccctccagccgtcggtgggggtgagccctgtgccgctccgtgctgttgtttaccccaggaggaaacagtggcctgggtgcagtgcgatggctgcgatgtgtggttccacgtggcttgcgtcggatgcagtattcaggccgctcgggaggccgacttccggtgtcccggatgtagagctggaatacagacttag

SEQ ID NO: 244370 - DNA, 1038 bp, Artificial Sequence
  Description of Artificial Sequence: Synthetic coding sequence
atgcttccctgttttcagctgcttcgtattggtggaggtcgcggaggagacctctatacttttcaccctccagccggagcaggatgcacgtatcgccttggccaccgcgctgacctttgtgatgtagcccttcggccacaacaggaacctggcctgatttccggaattcatgcagagcttcacgcagagccgcgaggagacgactggcgagttagcctggaagatcattctagccagggaactttagtcaataatgtaagactgcctaggggccaccggctggagctgagcgatggtgacctcctcaccttcgggcctgaaggacctcctgggacaagtccttcagagttctacttcatgttccagcaggtgcgtgtcaagcctcaggacttcgcagccatcacaattcccaggtcccgaggagaggctcgggtcggagctggcttcagaccgatgcttccttcccaaggcgctccgcagagaccgctctcgactttctcccctgcacctaaggcaacgcttatccttaacagtatcggttccctcagtaaattgcgccctcagccgctgactttctctccaagctggggtggacccaagtctctgccggtgccagctcctcccggtgaggttggcacaaccccatccgctcctcctcagcggaaccgaagaaagtccgtccaccgggttctggcagagttagacgatgagagtgaaccacctgagaaccctccaccagttttgatggagccccgtaagaagttacgtgttgataaggcacccttaacacccacggggaataggagagggaggcctcggaaatatcccgtctctgcgcctatggctcctcctgctgttggtggaggagaaccttgcgcggcaccttgttgttgcctcccacaggaggagactgttgcttgggtccagtgtgacgggtgtgacgtctggttccatgtggcatgcgtgggttgctcaattcaggctgcacgtgaagccgactttcgatgccccggttgtagagcaggcattcagacctag

SEQ ID NO: 244371 - DNA, 1038 bp, Artificial Sequence
  Description of Artificial Sequence: Synthetic coding sequence
atgttgccatgttttcagctactgcggatcgggggaggcagaggcggagatctgtacacgtttcatcccccagccggtgccggttgcacctatagactcgggcatagggcagacttatgcgacgtggccctcaggcctcaacaggaacctggtcttatcagtggaattcacgctgaactgcacgcagaacccaggggggacgattggcgtgtgtccttggaagatcattccagccaaggcactctggtgaacaatgtccgccttcccaggggccaccgtcttgaactctctgatggtgacctcttgacctttgggcctgaaggcccacctggtaccagcccttccgaattctactttatgtttcaacaagtgcgagtgaaaccacaggactttgctgcaataacgattccaaggagccgcggtgaagccagggtgggagcaggctttcgcccaatgctgccatcgcagggggctccacagcgacctctcagcacattttccccagcacctaaggccactctcattctgaacagcattgggagtttgtcgaagctccggccacagccattaaccttcagcccatcatgggggggtcccaaatctctcccagtgcctgctcctcccggagaagtgggcactacgccatcagcccctcctcagaggaacagaagaaaatccgtacaccgcgtgttagctgagttagacgacgaatctgagcctcccgaaaaccctcccccagtattaatggaacctaggaagaagctgcgggtggataaggcccctctgacccccacaggtaaccgacgcggacggcctagaaaataccccgtgtccgcccctatggctccacccgctgtcggaggaggggagccttgtgccgcaccctgttgctgcctccctcaggaggaaactgtcgcatgggtgcagtgtgatggttgtgatgtgtggtttcatgttgcttgcgttgggtgctctattcaagccgctagggaagcagattttcgttgccccggatgccgggcagggatccagacatag

SEQ ID NO: 244372 - DNA, 1038 bp, Artificial Sequence
  Description of Artificial Sequence: Synthetic coding sequence
atgctcccgtgcttccagcttctgcgtataggcggtgggaggggaggggacttgtatactttccaccctcccgcaggcgctggatgcacgtacagattgggccaccgggctgacctgtgcgacgtggcactgaggccccagcaggagcctgggctgatttccggtatccatgctgaattacatgccgaaccacgaggggatgactggcgggtgtcactggaggaccactcttcccagggtaccctggtcaacaacgtccgccttcctagaggacacagattggagctgtctgatggcgatcttcttaccttcgggcctgaagggccacccggaacaagcccgtctgagttctactttatgttccagcaggtgcgggtgaagccacaggattttgccgcaataaccattcctcggagtaggggggaggccagggtaggcgcaggatttagacccatgcttccttcacaaggagccccacagagacccctgagcacattctcccctgccccaaaggcaaccctcattctaaacagcatcgggagcctgagtaagttacgtcctcagcccctcacgttttccccatcatggggcggtcccaagagcttgcccgtacccgcacccccaggcgaagtaggtacaacccccagtgcccctcctcaacggaatcggcgtaaaagcgtacaccgagtgctagccgagctcgacgatgaaagcgaaccacctgaaaatcctccccctgtgcttatggagcccaggaagaagctgagagtcgacaaggcaccactcacgccaaccgggaatcgtcggggaaggcctcgaaaatacccggtttctgctcccatggccccacccgcagtgggcggtggtgagccttgtgcggctccctgttgctgtcttcctcaggaagagaccgttgcctgggttcagtgtgacgggtgtgacgtgtggttccatgtcgcctgcgtgggttgtagcattcaggccgctcgcgaggccgactttaggtgtccgggttgcagggccggtatacagacgtag

SEQ ID NO: 244373 - DNA, 1038 bp, Artificial Sequence
  Description of Artificial Sequence: Synthetic coding sequence
atgctcccatgctttcagctccttaggattggaggaggtagaggcggagacctgtacacttttcaccctcctgccggagccggatgtacatatcgtttgggacatagagccgatctgtgtgatgtagctcttcgaccccagcaggaacccggactgatctcaggaatacacgccgaactgcacgctgagcctcggggagacgattggcgggtttcattggaagaccacagctcccagggcaccctggtaaataatgtcagattaccgcgaggtcacaggctcgagctgtccgacggtgatttgctgacattcgggcctgagggtcccccaggaacgtcaccaagtgaattctatttcatgttccaacaggtgcgagtcaagcctcaggactttgctgccataactattcctcggtcgcggggtgaggccagggtaggagcagggtttcgtccaatgctgccttcccagggcgctcctcagcgaccattaagtacattcagtccagccccaaaagccaccctcattctaaattcaatcgggagtctgtctaaactcagaccccaacccctgacgtttagtccgtcctgggggggaccaaaatcacttcccgtgccagcgcctcctggggaagtgggcactactcccagtgctccccctcagcggaaccgccgaaagtctgttcatcgggtcctagccgaattggatgacgagtcggaaccaccggaaaacccaccaccggtactgatggagccgcgaaagaaactgcgtgttgataaagcacctctaacccctaccggcaatcgcaggggccgacctagaaaataccctgtgtcagcacccatggcgcctcccgctgtaggcggaggggagccttgcgctgcgccatgctgttgcctgccacaggaggagacagtggcctgggtacagtgcgacggatgcgatgtgtggtttcacgtagcttgcgttggatgttccattcaagccgcaagggaggccgacttccggtgcccgggatgtagagctgggatccagacttag

SEQ ID NO: 244374 - DNA, 1038 bp, Artificial Sequence
  Description of Artificial Sequence: Synthetic coding sequence
atgctgccctgctttcagctgttacggatcgggggaggccgaggtggggacctatatacattccacccccctgccggtgctggctgtacctacagactcggtcacagagcagatctctgcgatgtggctctgcgccctcagcaagaaccagggcttatttctgggattcatgccgagttgcacgctgagcctagaggggacgactggagggtatcccttgaggatcactcaagtcaggggacactcgtcaataacgtgagacttccacggggacacagactcgaactgtctgacggagacctcctgacctttgggccagagggttctccaggtacttcgcccagcgaattttatttcatgttccagcaggtgcgagttaagcctcaggatttcgccgctataacgatccctagatccagaggagaagcaagagtgggagctgggttccggcctatgctgccgagccagggagccccacaacgccctctcagcactttttcaccagctcccaaagcgaccttaattctgaattccattgggtcactgtcgaaactccgcccacagcctctaaccttctcccccagttggggcggacccaagtcactaccagtacccgctcctcctggggaagtggggacgaccccgagtgctccacctcagcggaaccggaggaagagcgtgcaccgggtactcgccgagcttgacgatgagagcgaaccccctgagaacccaccccctgtgcttatggaacccaggaaaaaactaagagtagataaggcccctctaacaccaactggtaatcgcagaggcaggcccagaaaataccctgtcagcgccccaatggccccaccggcagtgggtggaggagaaccatgtgctgctccatgctgctgcttaccacaagaggaaaccgtggcttgggtgcagtgcgatggctgtgatgtgtggttccacgtggcttgcgtcgggtgctcaatccaggccgcaagggaagcggactttaggtgccctgggtgcagagcaggcatacagacctag

SEQ ID NO: 244375 - DNA, 654 bp, Artificial Sequence
  Description of Artificial Sequence: Synthetic coding sequence
actcttgttaataacgtcaggttgcctcgcggacaccgcctcgagctctcggatggggatcttctcacatttgggcctgagggtccacccggaacttcgccctccgaattctattttatgttccagcaagtcagagtgaagccccaggattttgctgccataacaattccaagatctagaggtgaagcaagagtcggcgcaggcttcagacccatgctcccttctcaaggtgcccctcaaagaccactaagtacattcagccccgcaccaaaagctaccctgattttaaactcgatcggatcactgagcaaactacgcccacaaccactaaccttttcaccctcctggggcggacccaagtctctgcccgtcccagcacctcccggagagatgggtaccacaccttcagcgcctcctcagcggaatcgcaggaaaagcgtacaccgcgttctggccgagttagatgatgagtctgagccaccggagaacccaccaccagtgctcatggaaccacggaaaaagttacgcgtggacaaagctccgctgactcccacaggaaactggcatatccaggggatgcaaagcatagtgaaagggcagaaagaacgcccttggcccagggaacacctgtctggctacgaagaggccagctag

SEQ ID NO: 244376 - DNA, 645 bp, Artificial Sequence
  Description of Artificial Sequence: Synthetic coding sequence
atgagccagaggaaagcgagggggcctcccgcaatgcctggcgtgggccattctcagacccaggccaaggcgagactcctcccaggagccgaccggaagcgctcacggctttcgcgtaccagacaggatccctgggaggagaggagctggtcaaatcaacgctggagcagagcaacccccggaccacggggaacccgggctgggggactagccctgggaagaagtgaagctagccctgaaaatgcagcccgagaacgcagcagggtccgtactttgcgccaggcgttcttggcactccaggccgctctccccgcagtgccccctgatacaaaacttagtaaattggatgtgcttgtactggcggcttcatatatcgcgcatcttacccgcacccttggccatgagctccccggtcctgcttggccacctttccttcggggtttgcggtacctgcatcccctgaaaaaatggcctatgagaagcagattgtatgcaggcggactggggtattcggacctggatagcaccacggcatccactccaagccagcggacccgcgatgccgaggtcggttcacaggttcctggcgaggccgacgctctgctcagtactacacccctctctccagcactgggagataaatag

SEQ ID NO: 244377 - DNA, 2031 bp, Artificial Sequence
  Description of Artificial Sequence: Synthetic coding sequence
atgtccagacgggcactgagacgattgcggggagagcaaaggggacaggagcctctgggaccaggagctctgcacttcgatcttcgcgatgatgacgacgccgaggaagagggccctaagagagaactcggcgttcggcgaccgggtggcgctggaaaggaaggcgtgagggtcaataaccgcttcgagcttatcaacatagatgatttagaagacgaccctgtcgttaacggagagagaagcgggtgcgcactgactgatgcagtggcgccaggaaataagggacgtggccagagaggtaacacagaaagcaagacagatggggatgatacagaaactgttccatccgagcagtcccacgcttctgggaagcttcgtaaaaagaaaaagaagcagaaaaataagaagagctctacaggggaggctagcgagaatgggctggaggatatcgataggatcctagaaagaattgaggactccacaggtttgaacaggcccggaccagctcctctcagttctcgcaagcatgtgctctacgttgaacaccgccacctgaatccggatacagaattaaaacgctattttggggctagggctattctgggagagcaacgccctaggcagaggcagcgagtgtatccaaagtgcacctggctgactacccctaaatccacctggccccgatactctaagcctggactcagcatgcgtctcctggagagcaagaagggcttgagcttctttgcgtttgaacattccgaggagtaccaacaggcccagcataagtttttggtggctgtagaaagtatggagccaaacaacatagtggtgctcctgcagacgagtccctaccacgtcgacagcctgctccagctgagtgacgcttgtcgcttccaggaagaccaagaaatggcccgtgacctagtcgagcgggctctctactctatggaatgcgccttccatccactcttttcacttaccagcggcgcatgcaggttagattacagaagacccgaaaacaggtccttctacttggccctatataagcagatgtcctttttagagaagagaggttgtccacgcaccgccctggaatactgtaagctgatattaagtctagagcctgatgaagacccgttatgtatgctactattgatcgatcatctcgccctgcgcgcaagaaactatgagtatctcatccggttgtttcaggagtgggaggcgcacagaaacctgtcacagcttccaaattttgctttttcagtgccattggcgtactttctgctgagtcaacagactgatctccctgaatgtgaacaatcctctgcgcgacagaaagcgtccttgctgattcaacaggctctaactatgtttccaggtgtcctgctccctcttttggagtcatgctccgttcgacccgacgcaagcgtgtcctcgcacagattttttggccctaatgctgaaatcagccagcctcctgccctctcacagctggttaatctctacttaggccgatctcatttcttatggaaggaacccgcaacgatgtcttggctggaggagaatgttcacgaagtcctgcaggccgtggacgcgggagacccagcggttgaggcctgtgaaaacagacggaaggtcttgtatcagagggcacccaggaacatccacaggcacgtgatcctgtcagagattaaggaggccgtggcagctctgccccctgatgtcactactcaatccgtgatgggctttgacccactccccccttccgatactatatacagctatgttagacctgagagactgtccccaatctcccacggtaacaccatcgcactgttttttcgatcactgctgcccaactacacaatggagggggaacgacctgaagagggagtggctgggggtttgaaccggaaccagggactcaaccgtctaatgctagctgtgagggatatgatggccaatttccatctgaatgacctggaagccccacacgaggacgatgctgagggcgaaggagagtgggactag

SEQ ID NO: 244378 - DNA, 1422 bp, Artificial Sequence
  Description of Artificial Sequence: Synthetic coding sequence
atgagacttctcgagagcaagaagggcctgtccttcttcgcattcgagcactctgaggagtaccagcaagcccaacataaatttctggtcgccgttgagtccatggagccaaacaatatcgttgtgttgctgcagacctccccttaccatgtcgactctctcctgcagctctccgatgcgtgcagattccaggaggatcaagagatggccagagatctggtggaacgagctctgtatagtatggagtgtgcgtttcacccacttttttctctgacttcaggggcatgcagactggactatcgcaggccagagaatagaagcttctatctggctctctataagcagatgagctttctagaaaagagggggtgtccacgcacagcccttgaatattgcaagttaatccttagtctggaacccgatgaagacccactgtgtatgctgctcctgattgaccaccttgctttgcgcgcacgaaattacgaatacctgatccgcttatttcaggaatgggaagcccacaggaacctgagccagctccctaactttgctttttctgtgcctcttgcctattttcttctcagtcagcaaacagatcttccagagtgtgaacaatcttccgccaggcaaaaggcttcacttttgatccagcaggccttaaccatgttcccgggtgtcctgctcccactcctggagagctgcagcgtcagacctgacgctagcgtgtcttctcaccgatttttcggcccaaatgcggaaatcagccagccaccagccctgtctcagctggtcaacctatacctagggagaagccacttcctgtggaaagaacctgccaccatgtcttggctcgaagaaaatgtacacgaagtcttacaggcagtcgacgccggagaccccgcagtcgaagcctgtgagaatcgacggaaggtgctgtaccagcgtgcacctagaaatattcacaggcacgtgattctgtctgagatcaaagaggccgtcgccgctctgccgccagatgtgaccacacagtccgtcatgggattcgaccccctgcccccatcggacacgatctattcatacgtcagacctgaaaggaaaggggaagaggagagaaacagcgtcatctggggctctcagctctgtgtctgcagacctaggagcttccctagcccacccaatgtccaggctttagcctgccgccctctatggcaggcaaaatcctatcagccatggaaacaccactgctctctgttgccagtcacagtcgctaagttgtatcacggcggaggagaagcaagagggaggagtgggtggggctcggagcctcaaccgggaccagaacaagcagatgcaggatgcgctagacacgatgggcagttaccaccgcagcgtcctgggggagcagctaggggacgccgatag

SEQ ID NO: 244379 - DNA, 651 bp, Artificial Sequence
  Description of Artificial Sequence: Synthetic coding sequence
atgagtaggcgggcattacggagactgcgtggcgaacaacgcggacaggagcccctgggacccggtgcccttcacttcgacttaagagacgacgacgacgccgaagaagaagggcctaagcgcgaactaggggtccgtagaccaggaggagcaggcaaggagggagttagagtaaataaccgattcgaactaattaatattgatgacctggaggacgaccctgtagttaacggggagcgttcagggtgtgctctgaccgatgcagtggcacctgggaataaggggagagggcagaggggcaatacagagtcaaagacagacggagatgacacagagactgtgccatcagagcaatcccatgctagtggcaagctccggaagaaaaagaagaaacagaagaacaaaaagtcctccacaggcgaagcttctgaaaacggcctggaagacatcgatcgtatcctggaacggattgaggacagcaccggcctcaacaggccaggtccagctcccttatccagccgtaagcacgtgctgtacgtcgagcatcggcacctgaatcctgacacggagctgaagcgctattttggcgctcgggctattctcggcgagcagagagatcgagtgctgctcggctgccccgtctggttctag

SEQ ID NO: 244380 - DNA, 624 bp, Artificial Sequence
  Description of Artificial Sequence: Synthetic coding sequence
cttactgtgaatgcgtcgatgtcccggttcccccctcatatggtcccacctcatcacacgcttcacactaccgggatcccccatcccgcaatcgtgacccccactgttaaacaggagtctagccagtctgacgtgggctcacttcactctagcaagcatcaggacagtaagaaggaagaggaaaagaaaaagccacatatcaagaagcctctcaacgccttcatgctgtatatgaaagaaatgcgggctaaagtggtggcagagtgcactctcaaagaatcagcagccattaaccagatcttaggaaggaggtggcatgccctcagccgcgaagagcaggcaaagtactacgagctggcccgtaaggaacgacagctacacatgcagctctaccccggatggtcagcaagagataactacggcaagaagaaaaaacgcaagagggacaagcagcctggcgaaaccaatgacctcagcgcgcctaaaaagtgccgggctcgattcggtttggaccagcagaacaactggtgcggaccttgtaggaggaagaagaaatgtgtccgctatatccagggcgagggatcctgcctgtctcctcccagttcggacggctccctcctctag

SEQ ID NO: 244381 - DNA, 669 bp, Artificial Sequence
  Description of Artificial Sequence: Synthetic coding sequence
accaatcagaatagcagttccgactccgaagcggagcgcagaccccctcctagatctgaaagtttccgcgataagtccagagagagtcttgaggaggctgcgaagagacaggatggcggtctgttcaaggggccaccataccccggatatcccttcattatgatcccagacctgacctctccttatcttccgaatggctctctgagtcctacggccaggaccctgcacttccagtccggatcaacacactatagtgcctacaagactatcgagcatcagatagctgtccaatacttgcagatgaagtggcctctgttggatgtccaagcaggatctctgcagagccggcaggccctcaaggatgcaagaagcccttcaccggctcacatcgtaagccctcttccatgctgcacacagggacacgactgtcagcacttctatcctccttcggacttcacagtttctacccaggtgttcagggacatgaaacgttcacatagcctccagaaggtgggtgagccttggtgtattgagagcaataaggttcctgtggtccaacacccacatcatgtccatcccctcacgccactgatcacatacagcaatgagcattttactccaggaaacccgccaccgcaccttcctgcggatgttgaccctaagacgtag

SEQ ID NO: 244382 - DNA, 867 bp, Artificial Sequence
  Description of Artificial Sequence: Synthetic coding sequence
atgccccagctcaacgggggaggaggagacgatctgggggctaacgatgagctgatttccttcaaggacgagggcgagcaggaagagaaatcctctgagaatagcagtgcagagcgcgacttggccgacgttaaatctagtcttgtgaatgagagcgagactaaccaaaacagctcaagtgacagtgaggctgaacgacgaccgccaccaagatctgaaagttttagggacaagagccgcgagtctctcgaggaggctgccaagaggcaggatggcggactttttaagggccctccctatcccggatacccgttcatcatgatacccgaccttacaagtccatacctgcccaacggaagcctctccccgaccgccaggactttgcacttccagtccggatccactcactacagtgcctataagaccatcgagcaccagatcgctgtccagtacttgcaaatgaaatggccactgctggatgtccaagccggttcgctgcaaagccggcaggcgcttaaggacgctaggtctcctagcccagcccatatcgttagtaataaagtaccagtggttcagcacccccaccatgtgcatcctttaacaccactaatcacctattctaatgaacacttcacacccggtaatcctccaccccatctgcccgctgacgtggaccccaagaccggaattcccagacctccacaccctcccgacatttccccctattatccgctgtcccctggaacagtgggtcagatacctcatccactcggatggcaagggcagccagtctacccgattacgactggagggtttcgacatccttatccaacagccctgactgtgaacgctagcatgtcgaggtag

SEQ ID NO: 244383 - DNA, 1380 bp, Artificial Sequence
  Description of Artificial Sequence: Synthetic coding sequence
atgcctcaactgaacggcggtgggggagacgaccttggggctaacgatgagctgataagcttcaaagatgagggagaacaagaggaaaagagtagcgagaattctagtgccgagagggacctcgctgacgtcaaaagcagcctcgtcaacgagagcgagaccaatcagaactctagtagtgactcggaggctgagagaagaccccctcccagatccgagtcttttagagacaaatctcgggaatccctcgaggaggcagccaaacggcaagacgggggactgtttaagggcccaccttaccctggctaccccttcattatgatcccagacctaacgtctccatacctacccaatggctctttgtctcctaccgcccgtacatacctgcaaatgaaatggccgcttctggatgtccaagcgggtagcctgcaatcccggcaagcgctgaaggatgctcgaagtccctctccagctcatatcgtgtccaacaaggtccccgtggttcagcacccacaccatgtacatcccttgactccccttatcacgtatagcaacgaacactttactccaggaaatccccctccccatctgcccgctgatgtggacccaaaaaccggcataccccgaccccctcatcccccagacatcagcccgtattatcctctttcccctgggaccgtcggacaaatacctcatcccttgggatggctggtgccgcagcaagggcagcccgtttaccccatcaccaccggtgggtttagacatccgtacccaacagctctgaccgtcaacgcctccatgagccggtttcccccacatatggtccccccacaccacaccctccacaccacaggtataccacacccagcgatcgtgacaccaaccgtcaaacaggaaagttctcagtctgatgtcgggagtttgcatagcagtaagcatcaggatagcaagaaagaggaagaaaaaaaaaaaccgcatattaaaaaaccccttaacgcctttatgctctatatgaaagaaatgagagcaaaagtggtggctgagtgcactctcaaagaatctgcagcaatcaatcagatactagggcgtaggtggcatgctctctctcgcgaggaacaggctaagtactacgagctggcacgcaaggagcgtcagctgcacatgcagctgtacccagggtggtccgcccgtgacaactacggaaagaagaagaaacgcaagcgcgacaaacagcccggagaaacgaacgagcacagtgagtgctttcttaacccttgcttatcgttacctccgataacggaccttagcgcccctaaaaagtgccgagctcgctttgggcttgaccagcaaaacaattggtgcggcccatgcagcctatag

SEQ ID NO: 244384 - DNA, 1470 bp, Artificial Sequence
  Description of Artificial Sequence: Synthetic coding sequence
atgccacaactcaacggaggaggcggagacgacctgggtgcaaacgacgaattaatttcgtttaaagacgagggggagcaagaggagaaatcctcagagaacagtagcgccgaacgtgatctggctgatgtgaaaagctcgctcgtgaatgaaagcgagactaatcagaactcctccagcgactcagaggcagaacgcaggccacccccacgctctgagagttttcgggataagtccagagaaagtcttgaggaggccgctaaacggcaggatggcggtttatttaagggacccccttacccgggatatccgtttatcatgattcctgatctgaccagtccctacctgcctaatggttctctctcccccaccgctcgaacctacctgcagatgaagtggccactcctggacgtacaggcgggaagccttcagagtagacaagcgctcaaggacgcaagatcccccagcccggcacatatcgtcagcccactgccctgctgtacccaagggcacgattgccagcatttctaccccccaagcgattttaccgtttccacccaagtgtttagggacatgaagagatcccatagcctgcagaaagtgggtgagccttggtgtattgaatcaaacaaggttccggtcgtgcagcacccacatcatgttcatcccctgaccccattaattacttatagtaatgaacatttcactcctggcaacccaccgccacatctcccagccgatgtcgatcccaagaccggtatcccgcgaccaccccaccctcccgacatatcgccgtactaccccctgagtcccggtaccgtgggtcagattccacatcccctaggctggttagtcccccagcagggccagcccgtataccccattaccacaggcggattcagacacccataccccaccgctctcacagtcaacgcgagcatgtcccgcttccctccccacatggtcccacctcaccatacgctgcacacaacagggatcccgcatcctgccatcgtgaccccaaccgtcaagcaagagagctctcagtccgatgtcggcagcctccacagcagcaagcaccaggactcaaagaaggaagaggagaagaagaagccccacattaaaaagccattgaatgccttcatgctctatatgaaagagatgcgagcaaaggtggtggcagagtgcacccttaaggaatcagccgctataaatcaaatactcgggagaagatggcatgcactgagcagagaagagcaggcaaaatattatgagctagcacgcaaagaaagacagctacacatgcagttgtaccccggatggagtgcgagagataactacggtaaaaaaaagaagcgcaaacgcgacaagcagcccggagaaaccaacggagagaagaagtctgcattcgctacgtataaagtcaaggccgctgccagcgcccacccactgcagatggaagcgtactag

SEQ ID NO: 244385 - DNA, 1860 bp, Artificial Sequence
  Description of Artificial Sequence: Synthetic coding sequence
atgcctcaactcaatggtgggggtggggacgacctcggggctaatgacgagttgatttcttttaaggatgagggcgagcaagaagagaaaagctctgagaactcgtctgcagagagggaccttgccgatgttaaatcctctttggtgaatgaaagcgaaactaatcagaatagttcctcagactcagaggctgagcggcgtccgccacccagaagtgaaagttttagagataaatctcgcgagtcactagaggaggccgcaaagcgacaagacggtggcctttttaagggccctccctatcctggatacccctttatcatgattccagatctgacatccccttacctgccgaacggctcactcagtcccacagcacgaacactacacttccaatctgggtccactcactactctgcgtataagactattgaacaccagatagcagtgcaatacctgcagatgaagtggcctctgttggatgtgcaggctgggagcctccagtcccggcaggccctgaaggacgctcgctccccctcaccggctcacatagttagcaataaagtgcctgtggtccagcatccacatcatgtacacccactcactccactcattacgtattcaaacgaacactttacccctggcaatccacctccacatttacccgcagatgtggatccaaagactgggatccctaggcctccgcacccaccagatatctccccctactaccctctctcacctggtaccgtaggacaaatacctcatcccctcgggtggctggtgcctcagcaaggtcagcctgtctacccaatcaccaccgggggattccgccatccataccctaccgccctaactgtgaacgcctccatgtctaggttcccccctcacatggtccctccgcatcatactttgcatacgaccggaatcccccaccccgctatcgtgaccccaaccgtgaagcaagagtcctcccagagcgatgttgggtctctgcacagctctaagcaccaggatagcaagaaggaagaggaaaaaaagaaacctcacatcaagaaaccactgaatgcatttatgctgtacatgaaggaaatgagggctaaggtagttgctgaatgtaccctgaaagaaagcgcggcaataaaccaaattctcgggcgaagatggcacgccctctcaagggaggaacaggctaagtactacgaactggcgagaaaggagcgccagttgcacatgcagctctacccaggctggtcagccagggataactatggcaaaaagaaaaaacgcaagcgggataaacagccaggcgaaaccaatgagcactcggaatgctttctcaacccttgcctgtccttgcctccaatcacagatttgagcgcgcctaagaaatgcagagcaaggttcggccttgaccagcaaaataattggtgtgggccatgtagaaggaagaaaaaatgcgtgcgttatatccagggcgagggctcctgtctgtccccccctagtagcgatgggtccctgctggattctccacccccatccccgaacctattggggtcacccccaagagatgcgaagagccagactgagcaaacacagccattatctctgtccctgaagccagacccattggcacatttgtcaatgatgccccctccaccggcacttctgctcgcggaggctacgcacaaagcctccgcactgtgccctaacggcgctttagacttgccacccgcagccctccaaccagcagcaccatcgtccagcatcgcacagccctccacaagtagcctccactctcacagtagcctggcagggacccagccccaacccctatctttagtgacaaaatctctggagtag

SEQ ID NO: 244386 - DNA, 363 bp, Artificial Sequence
  Description of Artificial Sequence: Synthetic coding sequence
atgctctatatgaaggaaatgagggcgaaggtggtggccgagtgcacgctaaaagaatccgccgcaattaaccagatcctgggtcgtcgctggcacgccctgtcaagggaggagcaggcaaaatattatgaactggccaggaaagaacgccagttgcacatgcagttataccccggttggtccgcgcgagacaattatgggaagaagaaaaaacggaaaagagataagcagccaggcgaaaccaatgacctgtctgctcctaaaaaatgtcgagctagattcggactggatcagcagaataactggtgcggcccttgccgatgcaaatattctaaagaggtctccggcaccgtgcgagcatag

SEQ ID NO: 244387 - DNA, 531 bp, Artificial Sequence
  Description of Artificial Sequence: Synthetic coding sequence
atgtcaagattcccgcctcacatggtgcccccacaccatacactgcatactaccggaattccccatcccgcaattgtgacaccaactgtgaaacaggagagttcacagagtgatgtcggctctctacactcgtcgaagcaccaagactccaagaaagaagaagagaagaaaaaaccacacatcaaaaagcctcttaatgcctttatgttatatatgaaagaaatgagagctaaagtcgtagccgagtgtacgctgaaagaatcagccgcaatcaaccagattttgggcagacggtggcatgctctgagtcgcgaggagcaggcaaagtattatgaattagcacgtaaggagaggcaattgcacatgcagctgtatcccggttggtctgcacgcgataactacgggaagaagaaaaaaagaaagagagataaacaaccaggggagacaaatggtgaaaagaaatccgccttcgcaacatacaaagttaaagcagcagcgtctgcccatccgcttcagatggaggcctattag

SEQ ID NO: 244388 - DNA, 954 bp, Artificial Sequence
  Description of Artificial Sequence: Synthetic coding sequence
atgcctcaactgaacggaggcggtggcgacgatctgggggctaacgacgagctaataagcttcaaagatgaaggggagcaggaggagaaatcctcagagaacagttccgccgaacgagacctggccgacgtgaaatcaagtctggtgaatgagagtgaaacaaaccagaactcaagttccgatagtgaggccgagcggcgtccccctcccagaagcgagagctttcgagacaagtcgcgtgagtccctcgaggaagcagcgaaaaggcaggatggaggcctgtttaaggggcctccctatcccggataccctttcattatgattccagatctgacctccccctatctgcctaacggttctttgtcgcctacagctagaacatacctacagatgaaatggcctctgttagatgtgcaggccggttctctgcaaagtcgtcaagcactcaaggatgcaagaagcccaagcccagcacacatagttcagtctcccttgccatgctgtacccaggggcacgattgccaacatttttatccacctagcgacttcacagtgagcacgcaggtgttccgggatatgaaaaggagccattccctccagaaagtcggggagccttggtgcatcgaaagcaacaaagtgccagtggtacaacatccccaccacgtgcaccctctgactcccctcatcacttacagcaacgagcacttcaccccaggaaaccccccaccacacctcccagctgacgtggatcctaaaacaggaatcccaaggcctccccacccacccgatatatcgccctattatcctctgagcccaggaaccgtgggtcagattccccatccgctgggatggcttgtgccccagcaggggcagcctgtctatcctatcacaacgggagggtttcggcatccctatcccacagccctgacggtgaacgcatcaatgtcaaggtag

SEQ ID NO: 244389 - DNA, 1791 bp, Artificial Sequence
  Description of Artificial Sequence: Synthetic coding sequence
atgccccagctgaacggaggaggtggcgatgacctgggagctaacgatgaactgatctcttttaaggacgaaggcgaacaggaggagaagagctcagaaaactcgagcgccgagcgtgaccttgccgatgtaaagtctagcctggtgaatgaaagcgagacaaatcagaattcgagctccgacagtgaggcagaaaggcggcctccgccacgttcagaatcttttagggacaagagtcgcgagagcttagaggaggccgcaaagagacaggatggagggttgttcaaagggccaccctacccagggtaccctttcatcatgataccagatttgacaagtccttacctgccaaacggctcactgagcccaactgccagaacgtacctgcagatgaagtggcccctcctagacgtgcaggcgggtagtcttcagtcccggcaagctctgaaagatgctcgatcccccagtccggctcacatcgtctctaacaaggtacctgtggtgcagcatccgcaccacgtgcaccctctgacacctctgatcacttatagcaacgagcattttaccccaggcaatcctcccccacacctgcccgcagacgtcgacccgaaaacaggaatcccgcgacccccacaccccccagatatctccccatactatcccctgtcacctggcacggtcgggcagataccccacccccttggttggctggtcccacagcagggccagccagtgtaccccatcactaccggcggtttcagacacccttaccccaccgctctgacagttaatgccagtatgtcaagatttcctcctcacatggtgccaccccatcacaccctacacactactgggattcctcaccccgcaattgtgacaccaacagtcaaacaagagagcagccagtcggatgtgggtagccttcactcatccaaacaccaagattccaaaaaggaggaggagaaaaaaaaaccccatataaaaaagcccctgaatgccttcatgttgtacatgaaagagatgagagcaaaggttgtcgccgaatgcactttaaaggaatcagccgcaataaaccagatcctgggcagaaggtggcacgctctcagtcgtgaggagcaagcaaaatattacgaattagccagaaaggaaagacagcttcacatgcagctgtatccaggatggagcgcccgagataactatgggaagaaaaagaaaaggaagcgggacaaacagccaggagagaccaacgagcacagcgagtgttttctaaacccctgcctcagcctcccccctatcacggacctcagcgctccaaaaaagtgtcgagcaaggttcggtctcgatcaacagaacaactggtgcggaccctgtcggcgaaagaagaagtgcgtgcgctacatccaaggcgagggttcctgcttgagcccccctagttccgacggttccctgcttgatagcccgcctcctagtcccaacctgctcggttcacccccaagagacgctaagtcacagaccgaacagacacagcctttatccctctctttgaagcccgaccctttggcccatctgagcatgatgccccctccacccgcactccttctcgccgaggccacccacaaggcaagcgctctttgccccaatggcgcactggacctcccacccgcagcactgcagccagctgctccatcaagctctattgcccagcctagcacatcctcccttcactcgcattccagtcttgcaggcacacaaccacaacctctgtccttggtcactaagagccttgagtag

SEQ ID NO: 244390 - DNA, 1485 bp, Artificial Sequence
  Description of Artificial Sequence: Synthetic coding sequence
atgcctcagctcaatggtggcggtggagacgatctcggagctaatgatgagcttatctcattcaaggatgagggggaacaggaagaaaaaagctcagaaaattcaagcgccgagagggacttagctgacgtgaagtcctcactcgtcaatgagagcgagacaaaccagaactcatccagtgacagcgaggctgagcgcaggccccctccaaggtctgaaagctttcgcgacaaaagtcgggagtccctggaggaagccgctaaaaggcaggatggcggtctgtttaaggggccaccttaccctggataccccttcattatgattccagatcttaccagcccatatctccccaatggctccctttctccaaccgccagaaccctgcactttcagagtggatctacgcactattcagcttataaaacgattgagcatcagatagccgtgcagtacctccagatgaagtggcccctcctggacgtccaagctggctcgctgcagtctcgacaggctttaaaggacgcccgatcaccatctccagctcacattgtgtctaataaggtgcccgtggtgcagcaccctcaccacgtccatcctttgactcccctcattacatatagtaatgagcacttcacacctgggaatccccctcctcatctccccgctgacgtcgaccccaaaacaggtattcccagaccgccacacccccctgatatcagcccctattaccccttgtctcccggtactgttggccaaatcccccacccattgggttggctagtcccgcagcaaggacagcctgtgtacccgattacgacaggaggcttcaggcacccctatcctactgcccttacggttaacgcttcaatgtcaaggttcccaccccatatggtgccacctcaccacacccttcacacgacaggtatcccacatcctgctatcgttacccctaccgttaagcaagagtcttcacagtctgatgttggaagtttacattcctctaagcatcaggattccaaaaaggaagaagagaagaaaaagccgcacatcaagaaacctctgaacgccttcatgttgtatatgaaagagatgagggcaaaggtggttgccgagtgtacgctgaaggagagcgccgctatcaaccaaattttaggcagacggtggcatgccttgtcacgagaagaacaggcaaagtactacgaacttgctagaaaggagagacagctgcacatgcagctttaccccggatggtccgcacgcgataactatggaaaaaaaaagaagaggaagagggataagcaacctggcgaaaccaacgaacactctgaatgttttctgaatccatgcctttccctgccgccaattacagatttaagtgcgccaaaaaaatgtcgcgcaagatttggcctggatcagcagaacaactggtgtggcccttgtcggtgtaaatacagcaaggaggtatcagggactgtgcgggcttag

SEQ ID NO: 244391 - DNA, 1809 bp, Artificial Sequence
  Description of Artificial Sequence: Synthetic coding sequence
atgccacagctgaatggaggtgggggtgacgatctaggtgcgaacgatgagcttatatccttcaaggacgagggtgaacaggaggagaaatcctccgagaacagctccgccgaacgagacctggctgacgtgaagtcgtcgctggtgaacgagtcggaaacgaaccagaattcttcatctgacagtgaagctgaacgaaggccacctcctcgatccgagtcctttcgtgataagtcccgcgaatctctagaggaggctgctaaaagacaggacgggggtctcttcaagggtcccccttatcccggatacccatttatcatgatacctgacctgactagcccctatttgcccaatggctcactgagccccacggcaaggactctgcactttcagagcggtagcacacactattccgcttataagacgattgagcaccagattgccgtccagtacttacaaatgaaatggcctctgctcgacgtgcaagcaggctcattgcagtcaagacaagctctgaaggacgctagatccccatccccagcacatattgtgagcaataaggtgccagttgtccagcacccgcaccacgttcatccactgaccccccttattacatattccaatgaacacttcaccccgggaaacccaccaccgcacctccctgccgatgttgatcccaaaaccgggatcccccgtccaccgcatcctccagacattagtccctactaccccctgtcaccaggtacagtagggcagatcccacacccactcgggtggctggtaccccagcagggccaaccggtgtatccaatcaccacgggaggtttcaggcacccatacccaacagcgttgaccgtgaatgcttcgatgtcccgtttccctccccacatggtccctcctcaccacacactccatactaccgggattccccaccctgctattgtaactccaactgtcaagcaggagagctcacagtcagacgtgggaagcctgcactcatctaaacaccaggattccaagaaggaggaagaaaagaaaaagccccatatcaaaaagcctctgaatgctttcatgctgtatatgaaagagatgagggctaaggtggtcgccgagtgcactctgaaggagtctgctgctatcaatcagatcttaggaaggcggtggcacgccctatcccgggaagagcaggctaagtactatgagttagcacgcaaagaacggcagttacacatgcagctgtatcctggctggtcagccagggacaattatggcaagaagaagaaacggaaacgtgataagcagcccggtgaaacaaacgatctgtctgcaccaaaaaagtgccgagccagattcggattagaccagcagaacaactggtgcggaccatgtcggcgtaagaagaagtgtgtgagatacatccaaggagaaggttcctgcctgagccccccatcttccgatggcagtttactggactctccacctcccagcccaaatctgctgggttctccccctagggacgcaaaaagccagacagagcaaacacagcctctcagtctctccttaaagccggaccccctagctcacttgagtatgatgccaccaccaccagctctgctgttagctgaagccacccataaggcttctgccttatgtcccaacggagctctcgatctcccacccgcagccttacagccagccgcaccatcgtcttcgatagcgcagccctcaacatcgagtcttcacagccatagttctctggccggtactcaaccacagcccctcagcctggtgaccaagtccctggagtag

SEQ ID NO: 244392 - DNA, 1449 bp, Artificial Sequence
  Description of Artificial Sequence: Synthetic coding sequence
atgcctcagctgaacggcggagggggagacgacctgggcgctaatgatgagcttatttctttcaaagatgaaggcgagcaggaggagaaatcgtcagagaacagctccgccgagagggatctggcagacgtaaaatctagcctcgttaacgagtccgagaccaaccagaactcgagtagcgacagcgaagcagagcgtcggcctccccctcggagtgaatcattccgagataagagcagggagtcactagaggaggccgctaaacgccaagatgggggactgtttaagggacctccctaccctgggtaccctttcatcatgatcccggatctgactagtccttatctgcctaatggcagtttaagccctaccgctcggacactgcattttcagtcaggatccacacattattcagcctacaagacaattgagcaccagatcgcagttcagtacttgcaaatgaagtggcccctcctagacgttcaagcaggctcccttcagtcaaggcaggccctcaaagacgctcggtcccccagccctgcacacattgtatcaaataaagtccctgtggtgcaacacccacaccacgtccatcctctgacgcctctgattacctattcaaacgaacattttacgcccggaaatcccccacctcaccttcccgctgatgttgaccccaagacgggaatccctcggccacctcacccgccagacatctcgccatattaccctctcagtccaggcactgtaggccagatcccccacccattgggatggctcgttccgcagcagggtcagccggtttatcccatcacaacaggtggcttccgccacccctaccctaccgccctgaccgtgaacgccagtatgtccaggttcccgcctcatatggtacccccacaccacacacttcacacaacagggatacctcaccccgctattgtcactcccaccgttaaacaggagtcttcccagtcagacgtgggctctctccacagcagcaagcaccaggactcaaagaaagaggaggagaaaaagaaacctcatattaagaagcccctgaacgcatttatgctgtatatgaaggaaatgcgagctaaggtggtggcggagtgcacactgaaagaatcagccgcaatcaatcagattcttgggagacgatggcacgcattatcacgggaagagcaggccaaatactacgaactcgccagaaaggaacggcaacttcatatgcagctgtatcccggttggagtgccagagataattatgggaagaaaaagaagcgtaagcgagataaacagcctggagaaacaaacgagcacagcgagtgtttccttaacccttgcctgagccttcccccaataacaggggagaagaagtctgccttcgccacgtacaaggtcaaagccgcagctagtgctcaccccctgcagatggaggcttactag

SEQ ID NO: 244393 - DNA, 1008 bp, Artificial Sequence
  Description of Artificial Sequence: Synthetic coding sequence
atgtctagcttcctgagttcacggttcccgcctcacatggttcctcctcaccacaccctacataccacgggcatcccacatcctgccattgttactcccaccgtcaagcaggaatccagtcaatccgacgtgggatcacttcattccagcaaacaccaagattcaaagaaagaagaggagaagaagaaaccccacataaagaaaccactgaacgcatttatgctgtatatgaaggaaatgcgcgcaaaggtcgtggcagagtgtaccttaaaagagtctgccgcaatcaatcagattttggggcgacggtggcatgctttatcaagagaggagcaagcaaagtactacgagcttgccaggaaggagcggcagctccacatgcagctgtatcctggctggagtgcaagagacaactatggaaagaaaaagaaaaggaagagggacaaacaaccaggagaaaccaacgaacatagcgagtgcttcctgaacccatgcctctctctgcccccaatcacagacttgtcagccccaaaaaaatgcagggcccgtttcggcttagatcagcagaataactggtgtgggccttgtaggcggaaaaagaagtgcgtgaggtacatacagggtgagggatcatgcctgagtcctccttctagcgatggatcactgcttgattccccccctcccagtcctaatctgctcgggtcccccccacgagacgctaagagtcagaccgagcagactcagccactttccctcagcctgaaacccgatccactagctcacttgtctatgatgcccccacctcctgctttgctgctggctgaagcgacacacaaagcatctgctttatgccctaacggggctcttgatttgccacctgctgctctgcagcccgctgccccttcttctagcatagcccagccttctactagtagtctgcactcgcatagctccctcgccggtacccagccacaacccttgagcctagtgaccaaaagtctcgaatag

SEQ ID NO: 244394 - DNA, 1809 bp, Artificial Sequence
  Description of Artificial Sequence: Synthetic coding sequence
atgcctcagctgaacggagggggaggtgatgacctaggtgcaaacgatgagcttattagctttaaagacgaaggagagcaggaagaaaagtcaagcgagaattcgtctgctgaaagagatcttgctgatgttaagtcaagcctggtgaacgagagcgaaactaatcagaattcaagctccgactctgaggcagaacgcagacctccaccccgtagtgagagctttagggataagagccgagagagcctcgaagaggcggctaaaagacaggatggcggtctattcaaaggacccccttatcctggataccccttcattatgatccccgatctcacttccccttacctgcccaatggctctctgtctccgactgcgagaacccttcactttcagtccggtagcacccactactctgcttataaaaccattgaacatcagattgccgtccagtatctgcaaatgaagtggccactgctggacgttcaggccggttccctgcaatctcgacaggcattgaaggacgcaaggagtccgagtcccgctcatattgtgagcaataaagttcccgtagtccagcacccccatcatgtgcaccctttgacccctctcatcacatattcgaacgaacactttacgccgggaaacccaccaccccacctgccagcggacgtggatcctaagactgggatcccgcgaccgccacatccccctgatatttcaccctattacccactttcccctggcacagtgggacagatcccccatccactcgggtggctggtacctcagcagggccagccagtctaccctattacaacagggggattccgccacccttatccaaccgctttgaccgtgaatgcctcaatgtcccggttccctccacatatggtcccaccccaccacacattgcacacgacgggcatcccgcatccagccatagtgacacctacggtcaaacaggagagctcccagtccgatgtcggaagcctacactccagcaagcaccaagacagcaagaaagaggaggagaagaaaaagccacacatcaagaaacccctgaatgcttttatgctatacatgaaggaaatgcgagcaaaagttgtggctgagtgtacacttaaagagtctgctgccatcaatcagatcttgggccgacggtggcacgctctgtcccgagaggaacaggctaagtactatgagttggctcgtaaggaaaggcaactacacatgcagctgtacccaggctggagtgccagggataactacggaaagaaaaagaagcgtaaaagagacaaacagcccggtgaaacaaacgacgctaacaccccgaagaagtgtcgcgcactattcggcttagaccgacagacactctggtgcaaaccgtgccgacggaagaaaaaatgcgtcagatacattcaaggggagggttcttgcctgtcccccccatcttccgatgggtccctgcttgactcacctccacctagccccaatttgttgggatctcctccaagagacgccaaatctcagactgaacagactcagccactgtccctctcgcttaagcctgacccactggcacatctgtccatgatgccccctcccccagcactgctgctagctgaagccacccacaaagctagtgctctgtgtcctaatggcgcactggacctgccgccagccgctcttcagccagcggcaccgtcttcctccatcgctcagccaagtacaagcagcctgcactcccacagctccctcgcaggaactcagccacagcccctaagtctggtgactaaatccttagaatag

SEQ ID NO: 244395 - DNA, 1860 bp, Artificial Sequence
  Description of Artificial Sequence: Synthetic coding sequence
atgccgcaacttaacgggggtgggggtgacgatctcggcgctaacgacgaactgatcagctttaaggatgagggggagcaggaagagaagtcttccgagaacagctcagccgagagagatcttgccgacgtgaagtcttctcttgtcaatgaatcagagacgaaccagaactctagcagtgacagtgaggcagagagacgtcccccacccaggtccgaatccttcagagataaatctcgcgagtcccttgaggaggcagctaaaaggcaggatggtggcctgtttaagggccctccttaccctggatacccgtttattatgattcctgatctcacgagcccatatctccccaacggttccttatccccaactgcacgaacactacatttccagagcggctccacacactactccgcttacaaaaccatcgaacaccagatcgctgtgcagtacttgcagatgaagtggcccttgcttgatgtgcaggcgggttcactgcagtcaaggcaagcgttaaaggacgccagatccccttcacccgcacatatcgtgtcaaacaaggtgcctgttgtgcagcatccacaccacgtgcatccattgacacccctgattacttattctaatgagcacttcactcctggaaatccaccaccccacctgccagctgacgtcgatcccaaaaccggaatcccgaggccccctcatcctcctgacatatctccatattatccattatcccctggtacggtcggccagatcccccaccccctcggctggctcgtcccccagcaaggccagcccgtgtaccctatcacaaccggcggatttcgacatccatatcctacagccctgacagtaaacgcgagcatgtcacgttttcccccacacatggtcccccctcatcatactctccacactactggtatcccgcatcctgctattgttacacctaccgtcaaacaagagtcaagtcaatcagacgtcggctctttgcattcttctaaacaccaggattctaagaaggaggaggaaaagaagaaaccccatatcaaaaagcctctgaacgcctttatgctctatatgaaagaaatgagggcgaaagtcgtggctgagtgcaccctgaaggagagcgcggcaatcaatcaaattctcggccgtagatggcatgccctctctagggaagaacaagcaaagtattatgagcttgcccgtaaggaaaggcagctgcacatgcaactgtatcccggttggagcgccagagataactacggtaagaagaagaagagaaagcgggataaacagcctggcgagaccaacgaacattccgaatgcttcctcaacccttgtctgtcgctgcccccaatcacggatgcaaatacccctaaaaagtgtcgcgctctttttggattggatcggcagaccctctggtgcaagccttgtagaaggaagaaaaagtgtgttcgctacatccagggcgaggggtcatgcctctctccgccttcctcagacggttctttattggattccccccctcctagtcccaacctactgggctcacctccgagagatgccaagtcccaaacagagcaaacccaaccgctctctctgtccctaaaacctgaccccctcgcgcacctgtcaatgatgccacctccaccagcgcttctgcttgccgaagccacgcataaggcaagcgccctttgcccgaatggcgcactcgacctgcctccagccgcactccaacctgctgccccttcttcatccatcgctcaacctagcacaagctcactgcatagccactcgagtctggccggaacccagccgcagcccctgagtctggtcactaaaagtcttgagtag

SEQ ID NO: 244396 - DNA, 645 bp, Artificial Sequence
  Description of Artificial Sequence: Synthetic coding sequence
atggccttcctgagatcaatgtggggggttttgtcggcacttggcaggtccggagctgaattatgtacaggttgtggcagcaggctgcgcagtcccttctcattcgtctacctcccgagatggttttcttccgtattggccagttgcccaaaaaaacctgtgtcttcctaccttagattttcaaaggagcagctccctatcttcaaagcgcagaaccccgacgccaagaccaccgaactgatcaggcggatcgcccagcgatggcgtgaactaccggattcaaaaaagaagatctaccaggatgcctatcgcgctgaatggcaggtctacaaagaagagatcagcagattcaaggaacagttgactcccagtcaaatcatgagcctcgaaaaagaaattatggacaagcacttaaagcggaaggccatgactaagaaaaaggagaagctcaagacggttaaggagaactggaagaatctgagcgacagtgagaaggaactctacattcagcatgctaaagaggatgagacgcgatatcacaatgaaatgaaatcctgggaagaacagatgattgaagtggggagaaaagacttgctgcggcgtacgatcaagaaacagagaaagtatggggctgaagaatgctag

SEQ ID NO: 244397 - DNA, 660 bp, Artificial Sequence
  Description of Artificial Sequence: Synthetic coding sequence
tgagagctatgtaccgggtgtggtagccgactgaggtcccctttctctttcgtctacctgccccgatggttctcttccgtcttggcttcatgccccaagaagcctgtgtcctcttatctccggtttagcaaggaacagttgccaatatttaaggcccagaatcctgacgccaaaaccactgaactgattcgtcgcattgcccagaggtggagggaactgcccgactccaaaaaaaagatttaccaggatgcatatcgggctgaatggcaggtctacaaggaagaaatttctcggttcaaagagcagctgacacccagtcagattatgtccctggagaaggagataatggacaaacacctgaagcgcaaggccatgactaagaagaaagagctcacgcttctcggtaaacccaaacgaccccgtagcgcatataatgtgtatgtcgctgaacggttccaggaggctaagggcgattccccccaggaaaaactgaagactgtcaaagagaactggaaaaacctgtctgattccgagaaggaggtcagtataacggtagtcagcctgaagtgtctcctgcgcatctcggtgcgcgagtgcattcgcgcacgattggactcttgtgaggataatctggtgctcctgatcatccaggtattctag

SEQ ID NO: 244398 - DNA, 741 bp, Artificial Sequence
  Description of Artificial Sequence: Synthetic coding sequence
atggcattcctgagaagcatgtggggcgtcctctcagcattaggtcgctcaggcgcagaactttgtaccggatgtggttctcgtctccggtctccattctcctttgtatatctgcccaggtggttcagctctgtgcttgctagttgccctaaaaaacccgtgtccagctatctcaggttttccaaggagcaactaccgattttcaaggcccagaacccagatgccaaaaccactgaactaattcgcaggattgctcagcgctggcgcgagctgccagattctaaaaagaaaatctaccaggacgcgtacagggctgagtggcaagtctataaagaagagatcagccggtttaaggaacagttaacccctagccagataatgtcactcgaaaaggagattatggataagcacttgaagcgcaaggctatgactaagaagaaggaattgactctgctaggcaagcccaagaggccaagatcagcatataacgtttatgtagccgaacgcttccaagaggccaagggagatagccctcaggaaaaactgaagacagtgaaggagaattggaagaatctgagcgacagcgagaaagagttatatatccagcacgccaaggaagatgagacaaggtaccacaacgagatgaaaagctgggaagagcaaatgatcgaggttgggagaaaagaccttctgcgacggacaatcaaaaaacaacgtaagtacggagccgaggagtgttag

SEQ ID NO: 244399 - DNA, 1302 bp, Artificial Sequence
  Description of Artificial Sequence: Synthetic coding sequence
atgtccatcctggccaagatgggggattggcaggaccggcacgatggcacgagtaacggaaccgcgcgacttccacagctaggcactgttgggcagtcaccttacacctcagctccacctttaagccacacgccaaacgctgattttcagccgccttacttccctccaccataccagcctatctacccacagtcacaggatccctacagtcacgtaaacgatccctatagcctcaatcctttacacgcacagccacaacctcagcaccctgggtggcctggccaaaggcaaagccaagaatcaggattgctgcatacccaccgcggattaccacaccagctctcaggccttgaccctaggcgagactatagaagacatgaggatctcttacatggtcctcacgccctgtcctcgggtctgggagacctctccattcattccctgccacacgccattgaagaagtcccgcatgtcgaagatcctgggataaatattccggatcaaacggtgattaagaaagggcctgtttcgttgtcaaaatctaattccaatgctgtgagcgcgataccaatcaacaaagataacctattcggaggggtggtaaacccgaacgaagtgttttgtagcgttccgggtcggcttagtctgctctcgagcaccagcaagtacaaagtgacagtcgcagaggtgcagcgcaggctcagtcccccagaatgcttgaatgcatctctcctcggcggagtgcttaggagggctaagtcaaagaatgggggaaggtctctcagagaaaaacttgacaaaatcggactgaatttacccgctggccgaaggaaagctgccaacgtgacattgctcacgtccttagtggagggagaggccgtacacctcgcaagggacttcggctacgtgtgcgagactgagttcccagcaaaggcagtcgccgagtttctcaacagacaacactccgaccctaatgagcaggtgacccgaaagaatatgttactagctaccaagcagatatgtaaagagtttacagacctgcttgcccaggacagatcacctcttggtaactccagaccaaatcccatccttgagccaggaatccagtcctgcctcacgcactttaacctcatcagccacgggttcgggtctcccgcagtgtgtgccgcagttaccgcactccaaaattacctgacagaagctctgaaggccatggataaaatgtatctgtccaataatcctaatagccacacagataataatgcgaaaagttccgacaaggaggagaaacaccgaaaatag

SEQ ID NO: 244400 - DNA, 1314 bp, Artificial Sequence
  Description of Artificial Sequence: Synthetic coding sequence
atgctgtggaaactcactgacaacattaagtatgaggattgtgaagataggcacgacggtacctccaatgggacagccagacttcctcagctgggaactgttgggcaatcgccgtatacaagtgcccctcctctctctcatacccccaacgcagattttcagcctccatactttccacccccttaccagccaatctatccacaatcacaagacccctactctcacgtgaacgatccatatagcctcaaccccttgcacgcacaacctcagccacaacacccaggatggcctgggcagcgacagtctcaagaatctgggttgttgcatactcacaggggccttccacatcagttatccggacttgatcctcgcagggactataggcgacacgaggacctcctgcacggacctcatgcgctgtcctctggcctgggggacctgagcatccattccctgcctcacgccatcgaggaggtgcctcatgtagaagacccaggtatcaacatcccagaccagaccgtcatcaaaaaaggccctgtgagcttgagcaaaagcaactcgaatgccgtttccgccatacctatcaataaagacaacctgtttggcggtgttgtgaatcccaacgaagttttctgctctgttcccggaaggttgagtctgctgagctctaccagtaagtacaaagtgacggtagctgaagttcagagaaggctttcacctcctgaatgtctcaacgcgagcctgctcggcggtgtattgcgtcgcgcaaaatcgaaaaatggcggaaggagcctcagagagaagcttgacaagatcgggctgaacctgcccgcaggaagaaggaaggcggctaacgtgacgctgctcaccagcttggtcgaaggcgaggctgttcacctggcaagggatttcggatacgtttgtgaaacagagtttcccgcaaaggccgtggcggagtttcttaacagacagcattccgaccccaacgagcaggtgacacgaaaaaacatgctgctggctaccaagcagatttgtaaggagttcacagaccttctggcacaggacaggagccctctcggaaactcgcgcccaaatccaattctcgaaccgggtattcagagctgcttgacccacttcaacttgatctctcacggtttcggcagccccgctgtttgtgctgctgtcaccgccctgcagaactatctgaccgaggctctaaaagcaatggacaagatgtacctgtctaacaacccgaacagccacactgataacaacgccaagtcgtccgataaagaggagaagcacagaaaatag

SEQ ID NO: 244401 - DNA, 1296 bp, Artificial Sequence
  Description of Artificial Sequence: Synthetic coding sequence
atgctagtgcacagcttcagcgccatggatcgacacgatgggacctctaatggaaccgcgcgattgccccagcttggtacagtgggacagagtccatacacgagtgccccaccactttctcatacccctaatgccgatttccagccgccatatttcccacccccttatcagcccatatacccacagtctcaggatccctatagtcatgtgaatgatccttacagcctcaacccacttcacgcccagccccagccccagcacccaggctggcctggtcagaggcagagccaggagtcagggctcctccacacccatagaggcctgcctcaccagttaagcggccttgaccctaggcgagattaccgtagacacgaagaccttctccacgggccacatgcattgtcatcaggcctcggcgatttgagcatccactccctgccacatgctatagaggaggtccctcacgtcgaggaccctggaattaatatacctgatcagactgtgattaagaaaggacctgtgtcgttgagcaagtccaattccaatgctgtgagtgcaatccctatcaacaaagacaacctgttcggcggtgtggtaaacccgaatgaggtattttgctcagtgcccggaagactttctctgctgtcctctacctctaaatacaaagtgactgtggccgaggttcagcggagactcagcccaccggagtgcctcaatgcctcgctattggggggagtgctgagacgggctaagtcaaaaaacggcggacggtccctgcgggagaagttggacaaaattggtctgaacctgccggctggcaggcgcaaagccgctaacgtgacactattgacaagcctggtggagggtgaggccgtccacctggcacgggattttgggtacgtttgcgaaacagaattccccgcaaaagccgttgcagaattcctgaacagacagcacagcgatcctaatgagcaagtcacccgtaagaacatgttgttggccactaaacagatctgcaaggagtttaccgatctcttggcacaggatagatctccattgggtaattcccgccctaacccaattctggagcccggtattcagtcatgccttacgcattttaacctgatctcccacgggtttggatcccctgcagtgtgtgccgctgtgacagcccttcaaaactatcttaccgaagccctcaaagctatggacaaaatgtacctgagtaacaacccaaactcacacactgacaacaatgcaaagtctagtgacaaagaggagaaacacaggaaatag

SEQ ID NO: 244402 - DNA, 1320 bp, Artificial Sequence
  Description of Artificial Sequence: Synthetic coding sequence
atgaaaatgctgtggaaactcaccgacaacattaaatatgaagattgcgaggataggcacgatgggaccagcaacggtacggctagattgcctcagctggggactgttgggcagtctccatacacgtcagctcctcccttaagtcatacccccaacgcagactttcaaccaccatatttcccacccccataccagcccatttatccccagtcccaagatccttacagtcacgtaaatgatccatattctctgaatccgctacacgcccagccacagccccagcaccccggatggcctggacaaagacagtcccaggagtcaggcctgctgcatacccatcgcggtttgccacaccagctgagcggactggacccaaggcgagactaccgtaggcacgaggatttactgcacgggcctcacgccctctccagtgggctcggggacctgagcatacattcccttcctcacgccatcgaggaggtgccccatgtcgaagatcccggaatcaatatcccggatcagactgtgatcaagaaaggacccgtgagtctttcgaagagtaatagtaatgccgtgagcgcaatccccatcaataaagacaatttgtttggaggcgtggttaaccccaatgaagtgttctgcagtgttccgggacgcctatcccttttgagctccacttcaaaatacaaggttacagtggctgaagtgcagagaagattgagccctccggagtgcctcaacgcctcgttgctgggcggagtgctacgcagagctaagtctaagaacggtggccgttctctgagggagaagcttgacaagattggtctgaatttgccggctggaagaagaaaggccgcaaacgtcactctgttgacatctctggtggaaggcgaagctgtacaccttgccagagatttcggctatgtctgcgaaacagaatttccagccaaggcagtagccgagtttctgaacaggcagcatagcgatccgaatgagcaggtgacccgcaagaatatgctacttgcaaccaagcaaatctgcaaagaatttacggatctgctcgcacaagatcgatcacccctgggaaattctaggcccaatccaattctcgaaccgggaattcaaagctgcttgactcattttaacctgattagccatggattcgggtccccggcagtgtgtgctgctgtgaccgccttgcagaactatttaaccgaagctctgaaggctatggacaagatgtatctgtccaataaccctaattcgcacacggacaataatgcgaagtccagtgacaaggaggagaagcacaggaagtag

SEQ ID NO: 244403 - DNA, 987 bp, Artificial Sequence
  Description of Artificial Sequence: Synthetic coding sequence
atgctgtggaaactaaccgacaacattaaatatgaggactgcgaagatcgacatgacggtacttccaatggaactgctcgtttgccccagctagggactgtcggccaatcgccatatacttccgcccctccactgtctcacacacctaacgccgatttccaacctccctatttccccccaccctatcagcctatttacccacaatctcaagacccatattctcacgtcaatgacccttatagtctgaaccccctccatgcccagcctcagcctcaacaccctggatggcccggacagagacagagtcaagaatccggcttgctccacacacatcggggactcccacaccagctgtcaggcctagacccgagaagggactatcgtcgtcacgaggatcttctccacgggcctcatgccctgtcctcgggcctgggagatctgagcatccactctttaccccacgctatcgaggaggtccctcatgtggaggatcctggcataaatatccctgatcaaaccgtgatcaaaaagggaccggtgtccctctccaaaagtaacagtaacgccgtttctgcaatacccatcaacaaagataacctcttcggaggggtggtcaatcccaatgaggtcttttgctcagttcctggtcgactcagcctgctgtctagtacttcaaagtacaaggtcaccgttgccgaggtgcagagacgtctgagcccccctgagtgcttaaacgcttccctcctcggaggggtattacgccgagcgaaatccaagaacggcggaaggagtctgcgagaaaagctggacaagattgggctcaacctgccagcaggcaggagaaaagctgccaatgtgaccctattaacctccctggtggaagacagatatgccaagtcatcacctacgtgttggctgcgtacagatctgccttgggggactcacggccctacaccatcttggagccccgcttccagagccgcatag

SEQ ID NO: 244404 - DNA, 1314 bp, Artificial Sequence
  Description of Artificial Sequence: Synthetic coding sequence
atgctatggaagctgaccgacaatatcaagtacgaagattgtgaagaccggcatgacggcacgtctaacggcaccgccagactgccccaactggggaccgtcggtcaatctccctatacctccgcgccaccactcagccatacgcccaatgccgactttcagcctccatatttcccgcctccctatcagcctatctatccccagtcacaagatccctacagtcatgtcaatgatccatacagcctgaatcctttgcacgcccaaccacagcctcagcatccaggttggcctggacaaaggcagtctcaggagagcgggctgctccacacccaccggggactaccccaccagctcagcggtctcgatcccaggagggattaccggaggcatgaggatctcctccatggaccccacgccctctcatccggcctgggggacctgtctatccattccctcccacacgcaattgaagaagtcccccacgtggaggacccagggatcaacattcctgaccagaccgtaattaagaagggtcccgtttccctgagcaagagtaactctaatgctgtgagtgctatccccatcaataaggacaacctgttcggtggggtggtgaaccccaacgaggttttctgctctgttccagggaggctgtcactcctgtctagtacctctaaatacaaagtcactgtggcagaagtgcagagaaggctctcccctcctgaatgcttgaacgccagcctgctcggtggtgtgctgcgccgagctaagtcaaagaatggtggtagaagtttgcgtgaaaagttggataaaatcgggctgaacttgcccgcagggaggcgcaaagccgcaaacgtcactctcttgaccagcctcgtagagggcgaggccgttcatctggcccgagattttggatacgtctgcgagaccgagtttccggcaaaggccgtggcagagtttctgaaccgacagcacagtgatcccaacgaacaggtaacccgcaaaaacatgctgcttgccacgaagcagatttgcaaagagtttacagacctgctggcccaggacagatctcccctggggaactctcgccctaatcccattctcgaacctgggatccaatcttgcctcacccacttcaacctgatctcccacgggtttggatccccagcggtctgtgcagccgtcacagctctccagaactacttgacggaagctttgaaggcaatggacaagatgtatctctcgaacaatcctaattcccatactgacaacaacgcaaagtctagtgataaggaagaaaagcaccgaaagtag

SEQ ID NO: 244405 - DNA, 1410 bp, Artificial Sequence
  Description of Artificial Sequence: Synthetic coding sequence
atgcattcaccaccaagggatcaggctgccataatgttgtggaaactggtagagaatgtgaaatatgaggatatttacgaaatgcttgtccacacatactcatcaatggataggcacgatggggtgccatcccattcgtctcgcctcagccagctgggctccgtctcgcagggtccatattccagtgcgcctcccttgtcccacactccttctagtgatttccagccaccctatttccctcccccttatcagccgttaccataccaccagtctcaagacccctatagtcatgtgaatgatccctactctttgaaccccctgcaccagccccaacaacacccctgggggcagaggcagcgccaggaggtgggctccgaggcaggcagcctgctgccccagccccgtgccgctctgccacagctttcagggctggatccgcgtcgagactatcactcagtccgaaggccggatgtgttgcttcattccgcacatcacggtcttgacgcgggaatgggcgactcccttagcctacacggactaggacaccctggcatggaggacgtccagagtgtggaggacgccaacaactctggcatgaacctgttggaccagtccgtcatcaagaaggtgcctgtgccacccaagagcgtgacttccctgatgatgaacaaagatggcttcttgggcggaatgtctgtcaacacaggcgaggtcttttgttctgttcccggacgactgtcattactctcaagcacgtccaaatacaaagtgaccgttggagaagttcagcggaggctgtcaccccctgagtgcttgaacgccagcttgcttggcggtgtgcttcgtcgagcaaaatctaagaacggtggtaggtcacttcgcgagagattagagaagattggcctcaatctccccgcaggcaggagaaaagcagcaaatgtgacactgctgacctccctggtcgaaggcgaagctgtgcatcttgcacgggacttcgggtatatctgtgaaactgaattccctgcgaaggctgttagcgagtaccttaatcggcagcataccgatcctagtgacctgcacagtcgaaagaacatgttactcgcgacaaagcagttatgtaaggaatttacagacttattggcccaggacaggacacccatcggcaacagtcgtccaagccctattctcgaacctggcatccagtcatgtctgactcatttctccctaattacgcacgggtttggagctcccgctatctgtgccgctctgactgcgcttcaaaattaccttaccgaagcccttaagggaatggacaaaatgttcttaaacaacacgaccactaacagacataccagcggagaaggcccaggttcaaaaaccggagataaagaagaaaaacataggaaatag

SEQ ID NO: 244406 - DNA, 597 bp, Artificial Sequence
  Description of Artificial Sequence: Synthetic coding sequence
atgctttggaaactggtggagaatgtgaagtatgaggacatctacgagatgctggtgcatacttattcctccatggaccgtcatgacggggtgccctcgcattctagccgcttaagccagctcggctctgtttcgcagggcccatactcgtccgcacctccactgtcccacacccccagcagtgattttcagcctccatacttcccccctccataccaacctctcccgtaccatcaatcacaggatccatacagtcatgttaacgatccctactccctgaaccctctccaccagcctcagcaacacccctggggacaaagacagcgccaggaagtggggtccgaggcagggagtctgttgcctcagcctcgagccgctctaccacagctcagtggacttgatccacgccgagattaccatagtgtgcgcaggccagatgttctgctgcactctgcccaccatggcctggacgccggaatgggagactctctgtccctgcacggcctggggcaccctggcatggaggacgtgcagagtgttgaagatgccaacaacagtgggatgaatctgctggatcagagtgtgataaagaaatag

SEQ ID NO: 244407 - DNA, 1383 bp, Artificial Sequence
  Description of Artificial Sequence: Synthetic coding sequence
atgcatagccctcccagagaccaagcagccatcatgctgtggaagctggtagaaaatgtcaagtacgaagatatttacgaggatcggcatgacggcgtgccgtcccattcctcgagactctctcagttgggttctgtgagccaaggtccatacagcagtgcccctccactctcccacacccccagcagtgacttccaacccccttacttccccccaccctatcagccactgccttatcaccagtcacaggatccttatagccacgttaatgatccctatagtctgaaccccctgcaccagccccagcagcatccgtgggggcagcgccaacggcaagaagtggggtcggaagccggtagcttgctccctcagccccgagctgctctacctcagctcagtggccttgaccctcgccgagactatcattctgtgaggagacccgatgtcctccttcacagcgcccaccacgggcttgatgccggaatgggcgattccttgtcattgcacggcctcgggcaccctggaatggaggatgtgcagagcgtggaagacgcaaacaacagcgggatgaatctgctggatcagtccgtcattaagaaggtgcctgtgccaccaaagtctgtgacaagtctgatgatgaataaagatggctttctgggaggcatgtctgttaataccggcgaagtgttctgcagcgttccaggaagattgtccctcttgtcttctacatcaaagtataaggtgactgtgggcgaggttcagcgtcggttgtcacccccagagtgcttgaacgcttcacttctgggaggggtgctaagacgggctaagagtaagaacggagggagatcattaagggaacgcttggaaaaaattgggctgaacctgccagcaggacgcagaaaagccgctaacgtgaccctgctgactagtctagttgagggggaggccgtgcatttggcaagggattttggatatatctgcgagacagaatttccagctaaggcagttagtgaatatctgaaccggcaacacaccgacccatccgacctccacagccgaaagaatatgttgctggccactaagcagctgtgtaaagaattcaccgacctgctcgcgcaggaccgcacccccatcggtaattctcggccttccccgattcttgaaccgggtatccagtcctgcctgacccacttctccctgatcacccacggcttcggggctccagccatatgcgccgctttgaccgcgctccagaactacctgacggaggccctaaagggtatggataaaatgtttctgaacaacactacaaccaaccggcatacctcaggagaagggccaggcagtaagacaggggacaaggaggagaaacaccggaaatag

SEQ ID NO: 244408 - DNA, 1359 bp, Artificial Sequence
  Description of Artificial Sequence: Synthetic coding sequence
atgagcaccacttttcccggacttgttcacgatgccgagatcagacacgacggctccaattcataccgactcatgcaactcggctgtcttgagtcggtcgctaactccactgtggcatactcatcttcttctccgctaacctatagtacaacagggaccgagttcgcatctccgtatttcagcaccaatcaccaatacacccctctccaccaccaatccttccattatgagtttcagcactcccaccctgcggtgacacctgatgcctatagtttgaactctctacaccactcacaacagtactaccagcagatacaccatggggagccaactgatttcatcaatttgcataatgctcgcgcactgaaatcgtcttgtctggacgagcaaagaagggaactgggctgcctcgatgcatatagacggcacgacctgtcccttatgagccatgggagccaatacggaatgcacccggatcaaaggttgctgcctgggcctagtctgggcctggccgcagccggagccgatgacctgcagggctccgtggaagctcagtgcggactcgtcctgaacgggcagggcggagtgatccggaggggcggaacctgtgttgtgaaccctactgatttgttttgttcagtgcctggaagactcagcttactctcatcgacgtctaagtataaagtcactatcgcggaggttaagcggaggttgtcgccccctgagtgcctgaacgcttcactgctgggaggtatcttgaggagggccaagagtaagaacgggggtcgctgtctccgtgagaaattggaccggctggggctcaacttgcccgcagggaggagaaaggccgcaaatgttactctgcttacatctctcgtcgaaggcgaggcgttacaccttgcaagagatttcgggtacacatgtgaaacagaattcccagcaaaggccgttggggaacatctcgcccgtcagcacatggaacagaaggagcagacagctaggaaaaaaatgattcttgccaccaaacagatctgtaaggaatttcaagacctcttatcgcaagatcgctcaccactgggtagtagcagaccaactcctatactggatcttgatatccaacggcatctcacccacttttctcttatcacacacggttttgggactccggctatatgcgccgctctgtctaccttccaaactgtgctgagtgagatgctgaattatctggagaagcatacaactcacaagaacggaggagcagccgatagcggacagggccatgcaaattcagagaaggccccattgagaaagacctccgaagcagccgtgaaagagggtaaaaccgagaaaactgactag

SEQ ID NO: 244409 - DNA, 1329 bp, Artificial Sequence
  Description of Artificial Sequence: Synthetic coding sequence
atgctggtacacacctattctgccatggaacggcctgacggccttggcgctgccgcagggggagccagattgagctcgctgccgcaggccgcttatggcccagcccctcctctatgtcatacgcctgcagccactgccgctgctgagttccagcccccatatttccctcccccttatcctcagccacccctgccatatggccaggcccctgatgccgcagctgctttcccccatcttgccggagacccatatgggggacttgcccctctggcgcagccccaaccaccccaggcagcttgggccgctcccagggccgctgccagagcccacgaggaaccgccaggactgctagctccaccggctcgagccctcggcctggatccaagaagggactacgccactgcggtccccagactgctgcacggactggccgacggggctcatggcttggcagatgcaccactcggtctccccggtctcgctgctgcgccaggcctagaagacctccaagctatggatgagcctggaatgtccttgctggaccagagcgtaattaagaaggtgccaatccctagcaaagccagtagcttgagcgcgctttccctggccaaagatagtctggtagggggtattacaaatcccggagaagtgttctgctcagtccccggacgcctcagtttgctgtcctcaacttctaagtacaaagtgacagtgggagaggtgcagcgtcgcctgtctcctccagaatgtcttaacgcctcccttctggggggtgtgttgcgacgagcaaagtccaaaaacggtggcaggtgcctgcgcgaacggctggaaaagatcgggctgaatctccccgctggtcgcaggaaagccgctaacgtgacgcttctgacttctctcgtcgagggagaagccgtacatcttgcacgggacttcggatacgtttgtgagacggagttcccagccaaggccgctgccgaatacctgtgtagacaacacgctgacccaggggaactgcacagcagaaaatctatgcttctagccgctaagcagatttgcaaagagtttgcagacctgatggctcaggatcggtcccccctggggaactctagaccggcattgattctggagcccggagtccagtcctgtctcacccatttttcactgatcactcacggttttggcggacctgccatctgtgcggcactgactgccttccaaaactacctgctggaaagcttgaaaggcctggataaaatgtttctgtcctcggtgggtagcggtcacggagaaaccaaggcctcggaaaaagacgcaaaacaccgtaaatag

SEQ ID NO: 244410 - DNA, 1353 bp, Artificial Sequence
  Description of Artificial Sequence: Synthetic coding sequence
atgctctggaagatcacagacaatgtgaagtatgaggaagactgtgaggataggcacgacggatcctcgaacggaaatcccagggtgccacacctgagttctgctggccaacatctgtatagtccagcacctcccctgagccacacgggcgtggccgagtatcaaccacctccttacttccccccaccttatcagcagcttgcctatagccagagcgcagacccctactcacacctgggtgaggcctacgctgcggctattaatccgcttcatcagcctgccccaacagggtcacagcagcaggcatggcccggacgccaaagtcaggaaggggctggtttgccctcccaccatggccgtcctgccggactactgccccacttgagcggattagaggctggcgctgtctccgccagaagagacgcttacagaagatccgatctgttgctgcctcacgcacacgcactcgacgcagcagggctggctgaaaacctagggctacacgacatgccacaccaaatggacgaggtgcagaatgtggacgaccagcatttgctattgcacgaccagactgtgattaggaagggcccaatctccatgactaagaatcccctgaatttgccgtgccaaaaagagctggtcggtgcagtcatgaatcccacagaagtcttttgctccgtaccaggtcggctctcactgctatcttccacttccaagtacaaagtgactgtggccgaagtgcagagacgcctgtcacccccagagtgcctgaacgcgtccctgcttggaggcgtgctgcggcgagctaagagcaagaatgggggaaggagcctgcgggagaagctggataaaatcggactcaacctgcctgctggcagacggaaagccgctcatgtgacgctgctgacttccttggtggagggcgaggctgttcacctggccagggattttgcctatgtttgtgaggctgaattcccctcaaagccagtggccgagtatttgacaaggccacatctgggcggacggaatgaaatggctgctcggaagaatatgttactcgcggctcagcaactttgtaaggagttcaccgaacttctgtcgcaagaccgcacaccacacgggacttcacgccttgccccagtgctggagacaaatatccagaactgcttaagccacttcagcctgattacccatgggtttggcagccaggcgatctgtgcggctgtgtcagccctccagaactacattaaggaagcgcttatcgtcatcgataagagttacatgaaccctggcgatcagagtcccgctgattctaacaagactttggaaaaaatggaaaagcatagaaagtag

SEQ ID NO: 244411 - DNA, 357 bp, Artificial Sequence
  Description of Artificial Sequence: Synthetic coding sequence
atgttcttgcaggatcgacacgacggttcttcgaatggcaatcccagggtgccacatctgtcgtcagccggtcagcacctctactcgccggcaccccctctgtcccacacaggggtggctgagtaccagccgcctccttatttcccaccaccctaccagcagcttgcatactctcagtccgccgatccctactcccacctgggtgaagcctacgctgccgcaattaatccgcttcaccaaccagctccaaccggctcacaacagcaggcctggcccggaagacaaagccaggaaggagccggactgccaagccaccacggcaggccagccggtcttctgccacatctctccggctag

SEQ ID NO: 244412 - DNA, 846 bp, Artificial Sequence
  Description of Artificial Sequence: Synthetic coding sequence
atgcctcatcagatggacgaggtgcagaatgttgacgaccagcacctgctgctgcacgaccaaaccgtgatccgcaagggcccaatcagtatgaccaagaacccattgaatctgccttgccaaaaagagcttgtgggtgccgtgatgaaccctaccgaggtcttctgtagtgtgcccggtaggctctccctgttgtcaagcacaagcaaatacaaggtgaccgtggccgaggtacagcggaggctgtcccctcctgagtgtctgaacgcctctctcctcgggggagttcttcggagagcaaaatccaaaaatggaggtcggagcctgcgggagaagctggacaagattggactaaacctacccgcagggagacgaaaagccgctcatgttacactgctcaccagtctcgttgaaggagaagccgtgcatctggccagagatttcgcttacgtgtgcgaggctgagttccctagcaagccagtggccgagtacctcactcgccctcacctcgggggtcggaatgagatggctgccaggaaaaatatgctgcttgctgcacagcagttatgcaaggagtttaccgaactcttgtcacaggataggacgcctcacggcacttcccgactggcgccagtgctagagacaaatatccagaattgcctcagtcacttttctctgatcacacacggctttggttcccaggctatctgtgcggctgtatccgcactgcaaaattacataaaagaggcactcattgtgatcgacaagtcttacatgaaccccggtgaccaatctccagccgacagtaataagacactggaaaaaatggaaaaacacaggaagtag

SEQ ID NO: 244413 - DNA, 1041 bp, Artificial Sequence
  Description of Artificial Sequence: Synthetic coding sequence
atggcggcatctggcaagctgtccacatgtcgcttgccgcctctgcccaccatcagggagatcattaagttgttgcgcctgcaagccgcaaaacagttatcccagaactttctactcgacttgcggctgaccgacaagatcgtcagaaaggcaggtaatcttacaaatgcttatgtctacgaggtgggtcctgggccaggaggaatcacgcgctcaatcttgaatgccgatgtagccgagttgctggtggtggagaaagacactaggtttattcctggacttcagatgctgtctgacgccgcaccaggcaagttgcgcattgttcacggagatgttttgacctttaaggtggagaaggccttcagcgagagcctaaagcgcccttgggaggacgaccccccaaatgttcacattattggtaatctccctttcagtgtgtctacacccttgattatcaagtggctggaaaacatcagttgtagggatgggcctttcgtttatgggagaacccagatgacactgaccttccaaaaggaagtggcagaaagattggcggctaataccggtagtaagcagcggtcacgactgtctgttatggctcaatacctgtgtaacgttcgtcatattttcactatccccggtcaggcttttgtgcctaaacccgaagtcgacgtcggtgtagtgcatttcacccccctgatccagccaaagatcgaacaacccttcaaactggtggaaaaggtggttcagaacgtgtttcagttccgaagaaagtattgtcatcgcggactccgcatgctcttccctgaggcccagcgccttgagtcaactgggagattacttgagcttgctgatattgatcccactctgcggcctcgacagctatctatctcacattttaaaagtctttgtgacgtctatagaaaaatgtgtgacgaggacccacagctgttcgcatacaactttcgcgaggagcttaaacgccgaaaatctaaaaatgaagagaaagaggaagacgacgccgaaaactatcggctatag

SEQ ID NO: 244414 - DNA, 1728 bp, Artificial Sequence
  Description of Artificial Sequence: Synthetic coding sequence
atgagccatgccgcagagcccgcacgagacggggtcgaggcaagcgctgaaggacccagagccgtcttcgttttgctggaggagaggcgtccggcagattcggctcagctgctgagccttaattccttgttgcctgagtctggcatcgtggctgatattgaattggagaacgtgctggacccggactctttctatgaactaaagagccagcccctgcctctgcgtagctcactgcctatcagcctgcaagccacacctgcaacaccagccacactgagtgcatcttcctcagccggaggctcccgcactcctgctatgagcagctctagctcttcaagggtgcttctgcgccagcagctgatgagggcccaggctcaggagcaggagcggcgagaaagaagggaacaagccgctgcggcaccgtttccttcacccgcaccagcttcacctgcaataagcgtcgtaggagtgagtgccggaggccatacccttagtcgcccacctcctgcccaagtgcccagggaagtactaaaagtccaaacccatctagagaacccgacgcggtatcatctgcagcaggcacggaggcagcaggtgaaacagtacttgtctaccactctcgggcctaagctagcttcacaagcacttaccccaccgccagggccagcgtccgcccagccgctgccagcccctgaggcagcgcacacgacgggaccgactggttccgcccctaattctccaatggctcttctgaccattggtagtagctctgaaaaggagattgacgatgtaatcgacgagatcatttcactggagtcctcttacaacgatgaaatgctgagctatttgccaggcggtactacaggtctgcagctcccgtcaacactcccggtgtccggcaatctgttggacgtctactcctcgcagggtgtcgcaacgccggctatcaccgtctccaactcctgcccagcggagctccctaacatcaagcgcgaaataagtgaaacggaagccaaagctttgctgaaagagcggcagaagaaagataatcataacctcattgagagacgacggaggttcaatatcaacgaccgcattaaggaactaggcacactcatacccaaatcctctgacccggagatgagatggaacaaagggacgatacttaaggcctctgtggattatattagaaagctgcagaaagaacagcagcgtagtaaagacttggaatctcgacagcggtcactagaacaggccaacaggtccctccagctccggatacaggagctggaactacaggcccaaatccatgggctccccgtgccgccaactcccggtctgctgagcctcgctaccacttctgcgtccgattcccttaaacctgagcagctcgatattgaagaagaagggagacccggagcagcaactttccacgttggagggggtcccgcacagaacgccccacaccaacagcccccagccccaccaagtgacgctctgttagatcttcacttcccttctgaccatttaggagacctgggggaccccttccacctagggttggaagacatactgatggaggaggaggagggtgtggtaggaggcttatctggtggcgcactgtctcctctccgggctgcctctgaccctctgctgtcaagtgtgagcccagcagtgagcaaagcatcctcacgcagatcctcgttcagtatggaagaagagtcatag

SEQ ID NO: 244415 - DNA, 1509 bp, Artificial Sequence
  Description of Artificial Sequence: Synthetic coding sequence
atggcatgggctctcaaactgccccttgccgatgaggtcatcgaatccgggctcgtgcaggattttgacgcatccctgtcaggtatcgggcaggaacttggggcaggggcatattctatgtcggacgtgctggcgcttccaatctttaagcaggaggagtcatccctgccaccagataatgagaataaaattctcccatttcaatacgtactgtgcgcagctacctctcccgctgtgaaactgcacgacgagaccctcacctacctgaaccaggggcaatcttatgaaatcagaatgctggataaccggaaacttggtgagttgccagagattaatggaaagctcgtgaaatccatcttcagggtagtctttcacgatagacgtttgcagtacactgagcaccaacagctggaggggtggcgatggaatcggccaggagacaggattctggatattgatatccccatgtcagtcggaattatcgatcccagggctaaccctactcagctgaacacagttgaattcctgtgggaccccgctaagcggacctccgtttttatacaggtccactgcatcagtaccgagttcaccatgagaaaacatggcggtgagaagggcgtgccgttcagagtccaaatcgacacatttaaggagaacgagaacggcgagtatactgaacacctacattccgcttcctgtcagatcaaagtgttcaaaccaaaaggcgctgacagaaagcagaaaacagatcgggagaaaatggaaaaaagaaccccccatgagaaggaaaaatatcagccaagttacgagactacaatcttgactgaatgctcgccatggccagagattacctatgttaacaacagccccagtccagggtttaattctagtcactccagcttttccttgggcgaaggcaatgggtcaccaaatcatcagcccgagcccccaccccctgtgacagataatctcttaccaacgacgactcctcaggaagcccagcagtggctgcataggaataggtttagcactttcacacggcttttcaccaatttctcaggggcagacctgctgaagctcacccgtgatgatgtgatccagatctgcggtccagccgacggtattagactgtttaatgccctgaaggggcgaatggttcggcctcgactcactatctacgtatgtcaagagtcgcttcagcttagagaacagcagcagcagcagcagcaacagcaacagaagcatgaggatggtgattcgaatggcacgttctttgtctatcacgctatttaccttgaagaattaactgcagtagaactgactgaaaagatcgcccagcttttttccataagtccttgtcagatcagccaaatatataagcagggccctaccggaatacacgtgctgatcagtgatgagatgatccagaattttcaggaggaggcctgctttatcctcgacacaatgaaggccgagacaaatgactcctaccatatcatccttaagtag

SEQ ID NO: 244416 - DNA, 1356 bp, Artificial Sequence
  Description of Artificial Sequence: Synthetic coding sequence
atggcttgggcactgaagctgcccctcgcagacgaagtgatcgagagcggactggtgcaagatttcgacgcatccctgtctggcatcggacaggagttaggagctggggcttatagcatgagcgatgttttggccctgcccattttcaaacaagaagaatcttcactgccaccagataatgagaataaaatactcccctttcagtatgtcctctgcgccgcaacgagtccggctgtaaagctgcacgatgagaccttaacatacttaaaccagggtcagtcatacgaaataaggatgttagataacaggaaactgggcgaactgcccgaaatcaacggcaaactcgtgaagagcattttccgtgtagttttccatgaccgacggctgcagtatacggagcatcagcagttggaagggtggcggtggaatcgccctggggaccggatcctcgatatcgacattcccatgagtgtgggaatcatcgatccaagggcgaaccccacgcagttgaacactgtcgaattcttgtgggaccctgccaagcggaccagcgtctttattcagcctaagggcgcagaccgtaaacagaagactgaccgggagaaaatggaaaaaagaactccccatgagaaggaaaaatatcagccttcttatgaaactaccatcctaactgagtgctccccgtggcctgaaatcacctacgtcaacaacagcccaagtcccggatttaattcttcccatagctccttcagtctgggcgaagggaatggttcacctaatcaccagcccgaaccacctccacccgtgacagataatcttcttcctactactaccccccaggaggcacagcagtggttacatagaaatcgcttctcgacattcacacggttattcacaaacttttctggggcagacctgcttaagctgacacgtgatgacgttatacagatttgcggccctgccgacggcataaggctgttcaacgctctgaaaggtcggatggtgcggcctaggcttacaatatatgtgtgccaggagtcgcttcagttgagagaacaacagcagcagcagcagcagcagcagcagaagcacgaggatggcgattctaatgggacattcttcgtgtatcatgccatttatttggaagaattgacggccgtcgaactcactgaaaaaatcgcccagttgttctccatctctccgtgccaaattagtcagatttataagcagggccctactggtatccacgtgttgattagcgacgagatgatccagaattttcaagaggaggcttgttttattctggacactatgaaggcggagacaaatgacagttaccacattattctgaagtag

SEQ ID NO: 244417 - DNA, 1353 bp, Artificial Sequence
  Description of Artificial Sequence: Synthetic coding sequence
atggcttgggctctgaaacttcctctggccgacgaggtgattgagtcaggtttggtgcaggatttcgacgcatccctgagcggcatcgggcaggaactcggggctggcgcatatagtatgtcagacgtgttggccctgccaatcttcaagcaggaagaaagttctctgccaccagacaacgaaaacaagatcctaccgttccaatatgtactgtgcgctgcgacatcccccgcagtaaagttgcacgacgaaaccttaacctacctgaaccagggacagtcttacgaaattcggatgcttgacaatcgtaaactgggagagctgcccgaaattaacggcaagctagttaagagtatatttcgagtcgtcttccacgacagacgtctccaatacacagaacatcagcagctggaggggtggcgctggaatcgccctggggatcggattctcgatatcgacattcctatgtcggttgggatcatcgatcccagagctaatccaacccagttgaacacggtggagtttctgtgggatcctgcaaagagaactagtgtatttatccaacccaagggggcagacaggaagcagaaaacagaccgcgaaaagatggaaaaacgcactcctcacgagaaagagaagtatcaacctagctatgaaacaactattctcaccgaatgtagtccttggcccgagatcacctatgtcaataattcgccatctcccggtttcaatagttcgcattcttctttctcactgggggaaggcaatggtagccccaatcaccaacccgaacccccacctccggtgactgacaatctattaccaacaacaacaccacaggaggcgcagcagtggctccatcggaaccggttcagtaccttcacgcggctgttcaccaatttcagcggagcagatcttctgaaactgactagggacgacgtcatccagatttgtgggccagccgatggcatacgcctgtttaacgctctgaagggaagaatggtcaggcccaggcttactatttatgtctgtcaggaaagtctccagctccgagagcagcagcaacaacagcagcagcagcagcaaaagcacgaggatggcgattctaacggaaccttttttgtctaccacgcgatttatctggaggaactcacggctgtggagctgaccgagaagatagctcagttattttccattagcccatgtcagatctcccagatctataaacagggacccaccggcattcatgttttgattagtgacgaaatgatccagaacttccaagaggaggcatgtttcattcttgacacaatgaaggaaaccaatgatagctatcatatcatcctgaagtag

SEQ ID NO: 244418 - DNA, 1440 bp, Artificial Sequence
  Description of Artificial Sequence: Synthetic coding sequence
atgttattttggcatactcagccagaacactataaccagcataatagtggctcctacttgcgggacgttctcgctttgccgatctttaagcaggaggagccacaactgtctcccgaaaatgaggcacgattacctccactccaatacgtgctgtgtgccgctacctccccagccgtgaagttacatgaggagacactgacatatctgaatcaaggacaatcgtatgagatacgcctgctggagaatagaaagctgggagacttccaggacctgaacaccaaatacgtcaaatctataataagagtggtgtttcacgacaggagactccagtataccgagcatcagcagctcgaggggtggcggtggtcacgtcctggggacagaatcctggacatcgatatccccctttccgttggcatattagacccaagagcttcacccactcagttaaacgccgtggaattcctatgggatccagccaaaagagcatcagcattcatccaggtgcactgtatctcgacggagttcacgcccagaaagcacggcggagagaagggtgtgccattcagagtgcagatagacaccttcaagcagaatgaaaacggagaatacacggagcatctgcattctgcctcatgtcagattaaggtttttaagcctaagggcgctgaccggaagcaaaagaccgacagagagaaaatggaaaagcgtactgcacaggaaaaggaaaagtatcagccctcctacgagactactattcttaccgagtgtagcccatggccagatgtggcttaccaggtcaacagcgcccctagtccttcctataacgggagtccgaactcattcggactaggcgagggaaatgcgtcccccacccacccggtggaggccctgcctgtcgggagcgatcatctccttccgtccgcctccattcaggatgctcagcagtggttacaccgtaataggttttcccagttctgtagactttttgcctcattttccggagcagacctgttgaagatgagcagggacgatctggtacagatttgtggcccagccgacggaattcgactattcaacgcgattaagggccgtaatgtccgtcctaaaatgactatttacgtatgccaggaacttgagcagaatagagtgccccttcagcagaagagagacggtagcggagactccaatctctctgtataccacgccatcttccttgaagagctcactacccttgagctgatagaaaagattgcaaacctatactctattagccctcagcacatccatcgagtgtaccgtcaaggacccacggggatccacgtggttgtgagcaatgagatggtccaaaacttccaagatgaatcctgcttcgttcttagtaccattaaggcggagagcaacgacggctaccatatcatcctaaagtgcggcctctag

SEQ ID NO: 244419 - DNA, 99 bp, Artificial Sequence
  Description of Artificial Sequence: Synthetic coding sequence
atggttcagaattttcaggatgaaagctgttttgttctatcaacaatcaaggccgagagcaatgatgggtaccacatcatattaaagtgtggattgtag

SEQ ID NO: 244420 - DNA, 1218 bp, Artificial Sequence
  Description of Artificial Sequence: Synthetic coding sequence
atggccaagtatgtcagtttgacagaggccaacgaagagttaaaggtacttatggacgagaatcagactagccgaccggtcgccgtccacactagtactgtcaaccctctggggaagcaactcctcccgaaaactttcggacagtcttccgtaaatattgatcagcaggtggtaattggtatgcctcagaggcccgctgcatctaatatccctgttgtcgggagcccaaatccccctagtactcatttcgcatcacagaaccagcatagctactcaagccccccatgggccggtcaacataataggaaaggggaaaaaaatggcatggggctgtgccggttgtccatgaaggtgtgggagacggtacagagaaaagggacaacttcatgccaggaagttgtaggggagttggtggcgaaatttagggccgctagcaatcatgcctcgcccaacgagtccgcctatgatgtcaagaacatcaagaggcgcacctatgacgcgctgaacgtgctgatggctatgaatataatctcccgtgaaaagaagaaaatcaaatggataggccttacaaccaactctgctcagaactgccaaaacctgcgagtggagcgccaaaaacggctggagcgcataaagcagaagcagtctgaactccaacagctcattcttcagcagatcgctttcaagaacctggtcctgcggaatcagtatgtcgaggagcaggtgtcacagagacctctgcccaactcagtcattcatgtaccgtttatcattatctcctcaagtaaaaagaccgtcattaattgttccatcagcgatgataaaagtgaatatctgttcaagtttaattccagctttgagatccacgatgacaccgaggtccttatgtggatgggcatgacctttggcctggagtctggttcctgcagcgctgaagatctgaaaatggcccgaaacctagtgccaaaggccctcgagccatatgttaccgaaatggcacagggaacattcgggggtgtgttcactacagcaggaagtcgatccaacggaacatggctgagtgctagtgacctgaccaacatcgcgatcgggatgctggccacctctagtggcggaagtcaatactccgggtcacgcgtggaaacaccggcagtagaggaagaagaggaagaagacaataatgacgatgatcttagcgaaaatgatgaagacgactag

SEQ ID NO: 244421 - DNA, 2649 bp, Artificial Sequence
  Description of Artificial Sequence: Synthetic coding sequence
atggagggtgagagcagtcgcttcgaaattcatactccggtgagcgacaagaagaaaaaaaaatgctcaatccacaaggagcggccacaaaaacacagtcacgagatcttcagggacagcagtctggttaacgagcagtcccagatcaccaggcgaaagaagcgtaagaaagactttcagcacctgatcagtagtcctctaaaaaagagcagaatatgtgatgaaaccgcaaacgccaccagcaccctgaaaaaacggaagaagagacgctactcagccctcgaagttgatgaagaggccggagtgacggtggtattagtggacaaggagaacattaacaatacaccgaagcactttcgcaaggatgtggatgtcgtctgtgtcgacatgagcattgagcagaagctccccaggaaaccgaagacagataagttccaggtgctggctaaaagccatgcccataagagcgaggcattacactcgaaagtccgcgagaaaaaaaacaagaaacatcagcgtaaggcagcctcctgggaaagccaacgcgcaagagacacgctacctcaatctgaatctcatcaagaagagagctggctgtctgtcggccctggaggcgaaatcaccgaattgcccgcaagcgctcacaagaacaaatctaaaaagaagaaaaagaagtcttccaatcgggaatacgaaactttggcgatgcctgaaggatcacaagcaggaagagaggcaggcacagacatgcaagagagccagcctaccgtaggcttggacgacgagaccccccagctcctgggacctacgcataagaagaaaagtaaaaaaaagaagaagaaaaagtccaatcaccaggagtttgaagcactggccatgcccgaaggatcacaagtcggctctgaagtaggagccgatatgcaggagagcaggcccgctgtggggctgcatggtgagaccgcaggcatccccgcacccgcatacaaaaataaatctaagaaaaagaagaaaaagtcaaaccatcaggagttcgaagcagttgccatgcccgagtcactggaaagcgcttatccagaggggtcgcaggttggctcggaggtcggcactgtggagggtagcactgccttgaagggattcaaggagtctaacagtactaaaaagaaatcaaagaaacggaaactgacctcagtgaaaagggctcgtgtttcaggggatgacttctcagtgccctccaagaactccgagagtactttgtttgactccgtggagggagatggggcaatgatggaggaaggcgttaagagtagacccagacagaagaagacgcaggcttgtctggcctcaaagcatgttcaggaagctcctcggctagaacctgcaaatgaggagcataatgtggagaccgctgaggactctgagatcaggtacctttccgccgactctggagatgctgatgatagcgacgccgatctgggatcagccgtgaagcagctgcaggaatttatccctaacatcaaagaccgagccacctctaccatcaagagaatgtaccgggacgacttggagcgctttaaagagttcaaggcacaaggggtggccatcaagttcggcaagttctccgtcaaagaaaataaacagctggagaagaatgtcgaagacttcctggctctgactggtatagagtcagccgataagctgctgtacacagatcgctatccagaggagaagagcgtgataacgaacctgaaaagacgctacagcttccgtttacacatcggccgaaacatcgcacgcccatggaagctgatctactaccgggctaagaagatgttcgacgtgaataattataaaggcagatatagtgaaggggacactgaaaaactcaaaatgtaccactcgctcctgggtaacgattggaagaccattggggaaatggtggcgagaagcagcctgtccgtcgcgttgaaattttctcaaatatccagccagaggaacagaggagcctggtcgaagagtgagacaagaaagttgataaaggcggtagaggaagtgatcctgaagaagatgtcaccccaggaacttaaggaggttgactctaagcttcaggagaacccagaatcatgtctttccattgtgcgggagaaactctacaaagggatctcttgggttgaagtggaggcaaaagtacagactcgcaattggatgcagtgcaaatccaagtggacagagatcctcacgaaaagaatgacaaatggtaggcgaatctattatggaatgaacgcacttagagcaaaggtgagtctgatcgaacgtctgtacgagattaacgtcgaagataccaacgaaatagattgggaggacctcgctagcgctatcggagatgtgcctccgtcttacgtccagacgaaattctcacgactgaaggctgtttatgtgcctttttggcagaagaaaacattccctgagattatcgactatctgtatgagacgaccctccctctgctcaaagagaagctggaaaaaatgatggagaagaaaggaactaaaatccagacaccagccgcaccaaagcaggtgtttccttttcgcgatattttttactacgaagatgactcagagggcggtcatcggaaacgtaaacgacggtag

SEQ ID NO: 244422 - DNA, 2718 bp, Artificial Sequence
  Description of Artificial Sequence: Synthetic coding sequence
atggagggagaaagcagccggttcgagatacacactccagtgagtgacaagaaaaagaagaagtgctcgatacacaaagaaagaccgcagaagcacagccacgaaatttttagggattcatctttggttaatgaacaatctcaaattacccgcaggaaaaagaggaagaaggacttccaacacctgatctcttctccactgaagaaatcccgcatttgtgatgaaactgcgaatgccacatccactctgaagaaaagaaagaaaaggagatactccgccttggaagtagatgaagaagccggagtgactgtcgtgctcgtcgacaaggaaaacattaacaacacgcccaagcactttaggaaggatgtcgatgtagtgtgtgtggatatgagtattgagcaaaagctccctcggaagccaaaaacggacaagtttcaggtgctggcgaagagccatgcccacaagtcagaggcacttcactcaaaagtcagagaaaagaaaaacaagaagcaccagagaaaggcggcatcttgggaatcccagagagctagagacaccctcccacagagtgagagccaccaagaggagagctggctctcagtggggccaggcggagagattacggagctcccagccagtgcccacaagaataaaagtaagaagaagaagaaaaagtcttccaatcgggagtacgagaccctagccatgcctgaaggcagtcaggcgggacgcgaagctggaaccgatatgcaggaatctcagccgacagtgggattggacgacgagacgccacagctgcttggtcctactcacaagaaaaaatctaagaagaaaaaaaaaaagaagtcaaatcatcaggagttcgaagccctggcaatgccagagggctcccaagtaggctctgaagttggagctgacatgcaggagagtaggcccgctgttggtttgcatggcgaaacagctgggatacccgctcctgcatacaagaacaagtctaagaagaaaaagaagaagtcgaaccaccaggagtttgaggctgtagcgatgcctgaaagtctggagtccgcctatcccgaaggcagtcaggttgggtcagaagtggggacggtcgagggctcgacagccctgaagggcttcaaggagtcaaattccaccaaaaaaaagagcaaaaaacgcaagttaacttcagtgaagcgagcaagagtgtcaggcgacgattttagcgtgccatccaagaattccgaatccacactgtttgattcggtagaaggcgatggggcaatgatggaggagggcgtcaaaagcagacctcggcagaaaaagacccaggcctgcctggcttccaagcatgtgcaggaagctccacggttggagcctgccaacgaagaacacaatgtcgaaacagctgaggattcagagatcagatatctctcagccgatagcggagatgctgatgattcagacgcagacctcggctccgccgtgaaacagttgcaggagttcatcccaaatataaaggatagagccacttccacaatcaaaaggatgtacagagatgaccttgagaggtttaaggagttcaaagctcaaggtgtagcaattaaattcgggaagttctccgtaaaagagaataagcaactggagaagaatgtggaggatttcttggcactcaccgggatagagtccgctgataagttgttgtacaccgaccggtatcccgaggagaagtcggtgattactaacctgaaacggcgatactcctttaggctgcatattgggaggaacattgccaggccctggaagctcatttattaccgcgcaaaaaaaatgtttgatgtcaataactataaggggagatacagtgaaggggacactgaaaaactgaagatgtatcacagcctgctgggtaatgactggaaaaccattggagaaatggtcgcaagaagctctctgagtgttgctctgaaattttcacagatcagcagtcagagaaaccgtggggcttggtctaaaagcgagacacggaagctcattaaagccgtcgaggaagtcattcttaaaaaaatgtccccccaggaattaaaggaggtggactccaaacttcaggagaacccggagtcatgtctcagcatcgtgcgggagaagctgtataagggaattagttgggtcgaagtggaggctaaagtccagactagaaattggatgcagtgtaagtcaaagtggaccgagatacttaccaagcggatgacaaatggcagacgtatctactatggcatgaacgctcttcgcgctaaagtttcactcatcgaaaggctgtatgagatcaacgttgaagacacgaacgagattgattgggaagatctcgcttccgccatcggcgatgtgcccccttcttatgtccagaccaagttttccaggctgaaggcagtttacgtcccattttggcagaagaagacatttcctgagattatcgactacctgtatgagaccacacttcctctactaaaggaaaagctcgagaagatgatggagaagaaagggacaaaaattcagacaccagctgcccctaaacaggtatttccatttcgtgacatcttctactacgaggacgatagcgagggagaagatattgagaaggaaagcgagggccaagctccgtgcatggcacatgcttgtaattccagcaccctcggcggacaggggagatggattatttag

SEQ ID NO: 244423 - DNA, 3489 bp, Artificial Sequence
  Description of Artificial Sequence: Synthetic coding sequence
atggaggaggtgcgttgccccgaacatggtacattttgttttctaaaaacaggtgtccgcgacgggcctaataagggaaagagtttttatgtgtgcagggccgatacctgctcttttgtccgcgctactgatatcccagtgagccattgcctgctgcacgaggacttcgtcgtggagctgcaaggcctgctcctgccacaggataaaaaagagtatagattatttttccggtgtatccgcagcaaagcagaaggcaaacgctggtgcggtagcatcccatggcaagacccagactccaaggagcactctgtctctaataagagtcaacacgcatccgaaacattccaccactcatctaattggttgcgaaatcctttcaaggtcttagacaagaaccaggagccagcattgtggaagcaactcatcaaaggagaaggggaggagaagaaggccgacaaaaagcagcgggagaaaggtgaccagttattcgatcagaagaaagagcagaaaccggaaatgatggagaaggatctcagctctggcctagtccccaagaagaagcagtcagttgtccaggagaaaaagcaggaggaaggggctgagattcagtgcgaggccgagactggaggcacccataaacgggatttcagcgaaataaagtctcagcagtgccaaggaaatgaattgactcgcccaagcgccagtagtcaggaaaaaagtagcgggaagtcacaggacgtccagcgcgagtccgagcctttgcgagaaaaggtcacgcagttgctacctcagaacgtccattcgcacaacagcatcagtaaaccgcagaaaggtggacccctgaataaagaatataccaattgggaggccaaagaaacgaaggctaaagacggaccctccattcaggctactcagaagagcctccctcaggggcactttcaagaaagacccgagactcacagtgtaccagctcctgggggtcccgctgcccaagcggcacccgcagcacctggactgtccctcggggagggcagggaagccgcaacatccagcgatgacgaggaagaggatgacgtggtgttcgtttcttcgaagcctgggtctcccctcctttttgactcaaccttggatctcgaaactaaggagaacctccaatttcccgacagaagtgtgcagagaaaggtttcgccggcttctggggtgagcaaaaaagtggagcccagcgaccctgtagcccgacgcgtgtatcttacgacacagctgaaacagaagaaaagtactttggctagcgtgaatatccaagccctgcccgacaagggacaaaaactcattaagcagatacaagagctcgaggaagtcctgtccgggctgacactcagcccagaacagggaaccaatgagaagtccaattcacaggtcccacaacagagccatttcacgaagacaacaaccggacctccgcatctggtgccgcctcagcctctcccacgacgaggaacacagcctgtggggtccctggagttgaaatctgcatgtcaggtgacagccggtggaagcagccagtgctacaggggccataccaatcaggatcatgtccatgccgtatggaaaatcacctccgaggccatcggccagctgcaccggagcctcgaatcttgtccaggagagaccgtggtcgcagaagaccccgctggtttgaaggtgccactgcttctccatcaaaagcaggctctggcttggcttctctggagggagtctcaaaaaccccaaggaggtatcctcgctgacgatatgggcctggggaagactcttacaatgattgctcttatactgacccaaaaaaaccaggagaaaaaggaagagaaggagaagtccacggctctcacctggttaagcaaggatgattcttgcgacttcacatcccacggcacactgattatctgccccgcttcacttatacaccattggaagaatgaagtagagaagcgagtgaattctaataaactgcgggtttatctctaccacggccctaatagggacagtcgtgccagggtgctcagtacttacgacatcgttattacaacctactccctggtagccaaggagatacccacaaataagcaggaggccgaaatccctggcgctaacctaaacgtggagggcactagcacaccactgctccggatcgcttgggccaggattatactggacgaggcacataacgtgaaaaatccccgagttcaaacctccatcgccgtttgtaaattgcaggcatgtgctcgctgggccgtaacaggaacacccattcagaataatctgctggatatgtacagcttgcttaagtttctgaggtgctctccctttgacgagttcaacttgtggcgttcacaagtcgataatggcagcaaaaaaggaggggagaggttatcaatccttaccaagagcctgcttctgcgcaggaccaaagatcagctcgatagcactgggcgacccttagtcattctgccacagagaaagttccagttgcaccacctgaagctctccgaggacgaggagacggtgtacaacgtcttttttgcgcgatcaagatctgccctgcaatcctacttaaaacgacatgaatcaaggggcaatcagagcggcaggtcccccaacaatccattttctcgtgtagcactggagtttggatctgaggagccacggcacagcgaggccgcagactctcctaggagtagcacggttcacattctgtcacagctgctgcggctgcggcagtgctgttgccacctttcccttctgaagagcgccttggaccctatggaattgaagggcgagggcctggtgctctcgttagaagaacagctctctgcactcaccctgtcagaacttagagactcagagccaagctctactgtgtccctgaacgggacttttttcaagatggaactgtttgaggggatgagggaatcgactaagatttcgagtcttctcgctgagcttgaagccatccagaggaattccgccagccagaagtctgtcattgtgtctcaatggaccaatatgctgaaggttgtggcattgcatctcaagaagcacgggctgacatatgccacaattgatggcagcgttaatcctaagcagcgaatggatttggtggaagcctttaaccacagccgcggtcctcaggtgatgctcatctctctattagcaggcggagtcggcttgaatctcaccgggggaaatcatctgtttctactggatatgcattggaacccgagcttggaggaccaggcttgtgatcggatctaccgcgtgggacaacagaaggatgtcgtcattcaccggttcgtttgtgaaggcacggtagaggaaaaaattctccagcttcaagagaagaaaaaggacttggcgaagcaggtgctcagtggctcgggggagtccgtgactaagcttacattggccgacctccgcgtgctgtttgggatctag

SEQ ID NO: 244424 - DNA, 432 bp, Artificial Sequence
  Description of Artificial Sequence: Synthetic coding sequence
aacatgctgaaagttgtggccttacatctcaaaaagcacggactcacttacgcgactatcgacggctctgtgaatccaaaacagaggatggatctggtcgaagcctttaaccattcaagaggcccacaggtaatgcttatctccttgttggccggaggggtcggactgaatctgacaggtggcaatcatcttttcctgctggacatgcactggaaccctagtctcgaggatcaggcatgcgaccggatctatagagtagggcagcagaaggacgttgtcattcacagatttgtctgtgaaggaacagtggaagagaaaatcttgcagcttcaagagaaaaaaaaggatcttgctaagcaggtgctctccggaagtggggaatcagtgacaaaactcacgctagcggatcttagagttctctttggcatctag

SEQ ID NO: 244425 - DNA, 1263 bp, Artificial Sequence
  Description of Artificial Sequence: Synthetic coding sequence
atggcagaactgggcaagaagtactgcgtttattgcctggccgaagtatcacctctcaggttccggtgcaccgaatgccaggatatcgagctttgccctgagtgcttttcagccggagcagaaattggccatcacaggcgctatcacggttaccagctagtagacggcggacgatttaccctgtggggcccagaagcagaaggcggatggacatcaagggaggagcagctcctgcttgatgccatcgagcagttcggcttcggcaactgggaggatatggccgcacatgttggtgcaagccgaaccccacaggaagtcatggaacactatgtgtccatgtatatccacggtaatcttggaaaggcctgtattcctgacaccattcccaatagagtgaccgaccacacgtgcccaagcggcggacccctatcaccaagtctgactacccccctccctccacttgacatttctgtggccgaacaacaacagcttggatacatgcccctgcgggacgactatgagatagaatatgatcaagacgccgagacactgattagcggccttagtgttaattacgacgatgacgacgtggagatcgagctcaagagggctcacgtggacatgtatgtgaggaagctcaaagaaagacaaaggcgcaagaatatagccagagactataatctggtcccagcattcctgggcaaggataagaaagaaaaggagaaagcactgaaacggaaaatcaccaaggaagagaaggagctgcggctcaagctccggccactttatcagttcatgagttgtaaagaattcgatgacctgttcgaaaatatgcacaaagaaaagatgctgagggccaaaatccgagaattgcagcggtatagaaggaatggtattacaaaaatggaagaaagcgccgaatatgaggccgctcgccacaagcgcgagaagagaaaggaaaataagaatttagccggtagcaaaagagggaaagaagacggaaaggattccgagttcgccgctatcgagaatctccccggattcgaacttttgtcagatcgcgagaaggtgctttgttcatcgctgaacttgtccccagccagatacgtcacagttaaaactatcatcattaaggaccacctgcagaaaagacaggggattcccagtaaaagtaggctgcctagttatctggataaggtgctcaagaagcgcattcttaacttcctgacagagagcggctggattagccgggacgcgagctag

SEQ ID NO: 244426 - DNA, 366 bp, Artificial Sequence
  Description of Artificial Sequence: Synthetic coding sequence
atggcagcacacgtaggcgctagtcgaaccccacaggaagtcatggaacattacgtaagcatgtacattcacggcaacctgggaaaggcatgcatccccgacaccatcccgaatcgcgtgaccgaccacacctgcccttccgggggacccctgagcccaagtttaactacaccccttcctccactcgatatttctgtggctgaacagcagcagctggggtatatgccgttgcgggacgactatgagattgaatacgatcaggatgctgaaacactgatctctgggctcagcgtgaattacgatgatgacgacgtcgagatagaactgaagagggcccatgtagacatgtacgtccggaagctttag

SEQ ID NO: 244427 - DNA, 390 bp, Artificial Sequence
  Description of Artificial Sequence: Synthetic coding sequence
atggctgcccatgtcggggcttctaggacgccacaggaagtgatggagcactatgtcagcatgtacattcatggaaacctggggaaggcttgcatccccgatactattcctaaccgcgtcacagatcatacgtgcccaagcggcggtcctctgagcccatctctgaccacgcccctgcccccactagacatatccgtggcagaacagcagcagctcggctatatgcccctgagggatgattatgagatcgaatatgaccaggatgccgaaaccctgattagcggcctcagtgttaattacgatgatgacgacgtggagatcgagctcaaacgcgctcatgtcgacatgtacgtgcgaaagctgaaagagagacaacggaggaagaactag

SEQ ID NO: 244428 - DNA, 1038 bp, Artificial Sequence
  Description of Artificial Sequence: Synthetic coding sequence
atggccgagttgggaaagaaatattgtgtgtattgcctggcggaggaggacatggctgcgcatgtgggagcgtctcgcacaccacaggaagtgatggaacattatgtctccatgtacatccatggcaatttgggcaaggcctgtattccggacactattcctaatcgggtcactgatcacacttgcccctcagggggaccacttagcccaagcctgactactcccctgcctcccctcgatatctctgtcgcagaacaacagcagctcggctacatgccactgcgcgatgactacgagatagaatatgaccaggatgccgaaaccctcatcagcggcctgtcagtcaactacgacgacgacgacgtagagatcgaactgaagcgggctcatgtggacatgtacgtgagaaagctgaaggagcggcaacggcgaaaaaacattgcgagggactataacttggtgcccgcatttctgggaaaagacaaaaaagaaaaagagaaagccctcaagcgtaagatcaccaaggaggaaaaagagctgcgactcaagcttcgccctctgtaccaatttatgtcctgtaaagagttcgatgaccttttcgaaaacatgcataaggagaaaatgctacgagctaagattagagaactacagcggtatagaaggaatggaattactaaaatggaggagtctgccgagtatgaggctgctcgccataagcgagaaaagcgaaaggagaacaaaaacctagctggttctaaacgcggtaaagaggacgggaaggatagtgaattcgctgcaatcgagaatctccctgggtttgagctgctctccgatcgggagaaagtcctgtgtagttcactgaacctcagcccagctcggtacgtaactgtgaagaccattatcattaaagaccacctccagaagaggcaggggatcccctccaagtccagacttccttcttacttagacaaagtcctaaaaaagcggattctgaatttccttacggagagtggttggatttcacgggacgctagttag

SEQ ID NO: 244429 - DNA, 987 bp, Artificial Sequence
  Description of Artificial Sequence: Synthetic coding sequence
atggccgctcacgttggcgcttcccgcacacctcaggaagtgatggagcactatgtgtccatgtacattcatggaaatttgggcaaagcctgtataccggacaccatccctaacagggtgaccgatcatacatgtccaagtggaggccctctgtcaccgtccctcactacccccctcccccctctggatatatccgtggccgaacagcagcaactggggtacatgcctctccgcgacgactacgagattgagtatgatcaggacgcagaaactctaatctctgggttatccgtgaattacgatgacgacgatgttgagatagaattgaaaagggcccacgttgatatgtacgttcgcaagctgaaggagcggcagcgcagaaagaacattgcaagagattacaatctcgtgcccgcttttctgggcaaagacaagaaagagaaggaaaaagcactgaaacggaagatcacaaaagaggaaaaagagttgaggttgaagttgaggcctctgtaccaatttatgtcctgcaaagagtttgatgacctgttcgaaaatatgcacaaagagaagatgcttcgtgcgaaaataagggagcttcagaggtacaggcgcaatgggatcactaaaatggaagaaagcgccgaatatgaggcggctcgacacaaacgggagaagagaaaagagaacaagaatttggcagggtctaagagaggaaaagaggatggtaaagattcagaattcgccgctatcgaaaacttgcccggattcgagctgctctcagatagggagaaggtgctttgcagctccctgaatctttcaccagcccgttacgtcactgtcaagaccattattatcaaagatcacctgcagaaacgccaggggattccctcaaaatcgcggcttccaagttacctggataaggtcctgaagaagcgtattctgaacttcctgactgaaagcggctggatcagccgggatgcctcttag

SEQ ID NO: 244430 - DNA, 1299 bp, Artificial Sequence
  Description of Artificial Sequence: Synthetic coding sequence
atgtcagagctgaaagactgcccgctgcagttccacgatttcaagtctgttgaccacttaaaggtgtgccccaggtatacggctgtgttggccaggtcagaggatgacggcattggaatcgaggaactggatacccttcagttggagctcgagacgctcttgtcaagtgctagccggagattgcgcgttttggaagccgagacgcaaattttaacagattggcaggacaaaaagggagacagacgctttctgaaactcgggagggatcacgagctgggtgctcccccaaaacacggaaagccaaaaaaacagaagctagagggaaaggccggacacggcccaggtccaggacctggcaggcctaagtccaagaacctgcaacccaaaattcaggagtatgagttcacagatgatccaatcgatgtgccacgcatcccaaaaaatgatgcacctaacagattttgggcatctgtggaaccttactgcgccgatatcactagtgaagaggtgaggaccttggaagaactgctgaaaccccctgaggatgaggcagaacactacaagatcccacccttggggaaacattacagtcagcgatgggcacaagaggacttgctggaagaacagaaggatggcgctagggctgctgccgttgccgataagaaaaaaggcctgatgggacctttgacagagctggataccaaagacgtggacgcccttctgaaaaagtccgaagcgcagcatgagcagcccgaagatggctgtccctttggagccttgactcaacgacttctccaggctctcgtagaagagaatattatctcccccatggaggattctcccataccagatatgtctggaaaggagagcggggcagacggcgcttctacgtcacctagaaaccagaacaaaccattcagtgttccccacactaaaagcttagagagtcgcattaaggaagagttaatagctcagggcctgctggagtccgaggatcggcctgctgaggactccgaggacgaggtgctggctgaactccggaagcgccaggccgagctgaaggctctgtctgcccacaatcgcacaaagaaacatgatcttctacggctcgcgaaagaggaagtgtcccgtcaggagctaaggcagagggtgcgcatggcagacaatgaggttatggatgctttcagaaaaattatggctgctcggcaaaagaaacgtacaccaaccaagaaggagaaagatcaagcttggaagaccctcaaggagagggaaagtattctgaaacttctggacggttag

SEQ ID NO: 244431 - DNA, 1110 bp, Artificial Sequence
  Description of Artificial Sequence: Synthetic coding sequence
atgtctgagctcaaggactgcccactgcagttccacgacttcaagtctgtggatcacctaaaagtgtgccctcgctatacggccgtcctggcccgttccgaggatgatggaattgggatagaagagctagacactctccagcttgagttagagactttgctctccagtgcttcacgtcgcctgcgtgttcttgaggccgagactcagatcctgaccgattggcaggataaaaagggagacaggcgattcctgaagctcggccgtgaccacgaactaggggcaccaccaaagcatggcaagccaaagaagcagaaactggagggcaaagcgggacatggacctggaccagggccaggacgccctaagtcgaaaaatctccagccgaagattcaagagtacgaatttacagacgaccctatcgacgtccccaggatccctaaaaatgacgcacccaatcgcttctgggcctctgtggaaccttattgcgcggatattacgtcagaggaagtccggactctggaggaactgctgaaaccccctgaggacgaagccgagcactacaaaatacctcctcttgggaagcactactcccagcgctgggcccaagaggacctactagaggaacagaaggacggggctcgcgctgcagcagtggcagacaagaagaaaggcttgatgggccctctgaccgaactcgacactaaggacgttgatgctttattgaaaaagagtgaggcccagcacgagcagccagaagacggatgtccctttggagcgctgacacagcgactgcttcaagctctagtggaggaaaatatcatttctcctatggaagatagccctatccccgacatgtccggcaaagagagcggagcagacggcgcatccacatcccctagaaatcagaataaaccattttcagtgccgcataccaaaagcctggagtctcgtatcaaggaggaactgattgctcagggtctgctagagagcgaagatcggcctgccgaagattccgaggacgaagtgcttgccgagctgaggaagcgccaggcagaactcaaagctctgagcgcacataaccgtacaaaaaagcacgatctcctaagatag

SEQ ID NO: 244432 - DNA, 288 bp, Artificial Sequence
  Description of Artificial Sequence: Synthetic coding sequence
atgtctgaactgaaagattgtcctctgcagttccacgacttcaagagcgttgatcacttgaaagtgtgtcctcgatacacagccgtgctggctagatctgaggacgatggtatcggtatcgaggagcttgacacgctccagctggagctggagacactcttgtcatctgcaagccggcgtttgagagtcctcgaggctgagacccaaatcctcaccgattggcaggataaaaagggcgacaggcggtttctgaaattggggagggaccatgagttgggggcaccttag

SEQ ID NO: 244433 - DNA, 1299 bp, Artificial Sequence
  Description of Artificial Sequence: Synthetic coding sequence
atgtctgaactgaaggactgtcctcttcagttccatgatttcaagtctgtcgaccatcttaaggtatgtcctagatataccgcggtcttggccaggagtgaggatgatgggattggcatcgaggagctagacacactgcagttggaattagaaactctgctttcgagtgcttcgagacgcctgagggtcctagaggcagaaactcagattcttaccgattggcaggacaaaaaaggagataggcgatttcttaagctgggaagggatcatgaattgggagctccaccaaagcacggaaaacctaagaaacagaagctggaaggcaaagccggacacggccctgggcctggccctggaagaccaaaatcaaagaatctgcagcccaagatacaggaatatgagttcaccgatgacccgatcgacgtacctcggattcccaaaaacgacgcacctaaccgattttgggcctcagtggagccgtattgtgctgacataacatccgaggaagttcgcactctggaggaattgctcaagccacccgaagacgaagccgaacactataaaattccaccgctgggtaaacactacagtcagagatgggcccaagaggacctgctcgaggaacagaaggacggtgcaagagcagccgctgtcgcagataaaaagaaaggcctgatgggccctctcaccgagctggacaccaaggatgtggatgctttgctgaaaaagtctgaggctcagcatgaacagcccgaagatggctgcccattcggcgctctgactcagagactgctacaggccctggtcgaggaaaacatcataagtcctatggaggatagtcctatccccgacatgtctggtaaagaatccggggcagacggagcatcaacctccccacgaaaccagaacaagcccttttccgtgccgcacacaaaaagtcttgaaagccggatcaaggaagagcttatcgcacaaggactcctggagagcgaagaccgcccagcggaggacagcgaggatgaggtgctggcggagctgcgcaaacggcaggcagaactgaaagcgcttagtgcccacaacagaaccaaaaagcatgacttactgcggcttgccaaggaagaagtgtctagacaggaactcagacagcgggtgagaatggctgacaatgaggtcatggacgcatttcggaaaatcatggccgctcgccagaagaaacgtacccccacaaaaaaagagaaggatcaggcatggaagaccctgaaagagcgcgaatctatccttaagctccttgacgggtag

SEQ ID NO: 244434 - DNA, 1038 bp, Artificial Sequence
  Description of Artificial Sequence: Synthetic coding sequence
atgcagctggagattcaagtcgccttgaactttattatctcttatttatacaacaaattgcctcggagaagggtcaacatctttggcgaggaacttgagcgactcctgaaaaagaagtacgagggccattggtaccctgaaaagccttataagggatctgggttcaggtgcattcatatcggggaaaaggttgacccagtgattgaacaggcttctaaagagtccggcctggatatcgatgatgtgagaggaaacctcccccaggatctgagtgtgtggattgacccatttgaagtgtcctatcaaatcggagaaaaaggtccagtgaaagtcctgtacgtggacgataataacgaaaacggctgcgaacttgacaaagagatcaagaattccttcaaccccgaagcccaggtgttcatgcccatcagtgaccctgcttcctccgtgtcctcaagcccaagtccgccttttggacacagtgctgctgtctcaccgactttcatgcctaggtcaacacagcctttaactttcacgactgccacatttgcagccaccaaatttgggtcaacaaaaatgaagaactccggccgttctaacaaggtagccagaactagtcccattaatttggggctgaacgtgaatgaccttctaaaacagaaagccatttcgtcaagtatgcacagcctctacggtcttgggctgggaagccaacagcagcctcagcagcaacagcagccggcacagcctcccccaccccctccaccacctcaacagcaacaacagcagaagacgtcagctctgtctccaaatgcaaaggagttcattttccccaatatgcagggtcaaggctcaagcactaacggtatgttccctggcgactctcctttgaacctatccccattacagtactcaaatgcctttgatgtgtttgccgcatatgggggtcttaacgagaagtctttcgtggatggcctcaatttttccctgaacaatatgcagtactccaaccagcaattccagccagtcatggcgaactag

SEQ ID NO: 244435 - DNA, 1038 bp, Artificial Sequence
  Description of Artificial Sequence: Synthetic coding sequence
atgcagttagagatccaggttgccctaaatttcatcatatcgtatttatataacaagctgccacggcgaagagtgaatatctttggggaggaactggagcgactccttaaaaaaaagtacgaaggacattggtatccagagaaaccatacaaaggttccgggttccggtgtatccacatcggcgaaaaggtcgatcccgtgattgagcaggcctctaaggagtctggccttgacatcgacgacgttagaggaaatctgcctcaggacctctctgtgtggatcgaccccttcgaggtatcctaccagattggagaaaagggccctgtgaaagtgttgtacgtagacgataacaacgaaaacgggtgtgagctggataaagaaattaagaactctttcaatcccgaggcacaggttttcatgcccatatccgacccagctagcagcgtcagcagctccccatcacccccttttggccattctgccgcagtgagccctacattcatgccccgatccacacagcccctgacattcacaacagccacctttgctgctactaaatttggttctacgaagatgaaaaacagtgggcgaagcaacaaggtggcaagaacatctcccatcaatctgggcttaaacgtaaatgatcttttaaagcagaaggccatctcttcctcaatgcactctctgtatgggctgggactcggttctcagcagcagccccagcagcagcagcagccagctcagccaccaccaccacctcctccaccacagcagcagcaacagcaaaaaaccagtgccctatcacccaacgccaaggaatttatattccccaatatgcagggacagggatcttcaacaaacggtatgttccccggagactcaccactcaatctctcccctttacagtactccaatgccttcgatgtgtttgccgcatatggcggtctgaatgaaaagagcttcgtggatggtctgaatttcagtcttaacaatatgcaatactccaaccaacaatttcagcccgttatggccaattag

SEQ ID NO: 244436 - DNA, 1035 bp, Artificial Sequence
  Description of Artificial Sequence: Synthetic coding sequence
atgcagcttgagattaaggtcgctctgaattttattatatcatacctctacaacaagctgccaaggcgtcgtgccgacctgttcggcgaggagcttgaacggctgctgaaaaaaaaatatgaaggacactggtatccggaaaaacctctcaaaggctccggctttcgctgtgtgcatatcggtgaaatggtcgaccccgttgtggaattagctgcaaagcgatcgggcctggctgtcgaggatgtgcgggcaaatgtccctgaggagctgagtgtgtggatcgacccattcgaggtgtcatatcagatcggtgagaagggtgcagtgaaagtcctgtacctggacgacagcgaaggatgcggggctcctgaacttgataaggaaataaaaagcagtttcaatccagacgcccaggtgtttgtccccatcggttcccaggacagtagcttatcgaattcccccagcccatcattcggtcagagcccaagccctaccttcattccaaggagcgcacagccgatcacttttactaccgcatccttcgcagccaccaaattcggctcaactaagatgaagaagggtggcggtgcagcatctggaggtggagtcgcatctagtggcgctggagggcagcagcctccacagcaaccaaggatggcaaggagtccaaccaacagcctgctcaaacacaaatccctctcgctgtctatgcatagcctaaacttcatcaccgcaaatccagctccacagtctcagctgtccccaaatgccaaagagtttgtttataatggtggtgggtcacccagcctcttcttcgacgccgcagatggccaaggctccgggacccctggtccgttcgggggatcgggcgctggaacatgtaactcctcctcttttgacatggctcaggtgttcggaggcggtgcaaactcgctgttcctggaaaagactccatttgtagaagggctaagttataacctgaacacaatgcagtatcccagccagcaatttcagcctgtggttctggctaattag

SEQ ID NO: 244437 - DNA, 306 bp, Artificial Sequence
  Description of Artificial Sequence: Synthetic coding sequence
atgcagttagaaattaaggtggcactcaatttcattatcagctatctttacaataagttgcccaggcggagggcagacctgttcggcgaggagctggaacgcttgctgaaaaagaaatacgaaggacattggtaccccgagaagccacttaaaggatccggatttcgctgcgtacacattggtgaaatggttgaccctgtcgtggaactggctgcaaagcggtctggcttggccgtagaagatgtgcgggcaaacgtgcctgaggaactttcggtgtggattgaccccttcgaagtctcgtattag

SEQ ID NO: 244438 - DNA, 1569 bp, Artificial Sequence
  Description of Artificial Sequence: Synthetic coding sequence
atgtcaatcacctcagacgaggtgaattttctggtttatcgctacttacaggagtctggtttctctcatagcgcctttacttttggtatcgaatcccacatctcccagtcaaacatcaacgggactctagtgcctccctccgccctgatttccatacttcaaaagggattacagtatgtggaagcagaaatcagtataaataaggatggcaccgtcttcgattctaggcctatcgagtctctgtccctcatcgtcgcagtcatcccagatgttgtgcagatgcggcagcaagctttcggcgagaagctgactcagcaacaagctagcgctgccgcaactgaggcaagcgccatggcaaaggctgcaactatgacacctgccgcaatcagtcagcagaacccccctaagaatagggaggcaacagtaaatggggaggaaaacggagcccacgaaataaacaatcactcaaagcctatggaaattgacggcgatgtggagatcccccctaacaaagcaactgtgctccggggacacgaaagcgaggtgttcatttgtgcttggaacccagttagcgatttactggcttctgggtctggggacagcacggccaggatttggaacttgaacgaaaactcgaacgggggttccacccaactagtgctgaggcactgtattcgtgaaggtggccacgacgtgccatctaacaaagatgtcacttcacttgattggaatagcgatgggacactcctcgccatgggcagctacgacgggttcgccaggatctggactgagaatggcaacctggcctccaccctggggcagcataaaggcccaatattcgccttgaaatggaacaagaagggcaactacgtgctgagtgccggtgtcgacaagactactataatttgggatgcccacacgggggaggcaaagcaacagtttccctttcatagcgcacctgcactcgatgtggactggcaaaataacatgactttcgcaagctgctctaccgacatgtgtatccatgtttgcaggcttggatgcgaccatccagtgaaaacctttcagggccatacaaacgaggtcaatgctattaaatgggacccctctgggatgctgctggcttcttgctccgatgacatgacactaaagatatggtcaatgaagcaggacgcttgcgtgcatgatcttcaagcacattccaaagaaatctatactatcaagtggtctcctacggggccagccacgagcaacccaaattccagtattatgctggcttcggccagcttcgacagtacagtacggctgtgggacgtggaacagggcgtctgtacacataccttgatgaaacaccaggagccagtgtattctgtggctttctcacctgacggaaaatatctcgcttccgggtccttcgataaatacgtgcacatctggaacactcagtcaggaagcctggtgcattcataccagggaacgggtggcatctttgaggtttgttggaatgcccgtggagataaggtaggcgcatctgcgtccgacggaagcgtgtgcgtgctggatttgtag

SEQ ID NO: 244439 - DNA, 1569 bp, Artificial Sequence
  Description of Artificial Sequence: Synthetic coding sequence
atgagtattacctccgatgaggtcaacttcctggtttataggtacctgcaggagtcaggcttcagccactctgcatttacctttggtatagaaagccacatctctcagtcgaatatcaatggtaccctcgtgcctccctccgctcttatttcgattctgcaaaaaggcctgcagtacgtcgaggcagagatctccatcaataaagatgggacagtgtttgactctaggcccattgagtcactgagcttgattgtggcagtcatacccgacgtagtgcagatgaggcaacaagccttcggagagaagctgacgcagcagcaggcctcagctgccgcaactgaggcctcagctatggctaaggccgctaccatgactcccgctgccattagtcagcagaaccctccaaaaaaccgggaagccaccgtgaatggagaagagaacggagctcacgagatcaacaatcatagtaagccaatggagatcgacggggacgtggagatcccacctaacaaggctacagtgctgagaggacacgaatctgaggtgtttatctgcgcatggaatccggtctccgatctcctggcatctggctcgggcgatagtaccgccagaatatggaacctaaacgaaaattcaaacgggggttcaacccaattggtactcagacactgcattcgggagggaggccacgacgtgccctcgaacaaggacgtgacctctctagattggaactctgacggcacgcttctggcaatgggcagctatgacggcttcgctaggatctggacagaaaatggtaatctggcttcaacgttgggacagcacaaagggcctatctttgcgctgaagtggaataaaaagggcaactacgtgctgagtgctggcgtggataaaacgaccatcatttgggacgcgcatacaggcgaggctaagcagcagtttcccttccattcggcccctgctcttgatgtggattggcagaacaacatgacctttgcctcttgttccactgacatgtgtatccatgtatgcaggctcggatgcgaccatcctgttaaaacgttccaagggcacaccaatgaagtgaatgcgatcaaatgggaccctagtggaatgctgcttgccagctgctccgatgatatgaccctgaagatttggtccatgaaacaggatgcctgtgtgcacgatttgcaagcacacagtaaagagatctacaccataaaatggtcaccgacaggccctgctacgtccaaccccaacagctctattatgttggcctccgcatcttttgactccacagttcggctatgggacgtagaacagggggtgtgcacccacaccttaatgaaacaccaggagcccgtgtattccgtggccttcagccctgatgggaagtacctcgcatctggatcattcgacaagtatgttcacatttggaatacccagtctggctccctggtgcatagttaccaagggaccgggggaatctttgaggtttgctggaatgcaaggggggacaaagtcggagctagtgcttcggacggctctgtgtgcgttcttgacttgtag

SEQ ID NO: 244440 - DNA, 1569 bp, Artificial Sequence
  Description of Artificial Sequence: Synthetic coding sequence
atgtccatcacctctgatgaggttaatttcctggtttaccggtatctgcaggaatccggcttctcgcactcggcatttacttttggtattgagtcccatatatcacagtccaatattaacggcactctggtcccaccgtcagcccttatttctattctccaaaaaggcctgcagtacgtcgaggccgaaatatcaataaacaaagacggaacagtctttgactccaggccaatcgagtctttgtcgctcatagtcgccgtgataccagacgttgtacagatgagacaacaagctttcggggagaaactgacccagcagcaagccagcgccgctgctaccgaagcttctgctatggcaaaagcggctacaatgacgcccgcagctatatctcagcagaatcctccaaaaaaccgtgaggcgacggtgaatggtgaggaaaatggtgctcatgagataaataatcactccaagccaatggagatcgacggcgacgtggagatccctccgaataaagccaccgtgctgagaggccatgagtccgaggtgttcatctgtgcctggaatcccgtctcagacctcctggcatctggctctggggattctacggccaggatttggaatctgaatgagaattccaatgggggatccacccagctcgtgctaagacactgtatccgggaggggggtcatgacgtcccttcaaacaaggatgtgacctcgctggattggaattccgacgggacacttcttgctatgggctcctacgacggcttcgccagaatctggaccgagaatgggaatctcgccagtacccttggccagcacaagggaccaattttcgctctgaaatggaataagaaaggcaattacgtgcttagcgccggagtagacaaaactaccattatctgggatgcccacactggcgaagctaaacagcagtttcccttccactctgctccggcactggatgtggactggcagaataacatgacatttgcctcctgttctaccgacatgtgtatccatgtgtgtaggctcgggtgcgatcatcctgtcaagaccttccaaggccacactaacgaagtcaatgctatcaagtgggatccttccggtatgcttctcgcttcttgcagcgacgatatgacgctcaaaatctggagcatgaagcaagatgcttgtgtgcatgacctccaggcacacagcaaggaaatctacacaattaagtggtctcccacaggccctgccacatctaatcctaattcctctatcatgttggctagtgcatcattcgactccacagttcggctgtgggatgtagaacaaggcgtctgcactcacactctcatgaagcaccaggagcccgtttattctgtggccttctcgcctgatggcaagtatctggctagcggctcctttgataagtatgttcacatatggaacacccaatctggaagcctggtccactcctatcaggggacaggcggaatcttcgaggtctgttggaacgcaaggggagacaaggttggtgcctccgcaagcgacgggtctgtttgtgtgctggacttgtag

SEQ ID NO: 244441 - DNA, 1095 bp, Artificial Sequence
  Description of Artificial Sequence: Synthetic coding sequence
atggagattgatggtgacgtcgaaatcccccctaacaaagccaccgtgttgcgcggtcatgaatctgaagtgtttatatgtgcctggaacccagtgtctgatcttctcgcgtccggctccggggactctaccgcaaggatctggaacctgaatgagaactctaatggaggcagcacccagctcgtgcttcgccactgtatacgggagggcggacacgacgtgccgtccaacaaggatgttaccagtctcgactggaactctgacggcaccttactggcaatgggctcctatgacggatttgcccgaatatggaccgagaacgggaatctggcctcaaccctgggacagcacaaaggacctatcttcgccctgaaatggaacaagaagggcaattacgtgctgtccgctggcgtggacaaaaccactatcatttgggacgcgcataccggcgaggctaagcagcagtttcccttccactctgctcctgccctggacgtcgattggcagaacaacatgacattcgcctcttgcagtaccgacatgtgcatccacgtgtgtagactcggatgcgatcacccagtgaaaacctttcaaggacatactaacgaggtcaacgccattaaatgggacccatccggcatgctcctggcatcttgttcagatgacatgaccctgaagatctggagcatgaaacaagatgcttgcgttcatgacttgcaagcccacagcaaggagatttataccataaagtggtcccccaccggacccgctacctcaaaccctaacagtagcatcatgcttgcatctgccagcttcgacagcacggtgcgcctatgggatgtggagcagggcgtgtgcacacacaccttaatgaagcaccaggaacctgtgtatagcgtagcttttagcccggacggtaaatacctcgccagtggcagctttgacaagtacgtgcatatctggaatacgcagagtggttccctcgttcactcttaccagggaaccggtgggatatttgaagtgtgttggaacgccagaggtgacaaagtgggcgcttcagcctcagacggctccgtgtgcgtgctggacctgtag

SEQ ID NO: 244442 - DNA, 1752 bp, Artificial Sequence
  Description of Artificial Sequence: Synthetic coding sequence
atgcctttgcgaaagatgaagattccatttctgttacttttcttcttatgggaggccgaatcgcatgccgctagccgcccaaatataattctcgtcatggctgatgacttgggtataggagatccaggctgctacgggaacaagactatcaggaccccaaatatcgataggctggctagcgggggagtgaaattgacacaacatctggccgcttctccactgtgtacacctagccgggcagcctttatgacgggtcgttaccctgtgcgcagtggtatggcctcctggtctcgtacgggagtgtttctatttacggcctcttcaggtggtctgcccaccgacgaaattacgttcgcaaaacttctgaaggaccagggctactcaactgccctgatagggaagtggcacttggggatgtcttgccatagcaagaccgacttttgtcatcatccgctgcatcacgggttcaattacttctacggaatttctttgacaaacctccgcgattgtaagcccggagaaggctctgtgttcactacgggcttcaagcggctagtcttcttgcccctgcaaatcgttggggtgaccttgctcactttagctgcactcaactgtcttggcctattgcacgtacccctgggcgtttttttttctctgctctttcttgctgccttaatcctaaccctatttttgggatttctgcattattttcgacctctgaactgcttcatgatgagaaattatgaaattattcagcagcctatgagctatgataacctcacacaaaggctgacagtggaggccgctcagtttattcagcggaatactgagaccccatttttgttagttctcagctatctgcatgtccacactgccctgtttagctctaaagactttgcaggaaagagccagcacggcgtgtatggagacgccgtggaggaaatggattggagcgtaggccagatcctgaacctactggatgaacttcgtctggccaatgatactctcatctatttcacaagtgaccagggagcccatgtagaggaggtctcttcaaagggcgagatccatggtggaagtaatggcatttataaaggagggaaagccaacaattgggagggaggcatccgggtgcctggtatactgaggtggccaagagtcattcaggccggacagaagattgacgaaccgactagtaatatggatatattcccaacggtggcaaagttggctggcgctccactgcctgaagacaggatcattgatgggagggacctgatgcctctactcgagggcaagtcccaacgcagcgatcatgagtttttgttccactattgcaatgcgtacctgaacgccgtcagatggcatccgcagaatagcactagcatctggaaggcctttttctttacacccaacttcaaccctgtcggttctaacgggtgtttcgcgactcatgtgtgtttctgctttggttcgtatgtgacacatcacgacccgccattgctgttcgatatctcaaaagacccaagggagagaaatcccttgacccccgcttccgaacctcgcttttacgaaatcctgaaggttatgcaggaggcggcagaccgccatactcagaccttgcctgaagtgcccgaccagtttagttggaacaacttcctctggaagccttggctgcagctctgctgcccatccaccggactctcctgtcaatgcgaccgcgagaaacaggacaaaagactctcacgctag

SEQ ID NO: 244443 - DNA, 1581 bp, Artificial Sequence
  Description of Artificial Sequence: Synthetic coding sequence
atgagcattaccagcgatgaggttaacttcctcgtctacagatacttacaggaaagcgggttctctcactcagctttcacttttggcatagaatcacatatctctcagagcaatattaacggtacccttgtgccacccgctgctcttatctcaatcctccagaagggactgcagtatgtagaagcagagatctctattaatgaggacggaactgtgttcgatgggaggccaatagagagcctatctttaattgatgcagtgatgccagacgtggtacagaccagacagcaggcctttcgtgagaaactggcccagcagcaagccagcgccgcagcagccgcagctgcagccacagctgccgcaacagctgcaaccactaccagcgccggtgttagtcatcagaatccatctaagaatcgcgaagctaccgtcaacggtgaagagaacagggcccattcggtcaataaccacgccaagcccatggagatcgacggcgaagtcgaaatcccatcctcaaaagccactgtgctcaggggacacgagagcgaggtttttatttgtgcttggaatccagtgagtgatctgctcgccagcggctctggcgactctactgcacggatctggaacctgaatgaaaattctaacgggggaagtacccagttggtgcttcggcactgcattcgagagggtgggcacgacgtaccgtccaataaggatgtgacaagcttagattggaacacaaatggaacgctgctggcaaccgggagctatgatggtttcgccagaatttggacagaggacggaaacctggccagcaccctgggtcagcacaaagggccaattttcgccctgaagtggaatcggaagggtaactatattctgagtgctggggtggacaagactacaatcatttgggacgctcacacaggcgaggccaagcaacagttcccctttcacagcgcccctgctctggatgttgattggcagaataatactactttcgctagttgcagtactgacatgtgcatccacgtatgtcgcttagggtgcgatcgccctgtaaaaacctttcagggccacaccaacgaggtgaacgccataaaatgggatccttcaggtatgctgctggcgtcatgttcggatgacatgactctgaaaatttggagtatgaagcaggaagtgtgcatacacgatttgcaggctcataataaagagatctatacaataaagtggagccctaccggccctgcaacatccaaccctaattctaatattatgctggcaagcgcttcctttgactctaccgtccgcctctgggatatcgagcgcggtgtttgtacccacaccctcactaagcaccaggagcctgtgtacagcgtggctttttcacctgacggcaagtacctcgcttccggctcgttcgataaatgtgtgcacatctggaacacacaatctggaaacctagtccacagttaccgcggaactggtggtattttcgaggtttgctggaatgctagaggggataaagtgggggcttccgcttctgacggcagcgtgtgtgtcctcgacctcaggaaatag

SEQ ID NO: 244444 - DNA, 1734 bp, Artificial Sequence
  Description of Artificial Sequence: Synthetic coding sequence
atgactgaactggctggagcaagctcttcgtgctgccaccgaccagctgggcgaggagcaatgcagtcggtgctgcaccactttcagcgcctgcgaggtagagagggcggttctcactttattaataccagctcaccacggggtgaggctaaaatgtccataacctccgatgaggtaaacttcttggtgtaccgttatcttcaagagagcggctttagccactcagcctttacttttggtatagaaagccacatcagtcagtcaaatatcaatgggacgttggtaccccctgcagcccttatcagcatcctccagaagggattgcagtatgtcgaagccgaaatttcaatcaacgaggatggcaccgtctttgacggcaggccaatagaaagcctatctctcatcgacgccgtgatgccagacgttgtgcagactcgccagcaagccttccgggagaagctggcacagcaacaagcctctgcagctgctgcggctgctgccgcaacagccgcagccaccgccgcaaccacaacctccgccggtgtgagccaccagaacccatcaaagaatagggaagcaaccgtcaacggagaagagaacagagcacacagcgtgaataaccatgcaaaaccgatggagatcgatggggaagtcgaaattccctccagtaaagcaaccgtgctgagaggccatgaaagtgaagttttcatctgcgcctggaatccagttagtgatctccttgcatctgggtcgggtgactcaacagcgcgaatctggaatctaaatgaaaattcaaatggcggatctactcagctagtgctgcgccattgcattcgggaaggaggccatgacgtcccctccaacaaggacgtgaccagcctggactggaacacgaacggcactctgctggccacaggcagttatgacggcttcgctcggatttggaccgaggatggcaacctggcgtcgaccctcggccagcataagggccctatctttgccctgaagtggaataggaaaggaaattacattttatccgcgggagtcgacaaaacaacgatcatttgggacgctcacacaggggaggccaagcagcagtttcccttccattctgctcctgctctggacgtagattggcaaaacaatactacttttgcgtcgtgcagtacagacatgtgcatacatgtgtgccgcctagggtgcgataggcctgtaaaaaccttccaagggcatacgaatgaagtcaacgctattaagtgggatccctccggaatgttgctggcttcctgctcagacgatatgacacttaagatctggtccatgaaacaggaagtgtgtatccatgaccttcaggcccacaacaaagagatttacacaatcaaatggagtcccacaggccctgccacttccaaccccaactcaaatatcatgctagccagcgcttcattcgactctacagtgagattgtgggatattgaaaggggcgtgtgtactcataccctgacaaagcaccaggaaccagtatatagcgttgcatttagcccagacggcaagtatctggcctcaggttcatttgacaaatgcgtgcatatatggaacacacagtccggaaatctggtgcacagctatcgtggcacaggcggaatattcgaggtgtgctggaatgccaggggcgataaggtcggggcttccgctagcgacgggagcgtctgcgtgctggacctgcggaaatag

SEQ ID NO: 244445 - DNA, 228 bp, Artificial Sequence
  Description of Artificial Sequence: Synthetic coding sequence
atgtcaatcacctctgacgaggtaaactttctggtctatcggtatcttcaagaatcaggattttcacatagtgccttcacatttggtatcgaatcacacatctctcaaagcaacatcaatggtaccctcgttcccccagccgcactcatcagtattcttcagaagggactgcagtatgttgaagcagagattagcatcaacgaggacggaacagtgtttgacggctag

SEQ ID NO: 244446 - DNA, 138 bp, Artificial Sequence
  Description of Artificial Sequence: Synthetic coding sequence
atgagcatcacatccgacgaggttaacttcctggtgtaccgctatctccaggaatccggcttctcccactcagcgtttacatttggaatcgaatcacacattagtcagtcaaacattaatggtactttggtgccatag

SEQ ID NO: 244447 - DNA, 1581 bp, Artificial Sequence
  Description of Artificial Sequence: Synthetic coding sequence
atgtccatcacaagcgatgaggtgaatttccttgtgtaccgctatctccaagagtccggcttctcacacagcgcttttacattcggcatcgagtcccacatttctcaatcaaacattaatgggactctcgtgcccccagccgcacttatctctatcctgcagaagggcctgcaatacgtcgaagctgagatttccattaacgaagacgggaccgtatttgatgggaggcccattgagtccctgtcactgatcgatgctgttatgccagacgtcgtccagactaggcaacaggctttcagagaaaaactggcacagcaacaggccagcgccgctgccgctgcagccgcagctaccgccgcagcaacggccgcaacgacaacctccgctggcgtttctcaccagaatccctctaagaaccgtgaagccacggtgaacggggaggaaaatagggcccattcagtgaacaatcatgccaagcccatggaaattgacggagaagtggaaatccctagtagcaaggctactgtactgcggggtcacgaatctgaggtgtttatttgcgcctggaacccagtgtccgatcttttggcaagcggctctggggattctacagcaaggatatggaatctgaatgagaactccaatggaggcagcacccagctggtgctccgacactgcattagggagggaggccacgacgtcccatctaacaaagatgtgacatcccttgactggaataccaatggcacactgttggcaaccggctcttacgacggctttgcccgtatctggaccgaagatggaaatctggctagcacacttggacaacataaaggcccaatctttgcactgaagtggaatcgcaaaggaaattatatcctttcagccggagtagacaagaccactattatttgggacgcccatacaggagaggccaagcagcagttcccatttcactccgctcctgccctggatgttgattggcagaacaataccaccttcgcctcttgctctaccgatatgtgtatacatgtgtgtaggctgggctgcgataggcctgtgaagacctttcagggccacaccaacgaagtcaacgccattaagtgggacccttctggtatgctcctagcttcctgctctgacgatatgacgctcaagatatggagcatgaagcaagaggtctgcattcatgacctgcaggcacataataaagaaatctatacaatcaaatggagtcccacaggccctgccacgtctaatcccaattctaatatcatgctggcatcagccagcttcgactcaaccgtgcgactctgggatatagaacgaggtgtgtgcactcacaccttaacaaagcatcaggaacctgtttatagcgtggccttttctcccgacggcaaatacctggcgagtggttcatttgataagtgtgttcatatctggaatactcagtccggcaacctggtgcacagttaccgaggcactggaggcattttcgaggtgtgttggaacgctagaggagataaggtcggcgctagtgctagcgatggctctgtatgcgttctggatctccggaagtag

SEQ ID NO: 244448 - DNA, 180 bp, Artificial Sequence
  Description of Artificial Sequence: Synthetic coding sequence
atgaccgagctggccggagcaagttcttcatgttgccatcggccagccggtcgtggtgccatgcaatctgtactgcaccacttccagaggttgagaggcagggaagggggatctcatttcatcaatacgagttctccaaggggggaagctaagatgtcaattacttctgacgaagtttag

SEQ ID NO: 244449 - DNA, 243 bp, Artificial Sequence
  Description of Artificial Sequence: Synthetic coding sequence
atgaccgagttagccggtgcgtcctcctcctgctgtcacaggcctgcaggtcggggagcaatgcaaagtgtgctgcaccattttcagaggcttcgtggcagagagggcggtagccacttcataaacaccagttcacccaggggagaagctaagatgagtattactagcgacgaagtgaattttctggtctacagatatttgcaggaaagcgggttctcccattccgcttttaccttcggctag

SEQ ID NO: 244450 - DNA, 1581 bp, Artificial Sequence
  Description of Artificial Sequence: Synthetic coding sequence
atgtccataactagcgatgaggtaaactttctcgtgtatcgttatctccaagagagtggtttcagccactcggcttttactttcgggatcgaaagccacatctcgcagtcgaacataaatgggacccttgtgcccccagcggctttgatctcaatcctgcagaaggggctccaatacgtcgaagccgaaatctccatcaatgaggacggaaccgttttcgacggtaggccaatcgagagcctttcactcattgatgccgtgatgcctgatgtggtgcagactaggcagcaggcattccgggaaaagctggctcagcagcaggcgtccgccgctgccgcagccgcagccgcaacagccgctgctacggccgctacgacaactagtgccggtgtgagtcatcagaacccctcgaagaaccgcgaggctaccgtcaacggcgaggagaatagggcacatagcgtgaacaaccacgctaaaccgatggaaatcgatggagaagtagagatcccgtcatcaaaagccacagtattgcggggtcacgagtcagaagtgttcatatgcgcatggaacccagtcagcgatttgctggcctcaggatccggagattccaccgctcgaatttggaatctgaacgagaacagcaatggcggtagcacccagctggtgcttcggcactgcattagggagggtggacatgatgtgccttccaacaaagatgtgacatctctcgactggaacacaaatggaactctgctggctacagggagttacgacggatttgctcgtatttggactgaggacggcaacctcgcctccaccttgggccagcacaagggtcccattttcgccctaaaatggaaccgcaaaggcaactacattctgtctgccggagtcgacaaaaccaccattatctgggatgcccacacaggggaagctaagcagcaatttcctttccacagcgcgccagccctcgatgttgactggcagaataatactacattcgctagctgcagtactgatatgtgtattcatgtatgtagactcggctgtgaccgtcccgtgaagactttccagggccacaccaacgaggttaacgccattaagtgggatccaagtggcatgctcctcgcctcgtgtagcgatgatatgacccttaagatttggagcatgaaacaggaggtctgcatacacgatcttcaggcccataataaggaaatctacaccattaaatggtctcctactggccctgccactagcaatcccaacagcaacattatgcttgcttcagcctctttcgacagtactgttaggctgtgggacattgaaaggggagtttgcacgcatacgctgaccaagcaccaggagcccgtatattccgtagctttttcacctgacggcaagtatctggcgagcggatcttttgataaatgtgttcacatatggaacactcagagcggaaatttggtgcattcttatcgtggcacagggggaatttttgaggtgtgttggaatgcacgaggcgataaggtgggggctagcgcaagcgacggaagcgtatgtgtcctggatctgagaaaatag

SEQ ID NO: 244451 - DNA, 1344 bp, Artificial Sequence
  Description of Artificial Sequence: Synthetic coding sequence
atggaacttagccagatgagcgagctcatgggcctgtcagtgctgctgggactgctggctctgatggcgacagctgccgttgcacggggttggttaagagctggcgaggagaggagcggacgccctgcctgtcagaaagctaatggttttccccctgacaagagttcaggtagtaagaagcagaagcagtatcagcgcattcgcaaagagaagcctcagcagcacaattttacccaccgtctcttggcggctgctctgaagtcccacagtggtaatatttcatgtatggatttttctagcaacggtaagtacctggctacatgcgccgatgatagaacgattcgcatctggtccaccaaggatttcctgcaacgggaacatcgttctatgcgtgctaatgtcgaattggatcacgccaccttggtgcggttcagtcctgactgtagagcctttattgtctggttagctaatggagacacgttacgagtcttcaaaatgactaaaagagaggatggaggatacaccttcactgctactccggaggatttccctaaaaaacacaaggccccagtaatcgatatcggcattgctaatactggcaaattcattatgaccgcatcatcagacactactgtgctgatctggagtctgaagggccaggtcctaagcactattaacacaaatcagatgaacaacactcacgctgccgtaagtccctgcggcaggtttgtggctagctgcgggttcactcccgatgtgaaagtctgggaggtgtgctttgggaaaaagggtgagtttcaggaggtggtccgagcctttgaactcaagggtcactcagcagccgttcacagcttcgccttttctaacgatagtagaaggatggcatctgtgtcaaaggatggcacatggaagctttgggacactgatgtagaatataaaaaaaaacaggatccatacctactgaagacaggcagatttgaggaggcggcaggagccgcaccatgtcgcctggcactctcaccgaacgctcaggtgcttgccttggcatccggcagctccattcatttatataacacgcggaggggtgagaaggaggaatgcttcgagcgtgttcatggagaatgcatcgcaaacttgagtttcgacatcacggggcgtttcctagccagctgtggggaccgggctgtgcggcttttccacaatactcccggtcacagagccatggtcgaggagatgcagggtcacctaaaacgggcaagcaatgagagcacacgccagaggcttcagcagcagctaacccaggcccaggagactttgaaatctctgggagctctcaagaaatag

SEQ ID NO: 244452 - DNA, 1341 bp, Artificial Sequence
  Description of Artificial Sequence: Synthetic coding sequence
atggagctgtcacagatgtctgaactgatgggattgtccgtccttctcggcctgcttgccttgatggcaacagcagccgttgcacggggatggctgagagctggagaagagaggagcggaagaccagcctgccagaaggctaatgggttccccccagacaagagttcagggagtaagaagcagaaacagtaccagcggatccggaaggagaagccacagcagcacaattttacacatagactactggcagcagccctaaaatctcattctgggaacatctcgtgcatggatttctcatcaaatggcaagtacttagctacgtgcgccgacgacaggacgatcagaatttggagtactaaagattttctccagagagagcatcgctcgatgagagcgaatgtcgagctggatcatgccactctggtgcgattctctcccgactgccgtgcgttcatcgtctggcttgccaatggtgacacactgcgggtgttcaaaatgacaaagcgagaagacggagggtatactttcactgccacccctgaagacttccccaaaaaacataaagccccagtcattgacataggcatcgccaataccggtaaatttatcatgactgcaagctctgatactacggtcttaatctggtcccttaaggggcaggtcctcagtacaatcaacactaatcagatgaacaatacacatgctgcggtttccccgtgcgggagattcgtggcaagttgcggtttcacacccgatgtgaaggtctgggaggtgtgctttgggaagaagggcgagtttcaggaagtggtgagagcgttcgaactgaagggccacagcgcagcagtgcactcttttgcgttttccaacgatagccgtaggatggccagcgtctccaaggacggtacttggaaactatgggatacagatgtcgagtacaaaaagaaacaagacccttatctgttgaaaacaggcaggttcgaagaggctgcgggagctgccccatgtaggttggctctctccccaaacgcgcaggtgttagccctggcatcaggttccagcattcatctttataacacaaggaggggagagaaggaggagtgcttcgaacgggtccatggtgagtgcatcgctaacctgtcctttgatatcacagggagattcttggcctcttgcggagatagagccgtccgcttgttccacaacactcctggtcaccgggcaatggtagaggagatgcagggacaccttaaaagagcttcaaatgagagcacaaggcagagattacagcaacagttgacgcaggcccaggtgaccctggggggacccggagcggaggactag

SEQ ID NO: 244453 - DNA, 2427 bp, Artificial Sequence
  Description of Artificial Sequence: Synthetic coding sequence
atggcggaaactgcagcaggggtggggagattcaaaaccaactatgctgttgagaggaagattgaacccttctacaagggcggaaaggctcagctggaccagactgggcagcacctgttttgtgtctgtggaacacgggtgaatattctggaggtcgcatccggggctgtcctgcgaagcctggagcaggaggaccaggaagacattactgcctttgacctgtcccctgacaacgaggttctggtgacagcctctagggctctccttctcgctcagtgggcctggcaggaaggaagtgtgactcgtctgtggaaggctattcacaccgcgccagttgccacaatggctttcgacccgacatccacccttctcgccactggcggttgtgatggcgctgttagagtgtgggatatagtcagacattacgggacccaccactttagaggatctcccggagtagtgcatcttgtggctttccacccggatcctactagactcctgctgttttctagcgccactgacgccgctattcgggtttggtctctccaagatcgttcttgtctggccgtgctcacagctcactactctgccgtgaccagcttagcatttagcgcagatggacataccatgttgtccagcggacgcgataagatttgtataatctgggacttgcagtcttgccaggccaccaggacagtaccggtctttgagtcagttgaggctgccgtgttgctgcctgaggagcccgtgagccaactgggggtcaagtctcccggtctgtattttctgacggccggagatcaaggtaccctacgggtgtgggaagcggcaagcggccaatgtgtatacacacaggctcagcctccaggtcctggccaggagctgacgcattgtacgttggctcacacagcaggggtggtgctgaccgcaaccgcggatcataacctgctgttatacgaggcccgttcattgagactgcagaaacagtttgccggatacagtgaagaggtcctggatgttcggtttctgggccctgaagattcccatgtcgtggtcgccagcaacagtccctgtcttaaggtttttgagcttcagacgtccgcgtgccagattctgcatggtcacaccgacatcgtgttagccctggacgttttccggaagggctggctgttcgctagctgtgcgaaggatcaaagtgtgaggatatggagaatgaataaagctgggcaagtcatgtgcgttgctcagggcagtggtcatacacatagcgtcggcacagtctgctgttcgcgtctgaaagagtctttcctggtcactggtagccaggactgcacagtaaaattgtggcccttgccgaaagctttgctgtccaaaaataccgcccctgacaacggcccaatcctcctccaggcccagaccacccaacggtgccatgataaggatatcaactctgtagccatagctccaaatgacaagctcttagccactggctctcaagaccgcacggctaagctgtgggccctaccacagtgccaactcttaggcgtcttttcgggtcaccgcaggggcctgtggtgtgtgcagttctcaccaatggaccaggtcctggctacagcttcagccgacggcaccatcaagctttgggctcttcaggatttcagttgtctgaaaacgttcgaagggcatgacgctagtgtgctcaaggtggcttttgtctcaagaggaacacagctgctcagtagtggaagtgacggactggttaagctttggacaataaagaacaatgagtgcgtaagaaccctcgatgcccatgaagacaaagtctgggggctccactgctctcggctcgacgatcacgccctgacaggggcaagtgactccagggtgatcctgtggaaggacgtgacagaggccgagcaggccgaggaacaagcccgacaggaagaacaggtggtgaggcagcaggaactcgataacctcttgcacgagaagcgatacctgagagcactgggattggccattagcctggatcgaccccatacggtgctcactgtgatacaggcgatacgtcgcgacccagaagcctgcgagaaactcgaagctaccatgctgcgacttcggagggaccagaaagaggccctgttgcggttctgcgttacatggaataccaattctcgacactgccatgaagcacaggctgttctgggcgtcctgctccggagagaggcccctgaagagctccttgcatacgaaggtgtcagggcagccctcgaggcattgcttccctatactgagagacacttccagagactgtctcgaactcttcaagccgctgcctttctggatttcctctggcacaatatgaaacttccggtacctgcagcagcacccacgccatgggagacacacaagggggctctaccttag

SEQ ID NO: 244454 - DNA, 2427 bp, Artificial Sequence
  Description of Artificial Sequence: Synthetic coding sequence
atggccgaaacggccgcaggcgtgggcagatttaagactaactatgccgtggagcgcaaaattgaacccttctacaagggcggtaaggcccagttggaccaaacgggccagcacttgttttgcgtctgcggtacccgcgtgaacatcctcgaagtggcgtcgggagctgtcctccggtccctggaacaggaggaccaggaggatataacagccttcgacctgagcccagataacgaagtgctggtcaccgctagtcgggcacttctgctggcacaatgggcatggcaggagggttctgtgacacgcctgtggaaggctatccatacagcaccagtcgccacaatggccttcgacccaacctctactctactggccactggaggatgcgatggagccgtaagggtctgggatatagtccgccactatggcacccaccactttcgcggatcccctggagtggtgcacttagtggcctttcatccggacccaaccagattgctcctgtttagttccgctacggacgcggctatccgggtgtggagcctccaggaccggagttgcttggcggtgctcaccgcccactattctgccgtgacctccctcgccttctccgccgacggccataccatgctttcttcaggccgtgacaaaatatgtatcatttgggacctgcagtcatgccaggcgacgcggaccgtacccgtcttcgaatcggtcgaagccgctgtgcttctgcccgaggagccagttagtcaacttggtgtcaagtccccaggactctactttctgaccgcaggggaccaggggactctgagggtatgggaggctgcatcaggccaatgcgtttacacccaggcccagcctcctggcccaggccaggagctgactcattgcactttagcgcatacagctggggtcgtgctcacagccacagcagaccataacttactgctgtatgaagcccgttctctccggcttcaaaaacagttcgccggttactcagaagaagttcttgacgtacgcttcttggggcctgaggactctcacgttgtagtggcctctaatagcccatgcctcaaggtatttgagctgcagacctcagcttgccagatcctgcatgggcataccgacatcgtccttgcattggatgttttccgcaagggctggctgttcgcaagttgtgcaaaagatcagtcggttagaatctggagaatgaacaaagccggacaagtgatgtgtgttgcccagggcagtggacatacacatagcgtgggcactgtgtgctgctcaagactcaaggaatcatttcttgtgaccggaagtcaggactgcaccgtgaagctctggcccctccccaaggcgctgctgtctaagaacacagcacctgacaatggccctatcctgctccaggctcaaaccactcagagatgccacgataaggacattaactctgtcgctatcgctcccaatgataagctcctagcaacaggttctcaggacagaacggccaagctatgggccctcccgcagtgccagctcctgggcgtgttttctggccaccgcagaggcctgtggtgcgtgcagttttctccaatggaccaagttctagccaccgccagcgcagatggaaccatcaagctgtgggccttgcaggatttttcctgcctgaaaacctttgagggtcacgatgccagcgtgctcaaggttgcgttcgtgagtagaggtactcagttactgtcctccggatcggatggcttagtgaagctgtggactattaagaataatgagtgtgtgaggactctcgacgctcatgaggacaaagtatggggcctccactgcagtagactggatgaccatgcactgactggtgccagcgatagccgggttatcctgtggaaagacgtgactgaggctgaacaggccgaagagcaggctcggcaggaagaacaggtcgtgagacagcaggaattggataacctgttgcacgagaaaaggtatctgcgggctctgggtctggccatatccctggacaggccccacacggtacttacagtgatccaggcaatcagacgggatcctgaggcttgcgaaaagttagaggccactatgctccggttgaggcgggatcagaaagaagcattactccgcttctgcgtgacctggaacaccaattcacgccattgccatgaggcacaggcggtgctgggtgtgcttctgagacgtgaggctcctgaggagctgctcgcctatgaaggcgtgcgggctgccctagaagctctccttccctacactgaacggcattttcaaaggctgagtaggactcttcaggcagctgcctttctcgatttcttgtggcacaacatgaaactgcctgtgccagctgcagctcccacaccatgggagacccataagggggcattgccctag

SEQ ID NO: 244455 - DNA, 729 bp, Artificial Sequence
  Description of Artificial Sequence: Synthetic coding sequence
atgtttcctcagagccgccaccccactccccaccaggctgctggccagcccttcaaatttacaatccccgagtccctggaccgcatcaaagaggaattccagtttttgcaggcccaataccattccctgaagttggaatgtgagaagttggccagtgagaaaaccgagatgcaacggcattacgtgatgtattatgaaatgtcctacgggttgaatatcgagatgcacaagcagaccgagattgccaaacggttgaatactatatgtgcccaggtcattccattcctgtcacaggagcatcaacagcaggtcgcgcaggccgtggagagggcaaagcaggtcacaatggctgagctaaatgccatcattggcgtcaggggtcttcccggactgcctcccacacagcagcagctgcaggctcaacatctctctcacgggcacggtccgcctgttccacttactccacatcctagtgggctgcagcctccaggcatccctcctttagggggtagcgccggactgttggctttgagttccgcgttgtccggccaatcacacctcgccattaaagacgacaaaaagcatcatgatgcagagcaccacagaggtgagcgaccaggaaagagtaattccttgctcgtccccgattccctcaggggcacagacaagagaagaaatgggcctgagttttcaaacgacatcaagaagcggaaagtcgacgacaagtag

SEQ ID NO: 244456 - DNA, 435 bp, Artificial Sequence
  Description of Artificial Sequence: Synthetic coding sequence
atgcaacgacactacgtgatgtattacgagatgagttacggccttaatattgagatgcacaagcaaaccgaaattgcgaaaaggctgaacaccatttgtgctcaggttatcccctttctgtctcaggagcatcagcagcaggtcgctcaagcagttgaacgtgctaagcaggtcacaatggctgaactaaacgcaattatcggacagcaacagctccaggcacagcatctctcacacggacacgggcctccggtgcctttaactccccatccgtctggcctgcagcctcccggaattcccccattagggggatccgctggcttgctggccctctcttcagccttatcaggacaatctcatctcgctattaaggatgacaagaaacaccacgatgctgagcaccaccggggagaaagacctggaaaacccgattag

SEQ ID NO: 244457 - DNA, 384 bp, Artificial Sequence
  Description of Artificial Sequence: Synthetic coding sequence
atgcccacgccaggaacttcagccactcccggtctgaggccgggtttgggtaagccgcctgcaatcgatcctctggttaaccaggcggctgccggtttaaggacacccttagccgtccccggaccataccccgctcctttcggtatggtacctcatgccggaatgaatggcgaacttaccagccccggagcagcatacgcatctcttcacaacatgagcccccaaatgtccgcagccgcagcggcagcagctgtagttgcctacggccgaagccctatggtggggtttgacccccctccacacatgagggttcccactataccgccaaacctggctggaattcccggtggtaaacctagcctggtaccagcacccgctcactag

SEQ ID NO: 244458 - DNA, 384 bp, Artificial Sequence
  Description of Artificial Sequence: Synthetic coding sequence
atgcctacgcctggtaccagcgccactcccggtctgcggccaggcctggggaaaccacccgcaatcgaccctttagtaaatcaggcagctgccggattgcgaactcccctagccgtgcccggaccctaccctgctcctttcggcatggtgccacatgccggaatgaacggggagctgacgtctcccggagcagcttacgcatccctccataatatgagccctcagatgagcgccgctgccgctgcagctgcagtggtggcatatggcagaagcccgatggtaggcttcgatccacccccacatatgcgtgtgccaacaataccacccaatctggcaggtattccaggcggtaaacctagcctggtccccgcaccagctcactag

SEQ ID NO: 244459 - DNA, 2313 bp, Artificial Sequence
  Description of Artificial Sequence: Synthetic coding sequence
atgttccctcagagtaggcaccccacaccacaccaggccgcagggcaaccgttcaagtttacaatacctgagtccctcgacagaatcaaggaggaatttcaattcctgcaagctcagtaccactccttaaagctggagtgcgagaaactggcctctgagaaaactgaaatgcagagacactacgtgatgtattatgaaatgtcttatggtctgaatattgagatgcacaagcagaccgaaatcgcgaagcggctgaacactatatgcgcacaggtgattccatttctgtctcaggagcaccaacagcaagtggctcaggctgtggagcgcgctaaacaagtgaccatggccgaactgaacgccattatcgggcagcagcagctccaggcgcaacacctgtctcatggacatggccctccagtgcccttgacacctcaccctagcggactccagcctcctggaatcccacccctagggggatctgctggcctcttagcactgagcagcgccttgtctggtcagagtcacctggctatcaaagacgacaaaaagcaccatgatgctgagcaccaccgcgacagagagcctggaacttccaacagtttactggtacccgacagcttgaggggaaccgataagaggcggaatgggcctgaattttctaatgatatcaaaaaacggaaggtagatgataaggacagcagccattatgatagcgacggcgataaaagtgacgacaacctggtagtggatgtttctaacgaggacccaagcagtcctagagcgtctccagcccattcccctagagagaatggtatagataagaacagattgctcaaaaaggacgcttccagctccccagccagcacagcctccagcgcctcttcaacgagcttgaagtcgaaggagatgtcacttcatgagaaggcaagtacccctgtcctcaagtctagcacccctacgcctaggtcagatatgcccaccccaggtacatccgccactccagggttacgaccaggattgggcaaaccaccagctatcgaccctctggtgaaccaggcggcagccggtttacgtactcccctggccgtgccaggaccctacccagctccctttggaatggttccccatgccggaatgaacggcgaattgacgtccccaggcgcagcctacgcatctctgcacaatatgagcccccagatgagtgccgcagccgcagccgcagctgtcgtagcctatggccgaagtcctatggtgggcttcgaccccccaccacacatgcgggtcccgactatcccccctaatctggccggaatcccaggcggaaagccagcatactcctttcacgttactgctgatgggcagatgcaaccagtaccctttcctccagacgctcttatcggcccaggcatacccaggcatgcaagacaaatcaataccttgaatcacggcgaggtagtctgcgcagtgaccatctcgaatcccaccagacacgtgtataccggaggcaaaggctgcgttaaggtgtgggacatctcccatcccggtaacaagtcacccgtgagtcagttggattgtttgaaccgggacaattacattaggagttgcaagttgctccccgatggttgcacactgatagtgggaggggaagcctcaacactctccatctgggacctggccgctccaacgccccgaattaaagctgaactcacgagcagtgcgcctgcttgctacgctcttgctatatcccccgattctaaggtctgttttagctgctgtagtgacggtaacattgcagtgtgggatctccataatcagactttagtgaggcagtttcaaggccacaccgacggggcttcctgtattgacataagcaacgacggcacaaagctttggactggcggactggataacacggtgcggtcatgggatctcagggagggccgtcaattacagcagcacgactttacctcgcagatcttttccctcggttactgccctaccggtgagtggttggcagtgggaatggaatcgagcaatgtggaggtcctgcacgttaacaagccagacaagtaccaactccacctgcatgagtcttgtgtgttgagtctgaaattcgcatactgcggcaaatggttcgtgagtactggcaaggataacctgctaaacgcctggcgcactccttacggcgcaagcatctttcagagcaaagagtcaagttcagtcctgagctgtgacatcagcgtggacgacaaatatatcgtcacaggatctggcgacaagaaggcaacagtgtatgaagtgatttattag

SEQ ID NO: 244460 - DNA, 729 bp, Artificial Sequence
  Description of Artificial Sequence: Synthetic coding sequence
atgtttccccaatccaggcaccctactccacatcaggcggctggccagcccttcaaattcacaatcccggagtctcttgacaggattaaagaagaatttcagtttctccaggcccagtatcatagcttaaaacttgagtgcgagaagctggcaagcgaaaagaccgagatgcagcgtcactacgtcatgtactacgaaatgtcatacggattaaatatcgaaatgcataaacaaacagagatcgccaaacggcttaataccatctgtgcacaggttatccctttcctctcccaggagcaccaacagcaggtggcccaggcggtggagagggccaaacaagttacgatggccgagctgaatgcgataataggcgtgcgaggtctgccgggtctaccaccaactcaacagcagctgcaggcacaacatctctcacacgggcacggacccccagtgccactgacaccacatcccagcggactgcaaccccctggcattcctcctttgggtggttctgcaggcctgctcgccctgagttcagcgctctctgggcagtcacacttggctattaaggacgataagaaacatcatgatgccgaacaccaccgagaccgcgagccgggaacctctaacagcctgctggtgcccgactccctgcggggtacagacaaaagaaggaacggaccggaattttccaacgacatcaagaaaagaaaggtggatgataagtag

SEQ ID NO: 244461 - DNA, 2121 bp, Artificial Sequence
  Description of Artificial Sequence: Synthetic coding sequence
atggtccaatcccgcctgactgccacttcggcctcccaggactctccggctagtggcctccagaccccactgcagtctggtcagccattcaagttcagtatcctcgaaatctgtgatagaattaaagaggagtttcagttcttacaggcacagtaccattcccttaaactggaatgcgagaaactcgcgtctgaaaagaccgagatgcagaggcattatgtaatgtattacgagatgtcctatggactgaatattgaaatgcataagcaggcagaaatcgtgaaacggttgagcggtatttgcgctcagatcattccttttttgactcaggaacaccaacagcaggtcctgcaggccgtcgagagagcgaaacaagtaacggtcggagagctcaacagcctgattggacagcagcaactgcagcccctttcacaccatgctcccccagtgcctcttaccccccgaccagccggacttgtgggcggatcagcaacaggactgctggcccttagcggggctctagctgctcaagcgcagctggctgcggcagtaaaagaggatagagccggagttgaggcagaaggtagccgggtggagcgagccccaagcaggtcagcttcgccatctccccctgagtccctggtagaggaagagcggccttcgggcccaggaggcggaggcaagcaacgagcagatgaaaaagaaccctctggaccttacgaaagtgacgaggataaatccgactacaatctcgttgtggatgaagatcagcctagtgagccaccaagcccggctaccaccccttgtggtaaggtccctatttgtatccctgcgagacgggacctggtcgactcccccgctagcctggcctcctcactcggatcaccgcttccgagggcaaaggaattgatcctgaacgatctgccagcaagcacaccagctagcaagtcctgtgattccagcccacctcaggacgccagtacacctggtccctccagcgctagccacctgtgtcagcttgccgctaaacccgcaccctcaactgactccgtagccctccggagcccactcaccctgagctccccttttaccacctccttctcgttggggtcacacagcactctcaatggcgatctatccgttcccagctcatacgttagtcttcacctgagcccccaagtgtcaagttccgtcgtgtatggccgttcccccgtcatggcctttgaatcgcacccccatctaaggggatctagtgtgtcctcttctttgccctccatccccggtgggaagcccgcttactccttccatgtatctgccgacgggcagatgcagcctgtgccttttccatccgacgcccttgtcggggcaggcattcccaggcacgctcgtcagttgcataccctggcccacggtgaggtcgtatgtgcagtcactatctccgggtctactcagcacgtgtacacgggcggtaaaggatgtgtgaaggtctgggatgtgggacagcctggcgctaagactcctgtcgcccaactggactgcctgaaccgagataactacattcgctcttgcaagctgctccctgacggacggtctctaatcgtgggtggcgaggcttccaccctgagtatttgggacctggcagcccctactccgaggataaaagctgagctgactagtagtgctcctgcttgctacgccctggctgtgtctcccgacgccaaggtgtgtttttcttgctgtagtgacgggaatattgtcgtgtgggatttacagaaccaaacgatggtcagacaatttcaaggccataccgatggagccagctgcattgacatctcagactacggtacccgcctctggaccggcggactggataacacggtgaggtgctgggatcttagggaaggacgccagcttcaacagcacgacttcagtagccagatcttcagtctgggtcattgtccaaaccaggattggctggccgtgggtatggagtctagtaacgttgaaatccttcacgtccgcaagcctgaaaaataccagctgcacctgcatgagtcctgtgtgctgtctttgaagtttgcgtcatgcgtccagggagtcgtcttgagtcctgaactgtag

SEQ ID NO: 244462 - DNA, 2232 bp, Artificial Sequence
  Description of Artificial Sequence: Synthetic coding sequence
atgtacccgcaggggagacacccaactccattgcagtctggccagccatttaagttttcgattctagagatatgcgataggatcaaagaggaattccagttcctgcaagctcagtatcattccctcaagctcgaatgtgagaaactggcctcagaaaagactgagatgcaacggcactacgtcatgtactatgagatgtcatacggtttgaacatagagatgcacaaacaggcagagattgtgaaacgactctccggcatttgcgcacagattatcccgttcctgacacaggaacaccagcagcaggtcctccaagctgtcgaacgggcaaaacaggttacagtcggtgaactcaatagcttgatcggacaacagctgcagcctctcagccaccacgctccgcctgtccccctcacccctagaccagcgggtttggttgggggtagcgcaacggggctgttggccctgtccggcgctcttgccgcacaggcacagctcgcagcagcagtaaaggaagacagggctggagtggaggctgaaggaagtagagtcgagcgcgctccgtctcgatccgccagtccgagccccccagaaagcctcgtggaagaggaacgtccttccggaccagggggaggagggaaacagcgcgctgatgagaaagaacccagcggtccatacgagagcgacgaagataaatccgactataatctggtggtagatgaagatcaaccttccgagcctccctcccccgcaaccacaccttgcgggaaagttcccatctgcatcccagccagacgggacctggttgattctccggcatcgttagcatcctccctggggtcaccattaccaagagccaaagaactaattcttaacgatttaccagcctctacacctgcgagtaaatcatgcgacagctcacctccacaagacgcaagcaccccagggccttcctcagcatctcacctctgccagctggctgccaaacctgcacccagtacagacagcgtcgctctgaggtccccattgactctgtcttccccatttacaacttctttttctctgggctcccattcaacactgaatggcgatttgagcgtgcccagcagctatgtgtctctacacctgagcccacaggtatctagctcagtggtctacggccgtagtccggttatggcattcgagagtcatcctcaccttaggggaagctcggtatccagctcactgcctagcatccccggaggtaaaccagcatattcctttcacgtgtcagcagatggacagatgcagccggtgccttttcctagcgacgcattggtgggggctggcatccctcgccacgcacgtcagttgcacacgttggcacatggagaagtcgtgtgcgccgttaccatttcaggctcgacacagcatgtgtacacgggcggtaaggggtgtgttaaagtgtgggacgtcggccagccaggtgctaagaccccagtggcccaactggactgtctcaatcgcgataactatattaggagttgtaagttgcttcctgacggacgtagtctgattgtgggcggagaggccagcaccctgagcatttgggatctcgcagcgcctaccccgagaattaaggctgaactgacttcttctgcacctgcctgctatgctctcgctgtgagtcctgacgcaaaagtgtgttttagctgctgctcggatggcaacatcgtggtctgggacctgcagaaccaaaccatggtccgacagttccagggacataccgacggggcatcttgcatcgacataagcgactacgggacccggttatggaccggagggttagacaacacagtgaggtgctgggacttacgggaaggccgtcagctacagcagcatgattttagcagccagatcttttccctgggccactgccccaaccaggattggctcgcggttggcatggagagtagcaatgtggagattcttcacgtgaggaagcctgagaaataccagctgcacctccatgagagctgtgtactgtctcttaagttcgcatcgtgtggtagatggtttgtatcaaccggtaaggacaatctgcttaacgcttggcggactccatacggggcttccatctttcagtccaaggaatccagttccgtgctgtcatgtgacatctctaggaataataagtatatcgtcactggtagcggtgataaaaaagccacagtctatgaagtagtttactag

SEQ ID NO: 244463 - DNA, 879 bp, Artificial Sequence
  Description of Artificial Sequence: Synthetic coding sequence
ctggcacatggagaagtcgtgtgtgctgtgactatcagcggctccacacaacatgtatacacagggggaaaaggctgtgtgaaagtctgggatgtagacggcgctgttttcgcaggccagcgcggaggggctcaccaaccgattcgcaatagggacaactacatccggtcttgtaaattactacccgacggaagatctttgatcgtggggggtgaggcgagcacgctatccatctgggatttggccgctcccacccctcgaatcaaagccgagctaacgtcttccgctcccgcttgttatgctctggccgtatcaccagacgctaaggtctgcttttcctgctgttcagacggtaatatcgtcgtctgggacctgcagaaccagactatggttcggcaattccaaggacacacggatggcgcttcctgcatagacatcagtgactacggtacgcgtctgtggacaggcggacttgataacaccgtccgatgttgggacctgcgggaaggacggcagctccaacaacatgactttagttcccagatcttctctctcggccactgcccaaatcaggactggctagccgtcgggatggaaagttcaaatgtggagatcctgcatgtacgcaagccggagaaatatcaactacacttgcacgaatcttgcgtgttatccctaaagttcgcctcctgcggacggtggtttgtgtccactgggaaggacaatctgctgaatgcctggaggactccctatggagcatccatcttccagtccaaagaaagcagcagtgtcctttcctgtgacatcagtagaaacaacaagtacatcgttaccggatccggcgataaaaaagccacagtgtatgaggtagtgtattag

SEQ ID NO: 244464 - DNA, 2121 bp, Artificial Sequence
  Description of Artificial Sequence: Synthetic coding sequence
atggtgcagagccgtcttaccgccacctccgcttcacaggactcacccgctagcgggctgcaaaccccactccagtctggtcagcccttcaagttttccatcttagagatttgcgaccggatcaaagaggagttccaatttttgcaggcacagtaccactccttgaaactcgagtgcgagaagctggcaagcgagaagactgagatgcagaggcattacgtgatgtactacgaaatgagctatggcttaaatatcgagatgcataagcaggctgaaatcgtgaagagactgtctgggatttgcgcccagataattccatttctgacccaggaacaccagcagcaagtgctgcaagcggtcgagagggctaaacaagtcaccgtgggagagctgaatagtttaatcggacagcagcaactgcagcccctgagtcaccacgctccgcctgtgcccctgacccccaggccggcaggactggtgggcggatcagcgaccggactgttggccttgtctggcgcactcgctgcacaggctcagctcgccgcagctgtgaaagaggatagagctggggtcgaagccgaaggtagccgggttgagcgagctccttcacgatctgctagtccatctccccctgagtcgcttgtggaagaagagcgacctagtggacctggcggagggggtaagcagagagctgatgagaaagagcccagtggaccgtatgaatctgacgaggataagtccgactataaccttgtggttgatgaggaccagccctccgagccaccttcccctgccacaactccttgcggcaaggtgcctatttgcattcccgctcgtcgtgacctggtcgattcccccgcttctctggcatcatcactgggctctcctctcccacgcgctaaagagttgatcttgaacgatctgccagcatcaacccccgctagtaagtcatgcgatagctccccccctcaggatgcatctacgcccggtccaagcagcgcaagccatctatgccagctggctgccaagccggcaccaagcactgactctgtggcccttcgtagccccctgaccctgtcctcgccgtttacaactagtttttcccttgggtcacactctacgcttaacggtgacctgtccgtgccatccagttatgtgagcctgcatctttcaccccaggtgtcatctagcgtcgtatacgggaggagccccgttatggccttcgaatcacatccacacctgcgcggaagttccgtatcttcgtccctaccaagcattccagggggtaagccagcatacagcttccacgtcagcgccgatggccagatgcagcctgtccctttcccatcggatgcactagtgggagcagggatcccccgtcacgcacgccaactgcacacacttgcccacggagaggtggtgtgcgcagttacgatctcaggatctacacagcatgtctacaccggaggcaaggggtgtgttaaagtctgggatgtgggccagccaggggctaaaacgccggtcgctcagctggattgtctgaacagggataattatatccggtcttgtaaactcttaccagatggccgaagtttaatcgttggcggtgaagcctcaacactgtctatctgggacctggcggcacctacccctcgtataaaggccgagctgacatcaagtgcaccagcatgctatgccctggccgtgtccccagacgcaaaggtgtgtttctcgtgttgttctgatgggaatatagtggtatgggacctccaaaatcagactatggtacggcagtttcaagggcacactgatggtgcctcgtgcattgatattagcgattacggaaccaggctatggaccggcggtctggataacaccgttcgttgctgggacctgcgtgaggggaggcaactccagcagcacgatttcagcagccagattttcagccttgggcattgcccaaatcaggactggttggcagtgggtatggagtcctccaatgttgaaatcctccacgtgcgcaagccagaaaagtaccagctgcatttgcacgagtcgtgcgtgctatcactaaagtttgccagctgcgtccagggagtcgtactgtcccctgagctctag

SEQ ID NO: 244465 - DNA, 1083 bp, Artificial Sequence
  Description of Artificial Sequence: Synthetic coding sequence
atgtaccctcagggcaggcacccaaccccactacagtcgggacaacccttcaagttttccatcctggagatctgcgaccgaattaaggaggagttccaatttttacaggctcagtatcacagcctaaaactagaatgcgagaaactggcgtctgagaagactgagatgcagcgacattacgtaatgtattacgaaatgtcctacgggcttaacatcgaaatgcataaacaagccgagatcgtaaagagactctccggcatctgcgctcagattatcccattcttgacacaggagagcgcctcccccagccccccagagtcactcgtcgaagaggaaagaccctctggaccagggggaggaggaaagcagagagcagatgaaaaggaaccttccggcccatatgaatctgacgaggataaaagtgactacaacctagtcgtggacgaagaccagccatcagaaccacctagcccagcgacaactccttgcggcaaggtccccatttgcattcctgcacggcgagacctcgtggactctcctgccagcctcgcctcttcactgggttccccactgccgagggccaaagagttaattctgaatgatcttcccgcatcgactccagcctccaaaagctgtgactcctcgcccccacaggacgcatcaacccctggcccaagcagcgcatcacatctgtgtcagcttgccgctaaaccagctccttctacagacagcgtggctctgcggagtcccctgaccctgtcctccccctttactaccagtttttccctaggctcgcacagcacgttaaacggcgatttgagtgtaccttccagttatgtgagcctgcaccttagcccgcaggtatctagcagcgtcgtgtacgggaggagtccagtcatggcctttgaatcccacccacaccttagaggctctagtgtaagttccagtctgcctagtatccctggaggaaaaccagcttattcttttcatgtgtccgctgacgggcagatgcaaccggtcccatttcctagcgatgccctggtcggggcaggcattcccccatggccctcatctaccgcctag

SEQ ID NO: 244466 - DNA, 1866 bp, Artificial Sequence
  Description of Artificial Sequence: Synthetic coding sequence
atgcagcgacactacgttatgtactacgagatgtcatacggcctgaacatcgaaatgcacaagcaggcagagatagtgaaacgtctttctggcatttgcgcccaaattatcccgttcctaacacaggagcaccagcagcaggtcctgcaagcagtagagcgagcaaagcaggtgaccgtcggagagctgaattctcttattgggtctgcttccccttctccaccggaaagccttgtggaagaagagcgtccttccgggcctggaggaggaggcaagcagagggctgatgagaaggagcctagcggaccttacgagagcgacgaggacaagtccgactataatctggtggttgatgaagatcagccatcagaaccccctagccccgcaaccacaccctgcggcaaggttcctatctgcatacctgcgaggcgagacctggttgattctccggcttctctggcctcatctctcggctcccctcttcctcgcgctaaagaattaattctcaacgatttgccggcttcgaccccagcctcgaagtcctgtgacagttccccaccccaggacgcctcaaccccaggaccttcctccgcttcacacctctgccaactagcggctaagccagcacccagcacagactcggtggctcttaggagccctctgaccttgagcagtccatttactactagtttctccctcggcagtcattcaactttgaacggggacttgtcagtaccatcatcctacgtgagcctgcacttatctccccaggttagctcaagtgtggtgtacggacggtcacctgtcatggctttcgaaagccatccccatttacgcggttcttctgtatctagcagcctgccctctattcctggaggcaagcccgcatacagtttccacgtttctgccgatggccaaatgcagccagtcccgtttccttctgacgctctggtcggagcgggaattcccagacatgcgcgtcagctccatacgctggcacatggagaagttgtctgcgctgtgacaatttccggatccacacaacacgtttataccggcggaaaaggctgcgtcaaggtctgggatgtggggcaacccggagctaaaacaccagtggcccaactcgactgtttgaaccgggataattatatccggagctgcaaactgcttcctgatggtaggagcttgattgttggaggcgaggcatccactctttccatctgggatctggcagcgcctactcctcgcatcaaagccgaactcacatcaagcgctccggcatgctatgccttggccgtatcacctgacgccaaggtgtgcttttcatgttgtagtgatgggaatatcgtcgtttgggacctacagaatcagactatggtgcgtcaattccagggacatacagacggcgcttcctgcattgatatctcagattatggaactagattatggacaggcggtttagataatacggtgcggtgttgggacctgcgggagggtcgacagttacagcagcacgatttttctagtcaaatcttctctctcggtcattgccccaatcaggactggttagccgtaggcatggaatcttctaatgtcgaaattcttcacgtacgcaagccagagaagtaccagctgcacctgcacgagagttgcgtgttgagcttgaagttcgcatcatgtgggagatggttcgtgagcacaggcaaagacaacctgctcaacgcatggcgcacaccatacggagccagcatcttccagtccaaggagagttcttcagtcctgtcatgcgatatctctcggaacaacaagtatatagtcaccggcagcggtgataaaaaggcaacagtttatgaggttgtttattag

SEQ ID NO: 244467 - DNA, 1233 bp, Artificial Sequence
  Description of Artificial Sequence: Synthetic coding sequence
atgacttttccacccgctctcctccctcctaatccagtcactcctccaagacctcgcactctgccccctccagggccagctcgcccagtcaccagcgcctctttgttaccttctcagcatttgccacggaccgcctcggttagttctagtgttgtgtatgggaggagccctgttatggcctttgagagccatccccacctccggggttcctcggtgagctcgagcctgccatccatccctgggggaaaacccgcttactcattccacgtgtcggccgacgggcaaatgcagccagttccctttcctagcgacgccttggtcggggcaggcatccctcgacacgcgaggcagcttcataccctcgctcacggcgaagtcgtgtgcgctgtgactatctctggatctactcagcacgtttatactggtggcaaaggctgcgtgaaagtttgggacgtcggacaaccgggtgccaaaacacctgtcgctcagctggattgtctcaacagagataattatatcagaagctgcaagctgctcccagatggcaggtccctgattgtcggaggagaggccagcacactgagtatctgggacctcgccgcacccacaccacgtattaaggctgagctcacatctagcgcgccagcgtgttatgctctcgctgtgagtcccgatgccaaggtgtgcttctcttgttgctccgacggaaatattgtggtgtgggatttacagaatcaaaccatggtgcgccagtttcagggtcacactgatggcgcatcgtgcatcgacatcagcgactatggtacacgactttggacaggaggcctcgacaacacagttaggtgctgggatctgagagagggccgtcagctacaacagcacgatttcagcagccagatattttctctgggtcattgtcctaatcaggattggctcgccgtgggaatggagagtagcaacgtggaaattctgcacgttcggaagccggagaaataccagctccaccttcacgaatcttgtgtgctttccttgaagttcgcttcatgtggtaggtggtttgtttcaactggaaaggacaatctgttgaatgcttggagaacgccctacggggcatccatttttcagagcaaggaatccagcagcgtcttatcttgcgatatcagtcgaaacaacaaatacattgtgaccggctccggggataaaaaggcgacggtctacgaggtggtgtactag

SEQ ID NO: 244468 - DNA, 2061 bp, Artificial Sequence
  Description of Artificial Sequence: Synthetic coding sequence
caaacaccactgcagtcagggcagccctttaagttctccatcctcgagatctgcgacagaattaaagaggagttccagttcctacaggctcagtatcactctctaaaattggagtgcgaaaagctggcctctgagaagacggagatgcagcggcattacgttatgtattacgagatgtcctatggactgaacatcgagatgcataagcaagcagaaatcgttaagcgcctgagcgggatctgcgctcagatcattccattcctcacccaagagcaccagcagcaggtgttgcaggccgtcgagagggctaagcaggtgacggtcggcgaactgaatagcctaattgggcagcaacagcttcagcccctctcacaccatgccccacctgtgcccctcacaccccgtccggcaggccttgtcggtggtagcgcaactgggttgctggcactgtctggcgcactagcagcacaggcccagctcgccgcagcggtcaaggaggatcgggctggggtggaagccgaggggtcacgtgtcgagcgggcacccagccgcagcgcctcgccctcccccccagagtccctcgtcgaagaagaaaggcccagcggtcccggtggcggaggtaagcaacgggcagatgagaaggaaccctccgggccttacgagagtgatgaagataagagcgattacaacctggtggtggacgaagatcagcccagcgagcctccgtccccggctactaccccctgtggcaaagttcctatttgcattccggcaagaagggacctggtcgatagtccagccagtcttgcatcctcattagggagccctctgcccagggctaaggaacttatcctcaacgacctgccagcatcaacccccgcatcaaaatcctgcgactctagcccaccccaagatgcttccacacccggtccatcctcggcctctcacctctgccaactggccgctaagcctgcaccctcaacggactctgtggccctgcgatctcctttgaccctgtcctccccatttaccaccagtttctccctcgggagccattccacattaaatggcgacctttccgttccatcctcgtatgtgagcctccacctatccccccaggtttcctcgtccgtcgtttacggtcgttcacccgtgatggcattcgaaagccacccacatctgcgaggttcatccgtcagttcttcattacccagcattcctggcggaaagcccgcttacagcttccacgtgtccgcagatggtcaaatgcagcctgtgccctttcccagcgatgccctggtaggagccggtatcccacgccacgccaggcagctgcatactttggcccacggcgaagtggtctgcgctgttacaatttcagggagcactcaacacgtgtacacaggtggaaaaggctgcgtcaaggtctgggatgtcgggcagcccggagctaagacccccgtcgcccagctcgactgtctcaacagggataactacattcggtcctgtaagctgctgccagatggccgttctttaatcgttgggggtgaggccagtactctttccatctgggatctggctgcccctacacctcggatcaaggctgagttgacatcttccgccccagcttgctatgccctcgccgtatcccctgatgcgaaggtctgtttctcctgttgctcagatggcaacatcgtggtttgggatctccagaatcaaacaatggtgagacagttccaggggcataccgacggggcatcttgcatagatatcagcgactacggcaccaggttgtggactgggggtctggacaacacagttagatgctgggacctgagggaggggaggcagctgcaacagcacgattttagctcacagattttctctctcgggcactgtcctaatcaggattggctcgcggtggggatggaatcttcgaatgtcgagattttgcatgtacggaagccagaaaagtaccagcttcatttacatgagagctgtgttttgtccttgaagttcgcatcatgtgtgcagggagtcgtgctcagccctgagctatag

SEQ ID NO: 244469 - DNA, 1866 bp, Artificial Sequence
  Description of Artificial Sequence: Synthetic coding sequence
atgcagagacactacgtgatgtattatgagatgtcatacgggctgaatatcgaaatgcataaacaggcagagattgtgaagaggctttccggaatttgcgctcagattattcctttcctgacccaggagcaccaacaacaggtgctgcaggcagtggagcgcgcaaaacaggtgacagtgggtgagttgaatagccttattggatcagcctcaccaagcccaccagagtctctggtagaagaggagagaccaagtggaccgggagggggtggaaagcagcgagcggacgagaaagaaccctcaggtccttacgagtcagacgaagacaaaagcgattataatctagtggtggacgaggatcagccctcggagccaccttccccagcaactacaccctgcggcaaggttccaatatgcatccctgcacgcagagacttggttgatagccccgctagtctggcatccagcctgggttcacctcttccacgggctaaagagcttatactcaatgacttaccggcttcaaccccagcctccaaatcttgtgattcttcccctcctcaggatgcgagcacaccaggcccttctagcgcaagccatctttgccaactcgctgcaaaacccgctccctccacagactctgtggcgctgaggagccctctgaccctctccagcccctttactaccagcttctcattgggttcccactccacattaaacggggacttgagcgtacccagttcatacgtgtccctccatctctcacctcaggtgagcagttctgttgtgtacggacgaagtcctgtcatggccttcgaatcccacccacacttgcgtggctcttcggtgagttcttccctgccatcgatccctggaggcaagccagcttattctttccacgtctcggctgatggacagatgcaacccgtacccttcccatccgacgcgttggtgggtgcagggataccaaggcatgccaggcaactacatactctggctcatggcgaggttgtctgtgcagtgacgataagcggatctactcaacatgtgtacaccggcggaaagggatgcgttaaagtctgggatgtgggccagccgggagctaaaacccccgttgcccagctagattgtctaaaccgggacaattacatcagatcatgtaaactcctgcccgatgggcgttcactgattgtcggcggagaggcttccaccttgtccatctgggacctcgctgccccaacacctaggataaaggccgaactgacttcaagcgcgcctgcttgttacgcattggcagtgagtcccgacgccaaggtgtgcttttcgtgttgctctgatggcaacattgtggtctgggacctccagaatcaaacaatggtgaggcaatttcaaggacatacagacggcgctagttgcattgatatctccgactacggaacacgactgtggaccggcggactcgataacacggtgcgatgctgggacttgagggagggtaggcagctgcaacagcatgatttttccagccaaatattctcactcggccattgtcctaatcaggattggctggctgtggggatggagtctagtaacgtcgaaatcctgcacgtcaggaagcccgagaaataccaactgcatctccacgaaagctgcgtcctgagtctcaagtttgcatcatgtggaagatggttcgtgtcaaccggcaaagacaacctgttgaatgcctggagaactccttatggcgcatctatcttccagtccaaggaaagttctagcgtactttcgtgtgatattagtcggaacaacaagtacattgtaactggaagtggagataaaaaagccaccgtgtatgaagtggtctactag

SEQ ID NO: 244470 - DNA, 2283 bp, Artificial Sequence
  Description of Artificial Sequence: Synthetic coding sequence
atgtatccccaaggtcggcatcctgcccctcaccagcctggccagcctggctttaaattcaccgtagctgagtcatgtgaccgaatcaaggatgaattccagttccttcaagcgcaatatcatagtctgaaggtagagtacgacaagctggccaacgagaagaccgaaatgcaacgtcattacgtgatgtactacgagatgagctatgggctaaatatagagatgcataaacaaacagaaatagccaagagattaaatactattctcgcccagatcatgcctttcttgagtcaggagcatcagcaacaggtggctcaggccgtggagagggctaaacaggtcacgatgacggaactcaatgctattatcggacaacagcagttacaggcacagcatctctctcacgctacacacggcccacctgtccagctgccccctcatccttccggcttacagcctcctgggatccctcctgtaacaggatcctcttcaggccttctagccctgggggcactgggctcacaagctcacctgaccgttaaggacgagaaaaatcaccacgaactggatcatcgcgagcgcgaatcatctgccaataattccgtcagtccttctgagtccctccgcgcttctgaaaaacacagaggttccgccgactatagcatggaggccaaaaagcggaaagctgaggagaaggactcactttctagatatgatagtgacggagacaagagcgacgacttggtggttgacgtttctaacgaggaccccgcaaccccccgagtgagccccgctcactcacccccagaaaacggactggacaaagcacggtccctgaagaaggatgccccaactagtcctgcttccgtggcgagctcctcatctacaccttctagcaagaccaaagatttgggccacaacgataagagctccacgcccggactaaaaagcaacacgccgacccctcggaacgacgctccaactcccggtacctccactactcctgggctgcgatcaatgcctgcatccgctttacgcactcctatctcgattacttcaagttatgccgcacctttcgccatgatgtcacatcacgagatgaacgggagtctgacctcacctggggcttatgccggacttcataatatcccgcctcagatgtctgctgctgccgcagcagccgctgcagcctacggcagatccccaatggtgtctttcggcgcagtggggtttgatccccaccctcctatgcgagccacggggctcccatcttcattggcatcaattcccggaggcaagccagcttacagcttccatgtgagtgctgacgggcagatgcagcccgtgccgtttccacatgacgctctggccggtcccggaattcccaggcacgccaggcagataaacacgctctcacatggggaggtggtgtgcgcggtgaccatttcaaatcccacgagacacgtgtacacaggaggaaaggggtgtgtgaaaatctgggacatcagtcagcccggatctaagtctcccatctctcagttggactgcctaaacagggacaactacattcgaagctgcaagttactgcccgacggtcggaccctgatcgtcggtggagaagcgagcaccttaaccatctgggatttggcctctcctacacccaggataaaggctgagctgacatcttccgctccagcctgttacgccttggctatctcacccgatgctaaagtttgtttctcttgttgctctgatggtaacattgcagtgtgggacctccacaaccagactttggttcggcagtttcagggccacactgatggcgctagctgcatagatatatcacacgatggcacgaagttgtggaccgggggactggataatacagtgcgatcatgggacttgagggaagggcgacagctgcagcagcacgacttcacaagccagatcttctccctcgggtattgtcccaccggggaatggctagctgtgggtatggaaagcagtaatgtagaagtattgcatcatactaagcccgataagtatcagcttcacctgcatgagtcctgtgtcctgtctctgaagttcgcctactgtggtaaatggttcgtgtcaaccggaaaggacaatctgctcaacgcctggcggacgccttatggagccagcatctttcagtcgaaggaatcctccagtgtcctatcctgcgatatatcggccgacgacaagtatattgtgacagggtctggcgacaaaaaggccactgtgtatgaagtgatctactag

SEQ ID NO: 244471 - DNA, 2289 bp, Artificial Sequence
  Description of Artificial Sequence: Synthetic coding sequence
atggctccccaccagcccggtcagcccggatttaaatttactgtggccgaatcctgtgatcgcattaaggatgagttccagttcctgcaggctcagtaccattctctcaaagtggaatacgacaaattggcaaatgaaaagactgagatgcagaggcactatgtgatgtactatgaaatgtcatacgggcttaacattgaaatgcacaagcaaaccgaaatcgcaaagcgactcaatacgatattggcacagattatgccctttctcagccaggaacaccagcagcaagttgctcaagcagttgagcgcgcaaaacaggtcaccatgacggaattaaatgccattatcggacagcaacagctccaggcccagcacctcagtcacgctacccacgggcctcctgtacagttgcctccacacccgtcaggtttacagccacctggtatccccccagtgaccgggtcatcaagcggcctcctggccttgggggcactgggctctcaggcacatctgaccgtcaaggacgagaaaaatcatcatgaactggaccatcgcgaacgggagagcagcgcaaacaatagcgtttcccctagcgaaagtctgagggccagcgaaaagcatcgcggttccgccgattactccatggaagcgaagaaacgaaaggccgaagaaaaggacagtttgtcccgctacgatagtgacggtgacaaatctgatgaccttgttgtggacgtctctaatgaggacccagcgactcccagagtgtctccagctcattctccacctgagaacggcctagacaaagcacggagtttaaaaaaagatgccccaacctctcccgcttctgtggcatctagttcatccacaccctcctccaagacaaaagacctagggcataatgacaagtcctctacccccggtctcaaatccaatacacccaccccccgaaacgacgcccctacccccggtacatcgacaactcctggactcagatctatgcctggaaaacctccaggcatggatcccattgccagcgccttgagaacaccaatatccataacctccagttatgcagccccttttgctatgatgagtcatcacgaaatgaatggctctctaacaagtccaggggcttatgctggtctgcacaatatccctccccaaatgtctgccgctgccgcagccgctgccgcagcttatggaaggtcaccaatggtatctttcggtgctgtaggatttgaccctcatccacccatgagggcaaccggccttcccagctccttagctagcatccccggtgggaagcccgcatattcgttccacgtcagtgccgatggacagatgcagccagtgcctttcccgcacgatgctttggccggacctggcatcccaaggcacgcccgtcaaattaacaccctgagccatggcgaagtcgtgtgcgccgtgacaatttcaaaccccacccggcatgtgtacacaggagggaaaggatgtgtgaaaatctgggacatctcacagcccggatccaagagcccgatttcacagttggattgtctaaaccgagataattacataagaagctgtaagctgttgccagacggcaggaccttaatagtgggtggtgaagcaagtactttgaccatttgggacctggccagtcccacacccagaattaaggctgaactgacttcatctgcacccgcttgctacgccttggctatctcccctgacgcaaaagtatgcttctcctgctgtagcgacgggaatatcgcagtatgggacctccacaatcagacactggtgaggcagttccagggacacacagacggggcaagctgtatcgatatttctcacgacggtactaagttatggacgggagggttggacaataccgtcaggagctgggacctgagagagggtcggcagcttcaacagcacgactttacatcacagattttttcattgggctattgtcctacaggagagtggttggccgtcgggatggagtcctcaaacgtagaggtgttacaccacaccaagccagacaaatatcagctgcacctccatgaatcgtgtgtgctgtctctgaagtttgcctactgcggaaagtggttcgtctccaccggcaaagataacctgctgaacgcttggagaaccccctatggcgctagcatctttcagagcaaggaatcctcttctgttctgtcatgtgacatcagtgctgacgataaatatattgtaactggatcgggcgacaagaaggccacagtgtacgaagtgatttattag

SEQ ID NO: 244472 - DNA, 2295 bp, Artificial Sequence
  Description of Artificial Sequence: Synthetic coding sequence
atgtatccccagggcaggcatccagcaccacaccaacccggacagcctggcttcaaatttacagttgccgagagctgcgatagaatcaaggacgaattccaattcctccaggcacagtatcacagcttgaaagtcgaatacgacaaactcgcaaatgaaaaaacggagatgcagaggcactacgttatgtactatgagatgagctatggtctgaatattgagatgcacaagcagacagaaattgcaaagcggctgaacactattctagcccaaattatgccattcttgagccaggagcatcaacaacaggtcgctcaagccgtagagcgggctaagcaggttaccatgacggaacttaacgccattatcgggcaacaacagttgcaagcgcagcacctcagtcatgcgacccatgggcctccagtgcagctgccgccacatccatctgggctgcagccgcctggcattccacctgtgacggggtcatcctctgggttgctggctcttggggctctcggttcccaggctcatcttacagtgaaagacgaaaagaaccaccacgaactggatcacagagagcgctcaagcgcgagcaacaactccgtttctccatccgagagcttgagggcctcagagaaacaccggggaagcgccgattactctatggaagcgaagaagcgcaaagcagaggagaaagatagtctgagtcgctatgatagcgatggtgacaaaagcgacgacctggtggtggatgtctccaacgaggatcccgctacacccagagtttcgcccgctcactcccctcctgagaatggactcgataaagctagatcactgaaaaaggacgctccaactagccccgcaagtgttgcctccagcagctctaccccctcctccaagactaaagatttgggtcacaacgacaagagttctacccctgggcttaaaagcaacactccaactcctagaaacgacgcgccaacccctgggactagtacaaccccaggcctgagaagtatgcccggaaagccacctggcatggatcctatcgcctccgcgctccgcacaccaatcagcatcacatcaagctacgccgcaccatttgctatgatgagccaccatgagatgaatggctccctgacaagcccaggggcatacgccggactccataacattcccccacagatgagcgctgctgcggctgccgcagctgctgcctacggacgttcacccatggttggatttgatccacacccgcctatgcgggcaactggcctgccttcttccttagctagcatccctgggggtaagcccgcttattctttccatgtcagtgccgatggccagatgcagcccgtcccctttcctcatgacgcgctggctggacccggtatacctcgacacgcccgacagatcaacacgctgagtcacggagaagtcgtgtgtgctgtgacaataagcaacccaactcggcacgtgtacacaggtgggaaagggtgcgtgaagatctgggacatcagccaacccggatcaaagagccccataagtcagctggactgcctgaatcgggacaactacattaggagctgcaagttgctgcccgatgggagaacactgatagttgggggtgaggcaagcacccttaccatttgggatttggcttccccaactcctagaatcaaggctgaactgacatcaagtgcacctgcttgttatgccctggcgatctcacctgatgctaaggtgtgcttcagttgttgcagcgacggaaatatagccgtctgggacctacataatcagactctggtgagacagtttcaggggcacacggacggtgctagttgtatcgacatttcacacgatggcactaagctgtggaccggaggactggataatacggtccgcagttgggacttacgagaaggccgacagttacagcagcacgacttcaccagccaaatcttctctctgggctattgtcccaccggtgagtggctcgctgtgggaatggaatccagtaatgtggaggtgcttcaccatactaagcctgataaataccaactgcacctgcatgagtcctgcgttctcagcctgaaatttgcttattgcgggaaatggtttgtctccacaggcaaagataatctgctcaacgcatggcgtaccccctatggtgctagcattttccaatctaaagagagctcttctgtgctgtcttgcgatatctccgcagacgataagtatattgtaacagggagtggggataagaaggcaactgtgtatgaagtcatctactag

SEQ ID NO: 244473 - DNA, 2310 bp, Artificial Sequence
  Description of Artificial Sequence: Synthetic coding sequence
atgtatccacagggcagacatccagcccctcaccagcctggacagccaggctttaaattcactgtcgccgaaagctgcgatagaatcaaagatgaatttcaatttctgcaggctcagtaccattcacttaaggtagagtatgataagttggccaacgagaaaacagagatgcaacggcattatgttatgtactatgagatgtcttatgggctgaacattgagatgcataagcaaacagaaattgctaagaggctcaacaccattctcgcccagataatgcccttcctctcccaggaacatcaacagcaggtggcacaggccgtggagcgggctaagcaggtgacaatgactgagctgaatgccattattggacagcagcagctgcaggcccagcacctatcacacgctacacatgggccacctgtgcagctgccgcctcacccatcaggactgcagccacccggtatccctcccgtgaccggctcaagctctgggctgttggccctgggcgcactggggtcacaggctcaccttaccgttaaggacgagaagaaccaccacgagcttgatcatagggaaagggagtctagcgccaacaacagcgtttccccatctgagagtttgagagcaagcgaaaaacataggggatcagcagactactctatggaggctaagaaacgcaaggctgaagagaaggattccctgagcaggtacgactccgacggggacaagtccgacgatctggttgtggatgtctcgaacgaggatcccgctactcccagagtctcgcccgctcatagcccaccggagaatggactggacaaagctagatctttgaagaaggatgcgccaaccagtcctgccagtgtggctagctcgtccagtacccccagcagcaagacaaaggacctggggcacaatgacaagtccagcacacctggtttgaaatcaaacactcctactccccgtaatgacgccccaacgccagggacgagcactaccccaggacttagaagtatgcccggtaaacccccaggcatggaccccattgcctccgcgctacgaacacctatatctatcacatcaagctatgccgcaccgttcgctatgatgtcacatcacgaaatgaacggatctcttacatcaccaggcgcttatgcgggactccacaatattccaccgcagatgtcagcagctgcggctgccgctgctgccgcatacggcagatctccaatggtctccttcggagctgtggggtttgaccctcacccaccaatgagagctaccggtctgcccagctccttagccagcatccccggtggcaagcctgcctactctttccacgtttccgctgacggtcagatgcagccggttccattccctcacgatgccttggcgggacctggaatccctagacacgcccgtcagatcaacacattgtcccacggcgaggtggtgtgtgccgtgacaattagcaatccgacaaggcatgtgtatactggagggaaagggtgtgttaagatttgggacatctctcaaccaggcagtaaatccccaatcagccagctagattgtttgaaccgggacaactacatcaggtcgtgcaaactgttaccagatggtagaactctcattgtaggaggcgaggcgtctacccttacgatctgggatctcgcctcacctacgccccgtatcaaggcagaattaacatcaagtgcgcctgcctgttatgctctagctataagtcccgacgccaaggtttgcttttcttgttgctctgatggcaatattgcagtctgggatctgcacaatcaaaccttggtcagacaatttcagggtcatactgatggtgccagctgcatcgatatctctcacgatggcacaaaactctggacaggcggactcgacaacaccgtacggtcttgggacctgagagagggacgccagctacaacaacacgactttaccagccagatattctctcttggatactgcccaactggagagtggctcgcggtcggcatggaatccagcaacgtggaagttcttcatcatactaagccggacaagtaccaactgcacctccatgaatcgtgtgttctgtccctaaagttcgcgtactgtgggaagtggtttgtcagtacaggcaaagataatttgctcaatgcctggaggacgccttacggcgcttccatctttcaaagcaaggaaagctcatcagtcctctcgtgcgatatcagcgctgacgataagtacatcgtgaccgggtctggggataagaaggcgacagtttatgaagtgatttactag

SEQ ID NO: 244474 - DNA, 2295 bp, Artificial Sequence
  Description of Artificial Sequence: Synthetic coding sequence
atgtatccccagggaaggcaccctgccccacatcagcccggacagcccggtttcaaattcacggttgctgaaagctgcgaccggatcaaggacgaatttcagtttctccaagcccagtaccactcacttaaggtcgagtatgataagctggcaaacgagaagactgaaatgcagcgccattacgtcatgtattatgagatgtcctacggtctgaacatcgagatgcacaagcagaccgaaatcgcaaagagactgaatactatcttggcgcagatcatgccctttctttcccaagagcaccaacaacaagttgcccaggctgttgaacgagctaagcaggtgactatgactgagctaaatgcaatcattggccagcagcaactgcaggcccagcacttgagtcacgccacccatggacctccagtccaactgcctcctcatccatctggtctgcaacccccaggtattccacccgtgaccgggagctcttccgggctccttgcgttgggagcactgggctctcaggctcatttgacagtgaaagacgagaaaaaccaccacgagctggaccatcgcgagagagagtccagcgcgaacaactctgtctctccctcagagtctctcagagcctctgaaaagcataggggctccgccgattacagcatggaagcaaagaaaaggaaggccgaggaaaaggatagcctctctcgctacgatagcgatggggacaaatcagatgatcttgttgtcgacgtgtccaacgaagacccagccacccccagggtctcacccgcacattccccccctgaaaacgggctagataaagcacgatccctgaaaaaggatgcacctacaagccctgcctccgtggccagctccagctccactccctcttcgaaaacaaaggacctggggcacaatgataagtccagcactccgggtcttaagagcaacacccctaccccaaggaacgatgctcccaccccagggacaagtaccacccccggtctgcgcagcatgccgggtaagccccctggcatggaccccatcgcatccgctttgcgtactcctatctccattacctcaagctacgcagcacctttcgctatgatgagtcaccatgagatgaacggttcattgacaagtcctggcgcatacgcaggcttgcacaatattcctccccagatgtccgctgccgctgctgccgctgccgctgcatatggccgaagccctatggtcggcttcgaccctcatcctccgatgcgcgcaacaggactccccagtagcctagcctctattccaggtggtaagcccgcatactcctttcatgtgtccgccgatgggcaaatgcagccagttccgttccctcacgatgcgctagccggaccgggtattccaaggcatgcacggcagattaacactctgtcccacggtgaagtcgtgtgtgccgtgacaatatctaatcccaccaggcatgtctacacgggcggtaaagggtgtgtgaaaatctgggacatttcacagccaggatctaaaagccctatctctcagctggattgtctcaacagggacaactatattcgcagctgcaagctgctgcctgatgggaggacattgatcgtggggggagaggcctcgactctcaccatctgggacttggcgtcaccaacaccgaggattaaggcggagctcacatcttccgctcctgcctgctatgccctggctatcagtccagatgctaaagtttgcttctcatgttgtagcgacggaaatattgctgtttgggacctgcacaaccaaaccttggtccggcagtttcagggacacactgatggcgctagctgtatagacatttcccacgacggaaccaagctgtggacaggcggactggacaataccgtgcggtcttgggatctaagagagggcagacaactccaacagcacgattttactagccagatcttttcgctgggttactgtccaacgggtgagtggctggccgtaggcatggaaagcagcaatgtggaggtgctgcaccacacaaagcccgataagtatcagttacatctgcatgagagctgcgttttgtccctgaagttcgcctattgcgggaaatggttcgtttccacaggtaaggacaatttactcaatgcatggcgtaccccgtacggagccagcattttccaaagcaaggagtcatcgtcagtgttgtcatgcgacatctctgccgacgataaatacatcgttacaggatctggcgacaagaaagctactgtttacgaggtgatctattag

SEQ ID NO: 244475 - DNA, 2319 bp, Artificial Sequence
  Description of Artificial Sequence: Synthetic coding sequence
atgtatcctcaaggacgccacccagcaccacaccagcccggacagcctgggttcaaattcaccgtggctgagagctgtgatcggattaaggatgaattccaattcctacaagcacagtatcactccctgaaagtggagtacgataaactggccaatgagaaaaccgagatgcagcggcactacgttatgtactatgaaatgagttacgggctgaacatcgaaatgcacaaacagacagagattgctaaaaggcttaacacaatactcgctcagattatgccctttctgtcacaggaacaccagcaacaggtggcccaagctgttgaaagagccaaacaagttactatgactgagttgaacgcaattatcggtcagcaacagctgcaggcacagcatctcagccacgccactcatggtccgccagtccagttgccaccccacccgagtggcctccagcctcctggcattccacccgttaccggcagttcttccggactcctggcacttggggcacttggatcgcaagcgcatttgacagtaaaagatgagaagaatcaccacgagctagatcaccgcgagcgcgaatcatctgccaacaattctgtcagcccgtctgaatccctgcgggcatctgagaagcaccgtgggagcgccgactactccatggaggccaagaaaaggaaagcagaggagaaggactctctgtcacgctatgattctgatggtgataaaagtgacgacctggtcgtcgatgtgtcaaacgaggatcccgctaccccaagagtgtcacctgcccacagccctcctgagaatggtctcgacaaagcgagatccctcaaaaaagacgccccaacatcacccgcatcagtagcctcctcttcctccacccccagcagcaagacaaaagatctgggacataatgataagtcatcgacccccggtttgaagagcaacaccccgacacctaggaatgacgcgcctaccccaggaacttccacgacacctggcctcaggagtatgccaggaaaaccgcctggtatggacccaattgggatcatggcttccgcactacggacgcccattagcatcacgtcttcttatgctgctcccttcgccatgatgtctcatcacgaaatgaatggctctctcacaagcccaggagcctacgccggactccacaacatcccccctcagatgtctgctgctgcagcagccgctgccgctgcttatgggcgatcaccaatggtttcatttggggctgtgggatttgaccctcaccctccgatgcgggcaactggcctgccaagcagtttggcctcaattcccggaggaaagccagcatattctttccacgttagtgctgatggccagatgcagccagtgcctttccctcacgacgccctcgccggtcccggtatcccacgccacgctcggcagatcaacaccctttcacatggcgaggtcgtctgtgctgtgactatctcaaatcccacaaggcacgtatacacagggggtaagggctgcgtgaagatctgggacatctctcaaccgggatccaagtctcctatttctcagctggattgtctgaaccgtgacaactacatcagaagctgcaagttgttgcctgatggcaggactctcattgttggcggtgaagccagcactctgactatctgggatttggcaagtcccactcctcgcattaaggccgaactcacttcatccgctcccgcttgctacgcactggccatttctcccgatgctaaagtgtgtttttcatgttgctccgatgggaatatcgccgtctgggatctccacaaccagacactggtgcgtcagttccagggacataccgacggcgcttcctgtattgacatatcacacgacggcactaagctgtggaccggcggactcgacaatactgtccgttcttgggacctgcgggagggcagacagctgcaacaacacgacttcaccagccagatcttcagcctcggatactgccccaccggggaatggctggcagtgggtatggaatcttcgaacgtagaggttctgcaccacacgaagcccgacaaataccagctgcacttgcacgagagttgcgtcttgtccctcaagttcgcctactgcggcaagtggttcgtgtccaccgggaaagacaacctcttgaatgcctggcgcactccttacggcgcatccatcttccagagcaaggagtccagttcagtgctgtcatgtgacatttccgcggatgataagtatatagtcaccggtagtggagataaaaaagccacggtgtacgaggtgatatattag

SEQ ID NO: 244476 - DNA, 2319 bp, Artificial Sequence
  Description of Artificial Sequence: Synthetic coding sequence
atgcccccaccgccaccactgagttgtctgcggggtttgcaagctccacatcagccaggacaacctgggttcaagttcactgtggccgaatcatgcgaccggataaaagatgaatttcaatttctccaggctcagtatcattccttgaaagtcgagtacgataaactggcgaacgagaagaccgaaatgcagcgtcactacgtgatgtactacgaaatgagctatggcctaaacatcgagatgcataagcagaccgaaatcgcgaaacggctgaataccattctggctcagatcatgccattcctttcgcaggagcatcagcaacaggtggcacaagctgttgaacgcgctaaacaggtcactatgaccgagctgaacgccattattgggcagcagctacaggcacaacatctgagccatgcgacccacggtcctcccgtacagttgccaccccacccttctggcctgcagccgcctggtatacctcccgtgaccgggtcctcgtccggacttcttgccctcggagcccttggctctcaggctcacctaactgtgaaggatgaaaagaatcatcacgaactcgatcacagggagagggaaagctccgcaaacaactccgtctcgccctccgaatcgctgagggctagcgaaaagcaccgtggatccgcggactattcgatggaggctaaaaagcggaaggcagaggagaaagacagcttatcacgctacgacagtgacggagacaagtctgatgacctcgtggtggatgttagcaatgaagacccagccaccccaagggtctctccagcacactctcccccagagaacggtctagataaagctcgctctctgaagaaggacgcccctacctcacccgctagcgtggcctcatcttcgagtactccatcgtccaaaaccaaggatttggggcacaacgacaaatctagtacccctggtctcaaatctaacaccccaaccccgagaaatgacgccccaacaccaggcacatctacgacccccggactcaggtctatgccagggaagcccccaggtatggaccccataggaatcatggcttcagccctccgcactcctatctccattactagctcttatgccgctcctttcgcaatgatgtcccaccatgagatgaatggcagccttacctcacctggtgcttatgcgggactgcataacattccacctcagatgtccgcggcagcggcagccgcagccgcagcttacggaaggtctccaatggttgggttcgatccacatccacctatgagagcgactggcctcccgagctccctggcttccatcccaggagggaagcccgcatactcctttcatgttagcgccgacgggcagatgcagcctgttccattcccccacgatgcactcgccggacccggtatccctcgtcacgccagacagatcaacactctctcccacggagaagtggtgtgcgcggttacaatctccaatcccacccgccatgtgtacacggggggaaaaggatgtgtgaagatttgggacattagccagcccggtagtaaaagcccgataagccagttagattgtctcaatcgagacaattacatccggagctgtaagctcttgcctgacggcagaactctcatagttgggggagaagcctcaacactaacaatctgggacctggcctcacctacaccccgaattaaggccgagctcacttcctccgcaccagcctgttacgcgctcgccatctcaccagacgccaaggtctgcttcagttgttgttcggacggcaacatagccgtctgggatctccataatcaaaccctggtgcggcagttccaaggtcataccgacggcgcttcttgcatagacatcagccacgatggaacaaagctgtggacaggtgggcttgataacactgtgcgatcctgggacctccgtgaagggcgacagctgcaacagcacgacttcaccagccaaatattctccctcggttactgtcccacaggggagtggctggcggttggcatggagtcctctaatgtggaagtgttgcaccacaccaagccagacaagtatcagctccatctgcatgaatcatgtgtcctgtcactgaagttcgcctattgcggcaagtggttcgtgtccacgggtaaagacaatctgctcaatgcttggcggaccccttatggagcatctatttttcagagcaaggagtcctcctctgttctgtcttgtgatatcagcgccgacgataaatacatcgtgaccggatccggggataaaaaggcgactgtatatgaagtgatttattag

SEQ ID NO: 244477 - DNA, 2325 bp, Artificial Sequence
  Description of Artificial Sequence: Synthetic coding sequence
atgccgccaccgccaccactctcctgcttgagagggctgcaagcccctcaccagccagggcagcctgggttcaaatttacagtagccgagtcttgcgatcgcatcaaggatgaatttcagtttctgcaggcacagtaccattccctaaaggtggagtacgacaaactcgcgaatgagaagacagaaatgcagagacattacgtgatgtattatgagatgagctatgggctgaatatagagatgcataagcagacagagatcgcaaaaaggcttaatacaatcctcgcccagataatgccattcctgtcacaagaacatcaacagcaggtggctcaggccgtggaacgggcaaaacaagttaccatgaccgaactgaacgcgataatcggccagcagctacaggcccagcatttatctcatgcaacccatgggccacccgtgcagctacctccacacccttccggactccagcctccgggaattccgcctgtgactgggagctcgagcgggctgcttgccttgggagctttaggttctcaagcccacctcactgtgaaagacgaaaagaatcaccacgagcttgatcacagggagagggagagctctgcaaacaactcagtaagtcccagtgagtctctgcgcgcttctgagaaacaccgcggtagtgcagattactcaatggaggctaagaagagaaaggctgaggagaaagactcactctctcgctacgactccgacggagacaaatcagacgacctggttgtagacgtatcaaacgaggacccagccacgccaagagtttcaccagcccattcccctcccgagaacgggctggataaggctcggagcctgaagaaggatgcccctaccagccccgcaagcgttgcaagttccagcagcaccccgagttcaaagactaaagacctcggacataacgataaatccagcacccccggtctcaagagcaacacaccaaccccaaggaatgacgcccctacccccggaacttccaccacaccgggattgcgcagtatgccaggaaagcccccaggcatggatcctatagcctctgcgctccgcactccgattagtatcaccagctcttacgctgccccattcgccatgatgagccatcatgagatgaatggcagcttgacgtcgcccggagcttacgctggattgcacaatatcccacctcagatgtctgcggcagccgcagctgccgctgcggcttacggcaggtcgcctatggtttcgttcggagcagttggatttgacccacacccacccatgagagcaaccggactaccatcatcactagcctctatccctggaggtaagccagcttacagtttccacgtatctgcggatgggcagatgcagccggttcctttcccccatgacgcattggctggaccagggatccctcgccacgccaggcaaatcaataccctgagtcatggggaagtggtatgtgccgttaccatctctaaccctactcgacacgtctacaccggtgggaaggggtgcgtgaaaatttgggacatctctcaacctgggagtaaatcgcccatatcccagctcgactgcttgaatcgggacaactatattcgctcttgcaagctgttgcctgatgggaggactctcattgttggcggagaggcgagtacattgacaatatgggatcttgcaagtccgactccccgaatcaaggcggaacttacatcctccgcacctgcttgctatgctctcgccatcagcccagacgccaaagtttgtttcagttgttgtagtgacggcaacatagctgtttgggacctccacaaccagacccttgttaggcagttccagggccacactgacggagccagctgcatcgacattagtcacgacggcactaagctttggacgggcggtctcgataataccgtgcgatcatgggatctgcgggaaggaaggcagctgcagcaacacgactttaccagccagatcttctcactagggtattgcccaactggcgaatggctcgccgtgggaatggaatctagcaatgtcgaggttctacaccacacgaaacctgacaaataccagttgcatctgcatgagtcatgcgtgctgtctctgaagtttgcatactgcggcaaatggtttgtcagcacaggtaaggacaatctgctgaatgcttggcggacaccatacggggctagcatcttccagtcaaaagaatctagctcggtgctaagctgtgacatttccgccgatgacaagtacatcgttacaggttctggggacaagaaagctactgtctatgaagtgatctactag

SEQ ID NO: 244478 - DNA, 1719 bp, Artificial Sequence
  Description of Artificial Sequence: Synthetic coding sequence
atgacatctagggaccagcccaggccgaaagggcctccgaagtctacctcgccctgtccaggcatcagcaattcagagtctagcccaacgctgaactatcaaggcattttaaaccgcctgaagcagtttccacgcttcagccctcacttcgccgcagaactggagtccatctattactcccttcacaaaatccagcaggatgtagccgagcatcataaacagattggaaatgtgcttcagattgtcgaaagttgtagccaactgcaaggctttcagtcagaggaagtctctcctgcagaacctgcctctcccggaacaccccagcaggtgaaagataagactttacaagagtcaagtttcgaggacattatggccaccagatcaagtgactggctgcgtcgcccactgggggaggataaccagcctgaaacacaactgttctgggataaggagccctggttctggcacgacactttgaccgaacaactgtggagaattttcgcgggagtgcacgacgagaaagcaaagccccgagatcgtcagcaagcgcctggactggggcaggagtccaaagcaccaggctcttgtgatcccggaacggatccatgccccgaggatgcttccactcctaggccacctgaagcatctagcagcccacccgaagggtcacaggataggaacacgagctggggcgtcgtgcaggagccccctggaagggcctctagattcttacagtcaatctcatgggatccagaggattttgaggacgcttggaaacggcctgatgctctgcccggacagtccaagaggctagctgttccctgtaaactagagaaaatgaggatcctggcccacggggagctggtcctggccacagccatttcaagctttacaagacatgtgtttacctgtggaagaaggggaattaaggtgtggtcccttaccggacaggttgcagaagacagattccccgaatcccacctgcccattcaaacacctggggctttcctgagaacttgcttgctatcaagcaatagtcggtccctactgacaggaggatacaatctcgcaagcgtgagtgtctgggaccttgccgctccctccctacacgtaaaggagcagcttccgtgtgcaggactcaactgtcaagctctggatgccaatttggacgcaaatcttgcctttgccagtttcaccagcggcgttgtgagaatatgggacctgagggatcaatcagtcgtccgcgatcttaagggctatccggacggagtgaagtctatcgtggtgaagggctacaatatctggactgggggtcccgacgcctgccttcgctgttgggaccagcggactatcatgaagccgctcgaatatcaatttaagtcccagataatgtctctatcacacagcccccaggaagactgggttctgctgggtatggccaatgggcagcagtggctgcaatcgaccagtggaagtcagaggcacatggtgggccagaaggattctgttatcctgtccgtcaagttttctcctttcgggcaatggtgggcctctgtgggtatggatgacttccttggtgtctattctatgccagccggaactaaagtctttgaagtgccagagatgagcccggtgacctgctgcgatgtgtcatcaaataaccgactggtcgtgaccggctcaggcgaacacgcatctgtgtaccagattacgtattag

SEQ ID NO: 244479 - DNA, 1251 bp, Artificial Sequence
  Description of Artificial Sequence: Synthetic coding sequence
atggcaacaaggagttcagattggcttcgcagacccctcggcgaggataaccagcccgaaactcagctgttctgggacaaagagccgtggttttggcatgataccctcaccgaacagctttggaggatcttcgccggtgtgcatgatgaaaaggctaagcccagggacagacagcaggcaccgggacttggtcaggaaagtaaggctcctgggtcttgcgaccccggaacagacccatgtcccgaggatgcctcaacacccagaccaccagaggcttcatcatccccacccgaggggagccaggaccggaatactagctggggcgtggtacaagaacctccaggtcgggcatcccggttcctccagtcaatctcttgggacccagaagatttcgaagacgcatggaagaggccagatgctctccctggacagagtaaaaggctggccgtcccctgtaaactggaaaagatgcgaattctggcacatggggagctggtactcgccactgctatcagctcattcaccaggcacgtcttcacttgcgggagaaggggtattaaagtgtggtccctgacaggacaggtggccgaggaccgctttccagagagccatctccccatccagacccccggagccttcctgcgcacttgcttgctgagttctaattccagatctctccttactgggggttacaatttggcctccgtgtcagtttgggacctagcagcgccaagcttgcacgtgaaggagcaattgccgtgtgcaggcctgaactgccaggccctggatgctaatctggacgccaatctggctttcgcatcattcacttctggcgtcgtgcgcatatgggatttacgggaccagagtgtggtccgcgatctgaaaggatacccagacggagtcaaatccattgtggtaaaaggctacaacatatggaccggcggtccagacgcctgcctgcgctgttgggaccagaggaccatcatgaagcccctggagtatcagttcaagtcacagatcatgtctctgagccattccccacaagaggattgggtcctgcttggcatggccaatggacagcagtggctacagagtacctctggctctcaacgccacatggttggccagcgtcaacgtcaccctgagagacaggtcttacccctctggcccgtggttggcaagcggtggaacgggcgtctgccatggcgcttgcaacatgcaggcggagataagtcagtgaggggagcatag

SEQ ID NO: 244480 - DNA, 1719 bp, Artificial Sequence
  Description of Artificial Sequence: Synthetic coding sequence
atgacttcaagagaccagcctcgtccgaaaggccctcccaagtccacttccccttgcccagggatctcaaactctgaaagcagccccactctgaactatcagggtatactgaatcgtctgaagcagtttcccagattcagcccacatttcgcagctgaactggagagcatatactatagcttacacaagatccagcaagatgttgccgagcaccacaagcagatcggcaacgtcctgcagatcgtggaatcatgttctcagctgcagggcttccagagtgaagaggtaagtcccgcagaacccgcttcacccggtacacctcagcaggtgaaagacaaaacccttcaggagagtagtttcgaggacatcatggcaactcgcagtagtgactggcttcggaggcctctgggcgaggacaaccagcctgaaactcagttgttttgggataaggagccctggttttggcatgatacgcttacagagcaactctggcggatcttcgcaggtgtgcacgatgaaaaggccaagccaagagacaggcatttttcgatcttccagggtcaggaaagcaaagcgccaggttcttgcgaccccggtactgatccatgcccggaggatgcctctactcccagacctccagaagccagctcatcacctcccgaaggtagccaggacaggaacacctcatggggagtggtgcaggagccgccaggcagagcatcccggttcctgcagagcatttcctgggatcccgaagattttgaagacgcttggaaaagacctgacgcgctgccaggtcaatctaagaggttggcagttccttgcaagctggagaaaatgcgcatcttggcccacggagaactggtgttagctacagctatttcttcattcacccgccacgtcttcacgtgtgggcgacgaggcattaaggtgtggtcgcttaccggtcaggtggcggaggataggttcccggagtcgcacttgccaatacagacccccggagccttcttgcggacttgtctcctttctagcaactccaggtcccttttgacgggagggtacaatctggctagcgtttctgtgtgggacctcgctgctccatcactacatgttaaagaacagctcccgtgtgcaggcttaaactgccaagccctcgacgccaatctggacgccaacctggccttcgcctcgttcacatctggagtcgttaggatttgggatctgcgcgatcagagcgtcgttcgagacctcaaggggtatcccgacggagttaagtctatcgtggtgaaggggtataatatctggaccgggggtccagatgcttgccttcgctgttgggaccagcgcacaattatgaagcctctggaatatcagtttaagagccaaatcatgtctctgtcccactctcctcaggaagactgggtgctgttgggaatggcaaatggacagcagtggctacagagcaccagcgggagtcagaggcacatggtgggccaaaaggatagcgtgatcctcagcgtgaaattctctccatttggccaatggtgggcgtcagtaggcatggacgattttctgggcgtttatagcatgcctgccggaactaaggtgttcgaagtgccggaaatgagccccgtgacctgttgcgatgtgtcctccaacaataggctggtcgtgacggggtccggcgagcacgctagtgtctaccagatcacatattag

SEQ ID NO: 244481 - DNA, 1350 bp, Artificial Sequence
  Description of Artificial Sequence: Synthetic coding sequence
atggccactaggtcatcagattggctgaggagaccgctcggagaggataatcagccagaaacacagttgttttgggacaaagagccctggttttggcacgatactctgacagagcagctttggcgcatctttgcaggagtgcacgacgaaaaagccaaaccacgagacaggcaacaagccccaggactcggccaagagagcaaggcgcctggatcttgtgacccgggaaccgatccttgtcctgaagatgcctcgacccctaggcctcccgaggccagctccagtccacctgaggggagtcaagacagaaatacctcgtggggagtggtgcaggagccacctggacgcgcatctagattccttcagagcatttcctgggaccctgaggacttcgaggacgcttggaaaaggccggacgcactgcccggtcagagcaagagactggcagtgccatgtaaattagagaagatgcgcattctggcccatggggaattagtcttggctaccgctattagctcgtttactcggcatgtattcacctgcgggaggcggggtataaaagtgtggtcactcaccggacaggtggccgaggaccgctttccagagtcgcacctacctattcagacacccggtgcattcctcaggacctgtttgcttagctccaattctcgcagtctgctgactgggggttacaacctcgcatcagttagcgtctgggacctggccgcacctagccttcacgtgaaagagcagcttccatgcgctggcttgaactgccaagcactcgacgccaacttggatgcaaacctagccttcgcatctttcacaagcggggtcgtacggatttgggatttgcgcgaccagagtgtcgtacgcgacctgaagggctaccccgacggggtcaagtccatcgttgtgaaaggctataatatttggacgggaggaccagacgcatgtcttcggtgttgggaccagcggactatcatgaaacccctagaataccagttcaaaagtcaaatcatgtcactcagtcactcaccccaagaggactgggtgttgctgggcatggccaacggccagcagtggcttcagtctacttctggatctcagagacatatggtgggacaaaaggactcagtgatcctatctgtcaagttctccccgtttggacagtggtgggcctcagtaggaatggatgactttttgggggtttacagcatgcctgcaggaaccaaagtttttgaggtacctgaaatgtccccagtcacttgttgcgacgtaagttctaataaccgccttgtcgttaccggcagcggggagcatgcatccgtctaccagataacctactag

SEQ ID NO: 244482 - DNA, 1716 bp, Artificial Sequence
  Description of Artificial Sequence: Synthetic coding sequence
atgaaccaattgagaggcaagaaaagttgtcacactggtttggggagatctgcaggctggaatattccaatcggcctcctgtactgtgacctgccagagccacgaaaaccgctggaaaaggctgtggctaacttcttctctggttcttgtgcaccatgcgccgacggaactgattttcctcaactctgtcagttgtgccctgggtgtggctgctccacactcaaccagtatttcgggtactctggcgcattcaaatgccttaaagacggggcaggcgatgtggcatttgtcaaacactccaccatctttgagaaccttgctaataaggccgatagggatcagtatgaactcttgtgtctggataatactcgaaaacctgttgatgagtacaaagattgtcacttggcccaagtgccatcgcacacagttgtagccaggtctatgggaggtaaagaggatcttatctgggagctgttgaatcaggctcaagagcatttcggcaaagataagtccaaagaattccagttgttctcgtcccctcatggaaaggacctcctcttcaaggatagcgctcatgggtttctaaaagtcccacccaggatggatgcaaaaatgtacttgggttacgagtatgtgacagcgattagaaacctgagagagggaacctgtccagaggctccgactgatgaatgcaagcccgttaaatggtgtgcattatcccatcacgagaggttgaagtgcgatgagtggtctgttaattctgtcggtaaaatagaatgtgtcagcgcggaaaccactgaggactgcattgcaaagatcatgaacggggaggcagacgcaatgagtttggacggcggtttcgtctacattgccggtaagtgcggactggtgccagtcctggcagaaaattataataaatccgataactgcgaagacacccccgaggctgggtatttcgcaatcgccgtcgttaaaaagtccgcttcagaccttacatgggataatctgaagggcaaaaagagctgtcatacagcagtcggacgcactgccggttggaatatccctatggggctgctgtacaacaagattaaccactgcagatttgacgaattttttagcgaaggatgcgccccaggatccaagaaagactcttcactgtgtaaactgtgtatggggtctggactgaatttatgcgagcccaacaacaaagagggttattacgggtataccggcgctttcaggtgcctggtggagaagggggacgtggctttcgtcaagcaccagacggtcccccagaatacagggggaaagaaccccgatccttgggcaaaaaacttgaacgagaaggactatgaactgctgtgcctcgacggcaccaggaagcccgtggaggagtatgccaattgccatttggctagagcccctaatcatgcagtcgtcacaaggaaggacaaggaggcatgtgtacacaaaattctcagacagcagcagcacctatttgggtccaacgtcaccgactgttctggaaatttctgtctgtttagaagcgagactaaggatctgttatttagagatgacacagtctgtctggcaaagttgcacgacaggaacacatacgaaaaatatttaggggaagagtacgtcaaggctgtcggtaacctgcgcaagtgcagcaccagctctctgctggaggcatgtacatttcgtcgcccttag

SEQ ID NO: 244483 - DNA, 2097 bp, Artificial Sequence
  Description of Artificial Sequence: Synthetic coding sequence
atgcggctcgccgtcggggctctcctggtgtgcgctgttcttggcttgtgtcttgccgtgccggacaagaccgtacgatggtgcgccgtatcggaacacgaagcaacgaagtgccaatcttttagagatcacatgaaaagtgtcatcccatccgacggaccttcagtggcctgcgtgaagaaggccagttatctcgactgtattagagccattgcggctaacgaagcagatgcagtgacactggatgccggtctcgtatacgacgcgtatctggcacccaacaatctcaagcctgtggtcgcagagttttatgggtctaaggaggaccctcagacattttactatgccgttgcagtggtgaaaaaagatagcggattccagatgaaccaacttagggggaagaaatcctgccataccggtctgggtaggagcgccggatggaatatacctattggcctcctctactgtgacttgcctgaaccacgtaagcctcttgagaaggccgtcgccaatttctttagcggcagctgcgctccttgtgcagatgggaccgactttccccagctgtgccaattatgtcctggatgcgggtgcagcacccttaaccaatattttggatattcaggggcatttaagtgcctgaaagacggggcaggcgatgtggcattcgtaaagcatagcaccattttcgaaaacttagccaacaaagcagatagagaccagtacgaactgctgtgcctggataacacaaggaaacctgtcgatgaatacaaagattgtcatctcgcgcaagtacccagtcacactgttgtggccagatccatgggaggaaaggaagacctcatctgggaactgttgaaccaggcccaggaacactttggcaaggacaagtcaaaggagtttcagttgttcagcagcccgcacggtaaggacctcctgtttaaagatagtgctcacggctttctcaaagtgccgccaagaatggatgcgaagatgtatctcggctacgaatacgtaactgcgatcaggaacttaagagagggcacctgccctgaggctcccaccgacgaatgcaagccagtgaaatggtgcgcactgagccaccatgagcgtctcaagtgtgacgaatggagcgtcaattcagtgggcaagatagaatgcgtgtctgccgaaaccactgaggactgcatcgctaaaattatgaacggggaggcagacgccatgtccctggacggaggttttgtttatattgcaggcaagtgcggccttgtgcctgtgttagcagaaaattacaacaaatccgacaattgcgaggacacacctgaagcagggtacttcgccattgccgtggtcaagaagagcgcctctgacctgacctgggacaatttgaaaggaaagaagtcctgccacacagccgtaggccgtactgcaggctggaacattccgatgggactgctgtacaacaagattaaccattgtcggtttgatgaatttttcagcgaaggatgtgcgccaggatccaaaaaggattcctcactgtgcaaactgtgcatgggcagcggactcaacctgtgcgaacctaacaacaaggaggggtactacggctatacgggcgctttccggtgtctggtggaaaaaggcgacgtggctttcgttaagcaccaaaccgtccctcaaaatactggcggaaaaaaccctgacccttgggcgaagaacttgaacgagaaagactatgagctactttgcctcgacgggacccgcaaacccgtggaggagtacgccaattgccacctcgccagagctcccaatcatgcagtagtgacaaggaaagacaaggaagcctgtgtgcacaaaatccttcgccagcagcaacatctgttcggttccaacgtcacagactgctcaggcaatttttgtttgttcagatctgagactaaagacctcctcttcagagatgatactgtgtgcctggctaagctccatgatcggaacacctatgaaaaatatttgggagaggagtatgtgaaggccgtcggaaacctccgaaaatgttctacctcgagtcttctggaggcctgtacctttcgcagaccttag

SEQ ID NO: 244484 - DNA, 2283 bp, Artificial Sequence
  Description of Artificial Sequence: Synthetic coding sequence
atgatggaccaggccagatcggccttctcgaacctgtttgggggagagcctctaagttacaccagattctcattagctcgccaggttgatggtgacaattcacacgtcgagatgaaactagccgtcgatgaggaagagaatgctgacaacaacacaaaggctaatgtgacaaagccaaagagatgttctgggagcatctgctacggcacaatagcagtgatcgtatttttcctcattggcttcatgattggctatctgggctattgtaagggggtggaaccgaagactgaatgtgaacgactggccggaactgagagccctgttcgcgaggaacccggagaggattttccggctgctaggagattgtattgggatgatctcaagagaaaactaagtgaaaagctagattctacagacttcacaggaaccataaagcttctgaatgaaaatagttacgtgccccgagaagcgggttctcagaaagacgagaatctggctctgtacgttgagaatcagttccgtgagtttaaactttctaaagtctggcgcgatcagcattttgtcaagattcaagtgaaggacagcgcccagaattctgtaatcatcgtcgacaagaacggcaggctggtgtatttagtggaaaatccaggcggatacgtggcctatagtaaagcagccacagtgactggcaaactcgtgcacgcaaactttgggactaaaaaagactttgaggacctttatactcccgtgaacgggtccattgtaattgttcgcgcaggcaagattacctttgcagaaaaggtcgcaaatgcggagtcacttaacgcaatcggcgtcctgatctacatggatcagacgaagttccctatagtaaacgccgaactcagcttttttggacacgcccatctggggaccggagacccctatactcctggttttccctcttttaaccatacgcaattccctccttctcggtcatctggcctgccaaacatccccgtgcaaacaatctcccgtgccgcagctgagaagctgttcggaaacatggagggcgactgtccgtcggattggaagaccgactccacgtgtcgaatggtgacctctgaaagcaagaacgtcaaactaacagtctccaatgtgctgaaggagattaaaattttgaacatatttggggtgataaaagggttcgtcgagcctgatcattacgtggtggtcggtgctcagcgcgatgcatgggggccaggagccgctaaaagcggagttggcactgctctcctgctgaaactcgctcagatgtttagtgacatggtgttgaaagacggattccagccaagcaggagcattatcttcgcctcatggagtgcaggggatttcggatcggtaggagccactgaatggttggagggttaccttagctcactgcacctcaaggcctttacttatatcaatctggacaaagctgtgcttgggacgtctaacttcaaggtgtccgcctccccattattgtatacgctgatagaaaaaaccatgcagaatgtgaagcaccctgtgacgggacaattcctttaccaggatagtaattgggcttctaaagtcgaaaagctgaccctggacaatgcagcattcccgttcctggcctatagcggaatccctgctgtcagtttttgtttctgtgaggacaccgattacccttatctcggcaccacaatggatacctacaaggagctgattgagcggatccccgagttgaataaagtggctcgggcagctgcagaggttgccggtcagttcgtgattaaactgactcacgatgtggaattgaacttagattatgagcggtacaacagccagcttctctcatttgtccgggatttgaaccagtatagggcagacattaaagagatgggcctttcactgcagtggctgtactccgcgaggggagactttttcagagcaaccagcaggctcaccactgattttggcaatgctgaaaagaccgatcggttcgtcatgaaaaaactaaatgatcgtgtaatgcgggtggaatatcactttttgagcccctacgtatcgcccaaagagagcccattcaggcacgtattctggggatctggtagccataccctaccagccctgctcgagaatttaaaattgcggaaacagaataacggagcgttcaacgagactctgttccggaaccagttggcactagcgacttggactatacagggcgctgctaacgccctgtcaggcgatgtgtgggatatcgacaatgagttctag

SEQ ID NO: 244485 - DNA, 2283 bp, Artificial Sequence
  Description of Artificial Sequence: Synthetic coding sequence
atgatggatcaagcccgaagcgctttctcaaacctgttcggaggtgagccgctcagctatacgaggttttcccttgcccgtcaggtggacggcgataattcacatgtcgagatgaaactcgcggtagatgaggaggagaatgcagataataataccaaggccaatgttactaagcccaagcgctgttccggctcgatctgttacgggactattgctgttattgtgttttttcttatcggatttatgatcggctacctgggatactgtaagggcgtggagccgaaaacagaatgcgaaagactcgctggcacggagtcgcccgttcgggaagaaccaggcgaggatttccccgcagcaaggaggttgtactgggatgatctgaaacgcaagctgtctgagaagctggactctactgacttcaccggcactattaagctgttgaatgagaacagttacgtgccgcgtgaagcaggatcccaaaaagacgaaaatctggctctttacgtagagaaccagtttagagaattcaaactatctaaagtctggcgggaccagcacttcgtgaaaattcaggtaaaagattccgctcagaacagcgttatcattgtggacaagaatggacgccttgtctatctggtggagaatcccggaggttacgtggcatacagtaaggcagccactgtcaccggcaagctggtccacgctaactttgggacaaaaaaagatttcgaggatctgtacacacccgttaacggctcaatcgtgatcgtgcgagcaggtaagataaccttcgcggaaaaggtggctaacgcagaaagcctgaatgctatcggggtcttaatttatatggaccagaccaagttccctatagtgaatgctgagctttcattctttggacacgcacatcttggaacaggggatccatacactcctggcttcccaagctttaatcatacccagttcccgccatctaggagttccggccttcccaatatccccgttcaaactattagtcgcgcagcagccgagaagctgtttggcaatatggaaggtgattgtccctctgattggaagacagattctacatgcagaatggttacatccgaatctaagaacgtcaagctcaccgtgagtaacgtgctgaaggagattaaaattctgaacatatttggggtcatcaagggattcgtggaaccagaccactatgtggtagttggggcacaacgagatgcttggggccctggagctgccaagtcaggagtaggcacagccttgctcctgaaacttgctcagatgttctcagacatggtcctgaaggatggctttcagcctagtcgatccatcatcttcgcgagctggtcagccggagacttcggctccgtcggcgcaacagaatggcttgaaggctacctctcttccctgcacctaaaagcattcacctacataaacctggataaggcggtgctgggcaccagcaattttaaggtgtccgccagccctttactgtacacccttatagagaaaaccatgcaaaacgttaagcatcctgtgacaggacagttcctgtatcaggattccaactgggcctctaaagtcgaaaagctaaccctcgataatgccgcattcccttttttagcgtacagtgggattcccgctgtgagtttttgcttttgcgaggacaccgactacccctatttgggcactaccatggatacatacaaggagctcatagagagaatacccgaattaaacaaggtagcccgagccgcagctgaggtggccggacaatttgtgataaagcttacacatgatgtggagctcaatttagactatgaacggtataactcacagttgctttccttcgtccgagatctgaatcaatatagggctgacattaaggagatggggctttcccttcagtggttgtacagtgccaggggcgactttttcagggccacctctcggttaactacagactttgggaatgcagagaagacagataggttcgtgatgaaaaagctgaacgaccgggtgatgcgagttgagtaccactttctctcgccctatgtgtctccaaaagagtccccttttcgccatgtcttttggggaagtggctctcatacattaccagctctactggagaatttgaaactccggaaacagaataacggtgcctttaatgagaccctgtttcggaatcagctggccctggcgacttggacaatacagggagccgctaatgccttatctggggacgtttgggacattgataacgaattctag

SEQ ID NO: 244486 - DNA, 1437 bp, Artificial Sequence
  Description of Artificial Sequence: Synthetic coding sequence
atggaccaaaccaagtttccaatcgtaaacgctgaactcagtttcttcggccacgctcacctcggcaccggggacccttacacgcctggcttcccttcttttaatcacacccagttccctccttctaggagctcaggacttcccaacattccagtgcaaacaatatccagggcagctgcggagaagcttttcggaaatatggagggcgattgcccatccgattggaaaacggactcaacttgccgaatggtgactagtgagtccaagaatgtcaaactcaccgtgagcaacgtgctaaaagagatcaaaatcttgaacattttcggcgtgatcaagggcttcgtagagccagatcattacgttgtcgtcggggctcaacgggatgcatggggacccggagctgccaagagtggcgtcggaacagctctgctgctgaaattggcacagatgtttagcgatatggtgctcaaggacggtttccagccctcgcgttccatcatttttgcatcttggagtgccggtgacttcggttccgtgggggctaccgagtggctggaaggctatctatcttccctccacctgaaagcctttacctacatcaacctcgacaaggcagtgcttggcacttcaaacttcaaggtcagcgcgagtcccttactttatacattgatcgagaaaaccatgcagaacgtgaagcatcccgtgaccggccagttcctttaccaggactctaactgggcgagcaaagtcgagaaactgacgctggataacgctgcatttcctttcctcgcttacagcggaattcccgcagttagtttttgtttttgcgaggacacagactacccttaccttggaactactatggacacatacaaggagcttattgaacggatacccgaactcaacaaggtggcaagggctgctgccgaagtagcaggccaattcgtcatcaaattaacccacgacgttgagctgaacctggactacgagagatacaacagtcagttactcagcttcgtgagagatctgaatcagtaccgggctgacattaaggagatgggcctgagtttacaatggctgtattcagcgaggggcgatttcttcagggccacaagcaggcttactaccgacttcggcaatgccgaaaaaacagacagattcgtaatgaagaaactcaacgatagggtgatgagggttgagtatcattttctgagcccctacgtgtctcctaaggagagcccatttcgacacgtcttctggggctcaggttcccacacactgccagccctgcttgagaaccttaagttgcggaagcagaacaacggcgcattcaacgaaactctcttcaggaatcagctggcattagcaacctggactatacagggagccgcaaatgccctctccggagatgtgtgggatatcgacaatgaattttag

SEQ ID NO: 244487 - DNA, 42 bp, Artificial Sequence
  Description of Artificial Sequence: Synthetic coding sequence
atggatcaggccaggagcgccttttcaaacctggatctgtag

SEQ ID NO: 244488 - DNA, 11493 bp, Artificial Sequence
  Description of Artificial Sequence: Synthetic coding sequence
atggcttttgtcgccacacagggcgctacagtggttgatcagacaacgttgatgaagaagtacttacagtttgtggccgcactgaccgatgtgaatacgcccgacgaaactaaattaaagatgatgcaggaggttagcgaaaactttgaaaacgtcacctccagcccacagtactccactttcctggagcatataataccccgatttttgacgtttttacaggatggcgaagtccagttcctgcaagaaaaacctgcccagcagttgaggaagctcgtgctggaaatcatccatcgtatcccgactaatgagcaccttcgaccacacactaagaacgtactgtccgtgatgttcagatttttggagacagagaatgaggagaacgtgttaatatgtttaagaattatcattgagctccacaaacagtttaggccacccataacacaggaaattcatcatttcctggacttcgtgaaacagatctataaggagttacccaaggtcgtgaacaggtacttcgaaaacccacaggtaattcctgagaatactgtaccacctcccgaaatggtcggaatgatcacaacaattgctgtaaaagtcaaccctgagagggaagactcggaaacgagaacacactctatcattcccagagggagcctgtccttgaaggtgcttgccgaactgccgattatagtcgtcctgatgtaccagctatataagttgaacatccataacgttgtggccgaatttgtgcctctgataatgaacacaatagcaattcaagtaagcgcccaagcaaggcaacacaaactgtacaataaagagttgtatgcggacttcattgcagcacagattaaaacgctaagtttcctggcatatattataaggatctatcaggagttggttacaaaatactcacaacagatggtgaaggggatgctgcagctactcagtaattgtcccgcagaaactgctcacctcagaaaagaacttctcatcgccgcaaaacatattctgacaacagagctgagaaaccagtttataccttgtatggacaaactgtttgatgagtcaatactgattggcagtgggtatacggccagggagacacttagaccactggcatacagcacactcgcggatctggtccatcatgtgagacagcacctccccctgtcagacctgtctctcgctgtgcagctcttcgccaagaatattgacgacgaaagcctgccttccagcatccagactatgtcctgtaaattattgctgaacttggtagattgcattaggagtaagtcggagcaagagtcaggaaacggtcgggacgtattaatgcggatgctggaggtgtttgtcttaaaattccacaccatcgcccgataccagctgagcgcaattttcaagaagtgcaaaccacagtccgagctgggcgcagttgaagccgcactaccaggggtccctactgcgcctgccgctcctggccctgctccatcccctgctccagtgcccgctccacctcctccccctccaccccctcctcccgcaacccctgttacccctgcccctgtcccgccttttgagaagcagggggagaaggacaaggaagacaagcaaaccttccaggttaccgactgccgcagtctcgtgaagacactcgtctgtggggtaaaaaccattacctggggaattactagctgcaaggccccaggcgaagctcagtttatacctaacaagcaacttcagcccaaagagactcaaatctatattaaacttgtgaagtatgcgatgcaggctctcgacatctaccaggtgcagattgcaggcaacggacaaacttacattcgtgtggctaactgccagactgtgaggatgaaagaagaaaaggaagtgttagagcactttgctggtgtttttacaatgatgaacccattgacttttaaggagatcttccagaccactgtcccctacatggtggaacggattagcaagaattacgccttgcagatcgtggcaaattctttcctcgcgaacccaaccacatcagccctcttcgccactatcctggtcgaatatcttttagaccggctgccagagatgggaagcaacgtagagctgtcgaatctatacttaaaactcttcaagctggtcttcggatccgtgagtctctttgccgcagagaacgaacaaatgctcaagccgcacttgcataagatcgttaattccagcatggaactggctcagaccgcaaaggaaccgtacaactacttcctgctgctccgggctttattcaggtccatcggcggtgggtcccatgatcttctgtaccaggagttcttgccattgctacctaatctgctgcagggcctcaatatgctgcagtccgggctgcacaagcagcatatgaaagacctgttcgtcgagctttgtctgacagtccctgtacgtctaagcagtctgttaccctatttgcctatgttaatggaccccctggtgtctgctctgaacggatcacagacacttgttagccaggggctgcgtacactggagttgtgcgtggacaatttgcagcccgactttctctacgaccatatccagccagtgagagcagagctgatgcaggccttatggagaacccttaggaacccagcggactcaatcagccatgtggcatatcgggtattgggcaagttcggagggagcaaccgcaagatgctcaaggagagccagaaactacattacgttgtgacagaagtgcaggggccatccattaccgttgaattcagtgattgtaaggcatccctccaactgcctatggagaaagctatagaaactgccttggattgcctaaagagtgccaatactgagccatactatcgccgacaggcctgggaggtgatcaaatgtttcttggttgcgatgatgtccttggaagacaataaacacgctctgtaccaactcttagcccacccaaatttcacagagaagactattccaaatgtcataattagccacagatacaaggcccaggacactcccgcaaggaagaccttcgaacaggccctgaccggagcctttatgagcgcagtgattaaggatttaaggccttccgcactgccatttgtcgcctccctaattcgtcactacactatggttgccgtcgcccaacagtgcggcccattcttgctgccttgctaccaggtcggatcgcagcctagcacagctatgttccacagcgaggagaatggttcaaagggaatggatccattagttcttattgacgcaattgctatttgtatggcctacgaggaaaaagaattgtgcaagattggggaggtcgcactggccgtgatatttgatgtggcgagcatcatcctaggcagtaaagaaagagcctgccagctgccgctcttctcttacatcgtcgaaagattgtgtgcatgctgttacgaacaagcctggtacgccaaactgggcggagttgtttctatcaaatttttaatggagcggctccctctaacatgggtgttacagaaccagcaaacgtttctcaaggcactcctgttcgtgatgatggatttgaccggagaagtgagcaatggggctgtagcgatggccaaaaccacgcttgagcagctcctgatgaggtgcgctacacccctgaaagatgaggaacgcgcagaggaaattgttgctgcccaggagaagtcattccaccatgtaacacatgatcttgtgcgggaggtcaccagtccaaattcaactgttcggaagcaggccatgcattcactccaggtgctcgcacaagtgactggcaaatccgtaaccgtgatcatggaaccccataaggaagtgctacaggatatggtgcctccgaagaagcacctcttgaggcaccagcctgctaacgcgcagatcggacttatggaaggtaacactttttgtaccacattgcagccaaggctgttcaccatggacctgaatgtggtggagcataaagtgttctatactgagttgctcaacctatgcgaagccgaagattccgccctgacaaagctgccctgttacaaatctctccctagcctcgtgccattgagaatcgctgccctgaatgctttggctgcctgcaattatttgcctcagagtcgtgaaaaaattattgcggctctgtttaaagccctgaatagcaccaactccgaactgcaggaggccggagaggcatgcatgaggaagttcctagagggcgctacaatcgaagtagaccagatccatacgcacatgagacccctcctcatgatgttgggggactaccggtcgctaacactcaacgtggtcaataggctcacttcagtgaccaggcttttcccaaatagctttaatgataagttttgtgaccagatgatgcagcacttacgcaagtggatggaggtagtcgttattacccacaaggggggacaacggagcgatggaaatgaaatgaagatctgcagcgccatcatcaacctgttccatttaatacccgctgccccacagaccctggtgaaacctttgctggaggtggttatgaaaaccgagagagccatgctgatagaggcgggttccccgttcagagagcctctgattaagtttttgaccagacatccttcacaaaccgtagaactcttcatgatggaggcgactctaaacgacccgcagtggtccaggatgtttatgagcttcctgaagcataaagatgctcgtccactgagggacgtccttgctgctaatcccaatcggtttataactctattgctccctgggggagcacagaccgcggtgcgtccaggatctccgtctaccagtactatgagactcgatctacagttccaggctatcaaaataataagcattatcgtaaagaatgacgacagttggctagcttcacaacatagtcttgtaagtcagctgcgaagagtgtgggtgagcgaaaacttccaggagaggcatagaaaggagaacatggctgccacgaactggaaggaaccgaagctgctcgcctattgcctgctgaactattgcaagcgcaattacggagatattgagcttttattccagctcttgagggctttcaccgggcgatttctctgtaatatgactttcttgaaagaatacatggaggaagaaatccccaaaaattactcaatcgcacagaaaagagccctttttttccggtttgtagatttcaatgacccaaattttggcgacgaactcaaggctaaagtcctgcaacacattctgaacccagcttttctgtattcctttgaaaaaggcgagggggaacagctgctggggcctcctaaccccgagggtgataatcccgaatcaatcacatccgtgtttatcaccaaggtgctggaccccgaaaaacaggccgacatgctggattccctgcgcatttacctactccagtacgccaccctactcgtggagcacgcaccgcaccacatacacgacaacaataagaatcgtaactctaaactgagaagattgatgacattcgcctggccctgcctgttgtctaaggcctgtgtggatccagcttgtaagtatagtggccatctgctgcttgcccatatcatcgccaagtttgccatccacaagaaaatcgtccttcaagtgtttcattctctgctaaaagcgcacgcgatggaggctagggctatagttaggcaggccatggcaatactgacgccagctgtccctgccagaatggaagacggtcaccaaatgctgacacactggacccgcaaaattatcgttgaggaaggtcatacagtcccacaacttgtccatattttgcatttgatagtgcagcactttaaggtctattaccccgtccgccaccacctagtgcagcacatggtgtccgctatgcagcggctgggctttacaccctccgttacaattgaacagaggcggctggcagtcgacctgagtgaggtggtaatcaaatgggaactgcagcgaatcaaggaccagcaacccgacagtgacatggatccgaactctagcggcgagggtgtcaatagcgttagctccagcattaagcggggactaagtgtggacagcgctcaagaagtcaagcgcttccgcaccgctacaggagctatctccgccgtgttcggacgtagtcagtcactcccaggggctgattctctgcttgctaagccaatcgacaagcagcacacagataccgttgtgaatttcctgatccgtgtggcatgtcaggtgaatgataacactaacactgctggatctcccggagaggtccttagccggcgatgcgttaacctgcttaagaccgcactgaggccagatatgtggccaaagagtgagctgaagctgcaatggtttgacaagctcctgatgacggtggagcaaccaaaccaagtgaattatggcaatatatgtacggggctcgaggtactctcttttttgctgaccgtgttacaaagccctgccattctaagtagttttaagcctctacagcgaggcattgccgcttgcatgacctgtggaaatactaaggtactccgcgcagtgcactccctcctgtcacggttgatgtcgatattcccaaccgaacccagcacctcatctgtggcctccaagtacgaagagcttgagtgtctatatgctgcagtggggaaagtgatttacgaaggccttaccaactatgagaaagccactaatgcaaacccctcacagctattcgggacactgatgatactgaagagtgcctgctcaaacaatccatcttacatcgaccgtttgatctctgtgtttatgcggagcttacagaaaatggtgcgtgaacatctcaaccctcaggctgcctccggatccaccgaagctacttctggcacttctgagctcgttatgctgtctcttgagttagtgaagacccggctcgccgtaatgtccatggagatgaggaaaaattttatccaagctattcttacatcacttatagagaagagcccagacgccaaaatccttcgagccgtagttaaaatcgtggaagagtgggttaagaataattcccccatggccgcaaaccagacccccacactccgagagaaaagtatccttctcgtgaagatgatgacctacatcgagaaacggtttcccgaggatctggagctgaatgcacaatttcttgaccttgtgaattatgtgtatcgggatgagacactctccggcagcgaactgaccgccaaactggagcccgcatttctgtctgggttgaggtgcgcccaaccgcttatccgcgcaaaatttttcgaagtgtttgataactccatgaaaaggcgcgtgtatgagaggttgctgtacgtcacatgcagtcagaactgggaggccatgggaaaccacttctggattaaacaatgtatcgaactgctcttggctgtttgcgagaaatctactcctattggcactagctgccagggagctatgctgccctccatcaccaatgtgatcaacctggccgatagccatgacagagctgcttttgccatggtaactcacgttaaacaggagccccgtgaacgggagaattctgaatctaaggaggaggatgttgaaatcgacatcgagcttgctcccggagatcagacttctacccccaagaccaaagagctctctgagaaggatataggcaatcaattacacatgttgaccaacagacacgacaaatttttggatactttaagagaagttaaaactggcgctttattatcggctttcgtccaactgtgccatatctccaccacactggctgaaaagacatgggttcagctgtttccgagactatggaaaatcctctctgaccgtcagcagcacgctttggcaggtgagatttcacccttcctgtgttctggcagtcaccaggtgcagcgagattgtcagcctagtgccctgaactgcttcgtggaagctatgtcccaatgcgtcccacccattccgatccggccatgcgtgctgaaataccttggaaaaacgcacaatctttggtttcgttcgacactgatgctcgagcaccaggctttcgagaaggggctgtcgttgcagatcaagcccaagcagaccacggagttctatgaacaagagtctataacccctccccagcaggagatattagattccctcgctgagctttatagcctgctgcaggaagaggacatgtgggccggtttgtggcaaaaaaggtgtaagtattccgagactgcaaccgctatcgcatacgaacaacacggtttcttcgagcaggcccaggaatcgtatgagaaagccatggataaagccaagaaggaacatgaacgaagcaatgcgagtcccgctattttccctgaatatcaactgtgggaagatcactggatccggtgtagtaaggagctgaatcagtgggaagcactcacagagtatggacagtctaagggccacatcaatccatatctggtcctggagtgcgcatggagggtctcaaattggaccgccatgaaagaggccctggtgcaggtggaggtgtcctgccctaaggagatggcatggaaagtgaacatgtataggggctatctggccatctgccatcccgaagagcagcagctctcctttatcgagcgactggtcgagatggcaagtagtctcgctatccgtgagtggaggagacttccccacgttgtctcacacgttcatacgccactgctgcaagccgcacaacagataattgagctgcaggaagccgctcagatcaacgctggcctgcagccgacaaacctggggaggaacaactctttacacgatatgaagaccgtggtgaaaacctggcgaaatcgactccctatcgtgtccgatgatttgtctcactggtcaagcatatttatgtggaggcagcaccattaccaggctattgtgaccgcctacgaaaactcgtcacagcacgaccccagtagcaacaatgcgatgctaggcgtgcatgctagcgcctccgcaattatacaatatggaaaaattgcacggaagcaggggttggttaacgtcgctctggatattttatcaagaatccataccatccccaccgtgcccatcgtggattgtttccagaagattcgccaacaggtgaagtgttacctccagctagctggagtgatggggaaaaacgagtgtatgcaaggcctggaggttattgaatccactaacctaaaatactttactaaagaaatgacagccgagttctacgctctcaaagggatgttcctggctcaaattaacaagtccgaagaagcaaataaagcattcagtgccgctgtgcagatgcacgacgtgcttgtgaaagcctgggcaatgtggggagactacctggaaaacatctttgttaaggagcggcagctccacctgggcgtgagcgctattacctgctacttgcatgcatgtcgacaccagaatgagtctaaatcacggaagtacctggccaaggtcctctggttactgtcctttgatgacgacaaaaataccctcgccgatgccgtcgacaagtattgtatcggcgtgccaccaatccagtggttggcctggatccctcagcttcttacttgcttagtgggcagtgaaggcaagctccttctaaatctcatttcacaggtcggcagagtctacccacaggcggtgtacttccctattagaacgctctacctgactctgaagatagagcagagagagaggtataaatctgatccgggaccaatccgtgccacggcaccgatgtggcgctgctcaagaataatgcatatgcagcgggaattacatcccacacttctgtccagcctggagggcatagtggatcagatggtctggtttcgcgaaaattggcatgaagaggtccttcggcaattgcagcagggccttgccaagtgctactctgtggctttcgagaaaagtggagccgtgtctgatgccaaaatcacccctcacaccttaaactttgttaaaaaactcgtttccactttcggcgtgggcctagaaaacgtgtccaatgtgtcgaccatgttttcctctgctgcgagcgaatctctggcgaggcgagcacaggcgacggcacaggacccggtcttccaaaagctcaaagggcagtttacgactgacttcgatttctctgttccagggagcatgaaactccacaacttgatttctaaacttaaaaagtggattaagatcctggaggccaaaactaaacagctacccaagttctttctgatcgaggagaagtgccgattcttgtctaacttttcggcgcagaccgctgaagtggaaatacccggagaattcctgatgccaaaacctactcattactacatcaaaattgccagattcatgccgcgagtggagatcgtacaaaaacacaacacagccgctcggagactgtacatccggggtcacaacgggaaaatctatccttaccttgtcatgaacgacgcgtgtcttaccgaaagtcggagggaggagcgagttcttcagttactgaggctgctgaatccctgcctggagaagcgaaaggagacaactaaacgccatctattctttacagtacccagagtggtcgctgtgtcgccacaaatgcgccttgtggaggataatccatcatctctttcactggttgagatctacaagcaacgctgcgccaagaagggtatcgaacatgataacccaatcagccgctattatgatcggcttgccactgtccaggccagagggacgcaggcatcacatcaggtacttcgcgacattttgaaggaagtgcagtctaatatggttcctcgcagtatgctgaaggagtgggcattacatacattcccgaacgccactgattattggacctttcgaaaaatgttcacgattcagctcgctctcattggattcgctgaattcgtgctgcacctgaataggctgaatcctgagatgctccagatcgcgcaggataccgggaagctgaacgtagcctacttccgcttcgacatcaacgatgctacaggtgatctagacgcgaacaggcccgtaccatttaggttgactccaaacatcagcgaatttctgactactatcggagtgtctggcccactgacagcgtctatgattgcggtggcgcgatgttttgcccagccaaacttcaaggtcgacggcattcttaaaacagtattgcgcgacgagataattgcgtggcataaaaagacacaggaggacactagctctccgctttctgcagcgggacagccagagaacatggattctcaacagctggtgtcactggtccagaaagcagtcacagcaataatgacacgactgcataaccttgctcaattcgagggaggcgaatctaaagtgaacaccttagtcgccgctgctaatagtttggataacctctgcagaatggacccagcctggcatccttggctgtag

SEQ ID NO: 244489 - DNA, 11580 bp, Artificial Sequence
  Description of Artificial Sequence: Synthetic coding sequence
atggccttcgtggccacacagggagcaacagtcgtggaccagaccaccctcatgaaaaagtatctgcagttcgtggcggctcttacagatgtcaacacccctgacgagacaaagctcaaaatgatgcaagaggtgtctgagaatttcgagaatgtgacctcttcaccccagtacagcacattcctggagcacataatcccgagatttctcacattcctgcaggatggagaggttcaattccttcaagagaagccggctcagcaattgaggaagctggtcctggaaatcattcaccggatccccacaaatgaacatctgcgtccccataccaaaaatgtattatccgtgatgttcagatttctggagacagagaatgaggagaacgtgctgatctgcctgcgaatcattatcgagctacataagcagtttagaccgccaatcacacaggagatccaccactttctggatttcgtcaaacagatctacaaagagcttccgaaggttgtgaacaggtatttcgagaacccacaggtaatccccgaaaatactgtgccaccccctgagatggtcggcatgataaccactatcgcagtgaaggttaaccccgaacgggaggattctgaaacccggactcacagtattataccccgaggctctctttccctaaaggtgctggctgaactccccatcattgttgtgctgatgtaccagttgtacaagctgaacatccataatgtggttgcagaattcgtcccactaatcatgaatacaattgcgatacaggtcagcgcccaggcccgacagcacaagctctataataaggagctgtacgccgatttcattgcagcccaaattaaaactctcagcttcctggcctacatcattaggatttatcaggaactcgttactaagtacagccaacagatggtgaaagggatgctgcaattactctctaactgtcctgcggaaactgcccacctccgtaaagaacttctgatcgcggcaaaacatatcctcaccactgaactccgtaaccagttcataccctgtatggataagctgttcgacgaaagtatcctgataggatcaggttacactgccagagagacgctacgcccactagcgtactcgaccttagctgaccttgttcaccacgtgcgccagcacctacctctgagtgatctgtccctggcagtccagctatttgcaaaaaacattgacgatgagagtttaccatctagcattcaaacgatgtcttgtaaacttctcttaaatttagtcgattgcatcagaagcaagtctgagcaggagagtgggaacggacgtgacgtactcatgcgtatgctcgaggtgtttgtgctgaagttccacacgattgccaggtatcaactctctgccatcttcaaaaagtgcaagccgcagtcagagctgggagccgtagaggcagccctgcccggtgtcccgaccgctcccgctgctcctggacccgctccaagtcctgctcccgtacccgcacctccccctccgccaccgccacctcccccagcgacacccgtgacccctgcaccagtcccaccattcgagaagcaaggcgagaaggacaaagaagataaacagactttccaggtgactgactgcaggtcgctcgtgaagactctggtatgtggcgtaaaaaccatcacttgggggattacctcttgtaaggccccaggagaggcccaatttattcctaataaacagctgcagccgaaggagacgcaaatctacattaagctcgtgaaatatgccatgcaagctctggacatttatcaggtgcagatagccggaaatggacaaacctatatacgagtggctaattgccagactgtgcgcatgaaggaggagaaggaagtcctagagcactttgctggcgtgttcacgatgatgaatcctctgacctttaaagaaatattccaaactaccgttccatacatggtggagaggatttctaagaactacgccctccagattgtggcaaatagcttcttggccaaccccaccacctcagcccttttcgcaaccatccttgtcgagtaccttttagacaggctcccagaaatgggcagcaacgtggaactaagtaatctttatctaaagctgtttaagctggtgtttggctcagtgtcactatttgctgccgaaaatgagcaaatgttgaagccacacctccacaaaatagtgaatagttccatggagcttgcccagacagcaaaagaaccctataactattttctcctcctgagggccctgttcagaagcattggcggtggctcacacgacctgctgtaccaagagttcttaccactgcttccaaatttacttcaaggattgaacatgctgcaaagtggcctgcataaacagcatatgaaggacctgtttgtggaactgtgcctaaccgtacccgtgcggctgtcttccctcctgccgtaccttccgatgcttatggatcctctagtgtccgccttaaatggctcccaaactctggtaagccaaggactacgtacgctggagctctgtgtggacaatttacagcccgatttcctgtatgaccacattcagcccgtaagggctgaattgatgcaggctctatggagaaccctccgcaatcctgccgacagcattagccatgttgcatatcgagtgctgggcaagtttgggggttccaatagaaaaatgctcaaggaatctcagaaacttcactacgtggtgacggaggtccaagggccaagtatcactgtggagtttagcgattgcaaggcttccctccagctgcctatggaaaaggcaatagaaactgcgctcgattgcttgaagtcagcgaacacggaaccatactatcggcgacaggcctgggaggtgatcaagtgttttctcgtggcgatgatgtccttggaggataacaagcacgccctctaccaattgcttgctcatcccaatttcactgaaaaaaccatccctaatgtgatcatttcgcatcgctataaggctcaggacacaccagctagaaagacgtttgagcaggctcttacgggggctttcatgtctgccgtgataaaggacctgaggccaagtgctttacccttcgtggcctccctaatccgccactataccatggttgcagtggcacagcagtgcggcccatttctcctcccctgctatcaagtcggcagccagccaagtactgcaatgtttcatagcgaagaaaacgggtcaaaaggcatggatcctctggtgctcatcgatgccattgccatttgtatggcctatgaagagaaagaactctgtaagatcggtgaagtagctcttgcagtaatctttgacgttgcctccattattctggggagcaaggagcgagcctgtcagcttccactgttctcgtacattgttgaacgtctgtgtgcctgctgttacgaacaggcatggtacgcgaagctgggaggagtggtgtctatcaaatttttgatggaacgtctgcctttgacttgggtgctgcagaatcaacagacattcctgaaagctctgctgtttgtgatgatggatctcactggcgaggtgtctaacggagcagtcgcaatggctaaaacgaccctcgagcagttgctgatgagatgcgccacccccttgaaagatgaagaacgcgctgaggagatcgtcgccgcacaggagaagagctttcatcacgtgacgcacgacttggtgcgggaggtaacgtctccgaatagtacagtgcgaaaacaggctatgcacagcctgcaagtcctagcgcaagtaaccggaaaaagcgtaactgttataatggagccccataaggaggtcttgcaagatatggtccccccaaaaaaacatctgctgcgtcatcagccagcaaatgcccagataggactcatggagggaaataccttttgtaccactcttcagccgaggctgttcacaatggacctgaacgtggtggagcataaagtcttctacaccgagttgttgaatctgtgcgaggctgaagattctgccctcaccaaattgccatgctataaatcactgccatcactcgtcccactaagaattgctgcgctgaatgccctggcagcttgcaattacctgcctcagagtcgcgagaagataatcgcagcgctgtttaaggccttgaattccaccaactccgagctgcaggaagcaggcgaagcatgtatgcgcaagttcttggagggcgcaactatagaggtggaccaaattcacactcacatgaggccgctgttaatgatgctaggagattaccgaagtctaactctgaatgttgtcaatagactgaccagcgtcaccaggctgttcccaaactcatttaacgacaagttttgtgatcaaatgatgcagcaccttaggaagtggatggaggtggtggtgattacacacaaaggcggacagcgatctgacggcaatgaatctattagcgagtgcggcagatgtccactctctccattctgtcagtttgaggagatgaaaatctgtagtgcaatcattaacctgtttcacctcattccagctgctcctcagacactcgtaaaacccctgctagaggttgttatgaagacggaacgcgctatgctgatagaggccggaagcccctttcgtgagccactaattaaattcttgacacggcacccaagccaaactgtagagctgtttatgatggaggcaacccttaatgacccccagtggagtcgcatgttcatgtcatttctgaaacataaggatgccagacccctgagagatgtgcttgccgctaacccaaataggtttataactctgttgctgcctgggggagctcaaactgcggttagacccggatccccgtcaacttccaccatgcggctagaccttcaattccaagcaatcaagatcatctccattattgtcaagaatgacgactcatggttggcctcgcagcattccctggtttcacaactcaggcgggtgtgggtgtcggagaacttccaggaaagacaccgaaaagaaaatatggctgctaccaattggaaggagcctaaattgttagcgtattgtttattaaactactgcaagcggaactacggtgatattgagctgttattccagttgttgcgggcattcaccggtagattcctgtgtaacatgaccttcctgaaggagtatatggaagaagaaatacccaagaactatagcattgctcagaaaagagctctcttcttcagatttgtagacttcaacgatccaaatttcggggacgagttaaaagctaaagtccttcagcacatattaaacccagccttcttatactcattcgaaaaaggggaaggagagcagctcctgggccctccgaatcctgagggcgacaatcctgaatcaatcacgagcgtgttcatcacaaaggtgcttgaccctgagaaacaggccgacatgctcgacagcctccggatctacctgctacagtacgccactctcctggtggaacacgctccacaccatattcatgacaacaacaagaatagaaactcaaagctgaggaggttgatgaccttcgcctggccatgccttctgagtaaagcatgcgtggatccagcatgcaaatacagtgggcacctgttgctcgcccacattattgcaaagttcgcaatccacaagaagatcgtattgcaggtgttccattcccttttaaaggcgcatgccatggaggccagagccatcgtgaggcaggccatggctatcctgactccggcagtcccagcgagaatggaggacgggcaccagatgttgacacattggacccgtaagatcatcgttgaagagggtcataccgtccctcagctggttcatatcttacaccttattgtgcaacatttcaaagtttactacccagtgcggcaccaccttgttcagcacatggtgtccgccatgcagcggttgggattcactccttccgtaacaatagaacagcgccgactagccgtggacttgagcgaggttgttatcaaatgggaactacagaggatcaaagaccagcagcccgacagcgacatggacccaaattcttcgggggagggggttaattctgtgtcctcttcaattaagaggggcctttcagtggattccgcccaggaggtaaaaagattccgaaccgctactggcgctatttccgcagtgttcggcaggtcccaatccctgcccggtgccgacagcctgctggctaagcccattgacaagcagcataccgacacagtggtaaatttcctgattcgcgtcgcctgccaggttaacgacaatactaataccgccggttccccaggggaggtattatccagacggtgtgtgaatttattgaagaccgctctcaggccagatatgtggcctaaatcagaacttaaactacaatggtttgacaagctgctgatgacagttgagcagcctaatcaggtcaattacggcaatatatgtacaggtctcgaggtgctgagtttcctgttaacggtgctgcaatcacctgcaatcctctcttcattcaagcccctccagagaggaatcgccgcatgcatgacctgcgggaataccaaagttcttcgagccgtccatagcctgctgagcagattaatgtcgatcttccctaccgagccatccacgagctctgtcgcttcaaagtacgaggagcttgagtgcctctatgcggcagtcgggaaagtaatctacgagggtcttactaattacgagaaggctactaacgcaaacccctcccagttattcgggacactaatgatcctcaagtcggcctgctccaataacccctcctacattgataggttgatctccgtctttatgcggagtctccagaagatggtccgtgaacatttgaatccccaggcagcctctggcagtaccgaggcaacatcaggtacaagtgagttagtgatgctctcactggagcttgtaaaaaccagactggccgtgatgtcaatggaaatgagaaaaaatttcattcaggctattcttacttcactgattgaaaaaagccctgacgccaaaatcttaagagccgtcgtgaagattgtcgaagaatgggtgaagaacaactctccaatggcagccaatcaaactccaaccttacgggagaagtcaatccttctggtcaagatgatgacatatattgagaaacgcttcccagaggatctcgagctgaatgcccagttcctggatctggtgaactacgtatacagagatgagacgctatcgggctccgagttaaccgccaaattagaaccagcttttttatcgggcctgcgttgtgctcagcccctgattcgagcgaaattctttgaagtgttcgacaacagtatgaagcggcgtgtgtatgagagactgttgtacgtgacatgttcacagaactgggaggctatggggaatcacttctggatcaaacaatgcattgaattactgctcgccgtgtgtgagaagtctacacctatcggaaccagctgtcaaggggcaatgttaccatctatcaccaatgtgattaacctggctgacagccatgacagggccgcattcgccatggtcactcatgtgaagcaggagccccgagagagggagaacagcgaaagcaaggaggaggacgttgaaatcgatatcgagttggcacccggagaccagacatccacgcctaagactaaagaattatccgaaaaggacattggcaaccaactacatatgctgactaaccgccatgataagtttctggacacactacgggaagtgaagaccggagccctgctcagtgcttttgtgcagctttgccatatttcgacgaccctggccgagaagacatgggtgcaactgtttcccaggctctggaagattctgtcagatcgccagcagcacgcactagctggcgaaatttctccgtttctctgtagcggcagtcatcaggtgcagcgggattgccagccgtctgcgctgaactgcttcgtcgaagccatgagccagtgcgtgccacctatccccatcaggccttgcgttttgaaatacctggggaagacacacaatctctggttcagaagtaccctcatgttggaacatcaggccttcgaaaagggactgagcctccagattaaacccaagcagaccaccgagttctacgagcaggagagcataactcccccacaacaggaaattctagatagtctggcagagttatattccctcctgcaggaagaggacatgtgggccggattgtggcagaagcgatgcaagtattcagagacagccaccgccattgcatacgagcagcatggatttttcgagcaggcccaggaatcttatgagaaggctatggacaaagccaagaaggagcacgagcgctccaacgccagccccgctatatttcccgagtatcagctttgggaagatcactggatcagatgtagtaaagaacttaaccagtgggaagctctgaccgagtacggacagagcaagggacacatcaatccttatctggttttggagtgcgcatggcgcgtcagcaattggaccgccatgaaggaggctctggtacaagtcgaagtaagctgtcccaaggagatggcctggaaagtgaacatgtaccgcggatacctcgctatatgccaccctgaagagcagcagctgagctttatcgagagattggtggagatggcgtcgtcactggctatcagagagtggcgtcggctcccacatgtggtttctcacgttcacacaccgctattacaggccgctcagcagataatcgagctgcaggaggctgctcagatcaacgctggtctacagcctaccaatctgggtaggaacaattccctgcacgatatgaaaactgtggtaaaaacatggaggaaccggctgccaatcgtttccgacgacctctcgcactggtcaagcatctttatgtggcgacagcatcactatcagggtaagcctacttggtcgggcatgcacagctcgtcgattgtaactgcttatgaaaactccagccagcacgacccttcatccaataacgctatgctaggggtccacgcttctgcttctgctatcatccagtacggcaagatcgctagaaagcagggcctcgtcaacgtcgccctggacatcctcagccggatccacactatcccaactgtaccaatcgtcgattgctttcagaagatccgacagcaggtgaagtgctatcttcaactggccggagtgatgggtaaaaacgagtgcatgcagggactggaagtgatcgaatccactaatctgaagtatttcactaaggagatgacagctgagttttatgcgttgaaaggtatgttcctcgcccagatcaataaatccgaggaagcaaacaaagccttctcggctgcagtgcagatgcacgacgtgctagtgaaggcgtgggccatgtggggcgattacctagaaaatattttcgtcaaggagcgccagctgcaccttggggtgtcagccattacatgttacctgcatgcttgccgccaccagaacgaatccaagtctaggaaatacttagcaaaggtgctttggttgctgagctttgacgatgataagaacaccctggctgatgccgtggataaatactgcatcggcgtgccgccaattcagtggctcgcttggattccccagctcctgacatgcctcgtgggctctgagggcaagctgctgctgaatctaatcagccaggtaggtcgcgtgtacccacaggccgtgtacttccccattaggacactgtacttaaccctgaagattgagcagagggagaggtacaaatccgaccccggacctatccgagccacagccccaatgtggcgctgttcccgcattatgcacatgcagagggaactgcacccaaccctcttatcaagtctggagggcattgtggaccagatggtttggttccgggagaattggcacgaagaagtgcttagacagctccagcaggggcttgccaagtgttacagtgtggcattcgagaagtctggtgccgtgagtgatgctaaaatcactccacacaccttgaattttgtcaaaaagctggtgtccactttcggagtggggcttgagaatgtgagcaacgtaagcaccatgttcagtagcgccgcttcagaatccctggcccgtcgggcacaagcgacagcccaggacccggtgtttcagaaactgaagggtcagtttaccaccgatttcgattttagcgtgcctggatcaatgaagctgcacaacctgataagtaaactgaagaagtggatcaaaattctcgaagctaagactaagcagttgcccaaattcttcctgatcgaggagaagtgtagatttttatctaacttttctgcgcagaccgctgaggtggagatccccggtgaattcctcatgcctaaacctacacattactacattaagattgctagatttatgccccgagtagagatagtgcagaaacacaacactgcagccaggcggctttacattagaggccacaatggaaaaatttacccctacctagttatgaacgatgcctgcctcaccgagagccggagggaggagagagtacttcagttgcttcggctcctgaacccgtgtctcgagaagcgaaaagagacaaccaagaggcacttgttcttcacggttccacgggtggtggctgtgagtccccaaatgaggctggtggaagacaatccgagctctttgtcgttagttgagatctataaacagcgctgcgctaaaaagggaattgagcatgataatccgatctctaggtattatgatcgtttagctaccgtgcaggcaaggggcacccaagcctcacaccaggtgcttcgcgacatactgaaggaagttcagtccaatatggtgcctaggtccatgttaaaggagtgggccttacacacatttccaaatgccactgattattggaccttccggaagatgtttacaatacaattggcgttgattgggttcgccgaatttgttttgcacctgaacaggctcaacccagaaatgttacagatcgctcaagatactggaaaactgaacgtggcatattttcgcttcgatattaacgatgccaccggtgatcttgacgcaaacaggccagttccctttcgcttaacacctaatattagtgagttcctgacaaccatcggagtgtccggtccactgacggccagtatgatcgcggtggcaagatgctttgcacagccaaattttaaggtagacggcatcctcaaaactgtcttgcgagacgagattatcgcatggcataagaagactcaagaggatacctctagtccactgagcgctgcagggcagccagagaacatggacagccagcagctagtgtcgttggtgcaaaaagccgtcactgctattatgactaggctgcataatttagcacagtttgaaggcggagagtcaaaagtgaatactctggtggcagcagcaaatagcctggacaatctctgtcggatggatcccgcttggcacccctggctctac

SEQ ID NO: 244490 - DNA, 216 bp, Artificial Sequence
  Description of Artificial Sequence: Synthetic coding sequence
atggccttcgtggcgacgcagggtgccactgtggtggatcagaccacactcatgaagaaatacctccagtttgtggccgcactaactgacgtcaacaccccagacgaaactaagcttaagatgatgcaggaagtgtccgaaaactttgagaatgtcacatcctcaccgcagtattccacgtttctggagcatattattccgaggtttttaacatag

SEQ ID NO: 244491 - DNA, 117 bp, Artificial Sequence
  Description of Artificial Sequence: Synthetic coding sequence
atgtcggacagtggcgaacagaattacggcgagagggttaacgtggaggaaggaaagtgtggttcacgtcacctcactagctttatcaatgaatacctgaagttgcgcaacaagtag

SEQ ID NO: 244492 - DNA, 567 bp, Artificial Sequence
  Description of Artificial Sequence: Synthetic coding sequence
atgagtaccagacgccgtcatgtgggcaaccgggctaaccctgatccgaattgttgtcttggagtcttcggcctgtccctctacacgactgagagggacctgcgggaggtattttcaaaatatggacctattgccgacgtgagcatcgtttatgatcagcagtctcggaggagtcggggtttcgcctttgtttattttgagaatgtcgacgatgcaaaggaggctaaagagagggctaatggtatggagctcgacggtcgcagaatccgagtggacttttctattaccaagaggccacacacgcccacccccggtatctacatgggacggcctacttacggctcttcacggcgacgtgactactatgaccggggatatgatcgaggatacgatgaccgtgactactatagccggtcctatagggggggaggaggcggagggggtgggtggagagccgcacaggatcgggatcagatctaccgtcggagaagcccctcgccatactactctaggggaggctaccgcagccggagtcgatctcgcagttactcaccgaggcgatattag

SEQ ID NO: 244493 - DNA, 867 bp, Artificial Sequence
  Description of Artificial Sequence: Synthetic coding sequence
atgagtgacagcggtgagcagaattatggggagagagaatccagatctgccagtcgctctgggagcgcccatggaagcggtaaaagcgccagacatacaccggctcggtctcgcagcaaggaggatagcagaaggtccagatctaagagtagatcgcggagcgagtctcgcagccgttccaggcgaagctcccgcaggcattatacgcgaagtagaagccgatcccgatctcatcgccgtagcaggtcaagatcttactcccgggactacagacggagacattctcacagtcactctccaatgagtactcggagaaggcatgtcggcaacagagccaacccagaccccaattgttgtctgggggtgttcggattatctctgtacactacagaacgtgacctgagggaagtgttttctaagtacggccctattgccgacgtctctattgtatatgatcagcagtctaggagaagccggggattcgcctttgtgtatttcgaaaatgtggacgatgcaaaggaagccaaagaaagggcaaacggcatggaactggatggccgtcggatacgcgtcgatttttccataaccaagcgcccacatacaccaacgccaggaatctacatgggtcgaccgacctatggctcatcccgacgcagagactactacgacagagggtacgacagaggctacgatgaccgtgattattattctagatcctaccgcggtgggggtggtggtggcggtgggtggagagctgcacaggatagggaccagatctaccgcaggcgctcacccagtccgtactattccaggggagggtaccgatccaggagccgctccaggagctattctcctaggaggtattag

SEQ ID NO: 244494 - DNA, 483 bp, Artificial Sequence
  Description of Artificial Sequence: Synthetic coding sequence
atggtgccaagtgcaggccaactggcattgttcgcactgggcatcgtgttggcggcatgccaggccctggagaactccacaagccccctctccgcagatccaccagtggcggcagcagtggtgagccatttcaatgactgcccggattctcacactcagttctgttttcatgggacatgtcgttttttagtgcaggaagataaacccgcatgcgtgtgtcactctggctatgtgggcgcacggtgcgaacatgccgacctcctggcagtcgtcgccgcaagccaaaagaagcaggccattaccgccctggttgttgtgagtatcgtcgccctggctgtgctgattatcacgtgtgtgctaatacattgttgtcaggttcggaagcactgcgagtggtgcagagcactcatttgccggcacgagaaaccgtcggcgctgctcaaagggaggaccgcctgctgccactctgaaaccgtggtctag

SEQ ID NO: 244495 - DNA, 480 bp, Artificial Sequence
  Description of Artificial Sequence: Synthetic coding sequence
atggtaccctcggctggtcaattggccttgttcgctcttggaatcgtcttggcagcttgccaggctctggagaattcaactagtcccctgtcagatccacccgtggcggcagctgtggtgagtcactttaacgactgcccagatagccacacccaattttgtttccatggaacctgccggtttctggtgcaggaggacaagcctgcctgcgtgtgccattctggttacgtgggggcacggtgcgaacacgcggatcttctcgctgtcgtcgccgcttcccagaagaagcaggcaatcaccgcccttgtagtcgtcagtatagtggcccttgccgtacttataattacttgcgtgttaattcattgttgtcaggttaggaaacactgtgagtggtgccgggcactgatctgtaggcacgagaagccttcggctctcctgaaagggagaacagcttgttgccacagcgaaactgtagtatag

SEQ ID NO: 244496 - DNA, 2583 bp, Artificial Sequence
  Description of Artificial Sequence: Synthetic coding sequence
atgatgagcatcaaggcattcactctggtctcagcagtagagagagagctcttgatgggagataaagagcgagtcaatatcgaatgtgtggaatgctgcgggcgtgacttgtacgttggaacgaacgactgctttgtgtaccacttcctgctagaagagaggcctgttcccgcaggtccggctaccttcacagccactaagcagctgcagaggcatctaggctttaagaagcccgttaacgaactgcgcgcagcatcggcactaaatcgcctactggtgctttgcgataacagtattagcctggtgaacatgctgaacttagaaccagtaccctcaggtgctcgaatcaagggcgcagccaccttcgctctgaatgaaaaccccgtgtcaggagacccattctgtgtcgaagtctgcatcataagtgttaagagaagaacaatccagatgttcctggtgtacgaagacagggtccagattgtgaaggaggtatctacagccgagcagcctcttgccgttgctgtcgacggccatttcctttgcctggcactcaccacacagtacattatccacaattactcaacaggcgtgtcgcaggatctctttccatactgttccgaggaaaggccgccaattgtcaagcggatagggagacaggagtttctgctcgcaggtccagggggactgggcatgtttgcgacagtagcgggtatctctcagagggcccctgtgcactggtccgagaatgtgattggtgccgcagtttcattcccctatgtgattgcactcgacgacgagttcattactgttcacagtatgctcgatcaacagcagaagcagactctgcccttcaaggagggacacatcctgcaggacttcgaagggagggtaatcgttgccacttcgaaaggggtctatatcctggtaccactgcctctcgagaagcaaattcaggatctcctggctagcagacgcgtcgaagaggcgttagtgctcgctaaaggcgcaagacgcaacattccgaaagaaaaatttcaagtgatgtataggagaatcttacagcaggcaggctttatccaattcgcccaattacagtttctggaggcaaaagagttattcaggtcaggtcagctggatgtccgggagctcatcagcctttacccttttctgctgcctacaagcagctcattcactcgttcccaccctcccctgcacgagtatgccgatctcaaccagctgacccagggtgatcaggaaaagatggcaaaatgcaagcgattccttatgtcttacctgaatgaggtgagaagcaccgaggtggcgaatggctataaagaggatattgatacagctctgctgaaactgtatgccgaagccgaccatgactccttattagatctcctggtcacggaaaacttttgtctgctgaccgacagtgcagcctggcttgaaaaacataagaaatacttcgctcttggcctgctgtaccactataataatcaagatgcagctgcagtgcagctctgggtgaatatcgtcaacggggatgttcaagactcaactcgatccgacctctacgagtacatcgtggattttctgacatattgtctcgatgaggaactggtgtgggcctatgccgactgggtgctgcaaaaatctgaagaggtcggggttcaggtgtttactaagcgccctctcgacgagcagcagaaaaactcatttaatcccgatgacatcatcaactgcctgaaaaaatacccaaaggctctcgtcaaatacctggagcacctcgtgatcgataaacgcctgcagaaggaggaatatcacacacatcttgctgtgctttacctcgaggaggtgctcttacagagagcctctgcttcagggaagggtgccgaagctacagagacccaagctaagctccgtcgacttctgcagaagagcgatctatacagagtacactttttgctagagcggttgcagggagctggcttgccaatggaaagcgctatactgcacggtaagctgggagagcatgagaaggctctccacatcctggtacacgaactccaagattttgcagccgctgaagattactgcctgtggtgtagcgagggcagggacccacctcacaggcagcaactgtttcacactctcctggcgatctacctgcatgccggacctactgcgcacgagttggccgtagctgctgtggatcttttaaacagacacgccaccgagtttgatgccgcacaggttcttcaaatgttaccagatacctggtccgtgcagttgttgtgcccatttctgatgggcgctatgagggacagtatacacgccaggcgcactatgcaggtggctctcggcttggcgcgaagtgaaaatctgatttatacttatgataaaatgaaactcaagggttcaagtatccagttgagtgacaaaaaattgtgccaaatctgtcagaatccgttctgcgagccagtttttgtgcgctaccctaatggaggtcttgtccacacgcattgtgcagcatcaaggcatacaaatccctcatcttcctcacccggaactcgaacctag

SEQ ID NO: 244497 - DNA, 2583 bp, Artificial Sequence
  Description of Artificial Sequence: Synthetic coding sequence
atgatgtccatcaaagccttcactctggtaagcgccgttgagcgcgaacttctcatgggcgacaaagagagggtgaacatagagtgtgtggagtgctgtggcagagatctgtacgttggcaccaatgactgctttgtgtaccattttctgttagaagagcggcctgtcccggcaggtccagcgactttcactgcgaccaaacagctgcagaggcatttgggcttcaaaaagcccgttaacgagctgagggctgccagcgccctaaacagacttctggtgctgtgtgacaactcaattagtctggttaacatgctgaatctggaacctgtcccctcgggggctcgcattaagggtgctgctacattcgcgctcaatgaaaacccagtgtccggggacccattttgtgttgaggtgtgcatcatttctgttaaacgcagaacaattcagatgttcctggtatacgaagatcgggtgcaaatcgttaaggaggtgtcaaccgctgagcagccactggccgtcgcagttgatgggcactttctgtgcctggctctgaccacgcagtatattattcacaattattctacgggagtaagccaagacctgttcccctactgctctgaagaaagacctcccattgtcaagcgtatcgggagacaagaattcctcctggccggacccggaggtctgggaatgtttgctaccgtcgccggaatcagccagcgtgcaccagtacattggagcgagaatgtgatcggggctgcagttagcttcccctacgttattgccctcgacgatgagtttatcactgtgcacagcatgctggaccagcagcagaaacaaacattgcccttcaaggaaggccatatcctacaggattttgagggcagggtgattgtcgcaacaagtaagggcgtgtacatactggtccctctcccccttgagaagcagatacaggatctgctcgccagcagacgcgtggaagaagctctggtgctggcgaagggggcaaggcgtaatatccctaaagagaaattccaggtgatgtatagacgtattctgcagcaggcaggtttcattcagtttgcccagcttcagttcctggaagctaaagagctcttcagatctggacaactcgacgttcgagagctgatctccttatatccattcttgcttcccaccagtagctcattcaccaggtctcacccccctctgcatgagtacgccgatttaaatcaactaacacaaggggaccaggaaaaaatggctaaatgtaagaggtttctcatgtcatatctgaacgaggtgaggtctacagaggtggcgaacggttacaaagaggatatcgacacagctcttctgaagctgtatgctgaggccgatcacgattccctgctggatctcctggtaactgagaacttttgcctactgacggactccgcagcctggctggaaaagcacaagaaatacttcgcgctgggcctcctgtaccactacaataatcaggatgctgcagctgtgcagttgtgggtcaacattgtcaacggtgacgtgcaggatagcaccaggtccgacttatatgagtacatcgtggatttcctcacctactgcttagatgaagaactggtctgggcctatgcagattgggttctgcagaagagcgaggaggtgggcgtacaggttttcaccaaaagaccactcgatgagcagcagaaaaacagctttaatcccgacgatataatcaattgtctcaaaaagtatccaaaagcactggtaaagtacctggaacatttggtcattgataaacggcttcaaaaggaagaataccacacgcatctggccgtgctttacttggaggaagtgctgctccagcgcgcaagcgcttccggaaagggagccgaggctaccgagacccaagctaaactcagaaggcttttgcagaagtctgatctgtatcgagtgcacttcctgctggagcgtctgcaaggagccggactgcctatggagtctgctatattgcatggcaaactcggagagcacgaaaaagccttgcacatcttggtccatgagcttcaggactttgccgctgcagaggactactgcctgtggtgctccgagggccgtgacccaccccacagacagcagcttttccacacactgctcgcgatctatttgcacgcaggacccactgcacacgagctggcagttgccgcagtggacctgctgaacagacatgctacggagtttgatgcagcgcaggtcctgcagatgcttccagatacctggagtgttcagctcctctgcccattccttatgggagctatgagggactccatccacgcgagacgcacaatgcaggtggctctcgggttagctaggtcagagaatcttatctatacatacgataagatgaaattaaagggatcttccatacagctgagtgataagaagctgtgccagatatgtcaaaaccccttttgcgagcctgtctttgtgcggtacccaaacggaggccttgtgcacacacactgcgcagcatcgcgccataccaacccctcaagtagctctcctggcaccagaacttag

SEQ ID NO: 244498 - DNA, 948 bp, Artificial Sequence
  Description of Artificial Sequence: Synthetic coding sequence
atgctcattgggtcatgccggaaagtgaagagatccgtgcaggtgttcaccaagcgtcccttggatgagcaacaaaagaatagcttcaaccctgacgatattattaattgtcttaagaaataccctaaagcacttgtgaaatatctggagcatttagtaatcgataagcgtctgcagaaagaggagtatcacacacacttggcagtgctgtacttggaagaggtcctgctgcagagggcctccgcgagcgggaagggtgcggaggctacagagacccaagccaagttgagacgacttttgcagaagagcgatttgtatcgcgtgcacttcttgctcgagaggttgcagggagccggtctgcccatggaatctgcaatcctacacggtaaactgggagagcatgaaaaagccctgcacatcttggttcacgaactccaggacttcgccgcagccgaagactattgtctgtggtgttctgaagggagggatccccctcaccgtcagcaactcttccatacccttttggctatttacctgcatgcagggccaacagctcacgaactggccgtggctgcagtggacctactcaaccgacatgcgacagagtttgacgccgctcaagtgcttcaaatgttacccgacacatggtcggtgcagttactttgcccgttcctaatgggagccatgcgagattcaattcatgcaaggcgtacgatgcaggtggccctggggctggccaggtctgagaacctcatttacacatacgacaaaatgaagctgaaaggtagttctatccagctgagcgataaaaagttgtgccaaatatgtcagaacccgttttgtgaacccgtgtttgtgcggtatcccaacggcggtcttgtgcacacacactgcgcagccagcagacatacaaatcccagtagcagttcacccggaacaaggacttag

SEQ ID NO: 244499 - DNA, 1704 bp, Artificial Sequence
  Description of Artificial Sequence: Synthetic coding sequence
atgggtcggggattactgagaggactgtggcctctccacatcgtgttgtggacgcggatcgccagcacaatcccccctcatgtccagaaatcggtgaataacgacatgattgtgactgacaataacggagctgtaaagttccctcagctgtgtaagttctgcgacgtgcgctttagcacctgcgacaaccaaaagtcttgcatgtccaactgctcaattactagcatctgcgagaaaccacaggaagtttgcgtggcagtatggcggaagaacgacgaaaacatcacactcgagaccgtgtgtcacgaccctaaactgccttatcatgactttatccttgaggacgcagcgtcccccaagtgcatcatgaaagagaaaaagaaaccaggggagacgttctttatgtgcagctgttcatctgacgaatgcaatgataatattatcttttcagaagagtataataccagcaatcccgacctactgttggtgatattccaggtcacaggcataagcctgttaccaccactcggggtagcaattagtgtaataattattttttactgctatcgggttaaccggcagcaaaagctctcttccacgtgggagacaggaaagacccgtaagctcatggaatttagcgaacattgcgcaatcattcttgaggacgatcgctctgacatcagttcgacatgcgccaacaacattaaccacaacaccgaactgctaccaatagaattagacactctcgtgggaaaaggacgattcgcagaggtgtacaaggcgaaactcaaacagaatacatccgagcagtttgaaaccgtggcagtgaaaatctttccttacgaagaatacgccagctggaaaaccgagaaggacattttcagcgatatcaatctgaagcacgaaaacattctccagtttctaacggcagaagaacgaaagacagagcttgggaagcaatattggttaataaccgctttccacgcgaagggaaacctacaggagtatttgactcggcatgtcattagctgggaggatctgcgtaagctgggctcatctttagccaggggaatcgcacatctgcattctgaccatacaccctgcggcaggcccaagatgcccatcgttcatcgggatttgaaaagctcaaatattctcgtaaaaaatgacttaacttgttgtctgtgtgatttcggcctgtctctgagactcgaccctaccctttcagtcgatgacctggctaactcgggacaggtaggcacagcgaggtacatggcccctgaggttctggagtctcgcatgaacctggagaacgtagagtcattcaaacaaaccgacgtgtacagcatggccctggtgctttgggagatgacctctcgctgcaatgccgtaggcgaggtgaaggattacgagccacctttcggttcaaaggtgagggaacacccatgcgttgaatcaatgaaggacaatgttttgcgagaccgcggaagaccagagatccccagcttttggctgaaccatcaggggatccagatggtatgtgaaactttaacagaatgttgggaccatgatccagaagcaaggctaaccgcccagtgtgtcgctgagcgattttctgagctggaacacctcgatcgcctctcgggacgctcttgcagcgaagagaaaatccctgaggacggcagcttgaacacgacaaaatag

SEQ ID NO: 244500 - DNA, 1779 bp, Artificial Sequence
  Description of Artificial Sequence: Synthetic coding sequence
atgggtaggggcctgctcagaggactgtggccattgcacatcgtcctgtggacaagaattgcctcaactatccctcctcacgtccaaaagtcagatgtcgaaatggaggcccaaaaagacgagattatttgtccgagctgcaatcgtacagcgcaccccctgcgacacattaacaacgacatgattgttaccgacaacaatggagccgtcaaattcccgcagttgtgtaaattttgcgatgttcggttctctacctgtgacaatcagaagagttgcatgagtaactgttcaataacatccatttgcgagaaaccccaggaagtctgtgttgcagtctggagaaagaacgacgagaacattacactcgaaaccgtctgtcacgatccaaaactcccatatcacgactttatcctggaggatgcagccagccccaagtgcataatgaaagaaaaaaagaaacccggagagacatttttcatgtgttcatgttctagcgacgagtgcaatgataacatcattttctcggaggaatacaacacgagcaaccctgatctcctgcttgttatcttccaggtcaccggtataagcctgctgccacctttaggtgtggcaatttcagtgatcatcatcttctattgttatcgagttaaccgacaacagaaactttcttcaacatgggaaactggcaagaccagaaagttgatggagttttctgagcattgcgctataattcttgaagatgacagaagcgacatcagctctacttgcgccaataacataaaccacaatactgaactcctgcccatagaattagacaccctggttgggaaagggaggtttgccgaggtttataaggccaagctgaagcagaatacttctgagcaattcgagaccgtggccgttaaaattttcccttacgaggaatacgccagctggaagacggagaaagacattttctctgacataaatctaaagcatgaaaacattcttcagttcctgacagccgaagaaaggaaaaccgagctggggaaacagtattggctgattactgcatttcatgctaaaggcaacttgcaggaatatctcacgaggcacgtgatcagctgggaagacttgcgaaaactggggagtagcctcgcgcgtggcatcgcccatctacactcggaccacacaccatgtggtcgcccaaagatgcctatagtccacagagaccttaaatcttctaatattcttgttaagaatgatcttacgtgctgtttgtgtgacttcggattgtctttaaggttagatccaacactctcagtcgatgacctggccaattctggccaggtgggtaccgcccgatacatggcacctgaagtgctggagtcacggatgaacttagagaatgtagaatcctttaagcagacggatgtttactccatggctctggtcctatgggagatgacatctaggtgcaatgccgtgggagaggtgaaggactacgagccaccatttggcagcaaggtcagggagcatccgtgcgtggagagcatgaaggacaacgtcttacgggaccgtggcaggcccgagatcccgtccttttggttgaaccatcagggaatacagatggtgtgtgagaccctaacagagtgctgggatcacgatccagaagcgcgtctgactgcccaatgcgtcgccgaacgcttttccgagttggagcatctggaccgactttccggacgctcgtgctctgaagagaagatacccgaggatgggtcgctgaacacgactaaatag

SEQ ID NO: 244501 - DNA, 339 bp, Artificial Sequence
  Description of Artificial Sequence: Synthetic coding sequence
atgtgctcttgctcaagcgacgagtgtaatgacaatattattttttccgagggtcgatgcaagattcgccacattggctcgaacaaccgtctccaacggagcacgtgtcagaacacagggtgggaaagtgcacacgtgatgaagactcccggtttccgcgagtacaataccagtaatccagatttattgttagtcatcttccaagttacaggcatttctctactccccccactgggcgtagctatctccgttataattatcttttattgttaccgggtcaaccgccagcagaagctctcctcgacatgggaaacagggaaaacaaggaagttgatgtag

SEQ ID NO: 244502 - DNA, 1194 bp, Artificial Sequence
  Description of Artificial Sequence: Synthetic coding sequence
atgtgtagttgctcctctgatgagtgtaacgataacataattttttctgaagagtataacacctctaaccctgatctgctgctggtgatattccaggtcacaggcatttcccttcttccccctctgggcgtggctatcagtgtcataatcatcttctactgctaccgggtaaatcggcagcagaagctgtcttccacctgggagacgggcaagactcgtaaactcatggagttttccgaacactgcgccattatccttgaggatgataggtctgacattagttctacttgtgccaataacattaatcataatactgaactcttaccaattgagctagacactctcgtgggcaaaggccgattcgccgaggtgtacaaggccaagctgaagcacgagaatatcctgcaattcttaacagctgaggagcgcaagacagagctgggaaagcagtattggctaatcaccgcgtttcacgccaaggggaacctgcaggaatacctgacacgacatgtcatctcttgggaggacctcaggaagttgggctcttcgctggcgagaggaatcgcacacttacatagcgatcacaccccatgcggcagacctaagatgcccatcgtgcatcgagacctgaaatcttctaatattctggtgaagaacgacctgacatgttgcttgtgtgatttcgggctatctctgcgccttgatcccactctgtccgtggacgatttggcaaacagcgggcaagtgggtacagcgagatacatggccccagaagtgctggagagtagaatgaacctggaaaatgtcgaaagtttcaaacagaccgatgtgtattcaatggcacttgtcctttgggagatgacgtctaggtgcaacgccgttggagaagtgaaggattacgagcccccttttgggtctaaggtgcgtgagcatccatgcgtagagtcgatgaaagataacgtgttgagagacaggggacggcctgaaattccaagcttttggctgaaccaccagggaatccaaatggtttgtgagactttaacggaatgctgggatcacgatcccgaggccagactcacggcccaatgcgtggcggagcgcttttcggaactcgagcacttggatcgattgtcaggacgctcctgttcagaggaaaaaattccggaggacggctccctcaatacgactaaatag

SEQ ID NO: 244503 - DNA, 2244 bp, Artificial Sequence
  Description of Artificial Sequence: Synthetic coding sequence
atggccgacgaagccgcattggctctccagcctggcggttctcccagcgcagccggagccgacagggaagcagctagcagccccgctggcgaacctctgcgaaagagaccaagaagggatggacccggactggaacggtcccccggtgagcccggaggcgctgcgcctgaaagggaagtgcccgctgccgctaggggctgtcctggtgccgctgccgcagctctctggcgtgaagctgaagccgaggccgctgctgctggaggggagcaggaagcgcaggcgacggccgcagctggagagggagataatgggcctggccttcaggggccatctcgagagccacccctcgcagataatctatacgatgaagacgacgacgatgagggagaagaagaggaggaagccgctgccgctgcaatcggataccgtgataatttactgttcggagatgagattatcaccaacggcttccacagctgcgagtcagatgaagaggaccgggcttcccacgccagctccagcgactggacccccagacctcgcatagggccatatacattcgtgcagcagcacttaatgattggcacagatccgcgaacgattctcaaagatctcctgcctgaaaccattccaccaccggaacttgacgatatgacactgtggcagattgtcattaatatcctgagcgagcctcctaaaagaaagaaaagaaaagacatcaacactatcgaggatgccgtcaagctcctgcaggaatgtaagaaaattattgttttaacaggcgctggcgtctccgtgtcctgtgggatccccgacttccgctcgagagacggtatctacgccaggctggctgttgattttccggatctgccagacccccaggcgatgtttgacattgagtactttaggaaagaccctcgccctttcttcaaatttgctaaagagatctacccaggacagtttcaaccaagcctctgtcacaagtttattgctttgtctgataaagaggggaagctgctcaggaactatactcaaaacatcgacacccttgaacaagtggccggaattcagagaatcattcagtgtcacggctctttcgctactgcatcatgtctaatatgtaaatataaagtcgactgtgaagccgtacgaggcgacattttcaatcaggttgttcctcggtgccctcggtgtcctgccgatgaacccctggcaattatgaagccagagatcgtcttctttggggaaaaccttcctgaacagttccatcgagcaatgaaatacgataaggacgaagtcgacctgcttatagtaatcggaagcagcttgaaggtgaggcccgtcgcgctcattcctagctctatccctcacgaagtgccacagatattaattaatagggaacccctcccacacttgcactttgacgtagaactactcggcgactgtgatgtaattatcaacgaattatgccataggctgggcggagagtacgcgaagttatgctgcaacccggtgaagctgagcgaaatcacggaaaaaccacctcggacacaaaaagaactagcctaccttagtgaattacccccaacccctctacatgtgtccgaagactctagcagtcccgagcggacgtctccgccagacagtagcgtgatagtcactctattggaccaagcggcaaaatctaacgacgacctggatgtgtcagagagcaagggctgcatggaagagaaaccacaggaggtccagacctcacgaaatgtcgagtccattgctgaacagatggaaaatcctgacttgaagaatgtgggtagctctacgggagaaaagaacgagagaacgtctgtagccggaaccgtgagaaaatgctggccaaaccgggtggctaaggagcagatctctaggcgcttggacggaaatcagtatctgttcttaccccctaatcgatatatttttcacggcgctgaggtgtacagcgactccgaggatgacgtattaagcagcagcagctgcggctccaacagtgactcaggcacttgccaaagcccttctctagaggaacccatggaggacgagagcgagatcgaagaattttataatggactggaggacgagcctgatgtgccagagagggccggaggagccggattcggtacagacggggatgatcaggaggcaattaacgaagctatttcggtgaagcaggaagtcaccgatatgaactatccgagtaataagtcttag

SEQ ID NO: 244504 - DNA, 2553 bp, Artificial Sequence
  Description of Artificial Sequence: Synthetic coding sequence
atgaccagccactatgtgatcgccattttcgccctgatgagctcttgtctggcaacagctggtccagagcccggagcactgtgtgaattatcgccagtatccgcctcgcaccccgtgcaggcattgatggaaagttttaccgtgctctcggggtgtgccagccgagggacaacaggattgccccaagaggtgcacgtactgaatctgagaaccgccggacagggtcccggacaactgcagagggaagtaactctacacttgaaccctatcagctcggtccatatccatcataagagtgtggtgttcctgttgaacagccctcaccccctggtgtggcacctcaaaactgaaaggcttgcgactggggtctctaggttgtttctggtctctgaaggatccgtcgtgcaatttagctcagctaacttctcactgacggcggagaccgaggagaggaattttccccatggaaacgagcacctgctcaactgggctcggaaggagtacggagccgttaccagctttaccgaactaaagatcgctagaaacatctatattaaagtcggcgaggatcaagtattccccccaaaatgcaacattgggaagaattttctttctcttaactatcttgcagaatatctccagccgaaggctgccgagggttgtgtcatgtccagccaacctcaaaatgaggaagtccacatcatcgagctgattacacccaatagcaatccttacagtgccttccaggtcgatatcactatcgatatacgcccaagtcaggaggacctggaagtcgtgaagaacctcattctgatcttaaagtgcaagaaaagcgtcaactgggtcatcaaatcattcgatgtgaaaggctctttaaaaatcattgccccaaattccatcgggttcggcaaagaaagcgagcgctccatgaccatgacaaagtccattcgcgacgacataccgagtacacagggaaaccttgttaagtgggcccttgacaacgggtactcccccatcacaagttatacgatggctccagtagctaaccgattccatctgcggctggaaaataacgaagagatgggggatgaggaggtgcatactattcccccagaacttcgtattctacttgaccctggtgccctgcccgcattgcaaaatccgccaataaggggcggtgaaggccagaatggaggactccctttccctttccctgacatttcaaggagggtgtggaacgaggagggggaagacgggttacctcgccctaaggatccggtgatccccagtattcagttgttcccagggctgagagaacctgaagaagttcagggtagcgtggatatcgcactgtctgtgaagtgtgacaacgaaaagatgattgtggcagtagagaaagatagcttccaggccagcggatacagcggaatggacgtgactctgctggaccctacttgtaaagccaagatgaacggcactcactttgtgctggaatccccattaaatggttgtggtaccagacccaggtggtcggccctggatggtgtggtttactataattccattgtaatccaggtccccgcattaggtgactcctcaggctggccggacggctacgaggatctagaatccggggacaatggctttccaggtgacatggacgaaggcgacgcttctctgttcactaggcccgaaatagtggtgtttaattgttccctccagcaggtgaggaacccatcttcattccaagaacagccacacgggaacatcacttttaacatggaactatataatactgatcttttcctcgtgccctcacagggtgtcttctcggtcccagagaatggtcatgtctatgtcgaggtaagcgtgacaaaggctgaacaggagctgggattcgcgatccagacgtgctttatttcgccgtacagcaacccggaccgtatgtcccactatacaatcattgaaaatatatgcccaaaggacgaaagcgtgaaattctactctcccaagcgtgtacattttccaattcctcaagcagacatggacaaaaagcgcttttcatttgtcttcaagcccgttttcaacacttccctgctgttcctccagtgcgagcttactctttgtaccaagatggagaaacatccacaaaaactccctaagtgcgtgccacccgatgaagcatgtacctccctggacgcctcaataatttgggcgatgatgcagaacaaaaagactttcacaaagcccctggccgttatccatcatgaagcggagagtaaagaaaaaggaccatcaatgaaagagcctaatcctatttccccacctatcttccatggactggacaccttgaccgttatgggcatcgctttcgccgcatttgttatcggggctctgctgacgggggctttatggtatatctactcccacactggcgaaacggccggacgccagcaggtgcctacgtctcccccagcaagcgagaactcttctgccgcacacagcattgggtctacacagtcaactccatgctcatcatcttccacagcctag

SEQ ID NO: 244505 - DNA, 108 bp, Artificial Sequence
  Description of Artificial Sequence: Synthetic coding sequence
atgactagccactatgtgatcgccatcttcgctctgatgagttcgtgtctggctactgctggaccagaacctggcgctctttgtgagctttccccagtctcagcctag

SEQ ID NO: 244506 - DNA, 2553 bp, Artificial Sequence
  Description of Artificial Sequence: Synthetic coding sequence
atgaccagccactatgtcatcgccatttttgctctgatgagctcatgtttggcgaccgctggtcccgaacccggagcactgtgtgaactcagtcccgttagcgcgtcccatcccgtccaggcactgatggaatctttcaccgtgctgtctggctgcgcctctcggggaactaccggccttccccaggaagtacatgttcttaaccttagaactgccggacagggacctggtcaattgcaaagggaggtgacactgcacctgaatcccatcagctccgtccacattcaccataagtctgtggtcttcctgcttaattccccacatcctctcgtctggcacctaaagacagaaagactggcaaccggggtctcccgcttatttctcgtcagtgagggttctgtcgtccagttcagtagcgctaacttttcactgactgccgagactgaagaaaggaatttcccacacggcaacgagcacctcttaaactgggctagaaaagaatatggggcagtgacgtcctttactgagctcaagattgccaggaatatatacataaaggtgggtgaagatcaggtctttcctcccaagtgcaacatcgggaagaactttctgagcctgaactacctcgcagaatatctgcagccaaaggccgcagagggatgcgtgatgagctcccagcctcagaacgaggaggtgcacattatcgagctaataacgcccaattctaatccatattccgcctttcaggtcgatattacaatcgacatccgtccctcccaggaggatctggaggtagtgaagaatttgatcctgatattaaagtgcaagaaatctgtcaactgggtgattaaatcctttgacgtgaaaggatcattaaaaatcatcgcgccaaacagcatcgggttcggaaaggaatccgaacggtccatgactatgactaaatctattagggatgacatcccctccacacagggcaacctggtcaagtgggctctggataacggttacagccccatcactagttacacgatggcgcctgtcgcaaaccgctttcacctgcgtcttgaaaacaatgaggagatgggagacgaagaggtgcacaccattccacccgagctccgcatcctccttgacccaggagcactgccagctctgcagaacccacctatccggggtggagaggggcagaatggtgggctgcccttcccctttcccgacatatcaagaagggtatggaacgaagaaggtgaggacggcctgcccagaccaaaagatcctgtgatccccagcatacagctctttccgggattgagggaacccgaggaggtgcaggggtctgttgatattgcccttagcgtaaaatgcgacaacgagaagatgatcgtggccgtggagaaagacagtttccaagcatccggctactctggaatggacgtgactctcttggatcccacgtgcaaggccaagatgaacggcactcactttgtgctggagagcccactcaacggttgtggaacacgtccacgttggtccgcacttgacggtgttgtctactacaacagcatcgttatccaggtaccagctctaggggactctagtggttggcctgacggttacgaagatttggaatcaggcgataacggcttccctggggacatggatgaaggtgatgcctccttgttcaccagacctgaaatcgttgtgttcaattgtagcttgcagcaggtacgaaatccgtctagctttcaggagcagccacatggcaatattacgttcaacatggagctgtacaatactgacctgtttctggtgccctctcaaggtgtgttctccgtgcccgagaatggtcatgtctatgtcgaagtgtcagtgactaaagcagagcaggaactgggtttcgcaatccagacatgtttcatctccccttatagtaatcccgacaggatgtcccactacactatcatcgaaaatatctgtcccaaagacgagtctgttaagttttacagtccaaagcgggtccattttcctataccgcaggctgatatggataaaaaacgcttctcattcgtgtttaaaccagtcttcaatacctccctcttgtttctgcagtgcgaactgacgctctgcacaaagatggaaaaacaccctcagaaattacctaaatgcgttcctcctgacgaggcttgcacttctcttgatgcaagtatcatttgggcaatgatgcaaaacaagaaaacttttacgaaaccactggccgttatccaccatgaagccgaatccaaagaaaaaggaccatctatgaaagaacccaatcctatttctccacccatcttccatggactcgacaccctcacagttatgggcatagcattcgcagcatttgtgatcggggctttgctgaccggggctctgtggtatatttacagccacaccggtgaaaccgcaggtcgccagcaagtgcctacatcccctccagcctcagagaattcttcagccgctcattctatcgggagcactcaatccacaccttgttcgtcatccagcacggcatag

SEQ ID NO: 244507 - DNA, 2556 bp, Artificial Sequence
  Description of Artificial Sequence: Synthetic coding sequence
atgacatctcattatgtgatagccatcttcgccttgatgagcagctgtttagccacagctggacccgaaccgggtgcattatgcgaactctctcccgtttctgcctcgcaccctgtacaggctctgatggagtccttcaccgttctgtccggctgcgcctccaggggaacaacagggctccctcaagaagtgcatgtcctgaacctcagaactgcaggccaaggtccaggacagctgcagagagaagtgactctacacctaaaccctatttcttcagtccacattcatcacaagagcgtagtattcttgctcaactcccctcaccctctcgtctggcaccttaaaactgagaggttagccaccggtgtgagtcgcctgtttctggtgagtgagggatccgtggtgcagttttccagtgccaatttctcactgactgccgagactgaggaacgcaattttcctcatggtaacgagcatctactgaactgggcacgcaaggagtacggggcagtcacaagcttcaccgaacttaaaatcgctcgaaacatctacatcaaagtgggcgaggaccaagtctttcctccaaaatgcaacattgggaaaaacttcctgagtctaaattacttggctgagtatcttcagcctaaggcagcggaaggctgtgtgatgagttcccagccacagaatgaggaggtccacatcattgagctgataacccccaattccaacccatattccgccttccaggtcgatatcaccattgacataagaccaagtcaggaagatttggaggtggtcaaaaatctgattctgattttaaagtgcaaaaaatccgtcaactgggtgatcaagagttttgacgtaaaaggtagcctgaaaatcatcgccccaaactccatcggcttcggaaaggaatcggagagaagcatgacaatgactaaatccatcagagatgatatacctagcacgcagggaaatctcgttaagtgggccctagacaatggatactcccccattacatcctacaccatggcaccagtggctaatcgttttcatctgcgcctcgagaacaatgccgaggagatgggagacgaagaagtccatactatccccccagaactcaggatccttctggaccctggagctcttcctgcgctccagaaccccccaattagaggcggtgaaggccagaatgggggacttccatttccatttcccgacattagccggagagtgtggaatgaggaaggggaggatggactgccaaggccaaaagatccggtcatcccaagcatccagctgttccctggactcagagaaccagaagaggtgcagggatccgttgacattgcgctgtccgtcaagtgcgataatgaaaagatgattgtggctgtggaaaaagactccttccaggcttcaggctactcgggtatggacgtgacactcctcgacccgacctgtaaggccaagatgaatgggacgcacttcgtcttggagagcccactgaatggctgtggtacaagaccacgctggtcggctctggacggagtggtgtattataacagtattgtgatccaggttcctgccctgggagattcttctgggtggcccgacggctatgaggatctggagtccggcgacaatggatttcctggggatatggacgagggcgatgccagtctcttcactcgccctgaaatcgtcgtttttaattgttccctccagcaggtacggaatccctcctcctttcaggagcagcctcatggcaatataactttcaatatggagctatataacacggatctgttcctcgtgccttcccaaggcgtgtttagcgttccggagaatgggcacgtgtatgtggaggtgtctgtgactaaggccgagcaggagctcggcttcgccatacagacttgtttcatcagtccctattctaatccagacagaatgtctcactataccattatcgagaacatctgccctaaggacgaatccgtgaaattctattcccctaagagggtccatttcccaatcccacaggcagacatggacaagaaacgattctcattcgtgttcaaaccagtgttcaacacaagcctcttattcttgcagtgcgagctcaccttatgcactaaaatggaaaaacacccacagaagttgccaaagtgtgtccctccggatgaagcatgcacttctctggatgcttctattatatgggctatgatgcaaaataagaaaacgttcacaaagccccttgccgtgatccaccacgaggccgagagcaaggagaagggcccttccatgaaagaaccaaaccctattagccctccaatctttcatggcctcgacacacttactgtgatgggaattgcattcgccgcatttgtcattggagctctgttaacaggagcactgtggtatatctattcccacaccggtgaaacagcaggtagacagcaggtccctacctcacctcctgcgagcgaaaactcctctgccgcacattccatcggatcaacacagtctaccccgtgctcttcttcatccacagcctag

SEQ ID NO: 244508 - DNA, 2052 bp, Artificial Sequence
  Description of Artificial Sequence: Synthetic coding sequence
atggcgctgttcgttcggcttttggccctggccctggccttggccctcgggccagccgctactttggccggtccagccaagtcaccgtatcagctggtgttgcagcatagtcggctgagggggaggcaacatggtccgaacgtatgcgcagtacagaaggtaataggaacgaatcggaagtattttaccaactgcaagcagtggtatcaaaggaagatttgcggaaagagcacagtgatctcatacgagtgctgccctggctatgaaaaggtgcctggagagaagggctgcccagccgctttgcctctgagcaacctgtatgagaccctgggagtggtaggatctaccactacacaattatatacagatagaacagagaaattaagaccagaaatggagggcccagggagttttacaatatttgcgccaagtaacgaggcgtgggccagcctgcccgctgaggttctggactctctggtgagcaatgttaacattgagctgctcaatgcccttagataccatatggtgggccgtcgagtgctgactgacgagctgaagcatgggatgactctgactagcatgtaccaaaatagcaatatacagattcaccactaccccaatggaattgttactgtaaattgtgccaggctcttgaaggcggatcaccacgccaccaacggagtggtccacttgattgacaaggtaatttctaccatcacgaataacatccaacagattatagagattgaggatacgtttgaaactctccgtgccgctgtggccgcatctgggctgaataccatgctggagggcaatggacagtacactctgcttgcccctacgaacgaggcatttgaaaagattcctagtgagacccttaaccgaatattgggcgaccctgaagcgttgcgtgacctcctgaataaccacatcttaaagtctgcaatgtgtgccgaggcaattgtcgctggactgtcggtggaaaccctggaagggacaaccctggaggtggggtgctccggggacatgctgacaatcaatggcaaggccattattagcaataaagatatactggcaaccaacggcgtcatccactacatagatgagttgctgattcccgactcggctaaaaccctgtttgagctggccgcagaaagcgatgtgtccactgcgatcgatctgttcagacaagctggcctcgggaatcaccttagtggctctgaacggctgacgctgctggctcctctgaactctgttttcaaagatgggacaccacctattgatgctcacacaagaaatctgctgcgaaaccacattattaaggaccagttggcctctaagtacctctatcatggccagacactggaaacactcggcggaaagaaactccgggttttcgtgtacaggaactctttatgtattgaaaattcctgcattgccgcacacgataagagaggcaggtacggcaccctgttcactatggaccgggtcctgacgcccccaatgggcactgtgatggacgtgctgaagggggacaacagattctcaatgctcgttgctgccattcaatctgctggactcacagaaacattgaaccgggaaggggtatatacagtatttgccccaactaacgaagcatttcgggcactccccccacgcgagcggtctcgcctactcggggatgcaaaagagctggccaacatcctgaaatatcacatcggcgacgagattttagtatccggtgggataggagcactggtacgcctgaagtccctgcagggtgacaagctggaagtgagcctgaagaacaacgtagtgtcagtgaacaaggagcctgtagcagaacctgacatcatggccacaaatggtgtggtccacgtgatcactaatgtgctgcaaccacccgcaaatcgcccacaggagagaggagatgagctcgccgactctgccttggagatttttaaacaggcctccgcgttctctagaccggagcagcctcaggttctgtgcagtcctgtctaccagaaattgctggagcgtatgaaacactag

SEQ ID NO: 244509 - DNA, 1251 bp, Artificial Sequence
  Description of Artificial Sequence: Synthetic coding sequence
atgctagagggcaacgggcaatatacactgcttgctcccactaacgaggccttcgagaagataccatctgagactttgaaccgcatcctgggcgatcctgaggctctgagagatctgttaaacaatcatattctgaaatctgcgatgtgcgctgaggcaattgttgctgggttgagcgtggagacattagagggcacaaccttagaggtggggtgctctggggacatgctcaccatcaacggcaaagcaatcatttcaaataaggatatattggccacaaacggcgtgattcattatatcgatgagcttctcatcccggatagcgcaaaaacactgtttgagctcgctgccgaatccgacgtctcaaccgctattgaccttttccggcaggctggcctgggtaaccacttatccggatcagagcgactcacactgttggcacccctaaacagcgtatttaaggatggcacccctcctatcgatgcgcacacaagaaacctgctgaggaatcatattatcaaggatcagcttgcaagtaagtacctgtatcatggacaaacccttgaaacgctcgggggaaagaagctccgagtttttgtatatcgcaacagcctgtgtatagagaactcttgcattgccgcacacgacaaaagaggacgctacgggaccttatttacgatggacagggtgctcacaccaccaatgggaactgttatggacgtgttgaagggcgacaaccgcttctcaatgctggtggcagcaatccagtcagcgggattgaccgagacgttgaatagggagggggtgtataccgttttcgcacctacaaatgaggcttttagggcattgccaccccgagagcgaagccgcctgctgggcgacgcaaaggagctggcgaatatcttaaagtaccacatcggcgacgagattctggtttctggtggaataggggctctggttcgcttgaagtctctgcagggggataaactggaagtatcgctgaaaaacaatgtggtgtcagtgaataaggaacccgtggcggagcctgatattatggcaaccaatggagtcgtgcatgtgattaccaatgtgcttcagccgccagccaacaggccccaggagagaggggatgagctggccgattccgcacttgagatatttaaacaggccagcgcctttagcagggcatctcagaggagcgtccgcctcgcccctgtgtaccagaagctgttggagagaatgaaacactag

SEQ ID NO: 244510 - DNA, 2052 bp, Artificial Sequence
  Description of Artificial Sequence: Synthetic coding sequence
atggcgttgtttgttcggttgctggcgcttgccctggctctggctctaggaccagcagcaacactggcaggccctgccaaatccccttatcaattggttctgcagcactccagattgcggggacgacaacacggacctaatgtatgtgccgtccagaaagttatcggtactaatcgcaagtatttcaccaattgtaagcagtggtatcagaggaagatatgtggcaagagcaccgtgatcagctacgaatgttgcccaggatacgagaaagtacccggtgagaaagggtgccccgcagccctccctctgagcaacctttacgagaccctgggtgtcgttggaagcactacaacccagctgtatacagatcgaacagagaagctccgcccagaaatggaggggcctggatcatttactatcttcgcaccatccaacgaagcttgggcgagcctccctgcagaagttttggactccctggtgtctaacgttaatatcgagctgctgaacgcattgcgatatcacatggttggcagacgggtgctgactgatgagctgaagcacggtatgacactgacaagcatgtatcaaaacagtaacatccagattcaccactacccaaacggcattgtgactgtgaattgtgctcggctacttaaggctgatcaccacgctacgaatggggtcgtccacctgatagacaaggtgatcagcacaataacgaataacatacagcaaatcatagagattgaggacacttttgaaaccctgagggctgcggtggcagcctctggcctgaacaccatgttggagggcaatgggcagtacacccttctggcccctaccaacgaagccttcgagaagattccaagtgaaactctcaaccgcatccttggtgacccagaagcgctgcgtgacttactcaataatcacatcttaaaaagtgctatgtgcgccgaagctattgtggccggtctgtctgtggagaccctcgagggcaccactcttgaggtgggttgctctggcgatatgctaactatcaatggtaaagctatcataagtaacaaggatatcttagctacaaacggcgttatccactacattgacgaacttctaatacccgattcagccaagacacttttcgaactggccgcagagtctgatgtctcaaccgctatcgacctgtttcggcaagctgggctgggcaaccacctttcaggtagcgagaggttaaccctgctggccccactgaatagtgtttttaaagatggcactccaccaatcgacgcccatacgagaaacttgttgcgtaaccacatcatcaaggaccagctggcctcgaagtacttataccatggacagacattggagactctggggggaaaaaagcttagagtgttcgtgtatcggaattccctgtgtatcgagaactcctgtattgccgctcacgataaaagaggtcgctatggcactctgtttactatggatcgggtactgacgcctccaatgggtacagtgatggatgtgttgaagggggataataggttctcaatgctggtcgctgccatccagtccgcgggtctgaccgagactctcaatcgtgagggcgtctatactgtcttcgctccaaccaatgaggcctttcgcgctttaccacctagggagaggtccaggcttctgggcgacgccaaggagctggccaatatactgaagtatcacatcggggatgagatattggtctctggagggattggagcactggtcagactcaaaagcctacagggagataagcttgaggtgagcctcaaaaacaacgtggtatccgtaaacaaggaaccagttgctgagcctgatatcatggctaccaacggggtagtccatgttatcaccaacgtgctgcagcccccagctaaccgtcctcaggaacgcggtgatgaactggccgatagtgcccttgagatatttaagcaggctagcgcctttagccgcgcttcccagcgttcagtgcggctggccccagtctaccaaaagctgttggaaaggatgaaacactag

SEQ ID NO: 244511 - DNA, 1188 bp, Artificial Sequence
  Description of Artificial Sequence: Synthetic coding sequence
atggccttcagtccctggcagattctgtctccggtccagtgggcaaaatggacgtggagcgccgtccggggaggtgccgcaggcgaagacgaggccggaggtccagagggggaccctgaagaggaggactcgcaggccgaaaccaagtctctttcctttcgcagtggttgtaaagtaaagaagcacgagacccagtcactggctctcgatgcatgttcccgcgatgagggcgctgtcatatcacagatctccgatatctccaaccgcgatggacacgccactgatgaagaaaaattggcaagcacctcatgtggacagaagtcagctggggctgaagtcaagggtgagcctgaggaagatctcgaatactttgagtgttccaatgtgcctgtgtccacaatcaaccatgccttcagctcaagtgaagcaggaattgagaaagagacctgccaaaagatggaggaggacggctctacagttctcgggttactggaaagcagcgctgaaaaagctcctgttagcgtgagctgcgggggagaatcccccctggacggaatctgcctctctgagtccgacaagacggcagtactgacactgattagggaagagatcatcaccaaagaaatagaagcaaatgaatggaaaaaaaagtacgaagaaactaggcaggaggtgctggaaatgaggaagatcgttgcagagtacgaaaagactatagcacagatgattgaggatgagcagagaacttccatgacttcacagaaatctttccagcagctgaccatggaaaaagagcaggccctggcggatctgaatagtgtagaaagaagtctatccgacctgtttcggagatacgagaacctcaaaggtgttctcgagggattcaagaagaatgaagaggcccttaagaagtgtgcacaggattacttggccagagtaaagcaagaggagcagaggtaccaggcccttaaaatccacgccgaagaaaagctggacaaggctaacgaagaaatcgcccaagtgcgtaccaaagccaaagcagagagtgcggcactgcacgcgggattaaggaaggaacagatgaaggtggagtccctcgagagagctttgcagcaaaagaatcaggagatcgaggagctcactaaaatttgcgacgagctgatcgcgaaattagggaagaccgactag

SEQ ID NO: 244512 - DNA, 2418 bp, Artificial Sequence
  Description of Artificial Sequence: Synthetic coding sequence
atggccttcagtccttggcagatcctctctcctgtgcagtgggcaaaatggacttggagtgccgtccgcggaggagcagcaggcgaggatgaggcaggagggccagagggcgatcctgaggaggaggattcccaggctgaaaccaaaagcctttcctttagcagcgacagcgagggcaattttgagacaccggaggcagaaacacctattcgctctcccttcaaggaaagctgtgaccctagcctgggccttgctggcccaggcgcaaaaagccaggagtcacaagaagcagatgagcagctcgtcgcagaggtggtggagaaatgtagctcaaaaacctgctccaaaccatccgagaacgaggtcccccagcaagctattgattctcactcagtcaaaaactttcgggaggaacccgaacacgacttcagcaagatttccatcgtgagacctttcagtatagagaccaaggactcgacagatataagcgccgtcctcgggaccaaggccgctcacggctgcgtcaccgccgtgtctggaaaggcccttccctcctcacctccagacgccctgcaggatgaggctatgactgagggctccatgggagtgacccttgaggcttcggctgaagcagatcttaaagccggtaactcctgccctgagctggtgcccagtcgacgaagcaagcttagaaaaccaaaacctgttcctctgcggaaaaaagctatcggcggagagttttcagacaccaatgcagcagtcgaggggacacctcttcccaaagctagttatcacttttcccctgaggagctggacgaaaatacaagcccactcctgggggacgcgcgtttccagaaatccccaccagaccttaaggaaacacctggcacactgtccagcgacacaaacgactctggcgtcgagctgggggaggaaagcagatcatctcctctaaagttggagtttgactttacagaggacactgggaacatagaggcaagaaaggcgcttccccgaaagttgggtagaaaactggggtccaccttgacgcccaagatccagaaggatggaatcagtaagagtgctggactggagcagcccacggaccctgttgccagggatggacctctgagtcagacaagttccaaacccgatcccagccagtgggagtccccatccttcaaccccttcggctcccattccgtgttacagaatagcccgccactgtccagcgaggggtcctatcatttcgaccccgacaactttgatgagtccatggaccccttcaagcctaccactaccctcacgagctctgacttttgcagcccaaccgggaaccatgtcaatgaaattctcgagagccccaaaaaggccaagagtcggttaatcacgtcaggctgtaaagtgaagaagcatgaaactcagagcctggctctcgatgcctgctccagggacgagggggcagttatcagtcagatttctgacatcagcaatcgggacggtcacgcaacagatgaggagaagttagcgagcacttcttgcgggcagaagagtgctggtgccgaagtgaaaggcgagcccgaagaggacctggaatatttcgagtgttctaacgtgccggtatccaccatcaatcacgccttctcttccagcgaggctgggatcgagaaagagacttgtcagaaaatggaggaagacggctcgacggtgctaggcctcctggagtcttccgcggaaaaggctcccgtgagtgtcagttgcggtggtgagtctcccctggatggcatctgcctaagcgagtctgacaagactgcggtgctgacactgatcagggaagaaattattacaaaagaaattgaggcaaacgaatggaagaagaaatatgaggaaacaaggcaggaagtgttagagatgagaaaaattgtcgccgagtacgagaaaacaatcgctcaaatgattgaggacgagcagcgcactagcatgacgtcccaaaagagcttccagcagctgactatggaaaaggagcaggcgcttgctgacctcaactcagtggagaggagcctgtctgacctctttcgcaggtatgagaatttaaagggcgttcttgagggatttaagaaaaatgaggaggccctgaagaagtgcgcccaggattacctggctagagtcaagcaggaggagcagaggtaccaggcactgaagatccatgctgaggagaaactcgataaggcaaacgaagagatcgcccaggtgaggactaaagctaaggccgaaagcgctgctttacatgccggattgcggaaggagcagatgaaagtagagtcgctcgagcgagctttgcagcagaagaatcaggagatcgaagaactgacaaaaatttgcgacgaactgatcgccaaattagggaagacagattag

SEQ ID NO: 244513 - DNA, 1140 bp, Artificial Sequence
  Description of Artificial Sequence: Synthetic coding sequence
atgggtggatctcactctcaaactccccgaggaagggagcctgccggagaaagacatccacgcccaactgaaacggcaaccacagagcaggtaaaatttttgtgctttctgttaagcggctgtaaggtaaaaaagcacgagacacagagcctagctctggacgcctgctcccgggatgagggggcagtcatctcccagatctccgacatttctaatcgagatgggcacgcgaccgatgaagaaaagttggcatctacctcctgcgggcagaagtcagccggtgccgaggtcaagggtgagcccgaagaggatcttgagtactttgaatgctcaaacgtgccagtgtctaccatcaatcacgccttctcatcttccgaggctggtattgaaaaggaaacatgccaaaagatggaagaggacggcagcaccgtgttaggattactggagtcctctgccgagaaggcccctgtttctgtctcgtgtggcggtgaatcaccactcgatggtatctgcctgagcgaaagcgataaaactgccgtactgacactaatcagagaagagatcattaccaaggagatcgaggcaaatgaatggaaaaaaaagtacgaagagactaggcaggaggttcttgagatgcgtaagattgtcgcagaatacgagaagactatcgcccagatgattgaggacgagcagcggacttctatgacgagccagaaatctttccagcagctgactatggaaaaagaacaggccttggcagatctgaactctgtggaaaggagcctctctgacctgttcagacgatatgaaaacctgaagggggtgctagagggcttcaagaagaacgaggaagccctcaagaaatgtgcgcaggattatcttgcccgagttaagcaggaagaacagcgttatcaggccctcaagatccatgcagaagagaaactcgacaaggccaacgaggaaatagcacaggtcaggacaaaggctaaggccgagagtgctgcccttcacgccggactgcggaaggaacagatgaaggtagagtccctcgaacgggcattgcagcagaaaaaccaagagatagaagagcttactaagatttgcgacgagctcattgcgaagctgggtaaaactgactag

SEQ ID NO: 244514 - DNA, 1104 bp, Artificial Sequence
  Description of Artificial Sequence: Synthetic coding sequence
atgggtgggtctcactctcagacccctcggggacgagaacctgcaggcgaaagacatccaaggcctaccgagaccgccagtggctgcaaggttaagaaacacgaaacacagagcctggctctggatgcatgttccagagatgagggtgccgtgatcagccagatctccgatatctcaaatagggatggccacgcaacggacgaggaaaagctggccagtacttcatgtggtcagaaaagtgctggcgctgaggtcaagggggagccagaagaagatctggaatattttgagtgcagcaacgtccccgtgagtacaatcaaccacgcattcagtagctctgaggctggaatcgaaaaggaaacatgccagaagatggaggaagatgggagtaccgtgctgggcctcctggaatcatctgctgagaaagccccagtcagcgttagctgcgggggtgaaagccctctggacgggatctgcctgagtgagagtgataagaccgcagttttgacactgatcagggaggaaattatcaccaaagaaatcgaggctaatgaatggaagaagaagtacgaggagacacgccaggaagttttggaaatgaggaaaatcgtggccgagtatgagaaaaccatagcacaaatgattgaagatgaacaacgcacttccatgacctcgcagaagagcttccaacagctgaccatggagaaggagcaggccctagctgatttaaactcagtggaacggtcactctccgacttattccggagatatgagaacctgaagggagtgctggagggcttcaagaaaaacgaagaggcccttaagaaatgcgcccaagactacctggccagagtcaagcaggaggaacagcggtaccaggctctcaaaattcacgcagaagagaagctagataaggctaatgaggaaattgcacaagttaggaccaaggcgaaagccgaaagtgccgcattgcacgcaggcttacgcaaagaacaaatgaaagtggaaagcctggaacgtgcattgcaacagaagaatcaggaaattgaagaactaacaaagatctgcgacgaacttatagcaaagttaggcaaaacagactag

SEQ ID NO: 244515 - DNA, 2454 bp, Artificial Sequence
  Description of Artificial Sequence: Synthetic coding sequence
atggcattttctccatggcagattttgtcccccgtgcagtgggccaagtggacatggtcagctgtgagaggcggagccgctggagaagacgaggccggtgggccagagggtgaccccgaagaagaggacagccaggcagagactaagagcctgtctttctcctccgactccgagggcaatttcgagacaccagaggcggaaacccctatccggagcccctttaaggaatcatgcgatccaagtctgggcctggccggaccaggagcaaagtctcaggagagccaggaggcggatgagcaattggtggcagaggtagtggaaaaatgttcatccaagacatgttctaagccttccgaaaatgaggtaccccaacaggcgatcgattcccacagcgttaagaattttagggaagagccagagcacgacttttccaaaatttctatcgtgaggccattcagcatcgaaaccaaagacagcaccgacatctctgccgtcctcggaactaaggctgcccatggctgcgttactgccgtgtcaggaaaggctctcccctcctctccccctgatgccctacaggatgaggccatgacggagggctctatgggtgtgacactcgaggcctccgccgaagcagacctgaaagccggaaattcatgtcctgaactggtgcccagtcggaggtccaagctgcgtaagcccaagcccgtacctctgcggaaaaaggcgattggaggcgaattttctgatactaacgcagctgttgaggggactcctctgcctaaggcctcatatcactttagcccagaggaactagacgagaatacatcaccactgttgggggatgcaagatttcagaagagtcctcccgatctgaaagaaaccccgggaaccctgagctccgacaccaacgatagcggtgttgagctgggggaagagtctaggtcaagtccgctgaaacttgagttcgactttaccgaagatacaggaaatatagaggctaggaaggccctgccacggaaacttgggagaaagctcggtagtacccttacgccgaaaattcagaaagacggtatctcgaagtcggccggtctggagcagccaacggatcctgtagcacgggatggccctctgtcgcaaaccagcagcaagcctgatccaagccagtgggagtccccctcttttaacccattcggttcccattcagtgttgcagaactctccacctctatcctcagaagggtcctatcattttgacccagataactttgatgaatccatggatccatttaagcctactacaacactcacatcttccgacttctgttcccccacaggcaatcacgttaacgagattctggaaagtcccaaaaaggctaaatcgcgcttgattaccactaccgagcaggtcaagtttttatgcttccttctctcaggatgcaaggttaagaagcacgagacgcaaagcctggcactcgatgcctgtagtcgggatgaaggagcagttatctctcagatttctgatatatcgaatagggatggtcatgctacagacgaagaaaaattggcttcaacgagttgtggccagaaaagtgccggagctgaggtaaagggggaaccagaagaagacctggagtacttcgagtgttccaacgtgcccgtgtcaaccatcaaccacgcattttccagctcggaagccggaatcgagaaagagacctgtcagaagatggaggaggacggatcaacagtattgggcctactggagagcagcgccgagaaagctccagtgtcggtgtcttgcggcggagagtctccgctagacgggatatgtctttccgagtcggacaagacagctgttctcacactgatccgagaagagatcattaccaaggagatcgaggccaatgagtggaaaaaaaaatatgaggagaccaggcaggaggtgctcgaaatgaggaagatagtggccgagtacgagaagactatcgcccagatgatcgaggatgaacagagaacttcaatgaccagccagaagtccttccagcaactcactatggagaaagaacaggccctggcagacctcaattcagtggagcggtctctgagtgacctcttcaggaggtatgagaatttgaagggggtgctcgagggttttaagaagaatgaggaggctctcaagaagtgcgcgcaggactacctggccagagttaagcaggaggaacaacgctatcaagcccttaaaattcacgctgaggaaaaacttgacaaagcaaacgaggaaatcgcacaggtcaggaccaaagcaaaggcagaatccgctgctttgcacgcagggctgcgcaaggagcaaatgaaagttgagtccctcgagagggctcttcagcagaagaaccaggaaatcgaggagctgacaaaaatttgcgatgagcttatcgccaagcttggtaagaccgactag

SEQ ID NO: 244516 - DNA, 2379 bp, Artificial Sequence
  Description of Artificial Sequence: Synthetic coding sequence
atgcaacggcagactatcaagggggctggggcaggcggtgctgcactgatggccttttccccatggcagatcctttctcccgtgcagtgggcaaaatggacttggtccgctgtgcgcggaggtgccgctggagaagacgaggcgggagggccagagggcgaccccgaagaggaggacagtcaagcagagacaaagagcctgtccttctcctcagatagcgaaggcaatttcgaaactcccgaagccgagacacccattcgttcaccttttaaggagtcctgtgatccttcactgggactcgcagggcctggtgccaaaagccaggaaagccaggaggccgacgagcagttagtagccgaagtcgtcgaaaaatgcagctccaaaacctgctctaagccatcagaaaatgaggttccccagcaggcaatcgactcacactccgtcaagaattttcgcgaagaaccagaacatgacttcagtaagattagcatcgtgcggccattctcaatcgagactaaagacagcactgatatttccgcagtgctgggtactaaggccgcacatggttgcgtgactgctgtatccggaaaggctcttccaagctctccgcctgacgcattacaggacgaggctatgacagaaggaagcatgggggtcacactagaagccagcgcagaggctgacctgaaagcgggtaacagttgtcccgagttggtcccttcacgaagatctaagctccgaaaacctaaaccagttcccctcagaaaaaaagccatcggaggtgaattttccgataccaatgccgctgttgaggggacccccctacccaaagcttcttatcactttagtcctgaggagttagatgaaaacacttctcctctcctcggcgatgcacggttccagaagtcccccccagatctgaaagagacacccggaactctcagcagcgatacaaacgactctggggtggagctgggcgaggagtctaggtctagtcccctgaaactggagtttgattttaccgaggatacaggcaacatcgaagcacgcaaggcccttcccagaaaacttgggcgtaaactgggatcgacacttaccccaaagattcaaaaggatggaatctccaaaagtgcgggattagaacagcctacagaccctgtggccagagacggacctcttagtcagaccagcagtaaacccgatccaagccagtgggaatcacccagttttaacccctttggcagtcactcagtattgcagaacagccctccattgagttctgagggttcttaccactttgaccccgacaattttgatgaatccatggacccctttaaaccaacaactacactcacatctagcgacttttgttcaccaaccggcaatcatgtgaacgagatcctggaaagcccgaagaaagctaaatcacggctaataacctctggctgcaaggtgaagaaacatgagacccaatccttggcactcgacgcttgcagccgcgacgagggcgcagttatcagtcagatctctgacattagcaatcgcgatggacacgctaccgacgaggagaagctggcttctacctcgtgcggacaaaaatctgctggggcagaagtgaagggcatcgagaaggagacctgccagaagatggaggaggacggcagcactgtcctgggcctgctagaatcttctgccgagaaagcaccagtatcagtctcgtgtgggggtgaatcaccccttgatggtatttgcctgtcggaaagtgacaaaaccgccgttctaaccctcattcgggaagagatcatcaccaaggaaatcgaagcaaacgagtggaagaaaaagtacgaggaaacaagacaagaagtactggagatgcgtaagatcgtagctgaatacgagaagaccatcgcccaaatgatcgaggacgaacagcgaaccagcatgacgtctcagaagagttttcagcagctgactatggaaaaggagcaggctctggcggatctgaattcagtggagcggagtctgtccgacttgttccggaggtatgagaatcttaagggcgtcctcgaagggtttaagaaaaacgaggaggccttaaagaagtgtgcccaggattacttggccagagtgaagcaggaggaacagaggtatcaggccctgaagattcacgcggaggagaagcttgataaagcaaatgaagagattgcgcaagtgagaacaaaggccaaagcagagagcgctgctctgcatgcagggcttaggaaagagcagatgaaggtcgagtcactagagagagccctgcagcagaagaaccaggagatagaggaactaaccaaaatttgtgacgagttaattgctaagctcggcaaaaccgattag

SEQ ID NO: 244517 - DNA, 1431 bp, Artificial Sequence
  Description of Artificial Sequence: Synthetic coding sequence
atgaccgagggttcgatgggcgtgaccttggaggccagcgccgaagctgacctgaaagcaggcaactcatgcccagaattggtaccttcccgaaggtcaaagctcagaaagcctaagccagtgccactgcgaaagaaggccatcggaggggagttcagcgatacaaacgccgcagtggaaggcacaccccttcctaaggcatcctaccacttcagccctgaagagcttgatgagaatacaagcccactgctgggagacgcacgcttccagaaatctcccccagacttgaaggagacaccagggacccttagcagcgacacaaatgacagcggggttgagctgggcgaggagagtcgcagctctccactgaaattagagttcgactttactgaggacaccggtaacatcgaagccagaaaggccttgcctaggaaattagggagaaaactgggttctacactgacacctaaaatccagaaggatggcatctccaagtctgccggactcgagcaacccaccgatccagtcgcgcgtgatgggccactgagccagacctcttctaagcctgatcccagtcagtgggaaagccccagtttcaatccttttggatctcattctgtgctacagaattcccccccactctctagcgaaggtagctaccactttgacccggacaacttcgacgaatcgatggatccgtttaagcccacgacaacattaactagctccgatttttgtagcccaaccggaaatcacgtgaacgaaatcctggaatcccctaagaaggccaaatcccggctgattacttctggatgtaaggtgaagaagcatgaaacacaatctctggccttggacgcatgttctcgcgatgaaggggcagtgatttctcagatctcagatattagcaacagagatgggcacgccactgacgaggaaaagttagcttctacctcttgtggccagaagagtgccggtgccgaagtgaagggagagccagaggaggacctcgagtatttcgagtgtagcaacgtccctgtgtctacaataaaccatgccttctcctcatcggaggccggaatcgagaaggagacttgccagaaaatggaggaagatggatcaactgttcttgggctgctagaatcctcggccgaaaaggctcctgtttccgtctcttgcggcggtgaatctccacttgacggcatttgtctaagtgagtccgacaaaacggccgttctgactttaatccgggaggagattatcacaaaagaaatcgaggcaaatgagtggaaaaagaaatacttcaataaagaggtgttccggggagacatctgtcccaagcggtttggactgcagattcccgtaatattcaagaagcagctcaccacaaagtcactcagccttcatagggtgacagtcaaaaaattgatgtag

SEQ ID NO: 244518 - DNA, 2196 bp, Artificial Sequence
  Description of Artificial Sequence: Synthetic coding sequence
atgaacaacatactcaaactgaagtctagcgactctgaagggaatttcgagactccagaagcagaaacccccatcaggagtccctttaaagagtcatgcgacccctccctcggactggcgggtcccggagctaagagccaggagtcacaagaagccgatgagcaattagtggccgaggtagtggaaaaatgttcgtccaaaacatgcagcaaacccagcgagaacgaggtcccccagcaggcgatcgacagccattccgtcaagaacttcagggaagagccagagcacgacttttcgaagatctcaatcgtgcgacctttcagcatcgagactaaagattcaaccgacatatctgctgtcctgggcaccaaggctgctcacggctgtgtaactgcagtatcaggaaaggccctgccatcgtcacctcccgatgccctgcaggatgaggctatgacggagggcagtatgggcgtgacgctggaggcttctgccgaggccgaccttaaggctggcaattcctgtccagaacttgtaccatcacgacgaagtaagttgcgaaagcccaagccagtgcccctgagaaagaaggccattgggggtgaatttagtgacaccaacgcggctgtggaggggactcctctgcctaaggcgtcttaccacttttcccctgaggaacttgacgagaatacctcccctctgctgggagacgcaagattccagaagagtccacctgatttgaaggagacccccggtacgctgtcttctgatactaacgacagtggagtcgagttgggggaagaaagtcgatccagccccctgaagctggaattcgatttcaccgaagataccggaaacatagaggcacgaaaagcgctgccgcgaaagctgggaaggaaacttggtagcacccttacaccaaaaatccaaaaagacggcatttccaagagtgccggactggagcaaccaaccgaccccgtcgcaagagatggacccctgagccagacaagctctaagcccgatccctcgcagtgggagtctccaagcttcaatcccttcggctcccattccgtgctccaaaacagtccccctctcagcagtgaaggatcctaccacttcgaccctgacaactttgatgaatctatggatcccttcaaacccaccacaactctcacctccagcgacttttgtagtccgacaggaaaccatgtgaatgaaatcttggagtctcccaagaaagctaagtccaggctgattacatctggctgtaaagtgaagaagcatgagacacagagcctcgccctggacgcttgcagccgggatgaaggtgcagtgatttctcagatcagcgacatttctaacagggacggccacgccactgacgaggaaaaactcgcatctaccagctgcggccaaaaaagcgccggagccgaggtcaagggcatcgagaaagaaacgtgtcagaaaatggaagaggacggctccacggttttgggcctgcttgaatcttcagctgaaaaggcgcctgtcagcgtgtcttgcggcggagaatcccccctggatggaatctgcctgtcagaatcagataagaccgccgtgctcactctcatccgcgaagaaataataacgaaggagatagaagctaacgagtggaaaaagaaatacgaggagacccgtcaggaggtgctagagatgaggaaaatcgtggccgaatatgagaaaacgatcgcgcaaatgattgaggacgagcagcggactagtatgacctcacagaaatcctttcagcagctcactatggaaaaggaacaggcactggcggatctgaactccgtggagcgttctctatccgacttattcagacgatacgaaaacctgaagggagtgctggaaggttttaagaagaatgaggaagctctgaaaaaatgtgcacaggattacttggctagagtaaagcaggaggaacagcgctatcaggctctaaagatccacgctgaggagaagctggataaggctaacgaggaaattgcacaagttcgtaccaaggcaaaagctgaatcggccgcacttcatgcagggcttcggaaagaacaaatgaaagtggaaagcctggagagggctctgcaacagaagaatcaggaaatagaggagctgaccaagatctgtgatgagcttatagcaaagttggggaaaactgactag

SEQ ID NO: 244519 - DNA, 1833 bp, Artificial Sequence
  Description of Artificial Sequence: Synthetic coding sequence
atgacagaaggtagtatgggcgtgaccttagaggcatctgccgaggcagacctgaaggcaggaaatagctgcccagagctggtccccagccgtcggagcaagctgcggaagccgaaacccgtgccactgcgaaaaaaggctatcggaggtgagtttagcgatacaaatgccgctgtcgaaggaacgcccctgccgaaagcgagctaccacttttctcccgaggagcttgacgagaatacaagccctctgcttggagacgcaaggttccagaagtccccccctgacctcaaggaaacacctggcaccctgtcctccgatacaaacgactctggggtggaactgggagaagaatcaagatcatcaccactgaaactggagttcgacttcaccgaggacacggggaatatcgaagccaggaaggcactgcctcgaaaactggggagaaaactgggtagcacactcacacctaaaattcagaaagatggtatcagcaagagtgcgggactagagcaacccacagaccccgtggccagagatggtcctctgtcccagacaagctctaagccagacccctcccagtgggagtctccctcatttaacccattcggctctcattccgttctacagaacagccctcctctgtctagcgagggaagctatcacttcgatcccgacaacttcgacgagtctatggaccctttcaagccgaccaccactcttacgtcgagcgacttttgttctccgacagggaatcatgttaacgaaattctggaaagccccaaaaaagcaaagtcacgccttatcactagcggatgtaaagtaaagaagcatgaaacccagtcactggcgctcgacgcatgttccagagacgagggggcagtcataagccagatctccgacatctcaaacagggatggacatgccactgacgaagagaaactagctagtacatcttgtggccagaaatccgccggtgccgaagtgaagggggagcccgaagaggacctggaatatttcgagtgctccaacgtgcccgtcagtactatcaaccacgccttctctagtagcgaggccggtatcgagaaggaaacatgccagaagatggaagaggacggcagcacggtgctgggcctgctggagtcttctgccgagaaggctccggtcagcgtgtcatgcggcggagaaagcccactggatggaatctgtctctcagagtccgacaagaccgctgtactgacgttaatccgggaggaaatcattacgaaagaaatcgaggctaatgagtggaaaaagaaatacgaagagacaagacaggaagtgctggagatgcgcaaaatcgtggcggagtacgagaaaacaatcgcacagatgatcgaagacgaacaacggacctccatgacctcccagaaaagctttcaacagctgactatggagaaagagcaggccctcgccgatctaaattctgtcgaacggtcgcttagcgacctgtttcgcaggtacgaaaatctgaaaggggtcctggaaggatttaagaagaatgaggaggcccttaagaagtgtgcacaggactacttggctagagtgaagcaggaggaacagcggtaccaggcactgaagatccatgcagaggaaaaactagataaggcaaacgaagaaatcgcccaggtgcggacaaaggcaaaagcagaatccgccgctctgcacgccggacttaggaaggagcagatgaaggtggagagtctcgaacgggctctgcagcagaaaaatcaggagattgaggagctgaccaaaatttgtgacgaactcatagctaagttgggaaaaacagattag

SEQ ID NO: 244520 - DNA, 1746 bp, Artificial Sequence
  Description of Artificial Sequence: Synthetic coding sequence
atgaccgaggggtctatgggggtgacattagaagcttctgcagaagcagatctcaaagccggaaactcatgtccagagctcgtgccatctcgacgctcgaagcttaggaagcccaaacctgtgcccctgagaaagaaggccatcggcggtgaattcagcgataccaatgcagcggtggagggcacccccctgcccaaggcatcgtaccatttctcgcccgaggagctggacgagaatacttcccccctgctgggtgatgcaaggttccagaagtccccccctgatctgaaggaaacccccggaaccttgagttcagatactaacgacagtggagttgaactgggggaagagagcagatcaagtccattaaagcttgagttcgatttcaccgaagacaccggtaatatcgaagcgcgtaaggcacttcccaggaagctcggccgaaaactcgggtctaccctcacgcccaagattcagaaggacggtatctccaaaagcgcgggtctggagcagccaacggatccagtggccagagatggccctctgtctcagacaagtagcaaaccggaccccagtcaatgggagtcccccagctttaatcccttcggctctcactctgtgctgcagaactctcctcctctcagctcagaaggtagttaccatttcgatcctgacaatttcgacgaatctatggacccctttaagcctaccacaacacttacttccagtgacttctgctctccgaccggaaaccatgtaaacgagatcctggaatccccaaagaaagccaagagcaggcttatcaccagtggatgcaaagttaagaaacatgaaacgcagagcttagccctggatgcctgtagccgagatgagggagcagtgatatcccaaattagcgatatttcaaaccgggatgggcacgccacagatgaggagaaactcgctagcacctcctgcggccagaagtcggctggcgcagaggtgaagggtatcgagaaggagacttgccaaaaaatggaagaagacgggagcacagtcctcgggctattagaatccagcgctgagaaagctcctgtttcggtgagttgtggtggagagagtcctctcgatggaatatgcctatccgagtctgataaaacggctgtactcaccttgatccgggaagagataatcacgaaggaaatcgaagcaaatgaatggaagaaaaaatacgaggagactcggcaggaggtgcttgagatgaggaagatagtagccgaatatgagaagacaattgctcagatgatcgaggacgagcagcgcacctctatgaccagccagaaatccttccaacagctcacaatggaaaaagagcaggcccttgcagacttgaattcagtggagcgcagcctgtctgacttattccgcaggtacgaaaacctgaagggagtactggagggatttaaaaaaaacgaggaggctttaaagaaatgtgcccaagactacctagcccgagttaagcaagaagagcagaggtatcaagcccttaagatccacgcagaggagaaactcgataaagccaacgaggagatcgctcaggtgcgaacaaaggctaaagccgagtccgccgctttacacgccggtttgcgtaaagaacagatgaaagtggagtcactagagagagcgctgcagcaaaaaaatcaggagatcgaagagctgaccaagatctgtgacgagctaattgccaaactcggcaagactgactag

SEQ ID NO: 244521 - DNA, 93 bp, Artificial Sequence
  Description of Artificial Sequence: Synthetic coding sequence
atgacggagggaagcatgggggtcacgctggaagcttctgccgaggccgatcttaaagcaggcaattcatgcccagagttagttccgtcctag

SEQ ID NO: 244522 - DNA, 417 bp, Artificial Sequence
  Description of Artificial Sequence: Synthetic coding sequence
atgactgaaggatccatgggagtgacactggaagcctccgccgaggcggacctaaaagccggaaactcctgccctgaattggtaccatctcgccgttccaagctcagaaagccaaaacctgttccattgcgaaagaaggccattggcggagagttcagcgacacaaacgcagccgtcgagggcacccccctgcccaaggccagctaccacttcagccctgaagagctggacgaaaatacgtcccccttacttggcgatgcgcgttttcagaaaagccctccagatctgaaagagactcctgggacactgagtagtgatacgaacgatagcggcgtggaacttggcgaggagagtcgatccagcccgcttaaactggagtttgacttcactgaagatactgggaatatcgaagcttag

SEQ ID NO: 244523 - DNA, 186 bp, Artificial Sequence
  Description of Artificial Sequence: Synthetic coding sequence
atgaccgagggaagcatgggggtgaccctggaggccagcgccgaggccgacctcaaagccggaaactcctgccctgaattggtcccttccaggcgcagtaagcttcggaagccgaagcctgtgcccctccggaaaaaagctattggaggagaatttagcgacactaatgcagcagtcgaggggtag

SEQ ID NO: 244524 - DNA, 390 bp, Artificial Sequence
  Description of Artificial Sequence: Synthetic coding sequence
atggccttcagcccttggcagattctgtccccagtgcaatgggccaaatggacctggagtgccgtaagaggcggtgccgcaggtgaggatgaggccggaggacccgagggggatcccgaagaggaggattcgcaagccgagaccaagtctctgagcttttcttcagattcagagggcaatttcgagacccctgaagcggagacacctattcgcagcccattcaaagagagttgcgatcctagtcttggtctcgctggcccaggggcaaagtcacaggagagccaggaggctgacgagcagttggttgccgaggtggtagaaaagtgtagcagcaagacctgcagtaagcctagcgagaacgaggttccgcagcaggccattgatagttag

SEQ ID NO: 244525 - DNA, 3081 bp, Artificial Sequence
  Description of Artificial Sequence: Synthetic coding sequence
atggggggttcccaatccctgcagcctgcgccagcgagcgacctgaatcttgaagcttcagaggccatgagttccgattccgaagaggcctttgaaacccccgaaagcacaacaccagtgaaggctccaccagcccctccgccaccacccccagaggtgattcccgagcccgaagtgtcaacccaaccaccacccgaggaacccggttgcggaagcgagaccgtgccagtgcccgacggaccccgtagtgacagcgtggaggggagccctttcagacctccctctcatagttttagcgcagttttcgacgaagataagcccatcgcctcttcaggaacatacaatctggatttcgacaatatagaactagtggacacatttcaaacactcgagcctagggcctcagatgccaaaaatcaggagggtaaagtgaacactcggaggaagtcaacggacagcgtccccatttcaaagtccacactttctagatctctgagcttacaggcctctgactttgatggtgcgtcatcgagcggaaatcctgaggctgtggcactggcccctgacgcttactccactggtagcagcagcgctagtagtaccctgaagcggacgaaaaagcccaggccaccatctttgaagaaaaagcagaccacaaaaaagccaactgaaacaccaccagtcaaggagacacagcaggaacctgacgaagaaagtctagtcccctctggcgagaatctcgcctccgagacgaagacagaatctgcaaaaactgaaggacccagccctgccctgttggaggaaacaccactggaacccgcagttggacccaaagcagcatgccccctcgatagtgagtcagccgagggtgttgtgcctcccgcatctggtgggggtcgggtacagaatagcccccctgtaggtcgcaagacattgcctttgaccacggccccagaagccggtgaagtgactccctccgacagcggaggtcaggaagactcccccgctaaaggcctgtctgtccgcctggaatttgattacagcgaagataaaagcagttgggacaatcaacaggagaacccgccaccaacaaaaaagataggaaaaaagccagtggccaagatgcctctacgtcggccaaaaatgaagaaaactcccgaaaagcttgacaacacgcccgcttcacccccaagatctccagctgaacccaatgatatccccatagccaaagggacctacaccttcgatatcgacaagtgggatgatcccaactttaatcccttcagcagcacttctaagatgcaagagagccctaaattaccacagcagagttacaacttcgacccagatacctgcgacgaatccgttgatccatttaaaaccagctccaaaacgccgagctccccctctaagtcacccgcatccttcgaaatacccgcatccgcaatggaggctaatggtgtagacggagacggcctcaataagccagccaaaaagaagaaaacgcccctgaaaaccgatacgttccgcgtgaaaaagtccccaaaacggtctcctctatctgaccccccaagccaggatccaactccagctgctacacccgagactccccctgtgatctctgcagtggtgcacgccacagatgaagagaagctggccgtgactaaccaaaagtggacctgcatgacagttgacctggaagcggataaacaggactacccccagccatcagacctcagtacattcgtcaatgaaacaaagttttcctcccccactgaggaattagattataggaattcttatgaaattgagtacatggaaaaaattggctcctcgctacctcaggatgacgatgctcctaagaagcaggccctgtatctgatgttcgacacaagtcaggagagtccagtcaagtcaagtccagttcgcatgtccgagtcacctaccccctgtagtgggtccagtttcgaagagacagaagcacttgtaaatactgccgctaaaaaccagcaccccgtcccacgtggtcttgctcctaatcaggagtcacacctgcaggtccctgaaaaaagctcacagaaagaactcgaggcgatgggactgggcaccccatccgaggccattgagatcacggcccctgaaggaagctttgccagcgctgacgctctgttgtcccggctggcgcacccagtaagcctctgtggcgcattggattatctggagccagacctcgcggaaaaaaatccacccctattcgcccagaaactgcaggaagaactggaattcgcaatcatgagaatcgaggcactgaaactggcaaggcagatcgccctggcctcgagaagccatcaggacgctaagagagaagctgcccaccccactgatgtgtctattagtaaaactgcactgtattcgaggatcgggacagcggaggtcgagaagcctgctggccttctgttccagcagcccgaccttgattcagccctccagatcgccagagcggaaatcatcaccaaagaacgcgaagtctcagaatggaaggacaaatatgaggaaagccgccgagaagtgatggagatgcgtaagattgtggccgagtacgagaagacaatagcacagatgatcgaggatgaacagagggagaaatccgtttcacaccagacagttcaacaattggtgttagagaaagagcaggcattagccgacctgaacagcgtcgagaaatccctggccgatctgttccggaggtatgagaagatgaaggaggtcttagagggatttcgcaagaatgaagaggttctgaagcgctgcgctcaggagtacctgagcagagtgaaaaaggaagaacagcgttaccaggctcttaaggtgcacgcagaggaaaagctcgatagggccaatgctgaaatcgcacaagtgcgagggaaggcacagcaggaacaagccgctcaccaagcgtcgttacgcaaagaacaattgcgcgtggacgccttggagagaaccctggaacagaaaaataaggaaatcgaggagctgacaaagatatgcgacgaactcatagccaaaatggggaagtcctag

SEQ ID NO: 244526 - DNA, 8846 bp, Artificial Sequence
  Description of Artificial Sequence: Synthetic coding sequence
atggggaatgagaatagcacctccgataatcagcgcactttatcagcacagacaccgaggagcgctcagcctcccggaaacagtcagaatataaagcgcaagcagcaggataccccgggatctccggatcaccgcgacgccagcagcataggcagcgtcggtttgggtggtttctgtactgcctcggagtcgtccgcatccctcgatccttgcctggtgtcccccgaagtgacagagcccagaaaggatcctcagggagcacggggtccagagggatcactactgccgtccccccctcctagccaagaaagggaacatccaagcagcagtatgcctttcgctgagtgcccccctgaggggtgtttggccagtccggctgccgctccagaagatgggcctcagacacagagtcccagacgtgagcccgctcccaacgcacccggagacatcgctgctgcctttcccgctgagcgggacagtagcaccccttaccaggaaatcgccgctgtgccctccgccggacgcgaaaggcagcccaaggaagaagggcagaagtcctccttttcttttagctcgggaattgaccagtccccaggaatgagcccagttcccttgcgcgaacccatgaaggctccgctatgtggtgagggtgatcagccgggaggtttcgagtcccaggagaaggaagcagcgggaggattcccccctgcggagtctagacagggggttgcctcagtacaagtgactcccgaagctccagctgctgcccagcaggggaccgaatcaagcgctgtgctggagaaatcccccctgaagcctatggcccctattccccaggatccagcgcctcgcgcaagcgaccgagagcgaggccagggagaggctccaccccagtatttgactgatgacttggagtttctgcgcgcatgccacctgcccagatctaattccggggcagcacccgaggctgaagttaatgctgccagtcaggaatcatgtcaacagcccgtcggcgcatacctgccgcatgctgaactgccatggggcctgccgagcccagctctcgtgccagaagcgggtggctctgggaaggaagccttggacacaatagatgttcagggacatccacagacaggaatgaggggcactaagccaaaccaggttgtctgcgtggctgctgggggtcagcccgaaggcggtttgcctgtaagcccggagcctagtttgctcactccgaccgaggaagctcacccagctagctccctggcctccttcccggcagcacagatacctattgcagtagaagaacccggttccagctccagagaatccgtctcaaaagccggaatgcctgtcagcgcagacgcagccaaagaggtggtggatgccggacttgtgggactggagagacaggtctcggacttagggagcaagggcgagcacccagaaggcgatcctggggaggtgcccgcaccgtctccgcaagagagaggcgaacatctgaacacggagcaaagccatgaggttcagcccggagtgccaccccctcccctcccaaaggaacaatcccacgaagtgcagcctggcgctccacctcctccgcttcccaaggctccatctgagagtgctcgcggaccccctggcccaaccgatggtgctaaggtgcacgaggatagtacttccccagcggttgcaaaagagggatcccggagtcccggagacagccctgggggtaaggaggaagcgcctgaaccacctgacggcggagatcctgggaatcttcaaggtgaagatagccaagccttctcaagtaaaagggatcctgaggtcggcaaagatgaactcagcaagcctagtagcgatgctgagagtcgagatcaccccagttcacactccgcccaaccacctcgcaaaggcggagcaggacacactgacggccctcattctcagactgctgaggctgatgcctcaggtctgccccacaagctaggtgaagaagacccggtacttcctccggtacctgacggggctggagagcccaccgttcctgaaggagctatttgggaaggatctgggttacagcctaagtgccctgacaccttacagagtcgggaggggctcggacgcatggagtctttcttgacactggagtcagaaaagagcgactttcctcccacccccgtggcagaggtggcacccaaggctcaggaaggcgaatccacccttgaaattagaaaaatgggctcctgcgacggcgagggcctgctgactagtcctgatcagccccgtggacctgcctgcgacgcgagcagacaggaattccacgctggggtgcctcatcccccacaaggtgaaaacttagctgctgatctcggtctaaccgcacttatcctcgatcaggatcagcagggaatcccgagctgtcctggagaaggctggatccgcggagctgcaagcgaatggcctctgctgtcttcagagaagcatcttcagccatcacaggcccaaccagagacttccattttcgacgtgctcaaagagcaggcccaaccacctgagaatggtaaggaaacatctccttcacacccagggttcaaagaccagggtgcagatagctcccaaatccatgtacctgttgagccacaggaggacaataatctgcccactcacggcggacaggagcaggccctaggctccgagctgcagtcccagctcccaaaaggtacactaagcgacactcctacctcctcaccaacggacatggtgtgggaatcctcattaacagaggagagcgaactatcagcgccaactcgtcaaaaactccccgctctcggcgaaaagcgccctgagggggcatgcggtgacggacagtcgagtcgagtgagtccgccagccgctgatgtgctgaaggacttcagcctggcaggcaattttagccgaaaggagacctgttgcaccggccaaggtcccaacaagagtcagcaagccctcgctgatgctctcgaggaggggtcgcagcacgaggaagcatgccagcggcatcctggagcaagcgaagcagccgacggttgtagccccctgtggggcctatcaaaacgcgagatggctagcggcaacacaggagaggccccaccatgccaacccgatagtgttgccttgctcgatgcggtgccctgcctgccagcccttgccccagcctcccctggagtgacaccaacacaagatgctcctgagactgaggcctgtgacgaaacacaggagggccgtcagcagcccgtgcctgctccgcagcagaagatggagtgttgggcaacgtcggacgctgagagtcccaagctgctggcttcatttccaagtgctggggagcagggtggcgaggctggagctgctgaaacaggcggtagtgcaggcgctggcgacccaggcaaacaacaggcacctgaaaaacctggagaggctactctttcctgcggtctcctccagactgagcattgtcttaccagtggagaggaggcctcaaccagtgccctgcgagaaagttgccaggccgagcatcctatggcctcctgccaggatgctttactgcccgcaagagagctgggtgggattccgagatctaccatggatttcagcacacatcaggccgtacctgaccctaaagagctcctgctctcgggaccacccgaagtagccgcacctgacacaccatatctgcatgttgatagtgccgcacaacggggtgcagaggattctggggtgaaagcggtgagcagtgctgacccgagagctcctggggagagcccctgtcctgtaggagaaccccctctggcactcgagaacgcagcgtcactaaaactgttcgccggatctctcgcgcctctgctccagcccggagctgccggaggcgaaattccagctgttcaggcctcttctggatcaccaaaggctcgcacgacggaaggccctgtcgattccatgccatgtttagacaggatgcctttgttggccaaaggcaagcaggctaccggagaggaaaaggccgcaacagctccgggagcaggtgctaaggcaagcggcgaaggtatggcaggtgacgccgcaggcgaaaccgagggctccatggagaggatgggcgagccatctcaagatcctaagcaaggtacaagtgggggagtagatactagctcagagcagatcgcaacgctaaccggcttccctgactttcgagagcacatagccaagatttttgaaaaacccgtgctgggtgcgctcgcaactcccggtgaaaaggcaggcgctggcagatcagccgtggggaaggatctgacacggcctctcggccctgaaaagctgttggacggccctccaggagttgatgtgaccctccttccagcgcctcctgctaggcttcaggtagagaaaaaacagcagttggcaggggaggctgagatctcccatctggccttgcaggacccagccagcgataaattgctgggtcccgctggactcacttgggaacgcaacctgccaggcgctggggtgggaaaagagatggcaggcgtgcccccaacgttgcgcgaagatgaaagacctgaaggccctggggcagcatggcctgggctggaaggccaggcttattcgcagctcgaacgaagccggcaggaactggcctcgggtctcccttcaccggctgctacacaagagctccctgttgagcgggcagcggcatttcaggttgccccacactcacatggtgaagaagccgtcgctcaggaccgaattcctagcggtaaacagcaccaggagaccagcgcatgtgacagcccgcacggcgaggatgggcctggcgattttgcacacaccggagtgcctgggcatgtgcctcggtcaacgtgcgccccttctcctcagcgagaagttttaacggtgccagaagccaactctgaaccctggaccctggatacactgggcggtgagcgacggcctggcgttacagccggaattctggaaatgcgcaacgctctggggaatcagagcacccctgcccctcccaccggcgaagtggctgatacacctctggagccaggcaaggtcgccggagcagccggtgaagcagagggtgacatcaccctctcaactgccgagactcaggcatgtgcaagcggggacctcccagaagcgggaacgacgaggaccttcagcgttgtggctggcgatcttgttctacccggttcgtgccaggatcccgcttgctccgataaagctcctggcatggaaggcactgcagccctccacggcgattcgccagctcgccctcagcaagccaaagagcagcctgggccagaacgacccatacccgctggagatggcaaggtttgtgtgagctcaccccctgaacccgatgaaacccacgatcctaagcttcaacatctggcacccgaagagcttcataccgaccgggagtcccccagacctggaccatccatgctcccaagtgtgccaaaaaaggatgcccctcgcgtgatggataaagtcacctccgatgagactagaggggctgaaggaactgaatctagccccgtagcagatgacatcatacagcccgcagctcctgctgatcttgagagcccgactctcgcagcgagctcctatcacggcgacgtggttggccaggtgagcactgacctcatcgctcagagcatcagtcccgctgctgcacatgcgggactgccaccctctgctgcagagcacattgtttccccctcagcccctgctggtgaccgggtcgaggcatctaccccatcctgtccagatccggctaaggaccttagcaggagcagcgactctgaagaggccttcgaaactcctgagagcactacacccgttaaagcacctcctgctcctccccctcccccaccagaagtaattcccgagcctgaagtctcaacacagcccccacctgaagaacctggatgcgggtcagaaacagttcctgtgcctgatggacccagatccgattctgtagaaggaagtccatttcggcctccctctcactcctttagtgcagtctttgatgaggacaaaccgatagcttcttctggcacttacaacctggacttcgataatattgagctggtggatacattccagacccttgaaccgagagccagtgatgcaaagaatcaggaagggaaggtgaatacaaggcgtaaatctacagactcagttcctattagtaaatcaacactgtctaggtctttatcactgcaggcctccgacttcgacggggcatctagttccgggaaccctgaggcggtggccctcgccccagatgcttattctaccggatcttcaagcgcaagctccacgctgaagcgcacgaaaaaaccgagaccgccatccctaaagaaaaaacagaccaccaagaaacctacggaaaccccccctgtgaaggagacccagcaggaacccgatgaggagtccttggttccaagtggagaaaacctagccagtgaaaccaaaacagagtccgcgaaaaccgagggacccagcccagcattgttggaggagacgcctttggaacccgctgttggacccaaagccgcatgcccacttgacagtgagtctgccgaaggggtagtccctccggctagcggtgggggtagagtgcagaatagcccccctgtgggcaggaagacacttccattaacaaccgcacctgaagcgggagaggtgacaccctcagattcgggtggacaggaagactctcctgcgaaaggtctcagtgtacgtttggaattcgattatagcgaggataagagctcttgggataaccaacaagaaaacccccctcccacgaagaagattggtaaaaagccggtggccaaaatgccattgcgcagacctaagatgaaaaagactcccgagaaactcgacaacactccagccagcccaccgcgaagccccgcagagcctaatgatattccaatcgccaaggggacttatacctttgacatcgataagtgggacgacccaaacttcaatccattttctagcacaagtaagatgcaggaatcccccaagctgccgcagcagtcttacaactttgatccagacacctgcgacgagtccgtagaccccttcaagaccagcagtaaaaccccctcctcacctagtaagtcccccgcatcatttgaaatcccagcttccgccatggaggccaatggggtggatggcgatggcttgaacaaacctgcaaaaaagaaaaaaacacccctgaagactgacacatttagggttaagaagtctccgaaacgtagcccattgagtgatccccctagccaggaccctacacctgctgccaccccagagactcccccagtgatttctgctgtcgttcatgctaccgacgaagagaagttggcggtcaccaaccagaagtggacctgcatgactgttgatcttgaggcagataagcaggattaccctcagccaagtgaccttagtactttcgtgaatgagactaaattctcttcacctaccgaagagctggactatagaaactcctacgagatcgaatacatggaaaagatcggaagttctttgccccaggatgatgatgcccctaagaagcaggcactgtatttaatgtttgatacttcacaggagtctcccgtgaagtcttcaccggttagaatgtctgagtccccgacaccttgcagcgggtcctctttcgaagaaaccgaggccctagtgaatactgccgctaaaaatcagcaccctgtccccagaggccttgctccgaaccaggagtcacacctgcaggtacccgaaaagagcagccagaaagagctggaggcaatgggcctaggcaccccatctgaagccatcgaaattaccgcacctgaaggatcattcgcctccgctgacgccctgctgtcccgattggcacaccccgtctccctctgtggcgctttggactatctcgagcctgacttagccgaaaagaatccacccctgtttgcgcagaagctccaggaggaattggagttcgcgatcatgcgtatcgaagctctgaagctcgcgcgacagattgccctagccagcaggtcacatcaagacgccaaaagagaggccgcacatcctacagatgtctccatcagtaaaacagcactgtacagtagaatcgggacagccgaagttgaaaaacctgccggtttgctgttccagcaaccagatctcgattcggcactacagatcgcgagggctgagatcattaccaaagagcgcgaagtctcagaatggaaggataagtatgaggaatctcgacgcgaagtgatggagatgagaaaaattgtcgcagaatacgagaaaaccattgcccaaatgatcgaagacgaacaacgcgaaaagagtgtctcccatcaaactgtgcagcagctcgtattagaaaaagagcaggcactggctgatctaaattcagtggagaagtccttggctgacctttttcgcagatacgagaagatgaaagaagtattggagggctttagaaaaaacgaggaggtccttaagcggtgcgcgcaagagtatctgtctcgggtgaagaaagaagaacaaaggtaccaggccctgaaggtccacgctgaagagaaactggatcgggcaaatgcagaaatcgcccaggtcagagggaaggcccagcaggagcaggccgcacatcaagcttccctccggaaggagcaactgagggtggacgccctggaacgcacgctagagcaaaagaataaggagattgaggagctcactaaaatttgcgacgaattaattgccaagatggggaagtctta

SEQ ID NO: 244527 - DNA, 8585 bp, Artificial Sequence
  Description of Artificial Sequence: Synthetic coding sequence
cagcggacactgagcgcgcagacccccaggagcgcccaaccacctggcaattcgcagaacatcaagcgaaagcagcaggacactccgggttcaccagatcatagggatgcctctagcatcgggtctgtgggattgggaggtttttgtacagcctctgaatcatccgctagtcttgatccttgcctcgtatcccccgaagtcaccgagccgaggaaggatcctcagggggcaagagggccagagggatcacttctcccctcgccgccaccatcccaggaacgggaacacccatcctcgtccatgcccttcgctgagtgtcctcctgagggttgcctggcgtcaccggcagccgctcctgaggacgggcctcagactcagtcaccccgacgcgaacccgcacccaatgctccaggtgacattgcggcagcgttcccagccgagagagatagctccactccgtatcaggaaatcgcggcagtgccaagcgccggtagggagaggcagcctaaagaggaggggcagaagtcgagtttttctttttcatctggcatcgaccagtctcctggcatgtcccctgtccccctgagggaaccaatgaaggccccactgtgcggggagggagaccagcctggtgggttcgagagccaggagaaggaagctgctggcggttttccccctgctgagtcacgacagggggtggcaagcgtgcaggtgaccccagaagcgcctgccgctgcacagcaagggactgaatcatccgctgttctggagaagagtcccttaaagccaatggctcccattcctcaggatcccgcaccaagggcctctgatagagagcgcggtcagggggaggccccaccacagtacctcacagatgatctggagttcctgcgcgcttgccatttgccgcgaagcaactccggcgctgcaccggaggcagaggtgaacgctgcaagccaggagagctgtcagcaacccgtaggagcttacctgccgcacgccgaactcccttggggattaccctcccccgctttggtgccggaagcgggtggttccggaaaagaggctttggatactatcgacgttcaggggcatcctcaaactgggatgagaggtactaaacctaatcaggtggtttgcgtcgccgcaggagggcagcccgaaggagggctgcccgtgagtcctgagccgtcccttctgacccctacagaggaggctcaccctgcatccagcctggcttctttccctgcggcacaaattcccatcgcagtcgaagagcccggtagctcctccagggagtccgtgagcaaagccggaatgccagtatctgccgatgccgcaaaggaggtggtcgacgccggactggtcggtctggagagacaggtgtccgacttgggctccaagggcgagcatccagaaggagaccccggtgaagtccctgctccttctccgcaagagcgaggagaacatctaaatacagaacagtctcacgaggtgcaacccggtgtccctccaccaccactgccaaaagagcagtcccatgaggttcagccaggagctcccccacccccactgcccaaagcgccaagtgagagcgcgcgtggcccacccggtcctaccgacggggctaaggttcatgaagactcaacaagcccagccgtagcaaaagagggcagcagatcccccggagacagtccaggagggaaagaagaggcacccgagcctccggatggtggcgaccccggaaatctccagggcgaagattcccaggcctttagttccaaaagggacccagaggtcgggaaagacgagctgtcgaaaccgtcctctgatgcggaatcccgagaccatccctccagccattcagcccagccccctaggaaaggtggggcaggccacactgacgggccacactcccagacagccgaagcagatgcgtcaggactgccccacaaactgggagaagaggacccggtgttgccccctgttccggacggggcaggagagcctactgtgcccgagggggcaatttgggaggggagcggtctccagccaaaatgccctgataccttacagagtcgagagggcctgggcaggatggaatcctttctgaccctcgaatccgagaagtctgacttcccaccaaccccggtggctgaggttgctcccaaagctcaggaaggagaaagtacgctggaaatccgtaagatgggcagttgtgatggagaaggcttgctcacttcacccgatcagcctcggggaccggcttgtgatgcctctcgacaagagttccacgccggagttccccacccccctcagggcgagaatctggcagctgaccttggccttactgccttgattcttgatcaggaccagcaagggatacccagctgtccaggtgagggttggattaggggggctgcatccgaatggcccctgctgtcctccgaaaagcatttacagccctctcaggctcagcccgagacatcaattttcgacgttctgaaggagcaggcgcagccaccagaaaatggcaaagaaacctctccatcccaccccggttttaaggatcagggcgctgactccagtcagatacacgtccccgtggaaccacaggaagataataatttgccgactcacggaggtcaggagcaagcgctgggctccgagctgcagagccagctgcccaaggggactttgagtgatacccccacttcatcgcccacagacatggtatgggagagcagtttaaccgaggaaagtgaacttagcgcgccaaccagacagaagctgcctgccctcggggaaaagagaccagaaggcgcttgcggagatggacagtctagccgagtgtcgccaccagccgcagacgtcctgaaggatttttctctggcgggtaactttagtaggaaggagacttgctgcaccgggcaggggccaaataaatcccagcaggctctggcggacgccttggaggagggatcacagcatgaggaggcctgccagagacacccaggggctagtgaggcggcagacggctgcagcccactttggggactgtcaaagagagagatggctagcgggaacacaggagaagcgcctccatgccagcccgatagtgtggcgcttttagacgcagtgccatgtctgccagcccttgcgcctgcatcgccgggagtgacgcctacgcaagacgcccctgagaccgaggcctgtgatgaaacacaggagggcagacagcagcctgtaccagcgccacagcagaaaatggagtgctgggctactagcgacgctgaaagcccaaagttactagcatccttcccttctgcaggtgagcagggcggagaagccggtgcagcagaaaccggaggctctgctggagcaggcgaccccggaaagcagcaggcacccgagaagcccggagaggcgacacttagttgtggtttgctacaaacagagcactgcctgacttccggggaagaggcgtcaaccagtgcattgcgtgagtcatgtcaggccgagcacccaatggcctcttgccaggacgcactgctcccagccagggagctcggaggaatacctaggtccaccatggatttctcaactcatcaggccgtacctgacccaaaggagctgctcctgtctgggccacccgaggtcgccgcaccagataccccctacttacacgtggatagcgcagcgcagcgcggagccgaggatagcggggtgaaggctgtctcctcagctgatccgcgagcacccggagagagcccatgccctgtgggtgaaccacctctcgcactagaaaatgctgcctctctgaagctgtttgctgggagcttggcccctctgcttcagcctggggcagcaggtggggagatccctgctgttcaggcgtcttcgggatctcccaaagcccgaaccaccgaaggacctgtagactcaatgccatgtctggatagaatgccactactggccaaaggcaaacaggcaacaggcgaggaaaaagctgccacggctccaggcgcaggcgcaaaagccagtggagagggcatggcgggagatgccgctggcgaaacagagggctcgatggagagaatgggtgagccctcccaagatccaaaacagggaacctcagggggagttgacacctctagcgagcaaattgccaccttgacaggttttccagatttccgggagcatatcgccaagatatttgagaagcccgtactaggcgcacttgcaacccctggggagaaagctggcgctgggcgatctgccgtgggaaaggatttgacccgcccactgggcccagagaagctgctggacggtcccccaggcgtggacgtaaccctccttcccgctcccccagctaggttgcaggtagagaaaaagcagcagctagccggtgaggcagagatttcccaccttgcactgcaggacccagcaagtgacaagttgctcgggccagccggtctaacctgggaaagaaatttgcccggagccggagtggggaaggaaatggcaggagttccgcctaccctgagagaggacgagcgccctgaggggcctggcgctgcctggcctggactcgaaggccaagcttactcccagctggaacggagccgacaggagctggcttccgggctgccttctccagcggctacacaggagctgccggtcgagcgggctgcggcattccaggtcgctcctcactcacacggcgaggaggccgtggctcaggacagaattccttctggtaaacagcaccaagaaacctccgcttgcgatagtcctcacggtgaggatggtccgggtgactttgctcacacaggcgtcccaggccacgtgccacgaagcacatgtgccccaagtcctcagcgcgaagtcctgactgtgccagaagccaattctgagccatggacactggataccctcggaggcgagcggcgtcctggcgttaccgcgggaattttggaaatgcgcaatgcactgggaaaccaaagcacacccgcaccgccaacaggcgaagtggccgatacgcccctggagccgggtaaggtggcaggggctgctggtgaagctgagggcgatattaccctgagtactgcagagacccaggcctgcgcctcaggagatttacctgaggcgggaacaacaaggaccttttcagtggtggctggcgaccttgtgctcccgggaagttgccaggatccagcgtgtagcgacaaagcacctgggatggaaggaaccgctgctctacacggcgactcccccgctcgccctcagcaggcaaaggaacagccagggccagaacgtccaattccagccggagacggcaaggtttgcgtaagtagcccgcctgagcccgatgagacacacgatccaaagctgcagcatctggcccctgaagagctccatactgatagggaaagtccaaggcccggacctagcatgctgcccagtgtgccgaagaaagatgccccaagagtgatggacaaagtgactagtgatgagacaaggggtgccgaagggactgaatcaagcccagtcgccgacgacattattcaaccagccgcaccagccgacctggaatcacctaccttagccgctagcagctaccacggagacgttgttggacaggtgtcaacggatctcattgcacagtctatctcccccgctgccgctcacgccggtctgccaccatcagctgccgagcacattgtatccccttcagcccctgctggtgaccgcgtggaagcatcaacaccttcctgcccggaccccgcaaaggatctctccaggtcttctgattcagaggaggcgtttgagactccagagtccaccacccctgtaaaggccccaccggcacctcctccacccccacctgaggtgattcccgaacctgaggtttccacccagcctcctccagaggaaccaggctgcgggtcagagacagtcccagtaccggatggaccacggtcagactctgtcgagggtagcccattcagaccaccatctcattcctttagtgccgtgtttgatgaagataagcccatcgcttcctccggtacgtataacctagactttgataacatcgagctggtagatacctttcagacactggaacccagagcatcagacgctaagaaccaggagggaaaggtcaacacccggcgaaaaagtaccgattctgtcccaataagcaagtctaccctgagccgcagtctctcattacaggccagcgactttgacggtgcctcatcttctggcaaccccgaggcagtcgcccttgccccagatgcttactcaacgggcagctctagcgccagcagcactctgaaacggaccaagaagcctcgtccaccatccctgaagaaaaaacagaccacaaaaaaacccacggaaacaccccctgtgaaggagacccagcaagagcctgacgaagaaagtttggtcccaagtggcgagaacctcgcctctgagacaaagactgaaagtgctaagacagagggtccaagtccggctttgctggaggaaactccgttagagcctgcagtcgggccaaaagccgcatgccccctggatagcgaaagcgccgaaggcgtcgtgccaccggcatccggtggcggacgagttcaaaattctcctccagtgggacgaaaaacactgcccctcacaacagcgcctgaggcaggagaggttaccccgtcagactctggcggacaggaagatagcccagcaaaggggctgtcagtgagacttgaatttgattactcagaggataagagcagttgggataaccagcaagagaatccaccgcctacgaagaaaatagggaaaaagcccgtagcaaaaatgcccctcagacggccaaagatgaaaaaaactcccgagaaactggataacacccccgcaagccccccacggtcccctgctgagcccaatgacattcccatagctaagggaacctatacttttgacattgataaatgggacgacccgaacttcaacccatttagttctacctcaaagatgcaggaatctcccaaactgcctcagcagtcttacaatttcgatccagacacctgcgacgagagtgtagacccgttcaaaacgtcttccaagacaccatcgagccctagtaaaagtcccgcaagctttgaaatcccggcatctgccatggaagccaatggcgtggacggcgacgggctgaataaacccgctaaaaaaaagaaaaccccactcaaaacagacacctttcgcgttaagaagagcccaaagagaagtcctctgagcgaccctccgtctcaggaccccacaccggctgccacgcccgaaaccccaccagtcatctccgccgtggttcacgccacagacgaggagaagctggcagttacaaaccaaaaatggacctgcatgaccgtagatctggaagcagacaaacaagactatccacagccatcagacctgtcaacattcgtgaatgaaacaaagtttagtagtcccaccgaggaactggactaccgaaattcctacgaaatcgagtatatggagaaaatcggcagctcccttcctcaggatgacgacgcccctaaaaagcaggctttgtacctgatgtttgatacttctcaggagtcccccgtgaagagtagccctgtgcggatgagtgaatctcctacgccctgtagtggaagtagcttcgaagaaactgaagcattggttaatactgcagccaagaatcaacatcctgtgcccagagggcttgcccctaatcaggaaagtcacctgcaggtgcccgagaaaagctcccagaaggaactagaagccatgggacttgggactccctcagaggcaatagagatcagagaggctgcgcacccaaccgacgtgtccataagtaagacagctctgtatagtcgaattggcactgctgaggtcgaaaagcccgctggactgctgtttcagcaaccagacttggactcagccctacagatcgcacgtgctgaaattattaccaaggagagagaggtaagtgagtggaaagacaagtacgaggagagtcgcagggaggtgatggagatgcgaaagatagtcgccgaatatgagaaaaccattgctcagatgatagaagacgaacagagggaaaaaagcgtgtcccaccagaccgtgcagcaacttgtgctggagaaagagcaggcactggccgacctgaactctgtcgaaaaatctctggccgacctttttcgaagatacgagaaaatgaaagaggtgttagaggggtttagaaagaacgaagaggttctcaaaagatgcgcccaggaatatctcagccgcgtcaaaaaagaggagcaacggtaccaggctttaaaagttcatgctgaggagaagcttgatcgggctaatgctgaaattgcgcaggtcagaggaaaagcccagcaggagcaggccgctcaccaggccagcctgcgcaaggagcagctccgcgtggacgcgttagagcggacactcgaacagaagaacaaggaaatcgaagaacttactaagatctgtgacgagctcattgctaaaatggggaagagcta

SEQ ID NO: 244528 - DNA, 3285 bp, Artificial Sequence
  Description of Artificial Sequence: Synthetic coding sequence
atgggcaacgaaaattcaacttccgacaatcagaggacattaagcgcacagactcctaggagtgcgcagccgccaggaaattcccagaacatcaaaagaaagcagcaggacacccctgggtcccctgatcacagggatgcttcctcctcaccagtcgctgatgatataatccaacctgcagctcccgcagaccttgagtctccaaccctggcagcttcatcataccacggcgatgtggtcggacaggtctccacagacttgatcgctcagcggtccagcgactcagaggaagcattcgagactcctgaatcaacaactccagtgaaagcccctccagctcccccaccccctcctcctgaggtgattcctgagccagaggtctctactcagcctccccctgaggaacccggatgtggtagcgaaacagtccctgtgcccgacggcccacggtccgacagcgttgaaggctctccctttcgaccgccttctcatagctttagcgctgtttttgacgaggacaaacccatcgcctcttcagggacctacaaccttgactttgataacattgagctggtggataccttccagactctcgaaccaagggcctctgacgccaaaaatcaggaaggaaaggtgaatactcgcagaaaaagtactgactcagtgccgatctccaaaagtacactatcgcgtagcctgtccctgcaggcatccgatttcgacggtgcaagcagtagtgggaatccagaggctgtggcccttgcccctgacgcctattctaccggtagtagctctgcctctagcacccttaaacggacaaagaaacctagaccaccatcgctgaagaagaaacagaccacgaaaaaacccactgaaacgcctccagtaaaagagacacagcaagagccagatgaggagtctctggtcccatctggagagaatctcgcttcagagaccaaaacagagtctgcaaaaacagaaggaccctcccctgccctgctagaggagacccctctggagcccgcagtgggccctaaggccgcttgccccttggacagcgagagcgccgagggcgtggttccacccgcttcagggggtggcagagtgcaaaattctccacctgtgggtcggaaaactctgccacttactaccgcccctgaggcaggtgaggtaacacctagtgattccggaggccaggaggattcaccagctaaggggctatctgtccggctggagttcgactattcggaggataagtcctcgtgggataatcagcaggagaatcctccccctactaaaaagattgggaaaaagcccgtggccaagatgcctctgagaagaccgaagatgaagaaaacacccgaaaaattggataataccccggctagccctcccagatcccccgcagaaccgaatgatatcccaattgctaaaggcacatatacgttcgacatcgacaagtgggatgaccctaattttaaccctttctccagcacttctaagatgcaggaatcaccaaagctgccccagcagtcatacaatttcgacccagatacgtgcgatgaatcggtggatccctttaagaccagttctaagacgcctagctctccgtctaaatcccccgcttccttcgagatccccgcaagcgccatggaggccaatggggtagacggcgacggcctgaataaacccgctaagaagaaaaagacgccactgaagactgatacatttagggtgaagaagtcccctaaacgcagtcctctgtctgatcctcctagccaggaccccacgcccgcagccaccccagagacccccccagtcatctcggccgtagttcatgcaacagatgaggagaagttagcggtgactaaccaaaagtggacctgtatgacagtggacttagaggcagataagcaagattacccccaaccatccgatctcagtacattcgtgaatgaaactaagttctcctccccaaccgaagaactagattacaggaatagctatgagatcgaatacatggagaaaatcggaagttctctgccacaggatgacgacgctccgaaaaaacaggcattgtatcttatgttcgatacctctcaagaatctcctgtgaaaagcagccccgtgcgaatgtctgagagtccaaccccctgctctggcagctctttcgaggagactgaggccctggtcaacacagccgcaaaaaatcaacaccccgtcccccgtggcttggccccaaatcaggagagccacttacaagttcctgagaagtcgtcccagaaagaactcgaggcaatgggcctggggactccatccgaggctatcgagattacagcgcctgagggctctttcgcctctgccgacgctcttctatccagactcgctcaccctgtgagcctctgcggggcactcgactatctggagcctgacttggctgaaaagaacccccctctgttcgcccaaaagctccaggaagagcttgaattcgctataatgcggatcgaagctttaaagttagcgcgacaaatagcactggcctcccggtcccaccaggacgcgaagagggaggccgcacacccaactgacgtgagcatcagcaaaactgctttgtactcacggatcggcacagctgaggtagagaaacccgcaggtctgctgtttcagcagccagatctggactccgccttgcaaatagcacgagctgaaattatcacaaaggagcgggaggtgtcagagtggaaggataagtatgaagaatctcgcagggaggtcatggaaatgagaaaaattgtggctgagtatgagaagaccatcgcccagatgattgaggacgaacagcgcgagaagagtgtgagccatcaaaccgttcagcagctggttctcgagaaagagcaggccctggccgacttgaactctgtggagaagagcctggccgacctttttcgccgatacgaaaaaatgaaagaggtcctcgagggctttagaaagaatgaagaggttctgaagagatgcgcccaggaatatctttctagggtaaaaaaagaagaacagcgataccaagcgctgaaagtacatgctgaggagaagctcgacagagccaacgccgaaatagctcaggtgcgcggtaaagcccagcaggaacaggccgctcatcaagcatcgctgcggaaagaacagctccgcgtagacgccttggagcgcacactggaacaaaaaaacaaggaaatcgaggagttgaccaagatctgcgacgagctgatcgcaaaaatgggaaagtcatag

SEQ ID NO: 244529 - DNA, 2991 bp, Artificial Sequence
  Description of Artificial Sequence: Synthetic coding sequence
atgggcggaagtcagagcctgcagccggcaccagcttctgacctgaatctggaggccagcgaggcgatgagtagcgactcagaggaggcattcgagacaccagagagcactaccccagtcaaggcacccccagcccctccacccccaccacccgaagtgatcccggagcccgaggtgagtacacaaccgccaccagaggagcccggatgcggctccgaaactgtccctgttccagacggtcccaggagtgacagtgtggaggggagccctttccgccctccgtcccattctttctccgccgtgttcgacgaggacaagcctatcgcaagctcgggaacctataacctggacttcgacaacatcgaattggtggacacgttccagacccttgagcccagagcatctgacgcaaagaaccaagaaggaaaggtgaacacccgcagaaagtcaaccgactcggtgccaatctcgaagagcactctgtcccgatctctgagtctccaagcctcagactttgacggggcttcctcttctggcaaccccgaggccgtcgctctcgcccctgacgcctactctactggctcaagctcagcctcgagtacccttaaacggaccaagaagccacgacctccgtcattgaagaaaaagcaaacaaccaagaaacccacggagactccccctgtgaaagagactcagcaggaacccgatgaggagtccctggtgccatccggagaaaacctagcaagcgagacgaaaactgaatccgcgaagactgagggcccttcccctgcattacttgaggaaacccctctagaacctgccgttgggccaaaagccgcttgtcctcttgacagcgagagcgcagaaggggtggtgcccccagcttcaggcggaggtcgagtgcagaattcgcctccagtgggaagaaagacgttacctctgaccactgcacctgaagctggcgaggtaacacctagcgactccggtggtcaggaggatagtccagcgaagggcctgtctgtccggctcgagttcgactatagcgaggataagtccagctgggataatcagcaggaaaatccaccacctacaaaaaaaattggcaaaaaacctgtggctaagatgcccctgcggagaccaaagatgaaaaaaactcctgagaagctagataacacacctgcatctccccctcgctctcctgccgaaccaaacgacattccaattgccaagggaacttacacctttgatatcgataagtgggatgacccaaactttaatcccttctcttcaacttcgaaaatgcaagagtccccaaagctcccgcagcagagctacaacttcgacccagacacctgtgacgagagcgtggacccatttaagacctcttcaaagacccccagcagtccttcaaagtcccctgccagcttcgaaatcccagcatctgcaatggaagccaatggcgtggatggcgatggcctcaataaacccgctaaaaagaagaagacacctctgaaaaccgacacatttcgcgtgaagaaatcccccaagcgcagccccttgtctgatccacccagtcaagacccaacacctgccgcaacgccggaaacaccaccagtgatcagcgccgtcgtccatgccaccgatgaggaaaaactggcagtgacgaatcagaaatggacctgcatgacagtcgatctcgaagcggataagcaggactacccacagccatccgacctgtcaacttttgtaaacgagactaaattttcttcgccaacagaggaactggactatcgcaattcatatgagatcgagtatatggaaaagataggctcatccttaccacaagatgacgatgcacctaagaagcaggccctttatttaatgtttgacacaagccaagaaagccccgtaaaatccagtccagttcgcatgtcagagagccccacaccgtgctccgggtcctccttcgaggagaccgaagccctggtaaataccgccgcaaagaaccagcatcctgtgcctcgcggactcgccccaaatcaagagagccatctgcaggtccccgaaaaatcctcacaaaaggagctcgaggcaatgggtttgggtactccgtccgaagctattgaaatcaccgctcctgaaggaagtttcgcttcagccgatgccctgttgagtaggctcgctcatcctgtcagcctatgcggggctctcgactatttagaaccagatctggcggagaagaatcctccactgttcgcccagaagctgcagcgggaagccgctcatccaacagacgtaagcatctccaagaccgcactgtacagcaggataggcactgccgaggtggaaaagcctgcaggactgctctttcaacagccagacctggattctgccctacagattgctagggccgaaatcattacaaaggaaagggaagtatcggagtggaaagataaatacgaagaatcgcggcgagaggttatggaaatgcgaaagattgttgcagagtacgagaaaacaatagctcaaatgatcgaagacgagcaaagggagaagtctgttagccatcagaccgtacagcaacttgtcctggaaaaggagcaggcgctcgccgatcttaatagtgtggaaaaaagcctggcagacttatttcgcagatatgaaaaaatgaaggaagtactcgaaggattccgcaagaatgaagaggtcctgaagaggtgtgcccaggaatatttatctcgggttaagaaagaggagcagagatatcaagctttgaaggttcacgccgaagaaaagcttgatagggctaacgcggagatagcccaggtgaggggtaaggcacagcaggagcaagccgcacaccaggcctctctacgaaaagagcagctgagagtcgatgcactcgagcgcacgctagaacagaagaataaggaaatagaggagctgacaaaaatctgcgacgagctgatagcaaagatgggtaaatcttag

SEQ ID NO: 244530 - DNA, 1716 bp, Artificial Sequence
  Description of Artificial Sequence: Synthetic coding sequence
atgcctctgagaaggcctaagatgaaaaaaacgccagaaaaattggataacacaccagccagccctcctaggtcacccgctgagcccaatgacatccctattgctaagggtacatatactttcgacatcgataaatgggacgaccctaactttaatcccttctcatcaacctcaaagatgcaggaatcccccaagctgccacagcaaagttacaattttgaccctgacacttgtgacgaaagcgtggatccgttcaagacgagctcaaaaactccctcgtccccgagcaaatctcctgcttcttttgaaatccctgccagtgccatggaggcaaacggcgttgacggcgatggtctcaacaagcctgctaaaaaaaagaaaactcccctgaagaccgtcaaaaaatcccctaagagatctcccctttcagatccgccatcacaggaccccacaccggcagcaacacccgaaactccacccgtgattagcgccgtcgtgcacgccacagacgaggagaaactcgctgtgaccaaccagaagtggacctgtatgaccgtggatctggaggccgacaagcaagattatccacagccttcagatctgagtacttttgtcaacgagactaagttctcctccccaacagaagaattagattacagaaactcttacgagatcgaatacatggaaaagatcgggagctctctaccccaagatgatgacgccccaaaaaagcaggcactgtatcttatgtttgacacctctcaggagtctcctgtgaaatccagtcctgtacggatgtccgagtcacccacaccctgtagcggcagttccttcgaggagactgaggctcttgtgaataccgcggctaaaaatcagcatcctgtgcctcggggattggcgcctaatcaagagagtcatctgcaggtgccggagaagagttcacaaaaagaactggaggcgatgggcctcgggacgcccagcgaagccatcgaaataagagaagcagcgcatccaacggacgtgtctataagtaagaccgccctctatagcagaataggcacagccgaggttgaaaaacccgcaggcctgctattccagcaacctgaccttgactctgctctccagatcgcccgagccgaaatcatcaccaaagagagggaggtaagcgagtggaaggacaaatacgaagagagtagacgggaagtgatggagatgagaaagattgtggcagaatatgagaagacaatcgctcaaatgattgaggatgagcagagagagaagtcggtatctcatcaaacagtccagcagttagttctcgaaaaggaacaggccttggctgatctgaactcggtagaaaagtcgcttgctgatctttttcgtaggtatgaaaagatgaaggaggtattggaaggattccgtaagaacgaggaagtgcttaagagatgtgcccaggaataccttagtcgggtaaaaaaggaagagcaaagatatcaggctctaaaggtgcacgctgaggagaagctggaccgggctaacgccgagatcgcccaagttcggggaaaagcacagcaagagcaggccgcacatcaggcctctcttcggaaagaacagctgcgagtcgacgcgctagagaggacacttgagcagaagaacaaagaaatcgaggagctgactaagatttgcgacgagctgatagcaaagatggggaaaagctag

SEQ ID NO: 244531 - DNA, 8846 bp, Artificial Sequence
  Description of Artificial Sequence: Synthetic coding sequence
atgggcaacgagaacagcaccagtgacaaccagcgtacgttgtccgcacagacccctcggtctgcacagccccctgggaactcccagaatattaagaggaagcagcaagacactccaggctctccagaccaccgggatgcatctagtattggtagcgttggactggggggattttgcaccgcctcagagtccagcgctagtttggatccttgcctagtgtctccagaagttaccgaaccaagaaaagaccctcaaggggcacggggaccagagggctccctgcttccatcccccccaccaagtcaggagcgcgaacaccccagcagcagcatgccttttgcagaatgccccccagaagggtgcctagcgagtcctgccgctgcccctgaggatggcccacagactcagtcccccagacgcgagcctgctcccaatgcccctggggacatcgccgctgccttcccagctgagcgggacagcagcactccatatcaggaaatcgccgcagtgccttcggcgggtcgggagcggcagcccaaagaggagggtcagaagtccagcttctctttcagctctggcatcgaccagagccccggtatgagtccagtgcccctgagggagcccatgaaggcccctctttgtggggaaggggaccagcccggtggattcgagagccaggagaaggaggccgctggcggtttccctcctgccgagtcccgccagggggtcgcctccgtgcaggtgacgcctgaagcaccagccgcagctcagcagggcactgagtcttcggccgtcctcgagaagtctccccttaagcccatggcccctataccacaggatcccgcacccagagccagcgatagggagcgaggtcagggcgaggcccctcctcaatacctaacagatgatctagaattcctgcgtgcctgccacctccctcggtcgaatagtggcgcagcaccagaggctgaggtgaacgcggctagtcaggaatcatgtcagcaaccagtgggggcttatctgcctcacgccgagcttccatgggggctcccaagccctgccctggtgccagaagcgggaggatcaggtaaggaagccctggacacgatcgacgtgcaggggcatccccagacgggaatgagaggcactaagccaaatcaggtggtgtgcgtcgcagctggcggacaacctgaggggggattacccgtcagcccggagcccagcctgctgacaccaaccgaagaagcccacccagctagctcgttagcgagtttccccgcagcacagatccctatagctgttgaagagcccggttcatcctccagagagagcgtgtcgaaggccggtatgccggtctccgccgacgccgcaaaggaggtcgtggatgccggattagttggattggagaggcaggtaagcgatctcggctctaagggagagcatccagagggggatcccggagaagtgcccgctccctcccctcaagaaaggggcgagcatcttaacacagaacaatcgcatgaggttcagccaggggtgccacccccaccactgccaaaagagcagagccacgaggttcagcccggtgctccgccacctccactgccgaaagcgccttctgagagcgccagaggaccccctgggcctacagacggggcaaaggtccacgaagattctacatcgcctgcagtggccaaagaaggaagtagatctcccggagacagccctggcggaaaggaagaggcccctgaacccccagatggaggagacccaggtaacttgcagggagaggattcccaagccttttcctctaagagagatcctgaggtgggcaaggacgaactctctaagccatcctctgatgccgagtccagagaccacccctcctcacattccgcccagcctcccaggaaagggggagccggacatacggacgggcctcacagtcagacagcagaggccgatgcctccggactgccacacaagctgggcgaggaggatccagttctgcctccagtccctgatggcgctggagaacccactgtgcctgaaggcgcaatctgggaaggatcggggctccaacctaaatgcccagatacgctgcagtcaagagaagggttaggtagaatggagtcatttctcacactggagtccgagaagtcagattttccccctacacctgtcgcagaggtcgcccctaaggctcaagagggggagagcactttggagatccgtaaaatgggaagctgcgatggagagggattgctcacgagccccgaccagcccaggggtcccgcatgcgacgcaagcagacaagaattccatgccggtgtgccgcaccccccacagggcgaaaacctggctgccgatctgggtttaaccgcccttatactagatcaagatcagcaggggatcccgtcttgccctggggaaggctggatccggggtgcggcaagtgagtggccgctgctctcttctgaaaaacacctgcagccttctcaggcccaacctgaaacctcgatcttcgatgttttgaaggaacaggcccagcctccagaaaatggcaaagaaacttctcccagccaccctggtttcaaggatcagggagctgacagctcacagattcacgttcccgtggaaccgcaggaggacaacaatctgcctacacatggcggacaggagcaggccctgggaagtgagctgcagagccagctccctaagggaacactgtccgacacccccacgagctcacctactgacatggtgtgggaatctagtcttaccgaggagtcagagctgagcgcccctactaggcagaaactacctgctttgggcgagaagaggcccgaaggagcttgcggtgatggacaatcctcacgcgtgtccccgccagcggctgacgtgttgaaagacttttcccttgccggtaatttttcgaggaaagagacatgctgtaccggacagggacctaacaaatcccagcaggccttggcagacgcccttgaagaaggttcccagcacgaagaggcgtgccagcgccatccaggcgcatcggaggcggctgatggctgctctcccctttggggtctctccaaacgcgagatggcatcagggaacactggtgaggcccctccttgtcagcccgattcagtggctctcctggacgcagtaccttgcctccccgctctagctcccgctagtcccggagtgaccccaacacaggatgcccctgaaactgaagcttgcgacgaaacccaggagggccgacagcagcctgttcccgctccacagcaaaagatggaatgctgggcaacatccgacgctgagagcccaaagctgttggcatcctttccaagtgctggagagcaggggggagaagccggagccgcagaaaccggcggatcagccggtgccggagaccccggtaaacaacaggctccggagaagccaggggaagcaaccctgtcatgcggactcctgcagactgagcactgccttacgagtggcgaggaggcttccacctccgctctccgggaaagctgtcaggccgaacatcctatggctagctgccaggatgccctgctccctgcaagggaactgggaggaataccacggtcaacaatggacttcagcacccatcaagccgttcccgaccctaaggagcttctcctgtcagggcctcccgaagtggctgcgccagatacaccgtatctccacgtggacagcgcggctcagagaggcgcagaggactcaggcgtgaaagcagtgagctcagctgatcccagggcccctggcgaatcgccctgtccggtcggtgagccaccgctcgccttggagaacgccgcttctcttaagctgttcgctggatcactcgctccactactgcaaccaggcgcagcagggggtgagattcctgcagtgcaagccagttccggctcgcccaaagcccgtaccaccgaggggccagtggactcgatgccttgtcttgaccgtatgccccttctggccaagggcaaacaagccaccggagaggagaaagccgcaacggcgccaggcgctggcgcaaaggcgagtggcgaaggaatggctggagatgctgcgggagaaaccgagggcagcatggaacgtatgggagagccatcccaggaccccaagcagggcacctcgggcggtgtggacacgtcctcggagcagatagcaaccctcacaggattcccagattttcgggagcacatcgctaagattttcgagaagcctgtcctgggggctcttgccacgccaggcgaaaaggccggagcaggcaggagcgcagtgggtaaggaccttacccgcccattgggacccgaaaaattactggatggcccacctggcgtggatgttactctgttacccgcaccaccagctcgactgcaagttgagaaaaagcagcagcttgcaggggaggccgagatcagccaccttgctctgcaggacccggcaagcgacaaactgcttgggccagctggacttacctgggaacggaatttgcctggagctggtgtcggcaaagagatggccggtgtgccacccacccttagggaggacgaacgtcctgaaggcccaggcgcagcttggccaggcctcgagggtcaggcctacagccagctggaacggagcaggcaggagctcgccagcggactccctagtcctgctgcgacccaggaactccccgtggagcgtgccgctgcattccaggtcgcgccacacagccatggggaggaggccgtggcccaggatagaataccttctgggaagcagcaccaggagacgtcagcgtgcgactctccacacggggaggatgggccaggtgactttgcccataccggtgttcctggtcatgtcccacgatccacgtgtgctccaagtccacagcgggaggtgctgacagtgcccgaggctaactccgaaccctggactctggatactctggggggagaacgaaggccaggcgttacggccggtatactcgagatgagaaatgccctgggcaaccaaagtacacccgcacctccaaccggtgaggtggccgacaccccattagagccaggcaaagtggcaggggcagctggcgaggctgaaggagacattaccctttctactgccgaaacacaggcttgcgcaagcggcgacctcccagaggctgggaccacccgtacattctcagtcgttgctggcgatctggtgttgcctggatcttgccaggaccctgcctgttctgacaaggccccaggaatggagggaacagctgctctgcacggcgattcccctgctaggccacaacaggctaaagagcagcccggtccggagaggcccatcccagccggtgacggtaaggtgtgcgtttcctctcctccagagcctgatgaaacgcacgatcccaagttgcagcacctagcccctgaagagcttcacacggaccgtgaatcccccaggccaggacccagcatgctgccaagcgtgccaaagaaagatgcccctagagttatggacaaggtgaccagtgatgagacgcgcggtgcagaggggaccgagtcatctcccgtcgccgacgatatcatacaaccggctgcaccggcagatctggaatcccctaccctggcggcaagcagctatcatggagacgtggtcggacaagtatctacagacctcattgcacagtccatttctccagccgcagcccacgcaggcctgcccccttctgcagcagagcatattgtgagcccaagcgcaccagcaggggaccgagtggaggcaagcacccccagctgccctgatcccgctaaagatttgtcaagatcctccgacagcgaggaggcattcgagacacctgaatccacaacgccagtcaaggcccctccagccccaccccctcctcctcccgaagtgattcccgaaccagaggtctcgacccagcccccaccagaagagccaggatgcggatcggaaacagtgccggtgcctgacggcccaaggagcgactctgtggaaggctcccccttccggccaccttcacattcattttccgctgtgtttgacgaagacaagcctatcgcttcgtccggaacctacaacttagatttcgacaatatcgagcttgtggataccttccagacactggagcccagagcttctgatgcaaagaaccaagaaggtaaggttaacacaaggagaaagtctaccgattcggtgccaattagcaagtctacactgagccgctcactcagtttgcaagctagcgatttcgatggcgcttcttcttcgggcaatccggaagcagtggccctcgctcccgatgcctactcaacgggttctagcagcgcttcgtcaactctgaaaaggaccaaaaaacccaggccaccctctctgaagaaaaaacagaccaccaagaagccaactgagacaccacccgtgaaagagacacaacaagaaccggacgaggaatctctcgttccgagcggagaaaatctcgctagtgagaccaagacagagtccgctaaaactgaaggcccttctccagctctgctggaggagacaccgctcgagcccgctgtcgggcctaaggccgcatgcccgctggacagtgaatccgctgaaggggtggtgccaccggcatcgggagggggtcgcgtgcaaaactcccccccagttggcaggaaaacacttccgttgacaacagcgcctgaggctggcgaggttactcctagtgacagcggtgggcaggaggacagtcccgcaaaaggtttgtcagttcggctcgagtttgattattctgaagacaaatcctcctgggacaaccagcaggagaaccccccaccaacaaagaaaatcggcaaaaagcctgtcgcaaaaatgcctctccgacgacctaagatgaagaagacccctgagaagctcgacaacacaccagcctcccccccacgctctcctgctgagcccaatgatattcctattgcaaaaggaacctatacattcgatattgacaaatgggatgacccaaacttcaatcctttttcatccaccagtaaaatgcaagaaagtcctaaactgcctcagcagagctataatttcgaccctgatacatgcgatgagagtgttgatccatttaagactagtagcaaaacgccatcatcaccttcaaagagtcccgcaagcttcgaaattcctgcaagcgcaatggaggccaacggcgtggacggagatgggctgaacaagcctgcaaaaaaaaagaaaactcctctgaagacagatacctttcgggtgaaaaagtctcccaagagaagtcctttgagcgatcctccctctcaggatccgacgccagccgcaacccccgagacacctcccgtaatctcggccgttgtgcatgcgacagacgaggagaagctggccgtgacgaaccagaagtggacttgtatgaccgtggatcttgaagcagacaaacaggactatccccaaccgagcgacctgtccacatttgttaatgaaacaaagttttccagtccaacagaggaactagattaccgcaactcatacgagattgaatatatggaaaaaattggttcctcccttccacaggatgacgatgccccaaagaaacaggccctttacttgatgttcgacacctctcaagagtcgcccgtcaaaagctcacctgtgcgtatgagcgagagcccaaccccctgtagtggtagttcattcgaagagacagaagctctcgtgaatacggcggctaaaaatcagcaccctgtacccagagggctagccccaaaccaggaatctcacttacaggtgccggagaagtcgtcgcagaaagagctggaggcgatggggctaggaacccccagtgaagctatagaaataactgcccctgaaggatcatttgctagtgccgacgcgctgttgtcacgcttagcccaccctgtctccctctgtggcgctctggactacctagaaccagacttagctgagaaaaaccctccgctgtttgcacagaagctccaggaggaactcgagttcgcgatcatgaggatcgaagccctgaagctggccaggcaaattgcactcgcctctcgctcacatcaagacgccaagcgggaagcagcgcacccaaccgacgttagcatctcgaagaccgctctctatagtagaatcggcaccgccgaggtggagaaaccggctggcctgctcttccagcagccggatctggattctgccttgcagattgcaagagcagagataatcactaaagagagggaagtgagtgagtggaaagacaaatacgaggagagccggagggaggtcatggagatgagaaagatagtcgccgaatatgagaaaacaattgcccagatgattgaggatgagcaaagagagaagtccgtgtctcaccagaccgtgcagcagttagtgctggagaaggaacaagcgctggcagacctaaactcagtagagaaatccctggccgatctgttccggcgttacgagaagatgaaagaagttttagaaggcttcaggaagaacgaggaggtgttgaagaggtgtgctcaagagtatctgtcccgcgtaaaaaaagaagagcagaggtatcaggcactgaaggtgcatgccgaggagaagctggatagggccaacgccgagatcgcacaggtcagaggcaaagcccagcaggagcaggctgcccaccaggccagtctgagaaaagagcagctgcgagtcgacgcgctggagagaacactggagcaaaaaaataaagaaatcgaggagctgacaaagatatgtgacgagcttatcgctaagatggggaaatctta

SEQ ID NO: 244532 - DNA, 8627 bp, Artificial Sequence
  Description of Artificial Sequence: Synthetic coding sequence
atggggaacgagaactcgacgtcagataatcaaagaaccctcagcgcacagactcctcgctcagcccagccgccagggaattcccagaacatcaagcgtaaacaacaagacaccccaggtagtccggaccaccgagacgcctccagtattggatcagtggggctgggagggttctgcacggcgagtgaatcctcagcatcgttagacccctgtttagtgtcccccgaggtgacagagcctcgcaaggaccctcaaggcgctcgcggacctgagggatctctgctgccttcccctccgccatcccaagaacgcgaacacccttcctcttcaatgccatttgctgagtgcccacccgagggatgcttggcctctcctgcagccgctccagaagatggcccacagacccagtcacccaggcgcgagcccgcaccgaatgcacccggagatatagcagccgcatttcctgctgaacgcgattcatccactccataccaggaaattgcagccgtgccatcagccggacgcgagcgccagcctaaggaggagggacagaaatcaagctttagttttagttcaggtatagatcagagccctggaatgagccccgtgcctttgcgcgaacccatgaaggccccactgtgtggggagggagaccagcccggagggttcgagagtcaggagaaggaggctgccggagggttcccacctgctgagtcaaggcagggcgtggcttccgtgcaggtgactcccgaggcccctgcagccgcacagcagggaaccgagtccagtgctgtcctggaaaagagtcctctgaagcctatggcacctattcctcaggacccagcaccaagggcctcagatagggaaagaggacagggcgaggcaccacctcaatacctgaccgatgatcttgagtttctccgggcttgtcacctgccaaggagcaatagcggggcagctcctgaggcagaagtgaacgccgcatcgcaggagtcctgccagcaaccggtgggtgcctatctgccccatgccgagctcccttgggggctcccatcaccggctctggtaccggaggctggtggcagtggtaaagaagctttagacactattgatgtgcagggacacccgcagaccggtatgcgcggaactaaaccaaaccaggttgtctgcgtggccgcagggggacagcctgaagggggattgcccgtctcaccagaacctagcctactgacgcctacagaagaggctcatccagcgagctcactggcctcattccccgcagcccagatcccaattgccgtagaggaacccggatcaagttcacgtgaatccgtcagcaaagctgggatgcccgtgtccgccgatgcagccaaagaggtcgtggatgcaggactcgtaggccttgaacggcaggtaagtgacctgggaagtaaaggagaacatcctgaaggagatcccggagaagtcccagccccttctccccaagaacgaggggaacacctgaacacagagcagagccacgaggtgcaacccggtgtgccaccgccaccactgcccaaggaacaatcgcacgaagtccagccgggtgctcccccaccacctttaccaaaggcaccttcagagagtgcccgtgggccacctggccctactgacggggctaaggttcatgaggacagcacaagccccgctgtagccaaggaggggtcgcgtagtcctggcgactctcctggcggtaaagaggaagcgcctgaacccccagacggcggagatcctgggaatctacagggcgaggactcacaagccttttcatcgaagagggaccccgaggtaggtaaggatgagctttcaaaaccatcctccgatgccgagtccagagatcacccttctagccactcagcccagcccccacgtaaaggcggagctggacacacggacggtccccacagccaaacagcggaggcggacgctagtggcttacctcataaactgggggaggaggaccccgtgttaccaccggtgcccgacggagctggagagcctaccgtgcctgagggcgcaatctgggaggggagtgggctgcaaccgaagtgcccggatactctccagagccgcgaaggcctgggtaggatggaatctttcttaacactcgagagtgagaaaagcgatttcccgccaacccccgtggccgaggtcgcccctaaggcccaggagggggagtccaccctggaaatccgcaagatgggcagttgcgacggagagggattactgacctccccagaccaaccacgcggtcctgcctgcgacgcctctagacaggaattccacgctggagttccccacccaccccagggcgaaaacctcgccgctgatttaggcctgactgcccttatcctggaccaggaccagcaggggattccatcctgccccggagaagggtggattagaggcgcagcatctgaatggcccctactcagttccgaaaagcacttacagccatcccaagcacagcccgagacttccatctttgatgtgttgaaagagcaagctcagccccctgagaacgggaaggaaacaagcccctctcatcccggtttcaaagaccaaggagcagattcttcgcaaattcacgtccccgtggaaccacaagaggacaacaaccttcccacacatggaggccaggagcaagcgctaggatccgagctgcagagccagctgccaaagggaactttgtctgatactccaacatcaagccctacagacatggtctgggagagcagccttactgaggagtccgagctctctgcccctacacggcaaaaactgccagccctgggggagaaaaggccggagggagcctgcggagatggacagtcttctagagtgagccccccagctgccgacgtgttgaaagatttctctctggcaggtaatttttctaggaaagaaacatgctgtactggtcagggccctaacaagagtcagcaggctctggctgacgccttggaggaagggagccagcacgaggaggcctgtcagaggcaccctggggcatctgaggctgccgacggctgttctcctctgtgggggctgtccaaacgcgagatggcttccgggaacaccggagaggccccaccctgccagcctgatagcgtagccctgttagacgcagtcccctgcctgcccgcactggccccagcttcccctggcgtgacacctacccaagacgccccagagaccgaagcatgcgatgaaacccaggaggggcgacaacagcccgtgcccgcacctcagcagaaaatggaatgctgggcaacatctgacgcagagagcccgaaacttctggccagcttcccaagtgccggtgagcaaggcggagaggcgggtgctgcagagactgggggaagcgccggtgccggagatccagggaaacaacaggcgcctgaaaaacctggcgaagctacgctgtcctgtgggctcctgcaaacagagcattgcttaactagtggggaggaggcatcaactagcgccctgcgggagagctgccaggccgaacatccaatggcgtcctgtcaggacgcactactccctgccagggaactcggcggtatacccagatccacaatggatttttccactcaccaagcagtgcccgaccccaaggagctacttctgtcggggccaccagaggttgcagcccctgacacaccatatctacacgttgatagcgcagcgcagaggggcgctgaggactctggcgttaaagccgttagctctgctgatccgagagcaccaggtgagtctccatgccccgtgggggaacctccgctcgccctggaaaatgcagctagcctcaagctgttcgcaggcagcctagcccctttgctccagcctggtgctgcagggggagagatccccgcagtgcaggcatcttctggcagccctaaggctcgcaccaccgaagggccagtggacagcatgccctgcttagaccgcatgcctcttctcgctaaggggaagcaagccaccggagaagaaaaggctgcaacggctccaggggcaggcgcaaaggccagcggggaggggatggcgggagatgctgcaggggagaccgaaggatctatggaaaggatgggcgagccctcacaggaccctaagcagggtacctctggcggagtggatacctcaagcgaacagattgcgaccctcaccggtttccctgactttcgcgagcacattgccaaaatcttcgaaaaaccagtgctgggcgcacttgctacacccggtgaaaaagcaggcgcaggaaggtcggccgtgggcaaggatctgacgagacccctgggcccagagaagcttctggatggccctccaggtgtggacgtgacccttctcccagcgccacccgcacgcctacaagtcgagaaaaagcaacaattagccggagaagccgaaatcagtcacctggccctccaggatcctgcgagtgacaaactcctgggcccagctggcctcacatgggagcgcaatctgcccggagctggcgtgggcaaggaaatggctggcgtgcctcctacactccgagaagacgaaagaccggagggtcccggtgcagcctggcccggactggagggacaagcctatagccagctggaacggagcagacaggagctcgccagcgggctgcctagtccagcggctactcaagagttgcctgtcgagagggcagccgctttccaggtggctccgcactctcacggagaggaagcagtcgcgcaagatcgtatcccttctggcaagcagcaccaagaaacttccgcctgtgattctcctcacggcgaggacggtccaggcgactttgcccatacaggagtgccagggcatgttcctaggtcaacctgtgccccttccccccagcgcgaggttctcaccgtccccgaggcaaatagtgagccctggacgctggacaccctgggtggtgaacggcgaccgggtgtcacagctggcatcctggagatgaggaacgctctgggaaatcagtccaccccagccccacctaccggagaggtcgcggacactcccttagaacccggaaaagtcgccggagctgccggagaggccgagggggatataaccctgtctaccgctgaaacacaagcttgtgcttccggcgacttgcccgaggcgggtaccactcgcacattttctgtggtggcgggagatttggtgctccccggatcatgccaagatcccgcttgctctgataaagcccctgggatggaggggacagcagcacttcacggggacagtcctgcaagaccccagcaggccaaggagcagcctgggccagaacgcccaataccggcaggggatgggaaggtctgtgtgagttcacctcctgagcccgacgagacccatgacccgaagctgcagcacctcgcaccagaagaacttcacaccgaccgagaaagcccacgccctgggccttcaatgctgccaagcgtgcctaagaaagatgccccaagagtcatggataaagtgacaagcgacgagaccagaggagctgaagggacagagcgctcagcgaaagatataggcctgtggaaagcaatgatgcccagcctggatacagataccctcgatgtactcgagagaagggtggttctcatccagcacgagttcctgcacaaaaaagaagccaacgggcactctagattcatgtactcaagtcctgtggccgatgacataattcagcccgctgctccagccgatctggaaagcccaaccctcgcagccagtagctaccatggtgatgtggtcggtcaggtgtccactgaccttatcgctcaaagaagttcggattccgaggaggctttcgagactccagagtccaccactcctgtcaaggcccctcccgcacctccccctccacccccagaggtgattcccgaaccggaggtgagcactcagccccctcctgaggagcctggctgtggaagcgaaacggttcccgtccctgacggtcctagatccgactctgttgagggctccccatttcggccaccaagtcactctttttcggcagtttttgacgaggacaaacctatagccagcagtggtacatacaacttggattttgataatattgaacttgtggatacattccagacccttgagccccgtgcaagtgatgctaaaaaccaggagggcaaggttaatacaaggagaaaaagtactgattccgttcccattagtaaaagcacgctgagccgatctctctccctccaggcctcagactttgacggggcaagcagctccggcaaccctgaagcagtcgcactggcccctgatgcatactcgactgggagctcgagcgccagttctactctgaagcgcaccaaaaaacctcggcctccgtcattgaagaagaaacagacgactaagaagccaacagagacgcctcccgttaaggagacccagcaggagccagatgaagagagcctcgtaccttccggcgagaacctggcctcagagacaaagaccgagagtgctaaaaccgagggaccatcccccgcactgttagaagagacaccgcttgagcccgctgtgggcccaaaagccgcatgcccactcgattcagaatccgctgaaggagtggtacctccagctagcggcggaggccgtgttcaaaatagtccacccgtgggccgtaaaactctacccctaactaccgctcccgaggcgggagaagtgaccccttctgattcaggcggtcaggaggacagccccgcaaaggggttgtctgtacggctcgagtttgactacagtgaggacaaaagctcctgggataaccagcaggaaaacccgccaccaaccaagaagatcggcaagaagcccgtggccaaaatgcccttgcggcgacctaaaatgaagaaaactcccgagaagctagacaataccccagccagccctccccgttcacctgctgagcccaatgatattcctattgccaaaggcacttacacgttcgacatcgataaatgggacgaccccaattttaatcctttttcctcaacctccaaaatgcaagaaagtcctaagttgccacaacagagctacaacttcgatcccgacacatgcgatgagagtgtggacccatttaaaacaagctcgaagacgccctcttccccttcgaagtcacctgcttcctttgagatcccagcgtcggccatggaggcaaatggagtggatggggatgggctgaacaaaccagcaaaaaagaagaaaacccctttgaagacagatacatttcgtgttaaaaagtcccccaaaagatctcccctgagcgacccgcctagccaggaccccacacctgcagccactccagaaaccccccctgtgatctcagctgtggtccacgctaccgatgaagagaaactggccgtgaccaaccagaagtggacctgcatgaccgtcgatctagaagcagataaacaggactatccgcagccaagcgacctttcaactttcgtgaacgagaccaaattctctagccccacagaagagctcgattaccgcaactcatacgagatcgaatatatggagaagatcggttctagcttaccacaggacgatgatgcacctaagaagcaggccttgtaccttatgttcgacacatcacaagaaagtcccgtgaagagtagcccggtgcggatgtctgagtcccccaccccctgttccggtagctcattcgaggaaaccgaggccttagtgaacaccgctgctaaaaaccagcatcctgtgccaaggggactggccccaaaccaggagtcgcatctgcaagtgcccgagaagagcagccaaaaagagctcgaggccatgggacttgggacaccctctgaggcaatcgagattcgcgaagccgctcatccaaccgacgtatcaatttctaaaaccgccctgtacagccgaatcggcacggcagaggtagaaaagcccgctggcctacttttccagcaacctgacctagacagcgcccttcagatagcaagagcagagatcattactaaggaaagggaggtgtcagagtggaaggacaagtatgaagagtctcggagagaagtaatggaaatgcggaaaatagttgcagaatatgaaaaaaccatcgcacaaatgatcgaagatgagcagcgggaaaagtcggtaagtcatcaaacagtgcaacagctggtgctggaaaaggagcaggctctcgccgacctcaattccgtcgagaaaagccttgcagatctattccggagatatgagaaaatgaaggaagttttagagggctttcgcaaaaatgaggaggtgctgaaaaggtgtgcgcaggagtacctgtctcgggtgaaaaaggaagaacaaaggtaccaggccttgaaggtgcacgccgaagaaaagcttgatcgcgctaatgcagaaatagcccaggttcgagggaaggcgcagcaggaacaggccgctcatcaggcatccctacggaaggaacagctgagagtggacgcccttgagcgtacattagaacagaagaataaagagatcgaggagctcaccaagatttgcgatgagctcattgctaagatgggtaagtccta

SEQ ID NO: 244533 - DNA, 3285 bp, Artificial Sequence
  Description of Artificial Sequence: Synthetic coding sequence
atgggaaacgaaaattccactagtgacaaccagcgtaccctctccgcacagacccctaggtcagcacaaccccctggaaacagtcagaacattaagcgcaaacaacaagatacccccggatcacctgatcatcgggacgcatcttcctcacctgtggctgatgatatcatccagcctgccgctccagcagatctggaaagccccacactggcagccagtagctaccacggggatgtcgtaggccaggtctccacggacctgatagcccaaaggagctccgacagcgaggaggccttcgaaactcctgagtcgaccacccccgttaaagctcctcccgctcctcctcctccccctcctgaggtcattccagagccagaggtgtctacgcagcctccaccagaggagccagggtgcggcagtgagactgtccccgttcccgacggccctaggtcagatagcgttgaagggagcccttttaggcccccttcccacagtttttcggccgtgttcgacgaggataagccaatcgcttctagtggaacctacaatctggatttcgataatatcgagctggtggataccttccagaccctggaacctagggcttccgatgccaagaatcaagaagggaaagtgaacacacgtagaaagagtacagatagtgttccaataagcaaatccacgctgagcagatctctaagcctccaggcgtccgacttcgacggcgcatcaagttccgggaatcccgaagccgtcgccctggcgcctgatgcctacagtactggtagcagctctgcatcaagtacactgaaacggaccaagaaacccagaccaccctccctgaagaagaaacagacgacaaaaaaaccaactgagacaccaccggtcaaagaaactcagcaggaaccagacgaggaaagtctggtgccctccggcgagaacctagcgagcgaaaccaagaccgaaagcgcaaaaaccgagggacctagtcctgctctgctggaggaaacgccccttgaacctgctgtggggcctaaggcagcctgtcccctggatagtgaatcagctgaaggcgtcgtgccccctgcctctggaggtgggagagttcagaactcacccccagtggggcgtaagaccctgcctctgaccaccgcaccagaggccggtgaggtaactcctagtgacagcggtgggcaggaagactccccagccaaaggattgtccgttcggctggagtttgactattccgaagacaaaagctcatgggataaccagcaggaaaacccgcctcccaccaaaaagatcggcaagaaacctgtggccaagatgcccctgagacgacctaaaatgaagaagacccccgagaaactagataacacgcctgcctcccccccaagatcacctgctgagccaaatgatatcccaattgccaagggaacgtacaccttcgatatcgacaaatgggacgacccaaatttcaatcctttttccagcacgagcaagatgcaagagagcccaaaactgccacaacagtcctataacttcgaccctgacacttgcgacgagagtgtggatccctttaaaacctcctcaaagacccccagctctccctccaagtctcccgcttcatttgagatacctgctagtgccatggaggccaatggagttgacggagatgggctcaacaagccagctaagaagaaaaagacacccttaaagacagacacatttcgggtgaaaaaaagtcctaaaagaagccccctgtcagatcccccttcccaggacccaacgccagcagcgacaccagagaccccacccgtgatctccgctgtcgtgcacgccacagacgaggagaagctggcggtgacaaaccagaagtggacttgcatgacagtggacctggaagcagataagcaggactatcctcaaccgtccgacctcagcacatttgttaacgagacaaagttttcctctcctaccgaagagctggactatcgcaatagctacgagattgaatatatggagaaaatcgggtcttcactccctcaggatgacgatgcccctaagaaacaggcgttataccttatgttcgatacatctcaggagagcccagtcaagtccagtccagtgcggatgtctgaatcgccaactccctgcagtggctccagtttcgaagagacggaggcgttggtgaatactgccgcaaaaaatcaacacccggttccaaggggcctggcccctaaccaggaaagccacctacaggttccagagaagagctcccagaaggagctcgaggctatggggctgggtactccttctgaagccattgaaattacggccccagagggaagtttcgcttcagccgatgccctactgtcacgtctggctcatccggtcagtctctgcggcgctctggactacttggagccggatctcgcggagaagaatccaccattgtttgcccagaagctccaggaagagctcgaatttgccattatgcgaatcgaagcactcaaacttgctagacagattgccctggccagccgttctcatcaggacgccaaacgggaggccgcacaccccacagatgtgagtatcagtaagacagctctctacagcagaataggcaccgctgaagttgagaagccagcgggtctcctgttccagcagcctgacctggactcagctctccagattgctagagccgagatcataacaaaagagagggaagtgagcgaatggaaagacaaatatgaggaatcaaggcgtgaagtgatggaaatgcggaaaatcgtcgcagagtatgagaaaaccatcgcccagatgatcgaggacgagcagcgcgaaaagtcagtctcgcatcagactgtccagcagctggtcctggagaaagagcaagctctggctgatctgaactctgtggaaaagagcctagcggacttgtttagaagatacgaaaagatgaaggaggttttggaaggtttccgcaaaaacgaagaagtgctcaagagatgtgcccaagaatacctgtcacgggtgaagaaggaggagcagcgctatcaggccttaaaagtccatgccgaggagaagctagatagggcaaacgctgagatcgcccaggtccgtgggaaagctcagcaggaacaagctgcccatcaggcatccctgcggaaagaacaactgagggtcgacgctctagagcggacactggaacagaagaataaggagatcgaggaactgacgaagatctgcgacgagctgatcgccaagatgggtaaaagctag

SEQ ID NO: 244534 - DNA, 2517 bp, Artificial Sequence
  Description of Artificial Sequence: Synthetic coding sequence
atgagtttacaggttctcaatgacaaaaacgtctcaaatgaaaaaaacactgagaattgcgatttcctcttctctcctcctgaggtgacaggacgctcaagcgtgctgagggtaagccaaaaggaaaacgttcctccaaagaatcttgctaaagcaatgaaagtcactttccaaaccccattacgtgatcctcagacacatcgtattctgtcaccgtcgatggcctctaagctggaggcaccattcacccaggatgatacactggggctggaaaactcacaccccgtttggactcaaaaggaaaatcaacagctgatcaaagaagtggacgcgaagacgacccacggtatcctgcagaagcccgtggaggctgacacagacctgttgggcgatgccagtcccgcatttggcagtggctcatcttcagaatctggaccaggcgctctggccgacctcgactgctcatcctcgtcccaatcccccggtagttctgagaatcagatggttagccccggtaaggtgtccgggtcacctgagcaagccgtggaagaaaatctgtcctcctacagtctcgaccggcgtgtgacgccagctagtgaaacactggaggatccttgtcgcaccgaatctcagcacaaggctgagacaccgcacggagccgaggaagagtgtaaagccgagactccccacggcgcagaggaagagtgtcgccacgggggtgtgtgcgctcccgctgctgtggccacttctccacccggagctatcccaaaggaggcatgcgggggagcacccctgcaggggctcccgggagaggccttaggttgccccgctggcgtgggcacccctgtcccagccgatggcacccaaacactaacctgcgcccatacttcagcgccagaatcaaccgcgccaactaaccacttggtggctggtcgagctatgactcttagcccccaggaagaagtcgccgctggtcagatggcctcttcatctagaagcggtccagtgaagttggagtttgacgtgagtgacggcgctaccagcaagagagctccgcctccgaggagactgggagagcgcagcggcctcaagcctccactgaggaaagccgcagtgaggcaacagaaggctcctcaggaagtggaggaggacgacggacgatctggcgctggcgaggatcctccaatgccggcatcacgcggttcctatcatctggactgggacaagatggatgacccgaatttcataccattcggcggtgatactaaaagcggttgctctgaagctcagccacctgagtcccctgagacaaggttaggacaaccggctgcggagcagttgcatgctggtccggcaacagaagaacctggcccatgcctttctcagcagctgcattccgccagcgcagaggataccccggtcgtgcaattggccgctgaaactcccaccgccgagagcaaggaacgcgctctcaactccgcaagtacaagcctaccaacatcatgcccgggtagtgaacccgtgcctacacatcagcaggggcagcctgcgctagaattgaaagaagagtcttttcgggatcctgcggaagtcctgggcactggagcagaagtggattacctcgaacaattcggcactagttcattcaaggagagcgccctgcggaagcaatccctgtacctgaaatttgatccgttgctgcgagactcccctgggcgacccgtgcccgttgctacagaaacctcctccatgcatggtgctaacgagacgccttcaggacgcccacgggaagccaagctcgtggagtttgattttctgggagccctggatattcctgtgccgggtcccccaccaggggtgcccgctcctggaggaccgccattatctactggtccaatagtggaccttctccagtattcccagaaagaccttgatgcagtcgttaaggctacacaagaagagaaccgggaactcaggtcgaggtgcgaggagttacatggaaagaacctggagttgggaaaaattatggatcggtttgaggaggtagtataccaggctatggaagaggtacagaagcagaaagagcttagcaaggccgagatccagaaagtgctgaaggagaaggaccaactcacgacagacttaaattcaatggaaaaatcgtttagtgatctgtttaaaagattcgagaagcagaaggaggtcatcgaaggctatcgaaaaaatgaagaaagtcttaaaaagtgcgtggaggattacctggccaggatcactcaggagggccaacggtaccaagcgctcaaggctcatgccgaggagaagctacagctggccaacgaggagattgcacaagtcaggagtaaagctcaggcagaggctttggcccttcaagcctcacttaggaaagagcagatgcgcattcagagcttggaaaagactgtggagcagaagactaaggaaaatgaagagcttacccggatttgcgacgacctgattagcaaaatggagaagatctag

SEQ ID NO: 244535 - DNA, 438 bp, Artificial Sequence
  Description of Artificial Sequence: Synthetic coding sequence
atgtctcttcaagtgctgaatgataagaacgtgagcaatgaaaaaaacaccgaaaactgcgacttcctgttctcccctcccgaggtgactggcaggtccagcgtgctgcgcgtgtctcagaaagaaaacgtgccccctaagaacctggcaaaggccatgaaagtgacctttcagacaccattgcgcgatccacagacccatcggatactgagtccatcaatggcaagcaagctggaggctccattcacgcaggatgatacccttggccttgagaattcccatcctgtttggacacagaaagaaaaagctgcagcttttagtctgagcgggggacatgcttgcggtgcagtgggcagcagggaccccaattctcgagaacagggggagtcgctggagctgtgccagcacctcgcttctcacaagctcagcaggcaatag

SEQ ID NO: 244536 - DNA, 666 bp, Artificial Sequence
  Description of Artificial Sequence: Synthetic coding sequence
atgagcttgcaggtgctcaacgacaaaaatgtctctaatgaaaaaaacaccgaaaactgcgatttcttgttctcgcctccggaggtaaccggcagatcttcagtactgcgcgtcagccaaaaagagaatgtgccacccaaaaatctggccaaagccatgaaagtcactttccagacgccactccgcgacccacagactcacagaattctgtcccccagcatggcttccaagctggaggccccatttactcaagatgataccctcggattggagaatagccaccctgtgtggacacaaaaggaaaatcagcagctgattaaagaggttgatgcaaaaactacccacggaatcctgcaaaagcccgtcgaggctgatactgatctgcttggcgatgcatcaccagccttcggatccgggtcctcatccgaaagtggacctggggctctcgccgacctcgattgcagcagttcaagtcagtcacctgggagcagcgaaaatcagatggtttctcccggaaaggtcagcgggtcccctgaacaggccgttgaggagaatctgtcatcctattcactcgacaggagagtgacacctgcctccgagactctggaggatccatgtagaactgaatcacagcacaaagccgagaccccccacggcgcagagtag

SEQ ID NO: 244537 - DNA, 696 bp, Artificial Sequence
  Description of Artificial Sequence: Synthetic coding sequence
atgtccctacaggtgcttaatgataaaaacgtgtccaatgagaaaaataccgagaattgtgactttctcttttccccaccagaggtgactggtaggagctccgttcttagagtaagccagaaggagaacgtgccgccaaaaaatctggcaaaagcaatgaaggtgacctttcaaacaccattgcgagatccgcaaacgcacaggattctcagtcctagcatggcttcaaaattggaggctcctttcacccaggatgacacattggggctagagaactcacaccctgtgtggacacagaaggaaaatcaacagctgatcaaagaggtggacgccaaaaccactcatggcatcctgcagaaacccgttgaagcggatacggaccttctcggagatgcttcccctgcttttggtagcggttcaagctctgagagcggccctggagccttagcggatcttgattgctcttcatcttctcagagtccaggctcctcagaaaatcagatggtttcaccaggcaaggtgtccgggagtccggagcaggccgtggaggaaaacttgagctcttactcgttagatcgcagagtcaccccagctagcgagaccttagaggatccttgccggacggaatcacaacacaaggcagagacaccacacggggcagaagaggaatgcaaggctgaaaccccacatgggtag

SEQ ID NO: 244538 - DNA, 606 bp, Artificial Sequence
  Description of Artificial Sequence: Synthetic coding sequence
atggcgaacaagggaccttcttacggcatgagccgggaggtacagtcaaaaattgagaagaaatatgatgaagagctggaggagcgcctcgtggaatggattattgttcagtgcggccctgatgtagggcgtccagatagagggaggcttggcttccaggtatggctcaagaacggtgtcattctctcgaaacttgtcaacagcctttatccagatgggtccaagccagtgaaagtacctgagaaccctccttccatggtgttcaaacaaatggagcaggtagcccagttcctgaaggctgccgaagactacggagtaatcaaaactgacatgtttcaaaccgtggacctcttcgaggggaaagacatggccgcagtgcaacgcaccctcatggcgctcggcagccttgcagtgactaagaatgacggtcactacagaggcgaccctaactggttcatgaaaaaagcccaagaacacaaacgcgagttcacagaatctcagcttcaagagggaaagcacgtgatcggacttcagatgggctctaataggggcgcaagtcaagcaggtatgaccggctacggcaggcccaggcagattataagctag

SEQ ID NO: 244539 - DNA, 108 bp, Artificial Sequence
  Description of Artificial Sequence: Synthetic coding sequence
atggccaataaaggcccaagctatgggatgagccgcgaggtccagcccagtaggctggcttgcctgacccatacccgggtagtccctagtgcactggcaaagctgtag

SEQ ID NO: 244540 - DNA, 606 bp, Artificial Sequence
  Description of Artificial Sequence: Synthetic coding sequence
atggcgaataaagggccttcttacgggatgagccgggaagtgcagagcaaaatcgagaagaagtatgacgaggagttagaagaacgactggtggagtggattatagtccagtgtggacccgatgtgggtcgccctgatcggggaaggcttggttttcaggtatggctcaagaatggcgtcattctgagcaaactcgtcaattctctctaccccgatggttccaagcccgtgaaggtgccagaaaatccccctagtatggtgttcaagcagatggaacaggttgcccagtttctgaaggccgctgaagactacggggtaatcaaaacagatatgttccaaaccgtggatctctttgagggcaaagacatggcagcggtgcagaggactctgatggccctgggatcactggcagtgactaaaaatgatggccactacaggggagaccctaattggttcatgaagaaagctcaggaacataagcgagagttcacggagagccagcttcaggaaggtaaacacgtgataggcttgcagatggggtcaaatcggggtgctagccaggcgggtatgacagggtacgggagacccaggcaaatcattagttag

SEQ ID NO: 244541 - DNA, 606 bp, Artificial Sequence
  Description of Artificial Sequence: Synthetic coding sequence
atggcgaataaaggccctagttatgggatgagccgcgaggtccagagcaagatcgagaaaaaatatgatgaagagcttgaagagagactggtggagtggattattgttcagtgcggacctgatgtaggcagacccgatcgcggtcggctcgggtttcaggtgtggttgaaaaatggggtgatccttagcaagcttgtgaatagtctgtacccagatgggagcaaacctgtgaaagtgccagagaatcctccctcgatggtttttaaacagatggaacaggtagctcagtttctcaaggccgctgaagattatggcgtaatcaaaaccgacatgtttcagactgtagacttgttcgaggggaaagacatggccgctgtccaacggaccttaatggctctcggcagcctggccgtgacaaagaatgacggccactacaggggagacccaaattggttcatgaagaaggcacaggagcataaacgagagttcacagagtctcaactgcaggagggtaaacacgtgatcggcctgcagatgggctccaatagaggtgccagccaggccggtatgacaggctacgggagaccgcgacaaatcatttcttag

SEQ ID NO: 244542 - DNA, 276 bp, Artificial Sequence
  Description of Artificial Sequence: Synthetic coding sequence
atggccaacaaagggccttcatatggcatgagtagggaggttcagtccaagattgagaaaaagtatgacgaggagctggaggaacggctggtggagtggattatcgtgcaatgcgggcctgacgtgggcaggccagacagaggaagattagggttccaggtttggctgaaaaacggtgttatcctcagcaagctggtcaattctctttaccccgatggtagcaagcctgtcaaggttcccgagaatcctccctccatggtatttaagcaaatgtag

SEQ ID NO: 244543 - DNA, 606 bp, Artificial Sequence
  Description of Artificial Sequence: Synthetic coding sequence
atggcgaacaaagggccaagttatgggatgagcagagaggtgcagtccaagatcgaaaagaaatatgatgaggaactggaagagcgcctggtagagtggattatcgtgcagtgtggtccagacgtgggaaggcctgaccggggacgcctggggttccaggtctggcttaaaaatggcgtgattctgtctaaactagtcaacagcctttaccctgatggcagcaaaccagtcaaagtgccggagaaccctccctctatggtctttaagcaaatggagcaagtggctcaatttctcaaagccgcagaggattacggtgtgataaagactgatatgttccagacggtggacctattcgagggcaaggatatggccgctgtccagcgtaccttgatggctctgggcagtcttgctgttaccaaaaacgacggacactacagaggcgacccgaactggttcatgaagaaagctcaggagcataaacgcgaattcactgagtctcagttgcaggaagggaagcacgttatcggcctccagatggggagtaaccgtggagcatcacaggcagggatgactgggtatggtaggcctaggcagatcatttcatag

SEQ ID NO: 244544 - DNA, 606 bp, Artificial Sequence
  Description of Artificial Sequence: Synthetic coding sequence
atggcaaataagggtcctagttatggcatgagccgggaagtccagtccaaaattgagaaaaaatatgacgaagagctggaagagagattggtagaatggatcatcgtccagtgtggcccagatgtcggcagaccggatcgcggacgactggggttccaggtctggcttaagaacggcgtgatactttcaaaactcgtcaactcactgtatcctgacggcagtaaacctgtgaaagtcccagagaacccccctagtatggtgttcaagcagatggagcaggtggcacagttcttgaaggcagccgaggactatggagtgataaaaacggacatgttccagaccgtggatctttttgagggcaaggatatggcagccgtgcagcggacactgatggccctaggctccctcgccgtaactaaaaacgatggacactaccggggtgatcccaattggttcatgaaaaaagcccaggagcacaaacgagaattcacagaaagtcaactgcaggaaggcaagcacgttatcggattgcagatgggttcgaatcggggagcttcccaggcagggatgactggatacgggaggcctcgccagataatttcgtag

SEQ ID NO: 244545 - DNA, 600 bp, Artificial Sequence
  Description of Artificial Sequence: Synthetic coding sequence
atggcgaaccgtggacccgcttatggcctgtccagagaggtacagcagaagattgagaaacagtatgacgcggatctagagcaaattctcatccaatggattacaacacaatgtcggaaggacgtcgggaggccccaaccaggcagggagaacttccagaactggctaaaagacgggaccgtactatgcgaactgatcaatgctctgtatccggagggccaggcacccgtaaagaagattcaggcttcaactatggccttcaaacagatggaacaaatatcgcagttcctgcaggcggctgagcggtacggcatcaatacaaccgatatcttccagacagtggacttatgggagggtaaaaatatggcgtgcgtgcaacgcactctgatgaacctgggcggtctagccgtggctcgcgacgacgggctgttctcaggcgaccccaattggtttcccaaaaaaagtaaagaaaacccaaggaactttagcgataaccagctgcaggagggcaagaatgtgataggcttgcaaatggggaccaatcggggagcatcgcaggcgggtatgaccggctatgggatgccccgacagattttgtag

SEQ ID NO: 244546 - DNA, 663 bp, Artificial Sequence
  Description of Artificial Sequence: Synthetic coding sequence
atgtccgctttctcgctcgcgctcgctctcgtttcctctccacagcctccccctcccatcggtatggcaaaccggggtcctgcttacggactgtccagagaagtgcagcagaagatcgagaaacagtatgatgcagacttggaacagatcctgatccagtggattacgacccaatgtcgaaaagatgtaggcagaccgcagccaggacgagagaatttccagaattggctgaaagacggaaccgtcctctgtgaactcattaacgcgttgtatcctgaaggacaggcaccagttaaaaagatacaggcttccacaatggcctttaaacagatggagcagatctcacagtttctgcaggccgctgagcgctatgggattaatactacggatatttttcagaccgtagacctgtgggagggaaagaacatggcgtgtgtgcaacgaacactgatgaatctggggggtttggccgtggcccgagatgacggcctcttctcgggagatcctaattggtttccaaagaaaagtaaggagaatcctcggaatttctccgataaccagctgcaggaaggcaaaaacgtgatcgggctgcagatgggcacaaacagaggcgctagccaggcaggcatgaccgggtacggcatgcctcggcaaatcctctag

SEQ ID NO: 244547 - DNA, 600 bp, Artificial Sequence
  Description of Artificial Sequence: Synthetic coding sequence
atggctaatcggggaccggcttatggactcagtcgcgaagttcagcagaagatcgagaagcagtacgatgctgatctggagcaaatactgatccaatggattaccacacagtgcaggaaggacgtagggaggccccagccgggacgggagaatttccagaattggctcaaagatggcaccgtgctgtgcgagttaatcaatgcattgtatccagaagggcaggctccagtgaaaaaaatacaggcctccacaatggcatttaaacagatggagcagatatctcagttccttcaggccgctgagcggtacggtatcaacaccaccgacatctttcagaccgtggatctgtgggaaggcaagaatatggcctgcgtgcaaagaactctaatgaatcttggcggtctggcagtggcaagagacgatgggctgttttccggggaccctaattggtttcctaagaagtcaaaagagaatcccaggaatttctccgataaccagttacaagaggggaagaatgtgatcgggctccagatgggcactaataggggcgcttcccaggctgggatgacaggttacggcatgccccgacaaatactgtag

SEQ ID NO: 244548 - DNA, 564 bp, Artificial Sequence
  Description of Artificial Sequence: Synthetic coding sequence
atggcaaacagaggcccagcctacggcttgtccagagaggtacaacaaaagatcgagaaacagtatgacgcagatctcgagcagatactcatccaatggatcactacgcagtgtcgaaaagacgtgggccgacctcaaccgggaagagaaaacttccagaattggctgaaggatgggacagtgctttgcgagctgataaatgcactgtacccagaagggcaggctcccgtgaaaaagattcaggcctctaccatggcctttaagcagatggaacagatctctcagtttctccaagcagccgagagatacggcattaacacaaccgacatcttccagacagtggacttgtgggaaggcaagaacatggcctgtgtgcagcggaccttaatgaatttggggggactagccgtggccagagacgatggcctgttttcgggcgatccaaattggttcccaaaaaagagcaaagagaaccccagaaacttcagcgacaaccagctgcaggaaggaaaaaacgtgataggattgcaaatgggcacgaaccgtggggcttcccaggcctag

SEQ ID NO: 244549 - DNA, 3861 bp, Artificial Sequence
  Description of Artificial Sequence: Synthetic coding sequence
atgagtcatttagttgatcccacatctggggacctccccgtgagggacatcgacgctattccactcgtcctgccggctagcaaggggaagaacatgaagactcaacctccgctgtctcgaatgaaccgtgaggagttagaagactctttctttaggctgagagaggatcacatgctggtgaaggaactatcatggaagcagcaggatgagattaagcgcttgcgtaccacccttttgaggctaacagcagccggtcgggatctgcgggtcgccgaggaggcggcacctttgagcgagactgcgaggcgcggacaaaaagcgggttggaggcagcgcctatcaatgcaccagcgcccacaaatgcaccggctccagggacactttcattgtgtgggccctgctagtccccgaagggcacagcctcgagtgcaagtcgggcaccgccagctgcataccgccggtgcaccagtcccagaaaagcccaaaagaggacctagggaccggcttagttatacggccccaccttcttttaaggaacacgccaccaatgagaatcgaggcgaggtcgcaagcaagccatctgagctggtgagcgggtccaattctattatcagtttttccagcgtgattagtatggccaagcccatcgggctgtgcatgccgaattccgctcacattatggcatccaacaccatgcaggtggaagagcctccgaagagcccagagaagatgtggccgaaagatgagaatttcgagcagcgctcatccctggagtgtgctcagaaagctgccgagctgcgagcctccatcaaggagaaagtcgagctaattagattgaaaaagctgctgcacgaacgaaatgcgtccctggtcatgactaaagcccagttgacagaggtccaggaggcttgcacatttcttttgacccagaaccaggggatcctttctgccgctcacgaggcgttgctgaagcaggtgaatgaactccgggcagaactgaaggaggagtccaagaaggcagtcagtttgaaaagtcaattggaggatgtgagcattctgcagatgacattgaaggagttccaggagcgcgtcgaggacttggagaaagagcgcaaactcttgaatgacaactatgacaagctgctggagagcatgttggactcctcagatagctcttcccagccccactggtcaaacgaactgatcgctgagcagcttcagcagcaggtgagccagctccaggatcagctggacgcggagctagaggataaacgaaaagtactgctagagctaagcagagaaaaagcacagaatgaagatcttaagctcgaagtcaccaatatcctacagaaacacaagcaggaggtggaactactccagaatgccgctacaatttctcagccaccagatcgacaaagcgagccggctacccaccctgcagtgctccaggaaaacacacaaattgaacctagtgagccaaaaaatcaggaggaaaagaaactcagtcaagtcctgaatgaactccaggtctctcacgccgaaacaaccctggaattggaaaaaacccgcgacatgttgatattgcagaggaaaatcaacgtatgttatcaggaagagctcgaagccatgatgacaaaggctgacaacgataatcgcgatcacaaggaaaagctggagcggctaaccaggctcctcgatctgaaaaacaatcgtataaaacagctggagggaatcctacgttcccacgatctgcctacctcggagcagctgaaggatgtggcttatggtacccggccactttctttgtgcctggaaactctgcccgctcacggcgacgaggataaggtggatattagccttctgcaccaaggcgaaaacttattcgagcttcacattcaccaggcgtttctcacctcagccgctctggcgcaggccggtgatacgcagccaacaacgttttgtacctactcgttttacgattttgagacacattgcaccccattaagcgtgggtcctcagccactctacgatttcacatctcagtacgtgatggaaaccgactctctgttcctgcactacctacaagaagcttccgcacgcctggatattcaccaggcaatggcctcagaacattcgactctcgcagctggctggatctgtttcgatcgggttctcgaaacagtggagaaagtccacgggctagcaaccctgattggagcaggcggtgaagagtttggcgtcctcgagtattggatgagactgaggttccccatcaaaccctcactgcaagcctgcaataaacgcaagaaagcccaggtgtatctgagtactgatgtcttgggcggaagaaaggcgcaagaggaggagttcaggtctgaatcctgggaaccccagaatgagttgtggattgagatcacaaaatgctgcggcctgcgttctcgttggctggggacgcagccgtccccctatgccgtctaccgtttttttactttcagcgaccatgataccgctatcattcctgctagtaacaacccttatttccgtgatcaagccaggttcccagtgttagttaccagcgatttggatcactaccttaggcgtgaagccctgtcgatccatgtattcgacgatgaagatttagagcctggttcttatttgggacgagccagagtacccctgctccctttggccaagaatgagtccattaaaggcgactttaacctgactgatcctgctgagaaacctaatgggtctattcaggtacaactcgactggaagtttccctacatccccccagagagcttcctcaaacccgaggctcagacgaagggaaaggatacaaaagactcgagtaagatctccagcgaggaagagaaggcctcattcccaagccaggatcaaatggcttctcccgaggttcctattgaggccggacagtaccggagcaaacgcaaaccccctcatgggggtgagaggaaggagaaagagcaccaggtggtctcctattctagaagaaagcatggaaaacgcattggggtacaggggaaaaatcgcatggagtacctttcccttaacatccttaacggcaatacaccagagcaggtcaactatactgagtggaagttctcagagacgaactcattcatcggcgatgggtttaagaatcagcacgaagaggaagagatgaccctgagtcactctgccctcaagcagaaggaaccgctgcaccccgtcaatgataaagagagctctgagcagggctctgaagtaagcgaagctcagaccaccgactccgacgacgtcattgtgccgccaatgtcccagaaataccctaaggcggacagcgagaagatgtgtatcgagatcgtttcactggcgttctaccctgaagccgaggttatgagcgacgaaaacattaagcaagtgtacgtggagtataagttttacgatctgccgctaagcgagaccgagactcccgtctctttgagaaagccgcgtgccggtgaagagattcacttccatttctcaaaggttattgacctggacccccaggagcagcagggacggaggagattccttttcgacatgcttaacggtcaggatcccgaccaaggccatttgaaatttacagtggtgtcagaccccctggacgaggaaaaaaaagagtgcgaggaggtggggtacgcctatctccagctgtggcagatcctggagtccggacgcgacatactggaacaggagctggatattgtgagccctgaggacctcgccacccctatcgggcgactcaaagtgagcttgcaggccgctgctgtcctccacgcaatttacaaagaaatgaccgaagacctcttttcctag

SEQ ID NO: 244550 - DNA, 1128 bp, Artificial Sequence
  Description of Artificial Sequence: Synthetic coding sequence
atgaaacgaccagatttgccttctggttttgatgggtggcaggttgttgatgccactccccaggagacttctagcggaattttctgctgtggaccatgcagcgtagagtccataaaaaatgggttggtatacatgaagtacgacacgcctttcattttcgccgaagtcaatagcgacaaggtgtattggcaaaggcaggacgacggttcatttaagatcgtgtatgtggaggagaaagctatcggcaccctgatcgttacaaaagccattagtagtaacatgcgagaggatatcacctatttatacaaacacccggaaggttcagatgccgagagaaaagcagtggagaccgccgcagctcacggcagtaagccgaatgtttacgcaaacagaggatccgccgaggacgtagctatgcaggttgaggcccaggacgccgtcatggggcaggacctcatggtttcagtcatgttaataaatcacagctcatcgagacgcactgtgaagctgcatctctacctcagcgttaccttttacactggtgtgagtggcacaatatttaaagaaacaaagaaagaggtggagttagcgccaggcgcatccgaccgcgtgacaatgcccgtagcttacaaggaatatcgccctcatctggtggatcagggggctatgttgttgaacgtcagtggccacgtgaaagagagcggacaggtcctggcaaagcagcacacatttagactgcgtacccctgacttaagtctaactttgttaggcgctgcggtagttggccaggagtgcgaagtgcagatagtgtttaagaacccactaccagtcaccctgacaaatgtggtttttcggctcgaaggaagtggtcttcagagacccaaaatcctcaacgttggtgatatcggaggtaacgagactgtaactttgcgccaatcattcgtgcctgtgaggccgggaccaaggcagcttattgctagcctggacagcccacagttatcccaagttcatggtgtgattcaggtagacgtagccccagccccaggggatgggggatttttcagtgatgcaggcggagactcacacctgggagaaacaattcctatggcttctcgaggtggcgcatag

SEQ ID NO: 244551 - DNA, 408 bp, Artificial Sequence
  Description of Artificial Sequence: Synthetic coding sequence
atgatggatggcccacgaagcgatgtcggaagatggggtggcaatcctctgcagccacctaccacgccctctccagagccagaaccagaacccgacggcaggtcgcgacggggagggggacgtagcttttgggcccgatgctgcggttgctgcagctgcagaaacgccgcagatgacgattgggggccagagccgtcagattctcggggtcgaggcagcagttccggcactcggcgtcctggctctaggggcagtgactccaggcggcctgttagcaggggtagcggcgtcaatgccgctggtgacgggacaattcgtgagggaatgttggttgtgaatggggtggacctgctgtccagccgcagcgaccagaacaggagagagcatcatacagacgagtacgagtag

SEQ ID NO: 244552 - DNA, 129 bp, Artificial Sequence
  Description of Artificial Sequence: Synthetic coding sequence
atgatggacggaccgagatctgatgtgggaagatggggtgggaacccactgcaacctcctacaaccccttctccagaaccggaacccgagccagacggacgatcacgcagaggtggtggcagatcttag

SEQ ID NO: 244553 - DNA, 198 bp, Artificial Sequence
  Description of Artificial Sequence: Synthetic coding sequence
atgatggatggcccacggtccgacgtcggtagatggggcggtaatccgctgcagcctccaacgacccctagcccagagcctgagccggagccagacggaaggagtcgtcggggtggcggaaggtctttctgggcaagatgctgcgggtgttgttcctgccggaatgctgcggacgatgactggggtcccgagccttag

SEQ ID NO: 244554 - DNA, 153 bp, Artificial Sequence
  Description of Artificial Sequence: Synthetic coding sequence
atgatggacggcccaaggtccgacgtggggaggtggggcggaaatcctctacaaccccctaccacccctagcccagagcctgaaccagagcccgacggcagatctcgaagaggaggtggtagatccttctgggcacgttgttgcggatgttag

SEQ ID NO: 244555 - DNA, 30 bp, Artificial Sequence
  Description of Artificial Sequence: Synthetic coding sequence
atgatggacggacccaggagcgatgtatag

SEQ ID NO: 244556 - DNA, 2064 bp, Artificial Sequence
  Description of Artificial Sequence: Synthetic coding sequence
atggcggaagaattggtgcttgagaggtgtgacctggagctggaaaccaatggtagagatcaccacactgctgatctgtgtcgggagaagctagtagtgaggcggggtcaacctttctggctcactctgcactttgaaggccgaaactacgaggccagcgtcgactcactaaccttcagcgtggtcactggcccagcacctagccaggaggctggcactaaagcaaggtttcccttacgggacgctgtcgaggagggagattggacagcaactgtcgtcgatcaacaagactgtaccctcagcctccagcttaccactccagccaacgctccaattggcttgtatcggcttagtcttgaggctagcaccgggtaccagggttctagctttgttctgggccactttatcctgctgttcaatgcatggtgtccagccgatgcggtatacttggatagcgaggaagaacgccaggaatatgtcctgacccagcaagggtttatctatcaaggctccgctaaatttattaaaaatattccatggaatttcggacaatttgaagatggcatattggatatatgcctgatcctgctggatgttaaccccaagttcctgaagaacgccggtagagattgctctaggaggtcttcccccgtgtatgtgggacgagtggtgagtggtatggttaattgtaacgatgatcaaggagtcctgttgggtcgatgggacaataattatggcgatggcgtaagtccgatgtcttggattggcagcgtggatattttgcgcagatggaagaaccacggctgtcaacgggtcaagtacggacagtgttgggtgtttgcagcagtcgcctgtaccgtccttcgctgcttgggaatcccaacacgcgtggtaactaactacaactccgctcacgaccagaattcaaatctgttgatcgaatactttcgcaacgaatttggcgagatccagggggacaagagcgagatgatttggaatttccactgctgggtagaatcttggatgactcgaccagacctccagcccggatacgaaggatggcaggcgctcgatcctacacctcaagagaagagcgagggcacatactgttgcggcccagtgcctgtccgggctatcaaggaaggggacctgagcaccaagtatgatgccccttttgtgttcgcggaagtgaacgccgacgtggtggattggatacaacaggacgatgggtcagtccataagtcgattaacagatccttaattgttgggttaaaaatttcaaccaagtccgtcggccgtgacgaacgggaggacattacacatacttataagtatcccgaggggagtagcgaagagcgggaggcctttacgagggctaaccatcttaacaagctcgccgagaaggaggaaacaggcatggcgatgcgcatacgcgtggggcagtctatgaacatgggaagcgacttcgatgtgtttgcacacatcacaaataatacggctgaagaatacgtctgtcgactgctcctttgcgcgaggacagtgtcttataatggaatcctgggccctgaatgtggaaccaagtatctcctgaatctcaacttagagcccttttctgagaagtctgtacccctgtgcatactttatgagaaatacagagattgtctgactgaaagtaacctgatcaaggttagagcactgctggttgaacccgtgatcaactcgtacctcctggctgagcgtgatttgtacctggagaaccccgagattaagatcagaattctcggcgagccaaagcagaaacgtaagctggtcgctgaggtgtccctccaaaacccgcttcctgtggccctggagggttgcacgttcactgtggaaggggcagggcttaccgaggaacaaaaaacagtggagatcccagaccccgtcgaagccggagaggaggtaaaggtgagaatggacttgctgcccttgcacatgggcttgcacaagctggtcgtaaatttcgagtcagacaagctcaaagccgttaagggcttccgcaacgtcatcatcggacccgcatag

SEQ ID NO: 244557 - DNA, 846 bp, Artificial Sequence
  Description of Artificial Sequence: Synthetic coding sequence
atggcagaagagctggtgttggaaaggtgcgatcttgagctggagacaaatggtagagatcaccatacggccgacctgtgtcgggagaagttggttgtcaggcgtggacagccgttctggctcacgctgcacttcgaaggacggaactacgaggcttctgtggacagtctcaccttcagcgtggttactgggccagccccttcgcaggaagccggaaccaaggctaggttccctttgcgggacgctgttgaggaaggcgattggaccgccacagttgtcgatcagcaggattgtactctctccctgcaactcaccacgccagcaaacgccccaattggtttataccggctgagtcttgaggccagcaccggttaccaggggtcctcttttgtcctgggccattttatcctgctttttaatgcatggtgtcccgctgatgccgtgtacctagattcggaagaggagcgacaggagtatgttctaacacagcagggttttatttaccagggatctgcaaaattcatcaagaacataccctggaattttggtcagttcgaagacggcattctggatatttgtctgattctgctcgacgtgaaccctaaatttctgaagaatgccggtagggactgctcccggaggtcttcaccagtatacgttgggagggtggtctccggcatggtcaactgtaatgacgaccagggcgtactcctcggcagatgggataataattacggggacggggtgagccctatgtcttggatagggtccgttgatatcctgagacggtggaagaaccatgggtgccaacgtgtcaagtatgggcaatgctgggtctttgcttag

SEQ ID NO: 244558 - DNA, 483 bp, Artificial Sequence
  Description of Artificial Sequence: Synthetic coding sequence
atggcggaggagttggtgctggagcgatgtgaccttgaactggagactaatggtcgcgaccaccatactgccgatctatgtcgagaaaagcttgtcgttagaaggggacagcctttctggctgaccctccattttgaagggagaaattatgaagcctctgtggactctctgaccttcagcgtagtgacaggaccagcaccctcccaggaggctggcacaaaggcaagatttccattacgcgacgccgtggaggagggcgattggacggccacggttgttgatcagcaagattgtaccttgtccctgcaactcacgactcccgcaaacgctccaatcggcttgtacaggctgtctctcgaagcatctaccggatatcaggggagttcattcgtgctcggccacttcatcttgctcttcaatgcctggtgtcccgctgacgccgtgtacctggactccgaagaggaacgtcaggaatacgtgtag

SEQ ID NO: 244559 - DNA, 1821 bp, Artificial Sequence
  Description of Artificial Sequence: Synthetic coding sequence
atggccgaggaactagtactagaaaggtgcgatctggaactggagaccaacggaagagaccaccacaccgcagacctgtgccgggagaagttggtggtgagaaggggtcaacccttttggctgactctgcacttcgagggtagaaattatgaggcaagtgtggactccctcacatttagtgtagtcacagctgatgccgtgtatttggattcagaggaagagagacaggagtacgtacttacacaacaagggtttatctatcaaggatccgccaagtttattaaaaatattccctggaactttggccagttcgaggatggcatcctggatatctgcttaattctattggacgtgaacccaaaattcctgaagaacgccggacgcgattgttcacggagatcgagccccgtatacgtgggacgcgtagtaagcggcatggtaaattgcaacgacgaccagggtgttctgctaggcaggtgggacaataactacggcgacggcgtgtccccgatgtcctggatcggatccgtggacattctccggagatggaagaatcatggctgccagagggtgaagtatggtcagtgttgggtgttcgcagctgtggcttgtacagtcctcagatgccttggtatcccaactcgggtggtgaccaactacaattccgcccacgatcagaactcaaacctcctgattgaatattttcgcaacgagtttggagagattcagggcgacaagagtgaaatgatttggaatttccactgctgggttgaatcatggatgacgcggccagatctccagccagggtacgagggatggcaagctctggaccccaccccccaggaaaagagcgaggggacctattgctgcggccctgtgcccgtgagggcgattaaggagggtgacttgagcacgaaatatgacgcccctttcgtttttgcggaagtcaacgccgacgttgtggattggattcagcaagacgacggcagcgtgcacaagagtatcaatagaagtctgattgtcggtcttaagatctccactaaatcagtgggacgcgacgaacgagaagacatcactcacacctacaagtatcctgaagggagcagtgaagagcgagaggccttcactagggccaaccacctgaacaagctggcggaaaaagaggaaaccggtatggctatgcgcataagggtggggcagtcgatgaacatgggctccgactttgacgtgttcgctcacatcaccaataataccgctgaagagtatgtgtgtcggctgctgctatgtgcaagaacagtgagttataatggcatcctcggacctgagtgtggtactaaatatcttcttaacctgaacctcgaaccctttagcgagaagagtgttcccctgtgtatcctttatgagaaataccgggactgtcttacagagagtaacctgatcaaggtgcgtgccttactggttgagcctgtgattaactcttacttgttggcagaacgcgacttatatttggagaatccggaaattaaaattcggatcctgggagaaccaaaacaaaaaagaaagctcgttgccgaagtttccctccagaatcccttgcccgtcgccttggagggctgtacattcaccgtagagggggcagggctaacagaagaacaaaagactgtggaaattccagaccccgtggaggcaggcgaagaggtaaaggttaggatggacttgttgcctctgcatatggggctgcataagctcgtggtgaactttgagtctgacaagctgaaggctgtaaagggcttccgaaatgtgatcatcggacccgcatag

SEQ ID NO: 244560 - DNA, 1884 bp, Artificial Sequence
  Description of Artificial Sequence: Synthetic coding sequence
atggccgagggcccagccccttcccaggaagccggtaccaaggctcggtttcctctcagggatgctgttgaggaaggcgattggacggcaaccgtagtcgaccagcaggattgtacgctatcacttcagttgacaacacccgcaaatgccccaattgggctctacaggctcagtcttgaagcaagcactggctaccaggggagtagctttgttctgggccacttcattctgctgttcaatgcatggtgtcctgcagatgccgtctacctggactctgaagaggagagacaggagtatgtgcttacgcagcaagggttcatctaccagggctctgccaagtttatcaaaaacataccatggaatttcggtcagttcgaggacgggatcctcgacatctgcctgatcttgctggatgtaaatcctaaatttctcaaaaatgccggaagagattgctcaagaagatcctccccggtctacgttggccgagtcgtgtccggtatggtgaactgcaatgatgatcagggcgtcctgttgggtcgttgggataacaactacggcgacggcgtatcacccatgagctggattggatccgttgatatcctccgacggtggaagaatcatggatgtcagcgggtaaaatatggtcaatgttgggtcttcgctgctgtggcctgtacagtcctccggtgcttgggaatccccacgagggtggtcaccaattataattccgcacatgaccaaaatagcaatctactcatcgaatattttagaaacgagttcggggagattcagggagataagtctgagatgatatggaactttcattgttgggtggaatcatggatgacccggcctgacttacagcctggatacgagggatggcaggctctagacccaactccacaagaaaaatcggagggtacatactgctgcgggcctgtgccggtcagggcgatcaaagaaggagacctcagtacaaagtatgacgcccctttcgtatttgccgaggtgaatgccgatgttgtcgattggattcaacaagatgacggcagcgtccataaatctatcaacagaagcctgattgttggactaaagatctctacaaagtccgtcggaagggatgagcgtgaggacatcacccacacatacaaataccccgaaggtagctcggaagaacgcgaggccttcaccagagccaaccacctcaacaagctcgccgaaaaggaagaaacagggatggctatgcggattagagtggggcagagtatgaacatgggctctgactttgacgtgttcgcccacatcacaaataatactgcagaggaatacgtctgcaggctccttctgtgcgcgagaaccgtgtcttataatgggatcctgggaccggaatgtggtactaaatatctactgaacctgaaccttgagccattttccgaaaagtcagttcccctgtgcatcctgtatgaaaagtatcgggactgcctaacagagagtaacttaattaaggtccgagcattactagtggaaccggtgatcaatagttacctcttggccgagcgcgatctgtatctggaaaaccctgagattaagattcgaatccttggcgaacccaagcagaagcgcaagctggtcgctgaggtttcactccaaaaccccttgccagtggcccttgaggggtgtacttttactgtcgagggtgcaggactcacagaggaacagaaaaccgtggaaatcccagatcctgttgaggcaggcgaggaggtcaaggttcgcatggacttgctgccactgcatatgggcctgcataagctggtggtgaattttgaatctgataaattgaaggctgtcaagggatttcggaatgtgataatcggcccagcttag

SEQ ID NO: 244561 - DNA, 2082 bp, Artificial Sequence
  Description of Artificial Sequence: Synthetic coding sequence
atggcggctctgggagttcagagtatcaactggcagaccgccttcaaccgccaagcacaccatactgataaattcagctcccaagagttaatcttacgcagaggacagaacttccaggtgctcatgataatgaataagggcctcggaagcaacgagagacttgagttcatcgtctcaaccggaccatacccgtcggaaagcgcgatgactaaagcagtcttcccactgtccaatggctccagcggaggttggagcgctgtactgcaggcttccaatggaaatacactgaccatcagcatctcttcgcctgcctcagcacccatcggtcgctataccatggcgctacaaattttttctcagggtggtataagctccgtcaagctgggcacattcattcttctcttcaatccatggctgaacgttgacagtgtttttatgggcaatcacgctgagagggaagagtacgtgcaggaggatgccggtatcatttttgtgggcagcactaaccgtattgggatgattggatggaacttcggacaattcgaggaagatatattgtctatttgccttagcattttggacaggagcctcaacttccgcagggacgcagctacggacgtcgccagcagaaatgatcccaagtatgtcggaagagtgctgtccgctatgattaacagtaatgatgataatggcgtgctcgcaggcaactggagcggcacctacacaggtgggagggacccgaggtcttggaatggtagtgtggagatcttgaagaactggaagaaatcaggcttcagccctgtgaggtacggccagtgctgggtgtttgcgggaacgctgaatacggcactgcgcagcttagggatcccgagtagagtgatcacgaacttcaacagcgctcatgatacagaccgcaatttgtcggtagacgtgtactacgaccctatgggtaacccgctggacaagggtagcgactctgtgtggaacttccatgtctggaacgaaggctggtttgtgcgctccgacctgggcccatcttatgggggatggcaggtgcttgatgccacgccacaggagcgctcccaaggagtgttccaatgcggtcccgcttccgttattggtgtgcgcgagggtgatgttcagttaaacttcgatatgccattcatattcgccgaggtgaatgccgatcggataacatggctctacgataatactactgggaaacagtggaaaaactcagtgaacagccatactatcggcaggtacatttcaaccaaggccgtcgggagtaatgcacgcatggacgtgactgataaatataagtacccggagggctcggaccaggagagacaggtgtttcaaaaggctctgggtaagttgaagcctaatactccatttgctgccaccagttctatgggcctggagacggaggaacaggaaccctcaatcattggcaagttaaaggtggctggcatgctggcagtgggcaaagaggtgaacctagtattgctgctaaaaaacctgtcacgggacaccaagaccgtgacagttaacatgaccgcctggaccattatatacaacggcaccctggtgcacgaggtttggaaggactctgcaaccatgtcccttgaccccgaagaagaggcagaacacccaattaaaattagttatgctcagtacgagaaatacctcaaaagcgacaatatgatccgtattaccgccgtttgcaaagtgcccgatgagagtgaagtcgttgtggagagggatatcattctggacaatccaacactgacgctcgaggtgttgaacgaggctcgtgtacggaagcccgtgaatgtgcagatgctgttcagtaatcctttagacgagccagtccgcgactgcgtgctgatggtcgagggcagtgggctgctcctcggcaaccttaaaatcgacgtgccgactttaggtcccaaggagggatctcgggtgagatttgacatcctgccctcacgatccggaaccaagcagcttcttgcagatttcagctgtaacaagtttccggcaatcaaagccatgctctcgatcgatgtggcagaatag

SEQ ID NO: 244562 - DNA, 1602 bp, Artificial Sequence
  Description of Artificial Sequence: Synthetic coding sequence
atggcagcgcttggggtgcagtccataaactggcagactgcattcaataggcaggctcaccacacagacaagttcagcagccaggagctgatcctgcggagggggcagaattttcaggtgctgatgatcatgaacaaggggctgggctcaaacgagcggctagagtttatcgtaagcacaggcccttacccatccgagtctgccatgacaaaggccgtctttccattatctaacggatcttctggcggttggtctgccgtgctgcaggcaagcaatgggaatacactgaccatttctatatcgtcacccgcttcagcccctatcggccgttataccatggccctgcagatcttcagccagggagggatctctagcgtcaagctggggacctttatcctgctcttcaatccttggctgaatgtggattctgtattcatgggcaaccatgctgagagagaagagtatgtacaggaggatgccggaataattttcgtgggaagtaccaatcggatagggatgatcggatggaatttcgggcagttcgaagaggatatcttgtcaatatgcttgagcatactggaccgctcgctgaattttcggagagatgccgctaccgacgttgcttcccgtaacgaccctaaatacgtagggcgagtgctgtcggcaatgatcaactcaaacgatgacaacggcgtcctcgctggcaactggtcaggcacatatactggcggtcgcgacccaagatcttggaacgggagcgtggagattctgaaaaactggaaaaagtccggttttagcccagtgagatacggtcagtgctgggtattcgctgggactctgaataccgcattgcgctctctgggcatcccctcaagggtgatcactaatttcaactcagcgcatgacaccgaccggaatctctctgtggacgtgtactacgatcccatggggaatcccttggataagggaagcgatagtgtgtggaacttccacgtttggaacgagggatggtttgtgagatccgacctaggcccttcctacggaggatggcaggtgcttgatgccaccccccaggagcgaagccagggcgtatttcagtgtggccctgccagtgtgattggcgttagggaaggcgacgtacagctgaactttgacatgccttttattttcgctgaggttaatgccgaccgcatcacctggctgtacgataacactacaggaaagcagtggaagaactctgtcaattcccacaccatagggagatacataagcaccaaagccgttggatccaacgccaggatggacgtcacagacaagtataagtatccggaaggcagtgaccaggaaagacaggtgtttcagaaggctcttggtaaactgaagccaaacacacccttcgccgcaacctcatccatgggcctggagacagaagaacaggaaccctctatcattggaaagttgaaggtggccggaatgcttgccgtggggaaagaggtgaatctggtgctccttctgataccccacgccctccagtgttgtcgtatggactggcctctaacccagggactgtcgaagcgcgacacaggtgaaaaactggtctag

SEQ ID NO: 244563 - DNA, 2055 bp, Artificial Sequence
  Description of Artificial Sequence: Synthetic coding sequence
atgatggacgcttctaaggagttacaggtgttgcacatagatttcctgaaccaggataacgccgtgtcacaccacacctgggagttccagacctccagtccagtgttcagaagaggccaggtgtttcacctaagactcgttctgaaccagcctctgcagtcctaccaccaattgaaattggaattctcaacaggccctaatcctagtatcgcgaaacatacgcttgtggtgttggaccctcgcactccatcagaccactacaattggcaggcgacgttacagaacgagtccgggaaggaggtgaccgtggccgtaacatcctctcccaatgcgatcttgggcaagtatcagcttaatgtcaaaacaggaaaccacattctgaaatccgaggaaaatattctctacctgctgtttaatccttggtgtaaggaagatatggtcttcatgcccgacgaagacgagagaaaagagtacatcctgaacgatacagggtgccattacgtaggagcagccagatcaattaaatgcaaaccttggaacttcgggcagtttgaaaaaaacgtgctggactgttgtattagtcttctgactgagtccagcctcaaacccactgacaggagagacccagtcctggtctgccgcgctatgtgcgccatgatgagcttcgagaagggacagggggtgctgattggcaattggacaggtgattacgagggcggtaccgcaccctacaagtggaccggatccgcccctattcttcagcagtactacaacacaaaacaggcggtgtgcttcggtcagtgctgggtgtttgccggaattcttacgacagtcttgcgggctttgggaattccagcacgttctgtgaccggttttgattcagctcacgacactgaacgcaatctgaccgtcgatacctatgttaacgaaaatggagagaaaataactagcatgactcacgacagtgtttggaatttccatgtctggacagacgcctggatgaaacgccctgacctcccgaaaggatacgacggctggcaggcggttgacgctaccccacaggaaagaagccagggagtgttctgctgtggaccaagtccactgactgctatcagaaagggagatattttcatcgtgtatgacacaagatttgtgttcagcgaagtcaatggcgaccggctgatttggctcgtgaaaatggttaacggacaggaagagctccatgtgatcagcatggagacaacctcaattggaaagaacatttccacaaaggctgtgggccaggacaggcgacgcgatattacatacgagtacaagtacccagagggctcgtcagaggagcggcaagtaatggaccacgcttttttgctgctctcctcagaaagagagcaccgcaggcctgttaaggaaaactttctccatatgtccgtgcagagcgacgatgtgctactgggcaacagcgtcaactttacagtgatactgaagaggaagaccgcggcattgcagaacgtcaacattctcggcagcttcgaattgcaattgtatactggtaagaagatggctaagctgtgcgatctgaataaaaccagccagattcaagggcaagtgtcagaggttacactaacacttgacagtaaaacttacatcaattcactggccattctggatgacgagcccgtgatccgagggtttattatagctgagattgttgaatctaaagaaatcatggcctcagaagtgttcaccagtttccagtatccagaattcagcatcgagttacctaacacaggaagaatagggcaactgctggtttgtaactgcatttttaaaaacaccctggccataccgctcacggatgtcaaattcagcctcgagtcactgggaatctcctcactgcagacttctgatcatgggactgtacagcccggagagacgatccagtcacagataaaatgcaccccaattaaaactggtcctaaaaagtttatagttaagctctcttcaaagcaggtcaaggagataaatgcgcagaagatagtgctaataaccaagtag

SEQ ID NO: 244564 - DNA, 1626 bp, Artificial Sequence
  Description of Artificial Sequence: Synthetic coding sequence
atgttctcctggatgggccgtcaggcaggtggaagggaacgagctgggggagctgatgcagtccagaccgtaaccggcggactccggagcctttatctgcgcaaggtgttgccgctggaggaagcgtacagatttcatgagttccattctcccgcattagaagacgctgattttgaaaataagccaatgatcttgctcgtcggccagtactcaaccggcaagaccacctttatccgctacttgcttgaacaggacttcccagggatgagaatcggtcctgagcctacaactgatagcttcatcgctgtcatgtatggggaaactgaaggctcaacccctggaaatgcgcttgtagtggacccaaagaagcccttcaggaagctgtcccggttcggaaacgcctttctgaaccgttttatgtgctcgcagttgccaaatcaggttcttaaatctatcagcgttatcgatagtccaggtattctctcgggcgaaaagcagagaatttcacggggatatgacttttgccaggtcctccagtggtttgcagagagagtcgaccgcatcatcctgctattcgacgcccataaattggacatatccgacgaattcagcgaggcgattaaagcctttaggggccaggacgacaagatccgcgtggtgctcaataaggcagatcaggttgatacgcagcagctcatgagggtgtacggagcactgatgtggagtctggggaaggtgattaacacccccgaagtgctgagagtgtatatcggctccttttgggcgcaacccttacagaatacagacaatcgtaggcttttcgaagcagaagctcaggatctgttccgcgatattcagagtctgccacagaaagcagccgtgagaaagctgaatgaccttataaagagagcacggctcgcaaaagttcacgcatacataatctcctatctgaagaaagaaatgccaagcgtgttcggcaaggagaacaagaaacgggaactcatttcaaggctccccgaaatctacatccaactgcagagggaataccagatctctgctggcgacttcccagaggttaaagcaatgcaggagcagctggagaattacgatttcaccaaatttcactccctcaagccgaagctgatagaggcagttgacaacatgttatctaataaaataagcccactgatgaatctgatatcccaagaggaaacaagtaccccgacccagttagtgcagggcggtgctttcgatggaacaacagagggaccatttaatcagggatacggcgagggggctaaggagggcgctgatgaggaagagtgggtcgtggccaaggataagccagtgtacgatgaacttttttacaccttatcccctatcaatgggaaaatatccggcgtcaacgctaagaaagagatggtgacttctaagctccccaacagcgtgctcggcaagatctggaaacttgccgattgcgactgtgatgggatgttggacgaggaggagttcgccttggcaaagcatctaattaagattaaattggatggctacgagctgccaagctccctcccaccacatctggtcccgccttcccataggaagtctttgcctaaggccgactag

SEQ ID NO: 244565 - DNA, 1917 bp, Artificial Sequence
  Description of Artificial Sequence: Synthetic coding sequence
atggcccagggcctggaagtcgcccttactgatttgcagagttccaggaataacgttaggcaccatactgaggagatcaccgtggatcatctcttggtacgcagagggcaggcctttaacctaaccctttatttccggaatagaagcttccaacctggcctcgataatattatttttgtcgtcgaaaccgaagatgccgtctacctcgatagcgagccacaacgtcaggaatacgtaatgaatgattacggattcatctaccagggaagcaagaattggattaggccatgtccctggaattatgggcaattcgaggacaagattattgatatttgtctcaagctactcgacaaatccctccatttccagacggacccggcaacggactgtgctctgcgcggatccccagtttacgtctctagagtcgtatgtgcgatgatcaatagtaacgatgacaatggtgtcctgaacggcaactggtccgagaattacaccgatggcgcaaatccagccgaatggaccggatcggtggccattttgaagcaatggaatgccacaggctgccagcctgttaggtatggacagtgctgggtattcgctgccgttatgtgcactgtaatgaggtgcctggggattccaacgcgggtgattacaaacttcgactcagggcacgacaccgatggcaatctgattattgatgagtactacgacaacactggtagaatactgggcaataagaagaaggataccatctggaacttccatgtgtggaatgagtgctggatggcgaggaaagacctgcccccagcctacggcggttggcaggtcttagacgctaccccccaggaaatgagcaacggagtttactgctgtggccctgcaagcgtgagggcaatcaaagaaggggaagtcgacctcaactacgacacccctttcgtgttttcaatggtgaatgcagactgcatgtcatggttggtccagggcggtaaagagcagaagctccatcaagacactagctcagtaggaaacttcatctctaccaaatctatccagtccgatgagcgggatgacatcacggagaactataagtacgaagaagggtctctgcaggagcgacaggtttttttgaaagctctgcagaaattgaaggcgagatcctttcatgggtcacagaggggagctgaattgcagccatcccgaccgactagtttgagtcaagattccccacgtagtctacatacccctagtctgaggccctcagatgtcgttcaagtgagtctcaagtttaaattgctcgacccacccaatatggggcaggatatttgttttgtcttattggcgctgaatatgagctctcagtttaaagacctaaaggtaaacctgtccgcacagtcgttactccatgacgggtctccactgtcccccttttggcaggacaccgccttcatcaccttgtccccaaaggaagcgaagacgtatccttgcaaaattagttatagtcaatacagccagtatctgtccaccgataagctcatccgcatcagcgcattaggtgaagaaaagtcaagcccggagaaaattctggtaaataagataattactctctcctatcctagcattaccataaatgttcttggcgctgccgtagtgaatcaacccctcagtattcaagtgatctttagtaacccgctgagcgagcaggttgaggactgcgttctaacggtcgagggctcaggcctgtttaagaaacagcaaaaagtgttcttgggcgtactgaaacctcagcatcaggccagcatcattctggaaaccgtcccgtttaaaagcggtcagaggcagatccaggcgaacatgcgctccaacaagttcaaggatataaagggctatcgcaatgtatatgtcgacttcgcgttgtag

SEQ ID NO: 244566 - DNA, 2160 bp, Artificial Sequence
  Description of Artificial Sequence: Synthetic coding sequence
gcacagggactcgaagtggccctgacagacctgcagtccagtcggaacaacgtgcgccatcataccgaggagatcaccgtagaccatctcctggtccgcagagggcaggcttttaacctaaccctttacttccgaaataggtctttccaaccaggcttagataacatcatctttgtagtggagaccggtccgctgcccgatctggcgctgggtacgcgcgctgtcttttccctggcccgacaccactcacccagcccatggatagcgtggttagagacaaacggtgcgacaagtactgaggtttcactgtgcgccccacctactgcagccgttggaaggtacttgctcaagattcacatcgacagcttccagggctctgtcacagcctaccaactcggagaattcattttattgtttaacccctggtgccctgaggacgcagtgtaccttgactccgaaccacagagacaggagtacgttatgaatgactacggctttatctaccagggcagcaagaactggatcagaccgtgtccatggaactatgggcagtttgaggataaaattattgatatctgcctcaaactcctggataaaagcctgcacttccagacagaccctgcaactgattgcgctctccgtggcagccctgtgtacgtaagtcgcgtcgtatgcgccatgatcaactctaacgacgataatggggttctaaacggcaactggagcgagaactacacggatggcgctaatccagcagaatggaccggatcagtggctatcctgaaacaatggaacgccactggatgccagccagttcgatatgggcagtgctgggtgtttgcggcagtgatgtgtacagttatgcggtgtttgggtataccaacacgtgtcatcaccaacttcgattcaggccacgataccgacggaaatctgatcatcgacgaatactatgacaataccggcagaattttaggtaacaaaaaaaaggatacaatttggaactttcacgtctggaacgaatgctggatggccaggaaggatctgccaccagcatatggtggttggcaggtactggatgcgacgcctcaggagatgagtaatggagtctattgctgcggtcctgcctctgtgagggccattaaggagggggaggtggatctgaattatgatactccgttcgttttctcaatggtcaacgcggattgcatgtcctggctggtgcagggtggcaaggaacagaaactgcaccaggacacctccagtgtgggtaatttcatcagtaccaagtcaattcagagcgacgagcgggatgacataactgagaattacaaatacgaagagggttctttgcaagagaggcaggtatttctgaaggccctgcagaagttgaaagctcgcagttttcatgggtctcagcgcggtgccgaactgcagccttctaggccgacgtctttgagtcaagatagtcccagaagcttgcatactccatccctgcgacccagcgacgtagtccaggtgtctctgaagttcaaactgttggatccacccaatatgggacaggacatatgctttgtgcttttggcactcaatatgagtagtcaatttaaggatctaaaagtgaatctctctgcacagtccctgctacatgatggtagccccctgtctccattttggcaagatactgccttcataacactcagtcctaaggaggcaaagacttatccttgtaaaatctcctacagccagtacagtcaatacctttcaactgacaaactcattcggattagcgctctgggcgaagagaagtccagtcctgagaagatcctcgtcaataagatcattacattgagctaccctagcataacgataaacgtattgggagccgcagtcgtcaaccagcccctctctattcaggttatattcagcaacccactcagtgagcaggtcgaggactgtgttctgaccgtggaagggtcggggctgtttaagaaacaacaaaaagtctttctaggggtgctcaagccgcaacaccaggcgtccataatcttggaaactgtgccatttaagtccggccagcggcaaattcaagccaacatgcgcagcaacaagtttaaagacatcaaagggtatcgtaatgtttacgtcgacttcgctctgtag

SEQ ID NO: 244567 - DNA, 2121 bp, Artificial Sequence
  Description of Artificial Sequence: Synthetic coding sequence
atggcagggatcagggtgactaaagtagattggcagcggtcacggaacggcgctgctcaccacacgcaggagtatccatgtcccgaactggtggttcggagaggtcaaagcttctctctcactctggaactgagcagagctctggactgtgaggagattctcatctttacaatggaaacagggccacgcgcaagcgaagctctgcacacgaaggcagtctttcagacctccgaactcgagcggggagaggggtggacagcagccagggaagctcagatggagaaaactctaacagtgtctcttgccagccctccatcagctgtgatcgggagatacctattgtctattcggctgtctagccatcgtaagcatagcaatcgccgtcttggtgaattcgtactactatttaatccttggtgcgccgaggacgatgtgttcttagcttcagaagaagagaggcaggagtacgtgctgtctgacagcggcatcatcttcaggggagtggagaagcatattcgcgctcagggctggaactatggtcagttcgaagaggacatcctgaatatttgcctttctattctcgatcgcagccccggacaccagaacaacccagcaaccgatgtctcctgtaggcacaacccaatatatgtcaccagggtgatttcggccatggtaaactcaaataatgatcgaggtgtggttcaggggcagtggcagggcaaatacggaggtggcacctccccattgcattggagaggctcagtggctatcctgcagaagtggctgaaggggaggtataagccagtgaagtatgggcagtgttgggtctttgcgggagtcctctgtaccgtactcagatgtcttggtatcgcaactagagtcgtcagcaatttcaactcagcccacgacactgaccaaaacctttcagtagacaaatatgttgattcttttggcaggaccctggaagatttaacagaggactcaatgtggaattttcatgtctggaacgagtcctggtttgcccgtcaggatctggggccttcttacaacgggtggcaggtcttagatgctactccacaggaagaaagcgaaggcgttttccggtgcggaccagccagcgtgacagcaattagagagggagacgtccatctcgctcacgacgggccattcgtgtttgcagaggtgaacgccgattatattacttggctttggcacgaagatgaaagccgagagagggtatacagtaacaccaagaaaattggcaggtgcatatctactaaggctgtgggctctgacagtagagtggacattactgacctgtataagtacccagagggtagcaggaaggagcgacaagtgtactccaaggcggttaacaggctctttggtgtcgaagctagcgggaggcgtatttggatcagaagagcgggagggagatgtttatggcgtgatgatctgctcgagcccgcaacaaagcctagtattgctggcaaattcaaagtactggagccacccatgctaggccatgatttgaggttggcgctctgcctggccaatctaacatctagagcgcaacgcgtgcgcgtcaacctgagcggagcaacaattctgtatacaaggaaacctgtggcagaaatattacatgagtcacatgcagtgaggttagggccacaggaagagaagcgtatccccataactatatcgtactccaaatacaaggaagacctcaccgaggacaaaaagatcctgctggctgcaatgtgcctggtgacgaaaggcgaaaagctccttgtcgaaaaagatatcaccctggaggattttattaccatcaaggtgctgggcccagctatggtcggggtggcagtgactgtggaggtcactgttgtgaaccctctcattgagagggtcaaagactgtgccctgatggtggaaggttctggactcctgcaagagcagctttccattgatgtgcccaccctggaaccccaggaaagagcaagtgtgcagtttgatattacgcctagcaagtctggacctcggcagttacaagtcgacttagtaagtccccattttccggacataaagggattcgtcatcgtccatgtggctactgcaaagtag

SEQ ID NO: 244568 - DNA, 1878 bp, Artificial Sequence
  Description of Artificial Sequence: Synthetic coding sequence
atggcaggtatccgcgtgactaaggtggattggcagcgatcacgtaacggcgctgctcatcatacacaggagtatccgtgtcccgagttagtggtccggagaggccagtcatttagtcttaccctggagctgtcacgcgctctggattgcgaggagattctgatctttaccatggaaacaggcccacgggcatccgaggctctacacacgaaggccgtgtttcaaacaagcgagttggaaaggggtgaaggctggactgcagctcgcgaagcccaaatggagaagacgctgaccgtctctctggccagccccccttccgcggtgatcggccgatatctgctgtctatccggctgagttcccatagaaagcacagtaacagacggctgggggaattcgtgttgttatttaatccgtggtgtgccgaggatgatgtgtttctggcttccgaggaggaaagacaggagtatgtgctgtccgattccggaattattttccgcggtgtggagaaacacatccgggctcaggggtggaattatggacagttcgaggaagacattctgaatatctgtttgtctatcctagaccgcagccctggccaccaaaacaatccggctaccgacgtgagctgccgtcacaaccctatatatgtgacacgcgtaattagcgccatggtcaactctaacaacgacaggggagtggtccagggacagtggcagggaaaatatgggggtggcacatctcctctccactggcgcggaagtgtggctattctgcagaaatggttgaaaggtagatacaaacctgttaaatatgggcagtgttgggtattcgccggtgtgctctgcaccgtactgcggtgcctgggaattgctacacgggttgtttccaactttaactctgcccacgacacggaccagaatctctccgtggataaatatgtggatagtttcggacggaccctcgaggatctgacagaagatagcatgtggaacttccacgtgtggaacgaaagttggtttgcacggcaggatcttggcccaagttataatggctggcaggtactagatgcgacgcctcaagaggagtccgaaggggtctttcgttgcggccctgcctcagtgaccgctataagagagggcgatgttcatttagcacacgacggccctttcgtgttcgccgaagtcaatgcagattatattacctggttatggcacgaggacgagtctagggagagagtgtactccaacacgaagaagatagggcgatgcatcagcacgaaagccgttggaagcgattcacgagtcgacattaccgatctctataagtatccagagggctccagaaaggagagacaggtgtactcaaaagcggtaaaccgcttatttggagtggaggctagcggaaggcgcatttggatcagacgagcgggtggacggtgtctgtggcgggatgacttactcgaacccgcaactaaacctagcatcgccggtaaatttaaggttctcgagcctcctatgcttggacatgatttgaggctcgccctgtgtctcgccaatctcactagtcgcgcacagcgggtgcgcgtaaatctctccggagccacgattctgtatacccgcaaacctgtcgcagagatcctgcacgaaagtcatgcagtgcgcctggggcctcaggaggagaagcggatcccaataactatctcatactccaaatacaaggaagacttgaccgaggacaaaaaaatattactggcagccatgtgtctggtcactaagggtgaaaaactgctcgtggagaaggacatcactttggaggacttcataaccataaaacgcgcataccctggtgcctctggcgagggcttatctcctgtctag

SEQ ID NO: 244569 - DNA, 2133 bp, Artificial Sequence
  Description of Artificial Sequence: Synthetic coding sequence
atggaccaggtggccacgctgagactggaatcagtcgacctgcagtcaagtagaaacaataaggaacatcacacacaggaaatgggagttaaaaggctgacggttaggcggggacaaccgttctacctacgactctccttttctagaccattccagagtcaaaatgaccatattaccttcgtggccgaaaccggcccaaagcccagtgagctgctgggcacccgtgcaaccttttttttgactcgcgttcagcctggcaatgtgtggtcagcttctgacttcactattgatagcaatagtctgcaggtatccttgtttacacccgcaaatgccgtgatagggcactatactctgaaaatcgaaatcagtcaagggcagggccatagcgtaacatacccactggggactttcattctgctgtttaatccatggtcacccgaggacgatgtctatttgccttctgaaattttactccaagaatacatcatgagggattacggctttgtttataagggacacgagaggttcattacctcatggccatggaactacggtcaattcgaagaagatattattgacatctgtttcgagattctgaataagagtttgtaccatttaaaaaatccagctaaagactgttctcagcggaacgacgtggtgtacgtctgcagagtggtgagcgctatgattaactctaacgacgacaacggcgtgctacagggtaattggggtgaagactacagtaagggggtgagccctctcgaatggaaagggagtgtcgccattttgcagcagtggtctgcccgaggaggacagcctgttaagtacggtcagtgttgggtcttcgcttccgttatgtgcaccgtgatgcgatgtctgggggtacccacgcgggtggttagcaattttagatctgctcacaacgtggaccgtaaccttaccatagatacatactacgaccggaacgcagagatgttgtcgactcagaagagggacaagatttggaactttcacgtttggaatgagtgttggatgatccgtaaagacctgcccccagggtacaacgggtggcaggtattagatcccactccacagcagacatcctccggactgttctgctgcgggccagcctctgttaaggccattcgggaaggtgacgtgcatctcgcctacgatactccatttgtatacgccgaggtgaacgcagacgaggtgatatggctcctgggagacggccaagctcaagaaatcctggctcacaataccagcagtatcggtaaggaaatcagcaccaagatggttgggtctgaccaacgtcagtctataacctcttcttacaagtacccagagggttcacccgaggaaagagccgtgttcatgaaggcaagccgaaaaatgctaggaccccagagggcctccctcccctttctcgatcttcttgagtctggagggctcagggatcagcctgcacagctgcagctccatctcgcccgtattccagagtgggggcaggatcttcagttattactgcgtatacagagagttcccgactccactcatcctcgagggcctatcggcctcgtagtcagattctgcgcacaggctctcctgcatggcggaggaacccagaaaccgttctggaggcacaccgtccgaatgaacctagacttcggcaaagagacccagtggccactcctcctcccgtatagcaactacagaaataaattgacggacgaaaagctgatccgggtgagcggcatagccgaggtggaggaaactgggaggtctatgctggtcctcaaggacatctgtctggaacctccacatctcagtatagaagtcagcgaaagagcggaggtggggaaggctctgagagtccatgttacccttaccaatacgctgatggtggcgctatcctcttgcacaatggtcctggagggcagcggcctcatcaatggacagatagcgaaggatcttggaacactcgtggcgggacacaccctacaaattcagctggatctgtatccaaccaaggcagggcctcgccagctgcaggtgcttataagctcaaatgaggtgaaggaaattaaagggtataaggatattttcgtaaccgttgcgggagctccgtag

SEQ ID NO: 244570 - DNA, 846 bp, Artificial Sequence
  Description of Artificial Sequence: Synthetic coding sequence
atgcgttttgttgtggctttagtgctcctgaatgtagctgcagccggagctgtccctctattggcaacagaatcggtgaaacaggaagaagccggtgtacgaccctccgcgggaaatgtatccacccatccctccttgtcacaaagacctggaggcagcaccaagtcacaccccgagccacagacccccaaagactcaccctccaagagtagctcggaggcgcagactaccaaggatgtaccgaataaatccggcgctgacgggcagacccccaaagatgggtcttccaagtccggggcagaggaccaaacgcctaaggacgtccctaacaagtcaggggctgagaagcagacacctaaagacggcagtaacaaatcaggagctgaagagcagggcccaattgatggaccttcaaagagcggagcagaggagcagacaagcaaagacagccccaataaggaagaggttaaatctagtgaacctaccgaggacgtggagcccaaggaagccgaggacgacgatactggtcctgaagagggctccccacccaaggaagagaaagaaaaaatgtctggtagtgccagctctgagaatagagaaggaacgctgagcgacagcaccgggtctgagaaggatgacttgtaccctaacggaagcggcaacgggtctgcggaaagctcgcactttttcgcttacctcgtaacagcagcgattctggtcgccgtgctgtatatcgcccatcacaacaagaggaaaatcattgcttttgttcttgagggtaaacgaagcaaggttacaagaaggccaaaggcatcagactaccaacgtctggaccagaaatcgtag

SEQ ID NO: 244571 - DNA, 1314 bp, Artificial Sequence
  Description of Artificial Sequence: Synthetic coding sequence
atgagattcgttgtagctctggtgttgctcaacgtggctgccgcaggcgctgtcccgttactggctactgagtccgtgaagcaagaagaggcgggagtgagacccagcgcagggaatgtctcgacgcatccttcactgtcccaacgacccggaggatcgaccaagagtcacccagagcctcagacacctaaggactctccttctaagtcctcagccgaggctcagaccccagaggacactcctaacaagtctggggctgaagccaagacacagaaagatagcagtaacaagagtggtgcagaagccaagacgcagaaggggtctactagtaagtccgggtcagaagctcagacaacgaaagatagcacaagcaagtctcacccagagcttcagacacctaaggactcaacaggtaagtcaggggctgaggcccagaccccggaagatagccctaaccggtcgggagcagaggccaagactcagaaggactcaccatctaaatcgggcagcgaagcccagactactaaggacgtcccgaataagtccggggcagatggccagactcccaaggatggctcatcgaagtccggagctgaagaccaaactccgaaggacgttccgaataaaagcggcgctgaaaagcagacccccaaggatgggagtaataagagcggagccgaggagcaagggcctatcgacggacccagtaagagcggggcagaagaacaaaccagcaaagattccccaaataaagttgtaccagagcagcctagtcgaaaggatcacagtaagcccatcagcaatccaagcgacaacaaagaactcccaaaagctgacaccaaccagctagcagacaaaggcaaactgagtccgcacgctttcaagacggagagtggagaagaaaccgatctgatctccccgcctcaggaagaggtaaagtcaagcgaaccaacagaagatgtggagccaaaggaagcagaggacgacgatactggcccagaagagggctcccctccgaaagaggagaaagaaaagatgagtggatccgcctcttcagaaaatagggaggggacacttagcgattccaccggtagtgaaaaggatgacctgtatcccaatggcagcggaaatggaagcgctgagagtagccactttttcgcctacctcgtcactgctgcaatcttagttgcagtcctatacattgctcaccacaataagagaaagattattgcttttgtgcttgaaggtaagcgatctaaagtaacaaggagacccaaggcatctgactatcagcgcttggaccagaaaagctag

SEQ ID NO: 244572 - DNA, 1140 bp, Artificial Sequence
  Description of Artificial Sequence: Synthetic coding sequence
atgcggtttgtcgtggcgctagtccttttgaatgtggccgctgccggagcggtgcctctactcgctacagagtctgtgaagcaagaagaagctggagtccgaccatcagctggtaatgtcagtacacacccctccctctcccagagaccaggcggaagcacgaaatcgcatcctgagcctcagacacctaaggacagtccgagtaagagtagcgctgaagcccagacacctgaggatacacctaacaagagcggcgctgaggctaaaacccagaaggactcatccaacaagagcggagccgaggccaaaacccagaaggggagcactagcaaaagcggaagtgaagcccagaccaccaaagatagcacaagtaagtcacatcccgagttgcagacccctaaagactcgaccgggaaatctggggcagaggcacagacaccagaggattctccaaacaggagcggtgcagaggcaaagacccaaaaggatagtcccagtaaatctggaagcgaagcacaaacaacaaaggatgtgccgaataagtccggagccgacggacagacacccaaggatggtagctcgaaatctggggctgaggatcaaactcctaaagacgtgcctaataagagcggggcagagaagcaaacacccaaggacggttcaaataaaagcggagctgaggagcagggcccaatcgatggaccaagtaagagtggggctgaggagcagacaagcaaggacagcccgaacaaagaagaagtgaaatcttcggagcccaccgaggatgtggagccaaaagaggccgaagatgatgatactggacccgaggagggatcccctcctaaggaagaaaaggagaaaatgagcggttccgcctcatccgagaaccgcgagggaaccctgtctgatagcacaggatcggaaaaggacgatctgtaccccaacgggagcggaaacggctctgcagaaagcagtcatttcttcgcctatcttgtgaccgctgccatactcgttgcggtgctttacatcgcccatcataataagcggaagattattgccttcgtacttgaggggaagcgcagcaaggttactcgacggccaaaggcttcagactatcagcgcctggatcagaaaagctag

SEQ ID NO: 244573 - DNA, 1362 bp, Artificial Sequence
  Description of Artificial Sequence: Synthetic coding sequence
atgaggtttgtcgtggccctcgtgctgctcaatgttgccgctgcgggagctgtcccactcttggccaccgaatctgtgaaacaggaagaggccggagttcgcccatcagctggaaacgtctctacacaccctagtctgagccagcggccaggcggatccaccaagtcacaccccgagccacagactcctaaggacagcccctccaagagctctgctgaggctcagactcctgaggacacacctaacaagagtggggctgaagccaagacgcagaaagacagctccaacaagagtggcgcagaggccaaaacacaaaaagggtcaacctctaagagcggtagtgaagcccaaacaaccaaagacagcacctccaaatcccatcccgaacttcagactcccaaggatagtaccggtaaaagtggggctgaggcccaaaccccagaggactccccaaatcggagtggcgctgaggccaagacccagaaggactctccttcaaagagcggctcagaggcccagactaccaaagacgttcccaacaaaagtggagccgacggtcaaactcctaaggatggttcctccaaaagcggcgctgaggaccagaccccaaaagacgtgcccaataagagtggtgctgagaagcagacgccgaaagacgggtcaaacaagtctggggctgaagagcagggacctattgacggtccctcaaaaagtggcgcagaagagcaaacatcgaaggattccccgaacaaagtggtgccggaacagccatcccgtaaagaccatagcaaaccaataagtaacccaagtgacaataaggagctccctaaagccgacaccaaccagctggctgacaagggcaaactgagtccacatgcttttaaaacggagtcgggtgaggagactgatcttatttctccccctcaggaggaagtcaaaagctcggaaccaaccgaggatgtcgagcctaaggaagcagaggacgatgatacaggacccgaggagggaagtccccctaaggaggagaaggagaagatgagcggcagtgcttccagtgaaaacagagaagggaccctttctgatagcactggatcagaaaaagatgacttatatcccaacggatcagggaacggcagtgccgagtcatcccatttcttcgcttacctcgtgaccgccgcaattctggtcgccgtgttatacatcgctcaccacaacaagcgtaagattatcgctttcgtcttggagggcaagaggagtaaagtgactcgtcgccctaaggcaagtgattaccaaagactcgatcagaagatcttcttcccgctttcccctaatcgaatggtctattcgtctggaaaacgatag

SEQ ID NO: 244574 - DNA, 693 bp, Artificial Sequence
  Description of Artificial Sequence: Synthetic coding sequence
atgtatgtgagagtttcctttgatacaaaacctgatttgttgttgcacctgatgaccaaggaatggcagctcgaactccctaagttgctgatcagcgtccatggtggtcttcagaacttcgaactccagcctaaactcaaacaggtgttcggcaaagggttaatcaaagcagccatgacgaccggcgcttggatcttcactggcggagtcaacactggggtaatacggcacgtgggcgacgccctgaaggaccatgctagtaaaagcaggggcaagatctgtacaattggcatcgcaccctggggcatcgtggagaaccaggaggatctaatcggccgagacgtcgtccggccttaccagacaatgagtaaccccatgtctaagttaaccgtgctaaactccatgcattcccactttatccttgcagataacggaactactgggaagtacggcgcagaggtgaagctgcgtaggcagctggaaaagcacatcagcttgcaaaagataaatactagaattgggcagggcgtgccggtggttgcactgatcgttgagggagggcctaacgtgatctctatcgtgctcgaatacctccgggacactcccccagtgccagtcgtcgtctgtgacgggtccgggcgtgcatcagacatcctggctttcggacataaatactccgaggaaggcggttag

SEQ ID NO: 244575 - DNA, 2520 bp, Artificial Sequence
  Description of Artificial Sequence: Synthetic coding sequence
atgaagaagtggtccagcacagacctgggcgctgccgcagaccccctgcagaaggacacttgcccggatcctctggatggggaccccaatagtagaccgcctcctgctaagcctcagctgtctacagccaagagccggacccgccttttcggaaagggcgattcagaagaggccttcccggtggactgcccccacgaggaaggcgaactggacagttgccctaccattaccgtaagtcctgtgatcaccatccagaggccaggagatggtccaacgggagcccgactgctctcccaggacagcgtggcagcctcgacagagaaaacgctacggctctatgatagaaggagtatttttgaggctgtcgcccaaaacaactgtcaggacctggaaagcctactcttgtttttacaaaagagcaagaaacacctgaccgataatgaatttaaggatcctgaaacggggaaaacgtgcttgctgaaggctatgctgaacctgcacgacggacagaatacaactattcccctgctgttggagatcgcccgacagaccgattccctcaaggaactagtgaacgctagttacacagacagttactacaaaggacagacagcccttcacatcgctatcgagcgcagaaatatggcccttgtaactctgttagtggagaatggagctgacgttcaggccgctgcacacggtgatttttttaagaaaaccaagggaaggccgggtttctattttggcgaactacctttgtcacttgctgcctgtacaaatcagctgggaatcgttaaattcttgcttcagaattcttggcagactgccgacatctcggcgcgagactccgtcggcaatactgtgctgcacgctctcgttgaggtggcggataatacggccgataataccaagtttgttacttccatgtacaacgagattttgatgctcggcgctaaattacaccccaccctgaaactggaggaactgacaaacaagaaaggaatgacacctctagctctggctgccggtacagggaagattggtgtgcttgcctatatcctccagagagaaatccaagagcctgaatgtcgacacctctccaggaaatttactgaatgggcctacggccctgtgcatagttctctttacgaccttagctgcattgacacctgtgagaagaacagcgtactcgaagtcatcgcctactcctccagtgaaacaccaaatagacacgacatgttgctcgtggagccactgaataggctgctccaagacaaatgggaccggttcgtcaagagaatcttttacttcaacttcttggtttactgtctctatatgataatatttaccatggctgcttactatcgaccggtcgatggtctgccaccattcaagatggagaagacaggtgattatttcagagtaactggggagatcttgtcagtgctcgggggagtgtacttttttttccgtggaattcagtattttctccagcgcaggccgtctatgaagacattattcgtggacagctatagtgaaatgctcttcttcctgcagtcactgttcatgttggccaccgtggtcttatattttagccacctgaaggagtacgttgcctctatggtattcagcctcgccttggggtggaccaatatgctgtattacacgaggggctttcagcagatgggcatttatgccgtgatgatcgaaaagatgatcctgagagacctttgtcggtttatgttcgtttacattgtttttctgtttgggttctctacagctgtggtaaccctcatcgaagatggcaaaaacgattctctcccctctgaatctacaagccacagatggcggggaccagcttgcagacctcccgatagctcctataatagcctgtatagcacctgcctagagttgtttaaatttactatcggtatgggagatctcgagttcaccgaaaattatgatttcaaagcagtgttcattatattgttgctcgcttacgtcatcctgacctatatactccttcttaatatgttgattgccctcatgggcgagactgtcaataagattgctcaggagtctaagaatatctggaaactgcagagggccattacaatcctggatacagagaagagtttccttaagtgcatgcgcaaggcctttagaagtggaaagctcctccaagttggctacacacccgacgggaaggatgattacagatggtgtttcagggtagatgaggtgaattggacgacctggaataccaacgtgggaattatcaacgaagatccgggtaactgtgaaggggtgaagcgaacgctttcatttagtctgagatcttcaagggtctcaggccgtcattggaagaattttgccttagtaccgttgttgagggaagcctctgccagagacagacagtcagcacagcccgaagaagtgtatctacgacagttcagtggctccttgaaaccagaggacgccgaagtcttcaaatctcccgcagcaagcggggaaaaatag

SEQ ID NO: 244576 - DNA, 2373 bp, Artificial Sequence
  Description of Artificial Sequence: Synthetic coding sequence
atgaaggcccacccaaaagagatggttcccctgatgggcaagcgggtggcggctccatctggcaaccctgctattctacctgagaagagacccgcagagatcactcccactaagaagtccgcacacttttttctggagatcgagggtttcgaacctaatccaacagtggcaaaaaccagtccccctgtgttttccaaaccaatggacagtaatatccgacagtgcatctccggtaattgcgacgatatggatagtccacagagcccacaagatgacgtcactgaaacacctagcaaccctaatagtccttccgcacagcttgctaaagaagagcagagaagaaagaagaggagactgaaaaaacgaatttttgccgcagtcagcgaagggtgtgtagaagagctggtggagctcttggtggaactccaggagttgtgccgccgtaggcacgatgaagatgtgccggactttttgatgcacaaactaaccgcatctgatactgggaagacatgtttgatgaaagcgttactcaacattaacccgaacactaaggagatagtgagaattctcctcgcatttgctgaggaaaatgatattctaggtaggtttattaacgctgaatacaccgaagaggcctacgaggggcaaacagccttgaacattgctatcgaaagacgccagggggatattgccgctctcctgatcgccgctggcgcagacgtgaacgcccacgccaaaggcgctttctttaatccaaaataccagcacgagggcttttattttggggaaacaccactagccctggctgcttgcaccaatcaacccgagatcgtgcagctgcttatggagcacgaacaaacggacattacttcaagagacagccggggaaataatatcctgcacgccttagtaactgtggccgaggatttcaaaacccagaacgacttcgtgaagcggatgtacgatatgatccttctcagaagcggcaattgggaactggagactacccgaaataacgatgggctgactcctctccaattggcagccaagatgggtaaagctgaaattttgaaatatatactctctcgggagattaaggagaagaggcttcgctctctgtctcgcaagtttactgattgggcgtacgggcctgtgtccagctctttgtatgacctcactaacgtggatactaccaccgataatagcgtgctggaaattactgtctacaataccaatatcgataaccgccacgaaatgttgaccctggagcccctgcacactctgctgcatatgaagtggaagaagttcgcaaagcacatgtttttcctttcattctgtttctacttcttttacaacataactttgactctggtgtcttactatcgtcctagggaggaagaggccataccacacccgctagccctgacccataagatgggctggcttcagctgctagggcgtatgtttgttctgatttgggcaatgtgtatttcagtgaaggagggcatcgcgatttttctgctacgacccagcgatttgcagtccattctcagcgacgcttggtttcattttgtcttcttcatccaggccgtgctggttattttaagcgtgtttctgtacttgttcgcctataaagagtacctggcttgcctggtcctcgcaatggcactcggatgggcaaatatgctctattataccaggggatttcagagcatggggatgtacagtgtgatgatccagaaagtgattttgcacgacgtgctgaagtttttgttcgtgtatattgtatttctcttaggattcggcgtggctctggctagccttattgagaagtgtcccaaggacaataaggactgctcttcctacggttccttttcagatgcagtgttggagctgtttaagttgacgattgggttaggagatctgaacattcagcagaattctaaatatccaattctgtttctattcctgctgattacgtatgtaatcctgaccttcgtccttctgcttaacatgctcatcgccttaatgggcgaaaccgtggaaaatgtgtccaaggagtcagaacgtatctggcgtttgcagagggccagaactattcttgaattcgagaagatgctcccagagtggctgcggagcaggtttcggatgggagaactgtgcaaggtggctgaggacgactttagactctgcttacgaattaatgaagtgaagtggacagagtggaagacccacgtatcttttttgaatgaagatcctggcccagtgcggagaaccgattttaataagatccaggacagctccaggaacaattccaagaccacattgaacgcttttgaagaggtggaagagttccctgagacctccgtttag

SEQ ID NO: 244577 - DNA, 3360 bp, Artificial Sequence
  Description of Artificial Sequence: Synthetic coding sequence
atgaaaaggagtctgagaaagatgtggcggccaggcgaaaaaaaggaaccacagggagtcgtttatgaggatgttccagacgacacagaggacttcaaagagtccttaaaggttgtgtttgaaggctccgcctacgggcttcagaactttaataagcagaagaagctgaaacggtgtgatgacatggatacattctttctgcattacgccgctgcggagggccagattgaacttatggagaaaattactagagactctagtttagaagttctacacgaaatggacgactacggtaataccccactgcactgcgcagtcgaaaaaaaccaaattgagagtgttaaatttttgttatcaaggggcgctaacccaaatttgcgtaactttaatatgatggccccactacatatcgcagtgcagggaatgaataacgaagtaatgaaagttctactggaacatagaaccatcgacgtcaacctcgaaggtgagaacgggaacaccgccgttataattgcctgtaccaccaacaattctgaagccctgcaaattctgctgaagaaaggcgcaaaaccttgtaaatcaaacaaatgggggtgcttccccatccatcaagccgctttttcaggctccaaggaatgcatggaaattattctgagattcggcgaggaacacggctatagcaggcagttacatatcaactttatgaacaatgggaaagctactcctctccacctagcagttcagaacggcgaccttgaaatgataaagatgtgtcttgacaacggagcccagatcgatcccgttgaaaaaggacgatgtaccgcaattcatttcgccgctacccagggtgcaaccgaaatagtgaagctcatgattagctcctattccggctcagtggatatagtcaacaccaccgacggttgccacgaaactatgcttcacagagcaagcctgtttgatcatcacgagctggccgactaccttatctcggttggcgcagacatcaacaaaatcgatagcgaagggcgttctccgctcattcttgcaactgccagcgcgtcttggaacatagtcaatctcttactgtctaaaggagcgcaggtggatattaaggataacttcgggcgaaatttcctgcacctgaccgtgcagcagccttatggattaaaaaaccttcgacctgagttcatgcagatgcagcagataaaggagctcgtaatggacgaggacaacgacggatgtacgccactgcattatgcatgcagacagggaggcccagggagcgtcaacaatttgcttggctttaatgtttcgatacatagcaaaagcaaagacaaaaagtctcctctgcacttcgcagccagctacggacggatcaacacttgtcagagactgctgcaggacatttcagacactaggctcctgaacgagggtgaccttcatggtatgaccccacttcatctcgcggcaaaaaacgggcacgacaaagtggttcagcttctgctgaagaaaggagcactttttctgtctgatcacaacggctggactgctttacatcatgccagcatgggtggctatacccaaacgatgaaagtaatccttgacacaaacctgaaatgcactgaccggctcgatgaagatggcaacaccgcactccacttcgcggctcgcgaaggacacgctaaggccgtcgccctcttgcttagccacaacgccgatattgtcctaaataagcaacaggcaagtttcctgcacttggccctgcataacaagcgaaaagaggtggtgctaacaatcatccggagtaagcggtgggatgagtgtctgaaaattttctctcacaatagcccaggcaataaatgtcctattaccgagatgattgagtatctcccagagtgtatgaaagttttactggacttttgtatgctccattcaacggaagacaagagctgtcgggactattacatagaatataattttaagtacttgcaatgcccccttgagttcacaaagaagacgcctacgcaggacgttatctacgagcccctgaccgccctgaatgccatggtacaaaacaaccgcatcgagctcttgaaccaccctgtctgtaaggagtatctcctgatgaaatggcttgcctacggctttcgagcccacatgatgaatctcgggtcgtattgcctgggtttgattcctatgacaatcctggtggttaacattaaacccggaatggccttcaattctaccgggatcatcaatgaaacctccgaccactctgaaatcttggacaccaccaattcttatctcattaagacttgcatgatcctcgtatttctttcttcaatcttcggttactgcaaggaggcgggacaaatctttcaacagaaacggaattacttcatggatatctccaacgtactggagtggataatttatacaacgggcattatttttgtattgccactgttcgtcgagataccagctcacctgcagtggcagtgcggagctatagcagtgtacttctactggatgaactttcttctatatttacaacggtttgaaaattgcggaatattcatcgtcatgctcgaagtaattcttaagactctcctcagaagcaccgtggtctttatctttctgctcttggcattcggactctcgttctatatcctgctaaatctacaggacccctttagcagtccccttctttctatcattcagacgttcagtatgatgctgggggacattaactaccgcgaaagttttctggagccctatctaaggaatgaactagcccacccagtcctgagcttcgctcagctagtgagctttaccatttttgtgccgatcgtgcttatgaatctgctgatcgggctggctgtaggcgacatagctgaagtgcagaaacacgcaagtctgaagaggatagctatgcaggtggaactccatacatctctggaaaaaaagctgccactgtggttcttacgtaaggtggaccagaaatctaccattgtgtatccgaacaagccaaggtcaggcggaatgctgttccacatattctgctttctgttctgcacgggcgagatccgtcaggagatccccaacgcggacaagtccctcgagatggagatcctgaagcagaaatatcgtctgaaagacctaacgttcctgttggaaaagcagcacgagctgatcaaactgattatccagaaaatggagattatcagcgagaccgaagacgatgactctcactgctcctttcaggacagattcaaaaaagagcaaatggagcagaggaactcacggtggaacactgtccttcgggctgtaaaggcaaagacgcaccacctggaaccctag

SEQ ID NO: 244578 - DNA, 2280 bp, Artificial Sequence
  Description of Artificial Sequence: Synthetic coding sequence
atgatggccgcattgtatccatctaccgatctgtcaggtgcctcctcctctagcctgccatcctcaccaagttcgtccagccccaatgaagtgatggcccttaaggacgtacgtgaggtaaaggaagagaataccctgaacgagaaactgtttttactcgcgtgcgataagggagactattatatggtcaaaaaaatcctcgaagagaactccagtggcgatctgaatatcaactgcgtggatgtgcttgggaggaatgccgtcacgatcactatcgagaacgaaaacctggatatcctccagctcctgttagactatgggtgccagaagctcatggaacgcatccagaacccagagtattctacaacaatggatgtggcccctgttatccttgctgcccacaggaataattacgaaattcttaccatgcttctcaagcaggatgtcagcctgcctaaaccacacgcagtggggtgcgaatgcacactgtgttcagcaaaaaacaagaaggatagtctgcgccatagtagattccggctggatatctaccgttgcctcgcctcccccgcactcatcatgttgaccgaagaagaccccatcctgagagcgtttgagctgtccgcagatctgaaagaactttcactggtggaagtggaattccgaaatgactatgaagagctggctcgtcagtgcaaaatgttcgctaaggatctcctggcccaggcgcgaaactctagagagttggaggtgattctgaatcacactagcagtgatgaaccgctagacaagcggggacttctggaggaacgcatgaatctttctaggctgaaactggctataaagtataatcagaaagaattcgtgagtcagtctaattgccaacagttcctgaataccgtatggttcggccagatgagtggctacaggagaaagccaacgtgcaagaaaatcatgactgtcctgaccgtcggcattttttggcctgtgctgagcctatgctacttgatcgccccaaaatctcaattcggcagaatcattcatactccattcatgaaatttatcatacatggggcatcctatttcactttcctcctccttttaaatctgtactccctcgtctacaacgaggataaaaaaaacaccatgggccctgcgctcgagcgcatcgattacctactaatcctctggataatcggcatgatatggtccgatattaaaagactttggtatgagggactggaggatttcctggaagaaagcagaaaccaactgtcctttgtcatgaattcgctgtaccttgctacatttgcgttaaaagttgttgcacacaataaatttcacgattttgcggataggaaggattgggacgccttccatcctacccttgttgcagaaggcctgtttgcattcgccaacgtgctgtcctatttgagactgttctttatgtacactacatcgtctattttgggtcccctgcagataagcatgggtcaaatgctgcaggatttcgggaagttcctgggtatgtttctgctggtgcttttcagtttcactatcggactcactcagctctacgacaaggggtataccagcaaggaacagaaagattgcgtggggatattctgtgagcagcagagcaatgatacgtttcactcctttatcggcacctgtttcgcgctattttggtacattttcagcctggcccatgtggcaatctttgtgactaggttcagttacggggaagagttgcaatcttttgtgggtgccgtcattgttggcacatacaacgtggttgtggtgatcgtgctcactaagctgctggtggcgatgctccataagtcttttcagttgattgctaatcacgaggacaaagagtggaagttcgcccgagcaaaattgtggctgtcatatttcgatgacaagtgtacactccctcctccgtttaacataatccctagcccaaaaacaatttgctacatgatctcatcactgtccaagtggatttgctctcatacctcaaagggcaaagtgaaacgccagaactcactgaaagaatggcgtaacctcaagcagaagcgagatgagaattatcaaaaggtgatgtgctgcctggtgcacaggtacctgacatctatgcgccaaaagatgcagagcacggaccaggctactgtggagaatcttaatgaacttcgccaggatcttagcaagtttcgcaacgaaattcgggatctcctgggctttagaacgtctaagtatgccatgttctatcctagaaactag

SEQ ID NO: 244579 - DNA, 435 bp, Artificial Sequence
  Description of Artificial Sequence: Synthetic coding sequence
atgatctggtccgacataaaacggctgtggtacgaagggctcgaagatttcctggaagaaagcaggaaccagctgagtttcgtgatgaacagcctgtaccttgctacttttgctctgaaggttgtggcccataataagatctcaatgggccagatgctgcaagacttcgggaaattcctcggtatgttcctcctcgtgctcttctcgtttacaattggtctgacgcagctgtatgataaaggctatacctctaaggagcaaaaggactgtgtgggcatattctgcgagcagcagtctaacgacacgtttcattcttttattggtacatgttttgccctgttctggtatatattctctttggcgcatgtagccattttcgtgacaagattttcttacggcgaagaactgcagtcctttgtcggcgcagtcatttag

SEQ ID NO: 244580 - DNA, 2382 bp, Artificial Sequence
  Description of Artificial Sequence: Synthetic coding sequence
atgatggccgctttataccctagtacggacctgtctggcgcatcaagctctagcctgccatcatccccctcctccagtagtcccaatgaagtgatggccctcaaagatgtccgggaagtgaaggaagagaatactctgaatgaaaagttgttcttactggcctgcgataaaggcgattactacatggtcaaaaaaatactcgaggaaaacagttccggggatctcaatattaattgcgtggatgtgctagggcgaaacgccgtcacaattaccatcgaaaacgagaaccttgacatcctacagttgctgctcgattacgggtgtcaatccgcagacgccttgttggtggctatcgacagtgaagttgttggcgctgtcgatattttgctgaaccatcgcccaaaacgaagtagccggccaaccattgtcaaactaatggaaaggatccagaaccctgagtactcgaccacaatggatgtagctcccgtgatcttggcagcccaccggaataattacgagattttgactatgctgctgaaacaggacgtaagcctaccgaagccacacgccgtgggctgcgagtgcacgttgtgctccgctaagaacaaaaaggatagcctgcgacacagccgctttcggctggatatatataggtgtcttgcttcgcctgccttaattatgctcacagaggaagaccccatattgcgggctttcgagttgtcagctgacttaaaagagttatccctggttgaggtggagttccgcaatgactatgaggaattagctcgacagtgtaagatgtttgccaaggacctgctggcccaggctagaaacagccgcgagttggaggtcattttgaaccacacctcatcagatgagcctttagacaaaaggggacttcttgaggaacggatgaacctgtcacggctcaaactcgctattaaatataatcaaaaagagtttgtctcacagagcaattgccagcagtttctcaacactgtctggttcgggcagatgagcggatatcgtcgaaaaccaacctgtaagaagataatgaccgtgctgacagttgggatcttctggcctgtactgtccctgtgctacttgatcgctcccaagagtcagttcgggcgaatcattcatactccttttatgaaattcatcatacacggagccagttatttcacatttctgcttctgcttaatctttattctttggtctataatgaagacaaaaagaacactatgggtccagccctcgagcgaattgattacctgcttatcctatggattatcggcatgatttggtcggacataaagcggctgtggtacgagggtctcgaggacttcctagaagagagccgcaaccagctttcttttgttatgaactccttgtatctagcaactttcgccctgaaggtcgttgcccacaataagtttcatgacttcgcggatcgcaaggattgggacgcgtttcaccccactttggttgccgaaggcctcttcgcatttgctaacgtgctctcctatctccggctgttttttatgtatactacttctagtatcctcgggccactgcagattagtatgggccagatgctgcaggacttcggcaaattcttggggatgtttctgttggttcttttctcttttaccattgggttgacccaactctatgacaagggttacacaagtaaggagcaaaaggattgcgtcggtatattctgcgaacaacagtcaaatgacaccttccattcatttataggcacctgttttgccctattctggtacatattttcactggcacatgtcgccatatttgtcactcgattttcgtatggcgaagagctgcagtcctttgtcggggcagtcatcgtaggtacctacaacgttgtagtggtgattgttctcacaaagcttctagtggcgatgctccataaaagttttcagttgatcgccaaccatgaggataaagagtggaaattcgcaagggctaaactgtggctgtcctatttcgatgataagtgtacactcccaccccctttcaacattattccatcccctaaaacaatctgctatatgatctcgtctctgtctaagtggatctgctctcacacgtctaagggtaaagtgaaaagacagaactccttgaaggagtggcgcaacttgaaacaaaagcgcgatgagaattaccaaaaagttatgtgttgtctggttcaccggtacctcaccagcatgagacagaaaatgcagagcacagaccaggctacggtcgaaaacctgaacgagcttcggcaggacctgagcaagttccgtaacgagatcagagatctcctgggtttccggacatcaaagtatgccatgttctaccctcgtaactag

SEQ ID NO: 244581 - DNA, 2415 bp, Artificial Sequence
  Description of Artificial Sequence: Synthetic coding sequence
atggcccagttctactataaaagaaatgttaatgcaccttacagagacaggatccccctacggatcgtaagggcagaaagcgagctcagcccttccgagaaggcctatctcaatgccgtggagaaaggcgattatgcctccgtgaagaaaagcctggaggaagccgaaatctattttaagatcaacatcaactgtattgacccgttgggtcgcaccgccctgttgatcgctatcgaaaacgagaacctcgagttgattgagttgcttctgtcctttaacgtttatgtgggagatgcgctgttgcatgctatcagaaaagaggtggtgggcgctgttgagctcttgctcaatcacaagaagccatcaggggagaagcagtttgtggcccagcccaattgtcagcagttgttggcaagtagatggtacgatgagtttcccggatggcgaaggagacattgggccgtgaagatggtgacctgctttataatcggactgctgttcccagtgttctccgtgtgttacctgattgcccctaagagcccccttgggctgttcattcggaagcccttcatcaagttcatctgccatactgcgtcatatcttacctttttgtttcttctgctacttgcatctcagcacattgatcgcagtgacctaaacaggcaaggaccaccaccgacaattgtcgaatggatgatcctgccctgggtgcttggcttcatctggggagagatcaagcaaatgtgggatgggggtctgcaggattatatccacgactggtggaacctcatggattttgttatgaattcactgtatctagcaacaatttccttgaaaatcgtcgcttttgtcaaatacagcgcgctgaaccccagggaaagctgggatatgtggcaccctaccctcgtcgcagaggctttgtttgccattgccaatatcttcagtagcttacgcctcataagcttattcaccgccaattcacacttggggccactccagatctccctgggcaggatgctcctggatatcctgaagtttctgtttatttattgcctggtgctgctggcttttgccaacggcctcaaccaactctacttttattatgaagaaacgaaggggcttacatgcaaaggaatccgttgtgaaaaacaaaacaacgcgtttagtaccctgtttgagacgctgcaatccttattctggtctattttcgggctcatcaatctatatgtgaccaatgtcaaggcacaacacgagttcaccgaattcgttggcgctacaatgtttgggacctacaacgtgatctccctggttgtcctccttaatatgctcattgcgatgatgaacaactcctaccagttgattgcagaccatgccgatatcgagtggaagtttgctaggactaaactgtggatgtcctacttcgaggaaggaggaactctgcctaccccgtttaatgtcatcccctctccaaagtcactgtggtacctgattaaatggatatggacacatctttgcaagaagaagatgcgcaggaagcccgagtcgtttggtaccatcggcagacgtgccgcagataacctgaggagacatcaccaatatcaggaggttatgcgcaacttagtgaaacggtacgtcgcagccatgattagggatgcaaagaccgaagaaggtctgaccgaggagaacttcaaggaacttaagcaggatatctcgtctttccgtttcgaggttcttggactactccgaggaagtaagctgtcaaccattcagtctgccaacgccagcaaggaaagcagtaattccgccgattcagacgaaaagagtgattcagaagggaactcaaaggacaagaagaagaacttttccctttttgacctgactacactgatccaccctcgcagcgcagccattgcttcagagcgccataatataagtaatggttccgcattagtggttcaggaacctccgagagagaagcaacggaaggtgaacttcgtaaccgacatcaaaaatttcggactgttccacagaagaagcaagcagaatgccgctgaacagaatgcaaatcagatattttcagtgtcagaggaagtggccagacagcaagctgccggacctttggagcggaatatacagctggagtcaagggggctggcttctcgtggagaccttagcatccccggactctcggaacagtgcgtgcttgtggaccaccgggagcgcaatactgatacattgggactgcaagtgggcaagcgtgtgtgtcctttcaaatccgaaaaagtggtcgtggaagacaccgtacctataattcccaaggagaagcatgcaaaggaggaggattcatctatcgattacgatctcaatctgccggacacagtgacccatgaggattatgtcacaactcgcctttag

SEQ ID NO: 244582 - DNA, 2511 bp, Artificial Sequence
  Description of Artificial Sequence: Synthetic coding sequence
atggcacagttctattacaagaggaacgtaaacgccccatacagggaccgcattcctctccgcatcgtcagagccgagtcagagctaagtccatctgaaaaagcataccttaacgctgtggaaaagggggactacgcgtccgtgaaaaagagtctcgaagaagcagagatctatttcaagatcaatattaactgtattgatcctctgggcagaaccgctttgctgatcgccatagaaaatgaaaacctggaattaattgaactactgttatcttttaacgtgtacgtgggcgacgccctcctgcatgcaatcaggaaagaagttgttggagcagtggagcttttgctcaatcacaagaagccttctggagaaaagcaggtgccgccaattctcttggataaacagttcagcgaattcacaccagatatcacaccgatcatccttgccgctcataccaataactatgagataataaaattattagtgcaaaagggagtcagtgttcccaggccccatgaggtacggtgcaactgtgttgagtgcgtgagttctagcgatgtggacagcctccggcattcacggtccagattgaatatatacaaggcactggctagtcctagcctgatcgcattgtcttctgaagatcctttcttaacggccttccagctctcatgggagctgcaggagctttcaaaggtggagaatgagttcaaatcggagtatgaagagttgagcagacagtgcaagcagttcgctaaggatctgctcgatcagaccagatcatcacgcgaactggagattattcttaactatcgagacgacaattcactcatcgaggagcagagcggcaatgatctagcacgtctgaaactggcgattaaatatagacagaaagaattcgtggcccagcccaattgtcagcagctgttggcctcacgatggtacgacgagttccccggttggcgcagaaggcactgggccgtgaaaatggttacctgcttcatcatcgggctgttattcccggtattcagtgtctgctacctcattgcacctaaaagtccactggggctgttcatccgtaaacctttcattaagtttatctgccatacagctagctatctcacctttttatttttgctgttgctcgcttctcagcatatcgaccgttcagacctgaatagacaggggccacctcccactatcgtcgaatggatgatcctcccatgggtgctaggattcatttggggtgaaatcaagcagatgtgggacggcggtctgcaggattacatccacgattggtggaatctcatggacttcgtcatgaacagtctttacctcgcaaccatctctcttaagatagtcgcctttgtgaagtactctgccctcaatccaagagagtcttgggatatgtggcatccaaccctggttgccgaggccctgtttgcgatcgccaacatattctcctctttgcgtctaatatccctgttcaccgccaactctcacttggggcctctccaaatttcattgggacgtatgctactggatatactgaagttcctctttatctattgccttgtcttgctcgcattcgcaaacgggctgaatcagctctacttctattatgaggagaccaagggattgacatgtaagggcataagatgcgagaaacaaaataatgcattttccactctcttcgaaaccctgcagtcgctgttctggtccattttcggactgatcaacctgtacgtcaccaacgtcaaggcccagcatgagtttaccgaatttgtcggcgctaccatgtttggcacttacaacgtaatctctctggtagtactcctcaatatgctaattgccatgatgaataacagttatcagttgattgcagaccacgctgatatcgaatggaagtttgctaggacaaaactgtggatgtcctactttgaggaaggcggaacattaccaacaccgttcaatgtaatccctagtccaaagtctctttggtatttgattaagtggatctggactcacctgtgcaaaaagaagatgcgcagaaagcccgagagttttggtacaattgggaggagagccgcagataacctacggagacatcaccagtatcaagaggtcatgcgtaacctggtgaagaggtatgtggctgccatgatacgcgacgcaaagacagaggaggtcgctcgacagcaggctgctgggccactcgaaagaaacattcaactggagagccggggacttgctagtcggggagatctctctataccaggacttagtgagcaatgcgtcttagtcgatcatagggaacgcaatacagacaccctgggcctacaggtgggcaagcgggtgtgcccatttaagtctgagaaagtggtggtggaggatactgtgcctataattcctaaggaaaagcatgcaaaggaggaggacagttcaattgactacgatctgaacctcccagacacagttacacacgaggactacgtgaccacccgcctttag

SEQ ID NO: 244583 - DNA, 2682 bp, Artificial Sequence
  Description of Artificial Sequence: Synthetic coding sequence
atggcgcagttttactataaaagaaacgtcaatgcaccataccgggatagaatcccactgagaatagttcgcgctgaatctgagctctccccgtcagagaaagcttatctgaatgcagtcgagaagggcgattacgcttctgtcaagaaatctttggaggaggccgaaatctattttaaaattaatattaattgcattgatcctttgggtaggacagctttgctgatcgcgatcgaaaacgagaacctggagctgatcgaattacttctcagctttaacgtgtacgtgggcgacgctctgcttcatgccatccgcaaggaggtcgtcggagccgtcgagctcctgctgaatcacaagaaaccttcaggtgagaaacaggtaccacctattcttctggacaaacagttttccgagtttacccctgatattacacctatcatactcgcagcacatacaaacaactacgagatcatcaaattgttagtacagaagggagtctcagttcccaggccccatgaggtgagatgcaactgtgttgagtgcgtgagtagctccgacgtcgactcgctgagacactcaaggagtcgcctcaacatttacaaagcattggcatcgccatcgcttattgcgttgtcaagtgaagacccgttcctcacagccttccagctgagctgggaactgcaggaactgtccaaggtggaaaacgagttcaaatccgagtacgaagagctgtcgagacagtgcaagcagtttgccaaagacctcttggatcagacgaggtccagccgggagctcgagatcatattgaattaccgcgacgataactctctgattgaagagcagagcggcaacgacctcgccaggctcaagctggctatcaagtaccgccagaaagaattcgtggcccaaccaaactgccagcagttattagcttctaggtggtatgacgaattcccgggatggcgacgcagacattgggcagtgaagatggttacatgtttcatcatcggtctgttgttccccgtttttagtgtctgttatttgatcgccccaaagtcgccactgggcctctttatcagaaagccttttataaagtttatctgtcacaccgcctcctacctgacattcctgtttcttctgctcctggcttcccaacatatcgacaggagcgatctcaaccgacagggtccaccgcctactattgtggagtggatgattctcccttgggtccttggcttcatatggggcgagatcaagcagatgtgggacggaggcctccaggactatatacacgactggtggaatttaatggattttgtaatgaactccctatacctggctaccatctctctgaaaatcgtcgcattcgttaagtacagcgccctgaatcccagagaaagctgggacatgtggcaccccacccttgtggccgaggcactgtttgcgatcgctaacatcttttctagcctgcggcttatctcccttttcaccgcgaattcccacctgggcccactccagatttcgctcggacgtatgttactggatatcctcaaatttctcttcatttattgtttggtgctgctcgcgtttgctaatggccttaatcagctctacttttactacgaggagacaaagggcctgacctgtaaaggaataaggtgtgagaaacagaataacgcatttagtaccctgttcgagacactgcagagcttgttttggtccattttcggcctgatcaacttatacgtcaccaacgtcaaagcacagcatgagttcaccgagttcgtaggtgccaccatgttcgggacatataacgtgatcagcctggttgttctgctcaacatgctaatcgccatgatgaacaactcgtatcagcttatagccgatcacgccgatatcgagtggaagtttgccagaaccaaactgtggatgtcctatttcgaggagggtgggaccttgccaacccctttcaatgtcattcccagtccaaaaagcctgtggtacttaatcaagtggatatggacccacttatgtaaaaagaaaatgcgcaggaaaccagagagttttggcactataggcaggagagccgctgataacctgagaaggcaccaccagtaccaagaagtgatgcgtaacctggtcaagcggtatgtagcagccatgatacgagatgccaagacagaagaggggctgaccgaggaaaactttaaggaactgaaacaggatatctctagttttaggttcgaagtcttgggccttctgagggggtctaagctgagcactattcagagcgctaatgcgagtaaagagtcaagcaatagcgctgacagtgacgaaaaatcagattctgaggaagaggtcgctcggcagcaggctgccggtccactggagcgcaacattcaactcgaatcgcgagggctcgcttcccgcggagacctcagtatcccgggacttagcgagcagtgcgtgctggtcgatcaccgcgagaggaatactgacactttgggccttcaagtgggcaaacgcgtgtgcccattcaaaagcgagaaagtggtggtagaggatacagtccccatcattcccaaagaaaaacacgctaaagaagaagattctagtatcgattacgacctcaatctgcctgatacagtgacccacgaggactacgtgaccacccgcctgtag

SEQ ID NO: 244584 - DNA, 2487 bp, Artificial Sequence
  Description of Artificial Sequence: Synthetic coding sequence
atggcccagttctattacaagaggaatgtgaacgctccttatcgagatagaatccccctacgaatcgtgcgggctgaatctgagttaagtccctcagagaaggcctatctgaatgctgtggaaaagggggactacgcatcagtcaagaagtcattggaagaggccgagatttattttaaaattaatatcaattgcatagatccattaggaagaactgccctgctcattgccatcgagaacgagaatttagaactcatcgaattactgctgtcgttcaacgtctatgtgggtgatgccctgctccacgccattcgcaaggaggttgtgggagctgtcgaactgctactgaatcataagaaacccagcggtgaaaagcaagtccctcctatcctgctggataagcaattttcagaattcactcctgatattaccccaatcatcctcgcggcacatactaacaactacgaaattataaaactgctcgtgcagaaaggcgtcagcgtgcctcgaccccatgaagtgagatgtaattgcgtcgaatgtgtgtcctccagcgacgtcgatagcttgcgccattcccgcagtagattgaacatctacaaagcactggctagcccctccctgatagcattatcgagcgaggacccattcttaactgccttccagctctcctgggaacttcaggagctctcaaaagttgagaacgagtttaaatctgaatatgaggaactgagtcggcaatgcaaacagttcgccaaggacctgcttgatcagacccgctcttctagagaactagaaatcattctgaactatcgggatgataattctttgatcgaagaacagtctgggaacgacctagccagactgaagctagcaattaaatatagacaaaaggagtttgtggctcagcctaactgccagcaattgctcgcctcccgctggtatgacgaattccccggttggaggcgtagacactgggcagtgaaaatggtaacctgtttcatcatcggcctcctgttcccagtgtttagtgtgtgctatcttatcgccccaaaaagtcctctaggtttgttcattaggaaaccattcatcaagtttatttgtcacacagcctcctatctgacttttttattcctcttactgctggcttcccagcacatcgacaggagcgatcttaatcggcagggccctcctcctacaattgtggagtggatgattctaccatgggttctggggttcatatggggtgaaatcaaacagatgtgggatggcggactacaggactacattcatgattggtggaatttgatggactttgtcatgaacagcctgtatcttgcgacgatatccttgaagatcgtggctttcgtaaaatattcagctctgaaccccagagagtcctgggacatgtggcatcccacattagtggcagaagccctctttgcaatcgctaatattttctctagtctgcggcttatctccctgttcactgctaattcacatttggggcctctacagatttctcttggacgcatgctgttagatattctgaagtttctgtttatttattgtctggttttactggctttcgcaaacggccttaatcagctgtacttctattacgaggagacaaagggactcacctgcaaaggaatccgatgcgaaaaacagaataatgcctttagtacacttttcgagaccctgcagtctcttttctggagcatattcggcctaattaacttgtacgtaaccaatgtgaaagcccaacatgagtttacggagtttgtcggcgctactatgttcgggacttataacgtgatttccctggtggtactgctaaatatgctcattgccatgatgaataactcgtatcagttgatcgcgagaagggccgcagacaacctccgcagacatcaccaatatcaggaggtgatgcggaacctggttaagagatacgttgctgccatgatacgcgatgcgaaaaccgaggaggggctgaccgaagagaacttcaaagaactgaagcaagatatctcctcattccgattcgaagttttgggcctcttgcgaggatccaaactttccactatacaaagcgctaatgcctctaaagagagttccaactccgccgacagtgatgagaagtctgattccgaagaagaggtcgcgaggcaacaagctgccggaccattagagcggaatattcagttggagagcagaggacttgcttctaggggagatctttctatacccggattgagcgaacaatgtgtcttggtggatcatcgggaaagaaataccgatacgctcggattgcaggtgggaaaacgtgtgtgcccctttaagtctgagaaggttgtcgtggaggatacagtgccaatcatacctaaagagaaacatgctaaggaagaagacagctccattgattacgacctgaacctgccagacaccgttactcatgaggactatgtcactacccgcctctag

SEQ ID NO: 244585 - DNA, 2415 bp, Artificial Sequence
  Description of Artificial Sequence: Synthetic coding sequence
atggctcagttttactataagcggaatgtcaacgcgccttatagggatcgtatacctttacgaatcgtacgtgctgaaagcgagctatcaccaagtgagaaagcctatttaaacgccgtagagaaaggagattatgcatccgtgaagaagagcctggaggaagcagagatttattttaaaatcaacataaactgtatcgacccattaggcagaactgctctattaatcgcaattgagaacgagaacctcgagctaatagagctgctgctgtcctttaacgtgtacgtgggggatgccttgctgcacgcgattagaaaagaagttgttggggctgtggagttattgttgaatcataaaaagccatccggtgagaagcagttcgtggctcaacccaattgccagcagctgttagccagtaggtggtacgatgaatttcctggttggagaaggagacattgggccgtgaaaatggtcacctgctttatcatcggactcctgttcccggtgttctccgtgtgttatctgattgcacccaagtcaccactgggcttattcatccgcaagccctttatcaagttcatctgccatactgcctcttatctcacattcctcttcctccttctcctggcgagccagcatattgaccggagcgacctgaaccgccaggggccaccccctacaatcgtagagtggatgatcctcccttgggttctaggtttcatttggggcgaaatcaaacagatgtgggatggtggtctccaggattatatccacgactggtggaatctgatggactttgtcatgaattccttatatctggctacaataagtctgaaaattgttgctttcgtgaagtacagcgccctaaaccccagagaaagctgggatatgtggcatcctactctggtggccgaagcgctttttgcaatcgccaacatcttttcttcattgagactaatctctctgtttaccgcaaatagtcatctcgggcctcttcagattagcctggggaggatgcttcttgatattttgaaattcctatttatttactgtttggtgttgttagctttcgcgaatgggttgaaccagctctatttttattatgaagagaccaaggggctgacctgcaagggtattcggtgcgagaagcaaaacaacgccttcagcacacttttcgagactctccaatcattattttggtcaatctttgggctaattaacttatacgtgaccaacgttaaggcacaacacgagtttaccgaattcgttggggctacaatgtttggaacttacaacgttatcagccttgtggttcttctaaatatgttgattgctatgatgaacaatagctaccagttgatcgcggaccatgccgacatcgagtggaaattcgccaggacaaaactgtggatgtcctacttcgaagaaggaggaacattgccgacgcccttcaacgtgatccccagtcctaaatccctctggtacctgatcaagtggatttggactcatttgtgcaagaagaagatgagacgcaagcccgagagtttcgggaccattgggcgtagggctgccgacaatctgagacggcaccaccagtaccaggaagtcatgaggaacctggtgaaacgctacgttgccgctatgatccgtgacgcaaaaacagaagagggtttgaccgaggagaactttaaggagctcaaacaggatatctctagcttccgattcgaagtgctcgggctgttgcgcggatccaaacttagtaccatccagtccgctaatgcctctaaggaatcctcaaatagcgccgattcagacgagaagtccgacagtgaggggaacagtaaggataaaaagaagaacttcagcctgttcgacttgactaccttgatacatcccagaagtgcagctatcgcctccgaaagacacaacatttctaatggcagtgctctggtcgttcaggagccccctcgggagaaacaacgcaaagtgaacttcgtaaccgacatcaaaaattttgggttgttccacaggcggtcaaagcagaacgccgctgaacagaatgccaatcagatttttagtgtctcagaggaggtggccaggcagcaggccgcaggcccactcgaacgaaacattcagctggaaagccggggtcttgcctcccgaggggatctcagcattccgggtctgagcgaacaatgcgttctggtcgatcaccgagagcgtaatactgatacgctcggtctgcaggtcgggaaaagggtatgccccttcaagagtgagaaggtggtcgttgaggacacagtgccaataatccccaaggaaaaacacgcaaaggaagaagattcctctatagattatgatttgaacctaccagatacagttacacacgaagactacgtgacgacacggctgtag

SEQ ID NO: 244586 - DNA, 2949 bp, Artificial Sequence
  Description of Artificial Sequence: Synthetic coding sequence
atggcccagttttactataaaaggaacgtgaacgctccgtaccgggatcgaattccactccgcatagttagagctgagtcagaactgagcccgtctgagaaggcttatttgaatgccgtggagaaaggagattatgcctccgttaagaaatctctagaggaggctgaaatttacttcaagatcaatatcaattgtatcgaccccttaggccgaacagccctgctgattgccatagagaacgagaacttggagcttatagagctgctccttagctttaacgtatatgtaggtgatgccctgctgcatgccatccgtaaagaagtcgtgggggctgtggagttactcttaaaccataagaaaccatccggcgagaagcaggtacctcctatcctcttggacaagcaattctctgagtttacacctgacattaccccaatcatcctagccgctcatactaataattatgaaatcatcaagctgctggtgcagaaaggggtatccgtgcctagaccgcacgaagtgcggtgcaactgtgttgagtgcgtgtctagttctgatgttgacagcctgaggcatagccgcagtaggctcaatatttataaggctctggctagcccttcccttattgctctttcctcagaagacccgttcctaacggcattccagctatcgtgggagctccaagaactcagcaaagtggagaatgaatttaagagcgaatacgaggaattatcaaggcaatgcaagcagttcgccaaggatctgctggaccagactaggtcatcccgagagctggaaattatactgaactatagggacgataactcgctgatcgaagaacagtctgggaacgacctcgcacgattaaagctcgccatcaagtaccgacagaaggagtttgtggcccagcccaactgccagcagctcctcgcatcccggtggtatgacgaattcccagggtggaggagacgtcattgggctgtcaaaatggtcacctgttttattattggcctactattccctgttttttcggtctgttacctcattgcgcctaagtctcctctggggctgttcattaggaagcccttcatcaagtttatttgccataccgcttcttacctcacgtttctgtttcttctgcttctggcttcacagcatatcgaccgctccgacctgaacaggcaagggcctccacccacaatcgtggagtggatgatactgccttgggtgctcgggtttatatggggagaaattaaacaaatgtgggacgggggtctgcaggactacattcacgactggtggaacctgatggacttcgtcatgaactcactgtatctggccaccatatctctgaagatcgttgccttcgtgaagtattcagccttgaatccccgtgaaagctgggatatgtggcatccgacactcgtcgccgaagcactgtttgctatagcaaacatttttagctctctcaggctcatctccctctttacagccaacagtcatcttggacccttacagatcagtttggggcgaatgctgcttgacatcctgaaattcttgtttatctactgcctggtgcttttagcgttcgcaaacggactgaatcagctctatttttattatgaggagacaaagggtctaacttgcaaggggattagatgtgagaagcagaacaacgcatttagtacattgtttgagacacttcaaagtcttttttggtcaatttttgggctcattaatttgtacgtgactaacgtgaaggcccaacatgagtttacagagttcgttggagcgactatgttcgggacgtacaatgtgatctctctcgttgttctgctcaatatgctgattgctatgatgaataattcctaccaacttatcgcagaccacgccgacatcgaatggaaatttgcacgcaccaaactctggatgtcatatttcgaggaggggggaaccctgcccacaccttttaacgtgataccgtcgccaaaaagtctgtggtatcttatcaaatggatatggactcacctgtgtaagaagaagatgcgccgtaagcccgagagcttcggaacaattggggttcggacccagcatcgtagggctgccgataacctccggagacaccatcagtaccaggaagtgatgcggaaccttgtgaaacggtacgtggccgcaatgatccgagatgccaagaccgaggagggcctgacagaagaaaatttcaaagagctcaaacaggatatctctagctttcggtttgaagtgctcggtttgctgcggggatctaaacttagtacgatccagagtgcgaacgcgtccaaggagtcctccaattctgccgactccgatgagaaaagcgatagtgagggcaactccaaggacaagaagaagaactttagcctatttgacctcaccaccctgatccaccctcgcagcgcagctatagcctcagagagacacaacattagtaatggttccgctctcgtggtccaggaacccccacgcgagaaacaacgcaaagtcaatttcgtgacagatatcaagaatttcggactcttccaccggagatccaagcagaacgccgctgaacaaaacgccaaccaaatcttttccgtgtcagaagaagtggcaagacagcaggctgctggcccactggagcgcaacattcagctggagagccgaggccttgcaagccggggagatttgtctatccctgggttaagcgaacagtgtgtgttggtagatcatagagagcgaaacacggataccctcggtctgcaggtcggtaagcgggtgtgcccatttaagagcgaaaaagtcgtcgtggaagacaccgtccccattattcctaaagagaagcatgccaaggaggaggactctagcatagactatgacttgaatttacctgataccgttactcacgaggactatgtcaccactcggctctag

SEQ ID NO: 244587 - DNA, 2934 bp, Artificial Sequence
  Description of Artificial Sequence: Synthetic coding sequence
atggctcaattctactataagcgcaacgtaaacgccccataccgagacaggataccacttcgcatcgtgcgcgcagagagcgaactgagccctagtgagaaggcctacctgaacgccgtagaaaagggtgactacgcctccgtaaagaaatccctggaggaggcggagatctacttcaagatcaatatcaactgcattgatccattgggtcgaactgcattgttaatcgccatcgaaaacgaaaatttagagctgattgaactgctgctgtcgttcaatgtgtacgtcggagatgccctgttacacgctattcggaaagaagtggtcggcgcagtggaattactgttaaatcacaaaaaaccgtccggtgagaaacaggtgcccccaatactgctggacaagcagttttcagagttcactccagacatcacccctattatcctggccgctcacaccaacaattatgaaattattaagctattagtacagaagggtgtcagcgtgccccgtccacacgaggtgcgctgtaactgtgtggaatgcgttagttcatctgatgtagacagcctacggcactcgaggagcaggctcaacatctataaagctctggcatccccgtctttgattgctctgtcttcagaagaccctttcctgacagcgttccaactgagttgggagctccaggaactctccaaagtggaaaatgagttcaagtctgagtatgaggagctgtctcgccaatgtaagcagtttgccaaggacctgttggaccaaaccaggagcagccgagaattggaaatcatcttaaactacagggacgacaatagccttatcgaggaacagtccggcaacgatctggcacgtctgaaactcgctatcaaataccgccagaaagagtttgtggcacaaccgaattgccagcagctcctcgcctctcgctggtatgacgagtttcccggttggcgcaggcgccactgggcggtgaaaatggtaacctgtttcatcatcgggctattgttccctgtgttctctgtgtgttacctgatcgcacccaaatctcccctagggcttttcatccggaagcccttcattaaattcatatgccatacggcatcctatctgacatttttgtttctcctgcttcttgcctcgcagcatatcgaccgaagcgaccttaataggcagggtcccccaccaacaattgttgagtggatgattctgccatgggtgctgggattcatttggggggagatcaaacaaatgtgggatggtggcctgcaggactacattcatgactggtggaacctgatggactttgtcatgaattctctctacttagcaacgatctcattgaaaatcgtggcttttgtcaaatatagtgcactcaatccacgggagtcatgggacatgtggcacccaacactggtcgccgaagccctgtttgccattgccaacatcttttcctccctgcgactcatttccctttttaccgcaaactcacacctcggcccactccagatttcattagggagaatgctgcttgacatcctgaagtttctgttcatatattgcctggtactgttggctttcgctaatgggctgaaccaactgtatttctactatgaagaaactaagggcttgacctgcaaaggaatcagatgcgagaaacagaataacgctttctctactttatttgaaaccctgcagtctttgttttggtcaattttcggactaattaacctgtacgtgaccaatgtgaaggcccaacatgagttcacggagttcgtgggagctacaatgtttggcacttataacgtaatctctctggttgtgcttctgaatatgttgattgccatgatgaacaattcatatcagctgatcgccgatcatgcagatatagagtggaagttcgcacggacgaaactttggatgagttactttgaggaaggcggaacactacccactcctttcaatgtcattcccagcccgaagagcctatggtatctaataaaatggatttggacacacttatgcaaaaagaagatgcgtcgcaaacctgaatcattcggtacgataggacgccgagccgcagacaatctgcgacgccaccaccagtaccaagaggtcatgagaaatttagttaaacgatacgtggctgctatgattcgggacgcaaagaccgaggagggactgactgaagagaatttcaaggaactgaaacaggatatatcttccttccgatttgaggttctcggacttctgcgaggctctaaattatcaacaatccagtctgccaacgccagcaaggagtcctctaattcggcggactctgatgagaagagtgattcggaaggcaacagcaaggataaaaagaagaacttttcgctgtttgatctcacgacactgattcatccacgctccgccgctattgcatccgagcgtcataacatatcaaatggcagcgccctggttgtccaggaaccgccacgagaaaaacaacgcaaggtgaatttcgtgaccgatatcaaaaatttcggactctttcacagacggagcaaacagaacgccgcagagcaaaatgctaaccagatttttagcgtgtctgaagaagtcgccagacagcaggcagccggacctttggaacgaaatatccagttagagagtcggggtctggcttctcgcggagatctgtccattcccggactttccgagcagtgcgtcctggtcgatcatcgggagaggaacacagataccctcggattgcaggttggaaagagggtgtgcccattcaaatccgaaaaggtcgttgtagaggacaccgtgccaatcattccaaaggaaaagcatgcgaaggaggaagactccagtattgattatgacttgaaccttcccgacacggtcacccacgaggattacgtgactaccagactttag

SEQ ID NO: 244588 - DNA, 1383 bp, Artificial Sequence
  Description of Artificial Sequence: Synthetic coding sequence
atggcccaattttactacaagaggaacgtgaatgctccttatagagacagaatcccactgagaattgtgcgagcagaatctgagctcagcccctcagaaaaggcatatctgaacgctgtcgaaaagggcgattacgccagcgtaaaaaagagccttgaagaagcggaaatatatttcaaaatcaacattaattgcatcgatccccttgggagaacagccctcctaattgcgatcgagaacgaaaatctggagttgatcgagctgcttctatcttttaacgtctacgttggggacgccctgctccacgctattcgtaaagaagtggtcggtgccgtggaactgctcctgaatcacaaaaagccgagtggcgagaagcaagtccctcctatcctgctcgataagcagttcagcgaattcaccccagacatcacccccataatccttgccgcacacacgaataactatgaaatcatcaaactactagttcaaaagggagttagcgtgcctaggcctcacgaggtcagatgcaactgtgttgagtgtgtctctagctcagatgtggatagcctcagacatagccgatccagactcaatatctataaggccttggcttccccaagccttattgctctcagctccgaagacccttttcttaccgctttccagctgagctgggagctgcaggagctgtccaaggtcgaaaatgaatttaagtccgaatatgaggaactgtcgagacagtgtaagcagtttgccaaggatctactggaccaaacaagaagttcaagagaactcgaaatcatcctgaattaccgtgacgataacagcctgattgaagaacagagcggcaatgatttggctagactgaagttggctatcaagtatcgccagaaggagtttgttgctcagccaaattgtcagcagttgttggctagcaggtggtatgacgagtttcccggatggcggagacgccattgggccgttaagatggtgacctgttttataattgggctgctgttccctgtgtttagcgtttgctacctgatagcccctaaaagtccgctgggtctgtttatccgtaagccttttatcaaatttatttgccacactgcctcctaccttaccttcctgtttcttctgctcctggcgagccaacacatcgaccgctcagatctcaaccggcaaggcccacccccaaccatcgtggagtggatgatcctcccctgggtcctaggttttatatggggtgagattaagcagatgtgggacggcggtcttcaggactacatacatgattggtggaatctgatggacttcgtcatgaactctttgtatctagctactatttcgcttaagatcgtagcatttgtgaaggtgatctag

SEQ ID NO: 244589 - DNA, 2511 bp, Artificial Sequence
  Description of Artificial Sequence: Synthetic coding sequence
atggcccagttttactataagcgcaatgtaaacgcaccttatagagatcggatccccctcagaattgttagggccgagagcgagctatccccaagcgagaaagcttacctgaatgcagttgagaaaggtgattacgcatcagtgaaaaagagtctggaggaagccgaaatatactttaaaattaatatcaactgtattgacccactcggcaggaccgcgctcttaatcgctattgaaaacgagaacctggaactcattgaactgttactctccttcaacgtctatgtcggcgacgctctgctccatgccatccgaaaggaggttgtgggtgccgttgagctgttgctgaaccacaaaaaaccttccggagagaaacaggtgccccctattctgcttgataaacagttttcggagtttacccccgacatcacccccattattttagctgctcacaccaacaactacgagataatcaagctactggtgcagaagggcgtgagtgttccgaggccccacgaagttagatgtaactgcgtggaatgtgtaagttcatctgatgtagattccttgcgccattcacgatcaaggctcaacatatataaggcgttagctagtccatcattgatcgcactctctagtgaagatccattcctgacggcgttccagttgagctgggaacttcaagagttgagcaaagtagagaatgagttcaagagcgaatatgaggagctttcgaggcaatgtaaacaatttgcgaaggacctgcttgatcagactcggtcatcacgcgaactggaaattattctcaactatcgggatgacaattctctaatagaggagcagagtggcaacgatctagctcgacttaagctggcaattaaatatcgacagaaggagttcgtggctcagcctaattgtcagcagctgctggcttcaaggtggtacgatgaatttcccggatggcggaggcggcattgggctgtcaaaatggtaacctgtttcataattggccttctttttcctgtgttttcagtctgttacttgatcgcacccaagtctcccctcggcctgttcatcagaaaaccgtttatcaaattcatatgccataccgcgtcatatcttaccttcctgtttctgcttctgctggcaagtcagcatatcgacaggtccgatctcaatcgccaggggccacccccaactattgtggaatggatgatccttccctgggtgctgggtttcatctggggcgagattaagcagatgtgggacggaggtctgcaggattatatccacgactggtggaaccttatggatttcgtgatgaatagcctgtacctggccacaatcagccttaagattgtcgcctttgttaagtactctgcactgaaccctagggaaagctgggatatgtggcaccctaccctagttgcggaagccctcttcgccatcgcaaatattttctcatctctgcgcttaatcagcctgtttacggctaactcacatttggggccactccaaatatctcttggacgcatgctgctggacatattaaagtttctgtttatctactgcctggtgctcctcgcattcgcaaacggactgaaccaactgtacttctactatgaagagaccaaaggcctcacctgcaaagggatacggtgcgagaaacagaacaacgcttttagcaccctgtttgagacattacagagcctattttggagcatctttgggttgataaacctgtacgtgaccaatgtgaaagcccagcatgagtttaccgaatttgtgggagctacaatgttcgggacctataacgtaatcagtttagtggtactgttgaatatgctcattgccatgatgaataattcatatcagttaatcgccgatcatgcagacatcgagtggaaatttgctcggacaaaactgtggatgtcctatttcgaggagggtggaacacttcctacaccatttaatgtcatcccaagtcctaaatcattgtggtacctgattaagtggatctggacacatctgtgcaaaaaaaagatgcgcagaaagccagaatccttcggaaccattggaaggcgcgcagctgacaacctacgcagacatcaccagtaccaggaggtgatgcgtaatctggtaaagcgctacgtggcagccatgattcgggatgccaagaccgaggaggtcgccagacaacaggctgcaggccctctcgagcggaacatccagcttgagtcacggggactcgcctctcgaggcgatctgtctatccctggcctgtccgaacagtgcgtcttggtggaccaccgggaacgcaataccgacacactgggactccaggttgggaagcgcgtctgtccctttaaatccgaaaaggttgtggtggaggacacagtgcccataatccccaaggaaaagcacgccaaagaggaggattcatccatcgactacgacctaaatttacctgacaccgtgactcacgaagattatgtcaccacccgactttag

SEQ ID NO: 244590 - DNA, 2394 bp, Artificial Sequence
  Description of Artificial Sequence: Synthetic coding sequence
atggctgctgccccagttgctgccggttcgggcgcaggaagaggaagaaggtctgcagccaccgtagcagcctggggcggttggggcggaaggcccagacctggcaatattcttttacaactgaggcaaggccagctcacaggtcggggattagtcagagccgtgcaatttacggaaacgtttctcacagaacgggataaacagtccaagtggtctggaatcccccagctgctcctgaagctacacacaacgtcccacttgcacagcgattttgtcgagtgtcagaacattctgaaggagatctcccccctcctcagtatggaagcaatggcatttgtcaccgaggaacgcaagctgacccaggaaaccacgtaccctaacacatacattttcgaccttttcggtggcgtggatctcctcgttgaaattttaatgcgaccgacaattagcattaggggacagaagcttaagatcagcgacgagatgtccaaagactgcttgtctatattgtataacacttgcgtctgcacagagggggtgactaagaggctggctgaaaaaaatgatttcgtcatatttctgttcacgctgatgacaagcaagaagacctttctccaaactgccacgttgatcgaggacattctgggagtgaagaaagaaatgattcggttagatgaggtacctaacctgtccagtctggtctccaacttcgatcagcagcagctggctaatttttgtcggatcctggctgtcactatttcagaaatggacaccgggaatgacgacaagcacaccctactggcaaagaacgctcaacagaagaaaagcctgtccctcgggccttcagcagccgaaattaatcaagctgccctcctctccattcctggtttcgtcgagcggttgtgcaagctagccacgcgcaaggtgtccgagagtaccggcaccgcctcattcctacaggagctagaggagtggtacacatggttagacaacgctctcgtattggacgccctaatgagagtagcaaacgaagaatctgaacacaaccaggccagtattgtgtttccaccccctggcgcaagcgaggagaacgggctgcctcacacaagtgcgagaacccagctgcctcagtcaatgaagattatgcatgagataatgtacaaactcgaggtgttatatgtgctgtgcgtgcttctcatggggagacagagaaaccaagtgcataggatgattgcggagtttaagcttattcccggactaaacaacctgttcgataagcttatttggagaaagcacagcgccagtgccctggtactgcacggccataaccaaaactgtgactgcagccccgacataacgctgaagattcagtttcttcgactgctgcagtctttttcagaccatcacgagaacaaatacctgttattaaacaaccaggagctcaatgagctttccgccatctctctcaaagccaacatacctgaagtggaggcagttctgaacaccgaccgcagccttgtatgtgatggaaagagaggcctgctgaccaggctcctccaggtgatgaagaaagaacccgctgagtcctcattcagattttggcaggcaagggctgtggaatcgttccttagggggacaacctcttatgccgatcaaatgttccttctcaagcggggacttttggaacacattctgtattgcatcgtggacagcgagtgtaaatccagagatgtcctccaaagttattttgatctgctaggagaactgatgaagttcaacgtggacgctttcaagagatttaacaaatacatcaataccgacgccaaattccaggtgtttcttaagcaaattaactcatctctggtggatagcaacatgcttgtccggtgcgtgactttgtctttagacagattcgagaatcaggtggacatgaaggttgctgaagtgctctcagagtgccggctgctagcgtacatatctcaagtgcctactcaaatgtcatttctattcagattgatcaacatcatccatgtgcagacacttacacaggaaaacgtcagttgcctgaatacatcattggtgattcttatgctggcccgaaggaaggagcgccttccgctgtacctccgccttcttcagaggatggagcactctaagaagtaccctgggttcctgctcaataattttcacaacttactccgcttctggcagcagcattacctgcataaggacaaagattccacatgtctggagaattcgagctgtatatccttctcttattggaaggaaactgtgtctatcttgttaaatcctgatcggcagtctccgagcgctctcgtcagttatatcgaggagccatatatggatattgatcgagattttaccgaagaatag

SEQ ID NO: 244591 - DNA, 2277 bp, Artificial Sequence
  Description of Artificial Sequence: Synthetic coding sequence
atggccgctgccccagtggctgccggatcaggggcaggtagaggcagaaggtccgccgctacggtcgctgcctggggcggttgggggggtcggccaagacctggtaacatcctgctgcagcttagacagggccaactgaccggccgaggcctggtgagggccgtacaattcaccgagacgtttctcacagagcgggacaaacaatcaaaatggagcggcatcccacagctgctgctgaagctgcacactacatcgcatttacactctgattttgtcgagtgtcagaacattcttaagctcctcgtcgaaatcctcatgaggccgacaatctcaatacggggacagaagctaaagatatctgatgaaatgtctaaagattgccttagtatcctgtataacacctgcgtgtgcacagagggcgtaaccaaaagactggcagagaagaatgatttcgtcatctttctcttcactctgatgaccagtaagaagacctttcttcagacagctacactgattgaggatatcctcggagtgaagaaagaaatgatccggctggatgaggtgccgaacctcagctccctcgtgtccaacttcgaccaacagcagctggcgaatttttgccgcatcctcgcggtaaccatttcggaaatggacactggaaacgacgataagcacacccttctagctaaaaacgcccaacagaagaaatccctgtcccttggcccatcggctgctgagatcaatcaggccgctctactttccattcctggatttgttgagagactgtgcaaattagcgaccagaaaggtttctgagtcgacaggaaccgcgagtttccttcaggaactggaggaatggtatacctggctcgacaacgcgctggtgctcgatgctctgatgagggtcgcaaacgaagagtccgagcacaaccaagcttcaattgtctttccgccacccggtgcatccgaggaaaatggccttccacacacttctgctcgaacccagctgccacaatctatgaagataatgcacgaaatcatgtataaactcgaggtgctttacgtcctttgcgtccttctgatgggaagacagcgcaatcaggttcacaggatgatcgccgaattcaaacttattcctggtttgaacaacctgttcgataaactgatctggaggaaacatagtgcttctgcactagtgttacatggacacaaccaaaattgtgattgctcacctgatataactttaaaaatacagttcctcaggcttctgcaaagctttagtgaccatcacgagaataagtaccttctcctaaataatcaggagcttaacgagctgagcgccatcagtctgaaggctaacattcccgaggtggaggctgtgcttaacactgaccgaagcctcgtgtgtgatggcaagagaggacttttgacacggctattgcaagttatgaagaaggaacccgcagagtccagcttccggttctggcaggccagagcagttgagtccttcttgcggggaaccacatcctatgctgaccaaatgttcctacttaaacgcggactgctggagcatatcctttattgtattgtcgactcggagtgtaaatcacgagatgtgcttcagagctatttcgacctacttggagaactaatgaagttcaacgtggacgcatttaagaggttcaacaagtacatcaataccgacgcaaaatttcaggtgtttctaaaacagattaattcctcgttggtggacagcaatatgctggtgcgatgcgtcacactgtccctggatcgcttcgagaaccaggttgacatgaaggtcgccgaggtcctaagcgagtgccgccttctagcctacatctcccaagtgcctacgcagatgagttttctattcagactgataaatatcatccacgtgcagaccctcacgcaggaaaacgtgtcctgccttaacacttcgctcgtgatcctcatgctggcacggaggaaagagcggcttcctctgtatctgcgactgttacaacgcatggaacactcaaaaaaatacccaggattccttttgaataacttccacaatctgctgcgtttttggcagcaacactatcttcacaaagataaggactcaacatgtctggagaacagtagttgcatctcattcagctactggaaagagacagtcagcattctgctaaaccccgacagacagtcacccagcgctttagtatcctatatcgaggagccttatatggatattgaccgggatttcacagaggagtag

SEQ ID NO: 244592 - DNA, 2370 bp, Artificial Sequence
  Description of Artificial Sequence: Synthetic coding sequence
atggcagcggcacctgtggcagccggtagtggggctgggcgaggacggaggagcgcagcgaccgttgccgcttggggcggttgggggggacggcctaggccaggtaatattctactgcagttgcgacaaggccaactgacgggcagagggcttgtgagggccgtgcagttcacagaaacctttctgaccgagagagataagcagagcaaatggagcggaattccccagctgctgctgaagctccacaccacttctcacttgcattcggatttcgtggaatgtcagaacattctgaaggaaatttctcctctgctgtctatggaagcgatggccttcgtgacagaagagcgtaaattgacacaggaaaccacataccctaacacgtacatcttcgacctattcggcggagttgatctactcgttgagatcctcatgagaccaaccatttcaatcagagggcagaaacttaagatttcagatgagatgagcaaagattgcttaagcatactctataacacttgtgtgtgtacagaaggcgtaacaaaacgcctggcagagaagaacgatttcgtgatctttttgttcacgctgatgacatccaagaagacctttctccaaaccgctacattgatcgaggatattctcggcgtcaaaaaggagatgattcggcttgacgaggtacctaacttgtcatccttagtgagcaattttgaccaacagcagttagctaacttctgccggatacttgccgtaacaatttctgaaatggatacaggcaacgatgataagcacacactcttggccaaaaacgcacagcaaaagaagagcctctcattggggccatcagcggcagaaattaatcaggcagccctgctgtcaatccctgggttcgtggagaggctatgtaaattagcgacccggaaggttagtgagtcaacgggcaccgcatcattccttcaggaacttgaagaatggtacacatggctggacaatgccttagtgctggacgcccttatgcgcgtggccaatgaggagtcagaacacaatcagggggcttccgaggagaacggtctcccccacacgagcgccaggactcagttaccccagagcatgaaaattatgcacgaaatcatgtacaaattagaggtgctttacgtcttgtgtgttctgctgatgggccgacagcggaaccaagtacatcgtatgattgccgagtttaagctgatccccggtctaaacaacttgtttgataaactgatttggaggaaacatagcgcatcagctctggtccttcatgggcacaaccagaactgcgactgttcccccgacatcaccttaaagatacagttcctgcgtttattgcagtcgtttagtgatcatcatgagaacaaatatctgctgctcaacaaccaagagctcaatgagctctcggcaatctccctcaaagctaatatcccagaggtggaagccgtgctgaacaccgaccggtccctggtatgcgacggcaagagaggcctgttgacgcgacttctccaggtgatgaagaaagagcccgcagaaagctcatttcggttttggcaggcccgtgccgtcgaatccttccttcgaggaaccacaagttatgctgatcagatgttccttctgaaacgcggacttttggagcacatattgtactgtattgtcgattcagagtgcaagtccagggacgtgttacagtcttattttgatttgctgggtgagctgatgaagttcaacgtcgacgcctttaagcgattcaacaaatacatcaacactgatgccaagttccaggtgtttttaaaacagatcaatagcagcctggtcgattctaatatgctggtgagatgtgtgaccctgagcctcgatagatttgagaaccaggtagacatgaaagttgccgaggttttatctgagtgcagactgcttgcttacatctcgcaggtccccacccagatgagcttcctgtttcggttgataaatatcattcacgtgcagacacttacacaggagaacgtaagctgcctgaatacgagccttgtgattctgatgctggctagacggaaggagcgcctgcccctttatctccggctgctccagcggatggagcatagtaagaagtacccaggtttcctgttaaacaacttccacaacttgctcagattttggcagcagcactatctacataaagacaaagacagtacttgcttagagaattcgtcgtgtattagtttctcctattggaaggaaactgtgtcgatactccttaaccctgataggcagtctccatccgcactggtctcctacattgaagaaccttatatggacatcgatcgagattttaccgaggaatag

SEQ ID NO: 244593 - DNA, 1200 bp, Artificial Sequence
  Description of Artificial Sequence: Synthetic coding sequence
atgaggtctcagagtacaataaaggtccataggatgatcgcagaatttaagctgatccccggactcaacaacctgttcgacaaactgatttggagaaaacacagtgccagtgcactagtcctgcatggccacaatcaaaattgtgactgttcacctgatataaccctaaaaattcagttccttagactgctgcaaagtttctcagatcaccacgagaacaagtatctgctcctcaataaccaagaactcaatgaattgagcgctatcagcctgaaggctaacatccctgaagtcgaggcggtactgaatactgatagatctctggtatgtgacggcaagagaggattgctgactcggctgctgcaggtgatgaagaaggagcctgccgaatcaagcttccgattctggcaagcccgtgctgtggaatcgtttctgcggggaaccacttcctatgccgatcagatgtttttgctgaaaagagggctactggagcacatcctctactgtatcgttgactccgagtgcaaatcaagggacgttcttcagagttactttgatctactgggcgaattgatgaagttcaacgtggacgccttcaagagatttaataagtacatcaatactgatgccaaatttcaagtgttcctaaaacagattaactcttctcttgtcgacagcaatatgctggtacgctgcgtcactttatcacttgaccgtttcgagaaccaggttgatatgaaagtggccgaagtgctgagtgagtgtagactcctggcgtatattagccaggtgcccacacagatgagcttcctgtttaggctaattaatataatccatgttcagacattaacccaagaaaacgtgtcctgcctgaacacgtccctggtgattctgatgctggccaggcgcaaggagcgactgcccctctacttacgattgcttcagcgcatggaacattctaagaagtaccctgggtttctgctcaataacttccacaaccttctacgcttctggcaacagcactatctccacaaggacaaagattcgacttgtctcgaaaacagctcctgcattagcttttcttattggaaggagaccgtgagcattttattgaaccccgaccggcagtccccgtctgcacttgtgtcatatatcgaggagccttacatggacatcgatagggacttcaccgaagaatag

SEQ ID NO: 244594 - DNA, 2349 bp, Artificial Sequence
  Description of Artificial Sequence: Synthetic coding sequence
atggccgcagctccagttgcggctgggtccggggcaggtcggggtaggaggtcagccgctaccgtggccgcttggggcggatggggccagctgacaggccgaggtctcgtgagggctgttcagttcacagagacgtttttaacggaaagggacaagcagtcaaaatggtccggcatcccgcaactgctgctgaagctccacacaacttcccatctgcacagtgattttgttgagtgccaaaatatcctcaaggaaatcagcccactcctctccatggaagcaatggcttttgtcacggaagaacgcaaactgacacaggagacaacctatccaaacacttatatatttgatctgttcggaggagtggatctcctagtcgaaatcctgatgcgacctacgatatcaatccgaggtcaaaagcttaaaatcagcgacgagatgagtaaggactgcttatccatcctgtacaacacttgcgtttgtacagagggggtcacaaagcgcctagccgaaaaaaacgacttcgtgatattcctctttactttgatgacctctaagaaaacattcttacaaacggctacactgattgaagatatcctgggggtaaaaaaggaaatgatacgcctggacgaggttcccaacctaagtagtttggtgtccaactttgatcagcaacagctcgccaatttttgtaggatcttggccgtcacaatttctgaaatggacaccgggaacgatgacaaacatactcttctagccaagaatgcacagcagaaaaagtccctttctttggggcctagcgctgccgagatcaaccaagctgctctgctttcaatccctggattcgtggaacgcctgtgtaagctggcaacccggaaggtaagcgaaagtactgggactgcatccttcctccaggaactggaagaatggtatacctggttagataacgccctggtgctggatgccctgatgagagtcgctaacgaagaatcagaacacaaccaggcgtcaattgtcttccctccacctggcgcttccgaagagaacggcctgcctcacacctcggcccgaacccaactgccacaatcaatgaaaattatgcacgagatcatgtacaaactggaagtgctttacgtcttgtgtgtactcctcatgggaagacaaaggaatcaggttcataggatgatcgccgagttcaagctgattcccggtctgaacaacctgttcgataagctcatctggagaaaacactcagcttccgcgctggtattgcacggccataatcagaactgcgattgcagccctgatatcaccctcaaaatccagttcctgaggttgcttcagtcattttccgaccaccacgagaacaagtacctgcttctcaacaatcaggagcttaacgagctctccgcaattagtctgaaggccaatatccccgaagtggaagctgtactcaacacagaccgttctttggtctgcgacggtaaaagaggcttactcacaaggctactccaggtgatgaaaaaggagcccgcagaatcctctttccgattctggcaggctcgggctgtggagagcttcctgcgcggtacaacatcctacgctgaccagatgtttttgctgaagagaggcttattggagcatatcttatattgcatcgtggactccgagtgcaagtctcgggatgtactgcagtcatatttcgacctcctcggagaactgatgaagttcaacgtggatgcattcaagaggtttaacaaatacatcaacactgacgccaagttccaggtttttctgaaacaaattaacagctctctggtggactccaatatgctggtcaggtgtgtgaccctgagcctcgatagattcgaaaaccaagtggatatgaaagtggcagaagtcctgagcgaatgccggctgttggcatacatttctcaggtgccaacacagatgtctttcttgttcaggctgattaatataattcacgtccagactttgacgcaagagaatgtctcttgtcttaatacgtccctcgtgatcctgatgctagccagaagaaaggagcggctaccactctacttgcgacttctgcagagaatggagcacagcaagaagtacccaggtttcctgttaaacaacttccataatctgttgcgattctggcaacagcattatttgcataaggacaaagactcaacctgtttagagaacagcagttgcatatcattctcttattggaaagagaccgtaagcatccttttgaaccccgacagacagtccccaagcgctctggttagctatatagaagagccttatatggacattgatcgagactttaccgaagaatag

SEQ ID NO: 244595 - DNA, 2922 bp, Artificial Sequence
  Description of Artificial Sequence: Synthetic coding sequence
atggcacaactgtattataaaaaggttaattattcgccctacagagacaggatccccctgcaaatcgtcagggctgagacggagctctcagctgaggagaaagcctttctaaatgcagtcgagaaaggcgactacgctaccgtcaagcaagccttgcaggaggcagagatttactacaatgttaatatcaactgcatggatcccctgggccgatctgcactgctgattgccatagagaacgaaaaccttgagattatggaacttctgctgaaccactctgtctacgtgggggatgctcttctgtatgctatccgcaaagaggttgtgggggctgtggaactactcctgtcctatcggaggccaagcggagaaaagcaggtaccaaccctcatgatggacactcagttctccgaatttacaccggacataacccctatcatgttagccgcacatacaaacaattatgagattatcaaactactagttcagaagagggtaaccataccaaggccccaccagattagatgcaactgtgtggaatgcgtgagcagcagcgaagttgacagtctccgccattctagaagcaggctgaacatctacaaggcgctggcctccccctcactaatcgcactgtcctccgaggaccctatcttaactgcctttcgactggggtgggaactgaaggaactgtccaaggtcgagaacgagttcaaagccgaatatgaagagctgagccagcagtgcaaactattcgccaaagatctcctcgaccaggcccgttcgtcccgggagctcgagattatcttaaaccaccgagatgatcacagtgaggaattggacccgcagaaataccacgaccttgcaaagctaaaagttgccattaagtaccaccagaaggaatttgtggcccagccgaattgtcagcagctgctggccaccctgtggtatgatggcttccccggttggaggcggaagcactgggtggttaagttactgacatgtatgactatagggtttctctttcccatgctgtctattgcctatctcatttcccctcgctcaaacctggggctgttcatcaagaaaccatttattaagtttatttgtcacactgcctcgtatctgacatttttgtttatgcttctgcttgcgagtcagcacattgtgagaactgatttgcacgtccaggggcctccccctaccgtggtggagtggatgattctgccatgggtacttggctttatctggggggagattaaagaaatgtgggatggcggttttaccgagtatatccatgattggtggaatctaatggattttgccatgaacagcctgtatctggctaccatctctctaaagatagtcgcctatgttaagtacaatgggtcacgaccgcgtgaagagtgggaaatgtggcacccaactttaatcgccgaagccctcttcgctatttccaatatcttgtcctccctgagactgataagcctcttcaccgccaacagccacttaggacctctgcagatttcactcggaaggatgcttcttgatatcctcaaattcctgtttatatactgcttagtcctgctcgccttcgctaatggtctgaatcagctctatttttactatgaaacacgggctattgacgaaccaaataattgcaaaggcattcggtgtgagaaacagaacaatgctttttccacgctgttcgaaacactgcaaagcctgttttggagtgtgtttggattgctgaacttatacgtcaccaatgtaaaggcacggcacgaattcacagagttcgtcggtgcaaccatgtttggtacatataatgtgatctccttggtcgtgctcctcaatatgctcattgcgatgatgaataacagctaccagcttattgcggatcacgccgacatagaatggaaattcgcacgcactaaactctggatgtcctacttcgacgagggcggaaccctgccacctcctttcaatatcattccttcccccaagagctttctatacctgggcaattggttcaacaataccttttgcccaaagagggatccggacggcagacgtcgaaggagaaacctgagaagcttcaccgagagaaatgctgattcattgattcagaatcaacattaccaggaagtgatacgcaatttggtaaaaaggtatgttgctgctatgattagaaactccaaaactcatgaggggttgaccgaagagaactttaaggaactgaaacaggatattagctctttcaggtacgaagtgctggatcttctggggaatcggaagcatccccgatcgttttctacctcttctaccgagttgtcacaaagagatgataataatgatggatccgggggagcccgagcaaagagcaagtcggtgtccttcaaccttggatgtaagaagaaaacctgtcacgggccaccccttatccggacaatgcccaggtctagtggggcacaagggaagagcaaggccgaaagcagctcaaaacgctcctttatgggcccatctcttaaaaaactgggactcctcttcagcaagttcaacggccacatgtctgaaccaagctccgaacccatgtataccatttctgacggtatagtacaacagcactgtatgtggcaagatattaggtactcgcagatggaaaagggcaaggccgaagcttgcagccagtcagagattaacctgtccgaagtagaactgggggaggtccaaggagctgcccagtctagcgagtgccctttggcttgttcatcatctctgcactgtgccagctccatctgctcctccaacagcaagctgctcgactctagcgaagacgtcttcgagacatggggcgaggcctgcgacttgttgatgcacaagtggggagacggtcaggaagaacaagttactaccagactatag

SEQ ID NO: 244596 - DNA, 2796 bp, Artificial Sequence
  Description of Artificial Sequence: Synthetic coding sequence
atgtctcaatcacccgcttttggccctcgaagagggagttctcccaggggggcagcaggcgctgcagccaggaggaatgagagtcaggattatctgctgatggattcagaactcggagaggatggctgtcctcaggcgcctctgccctgttacggatattacccatgtttcaggggaagcgacaacaggctcgcccataggagacagactgttctgcgcgaaaagggtagacgtcttgccaatcggggtccagcttatatgttttctgatcggagtacctctctgagcattgaggaagagagattcctcgatgccgcagagtacggtaacatacctgttgtccgaaagatgttggaggagtgtcactcccttaacgtcaactgtgtggattatatgggtcaaaacgccttacagctagcagttgccaacgagcatctcgaaattaccgaattgctcctgaagaaggagaacttaagccgtgtcggcgacgctttactgctggcaatcagtaagggatacgtacgcatcgtggaggccatcttaagccaccccgcatttgccgaggggaagagactggccaccagcccttctcagagtgagctgcagcaggatgatttttatgcctacgacgaagatgggactcggttttcacacgacgtgaccccaattatcttagctgctcattgtcaagagtatgagatcgtccacacactgctgcggaagggtgccaggatagagcgccctcacgactatttttgcaaatgcaatgattgcaatcaaaagcagaaacacgacagcttctcgcacagtaggtctagaatcaatgcttacaaaggcctggcttcccccgcttacctatctctgtcgtcggaagatcctgtaatgacggctctggagctttctaacgagctggcagtcttggccaacattgaaaaggaattcaagaacgattataaaaagttgagcatgcagtgtaaggattttgtggttggtcttttggatctgtgtaggaacacagaggaggttgaagctattttgaacggtgacgtggaaacgctacagtcgggcgatcacggtcgacccaatctatctagattgaagctagccatcaaatatgaagttaaaaaatttgtcgcacatcctaactgccagcagcagttactgtccatctggtacgagaacttgtccggcctgagacagcagaccatggccgtcaaattcctggtggtgctggccgtggccataggtctgccttttcttgccttgatttactggttcgccccatgtagcaagatgggaaagatcatgcgcggtccctttatgaagtttgttgcccacgccgcttcatttaccatctttctgggtctgctcgtgatgaatgccgcagacagatttgaaggaaccaagctactccctaatgaaacctcaaccgataacgccaagcagttgttccgcatgaaaacaagttgtttctcatggatggaaatgctgatcatttcttgggtgatcggcatgatttgggccgagtgtaaggagatttggactcagggccctaaagaatacctgttcgagctatggaatatgttggatttcggaatgttggcaatttttgctgcctcattcatagccaggtttatggccttctggcatgcaagcaaggcacagtccattattgacgccaacgacacgcttaaggaccttaccaaggtgactctaggcgacaacgtgaagtattataacctagctcgcattaagtgggatcctagtgacccccagatcattagtgaaggactttacgctatcgccgtcgtcctgagcttctccagaatagcctatattcttcccgcaaatgaatcatttgggccactgcagatctctctcgggcgaaccgtaaaagacatcttcaaatttatggtcatatttattatggttttcgttgccttcatgatcggcatgttcaatttgtatagctattacattggcgctaaacagaatgaagcattcaccaccgtggaagagtccttcaagacactgttttgggccatttttggtctctccgaagtcaagtccgtcgtgattaattataaccataagttcatcgagaacattggttacgtgctgtacggtgtatacaacgttacaatggttatcgtgcttctgaatatgctcatcgccatgataaattccagctttcaggagatagaggacgatgctgacgtggagtggaaattcgctcgagccaagctctggttctcttatttcgaggaaggtcgaacattgcccgtacccttcaacttagtcccttctcctaaatcgttgttttacctgctgcttaagctgaaaaaatggatctccgaattgtttcagggccataaaaagggtttccaagaggacgccgagatgaacaaaattaacgaggagaagaagcttggcattcttggtagccatgaagacttgagcaagctcagcctggacaaaaaacaggtgggacacaacaaacagccctctatccgctcctccgaggattttcatctcaattctttcaataatcctcctcgccagtaccaaaaaattatgaagcgcctgatcaagaggtatgttcttcaagcacagatcgataaggagagcgacgaggtaaatgaaggggagctgaaggaaataaaacaggacattagttcactgcgttacgagctgctcgaagagaagtcccagaatacagaagatcttgctgaattgatccgcgagctgggggagaaactcagcatggaaccaaatcaggaggaaaccaatcggtag

SEQ ID NO: 244597 - DNA, 2448 bp, Artificial Sequence
  Description of Artificial Sequence: Synthetic coding sequence
atgtcacagagtccagccttcggtccaaggcgcggatccagtcctaggggagccgctggcgcagccgctagaaggaacgagagtcaggattacctgctgatggattcagaacttggcgaggatggatgcccacaggcacccctgccatgctacggctattacccctgcttcagagggagtgataaccgcttagctcaccgccgacaaactgttctccgcgagaagggcaggaggttagccaatcggggacctgcatatatgtttagtgatcggtcaacatccctgtctattgaagaagagcgattccttgacgccgcagaatacggcaatatcccggtggtacgcaagatgctggaagaatgtcactctttgaatgtgaactgcgttgactatatgggccaaaatgccctccaattggcagtggcaaacgaacatctggagattacggagttgcttcttaagaaggagaacctatctagagtgggagacgctctgctgctcgcgatttcaaaagggtatgttcggatagtggaggccatcctatcccaccccgcatttgctgagggtaagcgactcgccactagcccttcacagtcagagcttcagcaggacgacttctacgcatacgacgaagatggaacaagattctcccatgacgtgactcccatcatactggcagcccactgtcaggagtatgagattgtgcacacactgcttcgcaagggggcaaggatcgaacgcccacacgattacttttgcaaatgcaatgactgcaatcaaaagcagaagcatgattctttcagtcatagtcggagcaggattaacgcttataaaggcttggcgagtccggcttacttatcactttcatctgaggatccagtgatgacggccctggagctaagcaatgagctggccgtgttggctaacatcgaaaaagaatttaagatgggcaaaatcatgaggggaccttttatgaagttcgtggcccacgccgctagtttcaccatctttctgggcttgctggttatgaatgcagccgatagatttgagggaacaaagctcctaccaaatgagacctccactgataatgcaaagcaattatttaggatgaagacctcttgttttagttggatggagatgcttatcatctcatgggttattggcatgatttgggctgaatgtaaggagatctggacacagggcccaaaagagtacttatttgagttgtggaacatgctggactttgggatgctggcaatatttgccgcttcttttatcgcacgcttcatggcgttctggcacgccagtaaagcgcagtctattattgatgccaatgacacactcaaagatctcaccaaagtcactctgggggataatgtcaagtattataatttggcgaggatcaagtgggatccctccgacccacagatcattagtgagggcctttatgctattgcggtcgtgctgagctttagtagaatcgcgtacattcttccagctaacgaaagcttcggacctttgcaaatctccttaggacgcactgtgaaggatattttcaagttcatggtgatctttatcatggtgttcgtcgctttcatgatagggatgttcaatctatactcctactacatcggcgcaaagcaaaatgaggccttcacaactgtggaagagtcttttaaaacactgttttgggccatcttcggtctgtccgaggtgaagtccgtcgttatcaactataaccataaattcattgaaaacattggctatgtcctgtacggggtgtataacgtcacgatggtgatcgtgctcttgaacatgctgattgctatgatcaactcttccttccaggaaattgaagatgacgctgatgtggaatggaagttcgcaagggcgaagctgtggttcagctatttcgaggaaggaagaactctgccagttcctttcaatttggtccctagcccaaaatccctgttttatctgctgctgaaactcaagaaatggatctcggagctttttcagggtcataagaagggattccaggaagatgccgagatgaacaagattaatgaggaaaaaaagctgggcatcttggggtctcacgaggatctttcgaagttgtcactcgacaagaagcaagtcggccacaataaacagccttccattagaagctcggaggattttcatctgaactcctttaacaaccccccaagacagtaccagaaaattatgaagagattgataaagaggtatgtgctgcaggcccagatcgacaaagagtctgacgaggtgaatgagggcgaactcaaagaaataaaacaagatatttcatccctgaggtatgagctcttggaagagaagtctcaaaacactgaagatctggcggaactgattagagaactgggtgaaaagttgtcaatggagccgaaccaggaggaaaccaaccggtag

SEQ ID NO: 244598 - DNA, 2631 bp, Artificial Sequence
  Description of Artificial Sequence: Synthetic coding sequence
atgagtcaaagtcccgcttttgggccaagaaggggatcttctcctaggggggcagctggtgctgccgctcgacgcaacgaatctcaggactatctgctgatggactctgagctgggagaagacggctgtcctcaggcacctcttccgtgttacggttactatccttgctttcggggaagtgacaatcggctggcacataggcggcagaccgtgctccgagaaaaggggcgtcgacttgccaaccgaggcccagcttacatgttctcagatcggagtacttctttatccatagaggaggaaaggttcttggacgccgcagagtacggcaatattcccgttgttagaaagatgctcgaagaatgtcactcgctgaacgtgaactgcgtagactacatgggccaaaacgcactgcagctggctgtggctaatgaacacctggagataacagagctccttctaaaaaaggaaaatctctctcgggttggagacgccctactgctggcaatatctaaaggttatgtgagaattgtggaggcgattctttctcaccctgcatttgcggagggcaagcgacttgctacatctcccagccagtcagagctccagcaagacgatttttacgcatatgatgaagacggaacccgttttagtcacgatgtgactccaattattctcgctgcccactgccaggagtacgagatcgttcatactctgctccgaaaaggtgcaagaatcgaacgccctcacgactacttctgcaagtgcaacgactgcaaccaaaaacagaagcacgacagttttagccactctcggagccggatcaacgcctataagggactcgcaagtcctgcatatttatcgctctctagcgaagaccccgttatgactgcccttgagctgagtaatgaattggcagtcttagctaacatagaaaaagaattcaagaacgattataagaaactttcgatgcagtgcaaggatttcgtggtaggactcctggacctatgtcgcaacaccgaagaagttgaggctatcttgaacggagatgtcgagactctgcaaagcggcgatcacggcagaccaaatctctccagactcaagctggctatcaaatacgaagtcaaaaagatgggcaaaattatgaggggtccttttatgaagttcgtcgcacacgcagctagctttactatatttctcgggttactggtgatgaatgccgctgatcggttcgaaggaaccaaactcttgccaaatgagacctcaacagataatgcaaaacagctcttccgcatgaaaacctcttgcttttcttggatggagatgctgatcatatcttgggtcatcggcatgatatgggccgaatgcaaagagatctggactcagggaccaaaggagtacctgtttgagctttggaatatgctcgatttcgggatgctggctatttttgccgctagctttatagccagattcatggctttctggcatgcttccaaggcacagagcatcatagatgctaatgacacattaaaagaccttactaaggtaactctgggcgacaatgtgaagtactacaacctggccaggataaaatgggacccctccgatccgcagataatttccgaaggtttgtatgctatagcagtagtcctcagcttcagtagaatcgcctacatcctgcccgctaacgaaagtttcgggcctcttcagattagcctgggtagaactgtcaaagacatcttcaagttcatggtgatatttattatggtcttcgtggcttttatgattggaatgtttaacctttactcatactatatcggcgcaaaacagaacgaagctttcactaccgttgaggagtcctttaaaacactcttctgggcgatctttggcttgtccgaagttaagtccgtggtcatcaactataatcataaatttatcgagaacataggatatgtactgtatggcgtctataacgttacgatggtcatagtcttacttaacatgctgatcgccatgattaactcaagctttcaagagattgaagatgatgccgatgtggagtggaaattcgcgcgtgcaaagctctggttttcttacttcgaggaaggccgaactcttccagtccctttcaatctcgtgccatctccaaaatctctgttctaccttcttctaaagctcaagaagtggatcagcgaactgttccagggacacaaaaaaggattccaagaggacgcagaaatgaacaagattaacgaggagaagaagttgggcattctgggtagccacgaggatctgtccaagttgagtttagataagaaacaggtgggccataacaaacagccttctatccgctccagcgaagatttccatctcaattcattcaataacccaccacgccagtaccaaaagatcatgaagagactaataaaaaggtacgttctgcaagctcagatagacaaggaatcagatgaagtaaatgaaggagagctgaaggagatcaagcaggatatttcttctttgcggtacgagcttctggaggagaaatcccaaaacaccgaggatttagccgaactgattcgggaactcggcgagaaactgtcaatggaacctaaccaagaggaaaccaacaggtag

SEQ ID NO: 244599 - DNA, 2406 bp, Artificial Sequence
  Description of Artificial Sequence: Synthetic coding sequence
atgttgcgcaactctacgttcaaaaatatgcagcggaggcacacaaccctacgtgagaaggggaggcgtcaagccatccgcggaccggcatacatgttcaatgagaagggtactagccttacacccgaggaggagaggttcttagactccgcagaatatgggaacattcccgttgtgcgaaagatgctcgaggaaagcaagacattaaactttaattgcgtcgattacatgggccagaatgccctacagcttgcagttggcaatgagcacctcgaggtcacagagctgctgctgaaaaaagaaaacctcgcgcgtgtgggcgatgccttactgctggctattagtaagggctatgtccgcattgttgaagcgatcctgaaccatcctgcattcgcccagggccaaagactcaccctgtctcctctcgaacaggagttgagagatgacgacttctatgcttatgatgaagatgggacaagattctcgcacgacatcacgccgataattctggccgcacactgccaggagtacgagattgtccacattctgttgctgaagggagctaggattgagcgtccccatgattatttctgcaagtgcaacgaatgtacagagaagcagcgaaaagactccttttctcattctcgctctcgcatgaatgcctataaaggactggcaagtgcagcatatctctccttatcaagcgaagatccagttctgactgccctggaactctccaatgagctggctcgcctcgcaaatattgaaactgaatttaaattcgttgcccatcctaactgtcagcagcagctgttaaccatgtggtacgagaacctgtctggacttcgacagcagtccatcgcggtcaagttcctggcagtgttcggggtttctatcggtctgccatttctggctatcgcatattggatcgctccttgttccaaactcgggaggacgctgaggtctcctttcatgaaattcgtggcccacgccgtttctttcacaatttttctcgggctgctcgtagttaacgcttcggacagattcgagggcgttaagacattacccaatgagacctttacagattatccaaagcaaatattcagagtgaaaaccactcagttcagctggacagaaatgctgatcatgaaatgggtgctaggaatgatttggagcgaatgcaaggagatttgggaagagggtcctcgggaatacgtgctccatctgtggaatttgttggactttggaatgctgtccatcttcgtcgcctcattcaccgcaagatttatggctttcctcaaggccactgaagcccagctgtatgtggaccaacatgttcaggacgataccctgcataatgtgagcctgcccccagaggttgcatattttacttatgctcgtgacaaatggtggccctccgacccgcaaattataagcgaaggcctttatgccatcgcagttgtccttagcttctcccggattgcatacattttaccagcgaacgagtcttttgggcctcttcagatctctctaggcagaaccgtgaaggacatctttaaattcatggtgatctttataatggttttcgttgctttcatgatcggcatgttcaacctttatagttactaccggggagccaagtataacccagctttcactactgtggaggagtccttcaagactctgttttggtctatatttggtctcagtgaggtgatctcagtagtccttaagtatgaccataagttcatcgagaatatcgggtacgtgctctacggtgtgtacaacgtgaccatggtggtggtcctgctcaatatgctgatcgcaatgatcaacaattcttaccaggagatagaagaagacgccgacgtggaatggaaattcgctagggccaagctgtggctgtcgtactttgacgaaggcagaaccctgcccgctccatttaatttggtcccgtccccaaagtccttctactatcttattatgcggattaagatgtgtctcatcaagttatgtaagtcaaaggccaagtcgtgcgagaacgacctggagatgggtatgctgaactcaaaatttaagaagacccggtaccaggccggtatgagaaactccgaaaaccttacagccaataatacactatctaagcccacccggtatcagaagataatgaagaggctaatcaagcgctatgtcctgaaggcacaagttgacagagagaacgatgaggtgaacgagggagagctcaaagagatcaagcaggacattagttctctacgctacgagctgctggaagagaaatcgcaggcgacaggcgagcttgcagaccttatccagcagctgtccgaaaaattcggcaagaatctgaataaagatcacttaagagttaacaagggtaaggacatttag

SEQ ID NO: 244600 - DNA, 2241 bp, Artificial Sequence
  Description of Artificial Sequence: Synthetic coding sequence
atgctgcgtaactccacctttaagaacatgcagcggagacataccacactgcgagaaaaaggtagaagacaagccatccggggacccgcatacatgttcaacgagaagggtacctcgctcaccccagaggaagaaagattcctcgattctgccgagtatggaaacattccagttgtgaggaagatgttggaggaatccaaaactttaaacttcaactgcgtcgactatatgggccagaatgctctgcaattggccgtcggcaacgaacacctggaggtaactgagctgctcctgaaaaaagaaaatctggcccgagtgggcgacgccctgctgttagccatttccaagggatacgtgagaatcgtagaggccatcctgaatcaccccgcttttgcacagggacaacgcctgacactcagcccactggaacaggagctcagagatgacgatttttatgcatacgacgaagatgggacacggttcagccatgacatcactcccataatcctggctgcccattgtcaagaatacgaaatcgtgcacatacttctgttgaaaggggcaagaatagaacgcccacacgactatttctgcaagtgcaatgagtgcacagagaaacagcggaaggactcattttcacacagtcgttctcgcatgaacgcatataaaggccttgccagcgccgcttacctttctctctcaagcgaggatcccgtactaacagctctcgagctctctaatgagctcgcacggttggccaacattgaaaccgagtttaaattaggtcggactttgcgatcaccatttatgaaattcgtcgctcatgccgtgagttttacaatctttctgggtctgcttgtggtcaatgccagcgaccgattcgaaggcgttaaaaccctccccaatgagaccttcacagattatccgaaacagatctttagggtgaaaaccactcaatttagctggactgagatgctgataatgaagtgggtccttggaatgatctggagtgagtgtaaggaaatttgggaggaaggtcctcgtgaatacgtgttgcacctgtggaacctgctggattttggcatgctcagcatttttgttgcttcctttactgcgaggtttatggccttccttaaggctaccgaggcccagctgtacgtggaccagcacgtgcaggacgacaccctgcataacgtcagtcttccccctgaggttgcatacttcacttatgcacgggacaagtggtggccatctgatcctcaaataatcagcgagggactctacgctattgctgttgttctgagcttctccagaatcgcatacatcctccccgctaatgagtcgttcgggcctctgcagatcagcctgggacgtacggtgaaagacatcttcaaattcatggtgatttttatcatggtatttgtggccttcatgatcggtatgtttaatctgtacagctattataggggtgccaaatataatccggcattcactacagtagaagaaagctttaaaacactgttttggagcatattcgggttaagcgaggttatttctgtggttctcaagtacgaccataaattcattgaaaacatagggtatgtactgtacggtgtctacaatgtgaccatggttgtagtcctcttgaacatgctgattgccatgatcaataatagctaccaggagattgaggaagatgccgatgtggagtggaagtttgcacgcgctaaactctggttgtcgtactttgatgaaggccgtacccttccagcgccattcaacctagtccccagccctaaaagtttctactatctgattatgcggataaaaatgtgcctcattaagctctgcaagagtaaagcaaaatcttgtgaaaatgatttggaaatgggcatgctgaattccaagtttaagaagacaaggtaccaagctggcatgaggaatagtgagaacttaacggcgaacaatacactttccaagcccaccaggtatcagaaaatcatgaagaggcttataaagcggtacgtgctgaaagcacaggtggaccgagagaacgacgaggtgaatgaaggcgagcttaaggagataaagcaagacatctcctctctaagatatgagctgctcgaagaaaagtcccaggccaccggcgagttagcagatcttattcagcagttgagtgagaagtttgggaagaatctaaacaaggaccatcttcgggttaacaagggaaaggacatctag

SEQ ID NO: 244601 - DNA, 2589 bp, Artificial Sequence
  Description of Artificial Sequence: Synthetic coding sequence
atgttaagaaattcaacctttaaaaacatgcaaagacggcataccactctgcgcgagaaaggaagacggcaggcgataagaggcccagcctatatgtttaacgaaaaaggtacgtcactgacgccagaggaagagcgttttctcgatagcgcagagtacggcaatatccccgtcgtcaggaaaatgctggaagagtcaaagactttgaacttcaactgtgtagactatatgggccagaacgcactgcagctcgccgtgggtaacgaacacctggaggtcaccgaactactgctgaagaaggagaatttggcacgtgtcggagacgctctgctcctggccatctcaaaaggctatgtcaggatagtcgaggcgatcttgaatcatccagcgttcgctcagggacagaggctgacgcttagtccattggagcaagaactgcgcgatgacgatttctacgcctatgacgaggacgggacccggttttcacacgacattacacccatcattctggccgctcactgccaggagtacgagatcgttcacatcttgctcctgaagggtgcaaggattgagcgcccacatgattacttctgtaaatgtaacgagtgcaccgagaagcaaagaaaggactcctttagccattcacgatctaggatgaatgcctataagggattagcttctgctgcctatctgtcgctgtcatctgaggaccccgtacttaccgccctcgagttaagtaacgagctggccaggctcgctaatatagagactgaattcaaaaacgactaccgtaaactgtccatgcaatgcaaagatttcgttgtgggagtgctagatctttgtcgagacacggaagaagtcgaggctattttaaacggcgacgtgaactttcaagtctggagtgaccatcatcgtcctagcctgagtcgaatcaaactggcaatcaagtacgaggtcaagaagtttgtggctcatccaaactgtcagcagcagctgctcactatgtggtatgagaacctctcaggcctgcgccagcagtctatcgccgtgaagttccttgccgttttcggagtttcaatcggcctgcctttcctggcgattgcttattggatcgcgccatgcagcaagctcggtcgcaccctgcgaagcccgttcatgaaatttgttgcgcatgcggtttcttttactatttttctgggcttactggtcgtgaacgcatctgacagatttgaaggcgttaagactctgccaaacgagacattcactgattaccccaagcagatctttagagtcaagacgactcagttttcctggaccgagatgctcattatgaaatgggtcctgggaatgatttggtcagagtgtaaggaaatatgggaggaaggtcctcgggaatatgtgctgcacttgtggaacctgctggactttggaatgctgtctatctttgtagctagtttcaccgcaagattcatggcattcctcaaggcaactgaggcacagctatatgtggatcaacatgtacaagatgacacactacacaatgtgtcacttccccctgaagtagcatatttcacatacgccagggacaaatggtggcccagtgacccacagatcattagcgagggcttgtatgctatagcagtcgttctcagctttagtcggatcgcatatatcttgccagctaacgagagctttgggccacttcaaatttctctgggcagaaccgtaaaggatatattcaaattcatggtgatttttattatggtctttgtggcttttatgatcggtatgttcaacctgtattcatactataggggcgcaaaatataacccagcattcacaacagtggaagagtccttcaagacccttttctggagtatctttggattgagcgaagtaattagcgtggtgctaaagtacgaccataagttcattgaaaatatcgggtatgtcctctacggtgtgtataacgtaaccatggtggtagtgctacttaatatgctgattgccatgatcaataattcttaccaggaaatcgaagaagacgccgatgtggaatggaaattcgctcgcgcaaagctttggttaagttactttgacgagggcaggacgttgcctgccccttttaacctggtgccttcaccaaagagcttctactacttaatcatgcgcatcaaaatgtgccttatcaaactgtgcaagtcaaaggcgaaaagctgtgagaacgacctcgagatgggcatgttaaactccaagtttaagaaaacccggtatcaggccggaatgcgaaactctgagaatttgactgccaataataccctcagcaaaccaacaaggtatcagaaaatcatgaaaagattgattaagcggtatgtcctgaaagcccaagtggaccgggaaaatgatgaagtgaacgaaggagagctgaaagagatcaaacaggatatttctagcctgaggtatgagctgctcgaagagaagagtcaggcaacaggcgaactggcagatcttatccagcagttgagtgaaaaattcggaaagaatctgaataaagaccacctcagggttaataagggaaaggacatctag

SEQ ID NO: 244602 - DNA, 4350 bp, Artificial Sequence
  Description of Artificial Sequence: Synthetic coding sequence
atggagccctccgctctgaggaaagctgggagtgaacaggaggaaggctttgaaggcctcccacgacgcgttaccgatttaggaatggtttccaatcttcggagatcgaattcctccctgtttaaaagctggagactgcaatgtccttttggcaataacgacaagcaggaatccctctcctcttggattcctgaaaacatcaagaaaaaggagtgcgtctattttgtggagagctcgaagctttctgatgctggtaaggtcgtctgtcagtgtggttacacacatgagcagcatttggaagaagcaaccaagccccacacttttcaaggaacccaatgggatccaaagaaacacgtgcaggaaatgcccaccgacgctttcggagacatcgtttttacaggactgtcacagaaagtaaagaaatacgtaagagtgagtcaggacactccatctagcgtcatctaccacctgatgactcagcactggggcctggatgtgccaaacttactcatatcagtcacaggcggtgccaagaactttaacatgaagcccagactcaaatcaatatttagaagagggttggtgaaggtagctcaaaccaccggtgcttggattataacaggagggtcacatacaggggttatgaaacaggtcggggaggcagttagggactttagccttagtagtagctacaaagagggagagctgattaccataggtgtcgccacgtggggcaccgtccaccgaagagaagggctcattcacccaaccggatctttccctgcggaatacatattggatgaggacggccaggggaatctaacatgcttagattctaatcactctcattttatcctcgtggatgatgggactcacgggcagtacggagtggagattccactgcgaacaagactagaaaagttcatctctgagcagaccaaagaaaggggcggtgtcgccattaagatccctatcgtatgcgtggtactggagggaggtcccggaacacttcatacgattgacaacgcaaccactaacggaacaccatgcgttgtcgtggaagggtctggtagagtggctgacgtcatcgcccaggtggccaatctacccgtgtccgatattaccatcagtctgatacagcaaaagctctccgtcttctttcaggagatgtttgagacgttcaccgagagccggatcgtcgaatggactaagaagattcaggacatcgtgcggaggaggcagctactcactgttttccgggaggggaaggatggccagcaagatgtcgacgtcgccattctccaagccctgctaaaggcatctcggtcccaggatcattttggccacgaaaattgggaccaccagctgaagcttgccgtagcttggaaccgggtggacatcgccaggagcgagatttttatggacgagtggcagtggaagccgtcagatctccaccctaccatgaccgccgctctcatctccaataaacctgaatttgtgaaattattcttggagaacggggtgcagctgaaggaatttgtaacttgggataccctactttacctttatgaaaatctggatcctagctgcctgttccacagtaagctgcagatgcatcatgtggcccaggtgctgcgggagctgcttggggatttcactcagcctctgtacccaagacctaggcacaatgacaggctgcgcctgctgctgccagtgccacatgttaaactgaatgtacaaggcgtgtcacttaggtctctgtacaagagaagctctggacatgtaacctttacaatggatccgatccgcgatctgcttatctgggccatcgtccaaaatcgtcgcgaattggctggaatcatttgggcccagagtcaggattgcatcgcggctgctctggcgtgcagcaagattttaaaagagctaagcaaagaggaagaggacaccgactcatcagaggagatgttagcactcgcggaggaatacgagcaccgcgcaataggagtgtttacggagtgttaccgcaaagacgaggaaagagctcaaaagcttcttacccgtgtctcagaagcttggggaaaaacaacctgtctccagttagccttagaggctaaggacatgaagttcgtttctcatggcggtatccaggcctttttgaccaaggtctggtggggccagttgagcgtggacaatggtctgtggcgcgtcacactctgcatgttggcatttcctctgctgctgactggactgatctcctttagagaaaagagacttcaagacgtcggcactccagcagcgagggccagagctttcttcacggcaccggtggtggtgtttcatctgaacatcctctcatacttcgcgttcctgtgtctttttgcgtacgtgctgatggttgactttcagcctgtgccatcatggtgcgagtgtgcaatatatctgtggctgttctctctcgtatgcgaggagatgaggcagctgttttatgacccagacgagtgtggtctcatgaagaaggctgccctctatttctccgacttctggaataagcttgatgtcggggctattctactgttcgtggccggactgacgtgccggctgattcccgctaccctgtaccccggacgcgtgattctgagcctggattttatacttttctgtctgaggttaatgcacatcttcaccattagcaagacgcttggtcccaagatcatcatagtgaagcgaatgatgaaagatgtgtttttcttcttattcttgcttgccgtgtgggtagtgtcattcggagtggcaaaacaggcgatactcattcacaacgaacggagagtggactggctgtttagaggggcagtgtatcacagctaccttactatcttcggccagatccccggatatattgacggagtgaatttcaatcccgagcattgctccccgaatggcactgacccctataagccgaagtgtccggaatctgatgccacccaacagcgccctgctttcccggagtggcttactgtgctgttactgtgtctgtacctgttattcacaaacattctactgcttaatctcctgatagcaatgttcaactacactttccaacaggttcaggagcatactgatcagatttggaaatttcaacgccacgacctgatcgaagagtatcatggcagaccagccgctccgccacctttcatcctcctgtcacatttgcagctttttatcaagagagtagtccttaagacccccgcaaagcggcacaaacagctgaagaacaaactggaaaaaaatgaggaggctgcccttctcagctgggagatttaccttaaggagaattatctgcagaaccggcagttccaacagaagcaacgcccagagcagaaaatcgaggatattagcaacaaggtggacgccatggtggacttactagacctggatcctctgaaaaggtcaggctctatggagcagcgcctcgcttccttggaggagcaggtagcacagaccgcccaggcacttcactggattgtcagaacactccgagcatctggattttccagtgaggcagacgtacccaccttagcctcacagaaagctgccgaggagccagatgccgagcccggaggaagaaagaagacagaggagcccggtgactcctatcatgtaaatgcgagacatctcctatatcccaattgtcccgttacacggtttccggttccaaatgagaaagtcccttgggaaacagaatttctcatctacgatccccctttttacacagctgagcgcaaagacgctgcagccatggatcccatgggagaaaaccctatgggtcggactggactgagagggcgtgggagtctatcttgctttggccctaaccacacactatacccgatggtcacccggtggcgcagaaatgaggacggagcaatctgcaggaagtcaattaaaaagatgcttgaggtgttagtagtgaagctacctctgagtgagcactgggcactcccgggtgggtccagagaaccaggtgagatgctcccccgaaaactgaagagaatcctgcggcaagagcactggccgagtttcgaaaatcttttaaaatgtgggatggaggtgtataaggggtacatggatgacccacgcaacacggataacgcttggatcgaaacggttgcagtctctgtccactttcaggaccaaaacgatgtggaactgaatcgtctgaactccaatctgcacgcttgtgactccggggctagcatccgctggcaggtggtcgatcgcagaatacctctttatgccaaccataaaactctcctgcaaaaagccgctgccgaatttggtgcccactactag

SEQ ID NO: 244603 - DNA, 4512 bp, Artificial Sequence
  Description of Artificial Sequence: Synthetic coding sequence
atggaacctagcgcactccgtaaagctggatccgagcaagaggaagggttcgagggattacctcgcagggtcacagaccttgggatggtgtctaacctgcgccgttccaattccagtctcttcaagtcttggcggctccagtgcccttttggcaacaatgacaagcaagagagtttgtccagctggattccagagaatatcaaaaaaaaagagtgcgtatactttgtcgaaagttctaaactgagtgatgccggaaaggtggtgtgccagtgtggttacacccacgagcagcatctggaggaggctaccaagccccacacatttcagggtactcagtgggatcccaagaagcacgtgcaggaaatgcccaccgacgcctttggggatatcgtgttcaccggcctttcacagaaggttaaaaaatatgtcagggtgtcacaggacacaccttccagcgtgatctatcatctgatgacgcagcattggggtcttgatgtccctaacttgctcattagcgtgactggtggtgcaaaaaattttaatatgaaacccagactcaaaagtatttttaggagggggctggttaaggtagcacagactacgggagcttggattatcaccggcggtagtcatacaggcgtcatgaagcaggtcggcgaggcggtgagagacttttcactgtctagttcttacaaggagggcgaactgataacaattggcgtggccacttggggaacagtgcatcgccgagagggtctgatccacccgaccggcagctttcccgctgaatatatactggacgaggacggacagggaaacctgacctgcctggacagtaaccattcccactttattctagtggacgacggaacacatggccagtacggtgttgagattcccttgaggactaggctggagaaatttatatcagagcagactaaggagcgaggcggagtggctattaagattcctattgtgtgtgtagtgttagagggcggtccaggtaccctgcataccattgacaacgcgacaaccaacggaacaccctgcgtggtggtggaaggcagcggccgagtggctgatgttattgcgcaggttgctaatttgccggtgtctgatatcacaatcagccttatccaacagaaactgagtgtgttttttcaggagatgttcgaaacttttactgaatctaggattgtggagtggacaaagaagattcaggatatcgtacggagaaggcagctgctcacggtctttcgcgagggcaaggatggacagcaggatgttgatgtggcaattttgcaggccctgctgaaagcctcacggtcacaggatcacttcggccacgaaaactgggaccaccagctcaaactggccgtggcttggaacagagtggatatcgcacgcagtgaaatcttcatggacgaatggcagtggaagccatcggatttgcatccaacaatgacggccgctttaatcagcaacaagcccgagtttgtcaaactctttctcgaaaatggcgtgcaactgaaagagttcgttacgtgggacacattgctttatctgtacgaaaacctggacccgtcttgccttttccacagcaaattgcagaaggtgctcgttgaggaccccgaacggcctgcatgcgctcctgcggcaccgagattgcagatgcaccacgtcgctcaggtccttcgagagctcctgggcgacttcacacaaccactctatccacgacctcgccacaatgatagactgaggttactcctgcctgtcccgcatgtgaagctaaatgtgcaaggtgtatcgctgcggtccctgtacaagagaagcagcgggcatgttactttcacaatggatcctatccgggacctgctgatatgggccatcgtccagaaccggcgagagcttgcaggaatcatctgggctcagtcccaggattgcatcgctgccgcactagcctgctctaaaatactgaaagagctgtctaaagaagaggaagatacagactcctccgaagagatgttagcccttgctgaagagtacgaacatagggctatcggcgtgttcacagagtgttacagaaaagacgaggagagagcccagaaactgctcacccgggtatctgaggcgtggggcaaaactacttgtttgcagcttgccttggaggcaaaggacatgaagtttgttagtcatgggggaatccaggcatttcttacaaaggtctggtggggacagctgtctgtggacaacggcctttggagggtcacattatgtatgttagcctttcccctgctactgacggggttaattagctttagagagaagcgtctgcaggatgtaggcacccctgcagccagggcaagagcatttttcacagcccctgttgttgtgttccatctcaacatccttagctactttgcctttctctgtctcttcgcatacgtcctcatggttgatttccaaccagttccaagttggtgtgaatgtgcgatctacctgtggctgttttctttagtctgtgaagagatgcgccagctcttttacgatcccgatgagtgcgggctaatgaaaaaggcagcactctacttcagtgatttctggaataaattagatgttggcgcaatccttctgtttgtcgcgggtctgacctgcagattaatccctgccaccttgtacccaggccgtgtcatccttagcttagattttatcctcttctgcttgcgccttatgcacattttcacgatctcaaaaaccctgggacctaaaattataattgttaagagaatgatgaaggacgtgttttttttcctcttcctgctcgcggtctgggtggtcagcttcggtgtcgcaaaacaggcgatcctcatccacaatgagcggagggtcgactggctcttcaggggagcagtgtatcatagctacttgactattttcggacagattcctggatatattgatggtgtgaacttcaaccccgagcattgttcacctaacggtacggacccctataaaccgaaatgcccagaatctgatgccacacagcagcggccagccttccctgagtggctcaccgtgctccttctgtgtctctacctgctgtttaccaacatcctgctattaaacctgcttatagccatgtttaactacacttttcaacaggtgcaggaacatactgaccagatctggaaattccaaagacatgacctgattgaagaatatcacggcaggccagcagctcctccgccttttatcctcttgagtcatttgcagctttttattaagcgcgtcgtgttaaaaactccggcaaaacgccacaagcagctgaagaataagttagagaagaacgaagaggcggctttactctcttgggaaatctacctgaaggagaactacttacaaaacagacagttccagcagaaacaaagaccagagcagaagatcgaagatatatcaaataaagtggacgcaatggtcgatctcctggacttggatcctctgaagcgctctggatccatggagcagcgcttggcatcactagaggagcaagtggcccagacagcgcaggctctgcattggatcgtacgcaccttgcgcgcaagcggattcagctcggaagccgatgtgccaacgctcgcctcccagaaagccgctgaagagcccgacgccgagcccggtggcagaaagaaaaccgaagagccaggcgactcgtaccatgtgaacgctagacacctgttataccccaattgccccgttacccgcttcccagtccctaacgaaaaagtcccttgggagaccgagttcctgatttatgaccctcccttctatactgccgaaagaaaagacgctgccgctatggatcctatgggggacacattggaacccctgagcaccatacagtataatgtggttgacgggctccgggaccggagatcgttccatggcccttacacagtgcaagctggactgcccctaaatcccatgggaagaaccgggctgagggggcgtggtagcctaagctgcttcggccctaatcatacactctatcccatggtgacacgctggaggaggaatgaggacggagcaatctgcagaaagtctatcaaaaaaatgctcgaagtcctcgtcgtgaagctacccctttcggaacactgggccctgccgggaggatcacgggaaccaggcgaaatgctgcctagaaaactgaagaggatcctgcgtcaggagcactggccgagtttcgagaatctgctcaaatgcgggatggaggtctataagggctacatggacgaccccaggaacactgataatgcttggattgagacagtggccgtgtccgtgcacttccaggatcagaacgatgttgagctgaatagactgaattcaaatctacacgcttgcgacagcggcgcttctatcaggtggcaagttgttgatcgcagaattccattgtatgcaaatcacaagactcttctccaaaaagccgcagccgagttcggcgctcactactag

SEQ ID NO: 244604 - DNA, 4512 bp, Artificial Sequence
  Description of Artificial Sequence: Synthetic coding sequence
atggagccctctgccctgcgaaaagccggaagcgagcaggaggaaggcttcgaagggttgccgcgacgggtgacagacctcggcatggtgtccaatctccgtcgttcaaattcatccctctttaaatcatggagactccagtgtccattcgggaataacgataagcaagaatccttatcctcgtggatcccggagaacataaaaaaaaaagaatgcgtgtattttgtggagagcagcaaactgtctgacgcaggaaaggtcgtatgccagtgtggctacactcatgagcagcacttggaggaagctactaaaccccatacgttccaaggcacccagtgggaccccaagaagcacgtgcaagaaatgcctacggatgcctttggtgacattgtgtttaccggactgagccagaaggtcaagaagtacgtccgtgtgtctcaggacaccccgtcctcagtcatctaccacctgatgacacagcattggggcctcgatgtcccgaacttactcatcagcgtgacaggtggtgcaaaaaatttcaatatgaagccgagactaaaaagcatcttccggcgtgggttggtcaaagttgcccagaccaccggcgcatggattattacaggcggtagccacactggcgttatgaagcaggtaggcgaggccgtgcgtgactttagcctgagctcgtcctataaggagggcgaactgattactataggggtagccacttgggggaccgttcatcggagggagggcctgattcatcctacaggtagtttccctgcggaatatatactggatgaagatggccagggaaatcttacctgcctggactcaaaccactcacacttcattttagtggatgacggtactcacggccagtacggtgtcgagatccccttacgcacacgcttggaaaaatttatctccgaacaaacaaaggagcgcggtggtgtcgccatcaagattcccatagtttgtgtggtcttggagggcggtcccggaacactgcatacaattgataatgccaccacaaatggcacaccttgtgttgttgtcgagggcagcggccgagtggccgatgtgatagcacaagttgctaatctacccgtgtccgatataacgattagcttaatacagcagaagctctccgtgttctttcaggagatgttcgagaccttcactgaaagtaggattgttgagtggacaaaaaagatccaggacattgtgaggagacgccagttactaacagttttccgcgagggtaaggacggtcaacaggatgtggatgtggccattctgcaggcgctcttgaaggccagccgtagccaggatcattttggccatgagaattgggatcatcagctgaaactcgccgtcgcctggaatagggtggacattgccaggagtgagatttttatggacgagtggcagtggaaaccctccgacctgcacccgacgatgacagcagccctcatctcaaacaagcctgagtttgtgaagctgttcctggaaaacggcgtccagttgaaagaattcgtaacatgggatacactcctctatttatacgagaatctcgaccctagctgcctgttccattcaaagttacagaaggtgctcgtcgaggaccctgaacggccagcctgcgcacctgccgcacctagattacagatgcaccatgtggcgcaagtactcagggagctgttgggagatttcacgcagcccctgtaccctcgccctagacataatgatagactgcgccttcttctaccagtgccccacgtgaaacttaatgtacaaggtgtctcactcagatctctctataaaagaagctctggtcacgtgacctttaccatggatcctattagggacctgcttatttgggcaattgttcaaaatcgcagggaattagccggaattatatgggctcagtcacaagattgtattgcggctgcactggcctgttctaaaattctgaaggagctgagcaaagaagaggaggacaccgattctagcgaggagatgctcgcacttgccgaagagtatgagcaccgggctatcggggtgttcacagaatgttacagaaaggatgaagagagggcgcagaagctcctgaccagggtgtcggaggcttgggggaagactacctgcctgcagctggccctggaggcaaaagacatgaaattcgtctcccacgggggtatccaggcttttctgacaaaagtgtggtggggacagctgagcgtggacaatggactgtggcgtgtcaccctatgtatgctggcgtttccactgcttcttactgggctgatttccttcagggaaaaaaggcttcaggacgtaggtactcccgcagccagggcgcgagccttttttacagccccagttgttgttttccatcttaacatcctttcatacttcgcatttctttgcctgttcgcctacgtgttaatggtggattttcagccagttccctcctggtgcgagtgcgccatctacctgtggctgttcagtttggtgtgcgaggaaatgcgacagctgttctatgaccccgacgagtgcggcctgatgaagaaagctgcgctctacttctccgacttttggaacaaacttgacgtgggagcaatccttctcttcgtcgctggtctgacttgtcgactaatacctgctaccctatacccaggcagagtgattctgtcattagattttatcctattttgccttcgactgatgcatatttttacaatctccaagactctgggacccaaaatcattatcgttaagagaatgatgaaggacgtgttctttttcctgtttctcctggcggtttgggtggtatccttcggggtggctaagcaggctatactgatccacaacgagcggagggtggattggttgttcaggggagcggtttatcactcttacctgacgatttttggacagatccccggatacatcgatggggtcaatttcaatccagagcattgttctcccaacggcactgatccatataagcccaaatgtccagagtcggacgcgacccagcagcgccctgccttccccgaatggctgacggttctgttgttgtgtttgtaccttctctttacgaatattcttttactcaatttgcttatagcaatgttcaattacaccttccagcaggtgcaagaacatactgaccaaatatggaagtttcaaagacatgacttgatagaggagtaccacggacgcccagctgcccctccacctttcatcctgctgtcccatttgcagctatttataaaacgcgtggtgctgaagactcccgcaaagagacataagcagctgaagaataagctagagaaaaacgaagaggctgcccttctttcatgggaaatatatttgaaagagaactatctgcagaacaggcaatttcagcagaagcagcggccagaacagaaaatcgaggatatcagtaataaagtggatgccatggtggacctgctcgacctcgatcccctaaagagatcggggtcaatggagcagagactggcctctttagaggagcaggtagcccaaaccgcccaggcactgcactggattgtgaggaccttacgtgcaagcgggttctcaagcgaagctgacgttccgacattggcatcacaaaaggctgcggaggagcccgacgcagaaccaggcggacggaaaaagaccgaggaacccggagacagctatcacgtcaacgccagacatctactgtaccctaattgcccggtgactagattcccagtgcctaacgagaaggttccgtgggagaccgagtttttgatctacgatcccccattctacaccgccgagcgcaaggatgccgcagcgatggacccaatgggggacacactcgagccccttagcactattcagtacaatgtggtggacggcctgcgggaccgcaggagctttcatggaccctatactgtgcaagccggacttccacttaacccaatgggcagaaccggcctgcgcggacgcggatctctctcgtgcttcggacccaatcacactctctacccgatggttaccagatggaggagaaacgaagatggggcaatctgccgcaagagcataaagaaaatgctcgaagtcttagtcgtcaagctccctctgtcagagcattgggcgctgccgggtggctcacgagagcccggagagatgttaccaaggaagctgaaacgtattctgcgtcaggaacattggccctcttttgagaacctgctgaagtgtggcatggaggtatacaaaggatatatggatgatcctcggaataccgacaatgcttggatcgagaccgtggccgtgtctgtgcactttcaggatcagaacgatgtggagctcaatcggttaaattctaatctgcacgcttgtgattctggcgcatccatacgatggcaagttgtggaccggaggattcctctgtacgctaaccacaagactttgctgcagaaagcagcagccgagtttggggcacactattag

SEQ ID NO: 244605 - DNA, 435 bp, Artificial Sequence
  Description of Artificial Sequence: Synthetic coding sequence
atggagccttctgcactcagaaaagcgggatcagagcaagaggagggctttgaaggccttccacgtcgggtaaccgacctaggcatggtgtccaaccttcggcgatctaattcctccctgttcaagtcgtggagactgcagtgcccctttggcaacaacgacaaacaggagtccctgtcctcgtggatacctgaaaatatcaaaaagaaggaatgcgtctacttcgtggaaagcagcaaactctcagatgccggtaaggtcgtgtgtcaatgtgggtatacacacgaacagcacctggaagaagccacgaagcctcatacatttcagggaacccaatgggatccgaaaaagcacgtccaggaaatgcccaccgacgcatttggagacatcgttttcactggactgtcccagaaggtaaagaagtacgtgcgatag

SEQ ID NO: 244606 - DNA, 744 bp, Artificial Sequence
  Description of Artificial Sequence: Synthetic coding sequence
atgttatctagggaacaggaagaggacggcggagccggtcggcaatatcatgtgaacgctaggcatctgctgtatcctaactgcccagtaactcggttcccagtgccaaacgaaaaggtgccatgggagacggaatttctcatctatgatcctccattttacaccgcagaacgaaaagacgctgccgcaatggaccccatgggcgaaaaccccatgggacggactgggctccggggacgcggtagtctgtcttgctttggacccaaccacactttatacccaatggttactcgctggcggcgaaacgaagacggggctatttgtagaaagtcaatcaaaaagatgctggaagtcttggtggttaagctgccactatctgaacactgggcacttcccggaggcagccgggagcccggagagatgctgccgagaaagctgaaacgcattttacggcaggagcactggccctctttcgaaaacctcctgaagtgtgggatggaagtgtataaagggtatatggacgatcctagaaatacagataacgcctggattgagaccgtcgccgtctccgttcactttcaagatcagaacgatgtcgaactgaataggctgaacagtaaccttcacgcctgcgatagcggggcttctatcagatggcaggtcgttgacagaagaatccctctatacgccaatcacaagaccctcctgcagaaagctgccgctgagttcggcgcacactattag

SEQ ID NO: 244607 - DNA, 5136 bp, Artificial Sequence
  Description of Artificial Sequence: Synthetic coding sequence
atgggaaaaaaatggagggacgcagctgagatggagagaggatgttccgatagagaagataacgcagagagccgcagacggtctagatctgccagcagggggaggtttgcggaaagttggaaaagactctcatctaagcaggggagcactaaaaggtctggcctgccctcgcagcaaactcctgcccagaagtcctggatcgaacgcgcattttacaaaagagagtgtgtgcatattattcctagtactaaggaccctcacaggtgctgctgcggtcgcctgattggacaacatgtcggtctgacgccaagtatctctgttctgcagaacgagaaaaacgagagtaggctatctcgcaacgatatacagagtgagaagtggtccatctcaaagcacacacaactgtcacccacagatgcatttggcacaattgaattccagggtgggggacactccaataaagcaatgtatgtgagagtgtcctttgatacaaagcccgacctgcttctgcatcttatgaccaaggagtggcagcttgaattgccaaaactgcttatcagcgtgcatgggggactgcagaatttcgagctgcaaccaaagttaaagcaagtcttcgggaaaggccttatcaaggccgctatgacgaccggggcatggatctttacaggcggtgttaataccggggtgatacggcacgtcggagatgccctgaaagaccacgcttcaaagagccggggaaagatctgcaccatcgggatagccccatggggaatcgttgagaaccaggaggatttgatcggtagagatgtcgtccgaccttatcagacgatgagtaaccccatgtctaagctaacagtgttgaattcgatgcatagccactttattctcgctgacaatggtactaccggtaagtatggagctgaggtgaagctgagaagacagctggagaagcacatcagtctccagaagattaatactagaatcggacagggcgtgccagtggtggccttgatcgttgaaggcggaccgaatgtgattagcatcgtgctggaatatctgcgagacactccacccgtgcctgtggtcgtgtgcgatggtagtggcagagccagtgatatactcgcttttgggcacaaatattctgaagagggcggtctgattaacgagtctctaagggaccaacttttggtgactattcagaagacattcacatatacaagaactcaagcccagcacctgttcatcatcttgatggagtgtatgaaaaaaaaggagttgattactgtgtttcggatgggctccgaagggcatcaggacatagatttggctattctgacagccctgcttaaaggcgcaaacgcgagcgcaccggatcagctgagcctggccctggcatggaacagagtcgatattgcccgatctcagatattcatctacggccaacagtggcccgtgggctccttggagcaagctatgttagacgccctcgtcttggatagggtggatttcgttaaacttttgatcgaaaatggcgtgtccatgcaccgttttttgacaatctccagactggaggaactctataatacccgacacggaccttctaacacgttgtaccatttggtcagggatgtgaaaaaaagggagtatccaggcttcggctggatctattttaagggtaacctcccccctgactaccggataagtctgatagatattggcctggtgatagagtatctgatggggggtgcttataggtgtaactacacccgcaaaaggtttcggactttatatcacaacctgtttggaccgaagcgggatgatatcccccttaggcgcggacggaaaaccaccaagaagcgtgaggaggaagtcgacatagatttggacgaccctgagatcaaccatttcccattccccttccatgaactgatggtgtgggcagtgctcatgaagcggcaaaaaatggccctgttcttctggcaacacggagaagaagcaatggctaaagcccttgtggcgtgcaaactctgcaaggcaatggctcatgaggcctctgaaaatgatatggtggacgacattagtcaggagctgaaccataacagtcgcgatttcggacagctggccgtcgagctgctcgaccagtcatataagcaggatgaacagctggccatgaagttgctgacttacgaacttaaaaattggtctaatgccacctgtctgcaactcgctgttgctgctaaacaccgggactttatcgcacacacttgctcacaaatgctgctgactgacatgtggatgggacgactgcggatgagaaaaaactccggactgaaagtgatcctgggtatactcctccccccaagtattctttccttagagttcaaaaataaagacgatatgccttatatgagccaggcccaggagattcacctccaggagaaagaagccgaagaacctgagaaaccaacaaaagaaaaagaggaagaagacatggagctcacagctatgctgggtagaaataatggagaatcttcgcgtaagaaggatgaggaggaggtgcaatctaaacacagactgatcccactgggcaggaaaatttacgagttttacaacgcgcctattgtgaagttttggttttacaccttggcatatataggttatctgatgctctttaactacattgtactagtcaaaatggaaaggtggccttccacccaggagtggattgtaatcagctatatcttcaccctagggatagaaaaaatgagggagatactcatgagcgaaccaggcaaactcctccaaaaagtgaaggtgtggttacaggagtactggaacgtgacggacctgatcgcaatccttcttttcagcgtcggcatgattctaaggttgcaagatcagccgtttcgctccgacgggagagtgatttactgcgtcaacattatctactggtatattagactgttggacatatttggcgtgaataagtaccttgggccatatgtaatgatgattgggaaaatgatgatcgatatgatgtactttgttatcattatgctcgtggtgctgatgagcttcggtgtggcaaggcaggctattctgtttcccaatgaagaaccttcatggaagttagccaagaacatattctacatgccctattggatgatttatggtgaggtcttcgcagaccagatcgaccccccttgtggtcagaatgaaacccgcgaggacggcaaaatcatacagttgccaccctgtaagacgggtgcgtggatcgttcctgccataatggcctgctacctgctggtggcaaatattctcttggtcaacttgctcattgcggtcttcaacaatacattcttcgaggtcaagtccatatccaaccaagtctggaagtttcagcgatatcagctcataatgactttccatgaaaggccagtgctcccgccacccctgatcatcttcagccatatgacaatgatttttcaacatctttgttgtcgctggcgtaagcacgagagcgacccagatgagcgcgattacggattgaagctgttcattaccgatgacgaactgaaaaaggtgcatgattttgaggaacagtgcattgaagaatatttcagagagaaggacgaccggtttaacagctccaacgacgagcggatccgggtaacttcagaaagggtagaaaacatgtccatgaggcttgaagaagtgaatgagagggagcactctatgaaggcctcgctgcagaccgtggatataagactcgcgcagctcgaagatctgattggcaggatggcgaccgctctagaaaggcttaccggcctggagagagccgaatccaataaaatcaggtcaaggaccagcagcgactgcactgatgctgcctatatcgttaggcagtctagttttaattcacaagaggggaataccttcaagctgcaagaatccatagatccagctggtgaggaaacaatgtccccaacatcacccaccctcatgcctcgtatgcgatcccacagcttctacagcgtcaatatgaaggacaagggtggaatcgaaaagttagaaagcatcttcaaggagcggagcctctctctgcacagggcaacctcctcccatagtgtagccaaggagcctaaagcgcctgctgcccctgcgaatacactggcgattgtgccagatagtcgacgtcccagtagctgcatagacatctacgttagtgcgatggatgagcttcactgtgacatagatccactcgataactccgtaaacatactgggacttggagaaccatcgtttagtaccccagtaccttctacagccccaagcagctcggcctatgccactctggcacccaccgacagaccaccatcacggagcatagatttcgaggacataactagcatggacaccaggtcgttctcaagtgactacacacacttgcccgagtgccagaatccttgggactcagagcctcctatgtaccatacgattgagcgtagcaaaagttcccgataccttgctaccacgccctttcttctcgaggaagcaccaatcgtcaagtcacattcctttatgttttccccatcaagatcttattacgccaacttcggagtcccggttaagacggcagaatatacgagtatcactgactgtattgacacacgttgtgtgaacgcccctcaagcaatcgccgaccgcgcagcattccccggaggtctcggagataaagtggaagatctcacatgctgtcaccctgagcgcgaagccgaactgagccacccctcatccgactccgaggagaatgaagccaagggtcgacgggctactattgcgatctctagccaggaaggtgataacagcgagcgaactctgtccaacaatattacagtcccaaaaattgaaagagctaatagttattccgcggaggaacccagtgccccatacgcacacactagaaaatccttttctattagcgataagcttgatagacagcgaaataccgcgagcctgcggaatccattccagcggagtaagtcctccaaaccggaaggtcgaggagactcactaagcatgaggagactaagtagaacatccgctttccagtcttttgagtccaagcacaattag

SEQ ID NO: 244608 - DNA, 4710 bp, Artificial Sequence
  Description of Artificial Sequence: Synthetic coding sequence
atgtatgtgagggtgagtttcgacactaagccagacctgctgttgcacctcatgactaaagaatggcagttagagctgccaaaacttcttatttcagtccatggcggtctccagaatttcgagcttcagccaaagcttaaacaggtttttggcaaaggactgatcaaagccgctatgacaacaggggcatggattttcactgggggagtcaataccggtgtgatacgacacgtgggggatgctctgaaggatcacgcctccaagagccggggtaagatttgcacgataggtatcgccccttggggcatcgtggagaatcaggaggacttgatcggacgcgatgtggtcaggccataccagacaatgtcaaaccctatgagcaaactgaccgtgctaaactcaatgcactctcacttcatcctggctgacaacgggacaacggggaaatatggagcagaagtcaagctgcgacggcagttagagaagcacatctccctacagaaaattaatacaaggtgtctcccatttttctccctggacagccgactgttttatagcttctgggggtcctgccagctcgattctgtgggtatcggacagggtgtacccgtagtggccttgattgtcgaaggaggtcccaacgttattagcattgtcttagagtatcttcgcgacactccgcctgttccggttgttgtttgcgatggatccggcagggcatctgatattctcgccttcggtcataagtacagtgaggaaggtgggctgatcaatgaatcactgagggaccagctgttggtgacgatccaaaagactttcacctatacgaggacacaggctcagcatttattcatcatactgatggagtgtatgaaaaaaaaagaactgatcaccgttttccgtatgggtagcgagggccaccaagacatcgatctcgctatccttacggccctacttaagggcgcaaacgccagcgccccagatcagctatctctggcactggcctggaacagagtcgacattgctaggagccagatctttatctacggtcagcagtggcccgtaggctcattagaacaagccatgctggatgcactcgtattggatcgagtcgattttgttaaactgctcatcgagaacggggtgtccatgcacaggtttctgaccatcagcagactcgaggaactgtacaacactagacacggcccatcgaacaccttgtaccatctcgtccgtgatgtaaaaaaaggaaatctaccgcctgactatagaatctctctgattgatataggactcgtaattgagtatctgatggggggtgcatacagatgcaattacacacgcaagcgctttaggacactgtatcacaacctgtttggacctaagagagacgacatcccactgaggagaggcaggaagacgacgaaaaaaagagaagaagaagtagacatcgatctggatgacccagagatcaatcacttccccttccccttccacgagctgatggtgtgggccgtgctcatgaagagacagaagatggccttgttcttctggcagcatggcgaggaagccatggccaaagccctggtagcttgtaaactctgcaaagcgatggcacatgaagcctcggaaaacgatatggtcgacgatatctcacaggaactgaaccacaatagccgcgattttggtcaactggccgtcgagctgttggaccagtcttacaagcaggatgaacagcttgccatgaagttgcttacctacgagttgaagaactggtcaaatgcgacctgcctgcagctcgcggtcgccgctaagcacagagacttcatcgcccatacatgcagtcaaatgcttttaaccgatatgtggatgggccgtttgagaatgagaaagaactccggcctgaaggttattctggggattctgctccctccgtccatcctgagcctggagttcaaaaataaagatgatatgccttacatgtcccaggctcaagagatccacctgcaggagaaagaagcggaggagcctgaaaagcctacgaaagagaaggaggaagaagatatggagctgacagcaatgctggggagaaataacggggagagttctaggaagaaggatgaagaggaagttcaatcaaagcaccggctgatccctctcggaaggaagatctatgagttctacaatgcacctatcgtgaaattctggttttatacacttgcttacatcgggtatctaatgctgtttaattacatagtcctggtgaagatggagcggtggccttcaacccaggaatggattgtgatctcatacatattcactcttgggatagagaagatgcgggaaattctcatgtccgagccaggtaagctccttcagaaggttaaggtgtggctgcaagagtactggaacgtcaccgacctgatcgccattctcctattctccgtggggatgatcctgagactccaggatcagcctttccgcagcgatggaagagtaatatattgcgtgaacatcatttactggtatattcgtctcttagacattttcggcgtcaataagtatctggggccttatgtgatgatgatcggtaagatgatgatagatatgatgtacttcgttataatcatgctagtcgtgttgatgtccttcggagtggctaggcaggccatcctattcccaaacgaggagccatcctggaagctcgcgaaaaacattttctatatgccatactggatgatttatggcgaagtgtttgccgaccagatagaccctccatgcggccaaaatgaaacacgggaggatggaaagattatccagctgccaccctgtaagacgggtgcttggatcgtgcccgcaataatggcctgttatctgctggtggctaacattctcttggttaatttactgatcgcagtttttaacaacacatttttcgaggtcaaaagcattagtaatcaggtatggaagttccagcggtaccaactgattatgaccttccacgagcgtccagtcctcccgccacccttaataattttcagtcatatgactatgatctttcaacatctctgctgcaggtggcgtaagcacgagtccgatcccgatgagagggattatggcctcaaactgttcataacagatgatgagttaaagaaggtacatgactttgaggaacagtgcattgaggagtatttcagggaaaaagatgaccgatttaacagctcaaatgacgaaagaatccgtgttacatctgagcgtgtcgaaaacatgtctatgaggctcgaagaggttaacgagcgagaacattccatgaaggcaagtctgcagaccgtggatattcggttggcccagctggaagatcttattgggaggatggccaccgccctcgagcggctcacggggttggaaagggctgaatctaacaaaatccgcagtagaacgagctcagactgtaccgacgccgcatatatcgttcggcaatctagttttaattcccaggaggggaacacctttaagcttcaggagtctatagaccctgccggtgaggagaccatgtcacccacttctcccacacttatgcctcgcatgagatcgcattcattttacagtgtgaatatgaaagataagggtggcatcgaaaagctcgagagtatattcaaggaacgcagcctatctctacatagggcaacaagctctcacagcgtcgcaaaggagcccaaagcgcctgcggctcccgcaaatacgcttgcgatagtgccagacagccggcgtccgtcatcatgcatcgatatttacgtgtccgcaatggatgaattgcactgcgatatagaccctctcgacaattcagttaacattctagggcttggagagccaagcttttccacacccgtgccgtccaccgccccatcctcctcagcctatgctacacttgccccaaccgatcggcctccatccaggtcaattgatttcgaggacatcactagcatggacaccagaagcttctcaagtgactatacgcaccttcccgaatgccagaacccatgggatagtgaacctcctatgtatcatacaattgaaaggtctaagtcctctagatacttagccaccacgccatttttacttgaggaggcacccattgtgaagagtcattcctttatgtttagtccttcacgcagctactacgctaactttggggttccggtgaagaccgcggaatatacctctatcaccgactgtattgacacacgctgtgtgaatgcccctcaggccatcgctgatcgcgcagcttttccagggggtctcggcgataaggtggaagacctaacttgctgtcaccccgagcgggaggcagaactgtcccacccctcctccgacagcgaggagaatgaggccaagggcagaagagcgaccatagccatcagcagccaggagggagacaattccgagcgaacactatctaacaatatcacggtcccaaagatcgagagagcaaattcctattctgcagaagagccttcagccccatacgcccatacccgcaaaagcttcagcatcagcgataaactggaccgacagcggaataccgcatccctgcggaacccctttcaacgatctaagagctcaaagccagagggaagaggggatagtctcagcatgaggagattgtcgagaacatcagcatttcagagtttcgaatctaagcacaactag

SEQ ID NO: 244609 - DNA, 4710 bp, Artificial Sequence
  Description of Artificial Sequence: Synthetic coding sequence
atgtacgtgcgcgtgagctttgacacaaagccagatctattgctgcatcttatgacgaaggaatggcagttggaactccccaaactgctgatctcagttcacgggggtctgcagaacttcgagcttcaacccaaacttaagcaggtctttggcaaagggctgatcaaggccgcaatgaccacaggagcatggattttcacaggtggggtcaataccggcgtgatcagacacgttggcgatgctttaaaagaccacgcgagcaagagtcgaggcaaaatctgcaccatcggtatcgcgccatgggggatcgtggaaaaccaagaagatctcatcggcagggatgtcgtacggccatatcagacaatgtctaacccaatgtcgaaactaactgtcctgaattcaatgcactcccacttcatcctggctgataacggaaccactgggaagtatggggctgaggtcaaactaaggaggcagctcgaaaagcatattagcctccaaaagattaacactagatgcctcccgtttttctctctggactcacggctgttttattctttttgggggtcatgccagctggatagtgtgggcattggccaaggagtccccgtcgtggcactgattgtggaaggcggtcccaatgtaattagcattgtcctcgagtatctcagggacaccccacctgtgcccgttgtcgtatgcgatggaagcggtcgcgcaagcgacattttagctttcgggcacaagtactcagaagagggtgggctgattaatgagtcactgagagaccaacttttggtgacaatccagaagacattcacttatacccggacacaggcacagcatctcttcatcattcttatggaatgcatgaaaaaaaaagaactcattaccgttttccggatgggctcagagggtcatcaagatattgacctcgcaatcctcaccgccctattgaaaggcgcaaatgcatccgcaccagaccaactgagtctggcccttgcttggaatcgcgtggacattgctcgtagccagatctttatctatggacagcagtggcccgtgggctccttggagcaggcgatgctggacgcacttgttctggatagggtggattttgtgaaactgttaatagagaacggggtctccatgcacagatttctaaccatcagcaggttggaggaactctataacactaggcacggaccctctaacacgctataccacctcgtgagggatgtcaagaaaggcaacctccccccagattaccggatatcactgattgatatagggctcgtaatcgaataccttatgggaggagcttaccgatgcaactacacgcgcaaaagatttaggactttgtatcacaacctgttcgggcctaagcgcgacgatatcccactgcgacgaggccgaaagactacgaaaaaacgtgaggaggaagtggatatcgacctggatgatccggagatcaaccacttccccttcccctttcacgagctgatggtttgggcagtgttgatgaaaaggcagaagatggcactgttcttttggcagcacggcgaggaggccatggccaaagccctggtcgcttgcaagctctgcaaagcaatggctcatgaagccagtgaaaatgatatggtagacgacatttctcaagagttaaaccacaattcacgcgactttggccagcttgccgtagagctgttagatcaaagctacaagcaggatgaacagctcgccatgaagctactcacctacgagttgaaaaactggagcaatgccacatgcctgcagctagcagtggccgctaagcatagagactttatagctcatacctgcagccagatgctgctgacagacatgtggatgggacggctacgcatgagaaagaattccgggctgaaggtcatccttggtattttattgccacccagcattctgagtcttgagtttaaaaacaaggacgatatgccttatatgtctcaggcacaagaaatccatctgcaagagaaggaggccgaagagccagagaagcccaccaaggaaaaggaggaagaggacatggagctgaccgcgatgcttggaaggaataatggtgaaagtagtcgaaaaaaagacgaggaagaggtgcagagtaagcatagactgatccctctgggcagaaagatctatgagttctataacgcgccaatagtcaaattttggttttatactctcgcctatatcggctatctcatgctctttaattatattgtccttgtgaaaatggagcgttggccctcaacacaagagtggatcgtgatttcttatattttcactctggggattgaaaaaatgagagaaatactgatgagtgaaccaggcaaattactgcagaaagtcaaggtgtggctgcaagaatactggaacgtgaccgaccttatagccatcctgctgttttcagtaggcatgattctgcgcctgcaggatcagcctttcagaagcgacggcagagtaatctattgtgtcaacattatctactggtacatccggctgctggacatctttggcgtgaacaaatatctgggcccatacgtaatgatgatcggcaagatgatgattgacatgatgtacttcgtgatcatcatgcttgtcgtccttatgtcatttggtgtggccagacaggcaattcttttccccaacgaggagccctcttggaagctggctaagaacattttttacatgccctactggatgatttacggtgaagtgttcgcagaccaaattgatcccccatgtggacagaatgagacgagagaggatgggaagataatccaactccctccttgcaaaaccggagcctggattgtgcccgcaatcatggcgtgctacctcctcgtcgccaacattcttctggtcaatctgttgatcgcagtgtttaataacacttttttcgaggtcaaatcaatctctaaccaagtttggaagtttcagagataccagctcatcatgacatttcatgagcgcccagttctgcccccacccctgatcatcttttcccacatgacgatgatattccagcacctgtgctgtaggtggagaaaacatgagtccgacccagacgagagagactatggcctaaaactcttcattaccgacgacgaactgaagaaggtgcacgactttgaggaacaatgcattgaagaatactttcgcgagaaagacgacaggtttaatagttccaatgacgaacgtattcgagtcacgtccgagcgcgtggagaacatgtccatgcggctggaggaggtgaatgagcgagaacattctatgaaggcatctttgcagactgtggacatcagattagcccagcttgaggaccttatcggcaggatggccaccgctctggagagactgacaggactcgaacgcgcagagtcgaacaagatccggagccggacttctagcgactgcactgatgccgcttatatcgttaggcagagttccttcaattcacaggagggtaacacttttaaactccaggaatctatcgaccccgcaggtgaagagacgatgagtccaaccagcccaactctgatgccgaggatgagaagtcatagcttttacagtgttaatatgaaggataaggggggaatcgaaaaactcgaaagcattttcaaggaaagaagcctatcactacatcgggcaactagctcccactccgtggccaaggaacccaaagccccagcagccccagcgaatactcttgctattgtacctgacagccgtagacccagttcatgcatagacatatatgtttccgcaatggacgagttacactgcgatattgaccccttggataacagcgtgaacatccttgggttaggcgagccaagtttctcaacccccgtccccagcacagcaccctctagttccgcttacgccactcttgctcccacagaccgaccaccttcacgatcgatcgatttcgaggacatcacatccatggatactcggtccttttcctctgattatacccatttaccggagtgtcagaatccatgggacagcgaacctcccatgtaccacactatcgagagatctaagtcctcacgctatttagccactacgccgtttcttctggaagaagcgccaatcgtcaaaagccactcttttatgttcagcccttcccggagctattacgccaattttggggtaccagttaagactgccgaatacactagtataaccgattgtattgacacacgttgcgtgaacgccccacaggccatagcagaccgcgcagcatttccgggtggcctgggcgataaggtggaggacctgacctgctgtcaccccgagcgggaggcagaactctcccatccaagctccgactccgaggaaaacgaggctaagggtcggagggccacaatcgccatttctagtcaggagggcgataatagtgagcgtacactgtccaacaatatcaccgtgcccaagatagagagggccaacagctattccgcagaggaaccatccgcaccctacgcgcacacgcgaaagtccttcagcattagcgataagcttgaccgccagcgaaatacagccagcctgaggaacccctttcagcgcagcaaatctagcaagcccgaaggcagaggggacagcttatcaatgaggcgcctctcgagaacctcggccttccagtcatttgaatccaagcacaattag

SEQ ID NO: 244610 - DNA, 4701 bp, Artificial Sequence
  Description of Artificial Sequence: Synthetic coding sequence
atgtacgtccgcgtttctttcgataccaagcccgacttgctgcttcatctcatgaccaaggagtggcagctcgagcttccaaagctcctaatatccgtccacgggggtctccaaaatttcgaacttcagccaaaactcaagcaagtttttggtaaggggctgatcaaggccgcaatgaccacaggagcctggatattcaccggaggagtaaatacaggcgtgattcgccatgttggtgacgccctgaaagatcatgcctccaaaagtagaggcaagatctgtactattggaatcgcgccttggggcatcgtggagaatcaggaggacctgatcggcagggatgtcgtgcgcccttaccagactatgagcaatcccatgagcaagctgacagtgctgaactcaatgcacagccacttcatactcgctgacaacggaacaaccggcaaatacggagcagaggttaagttgcgcagacaactcgagaagcacatttctttgcagaaaatcaacacccgtattggacagggagttcctgtggtcgcgttaatcgttgaaggtggccctaacgtgatctcgattgtgcttgagtatctcagagatactccccctgtgcccgtcgtagtgtgtgacgggtctgggagggcatccgacatcttagcctttggacacaagtatagcgaggagggaggtttaatcaacgagagtctgagagaccaattgctggtcacaatccaaaaaacctttacatatacgcgtactcaagcacaacacctgtttatcatcctcatggagtgtatgaagaagaaagagctcataaccgtgttcagaatgggaagcgagggtcatcaggatatcgatctcgccattctcacagctctgctgaagggggcaaatgccagtgcacccgaccaactttctctagcactcgcatggaaccgcgtagacatcgccaggtcccagatatttatatatggacagcagtggcctgtagggtcactcgaacaagcaatgctggatgcactggttttggatcgggtggatttcgttaaacttctgatagaaaatggggtcagcatgcatagattcctcaccatctcccgccttgaagagctgtataacacccgtcatggcccttccaacactctgtaccacctagtccgtgacgtgaagaaacgggaatatccaggcttcggctggatctactttaaaggtaacttacctcccgattatagaatcagtcttattgacatcggacttgtgatagagtacctgatgggcggagcatacaggtgtaactacactagaaagcgctttcgcactctctaccacaacctgttcgggcctaaacgccctaaagccctgaagctcctcggtatggaggacgatatcccactgcggcgaggaagaaaaaccacgaaaaaacgtgaggaggaagtcgacattgacttggacgatccagagataaatcattttccttttcccttccacgagttgatggtgtgggctgtgcttatgaaacgtcagaaaatggctctgtttttctggcagcatggagaagaggcgatggccaaggctctggtcgcctgcaagctttgcaaagcaatggctcatgaggccagcgaaaacgacatggttgatgatatctcacaggagcttaaccacaatagtcgagatttcggccaactggccgttgagttactggatcagagctacaagcaggatgagcagcttgctatgaagctcctgacctacgaacttaagaattggagcaatgcaacttgcttgcagcttgcagttgctgcaaaacacagggacttcattgcacacacctgctcccaaatgctgctcactgatatgtggatgggtagactgagaatgcgcaagaattccggcctaaaggtcattttgggcatcctgctacctccaagtatcttaagcctcgagttcaagaataaagatgatatgccttatatgagtcaggcccaggaaatccatttgcaggagaaagaggccgaggaacctgagaaaccaacgaaggagaaggaagaggaggacatggaacttactgctatgctcggcaggaacaatggagagtcctcgaggaagaaagatgaggaggaggtgcagtctaaacatcgtctcatcccactggggcgaaaaatctacgagttctacaacgctccaatcgttaagttctggttctacacgctggcttatatcgggtatctgatgctgttcaactatattgttctggtaaagatggaaaggtggcctagtacccaggaatggatcgttatctcgtacatcttcacgctaggcattgaaaagatgcgcgagatcctgatgagcgaacccggtaagctgctgcagaaggtcaaggtgtggctgcaggagtattggaacgtgaccgatctgatagccattctcctgttctctgtaggaatgatactccggctgcaggatcagccattccgatcagatggcagagtaatttactgtgtcaatatcatttattggtatattcgcttgctggatatctttggtgtcaacaagtacctcggcccttatgtgatgatgataggaaagatgatgatcgacatgatgtatttcgtgattatcatgctggtagtcctgatgagctttggagtcgcacgacaggcaatcctgtttcctaatgaggaaccctcgtggaagctggccaagaacatcttctacatgccctattggatgatatatggtgaggtgtttgccgatcaaatcgaccctccttgtggacagaatgagacgcgtgaggatggcaagataatacagttgccgccatgtaaaaccggtgcgtggatagtcccagctatcatggcctgctacctactcgttgccaatatacttctcgttaacctgttgatagctgtgttcaataataccttttttgaggttaaatctatctccaaccaggtgtggaaatttcagcgttaccaactcataatgactttccatgaacgcccagtgctgccccctccactaattatcttctctcatatgacgatgatcttccaacacctgtgctgtcgttggaggaagcacgagtctgacccagatgagagagactacggcctgaagctttttataaccgacgacgaactgaaaaaagtccatgacttcgaagaacagtgtatcgaagaatacttcagggagaaggatgaccgctttaacagtagcaatgacgaaaggattcgagtgacgtccgagagagttgagaacatgtcaatgcgcctggaagaggtcaacgagcgagagcacagcatgaaggctagcctccagacggtcgacatacgtttggctcaactcgaggatttgattggccgtatggctacagcgctagagcgtttgaccggtctggagagagccgagtctaataagatacgctctcgcaccagttcggattgcaccgacgccgcttacatcgtgcgtcagagctcatttaattcacaggagggcaatacctttaaactgcaagagtcgatcgaccccgctggagaggagaccatgtcacccacaagccccacccttatgcctcgcatgcgcagccacagcttttactctgttaatatgaaagacaagggtgggatcgaaaagctcgagtctatttttaaggagcgatcattgtccctgcatagggccacaagctctcattctgtggcaaaagaacccaaagctcctgctgccccagcaaatactcttgccattgtgccagacagccgcagaccatcttcctgtatcgatatttacgtgtccgccatggacgaactgcactgtgacattgacccactggataatagcgtcaatattctgggcctgggagagccaagtttctcaacccctgtaccgtcgactgcaccgtcctccagcgcatacgcgacactggcgcctactgatcgcccaccaagcaggtctatcgattttgaagatattacgagcatggatactaggtccttcagttctgactacacccatttgcctgaatgccaaaacccttgggacagcgagcctccaatgtaccacaccattgaaaggagtaaaagttcacgatatctggccacaaccccatttttgctcgaagaggctccaattgttaagtcacactcattcatgttttcaccgtctaggtcctactatgctaattttggcgtgccagtaaagaccgccgaatatacttccattacagactgtatcgatacccgatgcgtaaatgcacctcaggccatcgccgaccgcgctgctttccctggagggctcggtgacaaggtcgaggatcttacttgctgccatccagagagagaagccgagctgtcccacccttcatcagattcagaggaaaacgaagcaaaagggcgacgggcaaccattgcaatatccagtcaagaaggcgacaattcggaaagaaccttgtccaataatattacggttcccaagattgaacgggcaaattcttacagcgcggaagagccttcggccccttacgcacatacgagaaaaagctttagcatctcggataaactcgacaggcagagaaatacagcctccctcaggaatccattccagcgcagcaaatcatcgaagcccgaaggccgtggggacagcttaagtatgcgcaggctctcccggacgtccgccttccaatcgtttgagagcaagcataattag

SEQ ID NO: 244611 - DNA, 4740 bp, Artificial Sequence
  Description of Artificial Sequence: Synthetic coding sequence
atgtatgtgagagtgtcgtttgatactaaaccggacctcctcctccacctcatgacaaaagagtggcaactggaacttcctaaattgctgataagcgtacatggcggtctgcaaaacttcgagctacagcctaaactaaagcaagtgttcggaaaaggcttgattaaagccgcaatgacaaccggcgcatggatctttactggcggtgtcaatacaggcgttatcagacatgttggcgatgcactgaaggaccacgccagtaagtcacggggaaagatctgcacaattggaatagcaccttgggggatagtggagaaccaagaagaccttatcgggcgagatgtggtccggccttatcagaccatgtctaacccaatgtccaaacttactgtgctgaatagcatgcatagccacttcattcttgccgacaacggcacgacagggaaatatggggcagaagtgaagctgagacggcagctggaaaagcacattagcttgcaaaaaataaacacccgctgtctgccattctttagccttgattcccggctgttttactcattctggggaagttgtcaactagatagtgtgggcatcggacaaggggtgcccgtggtagcgctgatcgtggaaggcggtccaaacgtgatctccatcgtgctggagtatcttcgggatacaccgccagtccccgttgttgtatgcgatggatctggcagggcatctgatattctggcttttggtcacaaatacagcgaggaagggggactgatcaacgagtcactccgggaccagctcctggtcaccatacagaaaacttttacatatacccgcacccaggcgcaacatttgtttataatcctgatggagtgtatgaagaagaaggaacttattacagtgttccgcatgggatcagagggtcaccaggacatcgacctagctatcctgaccgccctcctgaagggggctaacgcttcggcccctgaccaactcagcctggcgctcgcatggaatagggtagacatcgccaggagtcagatctttatctacggccagcagtggccggtgggttctctggagcaagccatgctggacgctctggtgctagaccgagtggactttgtgaagctgttgatagagaatggcgtaagtatgcaccgcttcttaacaattagtaggctggaggagctgtacaacaccagacacggaccatctaataccctgtaccacctggtgagagacgttaaaaagggaaatctaccacccgactatcgcatatccctgatagatatcggcctggttattgaatatttaatgggcggtgcttacagatgcaattataccaggaaacgtttcagaacactctatcacaatctgttcggtccaaagcggccaaaagccctaaagttgctgggaatggaggacgacatcccactgcggagaggaaggaagaccaccaaaaaacgggaagaggaagtcgatattgatctggatgacccagagataaatcattttcctttccctttccatgaacttatggtatgggctgtcttaatgaaacggcagaagatggccctttttttttggcaacacggagaagaggctatggccaaagctctggttgcttgcaagctctgtaaggcgatggcccacgaggcttccgagaatgacatggtagacgatatctcccaagaattgaaccacaattcccgtgacttcggccagttggctgtggaacttttagaccagtcatacaagcaggatgagcagctggctatgaaattgcttacctacgagctcaaaaattggagcaacgcgacttgcctgcagctggcagtggccgctaagcatagagacttcatcgcccacacatgtagccagatgctcctgacagatatgtggatgggaagactgagaatgagaaagaactcaggtctgaaggtgatactggggattttactcccccctagcatcctctcccttgagttcaaaaataaggacgatatgccttatatgagccaggcacaggagatccatctccaggagaaggaggccgaggaaccagaaaagcctactaaagagaaagaggaggaagacatggaactcaccgcaatgctcggacgaaataacggagagtcttctcgcaaaaaggatgaggaggaagtgcagtctaaacacagactcattccattagggcgtaagatttacgaattttacaatgcaccaatcgtaaagttctggttctacacattggcttatatcggctacctgatgttgttcaactacatcgtcctggtaaaaatggagcgctggccctccactcaggagtggattgtcataagttacatttttacgctcggaatcgaaaagatgagagaaattcttatgagcgagccaggcaagttacttcagaaggtgaaagtatggctccaagagtattggaatgtcacagatctcatcgctattctgcttttcagtgttggtatgatcctccgactgcaagaccagccatttagaagcgacgggcgtgtgatctattgcgtcaatattatctattggtacataaggttgctagatatctttggcgtgaacaagtacttagggccttacgtcatgatgattggcaagatgatgatagacatgatgtacttcgttattattatgctggtcgtgctcatgtcattcggggtggccagacaggctattctgtttcctaatgaagaaccatcctggaaactggcgaaaaacattttttacatgccctattggatgatatatggcgaggtgtttgccgatcagatcgatccaccctgcggccagaacgagacccgtgaagacggcaaaattattcagttacccccatgcaaaaccggcgcttggatagttcccgcaatcatggcctgctacctactggtcgcaaacattttgctggtaaacctgcttatagccgtgtttaataacacatttttcgaggtaaagtccatttccaaccaggtgtggaagttccagagatatcagctaatcatgacatttcacgaaagaccagttctgcctccgcctttaattatcttctcccacatgacaatgatcttccaacacctctgctgtcgctggaggaagcatgagagcgatcctgacgagcgagactatggtctgaaactgtttatcacagacgacgagctcaagaaggtgcacgactttgaggagcaatgcattgaagagtattttcgcgaaaaagacgatcgatttaattcatctaacgacgaacgcatcagagttacaagtgaaagagtggagaacatgtcgatgcgtcttgaggaggtgaatgagagggagcactccatgaaggctagtttacagactgtcgatatccgactggcgcagctggaggatctgatcgggcgaatggcaaccgctttggagagactcacaggcctggaacgagcagagagtaacaagattcgttcacgtacttccagcgattgcaccgacgccgcatacatcgtccgacaatcatccttcaactctcaggaaggaaatacatttaagctgcaggagtctattgatccggcaggcgaggaaacaatgagtccgacttcccctactctcatgcccagaatgcgctcccactctttttatagcgtaaatatgaaggataaaggtgggatagagaaactagagtcaatctttaaggagagatctctaagcctccatagagcgacttctagccactcggtagctaaagagcccaaggcgccagccgctccggcaaacaccctagcaatagtgcccgacagcaggaggccgagcagctgcattgacatctatgtgagcgcaatggatgagctccactgtgacatcgatccccttgataacagcgtgaatatacttgggctcggcgagccttccttctccacacctgtcccatcaacagctccttctagctctgcctacgccaccctggcccctacagaccggccaccgagtcgcagtatagactttgaggacatcacaagcatggacacacgttctttcagctccgactacacacatctccccgaatgccaaaatccttgggacagcgagccacccatgtaccacacaatcgagagaagtaagtcctcacggtaccttgccaccacacctttcttgttggaagaggctccaatcgtgaagagtcacagttttatgttctctccatctagatcatactatgctaacttcggcgtacccgtaaagaccgcagagtacaccagcataaccgattgcatagataccaggtgcgtcaacgcccctcaggccatcgcggacagagcagctttccctggaggactgggcgacaaggtcgaagaccttacttgctgtcatcctgaaagggaggctgagctgtcacatccctcctctgacagcgaagagaatgaggccaaaggcagaagagcaactatcgcgatcagctcccaggagggagacaacagcgagcgcacattgtcaaacaacattaccgtccctaagatcgagcgggcaaatagctatagcgcagaggagccctcagctccctacgctcatactagaaaatcattttccatttcagacaagctcgaccgtcagagaaacaccgctagcctccggaacccgttccaaaggagcaaatcttccaagcccgaagggaggggggactccctgtccatgaggaggttgagcaggacctctgctttccagtcatttgagtcaaagcataactag

SEQ ID NO: 244612 - DNA, 5123 bp, Artificial Sequence
  Description of Artificial Sequence: Synthetic coding sequence
atgcccgagccttgggggactgtttacttcctcggaatcgctcaggtcttctctttcctgttctcctggtggaacctggaaggggtgatgaaccaagcggacgctcctagaccacttaactggactattcggaagttgtgtcacgccgcatttctgccctccgttcggctcctcaaagcccagaagtcctggattgaaagggccttttacaaacgagaatgtgtgcacatcattccatcaacaaaagatccccatcgatgctgctgcggacgactgattgggcaacatgtgggcctaacaccttcgatcagcgtcttgcaaaacgagaaaaatgagagtcgtttgagccggaacgatatccagagcgagaaatggagcatctccaaacacacgcagttgtcgcccacagatgccttcggcactattgaattccagggagggggacactctaataaggcgatgtatgtccgggtttcattcgatactaaacccgatttacttctccacctgatgaccaaggagtggcagttagagttgcctaagttactcattagtgtgcatggtggattgcagaatttcgagctgcagcctaagctgaaacaggtgtttgggaaaggacttatcaaagcggcaatgaccactggcgcttggatttttactgggggagtcaataccggcgttatcagacatgttggcgatgctctgaaggatcacgcttctaagagtcggggaaaaatctgtacaattgggattgctccttggggaatagtggaaaatcaggaggatttgatcggccgagacgtggtaagaccatatcagaccatgtctaaccccatgtcaaagctgaccgttctcaactccatgcattcccactttattttggccgataacggaacaacgggcaagtacggggcagaagttaaactgcggaggcaactggagaaacatataagtcttcagaaaattaacacacgcatcggacagggagtccccgttgtggcactgattgtcgaggggggacccaatgtgatttctatcgtgctagagtacttgcgggatacccccccagtgccagtggtagtgtgtgatggctccgggagggccagtgatattttggcatttggacataaatattccgaagaaggcggactcataaatgaaagcctgagggaccaattgctcgtgaccattcagaagacctttacatacactaggacacaggcacagcatcttttcattatcctaatggaatgcatgaaaaaaaaagagctgataaccgtgttccgtatgggcagcgaaggccaccaggacattgacctcgcaatcttaaccgccttactcaaaggcgcaaatgcttctgccccagatcagctttcactggccctcgcctggaatcgggtggacattgctaggagtcagatcttcatctacggccagcagtggcctgtggggtcactggagcaggcgatgttagacgccctggtcctggaccgcgttgactttgtcaaactgctgatagaaaatggcgtgagtatgcatcggttcctcacaattagccgcctcgaggagttgtacaataccaggcatgggccaagcaatacactttaccacctggttcgcgacgtgaagaagggtaatctcccacccgattacaggatcagtctgatagatatagggctcgtgatagaatatctgatgggtggggcttatcgctgtaattacaccaggaaaaggttccggactctgtatcataacctgttcggacctaaaaggccaaaagccctcaaattgttgggaatggaggacgacatacccctccgacgcggtcgcaagactaccaaaaagcgagaggaggaagtcgacattgatttggatgaccccgagataaaccatttccccttcccttttcacgaactgatggtctgggctgtgctaatgaagaggcagaagatggcactgtttttctggcagcacggagaagaggcaatggcaaaggcactggtcgcttgcaagctttgcaaggcgatggcccacgaagcctccgaaaacgatatggtagacgacattagtcaagagctgaaccataatagccgcgatttcgggcaattggccgttgagctcctcgaccagagttataagcaggatgagcagcttgccatgaagcttttgacgtacgagctgaaaaactggtccaatgcaacttgtctccagctggccgtcgcggctaaacaccgagacttcatagcgcatacttgctctcagatgctgctgactgatatgtggatgggcaggctgcgaatgagaaagaacagcggccttaaggttattctcggtatcctccttccccctagtattttgtccctcgagtttaaaaataaagacgatatgccctacatgtctcaagcacaggagatacacctacaagagaaagaagcggaggagccagaaaagcccactaaagaaaaggaagaggaagatatggagctaacggcaatgctgggcaggaataatggagagtctagccgcaagaaagatgaggaggaggtgcagtctaagcatcgcctgattccactgggcaggaagatctatgagttttacaatgccccaatcgtgaaattctggttctacactttagcgtatataggctacctgatgctgttcaattacatagtgctggtgaagatggagaggtggccttcaacccaagagtggatcgttattagttacattttcaccctgggcatagagaaaatgcgcgagatcctgatgagcgagcccggaaaacttctccaaaaggtcaaagtgtggttacaggaatactggaacgtgacagatctcatcgccattttactatttagcgtcggcatgatcctgcgcttacaggaccagccgttcaggtctgacggccgagttatctactgcgtgaatataatctactggtacattagattgttagacatttttggagtcaacaagtatcttggcccatacgtgatgatgatcggcaagatgatgatcgacatgatgtactttgtgattattatgctggtagtgttaatgtcgttcggagttgccaggcaagctattctcttcccaaacgaggagccttcttggaaacttgccaagaacattttctatatgccctattggatgatctatggagaagtgtttgccgatcagatagaccccccatgcgggcagaatgaaaccagggaagatgggaaaattattcagctcccaccctgcaaaacaggtgcttggatcgtccctgccataatggcatgttacctgctggttgccaatatcctgctggtgaacctgcttatcgcagtctttaataatacgttctttgaagttaagagtatctctaatcaggtgtggaagttccagcgataccaactgatcatgacatttcatgaacgtcctgtgctgccccctccactgatcattttttctcacatgaccatgatatttcagcatctgtgctgcagatggagaaaacacgagagtgatcccgatgaacgggactacggcctgaaactatttattactgatgacgagcttaaaaaggttcacgatttcgaggaacagtgtattgaggaatattttagggaaaaagacgaccgattcaactcctccaatgacgagagaattcgtgtcacgagcgagcgggttgaaaatatgtctatgcggctggaggaggtgaacgaacgggagcatagcatgaaggccagtctgcaaactgtcgacatccgccttgcccagctggaggacctgattggccgtatggctaccgcgctggagagactgacaggcctagagcgagccgaaagcaataagatccgcagtagaacctcctcagactgtactgacgccgcttatattgtgagacagagctcatttaactcccaggagggtaacaccttcaaactgcaagaatcaattgatcctgcgggagaggaaaccatgtcacccacgtcccctacattgatgcctcgaatgaggtctcacagcttctactcggtcaatatgaaggacaaagggggaatcgagaaactcgaatcaatcttcaaggagcgaagtctgtctcttcacagagctacttctagccactctgtggctaaggaaccaaaagcaccagctgcgcctgccaacaccctggctatagtacctgactcccgacgccctagttcatgtatcgatatttacgtgagcgccatggatgagctgcattgcgacattgacccattggataacagcgtgaatattctcggcctcggcgagccatcattctctacacctgtgccttccacggcaccatctagctctgcatatgctacgctcgcccctaccgacaggccccctagtcggagcattgatttcgaggacatcacgtctatggacacgaggtcatttagttccgactatacacacctgcccgagtgtcaaaacccctgggactctgagccacccatgtaccatacgatcgagagatccaagtcatcccgataccttgctaccactccatttttgttagaggaagcaccgatcgttaagagccactcattcatgttctcacctagtcgaagctactacgccaacttcggggttcctgtgaagaccgccgagtatacctcaatcacagattgtatcgacactcggtgtgtcaacgcaccccaagccatagcagatcgtgcggcatttccaggtggcctgggcgacaaagtcgaggacctgacgtgttgccaccctgaacgtgaggccgaactgtcacacccctcatctgatagcgaggagaacgaggccaagggcaggagagccaccattgccatcagctcccaagaaggcgataatagtgagaggactctgtcaaataacatcacagtccctaaaatcgaaagagcgaattcgtacagcgccgaggaaccttctgcaccatacgcccatacccgaaaaagcttttccatttccgacaaactggacaggcagaggaacaccgcctccttgaggaaccccttccagcgaagcaaaagttctaaacccgaggggcgaggagattccctgagtatgcgaaggctgagtcggacaagtgcctttcagtcgtttgaatcgaagcataatta

SEQ ID NO: 244613 - DNA, 3978 bp, Artificial Sequence
  Description of Artificial Sequence: Synthetic coding sequence
atgcctgaaccatgggggaccgtttattttctgggaatcgcacaggtgttcagttttctcttctcttggtggaacctggagggggtgatgaaccaggctgacgcccctaggccgcttaactggactataaggaagctttgtcacgcagcgtttctacccagtgtcaggctgttaaaggcgcagaaatcttggatcgagcgggctttttacaaacgcgagtgtgtgcacataattcctagcaccaaggaccctcatagatgttgctgtggacggttgatcgggcagcatgtggggttgaccccatcaatcagtgttctccagaatgagaagaatgagagccgcctgtcccgaaatgatatccaatctgagaaatggtccatttctaagcatacacagctttcgcccaccgatgcctttggcaccatcgaattccagggaggaggtcattccaacaaggccatgtacgtgagagtgagtttcgacactaagcctgacttacttctgcatttgatgaccaaggaatggcagctggaactacccaagttgctcatctcggtgcatggaggccttcagaacttcgagcttcagcctaagttgaagcaggtttttggcaagggcttaattaaagcagccatgactactggggcatggatctttacagggggagtcaacacaggtgttatccgccacgttggtgatgcattaaaagaccatgcctctaagagtcgaggtaaaatctgtactattggaatcgcaccatgggggatagtggaaaaccaggaagatctgatcggtagagacgtggtccgtccataccagaccatgtccaatcccatgagtaagctaacagtgttaaactcaatgcacagccatttcattctggccgacaacggtaccaccgggaagtatggagccgaggtgaagttgcgtcgacagttagagaaacacatctccctccagaagatcaacacacgaatcggtcagggcgtgccagtggtggcgctcatagttgagggcggacctaacgtaattagtatcgttctggagtaccttcgggacactcctcccgtgccagtggtcgtttgcgacggctcaggcagagcctctgatattctggctttcggtcataagtatagcgaggaaggcggattgataaatgaaagccttagagaccagctgcttgtgacaatccagaaaaccttcacatatacaaggacacaggcacagcacctatttatcatcttaatggaatgcatgaagaaaaaggagctaataactgtattcagaatgggaagcgaaggccatcaggatattgatctggccatactgacagcattacttaagggtgctaacgctagcgcccctgaccagctgagccttgccttagcctggaaccgtgtggacatcgctcgctcgcaaatattcatctatgggcagcaatggccggtgggctctctcgagcaggctatgctcgacgccctggtgctggacagagtcgactttgtaaagctgctgattgagaacggggtgagcatgcacaggttcctgacaatttcacggctcgaagagctctacaacacaagacacgggccttctaatactttgtaccacctagtgcgggacgtaaaaaagggcaacttgcctcccgattatagaatttcactgatcgatattggcctggtcatagaatatttaatgggaggggcttatcgctgcaattatacacggaaacggttccgaaccctgtaccacaatctgttcgggccaaaacggcctaaagccttgaagctcttaggaatggaagatgacatcccactcagacgcggaagaaaaaccaccaaaaagcgcgaggaggaagtggatatcgatctcgatgaccctgaaatcaatcactttcccttccccttccacgagcttatggtttgggcggtgctcatgaaacgtcagaagatggccctcttcttctggcagcatggagaagaggcgatggccaaggcactggttgcttgtaagttatgtaaggcaatggcccacgaagcaagcgaaaatgacatggtggatgacatttcccaggagttgaaccataactctcgtgatttcggacaattagccgttgaactgctggaccagtcatacaagcaggacgagcagttggccatgaagcttctcacctatgagctgaagaattggagcaatgctacttgcctgcagctggctgtcgccgcaaagcacagggacttcatcgctcatacttgctctcagatgctcctaactgatatgtggatgggacgcctgaggatgaggaagaactcaggactgaaggtgattttgggcatattgttgcctccatcaatactcagtctcgaatttaagaataaggatgatatgccctacatgtcccaggcccaggagatccatctgcaggaaaaggaagcagaagaaccagagaagccaactaaagaaaaggaagaagaggacatggagctgaccgctatgctgggaagaaacaacggggaaagtagtcgtaagaaggatgaagaggaggtccagtccaagcatcgcttaattccgctaggcaggaagatctacgagttttataatgctcccatagtgaaattctggttctacacactggcctacatcgggtacctcatgttgtttaactatattgtgctggtgaagatggagcggtggccttctacccaggagtggatcgtgatatcttatatttttactctgggcattgagaaaatgagagaaattttaatgtctgagcccggaaaactattgcaaaaggtgaaagtctggttgcaggaatattggaacgtgactgacttgatcgcaatcttactgttttctgttgggatgattctgaggctgcaagaccagcccttcaggtctgatggtagagttatttactgtgtgaatattatttactggtacatcagactgctagatattttcggcgttaacaagtacctgggtccatacgtaatgatgatagggaaaatgatgatcgacatgatgtactttgtcatcattatgttggtcgtgctgatgagtttcggggtggcccgacaggccatcctctttccaaacgaagagccctcatggaagttagccaagaacattttttacatgccatattggatgatctatggggaagtcttcgctgatcagatcgatcccccatgcggccaaaatgaaactcgggaagatggcaaaatcatccaactgcctccgtgtaagacaggagcttggatcgtacctgccattatggcctgttatctgctcgtcgctaatattcttttggttaatttgttgatagcagtgttcaataataccttcttcgaagttaagagcatttcaaaccaggtctggaagttccagcgttaccagctcatcatgaccttccacgaaaggcctgttcttcctcccccacttataatcttctcacacatgaccatgattttccaacatttgtgctgccgctggcgcaagcacgaatctgaccctgatgagcgagattacggacttaagctgtttatcacagacgatgaactgaaaaaagtccacgatttcgaagaacagtgcatcgaggaatacttcagagagaaagatgataggttcaacagcagcaatgatgaacgcatcagagttacttctgagagggtcgaaaatatgagtatgaggctggaggaagtgaacgaaagggagcattcaatgaaagcctcactgcagaccgttgacatcaggctagcacaactagaggacctaatcgggcgaatggccacagccctggagcgtttgaccggtctggaaagagccgagagcaataagatcaggtccaggactagctcggattgtaccgacgctgcttatatcgttcgccagtcttctttcaacagccaggagggcaacacattcaagctgcaggagagcattgacccagcagagcaccccctgtactcagtgtag

SEQ ID NO: 244614 - DNA, 4671 bp, Artificial Sequence
  Description of Artificial Sequence: Synthetic coding sequence
tgatacgtgcgagtgtcttttgatactaaacccgatcttctcttgcatttgatgacgaaagagtggcagctggagctcccaaaactgctgattagcgttcacggcggacttcagaatttcgagttgcagcctaagctcaagcaggtctttgggaagggcctcattaaggccgctatgacaactggggcatggatcttcaccggcggagttaatacaggggtcattcgccatgtgggggatgccctgaaggaccatgcgagtaaaagccgagggaagatttgcaccattggcatcgcaccatggggcatcgtggagaaccaagaagatctgataggacgggacgtcgtgcgcccatatcagacgatgtctaatcccatgagcaaattaacagtgctaaattccatgcacagccacttcattctggctgataacggcaccactgggaaatacggagctgaggtgaagctcaggagacagttagaaaagcatatctccctgcagaagattaatactcgtataggacaaggagtccctgtggtcgcactgatcgtcgaggggggtcccaatgtgatatcaattgttctagaataccttcgcgacacccctcccgttcctgtggtggtgtgcgatgggtctggacgggcttccgatattctggcattcgggcacaaatactcagaggaagggggactcattaacgagagtctccgagaccagttgctggtgaccattcagaagaccttcacttacaccagaacacaagcccagcacctctttattatcctcatggaatgcatgaaaaaaaaggagctgatcactgtctttagaatgggttccgaaggccatcaggatatcgatctggctattcttaccgcgctgctgaaaggagccaatgcaagcgcaccagaccagctgagcctggctttggcgtggaaccgggttgacattgctcgtagtcagatctttatttacggacaacaatggcccgtgggatctctggagcaagctatgctggacgcacttgtgctggatcgcgtggacttcgttaaactgctgatcgagaatggagtttcaatgcatagattcctaaccatttcaagattagaggagttgtacaataccagacacggtccatcaaataccctctatcacctggtccgggatgttaaaaagagggagtatcctggctttggctggatatattttaaaggcaatctgcctcccgattatcggatcagtctgatcgatataggactcgtcattgagtacctgatgggaggggcttaccggtgtaattacactcggaagagatttcgaaccctatatcacaacctttttggaccaaagcgggatgacattcccctgagacgcggtcgtaagaccacaaagaaacgcgaggaggaagtggatatcgatctggatgaccccgagataaaccatttcccttttcctttccatgaactaatggtttgggccgttcttatgaagcgccagaagatggcactgtttttctggcaacacggtgaggaggccatggctaaagccctagtggcctgcaaactgtgtaaggcaatggcacacgaagcctctgagaatgacatggttgatgacatttcccaagaattaaatcataattcgcgcgattttgggcagctggccgtcgagctactagaccagagctacaagcaggacgagcagctcgccatgaagctgctcacctatgagctcaagaattggtcaaacgccacctgcctacagttagccgtcgcagcaaagcacagggatttcatcgcccatacttgcagccagatgctgctgacagacatgtggatgggtagactgaggatgaggaaaaacagtggtctcaaagtcattctgggtatattgttgccaccaagcattctgtcattagagtttaagaataaggatgacatgccatatatgtcgcaggcccaggaaattcacttgcaggaaaaagaagcagaggagccggaaaagcctacaaaggagaaagaggaggaagacatggagcttacggccatgttggggcgaaacaacggggagtcatcaaggaagaaggacgaagaggaggtgcagtcaaagcatagacttatcccactgggccgtaagatctacgagttctacaatgctcctatagtgaaattttggttttacactctcgcttatatcggatacttaatgctttttaactacattgtcctggtgaagatggaacgctggccctcaacccaggagtggatcgtgataagttacatatttactttgggcatcgaaaagatgagggagattctgatgtcagaaccaggcaagcttctccagaaggtcaaggtatggctacaggaatattggaatgttaccgacctgatagcaattctgctcttctctgttggcatgatcctccgcctccaggatcagccattccggtcagacggccgagtcatctactgcgtaaatattatatattggtacattcggctgctggacatcttcggggtgaacaaatatctcggtccgtatgtcatgatgatcgggaaaatgatgatcgatatgatgtactttgtcatcatcatgctggtagtcctgatgtcctttggggtagccagacaggccatactgtttcccaatgaggagccatcttggaagctggctaaaaacatcttttatatgccttactggatgatctacggcgaggtcttcgcagaccaaatagaccctccttgcggccagaatgaaacacgggaggacgggaagattatccagcttccaccttgtaaaaccggagcgtggatcgtcccagcgatcatggcctgttacttgctggtggccaacattttgctggtgaacctgctcatagccgtgtttaacaacactttttttgaggtgaagagcatttccaaccaggtctggaagttccagcgataccagctgattatgacttttcatgagcgcccagtactgcctcctcctctgatcatcttttctcacatgaccatgatctttcagcatctctgttgtaggtggcgcaagcacgagtcagatcctgatgagagggattatggtctgaaactgttcatcacagatgatgaattaaaaaaagtccacgatttcgaggaacagtgcattgaggagtacttccgggaaaaggacgacagattcaactccagtaacgatgaaagaatacgtgtcacttccgagcgggtggaaaacatgtcgatgagactggaagaggtcaatgagcgggaacactcaatgaaagccagcttgcagactgtggacataagactggcacaactggaggacctgataggacggatggcgacagcactcgaacgcctgactggcttggagcgggctgaatctaacaagatccggtcccggacctcttctgactgtacagatgcagcatatatcgtgagacaatctagcttcaacagccaggagggtaacacatttaagctccaggagagcatcgaccctgctggagaggagactatgagtcccaccagtcctaccttgatgccccgtatgcgctcacacagtttctactctgtgaacatgaaggacaagggagggatcgagaagttggagtccatcttcaaggaaagatcactttcgttacaccgagccacgtccagtcactctgtggcgaaggaacctaaagccccagctgctccagcaaatacgttagccatcgtgccagattctaggcgcccttcatcatgtatcgatatctacgtgtcagccatggacgagctgcattgtgacatagaccctttagataactctgtaaacatcctgggcctgggagagccttcattcagtacacccgtgccttccacagcaccgtccagcagtgcctatgccacactggcgccaactgatcggccaccgtccaggtccatcgatttcgaagacattacctccatggacaccaggagcttctcatctgactacacacacttgccagaatgtcagaacccatgggatagtgagccccctatgtatcacaccattgagaggagcaagtccagccgttatctggcgacgaccccctttctgctcgaggaagcaccaattgtgaaatcacacagctttatgttttctccgagccggagctattatgcaaactttggtgtgcccgtaaagactgcggagtacacgagcatcacagactgcatcgatacccgctgcgtgaatgccccacaggctatagcagaccgcgcagcttttccaggcggtttgggcgataaggtggaggatcttacatgctgccatcctgagagggaggccgaactgagccacccttcctccgacagtgaagaaaacgaagctaaaggccgacgagccacaattgcaattagcagccaagagggggataattcggagagaacgctctctaacaacatcacagtgcccaagattgagcgagccaactcgtacagtgctgaagagcctagcgctccatacgcccatacccgcaaatccttttctatatctgataaactagaccgacaaaggaacaccgcctcactgcgcaaccctttccagcgatctaagagctccaagccagaaggtcggggtgactccctatccatgcgtcggctgtctcggacaagtgccttccagagcttcgaaagtaagcataactag

SEQ ID NO: 244615 - DNA, 4701 bp, Artificial Sequence
  Description of Artificial Sequence: Synthetic coding sequence
atgtacgtgagggtgagctttgacaccaagcccgatctcttactgcacctcatgaccaaagaatggcagctggagcttcctaagttgctgatatctgttcacggaggtctgcagaacttcgagctccagcccaagcttaagcaggttttcggtaaaggcctcattaaagccgcaatgaccactggtgcctggatctttaccggtggcgtcaacaccggggtgattcgacacgtaggagacgccctcaaagaccacgcctcgaagtcccggggaaaaatatgtaccattggtatcgctccttggggcattgttgaaaatcaggaggatctcataggaagggacgtggtccggccttaccagacaatgagcaaccctatgagtaagctcacggtgctgaactctatgcactcacactttatcttggccgacaacggcacaacaggcaagtatggtgccgaggttaagcttagacgacagctcgaaaagcatatttctcttcaaaagattaatacacgaattggtcagggcgtgcccgtcgtggctttaattgtggaagggggacccaatgttattagtatagtgctcgagtatttgcgagacacacctccagttcctgtggtggtgtgcgacggttccggtcgggcttctgacattttagcttttgggcataaatacagtgaggaaggaggactcatcaacgaaagccttagggaccaattactggtcaccattcagaaaacgttcacttataccaggacacaggcccaacatttattcattattcttatggagtgcatgaagaaaaaggaactgatcaccgtgttccgcatgggctctgagggacaccaggacatcgacctggccatcttaaccgcgctgctgaagggggcaaatgccagtgcccctgaccagctgtctctcgctttggcctggaaccgcgtcgatatagctcgttctcagatttttatttatggccagcagtggccagtcggttccctggaacaggctatgctggatgctctcgtgttggaccgtgttgacttcgtgaaactcctgattgagaacggcgtctcaatgcatcggtttctgaccatatcaaggctggaagagctttataatacacgccacggtccaagtaacaccttgtaccatttggtccgcgacgtaaagaaaggaaatctgccacctgactaccgtatcagtcttattgacatcgggctggtgattgagtatctgatggggggtgcctacagatgtaactacaccagaaaaaggtttaggacgctttatcacaacctttttggcccaaagaggccaaaggccctcaagttgctcgggatggaagatgatatccctctgagaagaggaaggaagaccaccaaaaagagagaggaggaagtcgatattgatttagacgatcccgagattaatcacttcccttttcccttccacgagctgatggtctgggcagtgcttatgaaacgacagaaaatggctctgtttttctggcagcacggtgaagaagctatggcaaaggctttggtagcctgtaagctgtgcaaagcaatggcacacgaggcttcagagaatgatatggtggacgacatttctcaagagctcaaccacaattcacgagactttggacagctggccgtggagctcttagaccagtcttataaacaggacgaacagctggccatgaagctgttgacgtatgagctaaaaaattggagcaacgccacatgcctgcagcttgccgtagccgctaagcaccgagactttatagcccatacttgcagccagatgctattgactgatatgtggatggggaggcttaggatgcgcaagaattcaggcctcaaggtgatactcgggattcttctcccaccgtccatcctgagtctcgaatttaagaacaaagacgatatgccctatatgagtcaagcacaggaaatacacctgcaggaaaaggaggcagaagagccagagaaacctacgaaagaaaaggaggaagaggacatggaactaaccgcaatgctggggcgtaataatggcgaaagttccaggaagaaggatgaagaggaagtacagagtaaacacagactgatccctctagggagaaagatctatgagttctataacgcaccaatcgttaagttctggttctacaccctggcttacattgggtacctaatgcttttcaactacatcgtgttggtgaagatggagaggtggccctccacccaggaatggatagtcattagttacatctttacgctcggaatcgagaaaatgcgagagattctgatgtcagagcccggtaaactgttacagaaagtcaaagtgtggctccaggaatattggaatgtcactgatttgattgccatacttctattcagcgtagggatgatcctccggctccaggaccagccattcagatctgatggaagggtcatatactgtgtgaatataatctattggtacatccggctgcttgacatctttggggtcaataagtatctcggcccatacgtgatgatgatcggcaagatgatgattgacatgatgtactttgtgatcattatgttggtagtgttgatgtcatttggagtggctcgccaagctattctctttccaaacgaggagccaagctggaagctcgctaagaacatcttttacatgccatattggatgatatatggcgaggtcttcgccgaccaaatcgaccggaaacaggtttacgactcccatacacctaagagcgctccctgcggacagaacgaaactcgagaggatggaaagataattcaactgcctccgtgcaagaccggggcatggatagtgccagccattatggcgtgctacctgcttgtcgccaatatactgttggttaatcttttgatagccgttttcaataacactttcttcgaggtaaagtcaatttccaaccaggtgtggaaatttcagcggtatcaactgataatgacattccacgagagacctgtattaccccctccccttatcatttttagccacatgacgatgatcttccaacacctctgctgtcggtggcgaaagcacgaatccgaccccgacgaacgggactatggtctcaagctgttcattaccgacgatgagctgaaaaaggtccatgactttgaggagcagtgtatcgaagagtacttcagggagaaagacgaccgctttaacagtagcaatgacgaacggatacgggtcacatcggaaagagtggagaacatgagtatgaggctggaggaagtaaatgaaagggagcattcaatgaaagcaagtctacaaacagtagatatccggctcgcccagctggaggacctgatcgggcgaatggctaccgccctcgagagacttaccgggctggaacgggctgaaagtaacaaaatccgctctagaacatcctctgactgtacagatgcagcatatatcgtgcgccagagtagctttaattcacaggaaggcaatacttttaagctccaggaaagcatcgacccagctggagaggaaaccatgtcacccacttcaccgaccctcatgcctaggatgcgctcccattcattttattccgtcaatatgaaagataagggcggaatcgagaagctggaatcaatcttcaaggaaagatccctcagcctccatagagctacaagttctcactccgtcgcaaaagagcctaaagcaccggcagctccggcaaataccctggcaatagtcccagactccagacgacccagctcttgtatagacatttacgtgtccgctatggacgaattacattgtgacatcgatccgcttgacaacagtgtcaacatacttgggctgggcgagccttcgttctctacacccgtcccttcgacagcccctagttccagcgcttacgccaccttagcaccgaccgacaggccccctagcaggtcgatcgactttgaagacataacttctatggacacccgttctttttccagcgattacacccacctgccagagtgtcaaaacccttgggatagcgagccaccaatgtatcacacaatagaacgatccaaatccagtcgatacctcgccactacaccatttctgctggaggaagctcccatcgtcaaaagtcattcctttatgttctctcccagcaggtcctactatgcaaactttggagttcccgttaaaaccgcagagtatacctctatcaccgactgcatagatacaagatgtgtgaatgcacctcaagctattgctgacagggccgctttccctggcggactaggagacaaggtagaggacctgacatgttgccaccctgaacgcgaggctgagctctcccacccatcgtcggatagcgaagagaacgaagctaaggggaggcgtgccacaatagccatctcctctcaagagggcgacaacagcgaaagaacattatccaacaacataactgtcccaaagatcgagagggctaacagctatagcgccgaggagccttcagcgccatacgcacatacacgcaagtctttcagtatcagcgataagctcgacaggcaaagaaataccgcctccctgcgcaatcccttccagcggtctaagtcgagcaagcctgaaggtcggggagactctctctctatgcgcaggctgtcgcgcaccagcgcttttcagtcgttcgagtccaagcacaactag

SEQ ID NO: 244616 - DNA, 4740 bp, Artificial Sequence
  Description of Artificial Sequence: Synthetic coding sequence
atgtacgtcagagtgtcttttgacactaaacccgacctcttactgcacttaatgactaaagagtggcagctcgaattgcctaagctcttgatcagtgtgcacgggggattacagaatttcgagttgcagccaaaactgaaacaggtgtttggaaaaggattgatcaaggcagcaatgacaacaggggcatggatattcaccggaggagtgaatacaggagtgatcagacatgtgggggatgcacttaaggatcacgcaagcaaaagcagaggcaagatttgcacaattgggattgccccatgggggattgtggaaaatcaggaggatctgattgggagggacgtggtccgaccctatcagacgatgtctaaccctatgtcgaaactcactgtccttaattctatgcacagtcactttattctcgccgataacgggacgaccggtaaatatggcgctgaagtcaagctgcgcagacagctggaaaaacatattagtctccagaaaattaacactagatgcttaccttttttttcactggattcacgtttattttattccttctggggctcctgccagctagattccgtgggcatcgggcagggcgtgccggtggttgcattaatcgtggagggcggacctaacgtgatcagcattgtccttgaataccttagagacacacctccggtgcccgtggtggtgtgcgatggatccggcagagcatcagatattctggcctttgggcacaagtacagcgaggagggcggactcatcaacgaatccttgagagatcaactcctggttaccatccaaaagacattcacctacacccggactcaggctcagcacctgtttattatactgatggagtgcatgaaaaagaaagagttaattactgtgtttcgcatgggaagcgagggccatcaggatatcgatcttgctattctgaccgctctgctgaagggcgcaaacgctagtgcacctgatcagctgtcactggccctggcatggaaccgggtggatattgccaggagccagatttttatctatggccaacagtggccagtgggtagtctggagcaagccatgctggacgcactggttcttgaccgggtggactttgtcaaactcctcatcgaaaatggcgtaagcatgcaccggtttctcactatctcccgactggaggaattgtacaatactcgccatgggcctagcaatactctatatcacttggtgagggatgtgaaaaagggcaacctcccacccgactatcggatttctttgatcgacattggcttagtaatcgagtatctaatgggtggagcataccgatgcaactatacgcgcaaaaggttcagaacactgtatcacaatctgttcggaccgaagaggcccaaggcactcaagcttctcggcatggaggatgacatccctcttcgcagggggcgaaagaccacaaagaagagggaagaggaagtcgatatcgatctcgatgaccccgaaatcaaccacttcccgtttccgtttcacgagttgatggtgtgggccgtgcttatgaaaaggcagaagatggccttgtttttttggcagcacggagaggaggccatggcaaaagcactcgtcgcatgtaagctgtgtaaagctatggctcatgaggcatcagaaaacgacatggtagatgacatctcccaggaacttaatcacaattctagggactttgggcaactggctgtcgaacttctcgatcaaagctataaacaggatgaacaactggctatgaagcttctcacatacgagttaaaaaactggtctaacgcaacttgtctgcagttggcagttgctgccaagcaccgcgactttatagctcatacctgttcccagatgctattgactgacatgtggatgggaagacttcgaatgcgtaagaactccgggctaaaagtcatcctgggaattctgctccccccatctattctgtcacttgaattcaagaataaggacgacatgccatacatgtctcaggcgcaggaaatccatttgcaagaaaaggaggcagaggagccagaaaaaccaactaaggagaaggaagaagaagacatggagttgacagcgatgctgggcaggaataatggggaatcgtctcgcaagaaagacgaggaagaagtgcagagtaagcaccggttgatcccgcttgggaggaagatctatgaattctataacgccccaatagtgaagttttggttctataccctggcatatatcggctacttgatgcttttcaactatatcgtacttgtaaagatggagaggtggccatcaactcaagaatggatcgtgatcagctacatcttcaccctggggatcgaaaagatgagagagattttgatgagcgagccaggcaagttacttcagaaagtgaaggtctggctccaggaatattggaacgtgacggatctgattgctatcctgttgttctccgtgggtatgatcctgcgcctccaagatcagccttttagatcagatggcagagttatctattgcgtgaacatcatttattggtacatccgtctgctggatatcttcggcgtaaacaagtacctgggcccttacgtcatgatgatcggcaagatgatgatcgacatgatgtactttgtgatcatcatgttggtcgtcctcatgtctttcggggtggcaagacaggcaatattgtttcctaatgaggaaccttcgtggaagttggccaaaaatatcttttacatgccttattggatgatttatggagaagttttcgctgaccagatcgaccccccatgtggtcaaaacgaaactcgagaagacggcaagatcattcagctaccgccatgcaaaaccggggcatggattgttccagccattatggcttgctatctccttgtcgccaacattctgctcgttaacctgctcatcgcagtattcaataacaccttttttgaggttaagagcatctccaaccaggtctggaaattccaacggtaccaacttatcatgacctttcatgaacggcctgtgcttccacccccactgataatcttcagccacatgaccatgatttttcagcacctgtgctgccggtggagaaaacacgaaagtgatcctgacgagcgagattatggactcaaactattcatcaccgatgacgagttaaaaaaggtgcatgattttgaagagcagtgtatagaggagtattttagggagaaagacgaccggtttaacagctctaacgacgaaaggataagggtgacgagtgagagggtggaaaacatgtctatgcgcctcgaagaggtgaacgaaagggaacactccatgaaagcttcccttcagactgtcgacatcagactggctcagctcgaagacttaatcggcaggatggccaccgcactggaaaggctgaccggattggaaagagcagaaagtaacaagattcgcagtcgaacttcttcagactgtactgacgccgcatatatcgtgaggcagtcctccttcaacagccaagaaggaaacacttttaagctgcaggaatccatagaccccgctggagaggagaccatgagccccactagtcccaccctgatgccacgaatgcggagccactccttctattctgtcaatatgaaagataagggcggaatagagaagctggagtcaattttcaaggaacgcagtctatcacttcatagggccacatctagtcattctgtagccaaggagccaaaagctccagccgctccagcgaacacattggctattgtgcctgatagcaggcgccctagcagctgcatagatatctacgtgtccgccatggacgaactacattgtgacatagacccactggataactccgtgaatatcctcggcttgggcgaaccgtcgttttctactccagtgccaagtacagcaccatcctcttctgcctacgcaaccttggccccaactgaccgtcccccttcccgctcaatcgactttgaggatatcacaagcatggatacgcggagcttttcatccgattacacgcacctcccagaatgccaaaacccttgggatagcgagcctcccatgtaccacaccatcgaacgatccaaatcctcccggtatttggccactacaccattccttctggaggaggcccctatcgtgaagagtcactccttcatgtttagccctagcaggagctattatgctaatttcggcgttccagtcaagaccgcggaatacacttcaattacagattgcatcgatacccgatgtgtcaacgcaccacaagcaatagcggatcgggctgccttccctggcggactgggggataaagtggaggatctcacatgttgtcatccagaacgcgaggcagagctgtcacacccctcctcagatagcgaagaaaacgaggcgaaaggcaggcgagccaccattgccatctcttctcaggagggtgacaacagcgagcgcacactgtcaaacaatataactgtcccgaagatagaacgcgcaaattcctatagcgcagaggagccctctgccccatatgcacacaccaggaaaagcttcagcatttctgataaactggatcggcagcgcaatacggccagtctcagaaacccttttcagcgctcaaagtcctcaaagcccgagggcagaggggattcacttagcatgcgccgtttgtcacggacctccgctttccagtcattcgagagcaagcacaattag

SEQ ID NO: 244617 - DNA, 4701 bp, Artificial Sequence
  Description of Artificial Sequence: Synthetic coding sequence
atgtacgtccgagtatccttcgacacaaagccggatcttcttctgcatctcatgaccaaggaatggcagctggagttgccgaagctgcttataagcgtgcacgggggtctgcagaatttcgagctgcagccaaagctcaagcaggttttcgggaagggtctcattaaggccgctatgacaaccggggcatggatttttaccggtggcgtcaacactggtgtaattcgccatgttggggatgcactgaaggaccatgcctccaaaagtagaggtaaaatttgcactatagggattgcaccctggggcatcgtagagaatcaggaggatctgatcggtcgggacgtggttcgtccctaccagactatgtcaaacccaatgagcaaactcaccgtactgaactctatgcattcccacttcattttggcagataatggcaccacaggcaagtacggcgctgaggtgaaactgcgccgacagctagagaaacacatctcccttcagaagattaacacccggattggacagggggttccagtggtggctcttatcgtagaagggggtcccaacgtaatctcaatcgttcttgagtaccttcgagacacaccccctgttcctgtggtggtctgtgacggttctggcagagcaagcgacattttagcatttgggcacaagtattctgaggaagggggattgattaatgaatcgctgcgggaccagctattggtaacaatccagaaaacatttacatacacccgcacacaggcccagcatctcttcataatcctgatggaatgtatgaaaaagaaggaactcatcaccgtgttccgaatgggatctgaagggcatcaagacattgacctggctatcctcacggccctgctgaagggtgcaaacgcctccgccccagatcagctttctctcgctctcgcgtggaatagggtcgacatcgccagatcccagatctttatttacggacagcaatggccggtaggtagccttgagcaggctatgcttgatgccctggtgttggaccgggttgacttcgtaaagctactgatagagaacggagtatccatgcacaggttccttaccatctcccgtttagaggagctgtataacacgaggcacggacccagcaatacgctgtatcacctagtccgtgacgtgaagaaaagagagtacccaggcttcggctggatttattttaaaggcaatctaccccctgactacagaatctctcttattgatattggccttgtgatcgagtacctaatgggcggagcctaccggtgtaactatacccgtaaacggtttcgaaccctctatcacaatctttttggacccaagcggccaaaagccctgaagctgctgggtatggaagatgatattccactcagaaggggtcgaaaaaccacgaagaaaagagaggaggaagtggatattgacctggacgaccccgagataaaccactttccattcccattccacgaattgatggtgtgggccgtgctgatgaaacgtcagaagatggcgctgttcttctggcaacatggggaggaggccatggcaaaagctctggtcgcgtgtaagctttgcaaggccatggcccatgaggcttctgagaacgatatggtcgacgacataagccaggagctaaatcacaattcccgggattttgggcagctggccgttgagctcctcgaccaaagctataagcaagatgagcagctggctatgaagcttttgacctatgagctcaaaaattggagtaacgctacttgtctgcagttggctgtggccgcaaagcatcgcgacttcatcgcccacacctgtagtcagatgctgctgacagatatgtggatgggcagattgcggatgagaaaaaattctggtctgaaagtgatcttgggaatactcctgccaccctcaatcttgtctcttgagttcaagaacaaggacgacatgccatacatgtcacaagctcaggaaatccacctacaggaaaaagaagctgaagagccggaaaaacccaccaaggaaaaggaagaagaggatatggaacttacggccatgcttggccgtaataatggggagagctcgcgaaagaaggatgaggaggaggtgcagagtaaacatcggctgatcccactgggtaggaagatatatgaattttacaacgccccaatcgttaagttttggttttacacactagcgtacataggatacctgatgttatttaattacatcgtgttagtgaagatggagaggtggcccagtactcaggaatggatcgtgatcagctacatcttcactcttggcattgagaaaatgcgcgaaatcctgatgagcgaaccaggaaagctcctccaaaaagttaaagtctggctgcaggagtactggaacgtgaccgacctcatcgctatattattattctccgtgggaatgatcctgcggttgcaggatcaacccttcaggagtgatggacgtgtcatttactgcgtaaacataatttactggtatattcgtttgcttgacatctttggtgtaaataagtacctcgggccatacgtcatgatgatcggtaagatgatgatcgatatgatgtatttcgtcatcatcatgctggttgtgctgatgtccttcggtgttgctcggcaggcaatcctgttcccaaatgaggagccaagctggaagctcgcaaagaacatattttacatgccttactggatgatctacggcgaggttttcgcggaccagattgaccccccatgcggtcaaaacgagacacgtgaggatgggaagattatccaactgccgccttgcaagactggtgcttggatcgtgccagccatcatggcatgctacctcctggtggccaatattctacttgtcaaccttcttattgctgtcttcaataacactttctttgaggtaaagtccatttctaaccaagtgtggaagttccagcgttaccaactgatcatgacatttcacgagaggcctgttctcccacctccccttataatcttctcccatatgacaatgattttccaacacctttgctgtcgctggcggaagcacgagtctgatcccgatgaacgtgattacgggctcaaattgttcataacggatgacgagcttaaaaaggtacatgatttcgaggagcagtgcatcgaggaatatttcagagagaaggacgaccggtttaattcttccaatgatgagcgaatcagggtgacgtccgagcgagtggagaacatgtccatgaggctggaagaggtaaacgaaagagaacatagtatgaaagctagcctgcagaccgttgacattcggctggcacagctggaggacctcattggaagaatggcgactgcattggagaggctcacggggcttgagagagcggagtcaaacaagatccgaagcagaacaagcagcgactgcacagacgccgcttatattgtacggcagtcctcctttaacagccaggagggaaataccttcaagctccaagaaagtattgaccctgcaggagaggaaaccatgagccccacgtctccaacattgatgcccaggatgcgttcccatagcttttatagtgtaaatatgaaggataagggcggaattgaaaagctggaatcaatctttaaagaacgctctctctcattgcaccgggctacctcatctcatagcgttgctaaagagcctaaggccccagcagcacctgccaacaccttagccattgtgcctgacagccggcgaccaagttcttgcatcgatatttatgtgtcagccatggatgaactgcactgtgacatcgacccgctggataatagtgttaatattctaggtcttggagaacctagtttctccacccctgtccctagcacagcccctagctcctcagcttacgccactcttgcccctacagaccggcctccaagccgaagtattgacttcgaagatattacatccatggatacaaggtccttctcaagtgattatacacatttacccgaatgccagaacccctgggattccgaaccccctatgtaccacacaattgagcgctccaagtcgtctaggtacctcgccaccactccttttctgctcgaggaggcacccatagtaaaatctcattcctttatgttctccccaagcaggtcctattacgcaaacttcggtgtgcccgtgaagacagccgaatacacgagtattaccgactgcatcgatacccgctgcgtgaatgcccctcaagctattgcagacagagctgctttcccaggtggtctgggagataaggtcgaggacctgacctgctgtcatcctgagcgtgaggctgagctgagccacccttcctctgattccgaggaaaacgaggcaaagggcagacgagccactatcgcaatttcctcacaagagggtgacaattccgagcggactcttagcaataatatcacagtgcctaagatagagcgcgctaacagctattctgctgaggagcctagtgctccttacgcacacactagaaagtcctttagcattagcgataaactcgataggcagaggaacaccgccagcttgagaaacccgttccagcggagcaagtctagtaaaccagagggcaggggggactccctgagtatgcgaaggctgagtaggacctcggcttttcagagcttcgagtcgaagcacaactag

SEQ ID NO: 244618 - DNA, 5204 bp, Artificial Sequence
  Description of Artificial Sequence: Synthetic coding sequence
atggggaaaaagtggagagacgcagccgaaatggaacggggttgctcggaccgcgaagacaacgcggagagtaggaggcggagcagatctgcatcccgcggtcgatttgctgagagctggaagagactgagctctaaacagggctcaactaaacgttctgggctcccttcacagcagaccccagctcaaaagtcttggatcgaaagggcattctataaaagagagtgcgtacacataatcccgagcaccaaggatcctcaccgttgctgctgtggcagattgatcggacagcatgtcgggctgaccccctccatttctgtcctccaaaatgagaagaacgaaagccgcctgtcaagaaatgatattcaaagcgagaagtggagcatctccaagcacactcagctgtccccaacagacgccttcgggaccatagagttccagggaggaggccacagcaacaaggcaatgtacgtgagggtttctttcgatactaagccagaccttcttttgcatctcatgacaaaagagtggcagttggagttgccaaaacttctgataagtgtgcacggaggcctgcagaacttcgagttgcagcccaaacttaaacaggtttttggaaaaggcctgattaaggcggcaatgactaccggcgcttggatctttacagggggagtgaacaccggggtgatcagacacgtgggggatgcactaaaagatcacgctagcaagtctagggggaagatttgtaccatcggaatcgccccttggggaattgtggagaatcaggaggacctgatcggcagagacgtggttcggccataccagacaatgtccaacccaatgagcaagctgaccgtgttgaactcaatgcattctcattttatcttggctgataacggaacgaccgggaagtatggtgccgaggtgaagttgcggcgacagctagaaaagcatatttctctccagaaaattaatacgcgctgcctgcctttcttttccctcgatagtcggcttttctacagtttttggggaagctgccagcttgattctgtcggtatcggccagggagtccctgtggtcgccttaatcgtcgagggcggacctaacgtgatctcaattgttctcgaatatttgcgcgacacaccacccgtgccagttgttgtgtgcgacgggtccgggagggctagcgacatactggcttttggacataagtatagcgaagagggcggtttgatcaatgagagcctgcgcgaccagctgctcgtgaccattcagaagacctttacctatacacggacccaagcgcagcacctgttcataatcctgatggagtgtatgaagaagaaagaacttatcacggtgttcagaatgggaagtgaaggacaccaggatattgacctcgcaatactgacagccctgctgaaaggcgctaacgcttctgcccctgatcagctgtctttggccctggcctggaaccgtgtggacatcgccaggtcccagatcttcatctatggccaacaatggcccgtgggcagcctagaacaggctatgctagatgcactggtgctcgatcgcgtagacttcgtgaagctgcttatcgaaaacggggtctccatgcaccgttttctgacaatttctcgcttagaggaactttataatacacgccacggaccaagcaacacactgtaccacctggtgagggacgtgaagaaaggcaatttacccccagactaccgtattagtctgatagatatcggcctggtgattgagtacctgatgggcggagcctatcggtgtaactatacaaggaaacggttcaggaccctgtaccataatctgtttgggccaaagagacccaaagcattgaaactccttggcatggaagacgatatccctctgcgacggggacgaaagaccactaagaagagggaagaagaggtagatatcgacctagatgatccagaaatcaaccacttcccattccccttccacgaactgatggtatgggcagtgttaatgaagcggcagaagatggcactgttcttttggcagcatggcgaggaggccatggcaaaagccctggtggcctgtaagctttgcaaagctatggcccatgaggcctcagagaatgatatggtcgatgacatcagtcaagagttgaaccacaactctcgagatttcggtcagttggcagtcgaactactggatcaaagctacaaacaggatgaacagctcgccatgaaactcctcacctatgagcttaaaaattggagtaatgctacatgcctgcagttggccgtggcagctaagcaccgcgatttcatcgctcacacatgcagccagatgctgcttacagatatgtggatgggcaggctgaggatgcgtaagaatagtggacttaaggttatccttgggatattgcttccacctagcatcctgagcctggaatttaaaaataaagacgacatgccctatatgagccaagcccaggaaatccatctgcaagaaaaggaggcggaagaacccgaaaagcccactaaagaaaaagaagaggaagatatggaattgactgctatgctgggacgaaataacggcgagagctctcgcaagaaagatgaagaggaagtacagagcaagcaccgcctcatccccctgggaaggaagatttacgaattttacaacgctcctattgtgaaattctggttttacaccctcgcgtacatcggctaccttatgctgttcaattatattgttttggtgaaaatggagaggtggccctcaactcaggagtggatagtgatatcctacatcttcaccctcggcattgaaaaaatgcgtgagatcctgatgtctgagccaggcaagctattgcagaaggttaaagtgtggttgcaggagtattggaacgtgacagacttgattgctatcctcctgttttctgtgggcatgattctgaggctgcaggatcaaccctttagatctgacggaagggtgatctattgtgtgaacataatctactggtatattcgacttctagacatcttcggcgtgaataagtacctcgggccatacgtgatgatgattgggaaaatgatgatcgatatgatgtactttgtcattattatgttggtagtgttgatgtctttcggagtcgcacgtcaagcaattctttttccgaacgaggagcccagctggaagctggctaagaacattttctatatgccctattggatgatttacggtgaagtctttgctgatcagatcgatccaccttgcggccagaatgagacccgtgaggacgggaaaatcatacagttgcccccttgtaagacgggagcttggatagtgcccgctattatggcatgttacttgctcgtagcaaatatactgctcgttaacttgcttattgctgttttcaataatacgttcttcgaggtgaaatcgatctctaaccaggtctggaaattccagcgatatcagctcattatgacctttcacgagaggcctgtcttgccccctccattgatcatattcagccatatgaccatgattttccagcatctgtgctgccgctggcggaagcatgaatctgaccctgatgagcgggactatggcctaaagttgttcatcactgacgacgagctcaaaaaggtgcacgactttgaagaacagtgcattgaggagtacttcagggaaaaagatgatcggtttaatagttccaacgatgaaagaatacgcgtcacatctgagcgtgtcgagaatatgagtatgagactagaagaggttaacgaacgggaacactccatgaaggcgtcacttcagacagtcgatattagactggcacaacttgaggaccttatcggtcgcatggcaaccgctctggaacgcctaaccggattagagagagctgaatcgaacaaaattaggtccagaacctcttctgactgcacagatgccgcatatatcgtgcgacagtcttcattcaatagccaggaggggaacacgtttaagctccaggaaagcatcgacccagcgggagaggagacaatgtctccaaccagcccgactctgatgcctcgcatgcgcagtcatagcttttacagtgtaaacatgaaggacaaagggggtatagagaaactcgagagtatctttaaggaaagatccctgtcactgcaccgtgccacaagcagtcattcagtggccaaggaacccaaagcccctgctgccccagctaacactctggccatcgtgccagactctagacgcccttcctcctgtatcgatatttacgtgtctgctatggacgaattgcactgtgatatagatcccctggataatagtgtgaatatcctgggactgggcgaaccttccttctcgacccctgtccccagcacagcacctagttcaagcgcatatgcaactctagctcccacagatagacccccttcccggtctattgacttcgaggatattacatccatggacacaagaagttttagtagcgattacacccacttacctgaatgccagaacccatgggactcagaaccccctatgtaccacactatcgagcggtcaaaatcttctcggtacttggcaaccacacctttcctgctggaagaggcaccaatagttaaatctcactctttcatgttctctccctcacgctcctactatgcaaactttggcgtacccgtgaagaccgccgagtacacctcaattactgattgcatcgacacacgctgcgtcaacgctcctcaggcaatagcagaccgggcagcttttcccggaggtctgggagacaaggtcgaagacctcacatgctgtcaccctgagcgcgaggccgagcttagtcacccctcgtccgatagcgaggagaacgaagccaaaggacgacgggcaaccatcgcaatttcctcacaggaaggcgacaattcggagcgaactctctccaataacataactgtccctaaaatcgaacgcgctaacagctactctgcggaagagcccagtgccccttatgcgcatacgcggaagtcattttccattagcgataaactggatcgccagaggaacactgccagcctgcgaaacccctttcagcgcagtaagtcgtctaaacctgaagggaggggagattcgctctccatgcggaggctgtccagaaccagcgcttttcaatccttcgagagcaaacacaacta

SEQ ID NO: 244619 - DNA, 645 bp, Artificial Sequence
  Description of Artificial Sequence: Synthetic coding sequence
atgtacgtaagggtctcattcgacacaaagcccgatctgctcctgcatctgatgactaaagaatggcaactggagctgcccaaactcttaattagtgtacacggcggtctccagaatttcgaacttcagcccaagctcaaacaggtgtttgggaaggggttgatcaaagcggctatgacaacaggagcatggattttcacaggtggcgtgaacacgggtgtaattagacacgtcggggacgcattaaaggatcatgcgagtaaaagccgcggaaagatatgcacgatcgggatcgccccatggggaatcgtggaaaatcaggaggatcttatcggcagagatgtagtgaggccgtaccagacaatgtctaacccaatgagtaaacttaccgtccttaacagcatgcacagccacttcattctcgctgacaacgggaccacaggaaaatacggggctgaggtcaagctgcgccgtcagctggagaaacacatatcactccagaaaattaacacgtcctttcatagctacaaaaccgctcatgttgacctgcaagacaaaagacaggtaaagactgcattagaacaggcggagtggcagcccggtagaggcatgtttgaccatgacaacttgatgcagagcacctag

SEQ ID NO: 244620 - DNA, 3645 bp, Artificial Sequence
  Description of Artificial Sequence: Synthetic coding sequence
atggtggtgcccgagaaagagcagtcctggatccccaaaatcttcaaaaagaaaacctgcactacctttattgtagattcaacagatccaggcggtacactatgccaatgcggtcgtccacgtaccgcccaccctgcagtggcgatggaagacgcttttggcgctgcggttgtaacggtgtgggactctgatgcccataccacagaaaagcctacggacgcctacggcgaactggactttacgggcgcaggcaggaaacacagtaattttttgagactcagcgacaggaccgatcccgctgctgtttactccctggtgacacgcacatggggcttcagagctccgaatctggtggtctctgtccttgggggttccggcggacccgtattgcagacctggctccaggacctgcttaggaggggcctggtgagggccgctcagtctaccggggcttggattgtcactgggggtctccacacagggattggcagacacgtgggcgtggcggttagagatcaccaaatggctagtaccgggggtacaaaagtcgtcgccatgggcgtcgcaccgtggggagtggtcaggaaccgagacactttgataaatcctaaggggtcatttcccgctcgctaccgatggcgaggagaccctgaagatggggtccagtttccgctcgactataattactctgcttttttcttggtggacgacggtactcatggctgtctcggaggtgaaaatcgctttcgcttgcgactcgagagctacatctctcaacagaaaacaggagttggcggaacggggatcgacattcccgtgctgctcttactgatcgacggcgatgaaaaaatgctcactaggatagagaacgctacccaggcccagctgccttgcctgctggtggccggaagtggcggagcagcggactgtctggcagagactctggaggataccctggctccgggttccggtggtgctaggcagggggaggccagagatagaatcagacgctttttcccaaagggagacttagaggtgctacaagcacaggttgagagaattatgaccagaaaggaactcctgactgtctactcgagcgaggatggatccgaagagttcgagacaatagtcctgaaagcgttggtgaaggcatgcggaagcagcgaggctagcgcatatctggacgaactgaggttggctgttgcctggaaccgggtggacatcgcacagagtgagttgttcaggggcgatatccagtggcgctcttttcaccttgaggctagcctgatggacgcacttttgaatgatcgccctgaatttgtacgtctgcttatctcacacggcctgtccttgggccacttcctgaccccaatgaggttagcacaactctattctgcagcgccatccaactcactgatcaggaatctattggaccaggcctctcactccgctggtactaaagcccctgcgcttaaggggggagctgcggagctgcggcctcccgacgtgggccatgttctgcgaatgctgttaggtaagatgtgcgcccctcgatacccttctgggggtgcatgggatcctcacccaggccagggcttcggtgaaagcatgtatctgctgtctgacaaggctacctcccccctgagtttggatgctggcttaggacaggccccttggtcagacttacttttgtgggctctcttactgaacagggcccagatggccatgtacttctgggaaatgggctccaacgctgtttctagcgccctcggcgcatgtttgctactacgtgtcatggcgaggctggagcccgatgcggaggaagccgctagaaggaaagaccttgccttcaagttcgaaggaatgggagtggatcttttcggggaatgttatcggtcatccgaagtgcgggctgcacggctactccttagaagatgtcccctctggggcgatgctacttgcctgcagctcgctatgcaggcagacgccagagcttttttcgcccaagacggcgttcaaagtctcctgacccagaagtggtggggggacatggcaagcactacaccaatctgggctctggtgctggccttcttttgccctcctctcatttatacccgactcattacgttcaggaagagcgaggaagaaccgacaagggaggaactggagtttgacatggattcagtgatcaacggcgaaggtccagtcggaactgctgatcccgcagagaaaacacctttaggcgttccacgccaatcaggaaggcccggttgttgcggcggaaggtgtggtggaagacgatgcctgaggagatggtttcacttttggggcgctcccgtaacaatttttatggggaacgttgtctcgtacctgctgtttctgctgctgttttctagggttttgctggtggactttcaacccgctccgcctgggagtctggagctgctcctgtatttctgggcctttaccctgctctgcgaagagctccggcaagggctatctggcggagggggatcattggccagtggaggacctggccctggccatgccagcctgtctcagaggctgagactgtacctggctgattcctggaatcagtgcgacctggtggcgttgacctgcttcttgctgggcgtaggctgtcgcctgacacctggcctgtaccacctggggagaaccgttttatgcatcgacttcatggtgtttacagtgcgcctgcttcatatattcacagtcaacaaacagctcggccctaagatcgtcattgtttccaagatgatgaaagatgtcttcttttttttgtttttcctgggcgtttggctggtcgcctacggcgtagcaactgagggtctgttgcgacctcgcgattccgatttcccaagtatcctcaggagggtgttttatagaccatacttgcagatcttcggtcagattccccaggaagatatggacgtcgctcttatggagcatagtaactgctcctcggagcccggattctgggcccacccaccaggagctcaagcaggaacttgtgtttctcagtatgccaattggttggtggtactacttctcgtgatcttcctgctcgtcgcgaacatactgttagtcaacctgctcatcgccatgttttcttatacatttggcaaggtgcagggcaactctgatctgtattggaaggcacaaagataccgcttgatccgggagtttcactcgcgtccagcccttgcaccccctttcattgtaatttcccacctccgactattgttgcgtcagctctgcaggcgccctaggagcccccagccaagctcccccgcactggagcactttagggtgtatctctctaaggaagctgagcgcaagttgctgacctgggaatcagtgcataaagagaattttttactggcccgtgctcgtgacaaaagagagagcgatagtgagcgcctcaaacgcacctcacagaaagtcgacttagcactaaagcagctgggacacatccgggagtacgagcagcgcctgaaggtcctggagcgcgaggtccagcagtgctcccgcgttttagggtgggtagccgaggcactgtcacggtccgcgctcctccccccaggcggaccacctccgccagatttgccagggtctaaagactag

SEQ ID NO: 244621 - DNA, 2583 bp, Artificial Sequence
  Description of Artificial Sequence: Synthetic coding sequence
atgctgacccggattgaaaacgccacccaggctcagttgccttgtcttctagtggcaggatcagggggagccgcagactgccttgctgagacactggaagatacgctcgctccgggtagtggaggcgctagacagggcgaggccagagatagaatcaggcgattctttcccaaaggggacctcgaagttctccaggctcagtcttttcacctcgaagcctcactaatggatgcgctgcttaacgaccggcctgagtttgtgcggctgctaataagccatggtctttcactcggccattttctcacaccaatgagactagctcagttgtactctgccgctccatccaatagtctgatccgcaacctgctcgatcaggcaagccattctgccggtaccaaagcccctgctctgaaaggcggtgccgctgagctgcgtcctcctgatgttggtcatgtcctccgcatgctgctcgggaaaatgtgtgcacctcggtatccatcaggaggcgcttgggatccgcatccagggcaaggctttggcgagtccatgtatctgttaagcgataaggcaactagtcctctaagcctggacgccggtctgggccaggccccatggagcgacttgctgctctgggccctcctgctgaatcgggcacaaatggccatgtatttttgggaaatgggaagcaatgcagtgagctccgctctgggagcatgtcttctgctccgcgtcatggctcgactcgaaccagacgccgaggaggcagccagaagaaaagatttagccttcaagtttgaaggtatgggtgtagacctgtttggagagtgctatcgcagctcagaggtacgcgcagccagactcttactacggaggtgtcccttatggggcgatgccacttgcctgcaactggccatgcaggcagatgctagagcattcttcgctcaagacggagttcagagcctccttacacagaaatggtggggcgacatggccagtacaaccccaatctgggctttagtactcgcttttttctgtccccctctgatatatactaggctgataacatttcgaaagtcggaagaagaacccacaagggaagagctcgagtttgacatggattcggtgatcaacggcgaaggtcccgtcgggacagccgatccagctgagaaaacccctctgggtgtcccacggcaatcaggacgccctggttgttgcgggggacggtgtggcggacgtcggtgtcttaggagatggttccacttctggggcgctccagtgaccatctttatgggcaatgtcgtgagttacttgctttttctgttgttattttcacgcgtcctgttagttgatttccagcctgccccaccaggttctttagagttgcttctatatttctgggcatttacactgctgtgtgaggagctccggcagggcttaagcggaggagggggatcccttgctagcggaggacctggcccaggtcatgcatctttgtctcagcgcctgagactgtacctcgctgactcctggaatcagtgcgatctagtggctctgacctgcttcctgttgggggttgggtgtcgtctaactccgggactctaccacctgggcaggaccgtgctgtgtatagactttatggtctttaccgtcaggctccttcatatttttacggtaaataagcagctcgggcctaaaatagtaatcgtctccaagatgatgaaggatgtttttttcttcctatttttcctgggcgtatggcttgtcgcctacggggtggctaccgaaggactcttgaggccgcgtgattcagatttcccatctatcctccggagggtcttttatcgaccctatctgcagatttttggccagatcccacaggaagacatggacgtggccctgatggagcattcaaattgcagtagtgagcccggtttttgggcccatcctcccggagcacaggcaggcacttgcgtctcccaatacgcgaactggctcgttgtcctgctcctcgtcatcttccttttagtggctaacatactgttagtgaacctcctcatcgctatgttcagctacacattcgggaaagtgcaaggaaattcagatttatactggaaggcccagcggtacagactgatccgtgaattccactcccgacctgcacttgcgccacccttcatcgtcatttcccacttgcgattactgctccgccagttatgcaggagacccaggagcccccagccttcttctcccgctctggagcactttagggtttatctttctaaggaggccgaacggaagctgctgacatgggagtccgtgcataaagagaacttccttttagctcgggcacgagataagagagaatctgatagcgagagactgaagcgcaccagtcaaaaggttgacctagctctgaagcagcttggacacattagagagtatgagcaacgattgaaggtcctggagcgtgaggtccagcagtgctctcgggtccttggctgggtggcggaggcgttatctcggtcagccctacttcccccaggaggcccacctcccccagatctaccaggcagtaaagattag

SEQ ID NO: 244622 - DNA, 3210 bp, Artificial Sequence
  Description of Artificial Sequence: Synthetic coding sequence
atggtcgtgccggagaaagagcagtcgtggatccctaagatctttaagaagaagacatgtaccacttttatcgtggatagcactgatcccggtggaaccttatgccagtgtggtaggcctagaacagctcatcccgcagtcgccatggaggatgctttcggagccgctgtggtgaccgtctgggactctgatgcacacactactgagaaacccactgatgcctacggtgagctggacttcacaggagctggtcgcaagcacagcaattttctaagactgagtgaccggactgatcctgccgctgtatattctctcgtcaccagaacctgggggttccgggcaccaaatttggtcgtgagcgttctcggtggcagcgggggacctgttctccagacatggctccaagatttgcttcggagaggcctggttcgtgctgctcagtctaccggagcttggattgttactggcggactgcacacaggaataggcaggcatgtgggtgtagccgtcagggaccaccagatggccagcaccggcggaactaaggttgtcgcaatgggcgtagcgccttggggcgtagtgagaaatagagacacccttataaaccctaagggcagctttccagccagataccgctggaggggggatcccgaggatggggtccaattcccgttagactataactactctgccttctttctggtcgacgacgggacacacggttgtctggggggagaaaaccgattccgattgcgattggaatcatatatctctcagcagaagacaggagtggggggaactggtattgatatccccgtgctgctgttgcttatagatggtgatgaaaagatgctaactagaattgagaacgccacccaggcacaattgccctgcctgctggttgcgggttccggtggcgctgcagactgcttggccgaaacactagaggatacgctggcaccgggatctggtggcgcacgacagggcgaggcccgagatcgtatccgtcgtttttttcctaagggggatctcgaagtacttcaggcgcaggtggaacgcattatgaccaggaaagagctgctgacggtgtacagcagcgaagatggctcggaggaatttgaaactatcgtactcaaagctttagtgaaggcctgcggctcctccgaagcatccgcctatctggatgagttacgactggccgtcgcatggaatagggtggatatagcccaatcagagttatttcgtggagatattcagtggagaagtttccacctagaagccagcctcatggacgccctgctcaacgatcgcccagaatttgttcggcttctgatctcacacgggttaagcctgggccacttcctgactcccatgaggctggcacaactgtacagcgcagctccctctaatagcttgatccgtaacctgcttgatcaagctagccatagcgctggaacaaaggctccggctctgaaagggggtgctgccgagctgagaccacctgacgtgggacacgtgctcagaatgctcctgggaaaaatgtgtgccccacggtaccctagcggaggtgcctgggacccacaccccggtcagggctttggcgaaagcatgtatctgctctccgataaagccacatccccgctgtccctggacgcgggactgggccaggctccttggagtgacctgcttctctgggccctgctcctgaatcgcgcacagatggccatgtatttttgggagatggggtctaatgccgtttcatccgctctgggggcatgtctgcttctccgggtaatggcccgattagaacctgacgcagaggaagccgcaagacgtaaggatttggcgtttaagttcgagggtatgggtgtagacctcttcggagaatgttatcgatcttccgaggtgcgggcagcccgtctcctgttgaggcggtgccccctgtggggagatgcaacctgtctgcaactggcaatgcaggctgatgcaagggcttttttcgcgcaggatggggtgcagtcactgctgacacaaaagtggtggggggacatggcctctactacgcccatttgggcactagtccttgccttcttttgtcccccactaatctatacccgcctcattacgtttcgcaagtctgaagaggagccaacccgggaggagctcgagttcgacatggattctgtgatcaacggcgaggggcctgtggggctgaccccaggcctgtatcatctgggtaggaccgtcctgtgcattgactttatggtgttcacagtcaggttactccatatctttacggtgaacaaacagttgggacccaaaatcgtgatagtctctaaaatgatgaaggatgtattcttttttctgttctttctgggagtttggctggtggcttacggggtggcgaccgaaggccttctgcgcccacgagactcagatttcccatccattctccgcagagttttttacagaccatacctccagatttttggacaaattccacaggaagacatggatgtggccctgatggaacattccaactgctccagtgaacctgggttttgggcccacccccctggggcacaggcgggaacttgtgtgtcacagtacgctaattggctcgttgtacttctgctcgtgatctttttgcttgtggctaacattctgttggtcaacctactcattgctatgttcagttatacttttgggaaagtacagggaaattctgacctttattggaaagcgcagaggtataggctgatccgggagttccacagtagaccagcccttgcacccccatttatcgtgattagtcacctgagattgcttctcagacagctttgtcgacgccctcggagcccacagcctagctcaccagctctcgaacatttccgggtgtatctatcaaaggaggctgagcggaagcttctcacctgggagagtgtgcataaggaaaacttcctgctcgccagagctcgcgataaacgcgagtcagacagcgagcgcctgaagcgcacttctcagaaggtagatctggctcttaaacaactgggccatattagagagtacgagcagcgtctgaaggtcctggaacgagaggtgcaacagtgctcacgggtgcttggatgggtggcagaggctctctctcgtagtgcactcctgcctccgggagggccacccccacctgacctgcccggttctaaggactag

SEQ ID NO: 244623 - DNA, 3498 bp, Artificial Sequence
  Description of Artificial Sequence: Synthetic coding sequence
atgcaggacgtccaggggcctcgccctggatcacctggagacgctgaagatagacgagagcttgggctgcaccgcggtgaggtgaacttcggaggttccggcaaaaaacgcggaaagttcgttcgcgtgcctagcggcgtcgctccgagtgttttgttcgatctgcttctcgcagagtggcacctacctgcccctaatctcgtagtctctctggtgggggaagagcagccttttgcgatgaaatcatggcttcgggatgtgcttcgcaaaggtctggtgaaagccgctcagagtaccggggcttggatcctgacctctgccttacgcgtgggcctcgcaagacatgtgggacaggccgtccgcgatcattccctcgccagcacctcgaccaaagtgcgggtggtggccgtgggtatggctagcctggggagagtgctgcacaggagaatcctggaagaggcccaggaagatttccccgtccattaccccgaagatgacggaggctcacaaggaccactttgctcactggactccaatctcagccacttcatcttggtggagccaggccctcccggtaaaggcgacggattgacagaactccgcttacgtttggaaaagcatatcagcgaacagcgcgcaggatacggcggaacgggtagcattgagattccagtgttatgtctcctcgtgaacggggatcccaacacactggagagaatctcccgggctgtggagcaggctgcaccctggctgatcttggtgggcagcggcggaattgccgacgtgctggctgccctagtgaatcagccccacctgctggtgccaaaggtggccgaaaaacagttcaaagagaaattccccagcaagcatttctcctgggaagatattgtgaggtggactaagctgctccagaatatcaccagccaccaacacctgctcactgtgtacgactttgaacaagagggaagcgaagagctggacacagtgatcctaaaggcattggtcaaagcctgtaagagccacagtcaggagccacaggattacctagacgagttgaaattggccgtggcctgggaccgcgtggatattgccaagagtgagatattcaacggggacgttgaatggaaatcctgcgacctagaagaggtgatggtcgacgcgctggtgtcgaacaagcccgagtttgtgagacttttcgtggacaatggcgcagacgtagccgacttcttgacctatgggaggctccaggaactgtaccggtcagtgtctaggaaatctctgctttttgatctactccagagaaagcaagaagaggccaggctcacgctggcaggactcggtactcagcaggctcgcgagcctcctgctgggccaccggctttctcacttcacgaggtgtcaagagttctcaaggatttccttcaagatgcttgcaggggcttctatcaggacggtcggccaggagatcggagaagggctgaaaaaggccctgccaaacgtcccacgggtcagaagtggttgttggacctcaaccagaaatccgagaacccatggagggatttgtttctgtgggccgtgctgcagaaccgacatgagatggctacctacttttgggcaatgggccaggagggcgtggcagccgcattagcagcatgtaaaattctgaaagagatgtctcatctggaaacagaagcagaggctgctcgtgccactagggaggctaaatatgagcgactcgctttggatctgttcagcgagtgttattctaattctgaggcacgggctttcgcgctgctagtccggaggaaccggtgttggtcaaagactacctgcctacatctggcaacggaggcagacgccaaggccttcttcgcacatgacggggtgcaggccttccttacgcgaatttggtggggcgatatggcagccggaactcccattttgagacttctaggcgcatttctctgcccagctttggtgtataccaacctgattacgttctcagaagaagcgccactgcgtactggtcttgaagacctgcaagacctggactccttagacacagagaaaagtccattgtatgggctgcagtcccgagtggaagagctggttgaggcgcctcgggcacagggtgaccgtggtccaagggctgtgttcctcctgacacgttggcgcaagttctggggtgcccctgtcaccgtctttctaggaaatgttgtgatgtattttgcctttctctttctgttcacttacgtgctgctggtagacttcaggcctccccctcaaggaccttctggccctgaggtgaccctctacttctgggtctttaccctcgtgttggaagagatcaggcagggatttttcacagacgaagacacccaccttgtgaagaagtttacactctatgtgggagacaactggaacaagtgcgatatggtcgcaatcttcctcttcattgtgggggtcacctgcagaatgttgccgtctgctttcgaggcgggtcggacagtcttagccatggacttcatggtgttcaccctcagactgatccatatcttcgccatccacaagcagctggggccaaagataattgtggtagaacgaatgatgaaagatgtgttcttctttctgtttttcctctcagtgtggcttgtagcttacggagttactactcaggccctactgcatccacacgatgggagactcgaatggatttttaggagagtgctgtaccgtccatatctccagatcttcggacagatccccttggacgagattgacgaggccagggtgaactgcagcacccatcctctgcttctcgaggactctccttcctgccctagcctgtatgccaactggcttgtcattctgcttctcgtcacatttctcctcgtgaccaacgtgctgcttatgaacctgctcatcgcaatgttcagctacacttttcaggtggtccagggcaacgcagacatgttctggaagtttcaaagatacaaccttattgtggaataccacgagcggcctgccctagctcctccctttatcttactcagccatctgtcacttactttaagaagggtgttcaagaaggaagccgaacacaaacgagagcatctagagagagatctgccagatcctctggatcagaaagtagtgacttgggagacagtgcagaaggagaactttctctctaagatggagaagcggaggcgcgattctgagggcgaagtgttgcgaaagacagcccatcgggtcgattttattgccaagtacttgggaggacttagagagcaagagaaaagaattaaatgtctggagtcacagatcaattattgcagtgtgttggtcagctccgtcgccgatgttcttgctcagggtgggggacccaggtcttctcagcattgtggggaaggaagtcagctggtggctgcagatcacagaggaggactggacgggtgggagcaacccggtgccggacagccgccatcagatacgtag

SEQ ID NO: 244624 - DNA, 2619 bp, Artificial Sequence
  Description of Artificial Sequence: Synthetic coding sequence
atgcaagatgtgcagggccctcgccctggctctcctggggacgccgaagaccggcgagagttgggactacacagaggagaagtgaatttcgggggatcagggaaaaagcgaggcaaattcgtccgagtccccagtggagtggctccttccgtgctcttcgacttgctgcttgctgaatggcatctgccggctcccaacctggtcgtgagtcttgttggcgaggagcagccattcgctatgaagtcctggctgagggatgtgcttagaaagggattggtcaaagccgcacagagtacaggcgcttggattctcacgagcgcactgagggtaggcctggcccgacacgtgggccaggccgtgagagaccattcattagcgagtacaagtactaaggtgcgagtcgtggcagtgggaatggccagtctgggccgtgtgttacatagaagaatcttggaggaagctcaggaggactttccagtgcactacccagaagacgacggtggatcccagggcccactgtgttctctggattcaaatttatctcactttatccttgtagagcctggtccgcctggaaagggagatggcctgacggagcttcgactcagactagagaagcatatcagcgagcagcgcgctggctacggaggcacaggtagcatagagatccctgtcctgtgtctgctggtcaacggcgacccaaacaccctagagcggatctctcgcgcagtagagcaggctgctccatggcttattctggtcggttcaggcggaatagccgacgtactggccgcactggtgaatcagccccatctcctcgtaccgaaagtcgcagagaagcagttcaaggagaaattcccgtcaaagcacttttcttgggaggacatcgttcgatggacgaagctgctccagaatattacatcacatcagcacctcctgacggtatacgacttcgagcaggagggatcagaagagctggatacagtgatcctgaaagcattagtcaaagcatgcaagtcccactctcaggaaccacaggactatcttgacgaacttaagttggccgtcgcctgggacagagtcgatatcgccaaatccgaaatctttaatggcgatgtggagtggaagtcatgcgatctagaagaagtcatggtggacgccttagttagcaacaaacccgaatttgttcgcttgtttgtggacaatggggcagacgtggctgattttctcacatatggcagattacaagaactgtacaggtcagttagcaggaagtccttattgtttgatttattgcagagaaagcaggaagaggcacgcctcacactggctggtctcggcacccagcaggctcgggagcctcccgcagggcctcccgcatttagcttgcacgaggtttccagggtgctcaaggacttcctgcaggacgcatgccggggattttatcaggacggaagacctggagacaggaggcgagccgagaagggacctgccaagcgtcccactggccagaagtggctgctcgacctgaatcaaaaatccgagaacccatggagagatctctttttgtgggccgtgctacagaaccgtcatgaaatggctacctatttctgggctatgggacaggagggggtggctgccgctctggcagcttgtaagattctcaaagagatgtctcacctcgagacggaggctgaagccgctagagcaactcgtgaggccaagtacgagaggttggccttggatctgttttcggagtgctattctaacagcgaggcccgtgccttcgcgttgctcgtgaggcggaatagatgctggtcgaaaaccacctgtctgcatcttgcaactgaagctgatgcaaaagcattctttgcccatgacggtgtccaagccttcctgacacggatctggtggggcgatatggcagccggaactcctatcctcagactgttgggagcttttctttgccctgctctagtgtacacaaatctgatcactttctctgaggaggctcctctgaggacaggcctagaagacctacaggacttggacagtctggacactgagaagtcacccctctatggacttcaatccagagttgaggagttggttgaggcccctagggcacaaggagaccggggaccacgggcagtattcttgcttacacgctggaggaagttttggggggcaccagtaacagtgttcctaggaaatgttgttatgtactttgccttcctgttcctctttacctacgtgctcctggtcgactttaggccccctccacaaggacctagcggcccagaagtgaccctttatttttgggtcttcacattggtgctcgaggaaattcggcaggggttctttacagacgaagacacccacctggttaaaaagttcaccttgtacgttggcgacaattggaacaagtgcgacatggtggccatttttcttttcatagtcggggtcacatgcagaatgctgccttccgctttcgaggcgggtaggactgtgctggccatggacttcatggtatttaccttgcgccttatccatatatttgccatccacaaacagctgggtcctaaaattattgtcgtggaacgaatgaaaccagtgtag

SEQ ID NO: 244625 - DNA, 3504 bp, Artificial Sequence
  Description of Artificial Sequence: Synthetic coding sequence
atgcaggacgtacagggtccacgtcccggaagtccgggagacgcagaagaccgcagagagttaggactgcacagaggcgaggttaacttcggtggttcaggtaaaaaaagaggaaaatttgtgcgtgtgccttcaggcgttgctccatcggttctattcgatcttctcctcgcagagtggcatttaccggctcccaacctggtcgtgtcattggtgggcgaggagcagcccttcgccatgaagagttggcttagggatgtactgaggaagggactggtgaaagccgctcaatccaccggagcctggatcctgacctccgccctgcgcgtgggcttggctagacacgttggacaagcggtccgtgaccacagcctggcttccacatctactaaagtgcgagtagttgccgtgggtatggctagcttggggagggtactgcatcgccgtatcctcgaggaggcccaggttcatgaagattttcccgtgcactaccccgaagatgatggcggttctcaaggccctctctgttctctggatagcaacctatcacactttatactggtagaaccaggaccgcctgggaaaggcgacggattgactgagctgcgcttgagacttgagaaacatattagtgaacagcgggctggctacggtggaacaggttcaatagagattcccgtgctgtgcctcttggtaaacggtgatcctaatactcttgaacgtatatctcgggcagttgaacaagccgcaccatggctaatcctggtcggtagcggagggatcgcagacgtcctcgctgctcttgtgaatcaaccacaccttttagtgcccaaagtggcagaaaaacagtttaaggaaaagttcccaagcaaacacttctcctgggaggacattgtgcggtggaccaaattgctgcagaatataaccagtcatcagcacctactgactgtgtacgatttcgagcaggaaggctccgaagagctcgataccgtgattctgaaggctctcgtaaaggcctgcaagtcacactcacaggaaccgcaggactacttagatgaactgaaactggctgttgcttgggacagggtggatattgccaagagtgagatattcaacggagacgtggagtggaaaagttgcgacctggaagaggtaatggtggatgcactagtgtctaacaagcctgagtttgtccgattattcgtggataatggcgcagatgtcgctgactttctgacatatggtagattgcaagaactgtaccgttccgtctccaggaagtccctactgttcgacctgcttcagcgaaagcaggaggaggctagattgacgctcgctggtcttgggacgcagcaggcacgggaacccccagccggacctcctgcctttagcttgcacgaagtgtcacgtgtacttaaagacttcctgcaggacgcatgccggggattctatcaggatggaaggccaggcgataggagaagggccgaaaaggggccagcaaagagacccaccggtcagaagtggctactcgacctcaaccagaagtcagaaaatccttggcgcgacctgtttctctgggcggtcttacaaaatagacatgagatggccacctacttttgggcaatggggcaggaaggagtcgccgcagccctggctgcctgtaaaatcttgaaggagatgagtcacctcgagacagaagctgaagcagccagagcgacccgggaagcgaagtacgaacgtcttgctctggatctgttctcagaatgctactcgaacagtgaggcaagagcttttgcattgttggtgcggaggaaccgctgttggtccaagaccacctgcctccacctagccaccgaggccgacgcaaaagctttttttgcccacgatggtgtgcaggcctttcttacaaggatctggtggggcgacatggcagcaggcacacccattcttaggcttctcggggctttcctttgtcccgctctggtgtatactaatctgatcacctttagtgaggaggcacctcttagaaccggcttggaggacctccaggacctcgactccctggacacggaaaaaagcccgctgtatgggttgcaatctcgagttgaagagctcgttgaggctccacgagcccaaggagacagaggcccacgagccgtattcctgctaacaaggtggcggaaattttggggcgcaccagtgaccgtctttcttgggaacgtagtgatgtatttcgcctttctgtttctgttcacttatgttctcctggttgacttccggccacctcctcaggggccaagcggccctgaagtcaccttgtacttctgggtgtttacactggtattggaagagattagacaaggcttttttaccgacgaagatactcacctggtcaaaaagttcacgctttacgtgggcgataactggaacaagtgcgatatggtcgctattttcctgttcattgtgggggtaacatgcagaatgctaccttcagcttttgaagctgggcgaacggtgctagcgatggatttcatggtttttacccttcgccttatccatatcttcgccatacataagcagctggggcctaagatcattgttgttgagcgcatgatgaaagatgtgttttttttcctgttctttctctccgtgtggctggtagcctacggcgtaacgacacaggcgctccttcaccctcatgacgggcgacttgagtggatattccgtcgcgtactctataggccgtatttacaaatttttgggcagatacccctggatgagatcgacgaagcaagggtcaattgctccacacacccccttctcctggaggattcgccctcctgcccatcactttacgcgaactggcttgttattttactccttgtcaccttcttgcttgtgactaatgtcctgctgatgaacctgctcattgcaatgttctcctatacgtttcaagtggtacaaggtaacgctgatatgttctggaagtttcaaaggtacaacctgatagttgaatatcacgaacggccagcccttgccccaccttttatcctccttagccacttatcactgacgctgcgccgtgtgtttaaaaaagaggccgagcataagcgtgagcacctggagcgcgatctgcccgatccactggatcagaaggttgtcacatgggagaccgtccagaaggaaaatttccttagtaagatggaaaagcggaggagagattcagagggagaggtgctgaggaagaccgcgcacagagtggactttatcgccaagtatctggggggactcagggagcaagagaaacggatcaaatgtctggagtcccaaatcaattactgtagtgtgctggtttcttccgtcgcagatgttctggctcagggcggaggtccgcgaagttctcagcactgtggagagggctctcagctggttgcagcagatcaccgaggcggtctggacggctgggaacagcctggtgctggccaacccccatctgatacctag

SEQ ID NO: 244626 - DNA, 3480 bp, Artificial Sequence
  Description of Artificial Sequence: Synthetic coding sequence
cctggctctccgggtgacgccgaagatcgaagagagttaggtctgcaccggggtgaggtgaatttcgggggatccggcaaaaaacgcggaaagttcgtgcgagtgccttccggagtcgcccctagcgtactttttgatctactgctcgccgagtggcacttgcccgctccaaacctggtagtatccctggtgggcgaggagcaaccatttgcaatgaaatcttggcttagagacgttctgcgaaagggcctcgttaaagccgctcagtctaccggcgcatggattttgacttcggcattgagagtcggtctggccagacatgtgggtcaagctgtgagagaccacagtttggctagtacgagcacgaaggtgcgggtggtggccgtgggcatggcctccttaggacgggtgcttcaccgcagaattctggaggaagcgcaggtgcatgaggattttcctgtgcactaccctgaggacgacggagggtcccagggccctctgtgttcgctggactccaatctttcccacttcatcttggttgagcctggtcccccagggaagggggacggactgacggaacttcgcctaagactggagaagcacatttcagagcagcgggctggttatggaggtaccggcagtatagaaataccagttttgtgcctgctggttaatggcgaccctaacactctagaacgaataagtcgcgcagtggagcaagcagcaccatggctcatcctggtaggtagtgggggaattgctgatgttctggccgctttggtgaaccaacctcatcttctggtcccgaaggtggctgagaagcaattcaaggaaaaattcccatcaaaacacttctcatgggaagatatcgtgcgatggaccaagttgctgcagaatatcaccagccatcagcatttgcttaccgtctatgactttgaacaggagggctccgaagagctggacactgttatactcaaagcgctagttaaagcttgtaaatctcactcacaggaaccccaggattacttggacgagctgaagctagccgtcgcctgggacagagttgacatcgccaagagtgagatctttaacggcgacgttgaatggaaatcatgcgatcttgaagaggtcatggtggatgccctggtgtcaaacaaaccagagttcgtgcggctctttgtggataatggggcagatgtggcggacttcctaacttatgggagattgcaggagctatataggtcagtgagtcgtaagtctcttctcttcgacttattgcagcgcaagcaagaggaggcgagactgactctggccggattaggtactcaacaggcccgtgagccccctgccggaccccctgccttctccttgcacgaagtgtctcgcgtgctgaaggacttccttcaggatgcctgccggggtttctaccaggacgggaggccaggggataggcggcgtgcagaaaagggcccagctaagcgacccactggtcaaaagtggctgcttgatctcaatcagaagagcgaaaacccatggagggacttattcctctgggctgtgttgcagaataggcacgagatggctacatacttttgggctatgggtcaggagggggtggcggcagcacttgcggcttgcaaaatccttaaggaaatgtcccacctggaaacagaagctgaggctgctcgggctacccgtgaggcgaagtacgagagactggcacttgacttgttttcagagtgctattctaattccgaggcccgagccttcgcactacttgtccgcaggaaccggtgctggtcgaagaccacatgcctgcacctggccacagaggccgacgcaaaagcttttttcgcccacgatggagtgcaggcctttctcaccaggatatggtggggggacatggccgcagggacccccatcttgcgcttactgggcgcatttttatgtccagccctcgtgtacacaaatctaattactttttcagaagaggcacccctccgtaccggccttgaggacctacaggatctggactccctggataccgagaagtcaccgctttatgggctgcagagtcgtgtggaagagctggtcgaggccccacgggctcaaggggacagagggcctagggctgtgttcctcctgactcgctggcgcaaattttggggggcacctgtcaccgtgttcctgggaaacgtagttatgtactttgcattcttgtttctctttacttacgtactcctggtggacttccggcctccaccacagggcccatctgggccagaggtcactctgtatttctgggtgtttacactggttctcgaggagattcggcaggggtttttcactgatgaagacacccacctggtcaagaagtttaccctgtatgtgggagataactggaacaaatgtgatatggttgcgatatttctctttatagtgggggtgacctgtcgtatgttacctagcgctttcgaggcaggcaggaccgtgctggctatggatttcatggtctttacacttcgtctgatacacatttttgcaattcacaagcagctcggtccaaaaattatcgtggtcgagagaatgatgaaagacgtgttttttttcctgtttttcctgtctgtgtggctggtagcctatggggtaactacccaggctctgctgcatcctcacgacggaagactcgaatggatttttcgtagggtcctgtatagaccctacttgcaaatattcgggcagatcccactagacgagatcgacgaggcccgagtcaactgttctacacaccctctccttcttgaggacagcccatcttgccccagcttgtacgccaattggttagtaatactgttactggtcaccttcctactggttacgaacgtccttctaatgaatttgctgattgctatgttctcatacacctttcaggtggtgcagggcaacgccgatatgttctggaaattccagcgctataacttaattgtggaataccacgagcgcccagctcttgctcccccatttatcctactgagccacctgagcttaactctccgccgtgtgtttaagaaagaggccgagcacaaaagagagcatctggagcgggacctcccagatccactggatcagaaagtagtgacttgggagaccgtacagaaggagaatttcctgtcgaagatggagaagagaagaagggattctgagggagaggttttacgcaagacagcgcatcgtgtggatttcatcgcaaagtatttgggcggtctgagggaacaggaaaaacggatcaagtgtctggagtcacagataaactactgtagcgtcctggtttcaagcgtggccgacgttttggctcaagggggagggcctagatcaagccagcactgtggggaaggctcccagctagtggcagctgaccatcgcggagggcttgacggctgggagcagcccggagctggccagcccccaagtgatacttag

SEQ ID NO: 244627 - DNA, 3402 bp, Artificial Sequence
  Description of Artificial Sequence: Synthetic coding sequence
atgctgcggcctcaggtgaaagaggagattatatgcatgatccaaaatacctttaacttctctcttaagcaatcaaaacatttgttccaaatccttatggagtgcatggtacatcgggactgcatcactatctttgatgcggattccgaagaacagcaggacctcgacctcgccattctgaccgccctgcttaaagggacaaacctgtctgcatcagaacagctgaacctggcgatggcctgggatcgagtggacatcgccaagaaacacattctcatctacgaacagcattggaaacctgacgccctggagcaggcaatgtctgatgcactggtgatggatcgggtggatttcgtgaagcttttgatcgaatacggcgtcaacctgcacaggttcctgactatccctcggcttgaagagctctataacactaagcaggggccaaccaacactctccttcaccacttagtgcaggatgtaaaacagcacacactgctgtcaggatacaggatcacactcatagacatcggcctggtcgtagaataccttatcggcagagcgtacagaagcaactatacacgtaaacacttccgtgccctgtacaacaatctttaccgcaagtataagcaccagaggcattccagcggaaaccggaatgagagtgcggagagtaccttgcattcacagttcatcaggaccgcacaaccatacaagttcaaggagaagtctatcgtgctgcataagtctcgtaaaaaaagtaaggagcagaacgtgtcagacgatccggaaagtaccggctttctttacccctataatgatttgctggtctgggctgttctcatgaaaagacaaaaaatggccatgtttttctggcagcacggcgaggaagctacggtgaaagcggtgattgcctgcatactgtatcgcgctatggctcacgaggcaaaggagagtcatatggtggatgacgcctctgaagagctgaaaaactacagcaagcagttcgggcagttagccctggatctgctcgaaaaagccttcaaacagaatgaaaggatggcaatgaccctgttaacatacgaacttcggaactggtcaaatagcacctgcctgaaactggctgtgtctgggggactcaggccatttgtgagccacacctgtacgcagatgctactgaccgacatgtggatgggcaggctgaagatgaggaagaatagctggctcaaaataatcatctcaataatacttccccctacaattttgactctggagtttaagagcaaggccgaaatgagtcacgtaccccaatcccaggacttccaattcatgtggtactactctgatcaaaacgcatcgagctcaaaagaaagcgcatccgttaaagagtatgatctggagagaggccacgacgagaaattggacgagaatcagcatttcggactcgaaagcgggcaccagcacctgccttggacccgtaaagtgtacgaattttacagtgctcctattgtgaaattctggttctacaccatggcttacctagcctttctgatgcttttcacctatacggttctcgtagagatgcaacctcagcccagcgttcaagaatggttggtcagcatttacatcttcaccaatgcaatcgaggtggtacgggaaatctgcatctccgagccgggaaagtttactcaaaaggttaaggtttggataagtgaatattggaacctgacggagacagtggccatcgggctgttttctgccggtttcgtgttgcggtggggcgatccccctttccatacagccggtaggctgatctactgcatcgatatcatcttttggttcagtcgactgctggatttctttgctgtcaatcagcatgcaggaccctacgtgactatgattgcaaagatgacagcgaacatgttttacattgtcatcatcatggctatcgttctgctatcatttggcgtggcgaggaaagctattctttcccctaaagagcccccaagttggagtctggctagggatattgtctttgagccctactggatgatctatggagaggtttatgccggagagatcgacgtgtgttcctctcagcccagctgtcccccaggctcatttctcacgccctttctccaagccgtgtacctctttgtgcagtatataattatggtcaatctgctgattgcattcttcaacaatgtgtatcttgatatggaatccatctcaaataacctgtggaaatataaccggtacagatacatcatgacataccacgagaagccttggcttccaccaccactgatcctgctgtcgcacgttgggctgctcctgcgaaggttgtgttgccaccgcgctccccatgatcaggaggagggcgacgtcggcttgaaactttacctgagcaaggaggatcttaaaaagctgcacgacttcgaagagcagtgcgtcgagaaatatttccatgaaaagatggaggacgtgaattgttcttgcgaagaacggataagggttacctcagagcgagtaaccgaaatgtattttcaactaaaagaaatgaatgaaaaagtatccttcatcaaagattccctattaagcctggattcccaggttggtcatctccaagacctttctgcactgacagtggacacactgaaggtactttccgctgttgatactcttcaggaagatgaggctctgctggcgaagagaaagcacagcacctgcaaaaagctgcctcattcctggtcaaatgtgatctgtgccgaggtattaggatcaatggaaattgctggcgaaaaaaagtatcagtactactctatgcccagctctctgctgcgatctctcgctggaggacggcatccacctcgcgtgcagcgaggggctcttctggaaataactaactccaagcgggaggcaaccaatgtgcgcaacgaccaggaaaggcaagaaacccaatcttctatcgtggtcagtggagttagtcctaatcggcaggctcactcaaagtacggacagttcctgctagtgcctagcaacttgaaacgagtaccattctcggccgagactgttctgccactatctcggccatccgtacccgatgtactggccaccgagcaagatattcaaactgaggtgctggtgcatctaaccggacagactcctgtggtctcagattgggctagcgtggatgagcctaaggagaagcatgaaccaattgcccatttgctggatggacaggacaaagccgaacaagtgctcccaactctgtcttgtacaccagaaccaatgaccatgtccagtcctttgagaaggtaccgcccttttgcacgttctcatagctttcggtttcataaggaagagaaactcatgaaaatctgtaagatcaagagtaaagagtag

SEQ ID NO: 244628 - DNA, 912 bp, Artificial Sequence
  Description of Artificial Sequence: Synthetic coding sequence
atgaaggagcagccagtgctggagcgtctgcagtctcagaaaagctggattaagggcgtttttgacaagcgggagtgctcaactattataccatcaagtaagaacccccatagatgcactcccgtgtgtcaggtgtgtcagaacctgattcgatgctattgcgggaggctgatcggagatcacgcaggcattgattatagttggacaatttcagccgctaaagggaaggaaagtgagcagtggtctgtggagaagcataccactaaaagtcctacggacacgtttggaaccatcaatttccaagatggggaacatactcaccatgccaagtacatccggacatcctatgacacaaaactcgatcacctgcttcatctgatgctgaaagagtggaaaatggaattgccgaagctagtaatttccgtgcatggtggcattcagaattttacaatgccatcgaagttcaaagagatcttttctcagggactggtcaaggcggctgaaacaactggagcatggattataacagagggaatcaacaccggagttagtaagcacgttggtgatgcattgaagtcccacagcagtcactccctgagaaagatctggactgtcggaatacccccatggggcgttatagagaaccagagagatctaataggaaaagacgtggtctgcctataccagactctggataaccctttgagtaaactcacaacactgaatagcatgcacagtcactttatcttatcggacgacggtaccgtcgggaaatatggtaacgagatgaagctgcgacgcaacttagagaagtacctctctctgcaaaagatccattgccgcgagtatcatcgaggctcggtaacccagagcgggtgcaggcctgcagaagtatttcatgggctcccttag

SEQ ID NO: 244629 - DNA, 6068 bp, Artificial Sequence
  Description of Artificial Sequence: Synthetic coding sequence
atgaaggaacagccggtgcttgaacggcttcaaagccagaagagttggataaaaggggttttcgataaacgcgaatgttccaccataatcccaagctcaaaaaatccgcacaggtgtactccagtctgccaggtgtgccaaaacttgatccggtgctactgcggaaggctgataggagaccatgcagggatcgactattcatggactatctcggccgctaaaggcaaggagtctgagcaatggtcagtggaaaagcacacaaccaaatcacctaccgataccttcggtaccattaatttccaggatggcgagcacacacaccatgccaaatacattcgcactagctacgacaccaaactggatcatcttttacacttgatgctgaaagagtggaagatggagttgccaaaactcgtcataagcgttcacggtggcatacagaattttaccatgccctctaagtttaaggagatcttctcccagggtttggtgaaagctgccgagaccactggcgcatggattatcactgaagggatcaatacaggcgtgtctaagcacgtgggcgatgctctcaagagccatagctcccattctctgcgcaaaatctggacagtgggtattcctccatggggcgtgatagagaaccagagagacttgatcggaaaagacgttgtgtgcctgtaccagactctggacaaccccctcagcaaactgaccaccttaaactcaatgcactctcatttcatactatctgacgacggcactgtggggaagtacgggaacgagatgaagttgcgccgtaacctagagaagtacctttccctccaaaagatccactgcaggagcaggcagggagtgcccgtcgtcgggttggtcgttgagggtgggcctaacgtgatcctgtccgtgtgggagactgtgaaggacaaggacccagtggtggtctgcgaaggtaccggccgagcagcggacctgctggctttcactcataaacaccttgctgatgaggggatgttgcgcccacaggtgaaggaggagatcatctgcatgattcagaacactttcaacttcagtctaaagcagtccaaacacctttttcaaatcttaatggagtgtatggtgcaccgggattgtatcactattttcgatgctgattccgaggagcagcaggacctggacctggcaatcctgactgccctgctgaagggcaccaacctgtccgcctctgagcagctgaatttggctatggcctgggacagagtggacatagccaagaagcacatcctgatctatgagcaacactggaaaccagacgctctggaacaagccatgtcggacgcactagtgatggatcgggtggattttgtcaagcttctgatcgagtatggcgtgaacctgcatcgattccttaccatcccaagactggaggagctgtacaacaccaagcagggcccaacgaatacgctgctgcaccatctagtacaagacgtgaaacagcacaccctcttgagtggatatagaattaccttgattgacatcggtttagtggtggagtatctcattgggagggcttacagaagtaattacacgcgaaagcatttcagagccctgtacaataacctatacagaaagtacaaacaccaaaggcacagctctggaaacaggaatgagtccgcagaatctaccctgcactcacagtttatccggaccgcccagccctataagtttaaagaaaagtccatagtactgcataagagcaggaaaaagtctaaagaacagaacgtgtcagatgaccccgagagcacaggctttctctatccctataacgaccttctcgtgtgggccgtgctaatgaagagacagaaaatggccatgttcttttggcagcatggcgaggaagcgaccgtgaaggccgtgatcgcctgtattctgtatagagcgatggcacatgaggcaaaagaaagtcatatggtggacgacgcatcagaggagctgaagaactattccaagcagtttggacaactagctttggaccttcttgagaaggccttcaaacagaatgaaagaatggcaatgaccctgcttacttatgagttgcgcaattggagcaattcaacgtgccttaagctggccgtctcaggcggactgagacctttcgtcagtcatacttgcacccagatgctgttgacagacatgtggatgggtcgccttaagatgcgaaaaaattcctggttgaagatcatcataagcattattctcccacctacaatcctgactctagaattcaagagtaaagcagaaatgtcccatgtgccccagtcccaggacttccaattcatgtggtattactctgatcaaaatgccagttcgagtaaagagtccgcaagcgtcaaggagtacgacctcgaaaggggccacgatgagaagctggatgagaatcagcatttcggattagagagtggacaccagcatctcccttggacacggaaggtttatgagttttatagcgctccaatcgtgaaattttggttttatactatggcgtatctggccttcttaatgctctttacctacaccgtactggtagagatgcagcctcagccgagcgtccaggaatggctagtgtccatttatatttttactaacgcgatcgaggtggtccgcgaaatttgcatttccgagcccggaaagttcacccaaaaggtcaaggtgtggattagcgagtattggaacctcaccgagactgttgccattgggctcttttctgctggcttcgtactccgatggggggatcctccctttcacaccgcgggaaggctcatctactgtattgacattatattttggttcagtagactgctggacttttttgccgtgaatcaacacgccggaccttatgtgactatgattgcaaaaatgacagcgaacatgttttacatcgtgatcattatggctattgtgttgctgagctttggagtggccagaaaggctattctcagcccaaaggagcctcctagctggtcgctcgccagagacatagtgttcgagccttactggatgatctacggagaggtgtatgcaggcgagattgatgtttgctcatcacagccaagttgtccaccgggtagttttctaacaccctttctgcaggcagtgtatttatttgtgcaatatattattatggtgaacctgctgatcgcgtttttcaacaatgtgtatctggatatggaaagcatctccaataacctgtggaaatacaaccgctaccgatacatcatgacatatcacgagaaaccttggctcccacctccacttatcctgctttcccatgtgggtctccttctccggcgtctttgctgccatcgggctccacacgatcaggaagagggcgatgtcgggctcaagctttatttatctaaggaagaccttaaaaaactgcacgattttgaggagcaatgcgtggaaaaatatttccatgaaaagatggaagatgtcaattgttcttgcgaggagcgtattagggtgacatctgaacgagtaaccgagatgtactttcagctgaaagagatgaacgagaaggtgtcgttcatcaaagattccttgctgagtctggattcacaggtcggtcatctgcaggacctgagcgccctgaccgtggacacgctgaaggttcttagcgcagtggatacccttcaagaagatgaggcactgctggccaagcgtaagcacagcacgtgcaaaaaactgccccattcctggtccaacgtcatctgtgccgaagtcctgggatcaatggagatcgccggagagaagaaatatcaatattacagcatgccgtcgtccctgctcagatcactggctgggggaaggcaccctcccagggtgcagaggggggcattgctagagatcactaatagcaagagggaggccacgaatgtcagaaatgaccaggaacggcaggagacacagagctcaattgtggtaagcggagtctctcctaatcgccaggcccacagcaagtatggacagtttctcctggtgccatcgaacctgaagcgagttcccttctcggccgagactgtgttgcccctctcacgaccctccgtgcctgatgtgctggccaccgagcaagatattcagaccgaggtacttgtgcaccttacaggacagacccctgtcgtctcggactgggctagcgtagacgagccaaaggaaaagcacgaacccatagctcaccttctcgacggtcaggataaggcggagcaggtgctgcccacactgtcttgtactcctgagccaatgaccatgagttcaccgcttagccaggcgaagatcatgcagacaggaggtggctatgtgaattgggctttctcggaaggcgatgagaccggcgtattctcaatcaagaagaaatggcagacctgcctgccatccacttgcgatagcgattcatctaggtcagaacagcaccagaagcaggcacaggacagctctttaagcgacaatagtacgagatctgctcagtcatccgaatgctctgaggtgggcccttggttgcagcctaacacatctttttggataaatccgctgaggcgatacaggccctttgctcggtcacactctttccgcttccacaaagaggagaagctcatgaaaatttgcaaaatcaagaacctctccggcagcagcgagatcggccaaggagcatgggtgaaagcgaaaatgctcaccaaggatcgcaggctctccaagaaaaagaagaatacacaaggtttgcaggtgccaattattaccgtgaacgcatgctcccagagcgaccagctgaaccccgagccaggagagaattctattagtgaggaagagtatagcaagaactggtttaccgtgtcaaaattctctcataccggagtcgagccctatatccatcagaagatgaagaccaaagaaattgggcaatgtgccatacagatctcggattacttgaagcagtcacaggaagacctgtccaagaacagcctctggaattcaagatcaacaaacttgaaccgcaactcactcctgaaatcttccataggggtcgataagatcagcgcatcccttaagtcaccccaggaaccccatcatcactactcagcgatcgaacggaataatttgatgcgcctctcccagaccatcccttttaccccagttcaattgtttgccggtgaagaaatcaccgtataccgtttggaggaaagtagtccactgaacctggacaaaagcatgtcttcatggagccaacggggacgagctgcgatgattcaagtactgtctcgcgaagagatggacgggggtctcagaaaggctatgagggttgtgtctacatggagcgaggacgacattctgaagcccggacaggtgtttatcgtgaagtcattcctgccagaagtggttcgcacgtggcataagatttttcaggaatcaaccgtcctccatttgtgcctgagagagatccaacagcagcgagctgcgcaaaagctcatttacactttcaatcaggtgaaaccccagacaatcccgtacactccacggttcctggaagtgtttttaatttactgtcacagcgcgaaccagtggttaaccatagaaaagtacatgacgggggagttcagaaagtacaataacaataacggagacgagattacccccactaatacccttgaggagcttatgcttgctttttcgcactggacttatgaatacacacggggagaactgctggtgctggatctgcaaggagttggggagaacctgacagacccaagcgtgatcaaaccagaagttaaacagagtagggggatggtgtttggccctgccaaccttggagaagatgccattagaaattttatcgccaaacatcactgcaatagctgttgcaggaagttaaaacttccagatctgaagcggaatgattattcaccagaaaggatcaactccactttcggactggagatcaaaattgagtctgccgaggagcctccggctagggaaaccggcaggaattcgcccgaagacgacatgcagcttta

SEQ ID NO: 244630 - DNA, 6053 bp, Artificial Sequence
  Description of Artificial Sequence: Synthetic coding sequence
atgaccgcccctgttacatctcaaaaatcctggatcaagggagtcttcgataagagggaatgttctacgatcatcccatcaagcaaaaatcctcatagatgcacccctgtctgtcaggtgtgccaaaacctcatcaggtgctattgtggcagattaattggcgaccacgcgggtatcgactattcatggacaatctccgcagcaaagggaaaagagtcagagcagtggtcagtcgagaagcatacgacaaaatcaccgactgatactttcggcactatcaacttccaagacggggaacatactcatcacgcaaagtacattcggacttcttatgacaccaagctggatcacctcctgcacctgatgctgaaagagtggaagatggagttgcccaagctggttattagtgtgcacggcggaatccaaaactttacaatgccgagcaagttcaaggaaatctttagccaggggctggtaaaggctgctgagacaactggggcttggatcattacagaagggatcaatacaggggtgtccaaacacgttggcgacgctctgaaatctcattcaagccactcattgcgcaagatttggaccgtcggcattcctccttggggcgtgatagaaaatcaaagggacctgatcggcaaggatgtagtgtgcttatatcagactctggacaatcccctcagcaagttaacgactctaaacagtatgcactcacactttatcctctctgacgatgggaccgtggggaaatacgggaacgagatgaaactgagacggaaccttgagaaatacctttcgctacagaaaattcactgtagaagtcggcagggcgtgcccgtggtaggactagtggtggaaggcggaccaaatgtaattctgtccgtctgggagaccgtgaaagataaagacccggtcgtcgtctgcgaagggaccggcagagccgcagacttgctcgctttcacgcacaaacaccttgccgacgagggcatgctgcgtcctcaggtaaaggaggagattatttgcatgatccagaatacttttaacttttccttgaagcagagcaagcatctgtttcagattctgatggagtgtatggtacatcgcgattgcatcaccattttcgatgccgattcagaggaacagcaggacctggacctcgccattctgaccgctctgttaaagggcacaaacctgagtgcatcagagcaactgaatttagccatggcatgggaccgagtcgacattgcaaagaagcatattctgatttacgaacagcactggaaacctgatgctctggaacaagcaatgagcgatgcgctggtgatggaccgtgtagacttcgtcaaacttctgatcgaatacggagtcaaccttcaccgttttttgacaattcccagattagaagagctgtataataccaaacagggcccaaccaacactctcctacaccacttggtgcaggacgtcaagcaacacactctgctttccggctataggataactctgatcgacataggcttggtggtggaatacctgatcggccgtgcttatcggagtaactacacgcgaaagcactttagggctctatacaataacctgtaccgtaagtacaaacaccagcgccactcttctgggaacaggaatgagtccgccgagtccaccctgcattcacagttcattcgtaccgcacaaccctataagttcaaggagaagtctatcgtgctccacaagtcccgcaaaaaatcgaaggagcagaatgtttccgatgacccagagtctaccggattcctgtacccatataacgacctgttagtgtgggcagttctgatgaaaaggcagaagatggccatgttcttttggcagcatggcgaagaagcaactgtgaaagccgtaattgcgtgtatcctataccgggcaatggcccacgaggctaaggaatctcatatggtggatgatgctagtgaagagctgaaaaactactcaaagcagttcggccagctggccctggatctcttagaaaaggccttcaaacagaacgaacggatggccatgactttgttgacctacgagcttcggaattggtcgaattcaacatgcttgaaattagctgtcagcgggggacttagaccattcgtgagtcacacgtgcacacaaatgctcctcacagatatgtggatgggacgcctcaaaatgcgtaaaaatagctggttgaagatcattatatccataatcctgcctcccaccattctcactctagaattcaagtccaaggctgaaatgtcccatgtcccccagagtcaggacttccagtttatgtggtactattctgaccaaaatgcctcctcttccaaggagagcgcttccgttaaagaatacgaccttgagagaggacatgatgagaaactggatgagaaccaacactttggtctggagagcggacaccagcacttgccctggactcgcaaggtttatgaattctattcagcaccgattgtcaagttttggttctataccatggcatacttagcctttttgatgcttttcacatacaccgtgttggtggaaatgcagccccagccttctgtccaggagtggcttgtgtcaatttacattttcactaacgccatcgaggtcgtgcgcgagatttgcatctctgaaccaggaaaatttactcagaaagtaaaagtttggatcagtgagtattggaatttaaccgagactgttgcaatagggctgttttctgcagggtttgtgctgcgttggggagacccaccgttccataccgctggccgactaatctattgcatcgatattattttttggttctctcggctccttgatttctttgcggtaaatcaacatgccggaccatatgttaccatgattgccaaaatgactgctaacatgttttatattgtgatcataatggccatcgtgctgctgagcttcggggtggccaggaaggcaatactaagcccaaaggagcctccaagctggtccttggctagagatatagtcttcgagccctactggatgatctatggcgaagtgtatgctggggagattgacgtgtgttctagtcaaccctcttgcccacctgggtctttcctgacaccgttcctccaggctgtctatctattcgtccagtacatcatcatggtgaacctactcatcgcattctttaacaacgtctatctggacatggagagtatttccaataatctatggaagtacaaccggtaccgatatatcatgacctaccacgagaaaccgtggctgccccctcctttgattctgttaagtcatgttggactgttgctgagaagattgtgttgtcatagggcgccacacgatcaggaggagggggacgtcggcctcaagctttacctgtctaaggaagacctgaagaagttacatgactttgaggagcagtgcgtcgagaaatacttccatgaaaaaatggaggacgttaattgctcctgtgaggagcgcatccgagtgactagcgaaagggtaaccgagatgtattttcagttgaaagagatgaatgaaaaagtttccttcatcaaggattccttgttgagcctggacagccaagtggggcacttgcaggatctgagtgcactcacggtggacactctcaaagttctgagcgcagtcgacacactccaagaggatgaagccttgctcgccaaacggaagcactcgacatgtaaaaagttgcctcacagttggtccaacgtcatatgtgctgaggttttagggtcaatggaaattgcgggtgaaaagaaatatcaatattactccatgcctagcagcctcctcaggagtctggccggagggcgacaccctccaagagttcagcggggagcgcttcttgagattaccaactcgaaacgagaagctacgaatgtgaggaatgatcaagagaggcaggaaactcaatccagtatcgttgtctctggagtcagccctaaccggcaagcacattctaaatatggccagttcctcctggtaccatccaatctgaaaagggtgccattcagcgccgaaacggtgcttccgctctctaggccttccgtcccagacgtgctcgcaaccgaacaggacatccagactgaagtgttagtgcatctgaccggccagactcctgttgtctccgactgggcatcagttgacgagcctaaggagaagcacgaacctattgctcatctgctcgacggtcaagataaagcagagcaggtgctgcctacgctctcctgtacccccgaacctatgacaatgtcgtccccgttatcgcaggccaagataatgcaaaccggtggtggttatgtgaattgggctttcagcgaaggcgacgaaaccggagtattctccatcaaaaaaaaatggcaaacctgcctgcctagtacttgtgatagtgatagctccagatctgagcagcatcagaagcaggcgcaggattccagcctatctgacaatagtacacggtccgctcagtcgtcggagtgcagtgaagtcggcccatggttgcagcctaacacatccttctggatcaaccctttacgacggtacaggccattcgcccgttcccactcttttcggtttcacaaggaagagaaattgatgaagatttgcaagataaagaacctctcaggctcaagcgaaatcggtcagggagcttgggttaaggccaaaatgctgactaaagaccggaggctgagtaaaaagaagaagaatacccaaggtctgcaggtgcctatcatcacagttaatgcctgttcacaatccgaccaacttaaccccgagccgggtgaaaattctatctcagaggaagaatattccaagaactggtttaccgtgtccaaattcagccacacaggtgtcgagccatacatccatcagaagatgaaaaccaaagagattgggcagtgcgccatccagatttctgactatctcaaacagtcccaagaggacctctcaaagaactctctctggaatagtaggtccacaaatctaaatcgaaactctctgctgaagagcagcatcggcgtggacaagatctctgccagtctgaagagtcctcaggagcctcaccaccactatagcgccattgagagaaataatctgatgcgtctctctcagacgatccctttcacgcccgtccagctgttcgcgggagaggaaatcacagtttatcggcttgaggagtcgagccccctcaatctagataaatcaatgagtagctggtcccagcggggaagagccgctatgattcaggtcctgtctagggaggagatggacggaggactgagaaaggccatgagagtcgtgtcgacgtggagtgaggatgatattttaaagcctggccaagtcttcattgttaagtcatttttgccagaggtggtacgcacatggcacaagatctttcaggaatccaccgtcttgcacctgtgtctccgagagatccaacagcagcgggcagctcagaaattaatttacactttcaatcaggtaaaaccacaaacgattccatatacaccgaggtttctcgaagtcttcctcatatattgtcactcagcgaatcagtggctgaccatcgaaaaatacatgaccggcgagtttaggaagtacaacaataacaatggggacgagatcacacctacgaatactttggaggagctaatgctggctttcagccactggacctacgaatacacgcggggagaacttctggtgctggatctgcagggcgtgggggagaacctaacggacccatctgtgatcaaaccagaggtgaagcagtctcgcggaatggtgtttggaccagccaaccttggcgaggatgccatacgcaatttcattgctaagcatcactgtaactcctgctgcaggaagctgaagctccctgacctgaagagaaacgactattccccagagcgcatcaattctacgtttgggctcgagatcaaaattgagtccgcggaagaaccgccagcccgtgagacaggcaggaatagtcctgaggacgatatgcagctgta

SEQ ID NO: 244631 - DNA, 5843 bp, Artificial Sequence
  Description of Artificial Sequence: Synthetic coding sequence
atgaaggaacagcctgtgctcgaacgactccagtcacaaaaaagctggattaaaggggtatttgacaaacgcgaatgtagcacaataataccctcctctaaaaaccctcataggtgcacccctgtctgtcaggtgtgccagaacctgattcggtgttactgcggtcgactgataggcgaccatgcgggtatcgactactcttggacaatatctgcagctaaaggcaaagagtcagagcagtggtcggtcgaaaagcatactactaagtctccaacggatacttttggaaccatcaacttccaggacggcgaacatacgcatcacgctaagtacattcgcactagctatgacacaaagttggaccacttgcttcacctgatgttaaaggagtggaaaatggagctcccaaagctggttatttccgtccacggcggaattcagaacttcacgatgcccagtaagttcaaggaaattttctcacaggggctcgtgaaagccgctgagactacaggcgcttggataatcaccgagggcatcaataccggagtgtccaagcacgttggcgacgctctaaagagccattccagtcattctcttcgcaaaatttggactgtcggaatccccccttggggggtgatcgaaaatcagagagacttaatcggcaaggatgtggtctgcttgtaccaaacattggacaaccctctgagcaagcttacaaccctgaactctatgcatagccactttatcctcagtgatgatgggacggtcggaaaatacggtaacgaaatgaagctcagaagaaacctggagaagtaccttagccttcaaaaaatccactgcagatcacggcaaggcgtccccgtagtgggcctagtggtggagggtggccctaatgtgatcctcagcgtgtgggagactgtgaaagacaaggatccagtcgtggtgtgcgagggtacagggagagccgcagatcttttggccttcacccataagcacctggcagacgaaggaatgttgaggcctcaggttaaggaagaaataatctgtatgattcaaaatacttttaactttagccttaaacaatctaagcatctgttccaaatactgatggaatgcatggttcatagggactgcatcacaatcttcgacgccgactcagaagagcaacaggatttggacttggccatacttaccgcactgcttaagggcacgaatctgagtgccagcgaacagctaaatctagcaatggcgtgggatcgggtggatatcgcaaagaaacacattctgatctatgagcagcactggaaacccgacgccttggagcaagccatgtcagatgcacttgttatggacagagtggatttcgtaaaactcctaatcgaatacggtgtgaacttacacagattccttactatacctaggctggaggaactgtataacacaaaacaaggcccaactaacaccctccttcaccatctggttcaggacgtcaaacagcacactctgttgagtggctaccgtattacattgatcgatattggtttggtggtagagtacctgatcggcagggcataccgctcgaattacacacggaagcactttagagccctctataacaatctctatcgaaaatacaagcatcagcgtcactcgtccggtaatcgcaatgagagcgcagagagcaccctgcatagccagtttattagaacagctcagccttataaattcaaagagaagtcgatagttttgcataagagccgcaagaagtcaaaagagcagaatgtgagcgatgacccagagagcaccggattcttatatccttacaatgacctcctggtgtgggcagtgctgatgaaacgccagaaaatggcgatgttcttttggcaacacggcgaggaggccacggtgaaagccgtgatcgcttgcattctttaccgagctatggctcatgaggcgaaggagagccatatggtggacgacgcctctgaggagctgaagaattattcaaagcagttcggtcagcttgcactggatttactagaaaaggccttcaagcagaacgaaagaatggccatgactctcctcacgtacgaattacgaaattggtcaaacagcacctgcctcaagcttgctgtttcggggggtctgaggccttttgtgtcacatacatgcacccaaatgctcctcactgacatgtggatgggacgcctcaagatgcggaagaactcctggctgaaaattattatttccatcatcctcccacccacgatcctgaccctggaattcaaatcaaaggccgaaatgagccacgtgccacaaagtcaggacttccagttcatgtggtactactccgatcagaacgcctcctcatctaaagagagtgcctccgtgaaggagtatgacctcgagcggggtcacgatgagaagttggatgagaatcagcactttggcctcgagagcggacatcagcacttgccttggacgcgcaaggtatacgagttttactcggccccaatcgtgaagttttggttttataccatggcctatctcgcctttcttatgctctttacatatactgttctcgtggagatgcagccacaaccaagcgtccaggagtggttagtgtccatatatatctttacgaacgccatagaggtcgtgagagagatctgtattagcgaacccggaaagttcacccagaaggtgaaggtctggatctctgaatactggaatctgaccgagacggtggctattggacttttcagtgccggtttcgtcctgaggtggggagatccccctttccacaccgcaggaagattaatctattgcatagacatcattttctggttttccagacttctcgatttttttgccgtcaatcaacatgccggtccctatgtgactatgatcgctaagatgactgctaacatgttttatatcgtgattatcatggccattgttctgctatcctttggcgtcgctaggaaggccattctgtccccaaaagagcctccctcctggtcactggcaagggacattgtgttcgagccctactggatgatatacggtgaggtgtatgccggtgagatagacgtctgcagctcgcaaccctcatgcccacctgggagctttctgacaccctttctgcaagccgtgtatttatttgtgcaatacattattatggtaaacctcctgattgcatttttcaataatgtgtatctggatatggagtctatttccaacaatttatggaaatacaatcgttatcgatacattatgacttatcatgagaaaccatggctgccgccacctctgatactgctcagtcacgttgggcttctgttgcggaggctttgttgtcacagggcccctcacgatcaggaggagggagacgtggggctgaagctttacctcagtaaggaagaccttaagaagttgcacgacttcgaagaacagtgcgtcgagaaatatttccacgaaaaaatggaggacgtgaactgttcttgtgaggaacgaattagagttacctcagagcgcgtcacggaaatgtattttcagcttaaggagatgaacgaaaaagtctcatttatcaaggactccctgctgagcttggactcccaggtgggccacctccaggatttaagtgcactcacagtggacaccctgaaagtgcttagcgcagttgacacattgcaagaggacgaagctttgctggctaagaggaagcacagtacatgtaagaaattgccacactcttggtccaacgtgatctgtgccgaagtcttgggctccatggagatcgctggggagaagaaataccagtactacagcatgccctccagtttgctccggagtctggccggtggacgtcatccaccccgagtgcagaggggggctctcctggaaataacaaattctaagcgcgaagctaccaatgtgcggaacgatcaggagagacaggagacccaatcttccatcgttgtctctggcgtttctcctaaccgacaggcccatagtaagtacggccagttcctcctagtccccagcaatctgaagcgtgtgccattttcagccgagacggttctcccacttagtcggccttcagtgcccgacgtgctggccaccgaacaagacatccaaacagaagtgttagtgcatctaactgggcagactccagtagtgagcgactgggcttccgtggatgaaccaaaggaaaagcacgaaccaatcgcacacctactggatggacaggacaaggcagagcaggtattgcccaccctgtcatgcacccctgagcctatgactatgtcctcccctctgtcccaggccaaaatcatgcaaactggcggaggctatgtgaactgggccttctccgaaggtgacgagactggcgtattctctatcaagaaaaagtggcagacttgcttgccaagcacgtgcgatagcgattcctcccgaagtgaacaacaccaaaaacaggcccaggactcgagtctgtcagataatagcacccggtcagcccagagttcagaatgttctgaggtgggaccttggttacagccgaacacatcattctggattaatcctttgcgccgttaccggcctttcgcaagatctcactcttttagattccataaggaagagaagctcatgaaaatttgtaagatcaagaacctgtctggaagctcagagattggccaaggcgcatgggtgaaggcaaaaatgctaactaaagacaggagactaagcaaaaagaaaaagaatacccagggcctacaggtccctattatcacagttaatgcttgttctcagagcgaccaattaaaccctgagccaggtgagaattcaattagcgaggaagaatactcaaaaaattggttcactgtctcaaaattcagccataccggggtggaaccttatatccaccagaaaatgaagacgaaagagatcggacaatgtgctatccagatatctgattatctcaaacagagtcaagaagatctctccaaaaatagcttatggaatagtcgctccaccaacctcaaccgcaacagcctgcacgtcataaagatgccaatatccagcctcatctctgagatttcagcgagtttaaaaagcccccaggaacctcaccatcactactctgcgatcgagcggaacaacctgatgcgcctgagtcaaacgatcccctttacccctgtccagctgttcgcgggtgaagaaatcaccgtataccgcctcgaggaatcttctcccctcaacctggacaaatctatgtcttcatggtcgcagcggggacgagccgctatgatccaagtgctctctagagaggaaatggatggtggcctgcggaaggcgatgagagtggtctctacctggagtgaggacgatatactcaagccaggccaggtgttcatcgttaaatccttcctccccgaggtcgtgcgaacatggcacaagatattccaggaaagcactgttctccacctctgccttagagaaatacagcagcagcgcgcagctcaaaaactgatctataccttcaatcaggtaaagcctcagaccattccctacacaccacgttttctggaggtattcttgatctactgtcacagcgcaaaccagtggctcaccatcgaaaagtatatgaccggcgagttccgcaagtacaataataataatggggacgagataacccctactaatacattggaggagctgatgctagccttctctcactggacatacgagtataccagaggggagctcctggtgcttgacttgcaggctctgtggttctgggactccatgcttaaagccagattgggaggctggagaatgta

SEQ ID NO: 244632 - DNA, 1707 bp, Artificial Sequence
  Description of Artificial Sequence: Synthetic coding sequence
cgggaaagtccacacccagcgctactgcagtcgcagaagagctggatcaaaggcgttttcgacaagcgcgagtgcagcaccatcatcccctctagtaaaaacccgcataggtgtaccccagtatgccaagtgtgtcaaaacttaattcgctgctattgcggcagactgattggtgatcacgccggaatagattacagctggactatcagcgccgcaaaggggaaggagtccgaacagtggtccgtcgagaaacacacgacgaagtctccaaccgacacattcgggaccattaattttcaggatggggagcatacacaccacgcgaagtatattaggacatcgtacgatactaagctggatcatctgttgcacctgatgttaaaagagtggaaaatggagctgcccaagctcgtcataagcgttcacgggggaatacagaatttcacaatgccctctaaattcaaggagatcttttcccagggattggtgaaggctgccgaaaccacaggagcctggataatcaccgaaggcattaacacgggagtctcgaagcatgtgggagacgccctgaagtcccactcttctcactccctgcggaagatttggactgtgggaatccctccatggggagtcatcgagaatcagcgggacctcattggcaaagacgtggtttgtctgtatcagaccctggacaatcccttaagcaaacttaccactctcaatagcatgcattctcactttatcttatccgatgatggtaccgtcggcaaatatggcaacgagatgaagttaaggaggaatctggaaaagtacctgagtctccaaaaaatacactgcccaggcgaggagatcaccgtctaccgcttggaagaatcctctcctctgaatttagacaagtcgatgtcctcatggagtcaacggggtcgggcagcaatgatccaggtgctgagtcgagaggagatggatggtggcctgaggaaggctatgagagtcgtgtccacatggagtgaggatgacatcctgaagcccggtcaggtattcattgtgaagtcgtttttgccagaagtagtccgaacttggcacaagatcttccaagaatccactgtcttacacctgtgtctgcgggagatccagcagcagagagccgctcagaaactcatttatacattcaaccaggtgaagccccagacgataccatatacacccaggttcctggaggtgtttctaatttattgccattcagcaaatcagtggctcaccatcgaaaagtacatgacaggtgaattcaggaaatataacaacaacaatggcgacgagatcacccctactaacaccctggaggagctgatgctggccttctcccactggacttacgaatataccaggggggagttattggtacttgaccttcagggagttggcgaaaatttgactgacccctcagtgataaagcccgaggtgaagcaatctcggggaatggtgttcgggccagccaacttaggggaggatgccatacggaactttattgccaagcaccactgcaatagttgctgtagaaagctgaagctgcctgatcttaagcgcaatgactacagtccagagagaatcaacagcaccttcgggttggaaatcaagattgagtcagctgaagagcctccagcaagagaaactggtcgcaactctcctgaggacgatatgcagctatag

SEQ ID NO: 244633 - DNA, 2580 bp, Artificial Sequence
  Description of Artificial Sequence: Synthetic coding sequence
atgaaagaacagccagtattggagcgactgcagtcacagaaaagctggatcaagggggtattcgacaagcgcgagtgttccaccatcatccctagctctaagaatcctcatcggtgcacacccgtctgccaggtgtgtcagaatctgatcagatgttattgcgggagactaataggcgaccacgcaggaatagattattcttggaccatttctgccgctaaggggaaggagtccgagcagtggtcggttgagaagcatacaaccaaatcaccaaccgacaccttcggcacaattaatttccaggatggcgaacatactcaccacgctaagtatatcagaacatcatacgataccaaattggatcacctgctacatctcatgctgaaggaatggaagatggagctgcctaagttggtcatctcagtgcacgggggtattcagaattttacgatgccctccaaattcaaggagatctttagtcaaggcctggtgaaagcagccgaaactaccggagcctggattatcaccgaaggtatcaacacgggggtctctaaacatgtgggtgacgcactgaaatctcactccagccactccctgcgcaaaatttggacggttggtattcctccgtggggagtgattgaaaatcagcgcgacctgattggaaaggatgtggtttgcctttatcaaactctggataatcctctctcaaaactgactacattgaactccatgcacagtcactttattctgtctgatgatggaaccgtcgggaagtacggaaacgaaatgaagctccggaggaatctggagaaatacctcagtctgcaaaagatccattgcagatctagacagggtgtacccgtagtcggtctggtggtcgagggtgggcctaacgtcatcctgagtgtatgggagacagtgaaggataaggatccagtggtagtctgcgagggtacggggagggccgcagacttgttggcatttacccataagcacctggccgacgagggcatgttgcgtccccaggtcaaagaagagatcatttgtatgatccagaatacctttaatttcagcctgaagcagtcgaagcatcttttccagattctcatggagtgtatggtccacagagactgcatcaccatcttcgatgccgactcggaagaacagcaggatctcgaccttgccatcttgacagccctcctgaaaggcacgaacctatcggcgagtgaacagctaaacctcgccatggcatgggaccgagtcgacatagctaagaaacatattctcatttatgagcagcactggaagccggacgctcttgagcaagccatgtctgatgctctggttatggatcgcgtcgattttgtgaagcttctgatcgagtatggcgtaaatctccataggtttttgacaattccacgactggaggaactgtacaatacaaagcaggggcctactaatacattactgcatcacctagtgcaagatgttaaacaagatttgagcaagaacagcctttggaactctcgtagcacaaatctaaaccgcaactctttacatgtgatcaagatgccgattagctcgctgatttcagagatttccgccagccttaagagtccgcaggaaccccaccatcactactccgcgattgaaaggaacaacctgatgcgtctgagtcagaccattccatttactcccgttcagttgttcgccggagaagaaattacggtgtaccgattggaggaaagctcccctctgaacctggataaatcgatgagttcttggagccaaagaggtagagccgctatgatccaggttctgtctagggaggagatggacggaggactcagaaaggcaatgcgtgtagttagtacgtggagcgaagatgatatacttaagcccggacaggtgttcatcgtcaagtccttcttaccggaagtggttaggacctggcataagatttttcaagagagcacagtgctgcacctgtgcttgcgtgagatccagcagcagcgggctgcacagaagttaatatatacctttaatcaagtcaagcctcaaaccatcccttatacgcctagatttctggaagtgttcctcatctattgtcatagcgctaaccagtggctcacaatcgaaaagtacatgacaggcgaatttagaaagtacaataataacaatggtgacgagattacaccaaccaatacactggaggagcttatgctggctttctctcactggacctacgagtacactcgcggagaactcctagttctagacttacagggggtgggcgaaaacctaactgatccctcagttattaaacccgaggtcaaacagtcccgcggaatggtttttgggccagccaacctcggcgaggacgctataagaaatttcatcgccaagcaccactgcaacagttgctgcagaaaactaaaactgcccgatcttaaaaggaatgactactcaccagagcggatcaactccactttcggcctggaaattaagatcgagagcgccgaggagccacctgcccgagaaaccgggagaaacagtcccgaggacgatatgcagctgtag

SEQ ID NO: 244634 - DNA, 2934 bp, Artificial Sequence
  Description of Artificial Sequence: Synthetic coding sequence
atgaaagagcagcctgtgctggagagactgcagtctcaaaaatcctggataaaaggagtgttcgataaacgcgaatgctccacgatcatcccttcatctaaaaatccacatcgctgtacacctgtttgccaggtgtgccaaaatctgatccgctgctactgtggcaggctgattggagaccacgccggaattgactattcctggactataagtgccgctaagggaaaggagtctgaacagtggagcgtggaaaaacatacaacaaaaagcccaacagatacctttggcacaatcaacttccaggacggtgagcacactcaccacgctaaatatatccgaacttcatatgatacgaagctggaccatctgttacacttgatgctgaaggagtggaagatggaactaccaaaattggttatctcagtgcacggaggtattcagaacttcacaatgccctccaagttcaaggaaatcttcagccaggggttggtaaaagccgctgaaaccacaggcgcttggataatcaccgaggggatcaatactggagtgtccaagcatgttggggacgctctgaagtcacattcctctcacagcctccgtaagatatggactgtgggaatccccccatggggagtgatcgagaatcaacgcgacttgataggaaaagacgtagtatgcctgtaccaaactttggacaacccactctccaaactgacgaccctgaactctatgcactcacatttcatcctgtccgacgatggcacagttgggaagtatggcaatgagatgaagctacgcagaaacctagagaagtacttgtccctgcagaaaatccactgcaggtctcgccagggtgtgcccgttgtgggcttagtcgttgagggaggacccaatgtcatcttgagtgtctgggagacagttaaggacaaagacccagttgtggtgtgtgagggtacaggtcgggctgccgacctgctggcttttacccacaagcacttagccgacgaaggaatgctcaggccccaggttaaagaggagatcatctgcatgatccagaatactttcaactttagccttaaacaaagtaagcacctatttcagatactcatggaatgcatggtgcatcgggactgtatcacaatcttcgatgcggatagtgaggagcagcaagacctcgatttggccatcttgactgcgctgttaaaagggactaatctgtctgcttctgaacagttgaacttggctatggcctgggatcgcgtggatatcgccaaaaaacacattttaatctatgaacagcactggaaaccagatgcccttgagcaggctatgagcgatgcacttgtaatggatagagtggactttgtcaagctccttatagagtacggggttaatctccaccggtttttaactattcccaggctcgaagaactgtacaacacaaagcaaggccctaccaacacattgctgcaccatctcgtgcaggatgtgaagcagcatacactactttctggatacagaattacactcattgatattggccttgtagtagaatacctaattgggagggcatacagatccaactatacccgcaagcacttccgagccctgtacaataatctatatcgaaagtacaaaataatcacagtgaatgcatgtagccaatccgaccagttgaatccagaacccggtgagaactcaatatccgaggaggaatactccaagaactggttcacagtgtctaagttttcccataccggagtagagccatatatacatcagaagatgaaaacgaaggaaatcgggcaatgcgccattcaaatttctgactacctgaagcagtcccaggaagatctgtcgaagaactctctttggaactcgaggtcaaccaatctgaaccgtaattccctccacgtcatcaaaatgccgatctcatcactgattagcgaaataagcgcctctctaaagtcgccccaggaaccgcatcatcattacagcgccattgagaggaacaacttaatgcgactgtcccagaccatcccttttacacccgtccagcttttcgccggagaggagattacagtttacaggcttgaggaaagtagcccattgaacctcgataagtcaatgtcctcgtggtctcagagagggagggcagccatgattcaggtcctgtcaagggaggagatggatggcggactgagaaaggcaatgcgtgtggtctccacatggtccgaagacgatatactgaagcccggacaggtcttcatcgtcaagtcatttcttccagaggtggtccgcacctggcacaaaattttccaagaatcaacagtcttacatctgtgcctgagggaaatccagcaacaaagggccgctcagaagcttatctataccttcaaccaagtgaaaccccagaccatcccttatacaccgaggttccttgaggtgtttctgatttattgccacagcgccaaccagtggctgaccatcgaaaaatatatgacgggcgaatttaggaagtataacaataataatggcgacgaaataactcccaccaatactctggaggaactcatgctggccttttcgcactggacatacgagtacactagaggggaattactcgtcctcgaccttcagggcgtaggggagaatttgactgatccaagcgttattaaacccgaagtcaagcagtcacggggaatggtgtttggcccagccaacctcggcgaggatgctataagaaacttcattgccaagcaccactgcaattcctgctgtagaaaactcaagctacccgacttgaagcgcaatgattactccccagaacggattaatagcacctttggccttgaaatcaaaatcgaatccgccgaagaaccccctgccagagaaacagggaggaactctcctgaggacgacatgcagctgtag

SEQ ID NO: 244635 - DNA, 3402 bp, Artificial Sequence
  Description of Artificial Sequence: Synthetic coding sequence
atgcttcggcctcaggtcaaggaggagataatctgtatgatccaaaacacatttaatttttctctcaaacagtccaaacacctgttccaaatcctcatggaatgcatggtgcacagggattgtatcacaatctttgacgcagactcggaggagcaacaggacctcgacctggccatccttactgccttgctcaagggaacaaacctcagcgcgtccgaacagctgaatcttgccatggcctgggacagggtcgacatcgccaaaaaacacatcttgatatacgagcaacattggaagcctgatgctctggagcaggcgatgtccgacgccctggtaatggaccgggtggacttcgtaaaactgctgatcgaatatggagtcaatctgcacagattcctcacgatccccagactggaggagctgtacaacaccaagcaaggtcccacaaacaccttactccaccatctggtgcaggatgtaaagcaacacaccttgttgagcgggtatcgcataaccctcatagacattgggcttgtggttgagtacctcatcggacgtgcctatcggagtaactacacacgcaagcattttagagccctgtacaataacttgtaccggaagtacaaacatcagagacactcctccggcaacagaaatgaatctgctgaaagcaccctccactctcagtttataaggactgctcagccctataagtttaaagaaaaaagcatagtgctccataaatcccggaagaaaagcaaggagcagaatgtcagcgacgaccctgagagcactggcttcttatacccatataatgatctcctcgtctgggcagtgctgatgaaacggcagaaaatggccatgttcttctggcagcatggggaagaagctactgtcaaggcggtgattgcatgtattctgtatagggcaatggcccacgaagccaaagagtcacatatggtcgacgacgcctcagaggaactcaagaactattcaaaacagtttggtcaattggctctagacctgctagaaaaggccttcaagcagaatgaacggatggcgatgacgctgctcacctatgagcttcgcaattggagcaactccacctgcctgaaattagcagttagcggcggtcttaggcctttcgttagccacacctgtacacagatgctgctaactgacatgtggatgggcaggctcaaaatgagaaaaaacagctggctgaagattatcatcagcatcatccttccacctaccattctcacactcgagttcaagagtaaagctgagatgagccacgtgcctcaaagtcaggattttcagttcatgtggtattactcagatcaaaatgcctcctcttccaaagagagtgcgtcggtcaaggagtacgatctagaaaggggacacgacgagaagcttgatgagaaccaacattttggcttagaatcaggccaccagcatctcccatggacacgcaaagtgtacgaattttacagtgcccctattgttaagttctggttctacaccatggcctatctcgcattcctcatgctctttacctacacagtgctggtcgaaatgcaaccacagccaagtgtgcaagaatggctcgtgagcatttatatctttaccaatgcaatagaggttgtgcgcgaaatatgtatctcggaaccaggtaagtttactcagaaggtgaaggtttggatctctgagtactggaacttgacggagacagtcgcgattggccttttttcagctggctttgtgctgcgatggggagacccaccattccatacagctgggcgactcatatactgtattgatattattttctggttttcacgccttttggacttcttcgcagtcaaccaacacgccggtccatacgtgacgatgatcgcaaagatgaccgcaaatatgttctacattgttataatcatggccatcgtgctcctgagttttggtgtagctagaaaagcgattctgtcgccgaaagaaccaccaagttggagtctggcaagagacattgtattcgagccttactggatgatatacggcgaagtatacgcgggagagatcgatgtatgcagctcccaaccctcatgtccgccaggttccttcctgacaccttttctccaggctgtgtacctattcgtgcaatacatcattatggttaacttacttatcgccttttttaacaatgtatatctcgacatggagtcaattagcaacaatttatggaagtacaaccggtataggtacattatgacctaccacgaaaaaccatggctgccacctccacttatcctgctctctcatgtgggattgttgttgagacggctgtgttgccatcgcgctccacatgaccaagaagagggcgacgtgggcttgaagctctatttaagtaaggaagaccttaagaaattacatgatttcgaggagcagtgcgttgaaaaatatttccacgaaaaaatggaggacgttaactgcagttgcgaagaacgcatccgggtgacgtccgaacgggtcacagagatgtatttccagcttaaggagatgaacgaaaaggtgagcttcatcaaggatagcctgctctctctggacagccaggtaggtcaccttcaggacctcagcgcactgaccgtcgataccctcaaagtcctaagcgccgtcgacacgcttcaggaagacgaagctctgctggctaagcggaagcacagcacttgcaagaagctgccccacagttggtcaaatgttatttgcgccgaggtgctggggtccatggaaatagccggagagaagaagtatcagtattacagtatgcccagctctcttttgaggagcctggctggcggacgacaccctcctcgggtgcagcgaggggctctgttagaaattaccaactccaagcgtgaagctacaaatgtgcgcaatgaccaggagcggcaggagacacagtcgtccattgtggtctccggagtgtcccctaatcggcaggcccacagcaagtatggtcagttcctgctggtaccgtcaaatcttaagcgcgtgcctttcagtgcagagaccgtgctgccactgtccaggccaagcgtccctgacgtattggcaactgaacaggacatccagactgaagtattagttcatttgacaggccagactcccgtcgtgtcagactgggcgtctgtggacgagcctaaagagaagcatgagcccattgctcacttgctcgatgggcaggataaggccgaacaagtcctgccaacattaagctgtactcccgagcccatgactatgagcagcccactgtctagataccggccttttgccaggagccattcctttagattccacaaagaagagaagctcatgaaaatttgcaagattaagtctaaagagtag

SEQ ID NO: 244636 - DNA, 6054 bp, Artificial Sequence
  Description of Artificial Sequence: Synthetic coding sequence
atgattattttaagtaagagccagaagagctggataaaaggagtcttcgacaagagagagtgttccacaataataccttcttctaaaaacccgcatcgctgcacccctgtatgtcaagtttgtcaaaacttgatcaggtgttactgcggtagactaattggagatcatgctggaattgactactcttggaccattagcgctgctaagggcaaggaatcagaacagtggagtgtagagaaacacacaactaaatctccgacagacacattcggcacgattaattttcaagatggcgagcatacccaccatgcaaaatacatccgcacatcctacgacacaaagctagatcacttgcttcatctgatgttaaaagagtggaagatggagctgcccaaactagtgatcagcgttcatggagggattcagaatttcacaatgccatctaaatttaaagagatattcagccagggacttgtgaaggccgcagagaccaccggtgcatggattattactgaagggattaatacgggcgtgtccaaacatgtgggggacgccctgaagtcccactccagccacagcctgcgcaagatctggacagtcggcattcctccttggggcgttatcgagaaccagcgcgacctgatcggaaaggatgttgtgtgtctgtaccagaccctggataaccccctgtccaagctgacaaccctcaactccatgcactcacactttatactgtccgacgacggcacggtgggcaagtatggtaacgagatgaaactccgcaggaatctggaaaagtacctgagcctacaaaagatccactgcaggtcacgccaaggagttcccgttgtgggattggtggtggaggggggtcctaatgtcatactgtccgtttgggagacggtgaaggataaggacccagttgtggtgtgcgagggcaccggcagagcggctgacctactggccttcacacataagcacctcgccgacgagggaatgttgcgaccccaggttaaggaggagatcatctgtatgattcagaatactttcaacttcagcctgaaacaatcgaaacatctgttccaaatcctgatggaatgtatggtccatagggactgtatcaccatctttgacgctgactcggaggaacagcaggatctagatctggccatcctgaccgcactccttaaaggcaccaatctgtccgccagtgaacaactgaacctagccatggcctgggacagggtcgacatcgcaaagaagcatattttaatttatgaacaacactggaagcctgacgcactcgagcaggccatgagtgatgccctggtgatggatcgcgttgatttcgttaaactgctgattgagtacggggtgaatctgcatagattcctgaccatacccagacttgaggagctatacaatacaaagcagggaccaactaacacgctcttgcaccacctcgtgcaggacgtgaagcaacacacccttcttagtggatacaggattactctgatagatattggattggtggtggagtatcttattgggagggcctatagaagtaattacacccggaaacacttccgagccctgtataacaatctgtatagaaagtataagcaccagcgtcactcttctggcaacaggaacgaaagtgccgaaagcacactgcatagtcaatttattcggactgcccaaccctataagtttaaagagaaaagtatagtactccacaaatctcgaaagaaatctaaagagcagaatgtgtctgacgatcctgaaagcaccggctttctatacccatataacgatctgctcgtgtgggcggtcctgatgaagaggcagaagatggccatgtttttttggcagcatggcgaagaggccaccgtcaaggccgtgatcgcttgtatcctgtatcgcgctatggctcatgaagcgaaggagtctcacatggtggacgacgcatccgaggaactgaagaactactccaagcaatttggccagctggccctagatttactggagaaggcatttaagcagaacgagcggatggcaatgaccctgttgacctatgagctgcggaactggagcaacagcacttgccttaaactcgcggtctcagggggattacgtcccttcgtcagtcatacatgtacgcagatgctgttgacagacatgtggatggggaggcttaagatgcgaaagaactcctggttgaagattatcatcagtatcatcctgccgccaacgattctcactctggagtttaaatcaaaagcggaaatgagtcatgtcccccagagccaggactttcaatttatgtggtactatagcgaccagaacgcttcctctagcaaagaatctgcaagcgtgaaagaatacgatttggagcgaggtcatgacgaaaagttagacgaaaaccagcacttcgggctcgaaagtggccaccaacatcttccgtggacaagaaaggtatacgagttttactccgcgcctattgttaagttctggttttacacgatggcttacctcgcctttttaatgctgtttacttacacggtgctggtagagatgcagcctcaaccaagcgtccaagaatggctggtctccatttatatattcactaatgctatagaggtggtgagggaaatctgtataagtgaacccggaaagttcacccagaaagtcaaagtttggatcagtgagtattggaatctcacagagacagttgccattgggcttttctccgcgggttttgtgctgagatggggtgatccaccctttcacacagctggccgtcttatctactgcatagatatcatattttggtttagtaggctcttagacttcttcgccgtaaatcagcatgcaggcccatatgtgaccatgattgctaaaatgacagccaatatgttctacatcgttatcattatggccatcgttcttctcagtttcggagtcgccaggaaggccatcctgagtcctaaggagccgccatcttggagtctggcacgcgatattgtgtttgaaccgtactggatgatctacggcgaagtttacgccggagagattgacgtatgtagttcacagccgtcctgtccaccaggatcattcctgacccccttccttcaggcagtttacctgtttgttcaatacattattatggtgaatcttctcatcgcatttttcaacaacgtatatctagacatggaatcaatttccaataatttgtggaagtataatagatatcgctacattatgacttatcacgaaaagccttggcttcccccacctctaatcctcctgtcccacgtgggattgttgttgagaagactgtgctgccatcgcgcacctcacgatcaggaggaaggagatgtgggtctaaagctgtatcttagcaaggaagatctcaagaaactgcacgatttcgaggagcagtgtgtggagaagtacttccacgaaaaaatggaggacgttaattgttcatgtgaagaaagaatccgggtgacctctgaacgcgtgacggaaatgtactttcagctgaaggaaatgaacgagaaggtgagcttcattaaagacagcctacttagcctggatagccaggtcggccatctacaggatctctctgcactcacggtggatactctcaaagtgctgtctgccgtggatacgttacaggaagatgaggccttgctggcgaaacgcaaacattccacctgtaagaagctcccacactcttggtccaatgtgatttgcgccgaagtcctgggttctatggagatagccggtgaaaaaaaataccagtactactctatgccctccagcttactgcgatccctggctggagggaggcatccgcctagagtgcagcgtggagcactgttagagattacaaatagcaagagggaggctaccaatgtgcggaatgatcaggaaagacaagagacacaatcttcaattgtggtctccggggtgagtccaaatcgtcaggctcactctaagtacggacagtttctgcttgttccctcaaacttgaaacgggtgccattctctgcggagaccgtccttcccctcagcaggccctctgtgcctgatgtgctcgccacagagcaggacatccaaaccgaggtgctggttcacttaaccggccagactccggtggtgtctgactgggcctcagtagatgaacccaaagaaaagcatgagcctatcgctcatctgctggatggccaggataaagctgaacaagtgcttcctaccctgtcatgcacccccgagcccatgacaatgtcatcccccctgtcccaggccaagatcatgcagacaggcggaggatacgtgaattgggctttcagtgaaggtgatgagaccggagttttctccattaagaagaagtggcagacatgtctaccatcaacatgcgacagtgattctagccgttcagagcagcatcaaaagcaggcacaggactcaagcttgtcagataacagcactaggtccgctcaatcctcggaatgctcagaggtcggcccatggttgcagcctaatacatcgttctggattaatccactgcgtaggtatcgcccatttgcacgtagccactcattcaggttccacaaggaggagaaactgatgaagatttgcaagatcaagaatctctcaggctcgagcgagatcggccagggggcttgggtgaaggccaaaatgcttacaaaggaccgtaggctcagcaaaaagaaaaagaatacacagggtctacaagtgcctattattacagtgaatgcatgctcacagtccgatcaactgaacccggagccaggtgaaaacagcatctcagaagaggagtacagtaaaaactggtttaccgtcagtaagttctcccacacgggggttgaaccttacatccatcagaagatgaaaaccaaggaaataggccaatgcgcaatccagatctccgattatctaaagcagtctcaggaggacctgtccaagaactccctgtggaactcacgctctacaaaccttaacaggaattcactgctgaagtcctcaattggagtggacaaaatcagtgcctcactgaaatctccccaagagccccaccaccattattcagcaatcgagcggaataatctcatgcggctatctcagacaattcccttcaccccagtccagctgttcgcaggagaagaaataactgtgtaccgcctggaggagagctccccccttaacctggataagagcatgtcctcctggtctcagcggggacgcgctgctatgatccaggtcctgtcgagggaagaaatggatgggggtctgcggaaagcaatgcgggtggtgagcacatggtctgaggacgatatactgaagcctggccaggtttttattgtcaaaagcttcctgcccgaagtggttaggacctggcataagatcttccaggagtccaccgtcctgcacctgtgtctgagggaaatccagcagcagcgggcagcgcaaaagctgatttacaccttcaatcaggtcaagccacaaacgatcccctatacgccaaggttcctcgaggtatttctcatctactgccactcagccaaccagtggctcactattgagaaatacatgaccggagagttccgaaaatataacaataacaacggggatgagattactcccaccaacacactggaggagctcatgcttgctttttcccattggacctatgaatacacaaggggcgagttgctggtgctggacctccagggggttggggaaaaccttactgatcctagcgttatcaaacccgaggtgaaacagagcagaggcatggtcttcggacccgctaaccttggggaggacgctattagaaatttcatcgctaagcaccactgtaatagttgttgccgcaaactgaagttgcctgacttaaaaagaaacgattactctcctgaaagaatcaatagtactttcggattagaaatcaagatcgaaagcgctgaagagccccctgcacgcgaaactggacgaaattccccagaggatgacatgcagctgtat

SEQ ID NO: 244637 - DNA, 6080 bp, Artificial Sequence
  Description of Artificial Sequence: Synthetic coding sequence
atgaaggaacagcctgtcctcgaacggttacaatcacaaaaaagctggatcaagggagtgtttgacaagagggaatgttctacaatcattcccagttctaagaaccctcacagatgtacgcccgtgtgtcaggtgtgccagaacttgattcgatgttactgtggcaggttaattggcgatcatgctggcatcgattactcctggacaatctctgccgcaaaaggaaaggagtccgaacaatggtccgtggaaaaacataccaccaaatctccaactgatacctttggaaccatcaacttccaggacggcgagcacacacatcatgccaaatatatcagaacttcctatgacacaaagctggaccatctgctccacctcatgcttaaagagtggaaaatggagctccctaaattagtgatctcagtgcacggaggtattcagaatttcactatgccctctaagtttaaagagattttttctcaaggactggtgaaggccgctgagaccacaggagcatggattataactgagggaattaatacgggagttagcaaacatgtaggtgatgcacttaaatcccactctagccactcactgaggaagatttggactgtggggatccccccatggggcgtgatcgagaaccagcgggatctcatcggtaaggacgtggtgtgtctctatcagacattggacaacccactatccaaactcaccacgttaaattcaatgcacagccacttcattctgtccgatgatgggaccgtgggcaaatacggcaatgaaatgaagctcagacgcaatctcgagaaatacctttctcttcaaaaaatccattgtcgcagccgccagggggtccccgtcgtgggcctcgttgtggaagggggtcccaatgttatactctcggtttgggagacagtgaaggacaaggatcctgtcgtggtttgcgaggggacaggtagggccgcagacctgctcgcctttacgcataagcacttggcagacgagggtatgctccgaccccaggtcaaagaagagataatctgtatgatacagaatacgtttaacttttctttaaagcaatctaagcacctgttccagatacttatggagtgtatggtgcaccgcgactgcataacgatttttgacgctgacagcgaagagcagcaggatctagatcttgctattctgacagctctcctgaaggggacaaatttatctgctagcgaacagctcaacttggccatggcttgggaccgggttgacatcgcaaagaaacatattttgatatatgaacagcactggaaaccggatgctctggagcaggccatgtcagatgcccttgttatggatcgggtggattttgtgaaactgttgattgagtacggagtgaacttgcatcgatttttaacaattcctagacttgaagagttgtataatactaagcagggccctactaacactctgctgcaccatctagttcaggacgtcaaacagcacaccctcctgagtggctacaggataaccctgattgatatagggttagtggtggagtatctgatcgggagggcatacagatccaattacactagaaaacacttcagagccctatacaataacctgtaccgcaagtacaaacaccagcgacatagctctggaaataggaatgagtcagcggaatctaccctacattcgcagttcattcgcactgcccagccctacaagtttaaggaaaagtctatagtgctgcataagtccaggaagaagtccaaggaacagaacgttagtgacgaccccgaaagtacgggctttctttacccttacaatgatctgcttgtgtgggccgtgctcatgaagcggcagaagatggccatgttcttctggcagcacggagaggaagccacagtcaaagctgtgattgcctgtatcctctaccgtgcaatggcccacgaggccaaggaatcacacatggtggatgacgcgtctgaggagcttaagaattacagtaaacaattcggccagcttgctctggaccttctggaaaaggcgttcaaacaaaatgaacgcatggccatgactctgttgacatacgagcttcgtaactggagtaattcaacatgcctgaagctagccgtgtcaggaggcctgaggcccttcgtgtcacacacgtgtacgcaaatgctgctcaccgatatgtggatggggagattgaaaatgagaaagaacagttggcttaaaatcataatatcaattatccttccacctaccattcttactctcgagtttaaaagcaaggcagaaatgtcacacgtgccccaaagccaggatttccagttcatgtggtactattcagatcagaatgccagttcctccaaggaaagtgcttctgtgaaggagtacgacctggagaggggacatgatgagaagcttgatgaaaaccagcattttggcctcgaaagcgggcatcaacaccttccctggacgaggaaagtttacgagttttattcagcacccatcgtcaaattttggttttacaccatggcatacctagcattccttatgctgttcacttataccgtgctggtcgaaatgcagccccagccgagcgtgcaggagtggctggtatccatctatatctttactaacgccattgaagtggtgcgggaaatctgtatatcggagcctgggaaattcacccagaaagtaaaggtgtggataagcgagtactggaaccttaccgagactgtggccatcgggctctttagcgcgggatttgttctgaggtggggtgatcccccattccatacggccggacgtctgatctactgcatagacatcatcttttggttcagtcggctcttagacttcttcgcagttaaccagcacgctggcccttatgtgactatgattgccaagatgactgctaatatgttctacatcgtcatcattatggcaattgtgttgctctcttttggagtggcgaggaaagcaatcctctcgccaaaagaacccccttcctggagcctagcacgtgacatcgtgttcgagccatattggatgatttacggtgaggtgtatgcaggcgagattgacgtatgctcttcacagcctagttgtcctcccggatcattccttacccccttccttcaggccgtttatctgttcgtgcagtacattattatggtcaacctgttaatcgctttctttaacaatgtgtacttggacatggaaagcatttctaacaatctgtggaaatacaaccggtaccgctatattatgacatatcacgaaaagccctggctgcctccgccattgatcctgttgtcacacgtgggcctgctgctgagacgtctctgctgccaccgggctccccatgaccaggaggagggtgacgtcggcttaaaactttatctgagtaaggaagaccttaaaaaacttcatgattttgaggagcaatgcgtagaaaagtattttcatgaaaagatggaagacgtgaactgctcttgtgaagaacgaattcgtgtaaccagcgaacgtgtaaccgaaatgtattttcagctgaaggaaatgaacgaaaaggttagcttcatcaaggattccctcttatctcttgacagccaagttgggcatctccaagatctatccgctctcaccgttgatacgctgaaggtgctgagcgccgttgatacactccaggaggacgaggccttactggcgaaacgaaagcattccacttgcaaaaagctcccccactcttggtcaaatgttatatgcgccgaagtactaggctcaatggaaattgctggcgagaagaaataccagtactattcgatgccttcatctctattgagaagcttggccggtggcaggcacccacccagggtccagaggggggctctgctggagattactaattcaaagagagaagctacaaacgtgcgcaacgaccaggaaagacaggagacacagagttccattgtcgtctctggtgtctctcccaaccggcaggctcattccaaatacggacagtttcttttggtcccttccaatttgaagagagttccattcagcgcagaaactgttctgccattgtcccgccctagtgtgcccgatgtcctggccactgaacaggacatccagaccgaggttttggtgcatttgaccgggcaaactcctgtcgtgagtgactgggcaagcgttgatgaacccaaggagaaacacgaaccaattgcccatcttctggacggccaggacaaagccgaacaagttcttccaaccctgtcctgcacacctgaacctatgacaatgagcagtccactatcacaggccaagatcatgcagaccggtggtggatacgtcaattgggcatttagcgagggagacgagactggagtgttctcaatcaagaaaaagtggcagacgtgcctgcctagtacgtgcgattctgacagctccagatccgaacagcaccagaagcaggcccaggattcgtccttgtccgacaactccacaagaagcgcccagtcaagtgagtgcagcgaagtcggcccatggcttcagcctaatacaagtttctggataaacccactgcgtcggtacaggccttttgctcggtcccacagcttcagatttcataaggaggaaaagcttatgaagatctgcaaaatcaagaacctgagcggaagctccgaaatcggccagggggcttgggtgaaggctaaaatgcttaccaaggaccggagactgagcaaaaagaagaaaaatacacaagggcttcaggtccctattattacggtgaacgcttgcagccaatccgatcaactcaatcctgagccgggtgagaattctatttctgaggaggaatattccaaaaattggtttaccgtgtccaagttttctcataccggtgtggagccatatatccaccaaaaaatgaagaccaaggagataggacaatgtgccattcagatttccgattacctgaagcagtcgcaggaggatctgtctaaaaactccttgtggaactcaaggtccacaaacctcaaccggaattctttacacgttattaagatgcctatttccagccttatcagcgagattagcgcgtccctgaagtccccacaggagccccatcatcattacagcgctattgaaaggaacaacctgatgcggttatcccagacaatccccttcacgccagtacagctgttcgccggagaggagatcactgtgtacagactcgaggagtctagtccccttaatctagataaatccatgagctcatggtcccagagaggtcgcgctgccatgattcaggtgttatccagagaggagatggacggtggactgcggaaagccatgagggtagtgtcaacgtggagcgaggacgacatcttaaaacctgggcaagttttcatcgttaagtcattcctgccagaggttgttcgtacctggcacaaaattttccaggagagcacagtcttacacctctgtcttagagaaatccagcagcaaagagcagctcagaagctgatctacactttcaaccaggtgaaaccccagaccattccctacactcctcgatttctggaggtatttcttatctactgccactcggctaaccaatggcttactattgaaaagtacatgactggcgagttccgcaaatataataacaacaatggtgacgagattactcctaccaataccctggaggagctgatgttggcatttagccactggacatatgaatatacccggggagaactgctggtcctggatctccagggagtgggcgagaatttgacagatccctctgtcatcaagcctgaggtcaaacaaagccgcggaatggtattcggccctgccaatcttggcgaagatgcgattagaaactttatcgcaaagcaccattgcaacagctgttgccggaaactgaagcttccagacttgaaacgtaatgattatagccccgaacgcattaattctacgttcggtctggaaataaaaatcgagagcgccgaggaacccccagcacgagagacgggccgaaactctcccgaagatgatatgcagctata

SEQ ID NO: 244638 - DNA, 5598 bp, Artificial Sequence
  Description of Artificial Sequence: Synthetic coding sequence
atgtctcagaaatcctggatcgagtcaacacttactaaaagggaatgcgtgtatattattccttcttccaaagatccacaccgctgtctacccggatgccagatctgtcaacagctagtgcggtgtttttgcgggagactggtgaagcagcacgcatgctttacagctagtctggccatgaaatacagcgacgtgaagctcggcgaccatttcaaccaagcaatcgaagaatggagtgtcgagaagcacactgaacagagcccaactgacgcctatggggtaatcaatttccagggcggttctcattcttacagagcaaaatatgtccgcttatcctatgacactaagccagaggtgatattgcagctgctactcaaagaatggcagatggagctgccaaagctggtcatttcagtacacggcggaatgcagaaatttgagctgcatcccagaattaaacagctcttgggaaagggactaattaaagcagctgttacgacaggcgcatggatattgactggaggagtgaacactggtgttgcaaagcatgttggtgatgcactgaaggaacacgctagtcggtccagccgaaaaatctgcaccatagggatcgccccatggggagttattgagaatcgcaatgacctcgtgggtcgggacgtagttgcgccttaccaaaccctactaaatccgctgtccaagcttaacgttctgaacaacttgcacagccacttcatcctagtggacgacggtactgtcggaaaatatggggctgaagtaaggctgcggcgtgaactggaaaagacaataaaccagcaacgcatacacgcgagaataggccagggtgtgccagtggttgccctcatcttcgaagggggaccaaatgtgatcctgaccgtgctggagtacctgcaggagtcaccgccagtcccggtggtcgtgtgtgaaggtaccggaagagccgcagatttgctggcctatatccacaaacagactgaggagggagggaatttaccggatgcagctgagcctgatatcatttccactatcaaaaaaaccttcaatttcggacagaatgaggctctgcacctgtttcagacactcatggaatgtatgaaaaggaaggaattgataactgttttccacataggatctgacgaacaccaggacattgatgtggccattctcactgccctcttaaaaggaacgaacgctagcgcttttgatcagcttattctaacgctggcttgggatagagttgatatcgccaagaatcacgtcttcgtgtatggccagcagtggctcgtgggttccctggaacaggccatgcttgacgccttggtgatggaccgagttgccttcgtgaaactgctgatagaaaatggagtgagcatgcacaaattcttgactatacctcggctcgaagaactatacaatacaaaacagggacctaccaaccctatgctgttccacctcgtaagggatgtgaaacaggggaacctcccacccggatacaaaattacactgatcgacattggactcgtgatcgagtacctcatggggggaacctataggtgtacgtacaccaggaaacgattccggcttatctacaattccctaggcggtaataatagaagatcagggaggaataccagtagttctacaccacagctcagaaagagccacgagtctttcggcaatagggccgacaagaaggagaagatgagacacaatcacttcattaagacagctcaaccgtataggccaaaaatcgatacagtcatggaagaaggtaagaaaaaaaggactaaggacgaaatcgtggacatcgatgacccagagacaaaaaggttcccctaccccctcaatgagttattaatttgggcatgtctaatgaagcgacaagtgatggcccgtttcctttggcagcatggcgaagagagcatggctaaggccttagttgcttgtaagatctatagaagcatggcttacgaggctaaacagtcagacttggtcgacgacacctcagaggagctcaagcagtactcgaacgactttggacagctggctgtggaactgctcgagcagtcatttcgccaggacgagacgatggccatgaagctgctcacttacgagctgaagaattggtccaactctacctgcctgaagctcgcagtcagctcccgattacgtccatttgtggctcacacgtgtactcagatgttattgagcgatatgtggatgggccgtctaaacatgaggaagaatagctggtataaggtcatcctgtccatccttgttcctcccgctattttgttgttggagtacaagacgaaggccgaaatgagtcacatcccacagtcgcaagatgcccaccagatgacgatggacgattctgaaaacaatttccagaatatcactgaagagatacctatggaggtctttaaggaggttagaatcttggactcaaatgaaggaaagaacgaaatggaaatccagatgaagagtaaaaaactgccaattaccaggaaattctacgcgttttatcatgcacctattgttaaattttggtttaataccctcgcgtacctggggttcctgatgctgtacacctttgttgtgctggtgcagatggagcagttgccgtccgtgcaggagtggatcgtcatagcttacattttcacgtacgcaatagagaaggtccgcgaaatctttatgtccgaagctgggaaggtgaaccagaaaattaaggtatggttctctgactactttaatatatctgataccatcgccattatttcctttttcatcggcttcgggcttcggttcggggcaaagtggaacttcgcaaatgcctacgacaatcatgtattcgtagcaggtcgactgatttattgcttgaatattattttctggtacgtcagactcctcgacttcctggctgtgaaccagcaagcaggaccatacgttatgatgattggcaagatggtggcaaatatgttctacattgtggtgattatggccttagtcctactctcatttggcgtgccgaggaaagctattttatacccccacgaagccccaagttggacactcgcaaaagacattgtcttccatccatactggatgatattcggagaagtctatgcctacgagatcgacgtgtgcgccaatgatagcgtaatcccccagatctgcggcccaggaacctggctgacacccttcttgcaggcggtatacctcttcgtccagtatattatcatggtgaacctactgattgcgttctttaacaacgtttatctacaagtgaaggccatctcaaatatagtatggaaataccagaggtaccacttcatcatggcctatcacgaaaagcctgtcctgcctcccccactcattatcttgtcccatatcgtctcactgttctgctgcatctgtaagaggcgaaagaaagacaaaacgtccgacggaccaaaactgttcctgacagaagaggaccagaaaaaactgcacgactttgaggagcagtgcgtcgaaatgtattttaacgagaaggatgacaaatttcactcagggtccgaagaaaggataagagtgaccttcgagcgagttgagcagatgtgtatccaaatcaaggaagtgggcgatagggtgaattatattaaacgttccctccaaagcctggactcccaaataggacatttgcaggacctgtctgccctgacagtggacacactgaaaaccctgacagcccagaaagcctctgaagcttctaaggtgcacaatgagataacccgagagctcagcatctcaaaacacctggctcaaaacctgattgacgatggacctgtaaggccctctgtgtggaaaaagcacggagttgtgaatacgttgagttcttcactgccacagggtgaccttgaaagcaacaacccctttcactgtaatattctgatgaaggatgataaggatcctcagtgcaacatcttcggccaggacctcccggctgtgccacagaggaaagagtttaattttccagaagctggatcaagctccggggctctgtttcctagtgcagtatctcctccggagctgcgccaacgcctgcatggcgtagaactcctaaaaatcttcaacaagaatcagaagctgggttccagcagtactagcattccacacctgtcgtcaccccctacaaagttctttgtgagcacccccagccagccctcatgcaaaagccacctggaaacagggacaaaggaccaagaaaccgtatgttctaaagccactgagggagataataccgagttcggtgcgttcgttggccatagggactcaatggatctccagcgcttcaaagagacgagcaataagatcaagatcctatcaaataataatacctccgagaacaccttaaagcgcgtgtcctctctcgccggattcaccgactgtcacaggacttctattcctgtgcacagtaagcaggcagaaaagattagccgaaggccttccacggaagatacacatgaggtggacagtaaggcagccctgatcccagattggttacaggataggccctctaatcgggagatgccatcggaggagggcaccctgaacggactaaccagcccgttcaagcccgctatggatacgaattactattattctgctgtagagcgcaataacttgatgcggctgagccagagcattccattcaccccagtaccaccacgcggagagcccgtgaccgtttacaggctggaagaaagctcacctaacatcctcaacaattcaatgtctagttggtcccagctggggctttgcgcaaaaatcgaatttctgagcaaggaggagatgggtgggggactgcgtcgggctgtgaaggtgcaatgcacttggtcagagcacgacattctgaaatccggtcacctgtacatcatcaaaagcttcctgccagaagtagtgaacacctggtcatccatctataaggaagatactgtcctacatttgtgcttgagggaaatccagcagcagcgcgctgcacaaaaacttacattcgcgtttaatcaaatgaagcctaagagcatcccgtatagcccacgcttcctggaagtgttccttctgtattgtcattcggccggtcaatggtttgcggtcgaggaatgtatgacaggcgaatttcgcaagtacaataataacaacggcgacgagataatccccactaatacccttgaagaaatcatgctcgcgttcagtcactggacctacgagtatacccggggagaattgctggtgctagacttacagggtgttggggagaatctgacagatccatcagttatcaaggcggaggaaaaaaggagctgtgacatggtgttcggacctgctaatcttggcgaggatgctattaaaaattttcgcgcaaagcaccattgtaactcatgctgccgcaagttaaagctacctgatctcaagcgcaatgattacactccagacaagattattttccctcaggacgaaccatcagatttaaacctgcagccaggcaacagcacgaaagaatccgaaagcaccaattccgtcagattgatgctctag

SEQ ID NO: 244639 - DNA, 3315 bp, Artificial Sequence
  Description of Artificial Sequence: Synthetic coding sequence
atgagcttcagggctgccaggctgtccatgaggaatcgtaggaatgacaccctcgacagcactcggactctgtattcaagtgcttcacgatctacggatctcagctattcagaaagtgatctggtgaatttcattcaggccaattttaaaaagcgagaatgcgttttttttaccaaggattcgaaggcaacggagaatgtgtgcaaatgcggctatgcgcagtctcagcacatggagggcacccaaatcaaccaaagcgagaagtggaactataagaaacacacgaaagagttcccgaccgatgcttttggagatattcagtttgaaaccttgggcaagaaaggcaagtatatccggctgtcctgcgacaccgacgccgagatcctctacgagttgctgactcagcactggcatcttaaaactccaaatctggtgatttccgtcaccggtggtgctaaaaacttcgccctgaaaccgaggatgcggaagatcttcagccgattgatatacattgcccagtccaaaggagcgtggattctcactgggggtacgcactacgggttaatgaagtacattggggaagtggtccgtgataataccatcagtaggagctccgaagagaacatcgtggccatcggaattgctgcctgggggatggtctcaaaccgagatacattgattcgcaactgcgatgccgaggggtactttctggcccagtaccttatggatgattttacacgcgacccactgtacatcctggataacaaccacacccatctgctgctggtggacaatggttgccacgggcacccaaccgtcgaggcaaagctgagaaaccagttggagaagtacatctctgagagaactattcaagatagtaattatggtggaaagattcctatcgtatgcttcgcacagggaggaggaaaagagaccctgaaagcaatcaatacttctatcaaaaacaaaattccttgtgtggtggtcgaaggatcaggccagattgccgatgtgatcgcttcgctcgttgaagtggaggacgccttgacgagtagcgcagttaaggagaaattggtgcggttcctgcccaggaccgtgtctcggctgcccgaagaagaaacagaaagctggatcaagtggctgaaggagattctcgagtgtagccatttacttaccgtgatcaagatggaggaggcaggtgatgaaatagtgtctaatgcgatctcttacgcactgtataaggctttctccacttcggagcaggacaaggataattggaacggccagctgaaacttctgctggagtggaaccagctggatttggccaatgatgaaatatttacgaacgataggcgctgggagtctgcggaccttcaagaagtaatgttcactgcccttataaaggaccgaccaaaatttgtgcgcttgtttctggagaacggattaaatctccgaaaattccttacacacgacgttctgacagaactgtttagtaatcatttttccaccctcgtttacagaaacctccaaatcgccaagaatagttacaacgatgccctccttacatttgtctggaagctggtcgccaactttagacgtggctttagaaaggaggatcggaatggacgcgacgagatggacatagagcttcacgatgtgagtcctattactcggcaccccttgcaggcactgttcatatgggcaatactgcagaataagaaagagttgtcaaaggtgatctgggaacagacaaggggctgtactttggccgcattaggagcttctaagctcttgaagacacttgcgaaggtgaagaatgatatcaatgcagctggagaatccgaggaactggctaacgaatatgagactcgagccgttgagctttttactgagtgttacagctcagacgaagacctggcagaacagctgctggtctacagctgtgaggcctgggggggttcgaattgcctcgagctggccgtggaggctactgaccaacattttattgcacagcctggggtacagaactttctgagcaaacagtggtatggagaaatctcccgcgacacaaagaattggaagataattctctgtcttttcatcattcctctggtgggatgcggcttcgtctctttccggaaaaagccagtggacaaacacaagaaacttctctggtactacgtggcattcttcacaagtcccttcgtggtattctcctggaacgtggtgttttacatagcattcctgttgcttttcgcttatgtgttactaatggacttccacagtgtgccacaccccccagaactggtattgtattctctggtatttgtgttgttttgcgacgaggtgaggcagtggtacgttaatggggtcaattacttcacagatctgtggaacgtcatggataccctcgggctgttttattttatcgcgggaatcgtgttccgcctccactcatctaacaagtcctctttgtactctggcagagtgattttttgcctcgattacatcatattcacccttcgactcatacatattttcacagtatcccggaatttgggccctaaaataattatgttgcagcggatgctgattgacgttttcttttttctcttccttttcgctgtttggatggtagcgttcggcgttgcacggcagggcatcttgcgtcagaacgagcagaggtggaggtggatttttcgaagcgtaatatacgagccctacctggccatgtttgggcaggtcccctctgatgtcgatgggacaacctatgactttgcccactgtactttcactggcaatgaatccaaacctctgtgtgttgaactcgatgagcacaacttacctcggtttcccgagtggattaccatcccactcgtatgcatctatatgctaagtacaaacatcctactggtcaatctgcttgtggccatgttcggctacactgtggggacggtacaggaaaataacgaccaggtgtggaaatttcagaggtatttcctggttcaagagtactgttcaagacttaatattccattcccatttattgtattcgcctatttctacatggtggttaaaaagtgctttaaatgttgctgcaaggagaagaacatggagtcaagcgtgtgctgtttcaaaaacgaggacaacgaaaccctcgcctgggagggcgttatgaaggagaattacctggttaagatcaatacgaaagcgaatgatacctcagaggagatgcgccatcggttccgccagctggatactaagctgaacgatctcaagggactgctcaaagagatcgccaacaaaatcaaatag

SEQ ID NO: 244640 - DNA, 579 bp, Artificial Sequence
  Description of Artificial Sequence: Synthetic coding sequence
atgaaatcttttttgcccgtgcacactatcgtccttattcgcgaaaatgtctgcaagtgcggatatgcccagagtcaacacatggaaggaacccagatcaatcaatcagagaaatggaactataagaagcataccaaagagttcccaactgacgccttcggcgatattcagttcgaaactctgggcaagaaagggaagtatatacggctgagttgcgatacagatgctgagatcctgtacgagctgctgacccaacactggcacctgaaaacacctaatctggtcatctctgtcaccggtggcgctaagaatttcgctcttaaaccaagaatgagaaagatattctctaggttgatttatatagcgcagtcaaagggcgcttggatcctcacagggggtacccactatggcttaatgaaatatatcggcgaagtcgtgagggacaatacaatctctaggtcttccgaggaaaacattgtcgccattggaattgcggcatggggtatggtcagtaaccgtgatacgctcattaggaactgtgacgccgaggtgcccgtggggcaggaggaagtatgttag

SEQ ID NO: 244641 - DNA, 498 bp, Artificial Sequence
  Description of Artificial Sequence: Synthetic coding sequence
atggagggaacacagattaatcagtcggagaagtggaactataagaagcacactaaggaattccccacagacgcatttggtgacatacagtttgaaacactaggcaagaaagggaaatatatcaggctgtcctgcgacaccgatgctgagatcctttatgaattactcacgcagcactggcatctcaagaccccaaatctcgtaatatcagtgaccggcggagcgaaaaatttcgctctgaagcctcggatgaggaaaatctttagccgtcttatttatattgcacagagcaagggcgcatggattctgactggcggaacccactacgggcttatgaagtacatcggggaagtggtgcgcgataacaccatttcaagatcctctgaagagaatatcgtggccatcggcatcgctgcctggggaatggtgagtaatcgggacaccctgattcgcaattgtgatgcagaagtgccggttggtcaggaagaggtctgttag

SEQ ID NO: 244642 - DNA, 2049 bp, Artificial Sequence
  Description of Artificial Sequence: Synthetic coding sequence
atgcaggcgatcaatacatccatcaagaacaagattccatgcgttgtagttgagggctccggacaaatcgccgatgtgatcgcctcactagtagaggtagaggacgctctgacctccagcgcagtgaaggagaagctcgtgagattcctgcctcgcaccgtctccagattgccagaggaagagaccgagtcctggattaagtggctcaaagagatcttagaatgtagccatttactcaccgtgatcaaaatggaagaggcgggagatgagatcgtgagcaacgcaatatcgtatgcgctgtataaagccttctctacatcagagcaggataaggacaactggaacggacagttgaagttgcttttggagtggaaccagctagacttagcaaatgatgagattttcacaaacgatcggaggtgggagagcgccgaccttcaggaggtcatgttcaccgccctaatcaaggaccggcctaaatttgttcgtctgttcctggagaatggcctaaatctccgcaaatttcttacacacgacgtgcttacagaattgttcagtaatcacttcagcacccttgtgtaccggaacttgcaaatcgctaagaatagctataatgacgcgctcctcacctttgtctggaagctggtggccaattttaggcgagggttcagaaaggaagatcgcaatgggagagacgagatggacatcgaactgcacgatgtgtctccaatcacacggcacccgcttcaagctctgtttatttgggcaattttgcaaaacaagaaagagctttctaaggtgatttgggagcaaacacggggttgcacattagctgcactcggagcaagtaagctcctaaagacccttgcgaaggtaaaaaacgacattaacgcagcaggagaatcagaggagctcgccaatgagtacgagacgagagctgtcgaactgtttactgaatgttatagtagcgatgaggatctcgcagaacagttgttggtttattcctgcgaggcatggggtggctccaactgccttgagctggcggttgaagccacggaccagcactttatcgctcagccgggagtacagtggtacgtcaatggcgtgaactattttactgatctctggaatgtgatggacacattaggacttttctattttatcgccggtattgtatttcgcctccatagctctaataagtcatcactctatagtggcagggtaattttttgcctcgattacattattttcaccctgagattgatacacatttttacagttagccgaaacttgggcccaaagattattatgctgcagcgcatgctgatagacgtgtttttctttttgtttctcttcgccgtgtggatggtggcctttggcgtcgcacggcagggtattttgagacaaaacgagcaaagatggaggtggatctttagaagcgtgatctatgagccctaccttgccatgttcggccaggtcccaagcgatgtggatggtactacctacgatttcgcacactgtacttttactggaaatgaaagcaaacctttgtgtgtggagctcgacgaacataacctgccccgtttccccgagtggattacaatacctctggtctgtatttatatgctctccacaaacatactattggtgaatctcctggtcgctatgtttggatacaccgtgggaaccgttcaggagaacaatgatcaggtgtggaaattccagaggtacttcctggtgcaggaatattgctcacgacttaacattccttttccattcattgtctttgcttatttttacatggttgtgaaaaaatgttttaagtgttgttgcaaggaaaagaatatggagtctagtgtgtgttgttttaagaacgaagataacgagacactcgcctgggaaggagttatgaaagagaactatcttgtgaagattaatacaaaagctaacgatactagcgaggagatgaggcaccgctttaggcagctcgacacaaagctgaacgatctgaaggggctgttgaaggagatcgccaataagattaagtag

SEQ ID NO: 244643 - DNA, 2514 bp, Artificial Sequence
  Description of Artificial Sequence: Synthetic coding sequence
atggagacactgactccaggacaccttcagccatcaccctctagtcccagacctcgagccgcaccaggctccctaggcagggttacacgtaggcgtctgagtaggtggatagctcttactaggaaagtgtcctggacccctgctaggcctagtcagagcgccctgctctctccatccagaggccaggaaactgctcccccagtgccgggatgttgtccccgaacactgtcacctccagcccctaggcgcccatcaggttcaatgatcgccggagtgtccctgaaaccactgctccgcattactgctcgtatttggcgagcctgctgtagctcatgtcgcagggctaggtccacctcacagactacttcatcaaaagtggcgcctgcacttggttcggggagggccccagcacttgcctgcccggatccaccgctttgcctaagcgaccctgaaactgggaagacttgtctgttgaaagctatgctcaacttacatgacggacagaatactactatcccgctcttgttggaaattgccaggcagactgactccctcaaggaacttgtgaacgcctcgtatactgacagttactacaagggtcagactgccctccatattgctattgaacggagaaacatggccttggttactctgttggtcgagaacggtgctgatgtccaggccgctgctcatggcgatttctttaaaaaaactaaaggtcgtccaggcttctacttcggggagctgccactcagtctggctgcctgcacgaaccagctcggaatcgtcaaattcctcctccagaactcctggcagacagccgacatcagtgcgagggactcagtgggaaataccgtcttgcacgcactcgtggaggtcgctgacaatactgcagacaacaccaaattcgtcacctcaatgtacaatgagatcctcatgttaggtgccaaactacatccgactctaaagctggaagaactcacaaataagaagggcatgaccccattggccctagccgctgggaccggaaaaataggcgtcttggcctatatactgcaacgagaaatccaggagcctgaatgtagacacctctctcgcaagttcaccgagtgggcttatgggcctgtgcatagctccctgtacgacctatcgtgcatagatacgtgtgaaaaaaattcggtactggaggtgatcgcctactcttcttctgagacccccaatcgacatgacatgctgctagtggaacccctaaatagactcctccaggacaagtgggatagatttgtgaagcgtatcttttatttcaacttccttgtgtattgcctctatatgatcatattcactatggcggcatactatagaccagtggatgggctgccacctttcaaaatggaaaagactggtgactatttccgggtgactggtgagattctgtctgttctcggaggcgtgtatttcttttttagagggatccagtattttcttcagagacggcctagcatgaagactctgttcgttgactcatatagcgagatgcttttttttctgcagtctctctttatgctggccaccgtggtgctctacttctcccacctgaaagaatacgtggctagtatggttttctctttagctctgggctggacaaacatgttatattacaccaggggcttccagcagatggggatctatgcagtcatgatcgagaaaatgatcctaagggacctttgccggtttatgttcgtttatatcgtgttcctctttggcttcagcacagctgtggtgaccctcatcgaagacgggaagaacgactcactgcctagcgaaagcacttctcaccgatggcgtggccctgcttgtcggcctccggacagctcttacaactctctgtactccacctgcctagagctgttcaaatttaccattggcatgggcgatctggaatttactgaaaattatgatttcaaagcggttttcatcatcctgctcctcgcgtatgtaatcctaacgtatatactgctgttgaatatgttgattgccttaatgggtgagacagtgaataagatcgcccaggagagtaaaaatatctggaagttacagcgcgcaattacgatccttgacactgagaaatcctttctcaagtgcatgcgcaaggcttttcgcagcggtaagttactgcaggtcggttatactccagatggtaaggatgattacagatggtgcttcagagtcgatgaggtaaattggaccacctggaacaccaacgtggggatcattaatgaagacccaggcaactgcgagggcgttaaaagaacattgtctttttctttgcggagcagccgggtcagcgggcgacactggaaaaatttcgctcttgttccactgttgagagaggcttcagctcgggaccgccagagtgcgcagcccgaggaggtgtacttgcgccagttcagtggaagcctgaagccagaagatgcggaggtgtttaaaagcccagcagcgtccggcgaaaagtag

SEQ ID NO: 244644 - DNA, 2340 bp, Artificial Sequence
  Description of Artificial Sequence: Synthetic coding sequence
atgaagaaatggtcctcaaccgacctgggcgctgccgctgaccccttgcagaaagacacttgccctgacccattggatggggacccgaactccaggccacccccagcaaaaccccagcttagcaccgccaaaagccgcactagactgttcggaaagggcgacagcgaagaggcgtttcctgtggactgtcctcacgaagaaggggagctcgatagctgtccaactatcaccgtgagccccgtgataacaatccagaggcctggcgatggacccaccggcgcacgcctcctgagtcaggactctgtcgccgctagtacagaaaaaaccttgaggctctacgataggcgttcaatctttgaagctgtggcccagaacaattgtcaggatctagaaagtttgctgctgtttctccagaaatccaagaagcatctgaccgacaacgagtttaaggatcctgagaccggaaagacatgtctcctgaaagctatgcttaatcttcatgatggtcagaataccacaatccccctgcttcttgaaattgccaggcagaccgattccctcaaagagctggtcaacgcctcctatactgatagctattataagggacagaccgccctgcatattgccatcgaacgccgtaatatggccctggtcactttactcgtggaaaacggagctgacgtccaggctgcagcacacggagatttcttcaagaagacgaaaggaagacctggattctatttcggcgagttgcctctgtctttagctgcctgcactaaccagctgggtattgtgaagttccttctgcagaactcttggcaaactgccgacatctccgcaagggattctgtaggaaatacggtccttcacgcactggtcgaagtcgctgacaatacagccgacaacaccaagtttgtgacctcaatgtacaatgaaatcttaatgctcggtgctaaattacacccaacccttaagttagaggaacttacgaacaaaaaggggatgacccccttagcactggctgctggtacgggaaagatcgggaatcggcacgacatgctcctggtggagccgctgaataggctcctgcaggacaagtgggaccgttttgtcaaacgcatattttattttaatttcctggtctactgtctttacatgatcatctttacaatggcggcatactatcgccctgtggatggcctgcccccttttaaaatggaaaagaccggagactactttagagttactggcgagattctctccgtgctcgggggagtgtatttttttttcagggggatccagtatttcctgcagcggaggccatcgatgaaaaccttgtttgtagacagctattccgaaatgctcttttttcttcagtcccttttcatgctcgccacagtcgtgctctactttagtcatcttaaggagtacgtggcctccatggtttttagcctggctctgggatggacgaatatgctgtattatacccgcggatttcagcagatgggtatatacgccgtgatgatcgaaaagatgatactccgcgatctgtgcaggttcatgttcgtgtacatagtgtttttatttggcttctccacagctgtggtaaccctcattgaggatggcaagaacgatagtctcccaagcgaatcaacatctcataggtggagggggcctgcatgtcggcctcccgatagcagctataacagtctgtatagtacatgcctagagcttttcaaattcaccatcgggatgggggatctggaatttacggagaattatgacttcaaggctgtgttcattatactgctcctggcctatgtcatcttgacatatatactgcttttgaatatgcttattgcgctgatgggagagacggtcaacaagattgcacaggaaagcaaaaacatctggaaattacagcgcgctataacgatcctggacactgaaaaatccttcttgaagtgtatgaggaaggccttccgatctggcaaactactgcaggtcgggtacacccccgacggaaaggatgactacaggtggtgcttccgtgtggacgaagtgaactggaccacttggaacactaatgtggggattataaatgaagaccctggtaactgtgaaggcgtcaagagaaccctttcgtttagtctacgttcctccagggtgtcgggtagacactggaaaaattttgcattagtacccctcctccgggaggcttccgccagagatcgtcagagcgcacaaccggaggaagtgtatctgaggcaatttagcggctctttaaaacctgaggacgcagaggttttcaagagcccagcggcatcaggcgaaaagtag

SEQ ID NO: 244645 - DNA, 2520 bp, Artificial Sequence
  Description of Artificial Sequence: Synthetic coding sequence
atgaaaaagtggagttccactgatctaggcgcagcggcagatcctctccagaaggacacttgcccagacccgctcgacggagatccaaacagcaggcctcctcccgctaaacctcagctgtccacggccaagtccaggaccaggctattcgggaagggcgacagcgaagaagccttcccagtggattgcccccatgaggaaggggaattagattcgtgtcccacaattacggttagtcctgtcattaccattcagaggcctggtgatggccctacaggagcaagattgctcagccaggattccgtcgcagcgagtacggagaaaaccctgcgattgtatgatcgcaggtccatctttgaggccgtcgctcagaataattgtcaggacctggaatccctcctccttttcctgcagaaaagtaagaagcacctcacagacaatgagtttaaggatccagagaccggcaagacttgcctgcttaaagcaatgctcaaccttcatgatggtcagaatactacgatcccattgctgctggagatcgccaggcagactgattccctcaaggaactcgtgaatgctagttatactgactcttattataaaggccagacagccctccatatagcgattgaacgtcgtaacatggcattagtgactttactcgtggagaatggcgcagatgttcaggccgcagcacacggagatttcttcaaaaagacaaaaggacggcctggattttattttggtgagcttccactctcattagcagcttgcaccaaccagctgggcatcgtcaagttcttattacagaatagttggcagaccgctgacatttccgcgcgagacagcgtggggaacacagttctccacgcccttgtagaagtggctgacaatacagccgacaacacgaaattcgttacctccatgtacaacgagatcctcatgctgggagctaagctccatcccaccctgaaactggaagaactgactaataagaagggcatgaccccgctcgcactggcagctggaacaggcaagatcggtgtgctggcctacatccttcagagagagattcaggagcccgagtgtcggcacttaagcaggaaattcactgagtgggcatatggtccagtccactcctctctttacgatttgagttgtatcgacacatgcgaaaaaaattcagtactggaggtgatcgcatacagctcctccgaaacccctaataggcatgacatgctgttggtagaaccacttaatagactgctccaagataagtgggataggttcgtgaagcggattttctactttaacttcctggtttactgtctctatatgatcatctttacaatggccgcttactatcgccctgtggatgggctgccacccttcaagatggaaaaaaccggcgattacttccgcgtcacaggggaaatcctgtcagtgctcgggggtgtgtacttctttttcaggggaattcaatatttcctccagcgcagaccttcgatgaagaccctgtttgtggactcctattcagaaatgctcttcttcctgcagtccttgtttatgctggcaactgtagtgctgtatttttcgcacctcaaagagtatgtcgccagcatggtctttagcctcgccttgggatggaccaacatgttgtattacacccgaggatttcaacagatgggaatttacgccgtaatgattgagaagatgattctcagggacttatgtcgctttatgttcgtgtacatcgtctttctgtttgggtttagcacagccgtagtaacgctgattgaagacggcaaaaatgacagtctccccagtgagagcacatcacatagatggagaggaccggcatgccgtccaccagatagctcttataatagcttgtacagtacatgcttagagctttttaagttcacaatcggcatgggtgacctggagtttacagaaaactacgacttcaaagctgtgtttataatcttgttattagcatacgtgatcctcacttatatactcctcctcaatatgctcattgctttgatgggagaaacagtgaataagatcgcccaagaatccaagaacatatggaaattgcagagggcgatcacaatcctggataccgaaaaatctttcctgaaatgcatgaggaaggcttttaggtccgggaagctcctccaggttgggtacacccctgatggcaaggacgactacagatggtgcttcagggtggacgaggtcaattggacgacttggaataccaatgtcggaattattaacgaggatccaggtaattgcgagggagtaaagcgcactctttcattctccctccgttcgtctcgcgtgagtggacgtcactggaagaacttcgcccttgtcccacttctgagggaagctagcgccagagacagacaatccgctcagccagaggaggtgtatttacgtcagttttcaggcagtctgaaacctgaagatgccgaagtgttcaagtcccctgctgcctccggggaaaagtag

SEQ ID NO: 244646 - DNA, 2520 bp, Artificial Sequence
  Description of Artificial Sequence: Synthetic coding sequence
atgaagaagtggagttccacagatttaggggcagccgcagatcctcttcagaaggacacctgccccgaccctctggatggcgatccaaactctcgacctcctccggcaaagcctcagctttcaacagcgaagtctcgaacccgtctgttcggcaagggagattcagaggaggctttcccggtcgactgcccgcacgaggaaggagagttagatagttgcccaacgatcacagtgtcccctgtcatcacaattcagaggccaggggacgggcctactggcgcacgcttgcttagccaggactctgtggcggctagcacagagaaaacactcaggctgtacgatcgacgatccatcttcgaagccgtcgctcagaacaactgtcaggacctagaatctctactgctgtttctgcagaaatccaagaagcaccttacagacaacgaattcaaagacccagagaccggaaagacctgtctgctgaaagctatgctgaacctccacgatgggcagaacacaacgatacccttgctgctggaaatcgcacgacaaacagactcgctgaaggaactggtgaacgctagctacacagactcatactacaaggggcagaccgccctgcatatcgcaattgaaagacgaaatatggccttagtcaccttactggttgaaaatggcgctgatgtccaggccgcagctcacggcgatttctttaagaagaccaaaggaagaccgggtttctattttggtgagctccctttaagccttgcggcatgtactaaccagttaggcattgtgaaatttctgctgcagaactcctggcagacggctgacatttctgccagagatagcgtggggaatactgttctccatgccctcgtggaggtggcagacaacaccgccgataatactaagtttgtgacatcaatgtataatgagattctgatgctgggcgctaagctgcacccgaccttgaaacttgaagaattaactaataagaagggcatgacgcccttagctctagccgctgggaccgggaagattggtgtccttgcctacatcctgcagagagagatccaagagccagaatgtcgtcatctatcgaggaaatttaccgaatgggcctacggccctgtccactctagcctgtacgacttatcatgcattgatacctgtgaaaagaattcagtgctcgaggttatcgcctattcctcttcagagacccccaataggcacgacatgctgcttgtcgaaccgctgaatcgactgctgcaggataaatgggataggtttgtaaagagaatcttctatttcaactttcttgtatactgcctgtatatgatcattttcacaatggccgcttattaccgcccagtcgatgggctgcccccattcaagatggagaaaacgggcgattactttagggtaacaggtgagatcctcagcgtcctgggtggtgtgtatttcttcttccgcggaatccaatatttcctgcagaggcgaccttcaatgaagaccctcttcgtcgatagttactcagaaatgctgttcttcctgcagagcctgtttatgctggccacggtggtgctatatttctcccacttgaaggagtatgttgcctcaatggtcttcagccttgccctcggatggaccaatatgctgtattacactagagggttccagcagatgggtatctacgctgtaatgatagaaaagatgatcctccgagatctctgccgcttcatgttcgtctatatcgtgttcctttttggcttctcgactgctgtggtaacgctcatagaggacggcaaaaatgactctctgccatccgagtctactagtcacagatggcgcggaccagcctgtagaccacctgacagctcctataattccctgtattctacctgtctggagctttttaaattcaccatcggaatgggagatcttgagttcaccgagaattatgattttaaagccgtattcatcatcctgctgctggcttatgttattctcacttatatcctgctgttaaatatgctcattgccctgatgggggagacagtgaacaagatcgctcaggagagcaagaacatctggaaacttcagagggccattacaattctcgacactgagaagtccttcctgaagtgcatgagaaaggcttttagaagcggaaaactcttacaggtgggctatacccctgacggcaaggatgattatcgatggtgtttccgagttgatgaggtgaattggacaacttggaataccaatgtggggatcatcaacgaagaccctgggaattgtgagggcgttaagcgcacactcagcttcagcctccgatcttctcgggtgtctggcaggcattggaagaactttgccctggtgcctcttctccgcgaggcctccgccagggacagacagtccgcacagcccgaagaagtctacttgcggcagttcagcggatctctgaaaccagaggatgccgaggttttcaagtcacctgcagcttctggcgagaaatag

SEQ ID NO: 244647 - DNA, 2553 bp, Artificial Sequence
  Description of Artificial Sequence: Synthetic coding sequence
atgaagaagtggtcttcgaccgacctgggggctgccgcagaccctttacagaaggatacgtgcccagacccattggatggcgatccaaacagtagacctccccctgccaagccccagctgtcgacggccaaatcccggactcggctcttcggcaagggcgactccgaagaagccttccccgtggactgccctcacgaggaaggggagttggactcttgtccgactatcaccgtgtccccggtgatcacgatccaacgacctggtgacgggccaacaggcgctcgtcttcttagccaagattccgtggccgctagcacggaaaagacgttaagactatatgatagacgaagcatcttcgaggcagtcgcgcagaacaactgtcaggatctggaatctcttctgctcttcctgcagaaaagcaaaaaacatctgacagataatgaattcaaggacccggaaacaggtaagacctgcctgctaaaagccatgctcaatcttcacgatggccagaatacaaccatacctttgcttctggagatcgctaggcagactgactctctaaaggagctcgtaaatgcctcatataccgattcttattacaaggggcagaccgcattacacattgcgattgagcgcaggaacatggccttggtcaccctactcgtggagaatggcgctgatgtgcaagccgctgcacacggagatttttttaagaagacaaaaggccgtccaggtttttattttggcgagctacctttgagcctcgccgcttgcacgaatcagctcgggatcgtgaaatttttgctgcaaaattcctggcagaccgccgatatcagcgcacgcgattccgtgggcaatactgtcctgcatgccctggtggaagtggcggacaatactgccgataacaccaaatttgtgacttcaatgtataacgagatcttaatgttgggtgccaagctgcatccgaccctgaaactcgaggaattaaccaataaaaaaggtatgacacccttagccctggcggcaggcaccggaaagataggtgttattgaaaacggtccacctctcagttttatggttctggcctatatcctacagcgagaaatccaggagcccgagtgcaggcatctttccagaaagtttaccgaatgggcttacgggcctgtccattcctccctgtacgacctgtcttgtatcgacacctgcgagaaaaattctgtgctggaggtgatcgcatactcaagctcggaaacacctaacagacatgatatgctgctggttgagccactaaaccggttgttgcaggacaagtgggaccgctttgtaaaaagaattttttatttcaactttctggtgtattgtctctacatgatcatctttaccatggcggcatactaccggccagtggacggcctgccgccttttaaaatggagaaaaccggcgactacttccgcgtaacaggcgagattcttagcgtcctgggcggagtgtactttttcttccgcggtatccagtatttcctgcagcggcgtccctctatgaagaccctgtttgtggacagctacagcgaaatgctcttttttcttcagagcctgttcatgctggcaacagtggtactctattttagtcaccttaaggaatacgttgcgagcatggttttctcgttagccctagggtggacaaatatgttgtattacaccagggggttccagcagatgggtatttacgccgttatgattgagaagatgatcctgagggacctctgtcgcttcatgttcgtgtacattgtgtttctgttcggtttttctacggctgtcgtcacacttattgaagacggcaagaatgacagtttgccttccgagagcaccagtcacagatggcgcggacctgcgtgtaggcctcctgattctagttataactccttatacagcacttgccttgaactgttcaaattcaccatcggaatgggcgatttagaattcacagagaactatgattttaaggctgtgtttatcatactcctgctggcctatgtgatactgacctatatcctcctgctcaacatgctcatcgcattaatgggggagaccgttaacaagatagcgcaggaatctaaaaacatatggaagctccagcgcgctatcaccatcttagacacggaaaagtcctttctgaagtgtatgcggaaagctttcaggagtggcaaactgttgcaggtgggctatacacccgatggaaaggatgactacagatggtgtttccgggtggacgaggtgaactggacaacatggaatacaaacgttggcatcatcaatgaggatcctggtaactgcgagggcgtcaaacgcaccctctccttttcccttcggagttccagggtgtctggtagacactggaaaaattttgccctcgtgcctctccttcgcgaagcttcggcgagggacaggcaaagcgcgcagccagaggaagtgtacctgagacaattctcaggatccctcaagccagaagatgccgaagtgtttaagtcgcctgcagcatcaggggaaaagtag

SEQ ID NO: 244648 - DNA, 2295 bp, Artificial Sequence
  Description of Artificial Sequence: Synthetic coding sequence
atgacatctcccagctcctccccagtgttcaggctggagactctggatgggggacaggaggatgggagcgaggccgaccgcggtaagctcgatttcggcagtggcctgcctccaatggagagtcagtttcagggagaagatcgcaagtttgctccgcagataagagttaatctcaattaccgcaaaggtaccggggcttcacagccagacccaaatcggttcgatagggatcggttgtttaacgcggtgtccagaggggttccagaggacttggctggtttacctgaatacctgagtaaaacaagcaagtaccttactgattcagaatatacggaggggtctacaggtaagacctgtctgatgaaagcagtgcttaatctgaaagacggagtgaacgcctgcattttacccctgcttcagattgatagagacagtggaaacccacagcccttggtcaatgcccaatgtaccgatgattactacagaggtcactccgccctccacatcgccatcgaaaaaaggagcttgcaatgcgttaaacttctcgtggagaatggcgcaaatgttcacgcaagggcatgtggcaggtttttccagaaaggtcaaggcacctgtttctacttcggagaattgccactcagcctggctgcctgcacgaaacaatgggacgtagtgagttacctcctggagaatccacatcagcccgcaagcttacaggccacggacagtcaggggaataccgtccttcatgcgctcgtgatgatatcggataattccgcagagaacatcgccctggtcacaagcatgtacgatgggctcctgcaggccggagctaggctgtgccccaccgtccagctggaagacatacgcaacctgcaggatttaacaccactgaagctagcagctaaagaaggaaagatcgagatattccgccacattcttcagcgggagttttctggcctgtcacacctgtcaaggaaattcactgagtggtgttacggacctgtccgcgtctcactctacgacctggcctctgtggattcctgcgaagaaaattcagtgctcgagatcatcgcctttcattgcaaatctccccatcgccatcgtatggtcgtcctagaacctctgaataagctacttcaagcaaagtgggatctgctgattcccaaattctttttaaatttcttatgcaaccttatctatatgttcatattcactgctgtcgcctatcatcagccaactctaaaaaagcaagctgcaccccaccttaaagccgaggtgggcaacagcatgctgctcacggggcatatcctgatcctgctgggtgggatttacttgctggtgggtcagctgtggtacttctggcgacgccacgtgttcatttggatctcattcatagactcctactttgaaatattatttctgttccaggcactcttgacagtagtttcccaggtgctctgcttcctggccattgagtggtacctgcctctgctggtaagtgcccttgtattaggctggttgaacctcttgtactacaccagaggattccaacatacagggatatatagtgtgatgatccaaaaagtcatcctgcgagacctcctgagatttttgcttatctatcttgtattcttgttcggcttcgctgtggctctggtcagtctgagccaagaggcgtggaggccagaggctcctacaggtcctaacgccactgagtctgtacagccgatggagggacaagaagatgaaggcaatggcgctcagtatcgcggaatattggaggcatctctggaactgttcaagttcactataggaatgggtgagcttgccttccaggagcagctgcacttccgaggaatggttctcttactccttctcgcttatgtgctgctcacgtatatactgctgctcaatatgctcatcgccctcatgagcgagacagttaacagcgtcgctactgacagctggtctatatggaagctccaaaaggctatcagcgtcctcgaaatggaaaacgggtattggtggtgccggaaaaagcaaagggccggtgtgatgttgactgtgggtacaaagcccgatggaagtccagatgagcggtggtgcttcagggtagaagaagtgaactgggcgagctgggaacagactctgccaactctgtgcgaggatcccagtggtgccggagtccctagaactcttgaaaatcccgtcctcgccagtcctccgaaagaggatgaagatggcgcttcagaagagaactacgtgccagtgcagctgcttcagtccaattag

SEQ ID NO: 244649 - DNA, 801 bp, Artificial Sequence
  Description of Artificial Sequence: Synthetic coding sequence
tgagattttagcctcggagtgccctcttggtggtgcctaatctgcttcaacattgggccttccgtcgggccatcgcagccagaccccaacagattcgaccgcgacaggctatttaacgccgtctccaggggggtccccgaagacttagctggattgcctgagtacctgtctaagacttccaaatatcttacggattctgaatatacggagggtagcacaggcaaaacctgtctgatgaaggcggttctgaatctgaaggacggggtcaacgcctgcatcttgccactgctgcagattgaccgcgattctggtaatccccagcccctggtcaatgcccagtgtaccgatgattattataggggtcactctgccctccacattgcaatagaaaagcgttccttgcagtgcgttaagttactggttgaaaacggcgcaaatgtccacgccagagcctgtggacgatttttccagaaagggcagggcacttgtttctatttcggcgagttgccactttcactcgccgcttgtacaaagcagtgggatgtggtcagttacctgctggaaaaccctcatcaacccgcatctctgcaggctacggacagccagggtaatactgtgttgcacgcgcttgtcatgatcagtgacaacagcgcagaaaatatcgcactcgtcaccagcatgtacgatggactcctgcaggcaggagcaagactctgccctaccgtgcagcttgaggatattagaaacttacaggatctgacaccgctcaagcttgccgcaaaagaggggaagattgagtag

SEQ ID NO: 244650 - DNA, 2373 bp, Artificial Sequence
  Description of Artificial Sequence: Synthetic coding sequence
atgaaagctcaccccaaagaaatggtacccttgatggggaagcgtgttgcagcaccatccggcaacccagcaatcctgccagagaaaaggccagccgagattacaccgaccaagaaatccgcccacttcttcctggagatcgaaggatttgagcccaaccctacagtggctaaaaccagcccccctgttttttccaagcccatggattctaacatccgacagtgtatttcaggcaattgtgatgatatggattctccgcaatcacctcaagacgatgtcaccgagacgcctagtaacccgaatagcccctcagctcagctcgccaaggaggagcagcgccgaaagaaacggcgactgaagaagcggattttcgccgctgtttctgaaggctgtgtcgaagaattggtggaattactcgttgaattgcaagagctgtgcagaaggcggcacgatgaggacgtgccggacttcttgatgcataaattaactgcaagcgacacagggaaaacatgtttgatgaaggcccttcttaacattaatcctaataccaaggagattgtgcgcatcttgttggcctttgctgaagagaatgatatactcggcaggtttatcaacgcagaatatacagaggaggcgtatgaaggccagactgcccttaacattgccattgagcggaggcagggcgacatcgctgctctgctcatcgccgcaggagctgacgtgaatgctcacgctaagggcgcattttttaacccgaagtaccaacacgagggtttctactttggcgagacccccctggctctggctgcttgtaccaatcaacctgaaatcgtgcagctgctcatggaacatgagcaaactgatattaccagtagggactcacgaggcaacaacatcctgcatgcgctggtgacagtcgctgaggacttcaagacgcagaacgattttgtgaagcgtatgtatgatatgatccttctacggtccggcaactgggagctggagaccacccgtaacaatgatggcctcacccccctgcagctggctgccaagatgggaaaagcggagattctgaagtacatactgtctagagaaatcaaggagaagcgcctacgcagcctgtcccgcaaatttacggactgggcctatgggccagtgtccagctccctatatgatttgacgaacgttgataccacaactgataattctgtgctagagatcaccgtgtacaacactaacatcgacaatcggcacgagatgctgacactggagcctttgcatacattgctgcacatgaaatggaagaaatttgccaaacacatgttcttcttgtccttctgcttttattttttttataatataacgctgactttagtgtcctactaccgacctagggaggaggaggccatacctcatcctctcgctttaacgcataaaatgggttggttacagctgctcgggagaatgtttgtgcttatctgggcgatgtgcatttccgtgaaagaagggatcgcgatcttcctcttgcgacccagcgacctccaatctatcttaagcgacgcctggttccacttcgttttcttcatccaggccgtccttgttattctgtcagtcttcctatacctttttgcatacaaagagtatctagcttgcctcgtcttggcaatggccctgggttgggcaaacatgttgtattacaccagaggattccagtctatgggtatgtacagtgtcatgatccagaaggtcatactgcatgacgtgcttaaatttctgttcgtgtacatagtcttcctcctcggtttcggggtggccctggcaagcttgattgagaagtgccctaaagataataaagattgcagctcctacggctctttttcggacgcagtgctcgagctttttaaactgaccatcggcctaggagacctcaacatccagcagaatagcaagtaccctattctgttcctgttcttgttaataacatatgtgatcctcaccttcgtcctgttgctgaatatgctgattgccctcatgggagaaacggtcgagaatgtgagcaaagagtctgagagaatctggaggctgcagcgagccaggacaatcctcgagttcgaaaagatgctgcctgagtggctgcggagtcgcttcagaatgggtgagctgtgcaaggttgccgaggatgatttccggctctgtcttaggatcaacgaggtcaagtggactgaatggaaaacacatgtttctttcctgaacgaggaccctggccctgtgcgcagaaccgatttcaacaagatccaggatagtagcaggaacaattcaaagaccacactcaatgcctttgaggaggtagaagaatttccagagacctctgtctag

SEQ ID NO: 244651 - DNA, 2376 bp, Artificial Sequence
  Description of Artificial Sequence: Synthetic coding sequence
atgaaggcgcaccccaaagagatggttcccctgatggggaagcgggtggccgctcctagtgggaatccagcaatcctcccagaaaagagaccagcagagatcacaccaactaagaaatccgctcacttcttcctggagattgagggatttgaacccaacccaaccgttgctaaaacctctccccctgtattcagtaaacctatggattccaacatccgccaatgcatcagtggtaactgcgatgatatggatagtccgcaaagccctcaggatgatgtgacagagacacctagtaacccaaattctcccagtgcccagctggcaaaagaggagcaacgccgaaaaaagaggagactgaaaaaacggatattcgccgctgtttctgagggttgcgtggaagaactggtcgaactgctggtggaactccaggagctgtgtcggcgacgtcatgatgaagatgtccccgacttcttgatgcacaagctcaccgcatcagacaccggaaaaacatgtcttatgaaggcactgttgaatatcaatcccaataccaaggagatagtgagaatccttctcgcatttgccgaggagaacgacatacttggcaggttcattaacgcggagtacaccgaagaggcttatgaaggtcagaccgcactgaatatagctattgaaagaagacagggcgatatcgcagccctcctgatcgctgccggtgccgacgtgaatgcgcacgccaagggggctttcttcaacccaaaataccagcatgagggcttctattttggagaaacccctttagcgctggctgcttgtactaatcaacctgaaatagtgcagctgttgatggagcacgaacagaccgacatcactagccgcgactcccggggtaacaacatcttgcacgctcttgttacggttgcagaagacttcaaaacacaaaacgacttcgtaaagaggatgtacgatatgattcttctgcgcagtggcaactgggaattagagactacacgaaacaacgatggtctaacacccttgcagctcgctgcaaagatggggaaagccgaaatcctgaagtacatcttgtccagggaaatcaaggaaaaacgtttgcgcagcctgtctcgaaagttcacagactgggcttacggcccagtgagctcaagcctctatgacctaactaatgtggatacgacaaccgataactccgtccttgagatcacggtttacaacacaaacatcgataaccgtcacgaaatgctgaccctggagcccttgcataccttgttgcacatgaagtggaagaaattcgcaaagcacatgttttttctgagtttctgtttttacttcttctacaacataacactgactctagtcagctattaccgcccacgtgaagaggaggctatcccccatcctcttgccctcacccacaagatgggctggttgcagctcttggggagaatgtttgtcctgatttgggcaatgtgcatctctgtcaaggaagggattgcgattttcctgctccgaccttccgacttgcagagcattctgtcggatgcctggtttcatttcgtcttctttatccaagctgtactggtcattcttagtgtgttcctgtatctcttcgcctataaagagtacttagcatgcctggtgttagccatggcgctgggatgggcgaacatgctttactacacacgcggtttccagtctatggggatgtatagcgtcatgatccagaaagttatcttgcatgacgtgttaaagttcttgttcgtttacatcgtctttctcttgggattcggggtggcgctggcatcactgatcgagaaatgtcccaaagataacaaagattgctcaagctatggcagtttctcggacgcagtgttggaacttttcaaactcactattggactgggagaccttaatatacagcagaactcaaagtatcctatcctatttttatttttactgattacatacgtcattctgacttttgtgttgctgctgaacatgctgatagctttaatgggagagacagtggaaaatgtgtccaaggagagcgaaaggatttggagactgcaaagagcgaggactatccttgaattcgaaaagatgctgcctgagtggctgcgttctcgatttcgcatgggggaactgtgcaaagttgccgaggatgactttcggctgtgtcttcgaatcaatgaggtcaaatggactgaatggaagacacatgtgtcctttcttaatgaagacccgggacctgtgcgcagaactgcagacttcaataaaattcaggattcaagccgcaataactccaaaacaacgctgaacgccttcgaagaggtggaggaatttccagaaacatcagtctag

SEQ ID NO: 244652 - DNA, 2328 bp, Artificial Sequence
  Description of Artificial Sequence: Synthetic coding sequence
atgtcccaccatacctggcctagccctgcgttgaatcttgactttgctacatacctgctccgggacttaggagcacactttttcctggagatcgagggatttgagccaaatcctacagtggcaaagacttctccccctgtgttcagtaagccgatggattccaatatccggcagtgtatcagcgggaattgtgacgacatggatagtcctcagtcaccccaggatgacgtgaccgaaaccccctcgaacccaaattccccttccgctcagctggcaaaagaggagcagaggcgtaagaaacgcaggctgaagaaacgcatttttgcagctgttagtgaaggttgcgtggaagaactggtcgaactgctcgtcgagcttcaggaactctgtaggcggcgacacgatgaagacgtgccagactttcttatgcacaaactaacggcctctgatacagggaagacgtgcctgatgaaagcattgctcaacattaatccaaacactaaagagattgtccggatcctgctggccttcgcggaagaaaacgatattcttggacggttcatcaacgccgagtacacagaggaagcctacgaaggacaaaccgctctgaatattgctatagagcgacgccagggggatattgctgctctgctcattgcagccggagccgacgtcaacgcccacgccaagggggcatttttcaatcctaagtatcaacacgagggattctattttggggaaactccccttgcgcttgcggcatgtacaaaccaacccgagatcgtacagcttctcatggaacacgagcagactgacatcacaagccgcgactccagaggcaacaacatcctgcacgctctggtcacagtcgctgaagattttaagacccaaaacgactttgtaaagagaatgtacgatatgatcctgctgagatctggcaattgggagctagagaccacccgaaataacgatggactcactccacttcaattggcagccaaaatgggaaaggccgagattctgaaatacatcctgagtagagagatcaaagagaaaaggctcagaagcttgtctaggaagttcacagattgggcttacgggcctgtttcctcctcgctttacgatcttaccaatgtcgatacaacaactgataactctgtgttggagatcacggtgtataacactaacatagacaatcgacacgagatgttgacactggaaccactgcataccttattgcacatgaagtggaagaagttcgctaagcacatgttttttctcagcttttgtttctactttttctacaacatcaccctgaccctggtgtcctactatcgccctcgggaggaggaagctatcccacatcccttggcactaactcacaagatggggtggctacagttgctcggccgtatgtttgtgctgatatgggctatgtgcatctccgtgaaagaaggcatcgctatttttctcctgaggccctcagacctgcagagcatcctaagtgacgcctggtttcacttcgtattctttattcaggcggtcctcgtgattctgagcgttttcttatatctgttcgcatacaaggaatatcttgcctgcctggtgctggcaatggcgctgggttgggcaaacatgctgtactacacaagggggttccagtctatgggcatgtattctgtcatgatccagaaagttattctgcacgacgtgctcaagttcctgtttgtttacattgtgtttctcttaggattcggtgtcgcactggcctctctgatcgagaagtgccccaaagataacaaagactgctccagttatggctccttttccgatgccgtcttagagctgtttaagctgacaatcggtctgggagaccttaatattcaacagaattctaagtacccgattctgtttctgttcttactaatcacttacgttatactaacattcgtgcttcttcttaatatgttgatagctctcatgggagaaaccgtggaaaatgtgagcaaggagagtgagcggatctggcgtttacagcgcgcaaggaccatcctcgaattcgaaaagatgctgcccgaatggctgagatccagattcaggatgggagaactctgcaaagtcgccgaggacgactttcgcctctgcctccggattaatgaagttaagtggactgaatggaaaacacatgtgagtttcctgaatgaagatcccggtccagtaagacgtaccgctgattttaataagatccaggactctagcaggaataactccaagaccaccttgaatgctttcgaggaggtcgaagagtttcccgagacctctgtgtag

SEQ ID NO: 244653 - DNA, 2616 bp, Artificial Sequence
  Description of Artificial Sequence: Synthetic coding sequence
atggcagactcatcagagggaccgcgagcgggtcccggtgaagtggcggagctgccgggagatgagagcggaacccccggtggagaagctttccccctttcaagcctggcaaacctatttgaaggtgaggatgggtctctgtccccttctcccgctgacgccagcagaccggcaggacctggcgatggtagacctaatctgaggatgaaattccagggcgcattccgtaagggagttccgaatcctatcgaccttctggaatcaactctttacgagtcttccgtggtaccaggccctaagaaagcacctatggattctctatttgattacgggacctaccgccatcactcatcagataataaacgctggaggaagaaaataatcgagaagcagccacagtcaccaaaggcgccagcaccacagcctccccctatcctgaaggtcttcaataggccaatcctgttcgacatcgttagcaggggcagcacagcggatcttgacggtctacttcctttcttgctgactcacaagaaaagactaaccgacgaagagttccgagaaccaagcaccggcaagacatgcttacccaaagcactcttaaatctgtcaaatggcaggaacgataccattccagtgctgttagacatcgcggagagaactggcaatatgcgtgaatttataaactcaccgttccgtgatatatactatagaggacagacggccctacatatcgcgatcgagagaaggtgtaagcactacgtcgagctactggtggcacagggggcagatgtgcacgcacaggctagaggacgattcttccagcccaaagacgagggcggatatttttactttggcgaacttcctttatcactagccgcatgcactaaccaaccacatatcgtgaactatttaaccgaaaatcctcacaaaaaagctgatatgcggaggcaggactccagaggtaataccgtgctgcacgcgctcgttgcaattgccgacaacacgagagagaataccaagtttgtgaccaagatgtacgatctccttttgctgaagtgtgcaagactgtttccggattcaaaccttgaggctgttctgaataatgacgggctgagtcctctgatgatggctgccaagacaggcaagattgggatctttcaacacatcatccggagggaggttactgatgaagatacccgacatcttagccgaaaattcaaggattgggcgtacggacccgtgtattctagcctgtacgatctgtcctccctcgacacttgcggcgaagaggctagtgtcctggaaatcctggtctataacagtaagatagagaaccgccatgagatgctcgcagtagagccaattaatgagctactgcgagataaatggaggaaattcggagccgttagcttctatattaacgttgtcagctatctgtgcgcaatggtgatttttaccctcacagcatactatcagcccctggagggcaccccaccatatccctaccgcacaaccgttgattacttgcgcttagctggagaggtcattacactctttaccggcgttctgttttttttcactaacatcaaagatctcttcatgaaaaagtgccctggcgtgaactcgctcttcatcgatgggagttttcagcttctttattttatctattctgtgttggttattgtcagtgccgctctctatctggccggaattgaggcttatttagcagtgatggtattcgcactggtgctcggctggatgaatgcgctttactttacgcgtgggttgaagcttactggaacttattccatcatgatccaaaagatccttttcaaggatcttttccggtttcttctggtttatcttctgtttatgatcggctatgcttctgcattggtttcgttgcttaatccatgcgccaatatgaaggtgtgcaacgaagaccagacgaactgcactgttcccacttatccatcgtgtcgcgattcagaaacgttctcaacttttcttcttgatctcttcaaactaacaattggcatgggggacctggagatgctgagttccacaaagtacccagtggtctttattatactgctggtgacttacataatactgacctttgtactcctgctgaatatgctcattgcattgatgggggagactgtggggcaagtgtcaaaagagtcaaaacacatatggaagctacaatgggccactacgatcttagatatcgagcggagctttccagtttttttacggaaggcatttaggagcggtgagatggtaacagtagggaagtcaagcgatggaaccccagatagaaggtggtgctttagagtagatgaagtaaattggtcccattggaatcagaacctgggtattattaacgaggacccagggaagaacgagacctatcagtactatggattctcccacactgtgggacggctgcgtcgtgacagatggtcttctgtggtaccaagggttgtcgagctgaataagaatagcaatcccgacgaggtcgtggtgccgctcgattcaatggggaacccacgctgcgacgggcaccagcagggctatccaagaaagtggcgcaccgatgacgccccactgtag

SEQ ID NO: 244654 - DNA, 2436 bp, Artificial Sequence
  Description of Artificial Sequence: Synthetic coding sequence
atggcggattctagcgagggccctagggccggtccaggggaggtcgccgagctgccgggtgatgagtctggcacacctgggggtgaagcattcccactctcctctctcgccaatcttttcgaaggcgaggatgggagcctgagtccctcgcctgccgacgcatcaaggcccgcaggccctggcgatggacgccctaatctgcgaatgaagtttcagggggcattccgtaagggcgtgccgaacccgatagatcttcttgagtccacgttatacgaatcgtcggtcgtgccagggcctaaaaaggcaccaatggatagtctgttcgattacggtacatacaggcaccattcatcagacaataagagatggcgtaagaagattatcgaaaagcaacctcaatctccgaaggccccagcaccccagcctcccccaattctgaaagttttcaaccgaccgatcctgtttgacattgtgtcacgaggaagtacggcggacctggatggactgctaccatttttgttaacccacaagaagaggctgacagatgaagaatttagggagccaagcactggaaaaacatgcctgcccaaagccctactgaatctgagcaacggtcggaacgacacgattcctgtcttactggacattgctgagagaactggaaacatgcgcgagtttattaactctccctttagagacatctactataggggacagacagcactccatatcgcgatcgagagacgttgtaaacactatgtcgaactgctggttgcccagggggctgacgtgcacgcgcaggccaggggacggttctttcaaccgaaagacgagggaggctacttctattttggcgagctgccgctcagcctagcggcttgtacaaatcagccacatatcgtgaactacctgaccgaaaacccccacaaaaaagccgacatgcggaggcaggactccagaggcaacacagtactacacgcccttgtggctatagctgacaatacccgggagaacactaaattcgtgaccaaaatgtacgatctcctgctactcaagtgcgctagactttttccagattctaacctcgaggcggtgctcaacaacgacggcttgtctccacttatgatggctgctaaaacaggcaaaataggtaacagacatgaaatgctcgcagtggagccaattaatgagctgctccgcgacaagtggagaaagtttggggctgtgagtttttacataaatgtggtcagttacttgtgcgccatggtgatcttcactcttacagcatactaccagccactcgaagggacccctccatatccgtatagaacaacagtggactacctcaggctggcaggggaggtcatcacactctttactggtgtgctttttttttttacaaacattaaagacctctttatgaaaaaatgtcctggagtgaactctctattcattgacggaagttttcagctgctgtatttcatttactctgtgctcgttatcgtgagcgctgcactatatctggcagggatcgaggcataccttgcagtcatggtgtttgccttggtccttggctggatgaatgcactgtactttacccgtggactgaagctcacaggtacctattcgatcatgattcagaagattctttttaaagatctctttagatttctgctggtgtacctgctgttcatgatcggctacgcctcagcgctggtgagtttactgaacccatgtgccaatatgaaagtctgtaacgaggatcagaccaactgcactgtgccaacatacccctcttgcagggattccgaaacattctccactttcttgctcgaccttttcaagttgactattggcatgggcgacttggagatgttatcatcgaccaagtacccggttgtgttcataattctgttggtgacatatatcattctgacatttgtgcttttgctcaacatgcttatagcactgatgggcgaaaccgtgggccaggtttccaaggagagtaaacatatctggaaactacaatgggccactacgatactggacatcgaacggtcatttcctgttttcctccggaaagccttccgcagtggggagatggtgaccgtgggcaaaagtagcgatggcacacccgatagaagatggtgctttcgcgtggacgaagtgaattggtctcactggaaccagaatctagggataattaacgaggatccaggcaagaatgaaacatatcagtattatgggttttcccacacagttggccgtctgagaagagatcgctggagctctgtggtgcctcgcgtggtggagctgaataaaaatagtaaccctgacgaggtggttgtaccactggactcaatgggaaaccctaggtgtgacggtcatcagcaggggtatcctcgtaagtggcgcaccgacgacgctcccctgtag

SEQ ID NO: 244655 - DNA, 2475 bp, Artificial Sequence
  Description of Artificial Sequence: Synthetic coding sequence
atggccgacagttcggagggacctagagccggacccggtgaagtagctgagctgcccggtgacgaatctgggacccctgggggagaagccttccctctgtctagtttagctaacctgttcgagggagaggatggctcccttagtccaagccccgcagacgcttcccggccagccggtccaggagatggcaggcctaaccttcgcatgaagtttcagggagcctttcggaagggagtgcccaaccccatcgatttactggagagcacattatatgagtcctcagtggtgcccggaccgaaaaaagccccaatggattccctgttcgattatggcacataccggcatcacagctccgacaacaagcgctggaggaaaaagattatcgaaaagcagcctcagtctcctaaggcccctgctcctcagccacccccaattttgaaagtgtttaaccgtcccatcctatttgatatcgtcagtagggggagcactgccgatttagacggactgctgcccttcctcttgacacacaagaagcgcctgacggatgaggaatttcgcgaacccagtacgggaaaaacctgccttcccaaggccttattaaacctgtctaatggaaggaacgacactatcccggtgttattggatatcgccgaacgtaccggcaacatgcgagagtttatcaattcccctttcagggacatctactaccggggagaactgccactgtcactggcagcctgcaccaaccagccacacattgtgaactatcttaccgagaatccccataagaaagccgacatgcgaagacaagattcaagaggaaacacagtgctgcatgccctcgttgcgatcgccgacaatactagagagaataccaaatttgtgactaaaatgtatgacctgctgctgctaaaatgtgcacgcctgttccctgattccaacttggaggctgtacttaataatgacggtttatctcccctcatgatggccgctaaaacaggaaaaatcggcattttccaacatatcatccgtcgagaagtgaccgatgaggacacccgccatttgtctcgcaagtttaaagactgggcttacggccctgtgtattccagcctgtatgatttatcttctctcgatacctgtggtgaggaggctagtgtgctggaaatcctggtctacaattcaaaaatcgaaaaccgccacgagatgctggccgtggaacctataaatgagctgcttagggataagtggcgcaaattcggcgctgtatcattctatatcaacgtggtgagctatctgtgcgctatggtcatcttcactttgactgcttactatcagccgctcgaaggtacacctccatacccataccgtacaactgtggactatttgagactggcgggagaagtcatcacactatttacaggggtacttttctttttcactaatatcaaagatctgtttatgaaaaaatgccctggagtgaactctctgttcattgatgggagcttccagctgctgtattttatctacagcgttctagtcatagtgagcgccgctctatacttagcaggcattgaggcgtacttggctgtgatggtctttgcactggtcctcggctggatgaatgccttatactttacccgaggcctcaagctcacaggaacctacagcatcatgattcagaagatcctattcaaggatttgtttaggtttctgctcgtgtacctccttttcatgatcggttacgcctctgcgctggtgtcgctgctgaatccttgtgccaacatgaaagtctgcaatgaggatcagactaactgcactgttcctacatatcctagctgccgagatagcgagaccttcagtacgttcctacttgacctgttcaaactcacgattgggatgggggatcttgagatgctgtctagtacgaagtatcctgtggtgtttataatattactcgtgacctatattatccttacgttcgtgcttctgctgaacatgctgatcgcactcatgggcgagacagtgggccaggtctccaaagagagcaaacacatctggaaactccaatgggctaccacgatactggatatagaaaggagttttcctgtattcttacggaaagcctttcggtctggagaaatggttacagtggggaaatcttctgatggcacccccgatagacggtggtgttttcgcgtggatgaggtcaattggtcgcattggaatcagaatttggggatcatcaatgaggatccgggaaagaatgaaacgtaccagtactacggcttcagccataccgtcggtaggctgcgcagagatcggtggagcagcgtcgtcccgagagtggttgagctcaataagaactccaaccccgacgaagtggtggttccactcgattctatgggcaaccccaggtgtgatggtcaccaacaggggtatcccaggaagtggcggaccgacgatgcacccctttag

SEQ ID NO: 244656 - DNA, 2616 bp, Artificial Sequence
  Description of Artificial Sequence: Synthetic coding sequence
atggctgacagctcagagggccctcgagccggaccaggcgaggtcgccgagttacctggcgacgagtcaggtacacccggaggtgaagcatttcctttgtcaagtctcgcaaacctgtttgagggtgaagacgggtccctgagcccaagccccgcagatgccagtcgtccagccggtcccggtgatggacgtcctaacttacgtatgaagttccagggggcattccgtaagggcgtccctaatccaatcgacctgttggaaagcaccctgtatgagtcatcggtggtgcccggaccaaaaaaggctcccatggacagtctttttgactacggcacctaccggcaccattcctctgataacaagaggtggagaaagaagattatcgagaagcagccccagagtcccaaagcacctgctccccagcctccacctatactcaaggtttttaaccgcccaatcctcttcgatatcgtgtcacggggttccactgctgatctggacggcttgctacctttccttctgacccacaaaaagcggctgaccgatgaggaatttagggaaccatccactggaaaaacatgcctccctaaggccttgttaaatctctctaatggccgtaacgatacgatccctgtgctgctggacattgcagagcgaacaggcaacatgcgggaatttatcaacagcccttttcgcgacatatactaccgaggccagactgccctgcatatcgcaattgaacgcaggtgtaagcattacgtagaattgttggtagcccaaggtgccgacgtgcacgcccaagccagaggaagattctttcagccaaaggatgagggtggatacttttatttcggtgaattgcctctgtccttagctgcttgtaccaaccaaccacatatcgtcaactatctgaccgaaaacccacacaaaaaagccgatatgagacgtcaggacagcagaggtaatacagtgctgcatgctttagtggccatcgcggataatactcgggagaacaccaaattcgtgactaaaatgtatgatcttctgctccttaagtgtgctagactcttccccgactctaacctggaggccgtgctgaacaatgacggattgagtcctctgatgatggcagctaagacaggcaaaattggaatttttcagcatataatcaggcgagaagtgaccgatgaggatacacggcacctgtcccgcaagtttaaagattgggcgtatgggcctgtgtactcatctctatatgatctcagctcccttgacacgtgtggggaggaggcgtctgtgttggagattttagtctacaactccaaaattgaaaaccgtcatgagatgttggccgttgagcccataaacgaactgctgcgcgataaatggcgcaagttcggcgctgtgtctttctacattaatgttgtgtcgtacctttgcgctatggtgattttcaccttaaccgcctactatcagcccttagagggaacccccccttacccgtacagaaccaccgttgattacctgaggttggcgggagaggtaatcacgctcttcacaggcgtgctgttctttttcaccaatattaaggacctgttcatgaagaagtgtcccggagtgaatagcctttttatcgacgggagcttccagctcctgtactttatctactcagtcctggtgatcgtgtccgccgcattatacctcgccggtatcgaggcatatttagccgtgatggttttcgccctggtgctcggatggatgaacgcgctgtacttcactaggggtctcaagctcactggaacctatagcattatgattcagaaaatccttttcaaagatttattccgattccttctggtgtatctcttgtttatgatcggctacgcgagtgctctcgtaagcctgcttaacccctgcgcaaacatgaaagtttgcaatgaggaccagaccaactgcaccgtgccaacttacccaagctgtcgagacagtgaaacattctccacgttcttgctggatcttttcaagctcaccatcgggatgggagacctggagatgctctcgtccaccaagtaccccgtcgttttcattattctcctggtgacctacattatcctgacattcgttctcttactaaacatgttaattgcgctgatgggggagaccgtcggccaagtgtctaaggaatccaaacatatttggaaactccaatgggccaccacgatccttgatatcgaaagatctttccctgtgtttctgcgcaaggctttcagatctggggaaatggtgaccgtgggaaagagctctgatggaactcctgaccgtaggtggtgttttagggttgatgaagtcaactggtcccactggaaccagaatctcggcatcattaacgaggatcctgggaaaaacgaaacataccagtactacgggtttagccacaccgttggacgcctaagaagagacaggtggtcatctgttgtgccccgtgttgttgaattgaataagaattctaatcccgacgaagttgttgtgcctcttgacagtatggggaatccccgatgtgacggtcatcagcagggctatccacgcaaatggcggactgatgatgctccactctag

SEQ ID NO: 244657 - DNA, 2514 bp, Artificial Sequence
  Description of Artificial Sequence: Synthetic coding sequence
atggccgacagtagcgaaggccctagagcagggcctggggaggtcgccgagttacccggagacgaatccggaacaccaggcgatggaagacccaatctgcgcatgaagtttcagggcgcatttcggaaaggagtccctaatcctatcgatctcctggagtctactctgtatgaatctagtgtcgtgccagggccaaaaaaagcccctatggattccctcttcgattatggcacctatcggcaccactcttctgataacaaaaggtggagaaagaagatcattgagaaacaacctcagagccctaaggccccagcaccacaaccccctccaatcctgaaagtctttaatcgccctatcttgtttgacattgtcagcagaggtagcaccgcagacctcgatggcctgcttcccttcctgctgacgcacaagaagcgactaactgatgaggaatttagagagccttcaacgggcaagacctgcctcccaaaggctttgcttaatttgagtaacggaagaaacgataccattcccgtactattagacatcgccgaacgtactggaaatatgagggagttcatcaattcgcctttccgggatatctactatcgcggtcaaacagccctgcacattgcaatcgaaaggagatgtaagcactatgtggaactcctggtagctcaaggcgctgatgtacacgcacaagctcggggacgtttctttcagcctaaggacgaagggggatatttttatttcggggaattgcctctttcattggcggcatgcacaaatcagccacacatagtcaattatctcacagaaaatcctcacaaaaaagccgatatgcgacggcaggacagtcggggtaacactgtgctgcacgcactggtggccattgccgacaatacaagggagaacacgaagttcgtgacgaaaatgtacgatcttctgctgctgaaatgcgcacgactgttccccgattcaaatctggaggcagtcttgaacaatgacgggctttcacccctgatgatggccgctaagaccggtaagatcggaatcttccagcatatcatccgcagggaagtgaccgacgaggataccaggcatctctccaggaagtttaaggattgggcttacggtcccgtttatagcagtctctatgatctttcaagtttggatacatgtggcgaggaagcctccgtgttggagattctagtgtacaatagcaagatagaaaatcgccatgagatgctcgctgttgaacctatcaatgaactattgagagacaagtggcgtaaattcggcgctgtttccttctacattaacgtggtcagttacttgtgcgccatggtgatttttacacttaccgcttactatcagcctctggaagggactccgccttatccttaccggactaccgtggactatcttcgccttgctggcgaggtaatcaccctgtttacaggcgtgcttttcttcttcactaatataaaagatttgtttatgaaaaagtgccctggtgtaaacagcctgttcatcgacggcagcttccagctgctatacttcatctacagcgtactggttatcgtgtcagctgccctctacttggctggtatcgaggcctatcttgccgtgatggtctttgcccttgtgttgggatggatgaatgcactctattttactcggggactgaagctgacggggacgtatagcataatgattcagaaaatcttgttcaaggacctcttccgctttcttctggtgtacctcttgtttatgatcggctatgcatctgcccttgtcagtctgctgaatccctgtgccaatatgaaggtatgcaatgaggaccaaacgaattgtacagtcccgacttatccatcatgtagagatagcgaaacattttcaacatttcttctggacctcttcaagttaaccattggaatgggcgacctcgaaatgctttccagtactaaatacccagtggtgtttatcattcttttggtgacatacatcatcctcaccttcgtgctgttactcaatatgctcatagccctaatgggggaaaccgtcggccaagtttccaaagagtcgaaacatatctggaagctgcagtgggcaacaactatcctggacatagaaaggagctttccggtgttcctacggaaagcttttaggtcaggggagatggtgaccgtggggaagagctctgatggcaccccagaccgccgttggtgtttccgggttgacgaagttaactggagccactggaaccagaatctcggaatcatcaatgaagatcctgggaagaacgagacttaccagtactatggctttagccacaccgtgggacgtcttagaagggaccgttggtcatctgtagtgcctcgggtggtggagctgaacaagaacagcaatcctgatgaagtagtggtgcccttggacagtatgggaaaccctcggtgtgacggccaccagcaggggtatcctcggaagtggcgcacagatgacgcaccactgtag

SEQ ID NO: 244658 - DNA, 2436 bp, Artificial Sequence
  Description of Artificial Sequence: Synthetic coding sequence
atggcagattcctccgagggccctcgagccggtcctggcgaagtcgctgaactccccggagacgagtctggaacacccggaggcgaggcctttcccctcagtagccttgccaacctgtttgagggcgaagatggatcactctcacccagccccgctgatgcgtctaggccagcagggcctggtgatggcaggcctaatctgcgaatgaagttccagggggctttccgaaaaggagttccgaacccaatagacttactggaatccactctctacgaatcgtccgttgtccccggtcctaagaaggcgcctatggacagtctgttcgactacggcacgtatcggcaccactcttccgacaacaagagatggcggaagaaaattatcgagaaacagccgcagtctcccaaggcgccagctcctcagccccctcccatcctcaaggtgttcaatagaccaatcctgttcgacatcgttagccggggatcgacagccgacctcgacggactattgccattcttacttactcacaaaaagcgcttaactgacgaagagtttagggagccaagtacagggaagacctgtctgcccaaggccctgctcaacctaagtaacggcagaaacgataccatccctgtcttacttgatattgcagaaaggacgggcaatatgcgggagttcatcaactcgccattccgtgatatatattacagaggtcagaccgcactacacattgcaatagaacgtagatgcaaacactacgtagaattgctggtagctcagggagcggacgttcatgcacaagccagaggtcggttcttccaacctaaagatgaggggggttatttttattttggtgaactgccccttagtctggccgcatgcactaatcagccccacatagtgaattacttgactgaaaatccccacaaaaaagccgatatgcgaagacaagatagccggggaaatacagtcctgcacgctctggtggccatagccgacaacacacgcgagaataccaaatttgtgaccaaaatgtatgatctgctactcctgaagtgcgccaggctgttcccggactcaaatttggaggccgtgctgaataacgatgggttgtctccactgatgatggccgcaaagacaggcaaaatcggcaaccgacacgaaatgctcgccgtcgagcccatcaatgaactcctaagagataaatggcgcaagttcggcgcagtctctttttatataaatgtggtttcatatttgtgtgctatggtcatcttcaccctcaccgcgtattatcagccactggaggggacccccccatacccctacagaaccactgtagactatctcagactggctggtgaggtgatcaccttgttcaccggtgttttgtttttctttacaaacatcaaggacttgttcatgaagaaatgtcccggtgtcaatagtctctttattgacgggagctttcagctgctttacttcatctattccgtgctggtgattgtgtccgcagccctctacctcgcagggattgaggcttacctggctgtgatggtgttcgccctggtcttgggttggatgaacgccctgtatttcacccggggattgaaacttaccggaacctactccatcatgatccagaagattttattcaaagacctgttcagatttttgttggtgtacttgctgttcatgatcggatacgcaagcgcccttgtgtcactgctgaacccatgcgctaacatgaaggtatgcaatgaagatcagactaactgcaccgtgcccacctaccctagctgccgcgattcagagacgttcagtacttttcttcttgatctgtttaagctgactatcggaatgggagacctggaaatgctcagctcaacaaagtacccagttgtctttataatcctacttgtgacttacatcattctcacctttgtacttttactcaatatgttaatcgcgctcatgggtgaaactgtcggccaggtgtccaaagagagcaagcacatctggaaactccagtgggccaccaccatactggacatcgagagatccttccccgtattcctgcgtaaagccttccgcagcggggagatggtgaccgttggcaagtcctccgacggtacccccgatcggcgttggtgtttccgggtcgacgaggtcaactggagtcattggaaccagaacctcgggataatcaatgaggaccctggcaagaacgagacgtatcaatactacgggttctcccacacagtaggccgtctgaggagagatcgatggagctcggtcgtccccagggtggtcgagttaaataaaaattcaaatccagacgaggtggtggtacccctcgacagtatgggcaatccacggtgcgatggtcatcagcagggctatcccagaaaatggaggaccgacgatgcacccctttag

SEQ ID NO: 244659 - DNA, 2475 bp, Artificial Sequence
  Description of Artificial Sequence: Synthetic coding sequence
atggcagattcttccgagggcccaagagcgggacctggggaagtggctgagctacccggtgacgagtcaggaaccccgggtggtgaagccttccccctgtcatctctagccaacctatttgagggcgaggatgggtccctgtcccctagccccgcagacgcctcccgaccggcaggccctggtgatggacgaccaaatctgcggatgaaattccaaggagccttccgtaagggtgtgccgaaccctatcgacctgctggaatcgaccctctatgagtcttcagtggtccctggcccaaaaaaagctcctatggactctctcttcgactatgggacatatcgccaccactcctctgacaataaaagatggcggaaaaagatcatcgagaaacagccacagtcgcctaaggcccctgcgccacagccaccacccatactgaaagtcttcaataggccaattttgtttgatattgtgagtcgcggatctaccgcagacttagacggactactcccattcctccttacacataagaaacggctaacggacgaggagttcagagaaccctcaaccgggaagacctgtttgccgaaggccctactcaacctaagtaacgggaggaatgatacaatccctgtcctgctggacatcgcagagaggacggggaacatgagagagtttatcaactcgccgttcagggacatttattacaggggagagctgcccctttcattagctgcttgtacaaaccagccacacattgtgaactacttgacagaaaatccacacaaaaaggcggacatgcgaagacaggacagccgcggaaacaccgtgctgcatgctttggttgccatcgccgacaacaccagagaaaatacgaaattcgtgactaagatgtacgatttactccttctcaaatgcgctcgcttgttcccggacagtaacctggaagccgtcctgaataatgatggcctcagcccacttatgatggctgcaaaaacaggtaaaattggtatctttcaacatatcatcagaagggaagtgaccgatgaagacactcgccacctatcaaggaaattcaaggactgggcctacggaccagtgtattcatcattgtacgatctcagttcactggacacctgcggcgaggaagcttcagtgcttgaaatcctggtctacaactccaagatagagaacagacacgagatgcttgctgttgagccaattaatgaactcttgagagacaaatggaggaagttcggtgccgtgtcattctacattaatgtggtctcgtatttgtgtgctatggtaatcttcacacttaccgcctattaccagccactggaagggacacctccttatccttatcggactacagtcgactacctgcgactcgcaggggaggttatcacccttttcaccggggtgctcttcttcttcaccaatatcaaggacctgtttatgaagaagtgcccaggggtgaattccctcttcatagacggctcatttcagctgctatatttcatttactccgtgcttgtcattgtttccgcggctctgtacctggctggaatagaggcctatctcgctgtaatggttttcgcactcgtcctgggttggatgaatgccctatacttcacgcgagggttgaaactcaccggaacttattcaatcatgatccaaaagatcttgttcaaagatctcttccgatttttgctcgtgtatttgcttttcatgatcggatacgctagcgcccttgtgagtctgctgaatccatgtgctaacatgaaagtatgtaacgaagaccagacgaactgcacagtcccgacttatccctcctgcagggactctgagactttcagtaccttcctactggacctttttaaactgacaattgggatgggtgacctggagatgctcagcagcacaaagtacccagttgtgttcatcatactgctggtcacttatatcatactgacctttgtcctcctgctgaacatgctcattgctctgatgggggaaacagtggggcaggtgtctaaggagtcaaaacacatttggaaactgcagtgggccacaaccattctcgacatcgaacggtccttcccagtcttcctgcggaaggcttttcgcagtggcgaaatggtgacggtcgggaagagtagtgacggcacaccagatcgtagatggtgctttcgggtcgacgaagtgaattggagccattggaaccagaatctgggaatcatcaacgaggatcccggaaaaaatgaaacttaccaatattatgggttttcccataccgtagggagacttcggcgagataggtggtcgtctgtggtgcctcgggtcgttgaactgaataaaaactcaaacccagacgaggtcgtcgtgccactcgatagcatgggcaatcctcgatgtgatggtcaccagcaggggtaccctcggaagtggcggaccgacgacgctccgctctag

SEQ ID NO: 244660 - DNA, 2295 bp, Artificial Sequence
  Description of Artificial Sequence: Synthetic coding sequence
atggccgattccagcgagggaccgagagcgggaccgggagaggtggcagagctgccaggtgacgagtctggcaccccaggcggtgaggctttccccttgtcctcactggcaaatctttttgagggcgaggacgggtctctttcccccagccctgccgacgcctctcgcccagctggacctggtgacggtagacccaacctgcggatgaagttccaaggcgcttttaggaaaggtgtgcctaatcctatcgacttacttgaaagcactctttatgagagttcagtggtgccaggaccaaagaaggctcctatggattcccttttcgattacggcacatatagacaccattcctccgataataaaagatggcgcaagaaaatcatcgagaaacagccccagagcccaaaggcccctgcaccgcagcctcccccaatcctcaaagtatttaatagacctattctctttgacatcgtctcccgagggtccacggcagacctggacggcctgctcccatttctgctgacacacaagaaacggctgacagacgaggagttccgtgagccctcaactggtaagacttgtctccccaaggcgctgctgaatctgtctaacggccgtaatgatacaatcccggttctgctggatatagccgaacgaacgggcaatatgcgagagtttattaattctccttttcgagacatttactacaggggcgaactccccctatccctcgcagcctgtacaaatcagccccacatcgtcaactatcttacagagaatccgcataaaaaggcagacatgcgacggcaagattctagagggaacacggtcctacatgcgctcgtggccattgcagataatacacgggaaaacacaaagtttgtgactaagatgtatgatctgctcctgctcaaatgtgctcgactatttccagatagtaatctcgaggctgtcctcaacaatgatggactatcacctctgatgatggccgctaagacgggtaaaattgggaatcgtcacgagatgctggccgtcgaacctatcaacgagctcctcagggataagtggcgcaagtttggggcagtctccttttatatcaatgttgtttcctacttgtgcgccatggtgatttttacactgactgcttattatcagcctctggagggcacccctccctacccatataggacgacagtcgattacctgagactggccggtgaggtgatcacacttttcactggagtgctatttttctttactaatatcaaggacctcttcatgaagaagtgtccgggagtgaactctcttttcatcgatggcagcttccaattattgtactttatctactccgtgctggtgattgttagtgccgctctttacctggcagggatcgaggcctatttagcagtgatggtcttcgctctggtgcttggctggatgaatgccctatattttactagaggcttaaagctaacgggcacctattccatcatgatacagaaaattttgtttaaagacctctttcgctttctgttagtttaccttctgtttatgataggatacgcctccgctctggtaagcttgctcaatccttgcgccaacatgaaggtgtgtaatgaagaccagaccaattgtacagttcctacctaccccagctgccgggactccgaaacattttccacattcctgttagatctgttcaaacttactatcgggatgggagatcttgagatgttatctagcactaaatatccagtcgtgtttattattttattagtcacttacattattttaacctttgttctactcctaaacatgcttattgcactgatgggggaaacagtggggcaagtttccaaggaaagcaagcacatctggaaactccaatgggccaccacaatcctggatattgagaggagcttccctgttttcttacgaaaggcatttaggagcggggagatggtgactgtcgggaaaagttctgatgggacgccagaccgtcggtggtgtttccgggttgacgaagttaattggtcccattggaatcagaacttgggcatcattaatgaagatcccggaaagaatgagacctatcagtactatggcttctcacacaccgtcggccgtctccgcagggatagatggtccagtgtggtccccagagtcgtggagctcaataagaattccaacccagatgaggttgttgtgccgctagatagcatgggaaacccacgatgcgatggacaccaacaggggtatcctcgcaagtggagaactgatgatgcccctctctag

SEQ ID NO: 244661 - DNA, 2190 bp, Artificial Sequence
  Description of Artificial Sequence: Synthetic coding sequence
atgggaggattcctgcccaaggccgagggccctggaagccagctccagaaactgctgccttcatttcttgttcgggaacaggactgggaccagcacctcgacaagctccacatgctgcagcagaagcggattctggagtcacctctgcttagagctagcaaggaaaacgacttgtcggtcttacgccagctgctgctagattgcacgtgcgacgtgcgccaacgtggggctctcggagagactgcactccatatcgccgcactttacgacaacctagaggccgctcttgtactgatggaagcagcccctgaactggtgtttgaacctactacatgcgaagcatttgccggacaaacagctctacatatcgctgtcgtcaaccagaacgtgaatctggttcgcgcactgctgacaagaagggcctcggtgagtgcccgagcaacgggaacggccttccgcagatcccctagaaatctcatctattttggggagcacccactgtcctttgctgcctgcgtaaattcggaggagatagtcagattgttgatcgaacatggtgcggacattcgggctcaagactcactagggaataccgtcttacacatattgattcttcagccaaataaaacttttgcatgccagatgtacaacctgctgctctcttatgatgggcacggagaccacctccagccgcttgatttagtgccaaaccatcagggcttaacccctttcaaattggcaggggtcgagggtaataccgtcatgtttcaacacctaatgcagaaaagaagacatatacagtggacttatggcccactaacctcaatcttatatgacttaacagagatcgactcatggggagaggagctgtcctttctcgagttggtcgtctcaagcgacaagcgggaggcgagacaaatcttagagcagacccccgtaaaggaactggtgagtttcaagtggaataaatacggacggccttacttttgtatactggcggcactttacttgctgtacatgatttgcttcactacatgctgcgtttacaggcccctgaaatttcgtggcggtaaccgtacacattcacgcgatatcaccattttacagcagaagcttcttcaagaggcctacgagaccagggaggatattatccgtctggtgggagagctagtctctattgttggtgctgttataattctcctgctagagatccccgatatttttagagttggcgcatccaggtacttcggcaagactatactgggcggaccctttcatgtcatcattataacctatgcctccttggtcttggtaacgatggtgatgcggcttacgaataccaacggagaggttgtaccaatgtccttcgcacttgtgctgggatggtgctccgtgatgtactttacccgagggttccagatgttaggcccatttaccattatgattcagaaaatgatattcggagatctgatgcggttttgttggctgatggccgtggtaatcctagggtttgcctctgctttctatatcatttttcagactgaggaccccacttctctgggccagttctatgattatccaatggcactgtttaccacatttgagctttttctgactgtgatcgatgctcccgctaattacgatgtggatttaccttttatgttcagtatcgtaaatttcgcctttgccataatcgctaccctgctgatgttaaatttgttcattgcaatgatgggggacacacattggagggtcgcacaggagcgggatgaactatggagagctcaggtagttgccacaaccgtgatgcttgagaggaagctccctcgttgtctgtggccaaggagcggtatctgtggatgtgaattcgggctgggcgacaggtggtttctgcgcgtggagaaccacaatgatcaaaatccactgcgtgtcctgaggtacgtggaagtcttcaaaaacagcgacaaagaagatgaccaggagcacccttctgaaaaacagcctagtggagccgagagcgggacactggccagggcgagcctggccctaccgacaagttccttgagccgcaccgctagccagagcagctctcaccgtgggtgggagattttgcgtcagaatacgttgggccatctgaacctcggactgaatctcagtgagggagacggtgaagaggtttaccatttctag

SEQ ID NO: 244662 - DNA, 1146 bp, Artificial Sequence
  Description of Artificial Sequence: Synthetic coding sequence
atgggagggttcctcccaaaggccgaggggcctgggtctcaactgcagaagctgctaccatccttcctggtacgagagcaggattgggatcagcatctggacaagctccacatgcttcagcaaaaacgaatattggaatcacctctcctgagagcatccaaggagaatgacctatcggtgctgcgccagctgctgcttgactgcacatgtgatgtgcgccagcgcggtgctctgggtgagacagccctgcacattgctgccttgtatgataacctcgaagccgcactggtgttgatggaagctgcgcctgagttagtcttcgagccaacgacatgtgaggccttcgctggacaaacggcgctgcacattgcggttgtgaaccagaatgtgaacctcgtgcgggcattactgaccaggcgggcaagcgtgtccgccagggcaaccggaacagctttccgtcgctcaccaagaaatctaatatacttcggggagcaccccctgtcctttgcagcctgcgtgaactcagaggagattgtgagacttctcatcgaacatggcgcagacatcagagcccaggattcactgggtaataccgttttgcacatccttatcctgcagcctaataaaaccttcgcttgccagatgtataatctgctcttgagttatgacggccatggcgaccatttgcaacccctggacctcgtccccaaccaccaggggcttaccccgttcaagctggcaggcgtggaaggcaataccgtcatgtttcagcatctgatgcagaaaaggaggcatatccagtggacctacggtcccctgactagcattctgtatgacctcaccgaaatcgattcttggggggaagaattgtccttcctcgagctagtggtgagttctgataagagagaggctaggcaaatcttggagcagacaccggttaaagagctggtgagtttcaaatggaacaaatacggcaggccctacttctgcattcttgcggcattatacctcttgtacatgatctgctttaccacttgctgcgtttacaggccattaaaattccgcggaggaaatcgcactcactctcgtgacatcaccatcttacaacagaagttgctccaggttattctgcttcgcagagggtag

SEQ ID NO: 244663 - DNA, 1674 bp, Artificial Sequence
  Description of Artificial Sequence: Synthetic coding sequence
atggggctatctctaccaaaggaaaagggtctgattttatgtttatggagcaagttttgcaggtggtttcaggactctctgggaaacaccgtccttcatatacttatcttacaacccaacaagactttcgcctgtcaaatgtataaccttctgctaagttacgaccggcacggagatcaccttcagcccctcgatctggtgccgaatcaccaaggtctaacaccgtttaaactggctggggtcgagggaaatacagtgatgtttcagcacttgatgcaaaagaggaaacatactcagtggacatatgggccactgacatcgacgctttatgacctcacagagatagacagttccggcgacgagcagagcttgctggaactaataataacaactaaaaagcgggaggccaggcagatcctcgatcagacccccgttaaggaattggtttcactcaagtggaagagatatggacgcccatatttttgcatgctgggggctatctatctgctctatattatttgctttaccatgtgctgcatctatcgacccctgaagccccgaaccaacaacaggacttcgcccagagataatacgctccttcagcagaagctccttcaggaggcttacatgacccctaaggacgacatcaggctggtcggagagctggtgactgtcattggggcaattatcatcctgcttgtggaagttcccgacattttccgcatgggggttacacgcttctttggccaaacaatactaggtggaccatttcatgtgctaatcatcacttatgctttcatggtgctcgtgacaatggtgatgaggctcattagcgcaagtggggaggtagtgcctatgagctttgccctcgtattgggctggtgcaacgtgatgtatttcgctagagggtttcaaatgctcgggcctttcacaattatgattcaaaagatgatattcggggatctgatgcggttctgctggctcatggctgtagttatactgggatttgcctccgcattctacatcatatttcaaactgaggacccagaagagctcggccacttctatgattatcctatggcgctgttctccacatttgagctctttctgaccattatagatggcccagctaactataacgttgatttaccctttatgtatagtataacatacgcggcattcgctatcatagcgactttgctcatgctaaatctgctgattgccatgatgggagatactcactggcgggtagcgcacgaaagagacgaactttggcgagctcagatcgttgccacaaccgtaatgttagaacgaaagttaccaagatgtctgtggccccgaagcggcatttgcggtcgagagtatggacttggagaccgatggttcctgcgggtggaagataggcaggatttaaaccgccagcgaattcagcgatatgcccaagcatttcacactcgaggcagcgaggacctcgacaaagattcagtagagaagttggagctagggtgtcccttctccccacatcttagcttgcccatgcccagcgtgagcagatcaacctctaggtcatccgcaaactgggagcggcttcgccagggcacgcttcggagagacttgcgcggaatcattaaccggggactggaagacggtgagtcttgggaatatcagatttag

SEQ ID NO: 244664 - DNA, 2178 bp, Artificial Sequence
  Description of Artificial Sequence: Synthetic coding sequence
atgggcctgagcttgcctaaggaaaagggcctgattctctgcctctggagtaagttttgtcggtggtttcagcgacgcgagagctgggctcaaagtagggacgaacagaacctgcttcagcagaagcgtatttgggagagtcctctgttgctcgcagccaaagataatgatgtgcaggcacttaacaaactgttgaagtacgaggactgtaaggttcaccaacggggagccatgggagaaaccgcccttcatattgccgctctatacgataacctggaagctgcgatggtcctgatggaagctgctccagaactggtttttgaacccatgacatctgagttgtatgagggacagacagccttgcatatagccgttgtgaaccagaatatgaacttggtccgtgcgctgctcgcacgccgtgccagcgtgtctgcaagggccacaggcacagcctttcgtaggtctccctgcaatctcatttatttcggagagcacccactctcgttcgccgcatgcgttaacagcgaggaaattgtgcgacttctaattgaacacggggcagatataagggcacaggatagcttgggcaataccgttctgcatatccttatactgcagcctaataagacatttgcatgtcagatgtacaacttgctgctttcctacgaccgccatggagatcatttacagccactggacctggtgcccaatcaccaaggtctgaccccgtttaaattggccggtgtcgaaggaaatacagttatgtttcagcatctcatgcagaaaagaaagcacacacaatggacatacggcccactgaccagtactctctatgatctgactgaaattgactcatcgggcgatgaacagtccctgctggaactgatcatcaccacaaagaaaagggaggctagacagatccttgatcagacacccgtcaaggaattggtctccttgaaatggaagcggtacggccgaccatacttttgcatgcttggggctatatatttactctacatcatttgtttcaccatgtgctgtatctaccgaccgttgaagccacgtaccaacaaccgaacatctcccagggacaataccctgctgcagcagaagctcctgcaggaagcttatatgacaccaaaagacgatataaggctggtgggcgaactcgtgacagttattggggctatcataatcctgctggtcgaggtccccgacattttccgaatgggagtcacacggttctttggacaaacaattctgggcggtcctttccacgttttaataattacgtacgctttcatggtactggttacaatggttatgcggctgattagcgccagcggggaggtggtacccatgagtttcgccctggtcctcggctggtgtaacgtaatgtacttcgcgagggggttccagatgctgggcccttttaccataatgatccagaagatgatatttggcgatcttatgcggttctgctggctgatggcagttgttattcttgggtttgcttctgctttttacattatcttccagactgaggacccggaagagctgggacacttctatgattatccaatggcactgttttccaccttcgagctgttcttgaccatcatcgatggacccgctaattataacgtggatttgccatttatgtactccatcacctacgccgcatttgctataatcgccactttgctcatgcttaatctgctgattgccatgatgggagatacccactggcgcgtggcccacgagcgcgatgaactgtggagagcccagatagtggccacaactgtgatgctggaacggaagttgcctcgctgtctgtggccacgctcggggatctgcggcagggagtacggtctgggagatagatggttcttgagggttgaggacagacaggatctgaaccgtcaaagaattcaaaggtacgcacaggcctttcatactagagggagcgaagacctagataaggactccgtggagaaattggagctgggctgcccattctccccccatctcagccttcccatgccaagcgtgtctaggtctaccagccgatccagtgccaactgggaacgactgcgacaggggacactacggagagacctgcgtggtattatcaacaggggtttggaagacggagagagttgggagtaccagatctag

SEQ ID NO: 244665 - DNA, 168 bp, Artificial Sequence
  Description of Artificial Sequence: Synthetic coding sequence
atgagtactagtcgcaaattgaagagccatggcatgcgcaggagtaagagccggtcgccccacaagggcgtgaagcggggtggctccaaaaggaagtatcgcaaagggaacctaaagtcaagaaaacgaggggatgatgcaaaccgaaattataggagtcacttgtag

SEQ ID NO: 244666 - DNA, 417 bp, Artificial Sequence
  Description of Artificial Sequence: Synthetic coding sequence
atggatacccaaacccactcccttccgattacccacacacagctgcactccaatagccaaccccagagtcggacttgtacccgccactgccagaccttctcacagagctgtagacagtctcaccgcggatctaggtctcagagctcatcccaatcgcctgccagccacaggaaccctactggagcccacagttcctcgggacaccagtctcagtcacccaacactagcccccctccgaagagacacaaaaaaaccatgaactcccaccattcacccatgcgtccgacaattctgcattgtcgctgcccgaagaatcgcaagaaccttgagggcaagctgaagaagaagaagatggcaaagcgaattcaacaagtctataagaccaaaaccaggtcatccgggtggaagagcaattag

SEQ ID NO: 244667 - DNA, 1731 bp, Artificial Sequence
  Description of Artificial Sequence: Synthetic coding sequence
atggccgtgctttttttccatactatgcgatacaagtctcaggatcccaggaatccacacaatgatagattcgtactgagcaagggccacgctgctcctattctgtatgctgtttgggccgaagccggttttctggcagaagcagaacttctgaacctaaggaagatctctagcgatctggatggacatccggtcccaaagcaggcgtttactgatgtggctacagggtcactggggcaagggttaggcgctgcctgtggcatggcatatacaggaaaatacttcgataaggcctcctatcgggtgtactgtcttctgggagacggagagcttagcgagggcagcgtgtgggaggctatggcctttgcctcaatatataaactagacaacctagttgccatcctggatatcaataggctgggacaaagtgatcccgctccacttcagcaccagatggatatctaccaaaagcgctgcgaggcctttgggtggcatgccattatagtggacgggcattccgtggaagaattgtgcaaggcctttggccaggcgaagcaccagccaacggccataatcgcaaagacttttaagggtcggggtattaccggggttgaggacaaggagtcttggcatggaaaacctctccccaaaaacatggccgaacagataatccaagaaatctacagtcagattcaatctaagaagaaaatcctggccacgccaccccaggaggacgcccctagtgtggatatcgccaatattagaatgcccagtctacctagttacaaggttggtgacaaaatcgctacccgcaaagcctatggccaggctctcgccaagttaggacacgctagcgaccggataatcgcactggacggggacacaaagaattcaacctttagcgagatatttaagaaggagcatccggaccgattcatcgagtgttatattgccgagcagaacatggtctctatagcagtggggtgcgccactaggaaccggactgtgcccttttgcagtactttcgctgcgttcttcacacgggcattcgaccagatcaggatggctgccatctcagagtcaaacatcaacctttgtggtagccactgtggggtcagcatcggtgaggatggcccttctcaaatggctctggaagatctggcaatgttcaggagcgtacccacaagtacagtcttctatccctcagatggtgtagctaccgaaaaagctgtggagcttgcggcaaatactaaggggatctgtttcatcagaacatcccgtccagaaaacgccataatctacaataacaatgaagacttccaggtgggccaggcaaaagtggtcctgaaaagtaaggacgaccaagtcactgtgattggagccggagtaaccttgcatgaagcactggccgctgccgagttattaaaaaaagaaaagattaatatcagggttctggacccattcacgattaaacctctagatcgcaaactaattctggactcggctagggcgaccaagggcagaattctgacggtcgaagaccactattatgaaggcggtattggagaggctgtttctagcgccgttgttggcgaaccaggtatcactgttacacatctggctgtgaatcgggtcccaagatctggaaagcctgctgaacttctcaaaatgtttggtattgatcgggatgcaattgcacaggcagtgcgcggactgattaccaaagcctag

SEQ ID NO: 244668 - DNA, 1374 bp, Artificial Sequence
  Description of Artificial Sequence: Synthetic coding sequence
atggcttttgcaagcatctacaaactcgataatcttgttgccatcttggatatcaacagactcggtcaaagcgaccctgctcccctgcaacaccagatggacatttaccagaaaaggtgtgaagcattcgggtggcacgccatcatcgtggacggacattcggtcgaagagctttgtaaggccttcggacaagccaagcaccaacctaccgccatcattgcaaagacctttaagggcaggggaataactggggtggaagacaaggaatcctggcatgggaaacctttgcccaagaacatggcggagcagatcatccaagagatttactctcagatccagtccaaaaaaaaaatcctggcgacaccaccacaggaggacgcccctagcgttgatatcgccaacatacggatgcctagcctcccctcatataaggtaggagacaagatcgcaactaggaaggcctacgggcaggcgctggcaaaactaggccatgcatccgatagaatcatcgccttggatggcgacacaaagaacagcacttttagcgagatatttaagaaggaacacccagataggttcattgagtgttacattgctgaacagaatatggtatccatagcagtcggctgcgccacaagaaaccgaactgtcccattctgctccactttcgccgctttcttcacacgggcttttgatcagattcgaatggcagctatttccgaatccaacatcaacctttgtggttcccactgtggagtttccatcggcgaggacggaccatcccagatggcgctcgaagacctagccatgttcaggtcagttcccacctcaacagtgttttaccctagcgacggcgtcgccacagagaaggccgtggagttggccgcaaacacaaaaggaatatgcttcattagaacttctaggccggagaacgccattatttataataataatgaggactttcaggtcgggcaggcgaaagttgtgctgaagtctaaagatgatcaagtgactgtgatcggtgccggagttaccctccacgaagctttagcggctgctgagctgctaaagaaggagaagatcaatatacgggtcctggatccgttcaccattaagcctttagatagaaaattgattctcgacagcgcgcgagctacgaagggcaggatccttaccgttgaggaccactattacgaagggggaatcggagaggcggtgtcctctgctgtggttggcgagccaggcatcacggttacacaccttgcagttaatcgggtcccaagatccggaaaaccagccgaattactcaagatgtttggaattgaccgggacgccatcgcacaggctgtgaggggcctgatcaccaaggcgtag

SEQ ID NO: 244669 - DNA, 1872 bp, Artificial Sequence
  Description of Artificial Sequence: Synthetic coding sequence
atggagtcatatcataaacccgaccagcagaagctccaagcactcaaggatacagccaatagactgcgtattagcagcatccaggctaccaccgcggctggcagcggtcatccgacatcatgctgttctgctgccgagatcatggccgtactattttttcatactatgcgttacaaatctcaggatcctagaaatccccacaacgatagatttgtgctgagtaaggggcacgctgcccctatcttgtacgctgtctgggccgaggcagggttcctcgctgaggcagagctactgaacctcaggaaaatctcttctgatctggacggccaccccgtccccaagcaggcctttacggacgtggcaaccgggagcctaggccaaggactgggggctgcatgtggcatggcctacaccggcaagtattttgacaaggctagctacagggtgtactgcctgttgggtgacggtgagctgtcagagggaagcgtgtgggaggccatggcttttgcgagtatttataagctggataacctggtcgccatccttgacatcaatagactggggcaaagcgaccctgctccgctccaacaccagatggacatctatcaaaagagatgtgaggccttcgggtggcatgctattatcgtggatggacattccgtggaagaactatgcaaggcttttggtcaggcgaaacaccaaccgacggctatcattgcaaaaaccttcaagggtagagggataacaggcgtggaggacaaagaatcatggcacggcaaacccttgcctaagaatatggccgaacagattattcaggagatttacagccagatacagtccaaaaaaaagatcttggccacccccccacaggaggatgccccatcggtggatatagcaaacatcaggatgccctccctcccgtcatataaggtgggcgacaaaattgccacccgtaaggcatatggtcaggctctggccaagttaggccatgcctcagataggatcatcgccctagatggagacaccaagaattcaacgttcagtgaaatttttaaaaaagaacatccagacaggttcattgaatgttatattgcagaacagaacatggtgtctatcgccgttgggtgcgccaccaggaaccggacagtccctttctgtagcacatttgcggctttcttcacacgagcattcgaccagatcaggatggccgctatttcagagtctaatataaacttgtgtgggagtcactgtggagtgtcaattggggaagatggcccttctcaaatggccctcgaagacctcgctatgtttcgctccgtccctacatccactgtgttttatcccagtgacggcgtggccactgaaaaggccgtggaactcgcagctaacacgaagggcatctgcttcattaggactagcagacctgagaatgccattatatataataataacgaggatttccaagtgggccaggccaaggttgtccttaagtctaaggacgaccaggtcaccgtgatcggagcaggagtgactctgcatgaggcccttgctgccgcagaattgctcaaaaaagaaaagattaatattcgcgttcttgatccctttaccatcaaacctctggatcgcaagttgatcctggacagtgccagggccaccaaggggcgtatcttgaccgtcgaggaccactactacgaaggcggtatcggggaagctgtaagctctgccgtggtgggagaaccaggaatcactgtcacccatttggccgtgaatcgagtgcctcgaagtggaaagccagccgagctccttaagatgtttggtatagacagggatgcaatcgcacaggctgtccgcggtctgattacaaaagcatag

SEQ ID NO: 244670 - DNA, 1872 bp, Artificial Sequence
  Description of Artificial Sequence: Synthetic coding sequence
atggaaagctaccataaacccgatcaacagaagttgcaggcactgaaggacacagccaatcgattacgcatttcgtcaattcaagccaccacggctgcaggaagcggacaccctacatcgtgctgtagcgctgccgagatcatggcggtgctctttttccacacaatgaggtacaagtctcaggaccccaggaatccccacaacgaccgcttcgtgctctcaaagggccacgccgctcccattctttacgctgtgtgggctgaggcaggtttcctggcagaggcagagctgcttaacctccggaagattagcagcgacctcgacggacacccagttccaaaacaggcttttactgacgtggccactggcagtctgggtcagggccttggggcagcctgcggcatggcttataccggcaagtacttcgataaggcatcgtatcgggtctactgtttactgggggacggcgagctcagtgagggctccgtgtgggaagcaatggcttttgcctcaatctacaagttggacaacctggttgcaattcttgatatcaatagactgggccagagcgacccagcccctctccagcatcagatggacatctatcaaaagcggtgtgaggccttcggctggcatgccatcatcgtagatggtcacagcgtggaagaactttgcaaagcgttcggccaagctaagcatcaacctaccgccatcatcgccaagacgttcaaaggccgtggaatcaccggcgtcgaggacaaggaaagttggcacgggaaacctctgccaaaaaacatggccgaacagatcatccaggaaatctactcccagatccagtcaaaaaagaaaattctcgcgaccccccctcaggaagatgccccaagcgtagatatagccaacatacgcatgcccagtctgccatcttataaggtcggcgacaagatcgcaacaagaaaggcttatgggcaagcactggcaaagcttgggcacgcctccgaccggataattgctttagatggagacacgaaaaattctactttctccgagattttcaaaaaggagcaccctgatcgttttattgagtgttacatagcggagcagaatatggtcagtatcgcagtcgggtgtgccacccgaaatcggacagtacctttttgctccaccttcgccgctttcttcacccgagctttcgatcaaattcgaatggccgctattagcgagtccaatattaacctgtgtggcagccactgcggtgttagcatcggagaggatggcccttcccagatggcactagaggatcttgctatgttccgatcagtgcccacctcaaccgttttttacccgagcgacggggttgctaccgaaaaggcagtcgaactcgccgctaacactaagggtatttgttttattcggacttcccgacccgaaaatgcgataatatacaataacaatgaagactttcaggttggacaggcaaaggtcgtgcttaagtcaaaggatgaccaggtgaccgtcatcggcgcaggcgtgaccctgcatgaggccctcgcagcggctgagttactaaaaaaggagaaaattaacatccgcgtccttgaccctttcaccattaaacctctcgacagaaagctgattcttgattctgcacgtgctaccaagggccgaatccttacggtggaggaccattattatgagggcggtataggtgaagctgtttcctccgccgttgtgggagagcctgggatcacagtgacccacctggctgtgaacagagtgcccagaagcggcaaacctgccgagctgttaaaaatgttcggcatagatcgggatgcgatcgctcaagctgtaaggggcctgattactaaagcatag

SEQ ID NO: 244671 - DNA, 1896 bp, Artificial Sequence
  Description of Artificial Sequence: Synthetic coding sequence
atggaaagctaccataagcccgaccagcaaaaactgcaagctctgaaagatacagctaataggctgagaatctcctccatacaggctaccacagctgctggaagtggccatcccacctcttgctgtagcgctgcagagatcatggctgtgttattcttccacacaatgaggtacaaaagccaggaccccagaaatccacacaacgatcgcttcgtcctctctaaagggcacgcagctcctatcctctatgccgtgtgggccgaggctggcttcctcgccgaagccgaattgctgaatttaaggaaaatcagctctgatctggatgggcatcctgtgccgaaacaggccttcactgatgtggctaccggcagtctgggccagggtctgggcgctgcctgtggaatggcttacactgggaagtattttgacaaggcttctctcccctcttcatgggattacagctacagggtttactgtcttctgggcgacggcgagctgtccgaggggtctgtttgggaagccatggcctttgcttcaatatacaagctggacaatttggtggccatcctggacataaatagactggggcagtctgaccctgctccactccaacatcagatggatatataccagaagcgctgcgaagcatttggatggcacgccattatcgtggatggccactccgtggaggaactgtgcaaggcgttcggtcaggccaaacatcaacccacggccattattgccaagacattcaaagggaggggaatcacaggggttgaggataaggagagttggcacggaaagccattacctaagaacatggctgagcaaattattcaggagatttactcgcagatccagagtaaaaaaaaaatactggccacgcctcctcaggaggacgcccctagcgtggatattgcaaacatccggatgccgtccctgccctcttacaaggtgggcgataaaatcgcaacccgaaaggcatatggccaagccctggccaagctcggccacgctagtgatcgcattatcgccttggacggtgacacaaaaaactcaaccttctccgaaattttcaaaaaagaacaccctgacagatttattgagtgttacatcgcagagcagaatatggtctctatcgccgtcggttgcgctacgcgcaaccggacagtcccattttgcagcacatttgcagctttttttacaagggctttcgaccaaattcgcatggccgctattagtgagtctaatatcaatttgtgtggcagccactgtggcgtctcaatcggagaagacggcccaagccagatggctcttgaggacctggctatgttcaggtctgtacctacttcaacggtcttctacccaagtgatggggtcgccactgaaaaggcggtggagctggcagcaaacactaagggtatctgtttcataaggacttcaagaccagagaacgcgatcatctataataacaacgaagatttccaggttggccaggcaaaggttgtcctcaagagtaaggacgaccaggtaacagtgattggggcaggagttaccttgcacgaggctctggccgcagcagagctcttaaagaaggagaaaatcaatatcagggtgttggacccattcaccattaaacctctggatcggaagctcatacttgacagcgccagggcaacgaaaggcagaattctgaccgtggaggaccactactacgaaggaggaataggggaggctgtgtccagtgccgtcgttggtgaacctgggattacagtgacacacttggccgtaaaccgagtgcccaggagcggcaagcctgccgaactactgaagatgtttggaatcgatcgtgatgctattgcccaggctgtgcggggtctgattactaaggcttag

SEQ ID NO: 244672 - DNA, 1182 bp, Artificial Sequence
  Description of Artificial Sequence: Synthetic coding sequence
atggcccttaaggtggcaactgttgccggaagcgcggctaaggcagtgctggggcctgcccttttatgccggccttgggaggttctgggtgcccatgaagtccctagcagaaacatttttagcgaacagaccattcctccctcggccaagtacgggggacggcacactgtcacgatgattcctggcgatgggatcggtcctgagctgatgctgcatgtgaagtccgttttcagacatgcatgcgttcccgtggacttcgaggaggtccatgtctccagtaacgctgacgaagaagatattcggaatgctatcatggccatccgcaggaacagggttgccctgaaaggcaatattgagacaaaccacaatcttcccccttcacataaaagccgcaataacattcttaggacatcactggacctctatgcaaacgtgatccactgcaagagcctccccggagtagtcacccgccataaggatatcgatatcttaatagtccgagagaatacagaaggggaatatagctctctggagcacgaaagcgtggccggtgtcgtggagtcactaaaaattatcaccaaagctaagagcctgcgcatagcagaatatgcgtttaagctagcccaggaatcggggaggaaaaaggtcacagcagtacataaggccaacataatgaaacttggggatggtctgtttctacagtgttgcagggaagtggccgcacggtatccccagatcactttcgaaaacatgattgtggataacactactatgcagcttgtcagccgtccccaacagtttgatgtgatggtcatgcccaatctatatgggaacattgtcaacaatgtgtgcgcgggactcgtcggaggtcctgggttggtagctggggctaactatggacacgtgtatgcagtcttcgagactgcaacaaggaacacaggcaaaagcattgccaacaagaacatcgcaaatcctaccgcgactttgctggcgtcctgcatgatgctggatcatctcaagttacactcctatgcgacaagtatcaggaaagcagtcctggcctccatggataacgaaaatatgcacacccctgacatcggcggacaaggcacgacatcagaagccatccaggacgtaattcggcatatcagagtaataaatgggagagctgtggaagcttag

SEQ ID NO: 244673 - DNA, 1791 bp, Artificial Sequence
  Description of Artificial Sequence: Synthetic coding sequence
atggcggatgccgaagccagagctgagtttcctgaggaggcaaggccagaccggggaactctccaggttcttcaggatatggcgagtcgcctgcgaattcacagtattcgagccacatgttccacttcatctggccacccaacctcctgctcctccagcagcgaaatcatgagtgtcctcttcttttatatcatgaggtataaacagtctgatcccgagaaccctgataacgaccggtttgtccttgcaaaacggctctcctttgtggatgtagctactggatggcttggtcagggactaggagtggcatgcggtatggcctacacagggaaatattttgacagagcatcttacagagtcttctgcctgatgtcagatggtgagagcagcgagggatctgtgtgggaggccatggctttcgcatcctactattcactcgataaccttgtggccatattcgatgtaaataggttaggccacagcggcgctctgcccgcagaacattgtatcaatatctatcaaagaagatgcgaggcctttggctggaatacatatgtggtagatggcagagacgtcgaagccttgtgccaggtcttctggcaagcgtcacaggtcaaacacaaaccaactgcagtcgtggccaaaaccttcaaggggagaggcactccttcaatcgaggacgcagagagctggcacgcaaagcctatgccacgcgagcgtgcagacgccatcataaaattgattgagagccagatacagacctcccggaatcttgatccacagcctcccatagaagacagcccagaagttaacataacggacgtcaggatgacttcgcctccggattatagagtgggcgacaaaattgccactcgaaaggcttgcggactagccctagcgaaattgggttacgcaaataatagggtggttgtcctggatggcgacaccagatacagtacctttagcgaaattttcaataaggagtacccagagcggttcatcgagtgtttcatggcagaacagaatatggtaagcgtcgctctcggttgtgcgtctcggggaaggacaatagcgttcgcctccacctttgcagcatttttaacacgggcattcgatcatattcgtattgggggacttgccgaatcaaacatcaatattatcggatctcactgcggtgtgtcagtaggcgatgacggagcctcccagatggccctcgaggatatagctatgtttaggacgataccaaagtgtaccatcttctatcccaccgatgccgtgagcacagagcatgcagtggccctcgccgctaatgcaaaaggtatgtgctttatccgcactacccggccagaaaccatggttatttatacaccccaggaaaggttcgagattgggcaggccaaagtcctccgccattgcgtcagcgacaaggtgaccgtgatcggagccggtattacagtgtacgaagctctcgccgcagccgacgaattgtctaagcaggatatcttcattagagtcatcgatctgtttaccatcaagccactcgatgtggcgacaatcgtttcaagcgccaaggccacagaaggtcgtatcatcactgtggaggatcattacccacaagggggaattggtgaagccgtctgcgctgcggtaagcatggaccccgatatccaagtgcactccctggccgttagcggagttccacaaagtggaaagtccgaggagctgcttgacatgtacggaatatctgcgaggcacattatcgtggcggttaagtgtatgctcttgaactag

SEQ ID NO: 244674 - DNA, 1674 bp, Artificial Sequence
  Description of Artificial Sequence: Synthetic coding sequence
atgtccgttttatttttttatataatgcggtacaagcagtctgaccctgagaatcccgacaacgacaggttcgtgctggcaaaaaggttatccttcgtagacgtggccacaggctggctggggcaaggcctgggcgtagcttgtggcatggcatatacgggcaagtattttgatcgagcctcgtatagagtgttctgcctgatgtccgacggtgaaagcagcgaaggctccgtatgggaagccatggctttcgccagctactattcattggacaacctggtcgcaatctttgacgttaatcgcctaggccattctggcgctctgccagccgagcattgtatcaacatttaccagcggagatgtgaagccttcggctggaatacatacgtggttgatggtagggatgttgaagctttgtgccaggtgttttggcaggcttcacaggtaaaacataagccgacagccgtcgtggctaagaccttcaagggtaggggcacaccctctatcgaagatgctgagtcatggcacgctaaaccgatgccacgggagcgggctgatgcaatcatcaagctcattgagagccaaattcagaccagcagaaatctggatcctcaaccacccattgaagacagccccgaggtcaacatcactgatgtgaggatgacttctccacctgactacagggtcggcgataaaatcgcaacccggaaagcatgtgggttggctctggctaagttgggatacgccaataaccgggtggttgtgctcgatggggatacccgctactctaccttctctgaaatcttcaataaagaatatccggagaggttcatcgagtgctttatggccgagcagaacatggtgtccgtagcactggggtgtgcttccagaggaagaactattgcctttgcatcaactttcgctgcctttctgacaagggcattcgaccacattagaattggaggacttgcggaaagcaatatcaatataattggtagccactgtggcgtaagcgtcggggacgacggtgccagccaaatggctctggaggatatcgccatgtttcgcacaattccaaaatgcactatcttttatcctacagatgccgtgagcaccgagcacgctgtcgccctggcagcaaatgcaaagggaatgtgcttcattaggactacaaggccagaaactatggtcatctacaccccccaggagagatttgaaattggacaggctaaaggggtcagcatgttacaggactcctggagctctgttataagttatcagaaagtattgcgacattgcgtgagcgacaaagtcactgttattggggctggtatcactgtatatgaagctctagccgctgcagacgaacttagcaagcaggacattttcatcagggttatcgatctgttcacaatcaaacctttggatgttgccaccatcgtgtcttcagcgaaagccaccgaaggccgtatcatcacggtggaggatcactacccacaggggggtattggcgaagctgtctgcgccgctgtttcgatggatccggacattcaggtccactcactcgctgtaagcggtgtgccccagtccggcaagtcggaggagctgctggatatgtatggcatctccgctcggcacattattgttgcggtcaaatgcatgctcctgaattag

SEQ ID NO: 244675 - DNA, 1623 bp, Artificial Sequence
  Description of Artificial Sequence: Synthetic coding sequence
atgtccgtacttttcttttacatcatgcgctataagcagtctgatccagagaatccggataatgatagattcgtgctggccaaacggctgtcttttgtggatgtagccaccggatggctgggacagggactcggggtggcatgtggtatggcctacacaggtaaatactttgaccgtgctagttatcgtgtattttgtttaatgtccgacggagagtcatcagaagggtccgtctgggaggctatggcattcgcatcatattatagccttgataacctggttgctatttttgatgtgaacaggcttggtcattcaggcgctcttcccgcagagcactgcatcaacatctatcaacggagatgcgaggcctttgggtggaacacatacgtcgtggatggtcgggacgtggaggcactttgtcaagttttttggcaggcttcccaggttaagcataaacccactgccgttgtcgccaaaacttttaagggccgaggaacacctagtatcgaagacgccgagtcgtggcatgccaagcccatgcccagggaacgagctgacgctattataaaactcattgagtctcagatccaaaccagtaggaacctcgacccacaacccccaattgaggattcccctgaggtcaacattacagatgtgagaatgacatcccccccagactatagggtgggcgacaagattgcaacacgcaaggcttgtggcctcgctttggccaaattgggttacgctaataaccgcgtggtcgttctggatggcgacacccggtactctaccttttctgaaatctttaacaaagaatatcctgaaaggttcatcgaatgctttatggccgagcagaatatggtgtcggtggcattggggtgcgcgtccagggggaggactattgcgttcgcatccaccttcgccgctttcttgactagggccttcgaccatatccgcattggcggactcgccgagtcaaacatcaacatcatcggatcccattgtggcgtgagcgtaggggacgacggagcctctcaaatggccctggaggacatcgccatgttcagaactattcctaaatgcactatcttctaccccaccgatgctgtctccaccgagcatgctgtggcgctggcagcaaacgctaaaggcatgtgcttcattcgaactacccgccctgaaacaatggtcatctacacgccgcaagaacgtttcgagataggccaggcaaaggtcctgaggcattgtgtgagtgacaaagtaactgtgatcggggctgggataaccgtttacgaggcccttgccgctgctgatgaactgtcaaagcaagacattttcatcagggtgatcgacctgtttactataaagcctcttgacgtggcaacaattgtgtcttcagccaaggctaccgagggacgcatcatcactgtcgaagaccattacccccagggcggtataggcgaagccgtgtgtgctgcagtttctatggatccagacattcaggttcacagcttagctgtaagtggggttccgcagagtgggaaatctgaggagcttctggacatgtacgggattagcgcaagacatatcattgttgcagtgaaatgcatgctgcttaattag

SEQ ID NO: 244676 - DNA, 894 bp, Artificial Sequence
  Description of Artificial Sequence: Synthetic coding sequence
atgtcagcttgggctgccgcatctctctcaagggctgctgccagatgtctgttagctcggggtcccggagtgcgggctgcccctccaagggacccccgaccaagccatcctgagccaaggggttgcggagccgctccaggccgaaccctccacttcacggccgcagtccctgctggccataacaaatggagcaaagtgagacacattaaggggcctaaagatgtggaacggtctagaatctttagcaagctctgtctcaacatcagactcgcggtgaaggaagggggaccgaaccctgaacataactccaacctagccaatatcctcgaggtgtgcagaagtaagcacatgcctaaaagtactatcgagacagctctgaagatggaaaaaagcaaagatacatatctgctgtacgagggtcgcggaccgggtgggtctagcctgctaatcgaggcactcagtaatagcagccataagtgccaagcagacatccgacacattctcaacaagaacggtggagttatggcagtgggagctcgtcactcctttgacaaaaagggagtgattgtagtcgaggtcgaggacagggaaaagaaggcagtcaacctcgaaagagcactggagatggccattgaagctggcgctgaggacgtgaaagagaccgaagacgaggaggagcggaacgtgttcaaatttatatgtgatgcatctagcctccaccaggtgagaaaaaaattagacagcctgggactgtgcagtgtgtcatgcgcgttagaatttatcccaaactctaaggtacaattggccgagcccgacctcgagcaggcagctcacctgattcaggctctttctaatcatgaggatgttattcatgtctatgataacatcgaatag

SEQ ID NO: 244677 - DNA, 687 bp, Artificial Sequence
  Description of Artificial Sequence: Synthetic coding sequence
atgtcagtgtccgagatctttgtcgagctccagggttttttggccgctgagcaggacatcagggaagaaatcaggaaagtcgttcagagcctagaacagaccgccagagaaatcctaactctcctgcaaggggtgcatcaaggcgcagggttccaggatatcccgaagagatgcctgaaggccagggaacatttcgggaccgtcaaaacccacttgacatccctcaaaacgaagtttccagcagagcagtactatagattccacgagcattggagattcgtgctccagagacttgtttttctcgccgcttttgtagtttatctagagaccgaaactttggtcactcgggaggccgtgacggagatcctgggtatagagcccgatagagagaaggggttccatctcgacgtcgaggactatttatctggagtgctgatcctggcttctgaactcagcaggctgtcggttaattctgtgactgctggggactattctagacccctgcacattagtacattcatcaacgagctggattctggattcagattactcaacctaaaaaacgatagcctccgaaagcggtatgatggcctgaagtatgacgtgaaaaaagtggaagaggtggtatacgacctgtccatccgcggattcaacaaggagacagctgcagcttgtgtcgagaagtag

SEQ ID NO: 244678 - DNA, 585 bp, Artificial Sequence
  Description of Artificial Sequence: Synthetic coding sequence
atgagtgtctcagaaatctttgttgagctccaaggttttctggcggctgagcaagacatccccaaaagatgtctcaaagcccgtgaacacttcggcacggtgaagacgcacctgactagcctgaagaccaaatttccagccgaacagtattatcgtttccacgagcactggcgatttgtgttgcagcggctggtctttttagcagccttcgtggtgtacctagaaacagaaaccctagtgacccgggaagccgtcaccgagattctcggcattgaaccggaccgagagaaaggcttccacctggacgtcgaggattacctctcaggcgtgctgatattggcttccgagttgtcacgactttcggtgaacagcgtgacggcaggagattacagtcgaccgttacacattagcaccttcataaatgaactcgattccggatttcgtttgctgaatctcaaaaacgattccctgagaaagcggtatgacggcttgaagtacgatgtcaagaaagttgaagaggtggtttacgacctctctatcaggggcttcaataaagagactgctgccgcttgtgtagaaaaatag

SEQ ID NO: 244679 - DNA, 447 bp, Artificial Sequence
  Description of Artificial Sequence: Synthetic coding sequence
atgagtgtgtccgagatctttgtcgagcttcagggcttcttggccgctgagcaggacatccgtgaagagattcgtaaggttgttcagtcactcgaacagacagctcgcgagattctgacgttgctgcagggcgtccaccagggcgctggcttccaggacatcccaaagcgatgcctcaaagcccgtgagcactttgggaccgtcaaaacccacctcacatcactaaaaacaaaattccccgctgagcagtattatcgattccatgagcactggcggttcgtgctgcagcgcttggtctttcttgctgcttttgtggtttatctagaaacagaaacgttggttactcgggaggcggtgaccgaaattcttggcatagaggccgtgtgccaacagcgggactgttggagactacttccaaccccaccccacctccacctgcaccagtag

SEQ ID NO: 244680 - DNA, 873 bp, Artificial Sequence
  Description of Artificial Sequence: Synthetic coding sequence
atgagtaataaggagggatcagggggatttagaaaaagaaagcacgacaactttccacacaatcagcggcgagagggaaaagacgtcaattcctcttccccagttatgctagcgttcaagtcctttcagcaggagcttgacgccagacatgacaaatacgagcggttagtcaagctaagtcgagacattactgttgaaagcaagaggactattttcctccttcacaggattacctctgctccggatatggaggatatcttgaccgagagcgagatcaagttggacggcgtgcgccaaaaaattttccaggtggcacaggagttgtccggtgaggacatgcaccagtttcatcgggcaattacgacagggctgcaggagtacgtcgaagctgttagctttcagcatttcataaaaacgaggagcctcatctctatggacgagatcaataagcagcttatctttactaccgaggacaatgggaaagagaacaagaccccttcctccgacgcccaagacaagcagttcggtacgtggaggttgagggtgactcctgtcgattacctgctgggggtagccgatcttactggtgaactcatgaggatgtgtatcaacagcgtcggaaacggagatatcgacacccctttcgaggttagtcaatttctccgtcaggtctatgatggtttcagcttcatcggcaacactggaccctatgaagtttcaaagaaactgtacacactaaaacagagtcttgctaaggttgaaaatgcatgttatgccttaaaagtgagagggagcgagataccgaagcacatgttagctgacgtttttagtgttaaaaccgagatgattgatcaggaggagggtatctcctag

SEQ ID NO: 244681 - DNA, 492 bp, Artificial Sequence
  Description of Artificial Sequence: Synthetic coding sequence
atgtcaaataaagaaggaagcggcggatttcgaaaaaggaagcatgataattttcctcacaatcagcgtcgcgagggcaaggacgtgaacagctcttccccagtcatgctggcttttaaatcattccagcaggaattggacgccagacatgacaagtacgagaggcttgtgaaactttcgcgcgatatcactgtggaatccaagagaaccatttttctcttgcaccggattacaagctcacagtatctggaccacagcgccccagatatggaggatatccttacagagagcgagataaagctggacggggtacgacagaagatttttcaggtagctcaagagctctccggagaagacatgcatcaatttcacagggcaatcaccactggcctgcaggaatacgtggaggccgtgtcattccagcattttataaagactaggagcctcatttcaatggacgagattaacaagcaattgattttcactacctag

SEQ ID NO: 244682 - DNA, 273 bp, Artificial Sequence
  Description of Artificial Sequence: Synthetic coding sequence
atggacccattgcgagctcaacaactcgcagctgagctcgaggtagaaatgatggccgacatgtataataggatgacctcagcctgccaccgcaaatgtgtgccacctcattacaaggaggccgaactttctaagggggaatccgtttgcctagacagatgtgtgagtaagtatctcgacattcatgagaggatgggaaagaagctgaccgagctgtctatgcaggatgaggaactcatgaaaagggtgcagcagtcctcaggccctgcgtag

SEQ ID NO: 244683 - DNA, 273 bp, Artificial Sequence
  Description of Artificial Sequence: Synthetic coding sequence
atggatccactgcgcgcacagcagcttgctgctgagcttgaagtcgagatgatggccgatatgtacaaccggatgacttctgcctgccaccggaagtgtgtacccccacattacaaagaagccgagttgagcaaaggggaaagtgtctgccttgaccggtgcgtaagtaaatacctggacatccacgagcgcatgggcaagaaactgacagaactgtccatgcaagatgaggagctcatgaaacgggtgcaacagtcatccggccctgcctag

SEQ ID NO: 244684 - DNA, 273 bp, Artificial Sequence
  Description of Artificial Sequence: Synthetic coding sequence
atggaccccctgcgtgcgcagcaacttgccgcagaactcgaggtggagatgatggccgatatgtacaatcgtatgaccagtgcgtgtcaccggaagtgcgtacccccacactacaaagaagccgagctctctaagggggaatcagtttgtctggaccgctgcgtgtccaaatacctggatatccacgagcgcatgggtaagaaactcacggagttgtctatgcaggatgaagaactgatgaaacgagtgcagcaaagctccggacccgcatag

SEQ ID NO: 244685 - DNA, 927 bp, Artificial Sequence
  Description of Artificial Sequence: Synthetic coding sequence
atgaagcactatgaggtggaaattttagacgctaaaacaagggagaagctatgcttcctggataaggtcgaacctcatgcgacaatcgcagagattaagaatctgttcaccaaaacccatccccagtggtaccctgcacgccagtcgttgaggctggaccctaaaggcaagtccctcaaagatgaagacgtgctccagaaactgcccgtcggaactaccgccaccttgtacttccgagacctaggcgcacaaatctcttgggtcaccgttttccttacggaatacgctggcccactgtttatctacctcttattttatttccgggtgcctttcatctacggccataagtatgattttactagctcccgacacacagtcgttcacttggcttgcatctgtcactccttccactacattaaacgcttactggagactctctttgtgcatagattctcccacggcactatgcctctgagaaacatcttcaagaactgtacttattactgggggttcgcagcatggatggcatactatatcaatcaccccttgtatactccaccaacatacggcgctcagcaggtgaaattggcccttgccatctttgtgatttgtcagttgggaaatttctctattcatatggcgctgagggacctgaggccggctggcagcaaaacccgaaagattccttaccctaccaaaaaccccttcacttggctgttcttattggtttcatgcccaaactatacctatgaggttgggtcatggatcggcttcgcaataatgactcagtgtctgccggtggcactgttcagtttggtaggctttacccaaatgactatttgggccaaaggtaagcataggtcctacctcaaggagttccgcgactacccaccactgaggatgccaatcattcccttcctgctgtag

SEQ ID NO: 244686 - DNA, 516 bp, Artificial Sequence
  Description of Artificial Sequence: Synthetic coding sequence
atggaagagtatgccagagaaccttgtccatggcgtattgtcgatgattgtggcggagctttcacaatggggactattggaggaggtatttttcaggcaataaagggatttagaaatagcccagtgggtgtgaatcacagactcagaggcagcctcacagcaatcaaaaccagagctcctcagctggggggatcattcgcggtgtggggaggattgttctcaatgatcgattgcagcatggttcaagtgcgtggtaaagaggacccgtggaattcaatcacctcgggagccctgacaggagccattcttgctgccaggaacggccctgtagcgatggtcggctcagctgctatgggcggaattctgctcgccttaattgaaggggctggaatccttctgacaaggtttgccagtgcccagtttccgaacggccctcagtttgctgaggacccctcacagctcccgagcacacagttgccttcctccccttttggggattaccgccagtaccagtag

SEQ ID NO: 244687 - DNA, 519 bp, Artificial Sequence
  Description of Artificial Sequence: Synthetic coding sequence
atggaggagtacgctcgcgaaccatgcccatggaggatcgtggacgactgtggcggagccttcaccatgggggtcatcgggggaggagtgtttcaggccatcaaaggctttcggaatgcgcctgtcggcattagacatagacttaggggaagcgctaacgctgttaggatacgcgctccacagataggcggtagctttgccgtctggggcggactgttctctacgatcgactgcggattggtccgcctgaggggaaaggaggacccctggaacagcatcacctccggcgcattgaccggcgcagtcctggctgctcgttctggaccgcttgctatggtgggctcagctatgatggggggtatcttactcgctctgattgagggcgtgggcatactgctgacccgctacacagcccagcagttccgaaacgcacccccattcctggaagatccaagccaactccctcccaaggatggcacgcctgctccaggatacccttcatatcagcagtaccattag

SEQ ID NO: 244688 - DNA, 669 bp, Artificial Sequence
  Description of Artificial Sequence: Synthetic coding sequence
atggaggagtacgcaagggagccctgtccctggaggatcgtcgacgattgcggcggtgcttttaccatgggagttattggtgggggagtattccaagcaatcaaagggttccgcaacgcaccagtgtgtagattgctgagcgaggcacctttgtttatctactcatgctcccgctctgtcagtccaaccgtcaacgtttcctctgagagagctgaaagccgacccaccttgttcatggctgtttccctccatatggcttggtgtctcgctcacattgggataaggcaccgccttagggggagcgctaatgccgtgcgcattcgagctccacagatcggaggctcattcgccgtgtgggggggactgttttctaccattgactgcgggctggtgcggcttcgaggaaaagaggatccatggaattccatcacaagcggtgccctgacaggggctgtgcttgctgctaggagtggtcccctcgctatggtgggcagtgcaatgatggggggtatcctgctggccttaatcgaaggggtcggtatcctcctcacacggtataccgctcaacagttccgaaacgctcctcctttcttggaggatccctcccagctgccaccaaaggacgggaccccagcgcctggataccccagctaccagcagtaccattag

SEQ ID NO: 244689 - DNA, 585 bp, Artificial Sequence
  Description of Artificial Sequence: Synthetic coding sequence
atggcagcagccgctccaaacgctggtgggagcgccccagagactgcgggaagcgcagaggccccacttcaatatagtttattgctgcagtatttggtgggtgataaaaggcagcccaggttgctggagccgggttctttgggaggaatcccaagtccggcaaagtccgaggaacaaaaaatgatcgaaaaggctatggagtcatgcgcttttaaggcggcactcgcttgtgtaggcggtttcgtcctgggtggcgcattcggggtattcaccgccggaatcgacactaatgttggttttgatccaaaggatccctaccggaccccaaccgcgaaggaagtactcaaagatatggggcaacgaggcatgagctatgccaaaaattttgccatcgtcggtgcgatgttctcttgtaccgagtgtcttatcgaatcctacaggggaaccagtgactggaagaacagtgtgatttctggttgcattactggaggcgctatcggtttccgggctggactgaaagctggtgctattgggtgcgggggtttcgccgctttctcagccgctattgactattacctgagatag

SEQ ID NO: 244690 - DNA, 630 bp, Artificial Sequence
  Description of Artificial Sequence: Synthetic coding sequence
atggagggcggaggaggatcaggaaacaaaacgactggaggactggcagggtttttcggagcaggtggcgctggctactcccatgccgacctggcgggagtcccactgaccggaatgaatccgctctccccttacctgaatgtggacccgagatacctagtccaagatacagacgagttcatcctgccaactggagcaaataagacgagaggacgtttcgaactggctttcttcacgattgggggatgttgtatgacaggcgctgcattcggcgctatgaatgggttgaggctgggactgaaggagacacagaacatggcttggtcgaaaccaagaaacgtgcagattctgaatatggtgacccgtcagggggcactgtgggccaacacacttgggtctctggccttgctctactcggcgttcggagtgattatagagaagactagaggcgcagaggatgatctcaacactgttgccgcaggaacaatgaccggcatgctgtacaagtgcacaggcggtttgcgcggaatcgcgagaggaggccttactgggctgactctgacttctctgtacgctctctacaacaactgggagcatatgaagggatcactactgcaacagagcctgtag

SEQ ID NO: 244691 - DNA, 486 bp, Artificial Sequence
  Description of Artificial Sequence: Synthetic coding sequence
atggaaggcggagggggatctgggaacaagactaccggagggctggctggcttctttggcgctggcggagctgggtattcccatgctgacttggcaggcgttccgctgacagggatgaatcctctgtccccttatttaaacgtagatcccaggtacctagtacaagatactgacgagttcattctccccacaggcgcaaacaaaacacgagggagatttgaactggcgttctttaccatcggcggatgctgcatgaccgcgctgttgtacagcgcttttggcgttattatcgaaaaaacaagaggcgctgaggacgaccttaataccgtggcggctggcaccatgaccggcatgctgtataagtgtactgggggactcagaggtatcgccagaggaggtcttacgggattgacactcacatcactatatgccctgtataacaattgggaacacatgaagggctctctcctgcagcagagcctgtag

SEQ ID NO: 244692 - DNA, 519 bp, Artificial Sequence
  Description of Artificial Sequence: Synthetic coding sequence
atggaaggtgggggaggctccggtaataaaactacgggcggtctcgccggatttttcggagctggtggggcagggtatagccatgcagatttagcaggcgtgcctctaactgggatgaatcccctgagcccgtacctgaatgtcgacccgcgttacttagtccaggacactgacgaattcatcttacctacaggggctaataaaactcggggacggtttgaattggccttctttaccataggcggttgctgtatgaccggagccctgtgggccaataccctgggcagcctggccctgctctacagcgcctttggtgtgattatcgagaaaacccgcggtgccgaggacgatcttaatactgttgccgctgggacgatgaccggcatgctttataagtgcacaggaggcttgagaggcatagctaggggtggacttactggactgactttgacctccctgtatgcattatacaacaattgggaacacatgaaaggctcccttctgcagcagagtctctag

SEQ ID NO: 244693 - DNA, 381 bp, Artificial Sequence
  Description of Artificial Sequence: Synthetic coding sequence
atgactggcgctgcattcggcgcaatgaatggcctgaggcttggccttaaggaaacccaaaacatggcttggagcaagcctaggaacgtgcagattctaaatatggtgaccaggcaaggggctctgtgggccaatacattaggtagcctggcactcctttactcagcgttcggagtcatcattgagaaaacgagaggtgcagaggacgatctgaatactgttgcagctgggaccatgacaggcatgctctacaagtgtactgcgtcagcaagccaaagcgcacgaatagctgatgggctgatatttacagagttctgctcagtcgcccgattacaggggtccgggactattcttgcacattataacttacacctgccatag

SEQ ID NO: 244694 - DNA, 324 bp, Artificial Sequence
  Description of Artificial Sequence: Synthetic coding sequence
tagggcggatccgggaacaaaactaccggcggactcgcagggttctttggggctggcggagccggatactctcacgctgacctggcgggagtgcctccccttctgtacagcgccttcggcgtaatcatcgagaaaaccaggggtgctgaagacgatctaaacactgtcgccgctgggaccatgacagggatgctttacaaatgcaccggcggtctgaggggcatcgctagaggaggcttgacgggtctcacactgacttctctctacgccttatataataattgggagcatatgaagggtagcctgttgcagcaaagcctgtag

SEQ ID NO: 244695 - DNA, 1359 bp, Artificial Sequence
  Description of Artificial Sequence: Synthetic coding sequence
atggccgcagctgccctaaggtccggatggtgtcggtgtcctcggcgttgcctcggatccgggatccagttcttgagctcccataacctgccacacgggtccacctatcaaatgagacgaccagggggagagctgccgttgtctaaaagctactcctccgggaaccggaagggttttctctctggcctgcttgataatgtcaaacaggagctcgccaagaataaagagatgaaagagtctatcaaaaaattccgcgatgaggcccgtagattggaagagtctgatgtccttcaggaggccagaaggaagtacaagacaatcgaatccgaaaccgtgcggactagcgaggtgctgcgaaaaaaactgggcgaactgacaggcaccgttaaagagtcccttcatgaggttagcaagagcgaccttggccgaaagattaaagagggggttgaggaggcagccaaaacggcaaagcagagtgccgaatctgtgtccaaaggtggagaaaaactagggaggactgccgcatttcgggcattgtcccagggagtcgagtcagttaagaaggagatcgatgactccgtcttaggccaaacaggcccatacaggaggccccagagactgcgcaagaggaccgagttcgcaggggataagttcaaagaggaaaaggttttcgaacctaatgaagaggcattgggggtggtcctgcacaaggactccaagtggtaccaacaatggaaagacttcaaggagaataatgtggtgttcaataggttctttgagatgaaaatgaagtacgacgagtcagacaatgctttcatccgagcttctagggcactgaccgacaaagtgaccgaccttctcggtggccttttttccaagacggaaatgtccgaagtccttactgaaattctcagagtagatcccgctttcgacaaggacagattcttgaaacagtgcgagaatgatataatcccaaacgtcttggaggccatgatatccggtgaactagacatcctgaaggattggtgctatgaggctacatattctcagctagcccatcctatccaacaagccaaagccctaggccttcagtttcactcacggattctcgatatcgacaatgtggatctggctatggggaaaatgatggagcagggtccagttctcattatcacctttcaagcgcagctggttatggtggtgagaaatcctaaaggcgaagtggtagaaggtgatcctgacaaggtgcttcgcatgctgtacgtgtgggccctgtgtcgcgaccaggacgaactcaatccgtatgctgcctggaggctgctcgatatttctgcctccagcacagagcagatcctgtag

SEQ ID NO: 244696 - DNA, 294 bp, Artificial Sequence
  Description of Artificial Sequence: Synthetic coding sequence
atggactcttcctcatcaagttctgcagcaggtctgggtgctgtagatcctcagctgcagcattttattgaagtggaaacacaaaaacaacggttccagcagttggttcaccaaatgacagagctgtgctgggagaaatgtatggataaaccaggacccaaactggactccagggcagaagcctgtttcgtgaactgcgtcgaacggttcattgatactagccagttcatcttgaaccgcctcgaacagacacaaaagtccaaacccgtgttttcagaatctctgagcgactag

SEQ ID NO: 244697 - DNA, 270 bp, Artificial Sequence
  Description of Artificial Sequence: Synthetic coding sequence
atggctgctcagatcccagagtcggatcagatcaagcagtttaaggagtttctgggcacttacaacaaactgaccgaaacatgtttcctcgactgcgtcaaggactttaccactcgtgaagtgaaaccggaggaaaccacctgctcggaacactgtttacagaagtatttaaagatgacccagcgtatctccatgcgattccaggagtaccacattcagcagaacgaggctctggctgctaaagccggactcctgggacaacctaggtag

SEQ ID NO: 244698 - DNA, 270 bp, Artificial Sequence
  Description of Artificial Sequence: Synthetic coding sequence
atggcagctcagattcccgagtctgaccagatcaagcagttcaaagaatttctcgggacatacaataaacttacagaaacttgcttcctggactgtgtcaaggatttcacgacacgagaggtgaaacctgaagaaactacttgttcagaacattgcctgcagaagtacctgaagatgacacaacgtattagcatgcggttccaggagtatcatatccaacagaacgaggccctcgccgctaaggctggactattaggtcagcccagatag

SEQ ID NO: 244699 - DNA, 135 bp, Artificial Sequence
  Description of Artificial Sequence: Synthetic coding sequence
atggcggctcagatccctgagagcgaccagattaagcaatttaaggaatttctgggaacctataataagcttactgaaacatgctttttggactgtgtgaaagatttcactacgcgtgaggtgaagccagaatag

SEQ ID NO: 244700 - DNA, 270 bp, Artificial Sequence
  Description of Artificial Sequence: Synthetic coding sequence
atggcagcccagatcccagaatcggatcagattaaacaatttaaagagttcctgggcacctacaacaaattgaccgaaacttgcttcctggattgcgtcaaagattttactacaagggaagttaagcccgaagagactacgtgcagcgagcactgtcttcagaagtacctgaagatgactcagcgtatctccatgcgatttcaggagtatcacattcaacagaatgaagcactcgcagccaaggccggactgctgggtcagccccgatag

SEQ ID NO: 244701 - DNA, 270 bp, Artificial Sequence
  Description of Artificial Sequence: Synthetic coding sequence
atggccgctcaaatccccgagtctgatcagatcaagcagttcaaagagtttctggggacctataacaaactgaccgagacatgtttcttggattgcgtaaaagatttcaccaccagggaagtcaaacctgaggagacgacatgctctgaacactgcctgcaaaagtacctgaagatgactcagcggatttctatgcgcttccaggagtaccatattcagcagaatgaggccctggccgcaaaagccggactccttggccaaccgaggtag

SEQ ID NO: 244702 - DNA, 381 bp, Artificial Sequence
  Description of Artificial Sequence: Synthetic coding sequence
atgcctttctttggaaatactttctcgcctaagaagacaccacccagaaaatccgcctctctcagcaacctacattctctggatcgctcaaccagggaggttgagctcgggctggaatatgggtccccaactatgaatttggctggtcagagcctgaaattcgagaacgggcaatggatcgccgagaccggcgtgtccggaggggtcgatcggcgagaggtgcagaggctcagacgcaggaaccagcagctggaggaagagaataaccttctccgcctgaaagtggacatacttctggacatgctttcggagagcactgccgaaagccacctaatggagaaagaactggacgaattacgaatctccagaaagaggaaatag

SEQ ID NO: 244703 - DNA, 1086 bp, Artificial Sequence
  Description of Artificial Sequence: Synthetic coding sequence
atggggaatgtgctggccgcatcctcacctcctgctggtcccccaccacctccagcaccggcactcgtcggactgccccctccgccaccgtctcctcccggatttaccctgccccctctgggaggttctctcggcgctggtacttctacatctagatcaagcgagcgaacccccggagccgcaacagcatcagcttcaggcgctgccgaggatggggcatgtggctgtctccccaatcccggtacatttgaagagtgccatcgcaaatgcaaagagctatttccaattcaaatggagggcgtgaagcttactgtaaacaaagggctgtcaaaccactttcaagtgaatcacactgttgctctttccaccatcggggagagcaactaccattttggagtcacatatgttggaaccaagcaactatcccccacggaggcgttccccgtgttggtcggagatatggacaactccgggtctctgaacgcgcaagttatacatcagctgggcccaggtctacggtcaaagatggccatccaaactcaacagagtaagtttgtaaattggcaggttgacggagagtacagaggatcggattttactgctgctgttaccctggggaacccagatgtgctagtgggaagcggcattctggttgcgcattacttacagagtattaccccctgcctagctctgggaggagagctggtctatcatagacgccctggtgaggaaggtactgttatgagcttagccggaaaatataccctgaacaactggttggctaccgtcaccttggggcaggcaggcatgcacgcaacctattatcacaaggcgtcagatcaactgcaggtcggtgtcgagtttgaagcctctactcggatgcaagacacttcggtcagtttcgggtaccagctggatctacccaaagccaatctgctgttcaaggggtccgtggactcgaattggattgtgggtgccacactagaaaaaaaactcccgccactgccgctgactcttgcccttggggcatttctaaatcaccgaaaaaataagttccagtgcgggttcgggctcactattggatag

SEQ ID NO: 244704 - DNA, 1086 bp, Artificial Sequence
  Description of Artificial Sequence: Synthetic coding sequence
atgggcaatgtactggctgccagttcccctcctgccggtccacccccaccccctgccccagcccttgtgggattaccccctccacccccttcccctcccggtttcacactgccccctctggggggttcactgggagctggcaccagcacatccagaagttcagagaggacacccggagccgcaacggccagcgcctctggggcagctgaggacggagcttgcggctgtttgccaaatcctggcacgttcgaggagtgccacagaaaatgcaaggaactcttcccaatccagatggaaggcgtgaagctgactgtgaataaaggcctttctaaccacttccaggtgaatcataccgtcgctttgtccaccattggtgaaagtaactatcattttggagtaacgtatgtcggaactaaacagctgtcacccaccgaggcttttccggtgttggtgggcgatatggacaattctggcagcctcaacgcccaggtcatccatcagctcggacctggactgcgctccaaaatggctatccagacccagcagagtaagttcgtcaactggcaggtcgatggcgagtaccgcggaagcgatttcacggccgctgtgacattgggcaatccggatgtcctggtgggctctggaatcctcgtggctcattatctgcagtctataactccctgtttggcattggggggtgaactagtctatcaccgcagaccgggtgaggaaggtacagtgatgtcacttgccggaaagtatacactgaataattggctagcgactgttacactgggccaggctggaatgcacgcaacatactaccacaaagcctctgatcagttgcaagttggggttgagttcgaggcctcgacgaggatgcaggatacatctgtgagcttcgggtaccagcttgatctgcctaaagctaacctgctgtttaagggctcggtggacagcaattggattgtcggcgctaccctcgagaagaagctgcctccgttgccgttgaccttggcgctaggagcttttctgaaccaccgtaagaacaagttccaatgcggtttcggcctgaccatcggatag

SEQ ID NO: 244705 - DNA, 1086 bp, Artificial Sequence
  Description of Artificial Sequence: Synthetic coding sequence
atgggaaacgtgctggccgcttccagcccccctgcagggccaccaccgcctcctgcgcctgccctagtgggcctccctcccccaccgcctagcccgcctggctttaccctccccccactgggcggatcccttggggcagggactagcacaagccgatcttccgagcggacacctggcgctgccaccgcttcagcttcaggggcagctgaggatggagcctgcggctgcctccctaatcccggtacgtttgaggagtgccataggaagtgcaaggaactgttccccattcagatggagggggtgaaactcaccgtgaataagggcctgtctaatcattttcaggtcaaccatactgttgccttgtccaccattggcgaatctaattatcacttcggggtcacctacgtaggcactaagcaactctcccccactgaggcgttcccggttttggtaggggatatggataatagtgggtcgctgaacgctcaggttattcaccagctaggacctgggcttagatccaagatggccattcaaacccaacagtctaaatttgtaaattggcaggtggatggagaatatagggggtcagactttaccgccgcagtgaccctcggcaatcccgatgttctggtagggtccggcatcctagtggctcactatttgcagtccatcacaccatgcctagcattgggcggtgagctggtctaccatcggaggcctggcgaggaagggacggtgatgtcactcgcaggaaagtataccctaaataattggctcgccacagtcaccctcggccaggcaggaatgcacgccacatattatcataaagcctctgatcagctgcaggtgggggtggagtttgaggcctccacacgcatgcaggacactagtgtaagtttcggctaccagctggatctccctaaggcgaacctgctcttcaagggcagtgtggattctaactggattgtgggagcaactttggaaaaaaagctgccccctctccctctgactttagccctgggtgcctttctgaaccatcgcaagaataagtttcaatgtggcttcggtctcactatcggctag

SEQ ID NO: 244706 - DNA, 453 bp, Artificial Sequence
  Description of Artificial Sequence: Synthetic coding sequence
atgccttcatccggctctgtgtcaaggtcccggcagcgcggacggtctatggcaagcaggggcttcgatgggtccagacggggttcactccggcgtgccggagctagagaaccacccagtgaggttatcgaggccgcagcacaggcctccggtagctgttggtcctccccgtttttctctgcttctacgccgagtgcggctgccactggtgtgccaggaccgaccgatatggccgctgtgctccagcaggtgctagagaggacggaactgaacaagctgcctaaatccgtgcaaaataagctggagaagtttttggctgatcagcaaagcgagatcgacggactgaaaggcaggcacgaaaaattcaaagtagagtcagaacagcaatactttgaaatcgagaaacgactttcccactcacaagagcgcctcgtcaatgagaccagagaatag

SEQ ID NO: 244707 - DNA, 7091 bp, Artificial Sequence
  Description of Artificial Sequence: Synthetic coding sequence
atggcagcggtgctgcaacaggtactggagcggacagaactgaataagctccctaagtctgttcagaacaagctagagaagttcttggcagaccagcagtccgaaattgatggtcttaaagggagacacgagaaatttaaagtggaatcagagcagcaatacttcgaaatcgagaaacgactgtcccacagtcaggaacgcctggtaaacgaaacgcgtgagtgccagagcctgcgactggagctcgaaaagcttaacaaccagctaaaagccctcaccgaaaagaacaaggaactcgaaattgcgcaggatagaaatatagcaatccagtctcagttcacgaggacgaaggaggaattagaggccgaaaagagagacttaattcgcactaacgagagactgtcccaagagctagagtatctcactgaggacgtcaaacgcttaaatgagaaactcaaggagtcgaacacaactaagggggaactgcagctgaaactggatgagctgcaagcgtccgatgtcagtgtgaaatatcgcgagaagaggctcgagcaggaaaaagagctgctgcactctcaaaatacttggctcaataccgagctaaagactaagacggacgagctacttgccctgggacgggagaaaggaaacgaaatcctggaactcaagtgtaacctggaaaataagaaagaggaagtctccagactcgaggagcagatgaacggcctgaaaacgtccaacgaacatctccaaaagcacgtggaggatttactgaccaagttgaaagaggctaaggaacagcaggcctctatggaagagaagttccataacgagctgaacgcacacattaagctctcgaatctgtacaaaagcgcagccgatgacagcgaggccaaatccaatgagttaacaagggcagtggaggaactccacaaactgcttaaagaagctggtgaagcaaacaaggcaatacaggatcatctcctggaggtggaacagagtaaagaccaaatggaaaaagaaatgcttgaaaagattggaagattagagaaagaacttgagaatgccaacgacctgttgtcagccaccaagcgcaagggcgctatcttgtcagaggaagaattggccgcaatgagccctaccgctgccgcagtggccaagatcgtaaagcctggtatgaaacttacggaattatacaacgcatacgttgagacccaagaccagctcctgctcgagaagctggaaaataagcgcataaacaaatacttggacgagattgtaaaggaggtggaggctaaggctcccatcctgaaacgccagcgggaagaatacgagcgtgcacagaaagccgtggctagcctgtctgtaaaactggagcaggcaatgaaggagatacagagactgcaggaagataccgataaggctaataagcagagctccgtcttggaaagggacaatcgacggatggagatacaggtgaaagatctgtctcagcagatccgtgtactactgatggaactggaggaagccagaggtaaccacgttatccgcgacgaagaggttagttctgccgatattagttccagttccgaggtgatctcacaacatctggtttcttatcgtaatattgaggagctgcagcagcagaatcagaggctgctggttgccctgcgcgaattgggagagacccgcgaaagagaggagcaggaaacaacttcgagcaaaatcactgaactgcagttaaagctggagtcagcactgacagagctcgaacagttgaggaaatctagacagcaccagatgcagctggtcgacagtatcgtccgccaacgggacatgtatcgcatcctgctcagccagacaaccggtgtggccatccctctccacgccagttcgctggatgatgtctcactggcaagcacaccaaaacgcccatcaacatctcaaaccgtgagcactcctgctccagtgcctgtgatagaaagcactgaggccatcgaagctaaagccgcacttaaacagctacaggaaatctttgaaaattataagaaagagaaagctgagaacgagaagatccagaacgagcaactcgagaagctacaagaacaggtgaccgacctgcgatctcagaacaccaagatcagcacacagctagactttgctagcaagcgctacgagatgttgcaggataatgtagaaggttacaggagggaaattacatccctgcatgagcgaaatcaaaagctgaccgctacaacacagaagcaggagcagatcattaatactatgactcaagatctgcggggagccaatgagaagctggcggttgctgaagttagagctgagaacctgaagaaagaaaaggaaatgcttaagctgtcggaagtgagactgtcccaacaacgggaatcactgctagcagaacaacgcggtcagaacctgctcctaaccaatctccagaccatccaaggcatccttgagaggtcagaaaccgaaaccaagcagcggctgagcagccagattgagaagctcgaacatgagatttcacatctgaagaagaaactcgagaacgaggtggagcagcgccacacactcacaaggaatctggatgtccagctgttggacacaaagaggcagctggacaccgagaccaacctgcacctgaatactaaagagctgctaaagaacgcccagaaggaaatagctacactaaaacaacacctgtctaatatggaagtgcaggtggcatcccagagttcgcaaagaaccggaaagggacagcccagcaacaaggaagatgtcgatgacttagtgtctcagttacgccagacggaggaacaggtgaacgacctgaaagagcgcctgaagacctccacgtccaatgttgaacagtatcaagccatggttacctctctggaagagtccctgaataaggagaaacaggtgacggaggaagtgcgcaagaacattgaagtgaggcttaaagagtccgctgagtttcagacccagctggaaaagaagttaatggaggtcgaaaaggaaaagcaggagctgcaggacgataaacgcagggcaattgagtctatggagcagcaattatcagaactgaaaaagaccttatcctccgtgcagaacgaggttcaggaagccctgcaaagagcaagcaccgcgctgtctaacgaacagcaggctcgaagagactgtcaagagcaggcaaaaattgccgtggaagcgcagaacaagtacgaacgcgagcttatgctgcatgccgcagatgtggaggccctacaagcagcgaaagagcaggtctcaaaaatggcctctgtccgacaacacctggaagaaaccacccagaaagccgagagtcaacttctggaatgtaaggcctcctgggaagagagggagcgaatgctgaaggatgaggtctccaagtgcgtttgccgttgcgaggacctggagaaacagaaccggcttttgcacgaccagatagagaagctgtcggacaaggtggttgctagcgtgaaagagggggtgcagggcccactgaatgtcagtttaagcgaggagggcaagtcccaggaacagatactcgagatactgcggttcattcgtagagaaaaagagattgccgaaacccgctttgaagtggcacaggtcgagagcctgaggtaccggcaacgcgttgagttgctagagagggagcttcaagagctgcaggattcccttaatgcagaaagagagaaggtgcaggtcaccgcaaaaacaatggctcagcatgaggagcttatgaaaaagaccgagactatgaacgtggtaatggagactaacaaaatgttgcgggaggagaaggaacggctcgagcaggatctgcagcaaatgcaggcaaaagtgcggaagctggagctggatatcctccccctgcaggaggcaaacgccgagttgagcgagaagagtggcatgttacaagccgagaaaaagttattggaagaggacgtgaaacgttggaaggcaaggaaccaacacctcgtgtctcagcagaaggatcctgacaccgaagagtacaggaaactcctgtccgaaaaggaggtgcatacaaagaggatccagcagctgacagaagagatcgggagactcaaggcggagattgccaggagtaatgcctcactgacaaataatcagaatctaattcagtctttgaaggaggacctgaacaaagtccgcaccgaaaaggaaactatacaaaaggacctggacgccaaaattatcgatattcaggagaaagtaaagacaatcactcaagtgaaaaagattgggagaagatacaaaacccaatatgaggaactcaaagcacagcaggataaggtcatggaaaccagcgcgcagtcttctggagaccatcaagagcaacacgtgagtgtccaggagatgcaagagttaaaggaaaccctgaaccaagctgagacaaagagcaaatcattggagtcccaagttgaaaacctccaaaagaccctttctgaaaaagagacagaggccaggaatctacaggagcagaccgtgcagctgcagtccgaactcagcagactgcggcaagaccttcaggatagaaccacacaagaagaacagctgagacagcagattacagagaaagaagagaagactagaaaagctatagtggccgcaaaatccaaaatcgcccatctcgccggagtcaaggatcagttgactaaggaaaacgaagagctcaagcaacggaatggagccctggatcaacagaaggatgaactggacgtccgaattacagcactcaagtcccaatatgaagggaggataagcagattggagagagagttgcgtgaacaccaggagcgtcatctggaacaacgagatgaaccacaggaaccatctaacaaagtgcctgagcaacagagacagataaccctcaagacaaccccagccagtggtgaaaggggtatcgcttctacatccgaccccccaacggcaaacattaaacctacccccgttgtctccacccctagcaaggtgactgccgcagcaatggcaggaaacaagtccaccccgcgtgcttctatccggcctatggttacacctgcaacggtcaccaaccccaccaccaccccgacggcaacagtaatgcctactacgcaggtggaaagccaggaggcaatgcagtcggaggggcctgtggagcatgtgcccgtctttggatcaaccagcggatcagtgcggtccacatccccaaatgtgcagccatccatcagtcaaccaattctcaccgtgcagcagcagacccaggcaactgcatttgtgcaacccactcagcagtctcacccacaaatcgagcctgccaaccaagaactgagcagcaacatcgtggaagtggtgcagagcagccctgtggagcggccttctacctcgaccgctgtctttgggacagtatcagctacccctagctcctctctacccaagcgcacaagagaggaggaggaggactccacaatagaagcatctgatcaggtttcggatgacacagttgaaatgcccctgccaaagaaattgaaatctgttactcccgtaggaacagaggaggaagtcatggcagaggagtcaaccgacggagaagtagagactcaagtctacaaccaggacagccaggactctattggtgagggggtaacccagggcgactacacgcccatggaggactccgaggaaacctctcagagcctccaaattgatctgggtccccttcagagcgatcagcagaccactacctcctctcaggacgggcagggcaaaggggatgacgttatcgtgatagactcagacgatgaagaggaagatgacgacgagaacgatggagaacacgaagattacgaagaggacgaagaggacgatgacgacgatgaggacgatacagggatgggggacgagggagaagatagcaacgaagggacaggaagcgccgatggtaatgatggctatgaagctgatgacgctgagggtggcgatggtactgaccctggcacagagacagaggagtccatgggaggcggagagggcaatcatcgggctgccgacagtcagaatagcggtgaggggaatactggggctgctgagagtagcttttcccaggaggtatcccgtgaacagcagccaagcagcgccagcgagaggcaggccccacgcgctccccagagtcccaggcggcctccccacccgctcccacctagactcaccattcacgctccgccacaagaacttgggcctccagttcagagaatccaaatgacaagaagacagagtgtgggacgcggtctgcagttgacccccggaatcggtggaatgcaacagcactttttcgacgatgaggaccggaccgtgccaagcacccctaccttagttgtgccgcatagaaccgacggcttcgccgaggccatccacagcccacaggtcgctggcgtccctagatttcggttcgggcctcccgaggacatgccacagacctcatcctctcactctgacctgggccagctagcatcgcagggcggattagggatgtatgagactcccctcttcttggcccatgaagaggagtcgggtggacggagtgtacccacaactcccctgcaggtcgcggcaccggtcactgtttttactgagtccaccacctccgacgcctcagagcatgccagtcagtctgtgcccatggtcactacgagcaccgggaccctgtccactaccaatgagaccgccacaggcgatgacggtgatgaggtgttcgtcgaggccgagtctgagggaattagctccgaggctgggctggaaatcgacagtcagcaagaagaagagcctgttcaggccagtgatgaaagtgatcttcctagcacctctcaggacccaccgagttcatcatcggtcgatacgtcctcttcccagccaaagccattccgcagggtgcgacttcagactactctgagacagggtgtgcgtggccgtcagttcaatagacaacgcggagtttcacacgcaatgggtggtaggggcggaatcaataggggaaatatcaatta

SEQ ID NO: 244708 - DNA, 453 bp, Artificial Sequence
  Description of Artificial Sequence: Synthetic coding sequence
atgccttccagcggaagcgtttctaggagtagacagaggggccgatcaatggcgtcccgcggattcgacgggagccgccgagggagcttgcggcgagccggtgccagggaacccccaagcgaggttattgaggccgcagcccaagctagcgggagttgctggagtagcccttttttcagtgctagcaccccgtcagccgcagcaacaggcgttcctggcccaaccgatatggctgccgtcctgcagcaggtgttagagcgcactgagctcaacaagttgccaaaatctgttcagaataaactggagaagttcctggccgaccagcagagtgaaatcgacggcctgaaaggaagacacgagaagtttaaagttgagtcggagcagcaatatttcgaaatcgaaaaacggctctcccactctcaggaacggcttgtcaacgaaacccgagagtag

SEQ ID NO: 244709 - DNA, 510 bp, Artificial Sequence
  Description of Artificial Sequence: Synthetic coding sequence
atggctcctccatgggtgcccgcaatgggtttcactctcgccccatcgctgggctgtttcgttggatcccgcttcgtccacggcgaggggctgagatggtacgccggacttcagaagcccagctggcatcccccacattgggtgctggggccagtgtggggtactctgtacagcgctatgggctatggtagttatctggtgtggaaggaactgggcggatttactgagaaagccgtggttcccctcgggctctacactgggcaactcgctctgaactgggcctggcctccaatttttttcggcgcaagacagatggggtgggctctcgtggatttgctgctggtttcaggcgctgccgcagccacaactgtagcgtggtaccaggtaagccctcttgcagcaagactgttgtacccctatctcgcctggctggcctttacaacgaccctcaactactgtgtctggagggacaaccatggctggcgtggaggcaggaggctcccagagtag

SEQ ID NO: 244710 - DNA, 510 bp, Artificial Sequence
  Description of Artificial Sequence: Synthetic coding sequence
atggctccaccatgggtgcctgccatgggcttcactctcgccccatctctcgggtgcttcgtcgggtctaggttcgtacacggcgaaggcctccgctggtatgccggactgcagaaaccaagctggcacccaccacattgggtgctggggcctgtatggggcacgctgtattccgcaatgggctacggaagttatcttgtgtggaaggaactgggcggattcacagagaaagccgtggtgcccctgggcttatacaccggtcagctagcccttaactgggcttggcctcccatcttctttggcgctcggcagatgggctgggccctggtggatctgctgctcgtgtcaggggcagccgcagcaacaacggtggcatggtaccaagtctctcctctggccgcacggctcctttacccctatctggcatggctggcctttacaaccaccttgaactactgtgtatggcgcgacaaccatggatggaggggagggagaaggctaccagagtag

SEQ ID NO: 244711 - DNA, 309 bp, Artificial Sequence
  Description of Artificial Sequence: Synthetic coding sequence
atggccccacatctgctttggtgtccaaccaacggcttgggccttggtgggtcaccagccggacagtggggtggtgggtcacactatagagggctggtgccaggcgaaccagccggacggcctccagccctccctctgcctgggctggccggtctacacgaccatacacagctcttgcgcatggccggacagccatggctagcatggggcacagccgcagccagggtgagcgcccgaccaaccagagattgttcatgtacctccaggtgccaccacgcctgtgatgtggtggctgtaaccctgtcgtag

SEQ ID NO: 244712 - DNA, 324 bp, Artificial Sequence
  Description of Artificial Sequence: Synthetic coding sequence
atggcccctccatgggtccctgccatgggttttacactggccccaagcttgggatgctttgtgggtagtcgctttgtgcatggtgaggggctccgctggtacgcgggactacagaagccttcctggcaccctccacattgggttctgggccctgtatggggcactctatacagcgctatgggctatggatcatacctcgtttggaaggaattgggaggattcacagagaaggccgtggtgccattgggtctctataccggccagctggcactgaactgggcttggcccccaatattttttggcgctaggcagatggggtggtag

SEQ ID NO: 244713 - DNA, 609 bp, Artificial Sequence
  Description of Artificial Sequence: Synthetic coding sequence
atgtgttatggtaagtgcgcccgatgcatcggccattcactggttggactcgctcttttatgcatcgccgctaatatacttctttattttcctaacggtgagacgaaatatgctagcgaaaatcacctgagcagattcgtgtggttcttttctggaatcgttggtgggggtttacttatgctgctgccggcatttgtgtttattggattggagcaggacgattgttgtggctgctgtggccatgaaaactgcggcaagcgctgcgctatgctgagttctgtactcgctgctctgatcgggatcgcgggtagcggctattgtgtgatagtcgcggcattgggccttgctgaaggccctctttgcctcgattcgttggggcagtggaattatacatttgcctctacggagggacagtacctgctagacactagtacttggagtgagtgtacagaacccaaacacatcgttgagtggaatgtttcgctcttttccattttgctcgctttaggagggatcgagttcatcctctgcctgatacaggtcattaatggggtgctgggtggaatttgcggcttctgctgctctcatcagcagcagtacgattgttag

SEQ ID NO: 244714 - DNA, 699 bp, Artificial Sequence
  Description of Artificial Sequence: Synthetic coding sequence
atgtgttatggaaaatgtgcacggtgcataggacacagcctggtcggactggctctcctctgcatagccgctaatatcttactatactttcccaatggggaaactaagtatgcttctgagaaccacctttccagatttgtgtggttcttctctggcatcgtgggtgggggactccttatgctattacctgcttttgtgtttatcggattggagcaggacgattgttgcggatgctgtgggcacgaaaattgcggtaagcgatgtgctatgctgtctagtgttctggccgctttgatcgggatcgccggtagcgggtattgcgttatcgtcgccgctctgggactggcggagggcccactttgcctggattctctcggacaatggaactacacattcgccagtactgaaggtcaatacctgctggacacatctacttggtccgagtgtacggagcccaagcacatagtagagtggaacgtgtccctgttttctatcctccttgcgttaggaggaatagaattcatcctgtgcctgatccaggtcataaatggtgtgctagggggaatatgcggattctgctgcagccaccagcagcagatgactgctaaacgcacaaaccccggacagtcccacaacctccccttgttccattgcaacctctacatctcattggttttcatttgtaaaaccctgtattag

SEQ ID NO: 244715 - DNA, 609 bp, Artificial Sequence
  Description of Artificial Sequence: Synthetic coding sequence
atgtgtaccggagggtgcgcacgctgtctgggcggaactctaatccctctcgcgttctttgggtttcttgctaatatcctgctgtttttcccagggggaaaggtcattgatgacaatgaccacctgagtcaggagatttggttcttcgggggtatactgggttcaggcgtcctcatgatatttcctgctcttgtcttcctgggtcttaaaaacaatgactgttgtgggtgctgtgggaacgaaggttgtggcaagagattcgccatgttcacaagtacgatctttgcagtggtaggcttcctcggcgctgggtactcctttattatatccgccatttccatcaacaagggtccgaagtgcctcatggctaactcgacatggggctacccttttcatgacggggattatctcaatgatgaagccctctggaacaagtgccgtgagccattaaatgtggtcccctggaacctgacgctcttctccatccttctggttgttgggggtatccaaatggttctgtgtgctattcaagttgtaaacggcctactgggaacactgtgtggggactgtcaatgttgcggctgttgtggaggcgacgggccagtatag

SEQ ID NO: 244716 - DNA, 594 bp, Artificial Sequence
  Description of Artificial Sequence: Synthetic coding sequence
atgtgtactggtaaatgcgctcggtgtgtgggcttgagcctcatcacactttgcctggtgtgtatcgtggctaatgcccttttgttagtccccaacggcgaaacatcatggactaataccaaccacctctcgttgcaggtgtggctgatgggcggtttcattggagggggactgatggttttatgtcccggaattgcagctgtacgagcaggcggaaagggctgttgtggtgccggatgctgtggtaatagatgccggatgcttcgctctgtattcagttctgcattcggagtcttaggtgctatttactgcctcagtgtgtccggtgccggactcaggaacggaccccgttgcctgatgaatggtgagtggggctatcattttgaagataccgccggtgcttatctgctaaaccgaaccctgtgggatcgatgtgaagccccaccacgggtcgtcccgtggaatgtgacactgtttagcctgctggtggccgcaagttgcttggagatcgttctgtgtgggatccaactggtaaatgccacaattggggtcttctgcggcgactgcagaaaaaagcaggatacgcctcattag

SEQ ID NO: 244717 - DNA, 438 bp, Artificial Sequence
  Description of Artificial Sequence: Synthetic coding sequence
atgtcagccagcgcggcaacaggcgttttcgtgctgtctctcagcgctataccagtgacgtatgtgtttaaccatcttgccgctcagcacgattcatggacaattgttggagtagctgcccttatcctgttcctcgtggcactcttggccagagttctggtgaagagaaagcctccgagggatcctctgttctacgtgtatgcggtcttcggctttacaagcgttgttaaccttatcatcggcctagaacaggatggcataatcgacggatttatgacccattacctgcgggaaggagagccttacttaaatacagcttacgggcatatgatttgttattgggatggctcggcgcactacctgatgtatctcgtgatggttgcagcaatcgcttgggagtgctggcatatctgtagcatccttttcctaaccctctag

SEQ ID NO: 244718 - DNA, 1113 bp, Artificial Sequence
  Description of Artificial Sequence: Synthetic coding sequence
atgagtgcttcagctgccaccggagtgtttgtgctgtcactatcggcaattcctgtcacttatgtttttaaccaccttgcagctcagcacgacagttggactatagtgggcgttgcagctctgattttgttcctggtggccctgcttgccagagtgctggttaaaagaaaacctcccagggatccgctgttttacgtgtatgctgtctttggtttcacctctgttgtgaacctgatcatcgggctcgagcaggatggcattatcgatgggtttatgacgcactatctgagagagggcgaaccatacctgaatacggcctacgggcatatgatctgctactgggacggctcagcacattacctgatgtacttggtgatggtcgctgccattgcgtgggaggagacctaccgcactattggcttgtattgggtcggctctattatcatgtcggttgttgtgtttgtgccaggcaatatcgtggggaaatatggtacaaggatctgtcccgctttttttttaagtatcccctatacgtgcctgccggtgtgggccggttttaggatttacaaccagccgtccgagaattataattacccatctaaggttattcaggaggcacaggccaaagacctgcttagacgaccgttcgaccttatgctggttgtgtgcctgctgctagcgacagggttttgtttgttccgaggactgatcgctctggactgcccctcagagctctgtagattgtacactcagtttcaggagccctacctgaaggatcccgctgcatatccaaaaatccaaatgcttgcatatatgttctattcggtgccatacttcgtcacagccctgtacggattggtggtgcctggctgttcctggatgccagatatcaccctcattcatgcagggggactggcacaggcccagttcagccatataggcgcttcgttgcacgctcggactgcctatgtttacagggtccctgaagaggcaaagatcttgttcctggcccttaatattgcctatggtgtcctgccccagctcctcgcgtaccggtgtatctacaaacccgaattcttcatcaaaactaaagccgaggaaaaagtggaatag

SEQ ID NO: 244719 - DNA, 1020 bp, Artificial Sequence
  Description of Artificial Sequence: Synthetic coding sequence
atgtccgcgtccgcagctaccggggtctttgtccttagtctctctgcaatccctgtgacatacgtgtttaatcatctggcggcacagcacgattcgtggactatagtaggagtggccgctctgatcctttttctggtggccttactggcgcgtgtgttggtgaaacgaaaaccacccagggatccattattctacgtgtatgccgtttttggatttaccagtgttgtcaacctcatcatcgggctcgagcaggacggtattatcgacggattcatgactcactatttaagagagggggaaccatatctgaatacagcctatggccatatgatctgctattgggatggaagtgcccactacttgatgtacctagtgatggttgcagccatagcatgggaggagacctatagaacaattggcctctactgggtaggttctattattatgtctgtggtcgtgtttgtaccaggaaacatcgttggaaagtacggtacaaggatctgccccgcattcttcttgtctatcccatacacttgcctccctgtgtgggcgggatttaggatttacaaccagccgtccgagaactacaactatccatccaaggttattcaggaggcacaggccaaagatttattgaggcgcccttttgacttaatgctggttgtttgcctgctgttggcaactggcttctgccttttccgtggactgatgctggcttatatgttctactctgtaccatatttcgtaaccgccctttatggtttggtagtccccggatgctcttggatgcctgacatcaccctcattcacgctggcggattggctcaagctcagttctcccacatcggagccagcttgcacgccagaacggcttacgtatatagggtgccagaggaggctaagattctgttcctggccttgaacatcgcttacggagtgcttccacagctgctggcttacagatgtatctataaaccggaattctttattaagacaaaagctgaagaaaaggtcgaatag

SEQ ID NO: 244720 - DNA, 1122 bp, Artificial Sequence
  Description of Artificial Sequence: Synthetic coding sequence
atgagtgcttcagcagccactggggtgtttgtcctgagcctgagcgccattcccgtcacctacgtgttcaatcatttggccgcacagcatgactcatggaccattgtgggggtggccgcactcatcctcttcttggtagccctactggccagggttctcgttaagcgaaagcctccgagggacccactgttctacgtctatgccgtctttggtttcacgagcgtcgtgaatctgataatcggcctggagcaggacggtataattgacggctttatgactcactaccttagagagggggagccttatctgaataccgcgtatggacacatgatctgctattgggatgggtctgcccattacttgatgtatctagtgatggtggctgctattgcatgggactgttacagagaaacatatcgcactatcggtctgtattgggtcggtagtatcataatgtccgttgtcgtattcgttccgggtaacatcataggcaagtacggcactcggatttgcccagccttcttcctgtcgatcccctatacatgcttgcccgtgtgggccggtttccggatatataaccagcccagtgagaactacaactacccttctaaagtgatccaggaggcccaggcgaaagacctcttaaggagacctttcgatctgatgttggtagtgtgtcttctcctggctactgggttctgcctcttcagagggctgatcgcactcgattgcccatcagaactgtgcaggctatacactcagttccaggagccttatctgaaggatcctgccgcatacccgaagattcagatgctggcgtacatgttctatagcgtaccatatttcgtgaccgcactctatgggctagtggtgcccggttgctcctggatgccggacataaccctgatccatgctgggggtcttgcccaggcacagttctcccatattggcgcatcactgcatgctcgcacagcctacgtgtaccgggtgcctgaggaggcaaaaatcctgtttttggcgctgaatatcgcctacggcgtcttaccccagttgcttgcctacagatgtatatacaaaccagagttttttatcaaaacgaaggctgaagagaaagtagagtag

SEQ ID NO: 244721 - DNA, 567 bp, Artificial Sequence
  Description of Artificial Sequence: Synthetic coding sequence
atgtcagcttcagctgccacaggagtatttgtgctcagtctgagcgccatcccagttacctatgtgtttaaccatctcgccgcacagcacgactcctggactattgtgggtgtcgctgccttgattcttttcctggtcgccctattggctcgagtactagtgaagcgaaagccaccacgcgacccgttattttacgtatatgccgtgttcggattcacctccgtggtgaacctaataatcgggctagaacaagatggtattatcgacgggtttatgacacattatctcagggagggcgagccctatttgaataccgcctatggacacatgatttgttactgggacggcagtgcccactacctcatgtacctggtgatggtggctgcgatagcctgggaggagacgtatcggactataggactgtattgggtgggttctatcatcatgagtgtggttgttttcgtccccggtaatatcgtggacgctgggatctatgttctcttttgttccttactgtgcgactgcaccgtttggcttagcggctcttggatgttcctggacgcttag

SEQ ID NO: 244722 - DNA, 1020 bp, Artificial Sequence
  Description of Artificial Sequence: Synthetic coding sequence
atgtcagcctcagctgcaaccggagtgtttgtgctcagcctgagtgcaatccctgtgacatacgtgttcaaccacctcgctgcccagcacgactcttggactattgttggagtagcggctctaatcctattcttggtggccctcctggctcgtgtcctggtgaagcggaagccaccaagagacccactcttttatgtgtatgccgtctttgggtttaccagcgtcgttaatctcatcattggactcgagcaggatggaattatcgatggatttatgactcactatctgcgagaaggtgaaccatatcttaacacagcttatggccacatgatctgttattgggatggatctgcacattatctaatgtatttagtgatggtagccgctattgcatgggaagaaacctatcgaaccatcgggctctactgggttggatcaatcattatgagcgtcgtcgtgtttgtgcctggcaacatcgtgggcaagtacggcactagaatctgtcctgcttttttcctatccattccttatacctgcttaccggtctgggccggattcagaatctacaatcagccaagtgagaactacaactatcctagcaaagtaatacaggaggcccaggctaaggatctgttaagacgcccatttgacctgatgctcgtcgtgtgtctgctgttggccaccggcttttgcctgtttcgcggactcatgctagcctatatgttttattccgttccctatttcgttacagcactctatgggctggtggtgccgggatgttcctggatgccagatataactttgatccatgcagggggtctcgcacaagcccagtttagtcatattggtgcctctcttcacgctaggaccgcatatgtttatcgtgtgccagaagaagccaaaattctgtttttagccctgaacattgcttatggcgtgctgcctcagctcctagcctatcggtgtatctataaacccgagttcttcattaagaccaaggccgaagaaaaggtcgaatag

SEQ ID NO: 244723 - DNA, 1056 bp, Artificial Sequence
  Description of Artificial Sequence: Synthetic coding sequence
atggatatcccccctctggccggaaagatcgcagctctcagcctgtccgccctgcctgtttcttacgctctaaatcacgtttctgcgctctctcatcccctgtgggtggccctaatgagtgctcttattctgggccttctgttcgttgccgtttactctctttcccatggagaggtatcttacgacccgctgtacgctgtattcgcagtgtttgcgttcacaagcgtagtggaccttatcatcgctctgcaggaggattcctacgtggttggcttcatggagttctataccaaagagggcgagccttacctcagaaccgcacatggagtctttatttgttactgggatggcacagtgcactatttattgtatctggccatggcaggcgctatttgtaggcgcaaacggtaccggaactttggcctgtattggctgggctctttcgctatgtcgatactcgtgttcttaaccggtaatatcttgggtaaatattcgagcgagatcaggcctgcttttttcctcaccattccctaccttctggtaccctgctgggccggtatgaaggtgttcagccagccccgtgccctcacacggtgcaccgcaaatatggttcaagaggaacagcgcaagggcctcctccagcggccagcagatttagcactggttatctacttgattctagcgggattttttacactgttccgagggctcgttgtgcttgattgtcctaccgacgcctgttttgtttacatctatcagtacgagccatacctgagggaccctgtggcttatcccaaagtgcagatgttgatgtacatgttctacgtgctgcctttttgtggccttgcggcttacgcactgacgtttcccggttgctcttggctgccagattgggctttggtgtttgccggaggcatcggccaagcacagtttagtcacatgggcgcttcaatgcacctccgaacaccatttacttatcgatgtcttcaatggcctgcattcttccatcagcccccaccttccgacccactcgcgctccataagaagcagcattag

SEQ ID NO: 244724 - DNA, 1134 bp, Artificial Sequence
  Description of Artificial Sequence: Synthetic coding sequence
atggacattcccccactcgctgggaagatcgcggctctcagcttgtccgcactgcctgtgtcctacgcactgaatcacgtctcagccctgagccacccactgtgggtggccttgatgtccgcactgatcctgggcttgttgttcgttgcagtgtattctttaagccatggagaggtgtcttacgatcccctatatgccgtgttcgcagtctttgccttcacaagcgtagttgacctcatcatagctctccaagaggacagttacgttgtcggttttatggagttttatacgaaggaaggggaaccctacttgcggaccgcacacggtgtgtttatatgttactgggatgggacagtacactatctgttgtatctggccatggccggagccatctgtagaagaaagaggtaccgaaatttcggcctgtactggctaggaagctttgcaatgtctattctggtattcctgaccggaaacatcctcggaaaatactcttccgaaatacgtccagccttttttttaaccatcccctatctgttagtgccatgttgggcaggcatgaaagtctttagtcagccgagggccctgacgcgatgcacagctaacatggttcaggaggagcaacggaagggcctcctgcagagacccgctgacctggcacttgtcatctacctcatcctggccggttttttcaccctgtttcggggactggtagtgttggactgcccaacagacgcatgctttgtgtatatctaccagtacgaaccatacctgagagaccctgtggcctacccaaaagttcagatgttgatgtacatgttctatgtgcttcccttctgcggcctagccgcatatgccctgacctttcccggttgtagctggctgccagactgggcgctcgtgttcgccggtggaatcggacaggcacagttctctcacatgggcgcatccatgcaccttcggacccctttcacctatcgagttccggaagatacttgggggtgtttcttcgtgtgcaatctgctgtatgcccttgggccacacctattggcatatcgatgcctccagtggccggcattcttccaccagcctccaccctctgacccgctggctctccacaaaaaacagcactag

SEQ ID NO: 244725 - DNA, 642 bp, Artificial Sequence
  Description of Artificial Sequence: Synthetic coding sequence
atggacatacctccactggcgggtaaaatagcggcattatctttgtcagcactgcctgtttcgtatgcccttaatcacgtgtctgctctgtcacacccactctgggttgccctcatgtctgctctgatcctcggtctgttgttcgttgctgtgtactccttaagtcatggagaggttagctacgacccgctctacgcagtgttcgccgtctttgcatttacatctgtagtggatctaattattgcgctgcaggaagactcttacgtcgttggctttatggagttctataccaaggaagtgttgggcggacgcccagggagccctctgccacattgcccatctgagtcccccacttgcccacacagagagagtcacacatgtgcacagagaacagaaagcagcagtgcaaccgggatggcactgttcacaacatcttccacttggccctggcccgctccaagcgccgaaggcgcaggaggtcgcgagcgggtggctcctgaccccggtagagaggtggcatctagtgatggtgttcccggacaaggtggagctcgttccgtgtgcagacgaaaccaagatgctagcctgggcctccagcccggagttgcacgaaggcggttccagggtaccagccaggtgtag

SEQ ID NO: 244726 - DNA, 1257 bp, Artificial Sequence
  Description of Artificial Sequence: Synthetic coding sequence
atggctcccactcaggggcctcgtgcacctctagaattcggaggtcctcttggggctgcagcactcctcctgctgctcccagcaaccatgttccaccttctcctcgcagcccgttcaggcccagccaggttattaggcccacccgcatcactccctgggctggaggtcctctggtctcccagagccctcctcctgtggttagcctggttgggtctgcaggccgcattgtacctgctgccagccagaaaagtggccgaagggcaagagctgaaagataaatccagactaagatatcccattaacggcttccaggcgctggtgttaacagctctgctggttggcctgggcatgtcagctggcctccctttgggagcccttcccgaaatgcttctgccgcttgcgtttgtggctacacttactgcgttcatattctccctgttcctatacatgaaggcacaggtggcaccagtgtctgccctggccccaggaggcaactcaggaaaccccatttatgactttttcctgggcagggaactaaacccacgtatttgtttctttgattttaaatacttctgtgagcttaggccaggcctgatcggatgggtgctgataaatctggcactcttgatgaaagaagccgagctgcgaggaagccccagcctggcaatgtggcttgtgaatggatttcagctgctgtacgtcggagacgctctgtggcacgaggaggccgttctgactacaatggacattacacatgatggattcggattcatgctcgcattcggagatatggcctgggtcccttttacctacagcctgcaagcacagtttctactccatcaccctcagccccttggtctcccaatggctagtgtcatctgtctgataaacgccacgggctactatatcttcagaggagctaattcccagaagaacactttcagaaaaaacccgagcgatccccgagtggcaggcctggagacaatctcaaccgcgactggtcgaaagctcttggtgtcaggatggtgggggatggttcggcacccgaattacttgggtgacctgatcatggcgctggcttggtccctgccctgtggcgtatcccaccttctgccctatttctacctgctctatttcacagcgctccttgtgcaccgggaagcgcgtgatgagagacagtgcctccagaaatatgggcttgcttggcaagagtattgtcgtcgcgttccgtacagaatcatgccatatatttattag

SEQ ID NO: 244727 - DNA, 1176 bp, Artificial Sequence
  Description of Artificial Sequence: Synthetic coding sequence
atggcacccacgcagggtcccagagcccctctggaattcgggggtcctctcggggctgctgccttactgctgctcctcccagcaacaatgttccatcttctactagccgcaaggtccggacccgctcgactgctcggaccaccagcctctttacctggcttggaagtgctgtggtcccctagggccctgctgttgtggctggcctggctcggactccaggccgctttatacctgctccctgccagaaaggtggcagaagggcaggagctgaaagacaagagtagactaagataccctattaatgggttccaggcccttgtactgacagctctgcttgtggggttaggaatgagcgcgggattgccgcttggggcactcccagaaatgttgctgccactggcattcgttgctaccctgaccgcatttatcttttcactttttctgtacatgaaagctcaggtagctcctgtgagcgctctggctcccggaggaaacagcggcaatcctatttacgacttcttcctgggaagggagctgaaccccagaatttgcttcttcgacttcaaatacttttgtgaactgagaccaggactgattggctgggtgctcataaatctggcgctgttgatgaaagaagcagaattgcggggttctcctagtcttgccatgtggctcgtcaacgggtttcagttgctctatgtcggtgatgcgctttggcacgaggaagcagtattaactaccatggatatcactcacgatgggtttgggtttatgctcgcttttggagatatggcatgggtcccattcacatactccctgcaggcgcagttcttgctgcaccatccacagcccttgggactccccatggcatccgtgatctgcctgatcaacgggctggagactatctcaaccgccacaggcaggaaacttctcgtctctggctggtggggaatggttcgtcatcctaattacctaggcgacttgataatggctttggcatggagcctgccttgtggagtgagtcacctgctgccttacttttacctgctatattttactgccctgcttgtgcacagagaagcccgagacgaacgacagtgcctgcagaaatacggcctggcctggcaggagtattgtaggcgcgtcccttacaggataatgccctacatttactag

SEQ ID NO: 244728 - DNA, 909 bp, Artificial Sequence
  Description of Artificial Sequence: Synthetic coding sequence
atgtctgcagggctgcccctcggcgctcttcccgagatgttgctccctctggccttcgtcgctacattgacagcattcatattcagtctgtttctctacatgaaagctcaggtcgcccctgtttcggctctcgcgcctggcggaaacagcgggaatccaatctacgatttctttctgggaagagagcttaaccccagaatctgtttctttgatttcaagtacttttgcgagttgcgcccaggactaatcggatgggtgctcattaatctggccttgctcatgaaggaggccgagttgaggggatctccctctcttgcgatgtggttagtcaacggctttcaattgctctatgtgggggatgctttatggcatgaagaggccgttcttaccaccatggatatcactcacgacggttttggattcatgctggcctttggggacatggcttgggtgcccttcacatactcgctgcaagctcagttcctcctccaccaccctcagcccttgggcctcccgatggcaagcgtgatttgtctgatcaacgccacagggtactatattttcaggggcgctaattctcagaagaacactttccgcaaaaacccatccgacccccgagtcgctggcctggagacaatctcaactgccactggacggaaacttctcgttagtggatggtgggggatggtaagacaccccaactacctgggcgatctgatcatggcactggcctggtcgttaccttgtggcgtgtcccacttactgccctatttttacctactgtattttacggcccttctagtgcaccgcgaggccagggacgaaagacaatgtctgcagaagtatggactggcttggcaggaatattgtaggcgcgttccctacaggatcatgccatatatctattag

SEQ ID NO: 244729 - DNA, 1713 bp, Artificial Sequence
  Description of Artificial Sequence: Synthetic coding sequence
atgggctttctgcagctgctcgtggttgcagtgctggccagtgaacatcgggtggccggagccgcagaggtcttcggcaacagcagtgaaggacttatcgagttttccgtgggcaaattcagatattttgagctgaacagaccattcccagaagaggccatcctgcatgatatctcttccaatgtaacattcctgatcttccagatccacagtcagtaccagaacactacggtgagcttctcacccacattgctgagtaattcttccgagacaggtaccgcgtccggcctggtgttcattttgagacccgagcagtccacttgtacatggtacctgggaacttccggcattcaaccagtgcagaacatggcaatcctcctctcttacagcgagcgcgatcccgtgcccggtgggtgcaatctggagtttgacctagacatcgaccccaacatatatctcgaatacaactttttcgaaaccactattaaatttgcccctgccaatctaggctacgctaggggtgttgacccacccccttgcgacgccggaactgatcaggactcacggtggagactacagtatgacgtataccaatacttcctgccggaaaacgatctgaccgaagaaatgcttctcaagcatcttcagcgaatggtgagcgtgcctcaggttaaagctagcgccttgaaggtcgtgaccctaacagccaatgacaagaccagtgtttctttttcatccctcccaggccagggcgtgatatataacgtcatagtgtgggatccctttctgaacacgtcggccgcatatatccctgctcacacgtatgcctgctcctttgaggctggagaggggagttgtgcaagcctgggcagggtcagctccaaagtgttttttacactctttgctttactgggattctttatttgcttctttgggcatcgattctggaagacggagttgttttttataggctttatcataatgggattctttttctatatcttaatcactagactcacacccattaagtatgacgtcaatctaatcctgaccgcggtgactgggagcgtgggtgggatgttcttagtggccgtgtggtggaggttcggtatactttctatttgcatgctgtgtgtgggactggtcctcggctttctgatatcatcagtgaccttcttcacccccctgggaaatctgaaaatttttcacgacgacggggtgttttgggtgaccttcagctgcatcgccatcctaatacccgtggtgttcatgggctgtctgagaattctcaatattttgacctgtggtgttattggtagttatagtgtggtcctggctatcgattcttattggtccacaagcctgtcttatattacactgaacgtcctgaagcgcgctcttaacaaagacttccatcgcgcttttacaaacgtcccttttcagacaaacgatttcataatactagccgtttgggggatgctggctgtttctggtatcactttacaaatccggagggagcgaggccgacccttttttcctccacacccttacaaactgtggaagcaggagagagagcggagagtgacaaatatactagaccctagctaccatatcccacctctccgagagcggctttatggccgtctgacccagatcaagggtctattccagaaagaacaaccagccggagaacgaactccccttttactgtag

SEQ ID NO: 244730 - DNA, 351 bp, Artificial Sequence
  Description of Artificial Sequence: Synthetic coding sequence
atggggttcctgcagctgctcgtggtggcagtgcttgcctccgagcaccgcgttgctggtgctgccgaggttttcggaaattcttccgaggtgtacctggtagtgggattgattgaatttagcgtaggcaagttcagatacttcgaactgaatagacccttccccgaagaagccatcctgcacgacattagttcaaatgtgacttttcttattttccagatacactcccagtaccaaaacaccaccgttagcttttcgcccaccctcctcagtaattccagtgagactggaacagccagcgggctggtatttatcttgagacctgagcagagcacctgtacttggtattag

SEQ ID NO: 244731 - DNA, 1413 bp, Artificial Sequence
  Description of Artificial Sequence: Synthetic coding sequence
atgggtatctggacctccggtaccgacatctttctaagcctatgggaaatatatgtgtcgccccgtagccccggttggatggacttcatccagcatctcggggtgtgctgtctggtggccctcatctcggtcgggttgctctctgtggctgcctgctggttcctgccttctataatagcagctgctgccagctggattataacctgcgttttgctttgctgcagcaagcacgccaggtgtttcattctgttggtgttcctgtcatgcgggttgagggagggtcgaaacgcattaattgccgctggaacggggatagttatactcggtcatgtggagaacatcttccacaacttcaaaggcttgcttgacggcatgacgtgcaatctccgggctaaatctttctctattcacttccctttactgaaaaagtacatcgaggccatccagtggatctatgggcttgctaccccgctgagcgtcttcgacgacctcgtttcttggaaccagacacttgccgtgagcctgttcagcccatctcacgtgctggaggctcaactgaacgatagtaaaggcgaggttctaagcgtgttgtaccagatggccaccaccaccgaagtgcttagctcacttggccagaaactgctagcatttgcagggttgagtctcgtactgcttgggacaggcttgttcatgaaacgttttttgggtccctgcggctggaaatacgagaacatctatattacccgccagtttgtgcaatttgatgaacgcgaacgacatcagcagcgcccatgcgtgcttccactcaacaaggaggagcgtcgtaagtatgttatcattcctaccttctggcccactccaaaggagcgtaagaatctgggactcttttttctgcctattctgatacacttatgcatctgggtgctttttgcagcggtcgactatctgttgtatcgcctgattttcagtgttagcaagcagttccagtctctgccgggattcgaggttcacctaaaactgcatggtgaaaagcagggtactcaggatattattcacgacagttcattcaatataagtgtcttcgaaccgaactgtatcccaaagccaaaattcctgctgagtgaaacttgggtccccctttccgtgattctactgatcctggtgatgctggggctgctttcttcaattctgatgcaactgaagatcctggtttccgccagtttctaccccagcgttgagcggaagcgaatccaatacctgcacgccaaactgttgaaaaaacgcagtaagcagcctctaggggaagtaaagcgacgcttgagcctctacctgactaaaatccatttttggctacctgtgctgaaaatgatcaggaagaagcagatggatatggccagcgccgacaagtcctag

SEQ ID NO: 244732 - DNA, 567 bp, Artificial Sequence
  Description of Artificial Sequence: Synthetic coding sequence
atgagtacaatgtttgccgacactctgcttatagtcttcattagcgtatgtactgctttgttggcggagggcataacttgggtgctggtttacagaactgataaatacaaacgtctgaaagccgaagtcgagaagcagagtaagaagttagagaaaaagaaggaaaccatcaccgagagtgccggtcgccaacaaaaaaaaaaaattgagaggcaggaggaaaaactcaagaacaataacagggatctgagtatggtgaggatgaaaagtatgttcgctatcggcttttgcttcaccgccttgatggggatgttcaactccatcttcgacggcagggtggtcgctaagctcccttttacgccccttagttatatccaggggctgtctcaccggaacctgctaggggacgacaccaccgactgttcatttatcttcctgtacattctgtgtacaatgagcatccgccaaaacatccagaagattcttggcctggccccaagccgggcagccaccaaacaggccggaggcttcctgggtcccccaccgccttcaggcaagtttagctag

SEQ ID NO: 244733 - DNA, 510 bp, Artificial Sequence
  Description of Artificial Sequence: Synthetic coding sequence
atgagcactatgttcgccgacactttgctgattgtgtttatcagcgtatgtactgccttgctggctgaaggaatcacttgggtactggtctatcgcacggataagtacaagcggctcaaagcggaggtcgaaaaacagtctaagaagttggaaaagaaaaaggagactattaccgaatccgctgggcgtcagcaaaaggtgcgcatgaagtctatgttcgccatcggcttttgcttcaccgcccttatgggtatgttcaacagcatctttgacgggagggtcgttgcgaagctccccttcactccactttcctacatccagggactgtcgcacaggaatctgctgggggacgatactactgactgtagtttcatctttctgtatatcctatgtactatgtcaattcgccagaatattcaaaaaattctaggtcttgcaccctctagagccgctaccaagcaggctggcggattcttagggcctccacctccaagcgggaaattctcatag

SEQ ID NO: 244734 - DNA, 603 bp, Artificial Sequence
  Description of Artificial Sequence: Synthetic coding sequence
atgatgcattacgtagactactctatgatgtaccacttgattcgcggtcagagtgtcatcaaactctacataatttacaatatgctcgaggtggccgacagactattcagttctttcggccaggacatcctggatgcgctgtactggactgccacagaacccaaagaacgaaaacgtgctcacataggatttgtggaaattaaaggctcagtcttcaaaaagttcgagaagaataacctgttccagatgagcaactctgatatcaaagagaggttcaccaattacgtgctactgctcatagtctgcttgaggaatatggagcagtttagctggaaccctgatcacttgtgggttttgtttcccgatgtgtgcatggttatcgcatccgaaattgctgtagacattgttaagcatgcctttatcactaaattcaacgacataacagccgacgtgtactccgagtacagagccagtctggcatttgacctggtttcatcacgtcagaaaaatgcctacaccgattactcagacagcgttgccaggagaatgggatttatcccactgcccctggcagttctggtcgatatcccagagagtacatag

SEQ ID NO: 244735 - DNA, 1371 bp, Artificial Sequence
  Description of Artificial Sequence: Synthetic coding sequence
atggtgttcggtatctttctttgcctggacgccttcctctatgtgttcacactgctgcccctccgtgtgtttctggccctgtttcgcctactcactcttccttgctatgggctgagagacagacggctcctacagccagcccaagtttgcgatatcttgaagggagtgattctcgtgatatgctatttcatgatgcattacgtcgactatagcatgatgtaccacctcatccgaggtcagagcgttattaaactctatataatatataacatgttggaggtcgctgatcggctgttctcttctttcggccaggacatcctggatgcgctttactggactgccaccgagcctaaagagcgaaaacgagcacatattggagtaattccccattttttcatggccgtgctgtacgtgtttctgcacgcgatcctgataatggtacaggctacgactctgaatgtcgcgtttaactcccacaacaagtcactcctgacaatcatgatgtcaaacaacttcgtagaaatcaaaggaagcgtctttaaaaagtttgagaagaacaacctgttccagatgagcaactctgatattaaggagagatttaccaattatgtgctgctgttaatagtctgtctgcggaacatggagcaattctcctggaatcctgatcatctgtgggttcttttcccggacgtttgcatggtgatcgcctctgagatagctgtggatatcgtgaaacatgcttttataactaaatttaacgacataacagcagatgtttattcagagtatcgggcttctctggcctttgacctagttagctcaaggcagaaaaacgcgtacacggactactccgattcagtggcacgccgaatggggtttattccactgccacttgcagtgttactgatccgggtggtcacgtctagtattaaggttcagggaattctgtcttacgcctgtgtgatcctcttttattttgggttgatttctttgaaggtgctgaacagcatcgtgttgctgggcaagtcatgccagtatgtgaaagaggccaagatggaagaaaagctgtcaaatccacccgcaacctgtacgcccggtaaacccagcagcaaatcccagaacaagtgcaagccgagtcaagggctgagcaccgaggaaaatttatcggcctcaatcacaaaacaaccaattcatcagaaagagaatattattcccttactggttaccagtaactctgaccagtttctgaccactcccgacggggacgagaaggacattacccaggacaactctgagctcaagcatcggtccagcaagaaggaccttttagaaattgaccgctttactatttgtgggaacagaatagattag

SEQ ID NO: 244736 - DNA, 1704 bp, Artificial Sequence
  Description of Artificial Sequence: Synthetic coding sequence
atggcaggagtgggggacgcggcagcccctggcgaaggcggaggaggcggagtggatggccctcagcgtgatggacgaggagaggccgagcagcccggtggttctgggggtcagggcccacctccagctccacagcttaccgagacccttggcttctacgagtctgacagacgcagagaacggcgacgaggaagaacagagctaagcctgctgcggtttctgtctgccgagctcactcggggatatttcctggaacacaatgaggctaaatacactgaacgacgggaacgagtgtatacatgccttcgcattcctagagagcttgaaaagctcatggtttttggtatcttcctttgtctcgacgctttcctctacgtgttcactctcctcccactgcgcgtgttccttgctcttttccgactactgactctgccatgctacgggctcagagaccgccgactgctgcagcccgctcaggtgtgcgacatcctaaaaggtgtaatccttgtgatctgctacttcatgatgcactacgtcgattattccatgatgtaccacctaatccgagggcaatctgtaatcaaactgtatataatttacaatatgctggaggttgcggatagactcttttcatcatttgggcaggatatactcgacgctctctactggaccgcaacagaaccgaaagaacggaaaagggctcacatcggggtcattccacattttttcatggcggtcctctacgttttcctccacgcaatcttgatcatggtacaggccaccactctcaatgtggcatttaactctcacaataagtccctccttaccatcatgatgagtaacaattttgtcgaaattaaggggagcgtgtttaaaaagttcgaaaaaaataacctgttccagatgtccaactcagacattaaggagcggtttaccaactatgtcctcctgttaatagtgtgccttagaaacatggagcagttctcttggaatccggaccatttgtgggtcctgtttcccgatgtgtgcatggttatcgcctccgagatagccgtggatatcgttaaacatgccttcatcaccaaatttaacgatatcactgccgacgtgtattccgagtatcgcgcatcactcgctttcgacctggtttcttcaaggcagaagaacgcctacactgactactcggactctgtggcccgacggatgggcttcattccgctgcccctggccgtgctgttaatccgggtcgtaacctcctctatcaaggttcagggaattttgagctacgcatgcgtgatcctattctactttggcctcatctcattaaaggtactgaacagcatcgtgttattggggaagagttgccagtacgtaaaggaggcaaagatggaggagaaattatcaaacccacccgctacctgcacacctggtaagccaagtagtaaaagtcagaacaagtgtaagccatcacagggtctcagcactgaggaaaatctgtctgcaagtatcacaaaacagcccattcaccagaaggagaacattatccccctgttggttacatctaactccgatcaatttcttaccacacctgatggagacgagaaggacattactcaggataacagtgagttgaagcaccgcagctccaagaaagatcttctggagatagaccggtttactatctgcggcaaccggatagactag

SEQ ID NO: 244737 - DNA, 1689 bp, Artificial Sequence
  Description of Artificial Sequence: Synthetic coding sequence
atggcaggggtgggcgatgcagctgcacccggagaaggcggtggaggcggtgtggacggccctcagcgggacggcaggggagaggcagagcagccaggaggatcaggtggccaagggcctcctcctgcccctcaactgactgaaaccctgggcttctacgaaagcgaccgcagacgggagcgcagaaggggacgcacagagctgagtctactgagatttctctctgccgaattgacccgcggatattttctggagcacaacgaggctaagtatacagaaagacgagagagagtgtacacctgtctccgaatacccagagagttggaaaagcttatggttttcggtatttttttatgtttagacgctttcttatatgttttcacgctcttaccattgagggtgttcttagccctctttcggctactgaccctcccttgctacggactccgggaccgacgattgctccagccagcccaggtgtgtgatatccttaagggtgtgatcctggtcatctgttacttcatgatgcactacgttgattacagcatgatgtatcatcttatcagagggcagtcggttatcaagttgtatatcatctataacatgctcgaggtggcagacaggctgttcagctcattcggacaggacatcctggatgcgctctactggaccgctactgaaccaaaggagagaaagagagcgcacataggcgtcattcctcacttctttatggctgttctatacgtatttctgcacgctatcctgatcatggtccaggcaacaacactgaatgtggcttttaattcccataataaatccctgctgaccataatgatgtctaacaactttgtggagatcaaaggcagtgttttcaaaaagttcgaaaaaaacaatttattccagatgagcaatagcgacatcaaggagagattcaccaattatgtactgctactgattgtctgcctgcgaaatatggagcagttttcttggaaccccgatcacctgtgggtgctgttcccagacgtgtgtatggtgatcgcgagcgaaattgctgtcgacattgttaaacacgcatttatcacaaagttcaatgatataaccgctgacgtgtattccgagtatagagcatccctcgcctttgacctcgtgtcatcccgccaaaaaaatgcctacacggactacagtgactccgtggccagaagaatgggctttatccccctgcctcttgccgtcctgctgattcgagtcgttacgagctctatcaaagtccaagggattctgtcttacgcgtgcgtgatactgttctatttcggcctgatttcactgaaagttctgaacagcattgttttactaggcaaaagttgtcagtacgtcaaagaggccaaaatggaagagaaactctcaaatccaccagccacatgcacaccaggaaaaccatcgtcaaagagtcagaacaagtgcaaacctagtcaaggtctttctaccgaagagaacctgagcgcatccatcacaaagcagcccattcaccagaaggagaatatcatccctcttctggttacatctaactctgatcagtttctaacaacccccgatggcgatgagaaggacatcactcaagacaactccgagttaaagcaccgcagttccaaatccgttctgctgtgccagtcgggccttcccgaatgctag

SEQ ID NO: 244738 - DNA, 2283 bp, Artificial Sequence
  Description of Artificial Sequence: Synthetic coding sequence
atgtcacccaagaaggtgcagatcaaggtcgaagaaaaagaggatgagaccgaggaatctagctcagaggaggaagaggaggtggaggataagcttcccaggcgagagtcattgaggcctaagcgaaagaggacccgagacgtgatcaacgaagacgaccctgagcccgagcccgaagatgaggagacgagaaaggctagggaaaaagaacggagaaggagactcaagcggggagcagaggaagaggagatcgacgaggaggagctcgagagactgaaagccgaattggacgaaaaacggcagatcattgctacagtaaaatgcaagccatggaagatggaaaaaaaaatagaggttctgaaagaggccaagaaatttgtgtctgagaacgagggagcccttggaaaaggaaagggcaaaagatggtttgcctttaagatgatgatggcaaagaagtgggccaagttcctgagggatttcgaaaatttcaaagcggcatgtgtaccctgggagaataagatcaaagcaattgagagtcaatttggcagtagtgtggctagttatttcctcttcctgcgttggatgtacggtgtcaacatggtgttgttcattcttaccttcagcctcatcatgctacccgaatatctgtggggcctgccatacggttccctgcccaggaagacggtcccgcgagccgaggaagcttccgccgctaacttcggcgtactgtatgattttaatgggttagctcagtacagcgtgctgttttacggttattacgacaataagaggaccattgggtggatgaatttccggttgccacttagctattttctggtgggcatcatgtgcatcggctacagctttttggtggtgctcaaggctatgacgaaaaacataggcgacgacggcggaggggatgacaacacctttaatttctcatggaaggtctttactagctgggactacctcattggtaaccccgaaactgccgataacaaattcaattccattacaatgaattttaaggaggcaattaccgaggagaaggctgcccaggtcgaagaaaacgtgcaccttatcagattcctgcggttcctggcaaattttttcgttttcctgacccttggaggatccggctacctgatcttctgggctgttaagcggagccaagagttcgcacagcaggaccctgataccctgggatggtgggagaagaacgagatgaacatggtgatgtctctcttggggatgttttgcccgaccctgtttgacttgtttgcagaacttgaagactaccatcctctgatcgctctgaaatggctgctgggtaggatatttgcccttttgttggggaatctgtatgttttcatccttgccttaatggatgagataaacaataaaattgaagaggagaaacttgtgaaagcgaatattaccctatgggaagccaatatgatcaaagcatacaacgcttcctttagcgagaactcaactggccctccctttttcgtccaccctgccgacgtgccccgaggcccatgctgggaaactatggtgggtcaggagtttgtgaggctgaccgtgagtgacgttctaactacctatgtaacaattttaattggtgatttccttagggcttgctttgtgcgattttgcaactactgttggtgctgggacctggagtatggctacccctcttacaccgaatttgatatttcaggaaatgtactggctctgatttttaatcagggcatgatatggatggggagtttttttgccccaagtctcccagggataaatattctgcggttgcataccagtatgtatttccaatgctgggccgtgatgtgttgcaatgtgcctgaagcacgagtcttcaaggctagcagaagcaataatttctacctgggtatgctcctgctcatcctcttcctgagtaccatgccggttttgtatatgatagtaagcctgccaccatcatttgattgtggcccattctctgggaaaaacagaatgtttgaggtgattggggagacactggagcatgacttcccctcatggatggctaaaattctgagacaactctccaaccctggactggttatcgccgtcattctggttatggtgctggcaatttattacttgaacgccactgccaagggccagaaggcagcgaacctcgacctgaaaaagaaaatgaagatgcaggccctggaaaacaaaatgagaaataaaaagatggccgcagcacgggctgccgctgctgccggacgtcagtag

SEQ ID NO: 244739 - DNA, 2283 bp, Artificial Sequence
  Description of Artificial Sequence: Synthetic coding sequence
atgtccccgaagaaggttcagattaaggttgaggagaaagaggatgaaactgaagaatcctcatccgaggaggaggaagaggtggaggacaaacttcccagacgggagtccctcagacccaagcggaagcggaccagggacgtcattaatgaggatgacccggagcctgaaccggaagatgaagagacccgcaaggcgagagagaaggagcgtagacgcagactaaaaaggggagccgaggaggaagaaatcgatgaggaggaactggagcggctgaaggccgaactcgatgaaaaaaggcagattattgccaccgtaaagtgtaagccctggaagatggaaaaaaagattgaagttctgaaggaggccaaaaagttcgtgtccgagaacgaaggagctctcgggaaagggaagggcaagcgatggtttgcgttcaagatgatgatggccaaaaaatgggctaaattccttcgggacttcgaaaacttcaaggccgcttgtgtgccatgggaaaacaaaattaaagccattgagagccagttcggttctagtgtggctagttatttccttttcctcaggtggatgtatggggtgaatatggtgctctttattctgacattttctctgatcatgctgccggagtacctgtggggactgccttatgggagccttccccgaaagaccgttccaagggctgaggaggctagtgccgctaactttggcgtgctgtatgatttcaacgggttggctcagtactccgttctcttttacggttattacgacaataaaaggacaatcggctggatgaacttccgtctgcctctgagttattttctggtcggaataatgtgcattgggtactcgttcctcgtggtgctcaaagcgatgactaaaaacatcggagatgacggaggaggtgatgacaataccttcaatttttcatggaaagtgttcacttcatgggactatctcataggaaaccccgagaccgctgataataagtttaatagcatcactatgaattttaaagaagccattactgaggaaaaagccgcacaagtcgaggagaatgtgcaccttattaggtttctgagattcctcgcaaacttctttgtgttcctgactctgggtggcagcggatacctcatattttgggccgtgaaacgctctcaagagtttgcacagcaggatcctgacacccttggttggtgggagaagaatgagatgaatatggtgatgtcactgctggggatgttttgccctacactgtttgatctgtttgccgagctcgaagactaccacccccttattgccctgaagtggttactagggaggatttttgccctgctcctgggaaatctgtatgtgttcatcctggcgcttatggatgagataaataataaaattgaagaagaaaaactcgtcaaggcaaacatcacattatgggaagcaaatatgatcaaagcctacaacgccagcttttctgagaattctaccggcccaccgttttttgtccaccccgctgacgtgcccagaggaccttgctgggagacaatggtcggacaggagtttgttcggctaacagtctcggatgtcctgaccacatatgtgacgattttaataggcgacttcctgagagcctgtttcgttagattctgcaactattgctggtgttgggaccttgaatacgggtatccttcctacaccgagttcgatataagtggtaatgtgttggccctgattttcaatcaaggtatgatctggatgggatctttctttgctcccagtttacctggtatcaatatcctgagactgcatacgagcatgtacttccagtgctgggccgtcatgtgttgtaacgtgcccgaggccagagtgttcaaggcctctcggtccaacaacttttatctggggatgctactactgatcctgtttttgtctacgatgcccgtcttgtacatgatcgttagcctcccacccagtttcgactgtggcccattctctggcaaaaaccgaatgttcgaagtgattggcgaaacattggagcacgacttcccgtcctggatggcaaagatcctcaggcagctgtcaaaccctgggctcgtgatagccgtgattctcgttatggttctggcaatttattacctcaatgccactgccaagggtcagaaggcagccaatctggacctgaagaaaaagatgaagatgcaagcgctagaaaacaagatgcgaaacaagaaaatggctgctgcccgtgcggctgccgctgctggacgtcaatag

SEQ ID NO: 244740 - DNA, 2223 bp, Artificial Sequence
  Description of Artificial Sequence: Synthetic coding sequence
gtagaatggagcggcgagtgcctgagatcttgtaggcgcgaagtgcagatcaaggtggaggagaaagaagacgaaacagaggaaagtagttcagaggaggaggaggaggtggaagacaagctgcctagacgggaatcgttaaggccaaaacggaaaaggactcgggacgtgattaacgaagacgatcccgagccagaacctgaagacgaggagacaagaaaggccagggagaaggaaagacgacgtcgattgaaacgcggagcagaagcgaagaagttcgtgagcgagaacgagggagctctcgggaagggcaaaggcaaacgttggtttgcttttaaaatgatgatggctaaaaaatgggccaaatttttaagggactttgagaattttaaagccgcatgcgtgccttgggagaataagattaaagcgattgagagccagttcggctcctctgtggcgagctactttttattcctgcggtggatgtacggcgttaacatggtgctgtttatcctcacttttagcctgatcatgctgccggagtatctctggggtctgccctacggttcccttcctagaaaaaccgttccgcgagcagaggaagcatccgcagccaactttggggtgctgtacgactttaacgggctggcacagtatagtgtgctattctatggctattatgacaataaacggacgatcggttggatgaacttccgtcttcccctgtcttatttcttagtcggaatcatgtgtatcggatactccttcctggtggttctgaaagcaatgactaaaaatataggcgacgacggcggtggggacgacaacacatttaatttctcatggaaggtatttacctcctgggattatctgatcggaaatccggaaaccgcagataataaatttaacagtatcactatgaattttaaggaggccatcactgaggagaaggctgcccaagtagaagagaacgtgcacttaattcgatttttgaggtttctggctaatttcttcgtgttccttacactgggcggaagcggctacctcatcttctgggccgtaaagagaagtcaggaatttgcgcagcaggatcctgataccctagggtggtgggagaaaaatgaaatgaatatggtgatgtccctgctcggaatgttttgcccaaccctgttcgacctgttcgctgagctagaagactaccaccctcttatcgcacttaagtggctcctgggaaggatcttcgcgctcttactgggtaacttatatgtgttcatcttagcgcttatggatgaaataaacaataaaatagaggaggagaagttagtcaaagctaatattacattgtgggaggctaatatgattaaggcttacaacgcctccttctccgagaacagcaccgggccacctttcttcgtgcacccagcagatgtgcccaggggcccatgctgggaaactatggtaggacaggagtttgtccgcttaaccgtgagcgatgtgcttaccacctacgtgactatcttaatcggcgactttctccgcgcttgttttgtgagattctgtaactattgctggtgttgggatctggagtatgggtacccatcctatacggagttcgacatctcagggaacgtgctcgccctgatttttaaccagggcatgatctggatggggagtttttttgcaccctcattaccaggaatcaacatcctccgactgcatacatctatgtactttcagtgttgggccgttatgtgctgcaatgtgcctgaggctcgggttttcaaggcttcccggagtaataatttttacctcgggatgctcttgctgatcttgttcctatccacaatgcctgtcctgtatatgatcgtgagcctgcctcctagtttcgattgtggcccatttagcggcaaaaacaggatgtttgaagtcattggcgagacattggagcatgatttcccctcatggatggccaaaattcttcgccagctctccaatcctggcctggtcatagcggtaattttggtgatggtcctggctatctactacctcaacgccacagccaaagggcagaaagccgcaaatctagacttaaaaaagaagatgaaaatgctgcaactgctcgttgcctccaataaatatccagagagtccagaaaaggtccattttgccctgctcttcaagagtaatgcaatttgcgagaggcccgagaacaagcactgttag

SEQ ID NO: 244741 - DNA, 2283 bp, Artificial Sequence
  Description of Artificial Sequence: Synthetic coding sequence
atgtctcctaaaaaagtgcagatcaaggtcgaagagaaggaggatgagaccgaggaaagctcttctgaagaagaagaggaggtcgaagacaagctgcccaggcgggagtccctgcgtccaaagaggaagcgcacaagggacgtaatcaacgaagatgatcctgaaccagaaccagaggatgaggagactcgaaaggccagagagaaggaacgtaggcgacggcttaaacgaggtgctgaggaggaagaaatcgacgaggaagaacttgagaggctgaaagccgagctggatgaaaagcgccagatcatcgctactgttaagtgtaagccctggaagatggagaaaaaaattgaggtgctcaaagaagcgaagaaatttgtcagcgagaacgagggcgcactgggcaagggcaaaggtaaaagatggtttgcgttcaagatgatgatggcgaagaagtgggctaagttcctgcgtgatttcgaaaattttaaggccgcatgcgtgccttgggagaacaagatcaaggccatagaatcacagtttggctctagcgttgcctcttattttctttttctgaggtggatgtatggtgtgaacatggtgctcttcatactcacattctcgctgatcatgctacccgaatatctatggggcttaccgtacgggtctctcccacgcaaaactgtgccgagagcagaggaggcatcggcagccaatttcggcgtgctttacgacttcaatggccttgcccagtatagcgtcctcttttatggctactacgacaacaagagaaccatcgggtggatgaatttcaggctgcccctgagttatttcctggtgggcatcatgtgcatagggtacagcttcctggtagtacttaaagcaatgactaaaaacattggggatgatgggggaggtgatgataataccttcaactttagctggaaggtttttacaagctgggactatcttattggtaaccccgaaacggccgacaataaattcaatagcatcacaatgaacttcaaggaggctattacggaggaaaaggctgcccaggttgaagaaaacgtgcatctgatccgtttcttgcgatttttagccaacttttttgtctttctgactttaggcggtagcgggtacctcatcttttgggccgtgaagagaagtcaagagttcgcccagcaggatcccgatactctgggctggtgggagaaaaatgagatgaacatggtcatgtctctcttggggatgttttgcccaaccttgttcgatttgtttgccgagcttgaggactaccaccccttaatcgccctgaagtggctccttggacggatctttgctctactgctcggcaacctgtacgtgtttattctggccttgatggacgaaatcaacaacaaaatcgaagaggagaaattagtgaaggctaatattacactgtgggaggcaaacatgattaaggcctataatgcaagtttctctgaaaactccacaggccctccattctttgtgcaccccgctgacgtccccagaggcccttgctgggaaactatggtcggccaggagtttgtccgcctaaccgtgtccgatgtactaacaacatatgtcacaatcctcataggggacttcctgcgggcatgcttcgttcgtttttgtaattactgttggtgctgggatttggagtatggatatccgagttacacagagtttgacatctcagggaacgtattggccctgatattcaaccaaggcatgatttggatgggctcctttttcgcaccctccctgcccggtatcaacatactgaggcttcacacatcaatgtatttccagtgctgggcagtgatgtgctgcaacgttccagaggcacgagtcttcaaagcctcccgtagtaataacttttaccttggaatgttactcctgattcttttcttgtccacgatgcctgtgctgtatatgatagtgtctctgcctccctctttcgactgcgggccattctctgggaaaaaccgtatgttcgaagtcataggtgagaccctggagcatgactttcccagctggatggcaaagattctgagacagttgtccaatcctggattggtgatcgccgtgattctggttatggtgcttgcgatatattatctgaacgctactgcgaaggggcaaaaggcagctaatcttgatctcaagaagaaaatgaaaatgcaggctctggagaataagatgcggaataagaagatggctgcagctcgagccgctgccgctgccggacgccagtag

SEQ ID NO: 244742 - DNA, 2184 bp, Artificial Sequence
  Description of Artificial Sequence: Synthetic coding sequence
gtggaatggagtggggagtgcttgcgttcctgtaggcgtgaggtgcagattaaagtagaagaaaaagaagatgaaaccgaagagtcctcgtcagaagaggaagaagaggtggaagacaagctacctcgtcgcgaaagcctgaggcctaagcgaaagaggacccgggatgtgatcaacgaggatgatcccgagccagaacctgaagacgaggaaaccaggaaggcccgagaaaaagagaggagacgcaggcttaagcgcggagccgaggcaaaaaagttcgtgtctgaaaacgaaggagctctggggaaggggaaaggtaagcgctggtttgccttcaaaatgatgatggctaaaaagtgggcaaagttcctgagagattttgagaactttaaggctgcctgcgtgccctgggaaaacaagattaaagcaattgagtcccagttcggatcgtccgtcgcctcatattttctttttctccggtggatgtatggggtaaacatggttctgtttatcctcacattctcattaatcatgctgccggaatacctctggggactcccctatggcagcctcccaagaaaaaccgtacctagagcagaggaggcctcagcggcaaactttggggtgctgtatgatttcaacggtctcgctcagtacagcgtcctcttttatggttactacgacaataagaggaccatcggttggatgaacttccgactgcccttgagctattttttggtgggcattatgtgtattggctattcatttctcgttgtcctgaaagccatgacaaaaaacatcggcgacgatggcggaggggatgataacacctttaacttttcatggaaggtctttacctcttgggattacctcattggcaaccccgaaactgccgataataagtttaattccattacaatgaacttcaaggaggcaattaccgaagagaaagccgcacaagtggaagagaacgttcacctgatacggtttctgcgatttcttgccaactttttcgtgttcttgactctgggcggtagtggctatcttatcttttgggctgtgaagaggtcacaggagtttgcacaacaggatccagacacccttggctggtgggaaaaaaatgaaatgaacatggttatgtcattgttggggatgttctgcccaactctcttcgatctttttgcagagttggaagactaccaccctctcatcgctctgaagtggctactggggagaatctttgccttgctactgggcaatctgtatgttttcatacttgctttaatggacgagattaataacaaaattgaagaagagaaactcgtaaaagctaacataaccttgtgggaagccaacatgatcaaagcctataatgcttcattcagcgaaaattcaacgggacctccattctttgtgcatccagccgacgttcccaggggcccttgctgggagaccatggtcggacaagaatttgtaaggctgaccgtaagcgatgtattgactacatatgtgacgatcctaataggagactttctgagagcctgttttgtgagattttgcaattactgctggtgttgggatctagagtacggttacccctcatacactgaattcgacatatccggaaacgtcctcgctttaatctttaatcagggtatgatctggatgggatcctttttcgccccttccctccccggaatcaacatcctcagactgcacacctcaatgtattttcagtgctgggcagtcatgtgttgcaatgttcccgaggctcgcgtgttcaaggcaagtcgtagtaacaacttctatttggggatgctgctgctgatcctgttcctgtctactatgcctgtgctttatatgatcgtgagtctcccccctagttttgattgcggtccattctctgggaagaacaggatgttcgaggtcattggggagaccctggaacatgactttcctagctggatggccaagattctgcgtcagcttagcaaccccggactggtgatcgccgtcatcctggtaatggtgctggccatctactacctgaatgctactgccaagggacagaaggcagctaatcttgacctgaagaagaagatgaagatgcaggcacttgagaataagatgaggaataaaaaaatggcagccgctagagccgcagctgccgcaggcaggcagtag

SEQ ID NO: 244743 - DNA, 1665 bp, Artificial Sequence
  Description of Artificial Sequence: Synthetic coding sequence
gtggagtggagtggcgagtgcctgaggagctgccgtagggaagtacagatcaaggtggaagagaaagaggacgagacagaggagtcaagttctgaagaggaggaggaggtagaagacaaactgccgaggcgggaatccctgaggcctaaacggaaacggacccgcgacgtcattaacgaggatgatccagaacctgaacctgaagatgaagagactaggaaggcaagagagaaagagcgtcgaagaagactcaagcgaggtgctgaggccaaaaagtttgtgtcagagaatgaaggtgccctgggcaaggggaagggtaaacgctggtttgccttcaagatgatgatggcaaagaagtgggccaagttcctccgggacttcgagaacttcaaagcagcctgtgtaccttgggagaacaaaataaaggcaattgaaagtcagtttggaagtagtgtagcttcatactttctatttctgagatggatgtacggcgtcaacatggtactgtttatcctgacctttagtctcattatgctgcccgaatacttatggggcctcccgtatgggagccttccccgtaaaactgttcccagggccgaggaggctagcgctgccaattttggtgttctctatgatttcaacggcctagcacaatatagcgtcttgttttatggatactacgataacaagagaacaatcggttggatgaattttcggctgcctctgagttatttcctggttggtatcatgtgcatcgggtatagcttcctagtagtgctcaaggcgatgaccaaaaacattggcgatgacggcggtggcgatgacaacaccttcaacttctcgtggaaggtcttcacatcctgggactacctcattggcaacccagagactgcggataataaattcaatagcatcactatgaatttcaaggaagccatcacagaagagaaagccgctcaagtcgaagagaatgttcacctgattagattcctgcgtttcctggccaatttctttgtgttcctgaccttgggaggatcaggctaccttatcttctgggctgtcaagaggtcgcaggagtttgcgcagcaggaccccgacactctcggttggtgggaaaagaatgagatgaatatggtgatgtccctcctaggaatgttttgccccaccctgtttgatctgttcgcagaactcgaggattatcaccctttgatagctctgaagtggttgttgggtagaatctttgctctgcttctggggaacctctatgtgttcatactggcgttgatggatgaaatcaataacaaaatagaggaggagaaattagtcaaagccaacattaccctgtgggaagcaaacatgattaaagcctataatgcgagcttctccgaaaatagtactggaccaccatttttcgttcatcctgctgatgttcctcgcggaccatgctgggagaccatggtgggtcaagagttcgtcaggctcactgtgtcagacgttctgacaacctatgttacgattctgattggggactttctccgcgcttgcttcgtgcggttctgcaactattgctggtgttgggacctagagtatggatacccaagttataccgagtttgacattagcgggaatgttctcgcgctgatcttcaaccagggaatgatctag

SEQ ID NO: 244744 - DNA, 2265 bp, Artificial Sequence
  Description of Artificial Sequence: Synthetic coding sequence
cagatcaaggttgaggaaaaagaggacgagaccgaggaatcatcatccgaggaagaagaagaggttgaggataagctcccgagacgggagtcacttagacctaagcggaaacgtacgagagatgttatcaatgaagacgaccctgagccagagcctgaggacgaggaaacccggaaagcccgagaaaaagagagacgtagacgcctgaaacgcggagcggaggaagaagaaatcgatgaggaagagctggagagactgaaggcagagctcgatgaaaaaagacagattattgcgaccgtgaagtgcaagccctggaaaatggagaaaaagattgaggtactgaaagaggccaagaaattcgttagtgagaatgaaggggctctggggaaaggcaaaggaaagcgctggtttgccttcaaaatgatgatggccaagaagtgggctaagtttctgcgagatttcgagaactttaaggctgcctgcgtcccctgggagaacaagattaaagcgatagaatctcaatttggctcctccgtggcttcttatttcctttttctgaggtggatgtacggggtaaacatggtgttatttatactgacattttccctaatcatgctgcctgaatatctgtggggactgccatacggaagccttcccaggaaaacagtccctcgtgccgaggaggctagtgcagcaaacttcggagttctgtacgacttcaacggcctcgctcagtatagcgtcctcttctatggatattacgataataagagaactatcggctggatgaacttccggctaccgctgtcatacttcctagtcggaattatgtgtatcggatacagtttcctggtggttctgaaagctatgacaaaaaacatcggcgatgacgggggtggggatgataatacattcaacttctcctggaaggttttcacgtcctgggactacttgatcggaaacccggaaacagccgacaacaaattcaattcaatcaccatgaattttaaagaagccatcaccgaagaaaaagctgcgcaggtcgaggaaaacgtgcaccttattaggtttctcaggttccttgcaaacttcttcgtgttcttgacgctcggcggatcaggctacctcatattttgggccgtcaaaaggtcccaggaatttgctcaacaggaccccgatactctcggatggtgggaaaagaatgagatgaatatggttatgtcattactaggcatgttttgccctactttattcgacctgttcgctgaactcgaggactaccacccgctgatcgccctgaagtggcttctgggcagaatattcgccctgctgctcggcaacctgtacgtgtttattcttgctctgatggacgagatcaacaacaagatcgaggaagaaaaacttgttaaagccaacatcaccttgtgggaagccaatatgatcaaggcttacaacgcctcattctctgaaaattcaaccggtcccccattttttgtgcaccccgcagacgtgcctcggggaccttgttgggaaacaatggtgggtcaggagttcgtgagactgaccgtcagtgatgtgctcaccacttacgtaactattctgatcggagacttcttgagagcctgtttcgtgcgtttttgcaattactgttggtgctgggacttagagtacggctaccccagctacacagaattcgacatctctggcaatgtactggcgctgatctttaaccagggaatgatatggatggggtctttcttcgcgccttctctgcctggaattaacatcctgcgcctgcacacttctatgtactttcagtgctgggctgtcatgtgctgcaacgtgcccgaagcacgagtattcaaggcatctcggagcaacaatttctatctggggatgctcctcctgattctgttcttatctactatgcctgtgctgtatatgatcgtctccctccctccctcttttgattgtggcccattctctggaaagaaccgaatgttcgaagtgattggagaaacactggaacacgactttcccagctggatggccaagatcttaaggcagctgtctaaccccggtctggtgatcgccgtgatattagtcatggtcctggcaatttattatctgaacgcaacagcgaagggacagaaggccgctaacctggatcttaagaagaagatgaaaatgcaggcacttgaaaacaaaatgcgcaacaaaaaaatggccgctgcaagagccgatggagccgctggccgtgcctag

SEQ ID NO: 244745 - DNA, 2721 bp, Artificial Sequence
  Description of Artificial Sequence: Synthetic coding sequence
atgagccatcaggtgaaagggctaaaggaggaagcgagaggcggagtcaaagggagggttaagtcaggatcccctcacaccggcgacagactggggagacgatcctcaagcaaacgggcactcaaggctgaagggacccctggcaggaggggcgcacaaagaagtcaaaaggaaagagctggcggatctccatcacctggaagtccacggagaaaacagacggggaggcgacgacatcgggaggaactcggagaacaggagcgcggtgaggccgagcggacctgtgaggggagaagaaaaagggatgagagggccagttttcaggaacggaccgccgcaccgaaaagggagaaggagatccccaggagagaggagaaatccaagaggcaaaaaaagcctcggagttcatcactggcttcttctgcctcaggtggcgagagcttatctgaagaagagctggcccagatcttggagcaagtcgaggaaaagaaaaagctgattgccaccatgcgctctaagccatggcccatggcgaagaagttaaccgaactgagggaggcacaggagtttgttgaaaaatatgaaggcgcactgggtaaaggtaagggtaaacagttatatgcttacaagatgctgatggccaagaagtgggtcaaattcaagcgggattttgacaatttcaaaacccaatgcattccttgggagatgaagattaaggacattgaatcgcactttggcagctccgtggcgagctacttcattttcttgcgctggatgtatggagtgaacttggtactgttcggtttgatctttggcctggtgatcattcctgaggtcctgatgggtatgccatatggctccatccccagaaaaaccgtgcccagggcggaagaggagaaggcaatggactttagcgtcttatgggatttcgaaggctatattaagtactcggcgctgttttatgggtattataacaatcagagaacgattgggtggctgcggtatcgactgccaatggcatatttcatggtgggcgtgtcagtgttcgggtactcactgattatagtcatcagatccatggcgtcaaatacacaagggtctaccggggaaggagagagcgataacttcacgttctctttcaaaatgttcacctcgtgggactacctgatcgggaattcagagactgccgataataaatacgccagcattacaacaagctttaaagagtcgatcgtggatgaacaggagtcgaataaagaggagaatatacaccttacaaggtttttgcgtgtattagctaacttcctgatcatctgctgcctctgtggaagtggctatttaatctactttgtggtaaagcgctctcagcagttctcaaaaatgcagaacgtgagctggtatgaacggaatgaggttgagatcgtcatgtcactgctgggtatgttctgtccccctctgttcgagactatcgcagccctcgagaactatcatccaaggacaggattgaagtggcagttggggagaatcttcgccctttttcttggtaacctgtatacgttcctgctcgccctgatggatgatgttcatctgaagctggcaaatgaggagaccataaagaacattactcactggaccctgttcaattactacaattcgtccgggtggaatgagtccgtgcctcggcctccactccatcccgctgacgttcctcgtggatcctgctgggaaacagctgttgggattgagttcatgcgtctcaccgtatctgatatgttggttacctatattaccatcttactgggggatttcctgcgcgcatgtttcgtgagatttatgaactactgttggtgttgggaccttgaagcagggttccctagctacgcagagtttgacatttcaggaaatgtgttaggcctaatcttcaaccagggcatgatttggatggggtccttttatgcccctgggttggtcgggataaatgtgcttcgactgctgacatctatgtattttcagtgctgggccgtgatgtccagtaatgtacctcacgagcgagtcttcaaagccagtcgttctaataatttctacatgggcttgctgctgctggtgttgtttctcagcctgctgcctgtagcgtacacaatcatgagcctgccgccttcttttgattgcgggccattctcaggcaagaacagaatgtatgacgttctccaggagacgatagaaaacgacttccctacgttccttggaaagatttttgccttcctcgcgaatccagggcttatcatcccagccattctcctgatgttcctggccatttattatctgaactcggtgtccaaatctctgagccgggcaaatgcacagctacggaaaaaaattcaggtgttgcgggaggtcgagaagtcacataagtctgtcaagggtaaggcaactgccagggattcagaggatacccctaaatcctcttctaaaaatgcgactcagctgcagcttacaaaggaggagactacgccacccagtgcctcgcagagccaggcaatggataagaaggctcagggtccgggaacaagtaattctgcctccagaactaccctgccagccagcggccatttacctataagtagacccccagggatcggcccagattccggacacgcaccatcccagacacatccgtggcgaagcgcaagtggcaaaagtgcccagcgcccacctcactag

SEQ ID NO: 244746 - DNA, 1365 bp, Artificial Sequence
  Description of Artificial Sequence: Synthetic coding sequence
atggctcagcctctggcgtttatcctggatgtccccgagaccccgggtgatcagggacaaggacccagcccctacgacgaaagtgaagtgcacgactctttccagcagctgattcaggaacagagccagtgcactgctcaggaggggctcgagctgcaacagagagaaagggaggtgaccgggagtagccagcagacgctttggagaccagagggcacccagtccaccgctactttgagaattctcgcctccatgccttctaggacgatcggcaggtccagaggggctataataagccaatattacaatcggaccgtccaactcaggtgcagatcttcacgacctcttcttggcaatttcgtccgatctgcatggccctcacttaggttatacgatctggaacttgatcctactgccctggaggaagaggaaaagcagagtttgctcgtcaaagaactacagagcctagctgtagcccagagagatcatatgctgagaggaatgcctctatccctcgccgaaaaaagatccttgcgcgaaaaatctcggacaccgagagggaagtggcgtggacaacccggttccggtggggtgtgttcatgctgcggaaggctcagatatgcgtgtgtcttagcccttcactccctggggctcgctctgctgtccgcgttgcaggccctcatgccctggcgctacgccctaaagcgcataggcggacagtttggcagctcggttctgtcatatttcctctttctgaagaccctgctggccttcaacgcattactgctgctgctgctagtagcatttattatgggccctcaggtggcattccctccagctctgccgggtcccgctcccgtctgcacagggctggagctcctaacaggtgcagggtgcttcacccacaccgtgatgtattatggacattactccaatgctaccctcaatcaaccttgcggtagccccctggacggctcccaatgcacaccccgtgtaggaggcctgccttacaacatgcctctggcatatcttagcactgtaggggtttccttctttatcacctgcatcacattagtttacagcatggcacattctttcggcgagtcctatagggtggggtctacctctggtatccacgctatcacagtgttctgctcatgggactacaaggttacacagaagcgcgctagtcgtttacaacaagataatatcaggacgcggttgaaaggcgaggataaaatttttctcatcaataagctgcactcgatctacgaacgaaaggagagggaagaaaggtccagagtcgggaccacagaggaagcagcagccccacccgcactcctgaccgacgagcaagacgcttag

SEQ ID NO: 244747 - DNA, 2418 bp, Artificial Sequence
  Description of Artificial Sequence: Synthetic coding sequence
atggcccaacctctggcctttatactggatgtaccagaaacccccggagaccaagggcaaggacccagtccatacgacgaatcggaggtccatgacagctttcaacagttgattcaggagcagtctcaatgcacagcacaggagggactggagcttcagcaacgtgagcgggaagtgactggttcttcacagcagaccctttggagaccagagggaacccagtccacggcaacccttcgtatcttggcctccatgccgtcacgcaccattggaaggtccaggggagcaatcataagccagtattacaataggaccgttcaactgagatgccgctccagtcggcctttgttggggaattttgtcagaagcgcttggccttccctgcgactgtatgatctggagctcgacccgaccgcactcgaagaggaggaaaaacaaagtctcttggtgaaggaactgcagtcacttgctgtcgcccagcgcgatcatatgctgagaggtatgcccctttcactggctgaaaaacgaagcctgcgcgaaaagtcacgaactcctcggggaaaatggcgtggacagcccggttccggcggagtgtgttcttgctgtgggcgattaaggtacgcttgcgtgctggccttacactctctgggcttggcgctgctttcagcgctacaggccctgatgccgtggcgctacgctctcaaaaggatagggggacagtttggatcgtctgtcctgagttatttcttgtttctgaagaccttgctagcatttaatgccttattattgttgcttctggtggcctttatcatgggaccccaggtcgccttcccccctgcattgcctgggcctgcgcctgtctgtaccgggctggagctcctgaccggagccggatgcttcactcataccgtgatgtactatggacactattccaatgccacgcttaatcagccatgcggcagtcccttggatgggtctcagtgcactcctagagtcggcggacttccatacaatatgcctctggcgtacctttccactgttggagtctcttttttcatcacttgtatcactcttgtgtatagcatggctcattcattcggtgagtcgtatagggtcggtagcacaagcggtatccacgcaattacggtgttctgctcctgggactacaaggtgacccagaaacgggcaagtcgcctgcagcaggacaacatccgaacgcgcctgaaggaactcctcgccgaatggcagttgagacactcccccagaagtgtctgcggtcggctgagacaggccgctgttctgggccttgtttggttactatgcttaggaactgcattgggctgtgcggtcgcagtccacgtcttctccgaattcatgatccaaagccctgaagctgccggtcaagaggctgttttgctcgtgctgccacttgtggttggcttgctgaatctaggcgctccttatctttgtcgggtgctggccgcactcgagccccacgactcccctgtcttagaggtttatgttgcaatttgccgaaatctgatcctgaagcttgctatcttaggtactctttgctatcactggttgggacggagggttggcgtattgcagggtcagtgttgggaagatttcgtcggccaggagctgtacagattcttggtaatggatttcgttctaatgttattagacacactcttcggcgaactggtgtggcgcatcatctctgaaaagaagctgaagcgaaggcggaagcctgagtttgatatcgctagaaatgtcttggagttaatctacggacaaacattgacctggctgggggttttgttttcccctctcttacctgcagtgcaaatcattaagctcctgctagtcttctatgtcaaaaagacaagcctgcttgctaactgccaggcccctcgcagaccgtggctggcgagccacatgagtactgtctttctcacattactatgcttccccgcattcctgggcgctgcagtcttcttatgctatgctgtctggcaagtaaagccatcatctacctgcggaccttttcggacgctcgataccatgtacgaggcaggacgcgtttgggttagacacctggaggcagctgggcctcgagtgtcctggctcccctgggtccacaggtatctgatggagaatacttttttcgtgttccttgtgagcgcccttctcctggctgttatctaccttaatatccaagtggtgagaggacaaaggaaggtcatctgtctgctgaaggaacaaatttcaaacgagggcgaagataagatcttcttgatcaacaaactgcacagcatatacgagaggaaagagagggaggagaggtccagagtgggaaccactgaggaagccgctgcaccacccgcactcttaactgacgaacaggacgcttag

SEQ ID NO: 244748 - DNA, 1155 bp, Artificial Sequence
  Description of Artificial Sequence: Synthetic coding sequence
atggctcatagttttggggagtcctatcgagtcggtagtactagtgggattcatgcgataactgtgttctgcagttgggattacaaggtgacacagaaaagggccagccgccttcagcaagataacattcggacccggcttaaggagctcttagccgagtggcaactgcgtcactctcctcgctcagtgtgtggcaggctccgacaggccgctgtgcttggactcgtttggctcctgtgtctgggtaccgcattgggttgcgccgtcgccgtacacgtgttcagcgagtttatgattcagtctcccgaggccgctggacaggaggcagtgcttctggtgctccctctggtagttggactcctgaacctgggggctccttacctctgccgggtattggctgccctagaaccccacgactctcctgtcttagaagtttatgtcgctatctgtagaatcatttctgagaagaagttaaaaagacgccgtaagccagaatttgatatcgccaggaacgtgctggagctgatctacggacagaccctgacctggctcggggttttgttctctccacttttacccgctgtgcagattattaaactgctcctcgtgttctatgtaaagaaaaccagcctcttagccaactgccaggctcctaggcgcccttggcttgcaagccatatgtccacagtgttcttaacactgctatgtttcccagcattcttaggtgccgcagtctttctctgttacgccgtttggcaggtgaaacccagcagtacatgcggcccattcaggaccttggataccatgtacgaggctggcagagtgtgggtgcgacatctcgaggcagcgggacctcgcgtttcctggctcccatgggtacaccgctatcttatggagaataccttctttgtttttctggtgtctgccctgctcttagccgtcatttatctcaatattcaggttgtccgcggtcagcgaaaggtaatctgccttctcaaagaacagatttccaacgaaggagaagacaagattttcttaatcaacaagctccacagcatctacgagcggaaagagcgcgaagagcggtcacgggtgggcaccaccgaggaagctgctgcccctcctgccctcttaaccgacgaacaagatgcgtag

SEQ ID NO: 244749 - DNA, 417 bp, Artificial Sequence
  Description of Artificial Sequence: Synthetic coding sequence
cagtgctgggaagatttcgttgggcaggaactgtacaggttcttggtgatggactttgtgctgatgctgctcgatacactatttggagaactggaaaaccgttttcagagcgacgtgttttcgtcaagaatctgggcatggtggaggaagcccgagttcgatatcgcaagaaatgtgctcgaactgatttacgggcaaacactgacttggcttggtgtgcttttttccccactgctgcctgccgtccagattataaagttactcttggtattttacgttaagaagacgagtctgctcgccaactgtcaggcgcctcggcgtccctggctggcaagccatatgtctaccgtgttcctgacgctgctgtgcttcccagcctttttgggtgctgctgtgttcctgtgctacgcagtgtag

SEQ ID NO: 244750 - DNA, 2418 bp, Artificial Sequence
  Description of Artificial Sequence: Synthetic coding sequence
atggcccagccactcgccttcattctcgacgttcctgagacgcccggtgatcaggggcaggggccatccccttacgacgaatctgaagtccacgactcatttcaacagctgattcaggagcagtcacagtgcaccgcacaggaagggcttgaacttcagcagcgagagcgagaggtcactgggagctcccaacagacgctctggaggccagaaggcacccaaagcactgcgacactgcgtatcctcgcatcaatgccatcaagaactatagggagaagccggggagccattatcagccagtactataaccggacagtgcaactcagatgtcgttccagtcgaccactccttggaaactttgtgcgttctgcgtggccatctctccggctgtacgatctggagttagatcctaccgcactggaagaggaggaaaaacagagcttactcgtgaaggagttgcagtccctggcagtcgcacaacgggaccatatgttgcggggaatgccactgtcacttgccgaaaagaggtccttgcgagagaagtcacggacgccaagaggcaaatggagagggcagccaggttccgggggagtctgctcatgctgcggcaggctcagatatgcttgcgtattggccctgcattccttggggttagcactgctcagtgctctccaggctctaatgccctggagatatgcccttaagaggatcggcggtcagtttggatcgtctgtgctctcctatttcttgtttttgaaaacactgttggcatttaacgcactgctgcttctcctcttggtggcctttattatgggtccccaggttgcttttcccccagctttgccaggccctgcccctgtctgtaccggactggagctgctaacaggtgcagggtgtttcacacataccgtgatgtactacgggcactactcaaacgctacccttaaccagccctgcgggtctcctctcgacggttcgcagtgcacccccagagtggggggattgccctacaacatgcctctagcttatctctcaacagtgggagtctctttctttatcacctgtattactttggtctactccatggcacactcatttggagagtcgtaccgagtgggcagcaccagtggtatccacgccattaccgtgttctgcagctgggactacaaggtgacccagaagcgcgcatcccgactgcagcaggacaatatccgcacccgcctaaaggagctcctggccgaatggcagctgcggcactcaccccgatctgtctgtggcaggcttcggcaagctgcagtgctgggtctggtttggctactgtgcctgggtacagctctggggtgtgccgtagccgtgcatgtgtttagcgagtttatgatccagagtccggaagcagctggtcaggaggcagtgctgctcgttctgcctctggtggtgggcttgctgaacctgggtgcgccatacctgtgtcgtgtgctcgctgccctcgaacctcacgactcaccagtcctggaggtgtacgtcgcaatttgccgaaatctgatactgaaactggcaatcctcggaactctttgttatcattggctcggtcgaagggttggagtgcttcagggacagtgctgggaggatttcgttgggcaggagctctatcgtttcctggtcatggactttgtgctgatgttgttggacaccctattcggggagcttgtgtggcggataatctccgaaaaaaagttaaagagaaggcgcaagccagagtttgacatcgcgcgtaatgtgttggaactgatctacggccagacattgacgtggctgggagtattgttctcaccattgctcccggctgtgcagattatcaaactgctgctggtgttctatgttaagaagacaagtctcttagctaactgccaagcaccgcgacgaccttggttggcctcccatatgtctactgtgttcctgacacttttatgctttcccgcattccttggcgcagctgtgtttctgtgttacgccgtttggcaagtgaagccaagcagcacttgcggacctttcaggactctcgatacgatgtatgaagccggaagggtgtgggtgagacatctcgaggctgccggaccacgcgttagctggcttccatgggtgcaccgatacttaatggaaaacaccttcttcgtgttcttggtgagcgcactgcttttggcagtgatttatctgaacatacaggttgttcggggtcagagaaaggttatttgccttctcaaggagcagatatccaacgaaggtgaagacaagatcttcctaatcaataagttacattctatttatgaaagaaaagaacgcgaggagcgctccagggtgggcaccacagaggaggcagccgctcctcctgccctcctgacagatgagcaggacgcctag

SEQ ID NO: 244751 - DNA, 1098 bp, Artificial Sequence
  Description of Artificial Sequence: Synthetic coding sequence
atgaatatcatggactttaatgttaaaaagctggctgccgatgctggcactttcctgagtagagccgtgcagttcacagaggagaagctcggccaagctgaaaaaactgaactcgatgcacacttggagaatctgctgtcaaaggctgaatgtaccaaaatatggaccgagaagatcatgaaacagaccgaggtccttctgcagcccaatcccaacgctaggatcgaagaattcgtgtatgaaaagctggaccgcaaggccccttcccgtataaacaatcccgagctgctcggtcagtatatgatcgatgcaggaaccgaattcgggcctgggaccgcttatggcaacgccctgattaagtgtggcgaaacacagaagcggattggcaccgccgatagggaactgatccagacctccgcattgaatttcctgaccccccttcgaaactttatcgagggggattataaaactatcgccaaagagaggaagcttctgcagaataaaagactagaccttgacgcggcaaagacccgcttgaaaaaagcgaaagctgccgagactcgaaactccagcgagcaggaactgagaattactcagtcggaattcgatcggcaagcagaaatcactcgactcctgctagagggcatatcctcaactcacgcccatcacttgcgctgtttgaacgacttcgtggaggctcagatgacctattacgctcagtgctatcagtacatgttagaccttcaaaagcaattaggctcgttcccctcgaactatctgtcaaataacaaccagacctcagttactccggtcccctctgtcctgccaaatgctatcggctctagtgctatggcctctacaagcggcttggttatcactagtccctcaaatctgagcgacctgaaagagtgtagcgggagccgcaaggctcgggtgttatacgactacgacgccgcaaactctaccgagctgagcctgctggcagacgaagtgattactgtgtttagtgtcgtgggcatggactcagattggctgatgggagaacggggaaatcagaaagggaaggtgcccatcacgtacctcgagctgctgaattag

SEQ ID NO: 244752 - DNA, 636 bp, Artificial Sequence
  Description of Artificial Sequence: Synthetic coding sequence
atggcgggagtgggagctggacccctgcgtgcaatgggcaggcaagccctgttactgctggccctgtgcgccaccggggcacaagggctatattttcacattggagaaacggaaaaacggtgctttatcgaagaaattccagacgaaactatggtcatcggaaactatagaacccagggcatgcacgtagaagtcaaggaccctgatggcaaggtcgtgctgagccggcagtatggaagtgagggacgattcacattcaccagtcacacacctggagaccaccagatctgtctgcactccaactcaacacgcatggctctattcgctggcggaaagttgagagttcacctagacatacaagttggcgagcatgctaataactatccagagatcgcagcaaaggacaagttaacagagcttcagttgcgtgcgcgacaattgctggaccaagttgaacagatccagaaggaacaagactaccagcggtatcgcgaggaacgatttcgcctaacatctgaatcaactaaccagagagtgctctggtggtcaattgcccagaccgtaatactgattctaaccggaatttggcaaatgcgccacctgaaatcattctttgaggccaaaaaactggtgtag

SEQ ID NO: 244753 - DNA, 684 bp, Artificial Sequence
  Description of Artificial Sequence: Synthetic coding sequence
atggcgggagtgggagctggcccattacgggctatgggtcgccaagctctactgctgctagccctgtgcgcaaccggggcacaaggactgtacttccacatcggagagaccgaaaagagatgttttattgaggaaattccagatgaaacgatggtgataggaaattatcgtacccagatgtgggataagcagaaagaggtgttcctcccatctacacccggtttgggaatgcacgttgaagtcaaggatccggacggcaaagtggttttgagtcggcagtacgggtcagagggtcgatttacattcacaagtcacacaccaggggatcatcagatctgcctgcattcaaattcaactcgcatggccctctttgccggtggaaagcttagagtgcatctcgatatccaggttggcgagcacgctaataactatccagagatagcagctaaagacaaactgacggagctccagcttagagctcgacaactgctggaccaggtcgaacagatacagaaggagcaggattaccagcgctaccgggaggagcgttttcggctcacgtcagagtccacaaatcagcgagtgctttggtggtccatcgcccagaccgtcatcctgatcctgactgggatttggcagatgagacatcttaagtcgttctttgaagccaagaaattggtttag

SEQ ID NO: 244754 - DNA, 660 bp, Artificial Sequence
  Description of Artificial Sequence: Synthetic coding sequence
atgtctggattaagtggtcctcctgctcgaaggggcccattccccctcgcactgctgttactgtttctgctcggccctcgactcgtgcttgccatttcatttcacctgccgataaacagcagaaaatgcctgcgggaagaaatccataaggatctgctggttacaggcgcttatgagatatccgaccaatcaggtggggcaggcggattgcgctcccatctgaagataacagactcagcgggacacatactatacagtaaggaggatgctacaaaaggcaagttcgctttcactaccgaagactatgacatgttcgaagtatgttttgagtctaagggcacaggcagaattccggaccagctggtgatattggatatgaagcacggtgtcgaggccaaaaactacgaagagattgcaaaagttgagaaattgaagccactggaagttgaactcagaagactcgaggatctatcagaaagcatcgtaaatgatttcgcttatatgaaaaaaagggaggaagaaatgcgggacacgaatgagtctacaaatacaagagtcctatatttcagcatcttctctatgttttgcttaattggcctcgcgacttggcaggtattttatctgcggagattcttcaaagctaaaaaactcatcgaatag

SEQ ID NO: 244755 - DNA, 471 bp, Artificial Sequence
  Description of Artificial Sequence: Synthetic coding sequence
atggcgggttggccgggagccggaccactgtgcgtgctgggtggggctgctttaggcgtgtgccttgcaggggtcgctggccagttggttgagccttcaacagcgcctccgaagccaaaacccccacctttgaccaaggaaactgtggtgttttgggacatgagattgtggcatgtggtgggcatattctcactttttgtgctttccatcataatcacgctatgttgtgtattcaactgtagggtacctaggacacggaaggagatcgaagccagatatctccaaagaaaagctgccaaaatgtacactgacaagctcgagaccgttcccccactcaatgaactaacagaagtgccgggagaagataaaaagaaaaaaaaaaagaaaaagaaggactccgtcgataccgtcgctatcaaagtcgaggaggacgaaaaaaacgaagctaagaagaaaaagggggagaaatag

SEQ ID NO: 244756 - DNA, 1602 bp, Artificial Sequence
  Description of Artificial Sequence: Synthetic coding sequence
atgaacgagtcccccgatcccactgacttggccggagtcatcatcgagcttggccctaatgattccccgcagacgtctgaatttaaaggggcaactgaagaggcccctgcgaaagaatctgtgcttgctcggttgtccaaattcgaagtcgaggacgccgagaatgtggccagctatgatagcaagatcaaaaaaatcgtacattctatcgttagctcttttgcttttggactgttcggagtctttctggtgctgctggatgtcactctcattctggcagacctcatattcaccgattcaaaactgtatatccccctagagtaccggagcatcagtcttgctattgcgctgttttttctcatggatgttctcttgagggtgttcgttgagcgcagacaacaatatttctccgatctgtttaatattctcgatactgccatcatcgtcattttactcctggtggacgtggtgtacattttcttcgacatcaaattattgcgcaatatcccacgatggacccatctcttgaggctgctgagattgatcatcctgttacgcatatttcatctcttccaccagaaaaggcaacttgaaaagctgataaggcgccgtgtctctgaaaataagaggcgatatacacgagacggctttgatttagacttaacatacgtgactgaacgtataattgccatgtcattcccctcctccggcaggcaaagtttctaccggaacccaatcaaagaggtggtcaggttcctggataaaaaacatcgcaaccactacagagtttacaacctctgtagcgagagggcctatgacccgaagcacttccataatagagttgtgcgaatcatgatagacgaccacaatgtaccgaccctacaccagatggtggtgttcactaaggaagtcaacgagtggatggcacaggatctcgaaaatatagtagcgattcactgtaaagggggaacggataggacagggactatggtttgtgcatttcttattgcatccgagatctgtagcaccgccaaggaatccctctattatttcggagagagaagaacggataagacccactccgagaaattccagggtgttaaaacccctagtcagaagcggtacgtggcatattttgcgcaggttaagcacctttacaattggaatctgcctccaaggcggatccttttcataaaacatttcatcatatattcaatccctcgatatgttcgcgatctgaaaatccagatcgagatggagaagaaggtcgtgttcagcacaatttccctcggcaagtgctctgtgctggataacatcaccaccgacaagattcttatcgacgtgtttgacggtctgccactgtatgacgacgtaaaggtgcagtttttttatagtaacctaccaacatattatgataactgctccttctatttctggctccatacttctttcatagaaaataatcgcttgtaccttccaaagaacgagctcgacaatttgcacaagcagaaggctcgcagaatctacccttccgatttcgctgttgagattctttttggcgagaagatgactagcagcgacgtggtggcaggcagcgactag

SEQ ID NO: 244757 - DNA, 1542 bp, Artificial Sequence
  Description of Artificial Sequence: Synthetic coding sequence
atgaacgagagcccagacccgactgacctggccggtgtcataattgagctcggtcccaacgatagccctcagactagtgaatttaagggggctaccgaggaagcccctgctaaggagtcctccaagattaaaaaaatcgttcacagtatcgtgtcctcatttgcttttgggctctttggagtgtttctcgttctattggatgtaacgttaatcctagcagacctcatcttcactgattccaaactttatatacctctcgagtatcggagcatcagccttgcgatcgcactgtttttcctcatggacgtcttactccgagtgttcgttgaaagacggcagcagtactttagcgatctcttcaatatcttggatacagctataattgttattcttctcttagtggacgtggtgtatatcttctttgatatcaagctgcttagaaacatcccacgctggacacatctgctgagacttctacgactcatcattttgctccgcatttttcacctgttccaccaaaagaggcagctggaaaagttaatccgcaggcgcgtctcagaaaataaacgccgttacacacgcgacggcttcgacctggacctgacgtatgtcaccgagaggataatcgccatgtccttcccatcttccggaagacagtcattctatcgtaatccgatcaaggaggtcgttcggttcttggataaaaaacaccgtaatcactatagggtctataacctgtgttccgaacgagcctacgaccctaagcacttccataacagagttgttagaataatgatagacgaccacaatgtgcccacattgcaccagatggtagtgttcacgaaagaggtcaacgagtggatggcccaagacctcgaaaatatagtggccatccattgcaagggaggaacagaccgcactggaaccatggtatgtgccttcctgatcgcctccgaaatttgctctacagcaaaggagtcactgtactattttggcgagcgacggaccgataagactcatagtgaaaagtttcaaggagttaagacccccagccaaaagcggtacgtcgcatacttcgcacaggtgaaacacctgtataattggaatttgccccctaggaggattctgtttatcaaacattttatcatttacagtattcctagatatgtccgggacctgaagatccagattgagatggaaaaaaaggtggtgttttctacaataagcctaggcaagtgcagtgtgctggacaacatcacgactgacaagatcctaattgatgtttttgacggcctgccgttgtatgatgacgtgaaagtccagttcttctactccaatctgccaacatattatgacaattgttctttttacttctggttgcatacctcttttatagaaaacaaccgactctacctcccaaagaatgaactggacaacctccacaaacagaaagcgaggaggatttacccctccgatttcgcggtggagattctttttggagaaaagatgacttctagcgacgtggttgctgggtcagactag

SEQ ID NO: 244758 - DNA, 1656 bp, Artificial Sequence
  Description of Artificial Sequence: Synthetic coding sequence
atgaacgagagtccagaccccactgatctcgctggagtcatcattgaactgggacctaatgatagtccgcagacatctgagtttaaaggcgctacggaggaggcccctgcaaaagaatcccctcatactagcgaatttaaaggtgccgctagggtgtcacccatttcagagagcgtgcttgcacgcctgtctaagtttgaggtagaagacgctgagaatgtggcgtcttatgactccaaaatcaagaagatcgtgcactctatcgtgtcatccttcgcctttggccttttcggggtcttcctcgtgctccttgatgtcactcttatactggcggatctgattttcacagacagcaagctgtatattccacttgagtacaggagcatctctttagcaattgctctgttctttctaatggatgtacttttaagggttttcgtagagcgtagacagcagtatttctcagacttattcaatattctggacacagccattattgtgatcctcctccttgtagacgtagtctacatcttttttgatatcaaactactgcgaaatattccacggtggacacacctgctgcgtctcctacgcctgataatactccttcggattttccacctgttccatcagaaacgccaattagaaaaactcattcgcagaagggtgagtgagaacaagcgcagatatacaagggacggattcgacctggatctgacctatgtgactgaaaggattattgccatgagtttcccaagcagtggacgccagagcttttacaggaacccgataaaagaagtcgtgcgctttctggataagaagcaccgcaatcactaccgggtgtacaacttatgttctgaaagagcgtatgaccctaagcacttccacaaccgagttgtacgaattatgattgatgatcacaacgttcccacattacaccagatggtggtctttacaaaggaggtaaacgagtggatggctcaggacctggagaatatcgtggccatccattgtaaggggggtaccgatagaactggcactatggtgtgcgcttttctgatcgccagcgaaatctgcagcaccgctaaggagtcactatactacttcggtgagaggcgcactgataagactcatagcgagaagtttcagggtgttaaaacgccgtcccagaagcggtatgtggcgtacttcgcccaggtcaagcatctttacaattggaatctcccacctagaagaatactgtttattaagcatttcatcatatactcgattccacggtatgtacgggacttgaaaatccaaatagagatggaaaaaaaggtcgtgttctccaccatttctctggggaaatgctcagtgctcgataatattacaaccgataaaatcctgattgacgtgtttgacggccttccactgtacgacgacgtaaaagtccagtttttttattccaacctgcccacttactatgataactgttctttctatttttggctccatacgtcattcattgaaaacaacagactgtacctgcccaagaacgaactggataatctgcataagcagaaagccagacggatttacccttctgactttgccgttgaaattctctttggagagaaaatgaccagttcggatgtcgtggcaggctcagattag

SEQ ID NO: 244759 - DNA, 1692 bp, Artificial Sequence
  Description of Artificial Sequence: Synthetic coding sequence
atggagcgagactcacacggaaatgcctcaccggcacgcaccccatcggcaggcgctagcccggctcaggcaagtccggcagggactcccccaggcagggcatctcctgcccaagcctctcctgctcaggcctctcctgctggaactccgcctggacgcgctagccctgctcaagccagcccagccggtacgcctcccggacgggctagcccgggacgggcttcgcccgctcaagcctccccggctcaggccagcccagcccgtgcatccccagcgctcgctagccttagccggtcttccagcgggagatcctcttccgcgagatctgcaagcgtgaccaccagtccgacacgcgtgtacttagtgagagctacaccagtgggcgcagtccctatccgcagctcccccgctcggtcagccccagcgacccgggcaactcgagaatcacccggaacctctttgcccaagttcacctggagggaggggcagaagcagctcccgctgatcggatgcgtgcttttgctgattgccctagtcgtgagtctcatcattctctttcaattctggcagggccacactggtataaggtataaagagcaacgcgaaagttgtcctaagcacgcggtaaggtgcgatggggtggtggactgtaagcttaaatcagacgagctggggtgtgtgcggttcgactgggataaatcccttctcaagatttatagtggaagcagccaccagtggttgcccatttgttcctcaaattggaatgacagctatagcgagaagacctgtcaacaactcggcttcgagagcgcgcaccggacaactgaagttgcacaccgtgacttcgccaacagttttagcattctgagatacaattctacaatccaggaatctctgcaccgctcagagtgtcctagtcagcgctacatatcactgcaatgtagtcactgtggcctgcgggcaatgacgggaagaatagtgggtggggcattagcttccgacagcaagtggccttggcaagtatccctgcatttcggtaccacccacatttgtggcggaacactgatcgacgctcaatgggtgctcaccgcggcacactgtttcttcgtcacaagggaaaaggtgctggaaggctggaaagtgtatgcaggaacgagtaatctccatcaactcccggaggctgcttccatcgctgagatcatcatcaactccaactacacggatgaggaggacgactacgacattgcccttatgaggctgagcaaacccctgaccctaagcgctcacattcatccagcctgtctgccaatgcatggacagactttcagcctgaatgagacatgctggatcacgggtttcggtaaaacgcgggagactgatgacaagacttcgccattcttgagagaggtccaggtgaacctaatcgactttaagaaatgtaatgattacctggtgtacgactcttacctcacaccaagaatgatgtgtgcaggcgacctcaggggaggcagggattcttgccagggggattctgggggtccgcttgtgtgtgagcagaacaacagatggtatctagccggagtaacatcttgggggacgggatgtgggcagagaaataaacctggggtgtatacaaaagtgacagaggtgctgccctggatatactccaagatggagagctctgctgggtag

SEQ ID NO: 244760 - DNA, 1194 bp, Artificial Sequence
  Description of Artificial Sequence: Synthetic coding sequence
atggatcccgacagtgatcagcctttgaacagtctggtgaaggtgattctggacaagtactactttctgtgtgggcagcctctgcactttatcccacgcaaacagctctgtgatggagagctcgattgccccctcggagaagatgaggaacactgtgtcaagagctttcccgaaggccctgcagtggccgttaggttgagtaaggatcgctctacgctgcaggtcctcgattcagcaacaggcaactggtttagtgcatgctttgacaactttacagaagcacttgccgagaccgcttgtagacaaatgggctattcctcaaagcctactttccgcgctgtggagataggaccagaccaggatttggatgtggtagagataacggagaactctcaagagctaagaatgcggaactcctctggcccttgtctctccgggagtttggtatcacttcactgcttggcttgtggtaaaagccttaagaccccccgagtcgtgggagtggaggaggcaagtgttgattcttggccttggcaggtctcgatccagtacgataagcaacatgtttgcgggggatccattctggaccctcactgggtgctcaccgccgcacactgctttagaaagcacacagacgtttttaactggaaggtgcgggcaggatcagataagttaggatcgttcccatctctggctgttgcaaaaatcataataatagagttcaaccctatgtatcctaaagataatgacatagctctaatgaagctacaattcccacttacatttagtgggacagtcagaccaatttgcctgcctttctttgatgaagagttaacaccagctactcctctgtggatcatcggctggggctttactaaacaaaatggaggcaagatgtccgatattctgctgcaggcgtcagtgcaggtgattgactccactcggtgtaacgctgacgacgcctaccagggagaggtcaccgagaaaatgatgtgtgctgggatcccagagggcggtgttgatacgtgccagggagactccggtggccctttgatgtatcagtcagatcagtggcacgtagtggggatcgtgagttggggatacggctgtggcggtccatccactccgggtgtatacacgaaagtttcagcctatttaaattggatttataacgtatggaaggctgagttatag

SEQ ID NO: 244761 - DNA, 1266 bp, Artificial Sequence
  Description of Artificial Sequence: Synthetic coding sequence
atgatgtaccgaaccgtgggatttgggacaaggtcacggaatttgaagccatggatgatagccgtgttaatcgtgttaagcctgacagtggtggcggtgacgatcggcctgttggtgcactttctggttttcgatcagaagaaagagtattaccacggctcctttaagatactggatcctcagattaataataatttcgggcagtctaatacataccagctgaaggacctccgcgaaacaaccgagaatttggtctctcaggtcgacgagatctttattgattctgcctggaaaaagaattatatcaaaaatcaagtcgtgcggctcacccccgaagaggatggagtgaaagtggatgtcatcatggtcttccagtttcctagcactgagcagcgggcagtgcgtgagaagaagatacagagcattctgaatcagaaaatccgcaatttgcgggctcttccaataaatgcctcatcagtccaggttaacgctatgagttcatctactggggaactcacggtgcaggcgtcatgcggaaaacgagtggttcccctgaacgtaaacaggatcgcttcaggggtcattgcccctaaagccgcttggccttggcaagccagcctacagtacgataatatccaccagtgtggcgctacacttatctcaaatacctggctcgtaaccgctgctcactgttttcagaaatataaaaatcctcaccaatggaccgtgagtttcggcacaaagattaatccacctttgatgaaaagaaacgtgaggcgattcatcattcacgaaaaatatcgaagcgccgcacgcgagtatgatattgccgtagtccaagtttctagtcgcgtgaccttctcagacgatatcagacagatatgcctaccagaggcatcggccagttttcagcccaatctgacagttcacattacaggctttggggctctctattatggaggagagagtcagaatgatctgagagaagctagggtcaagatcattagcgatgacgtgtgcaagcagccgcaggtctacggtaacgacatcaagcctggcatgttttgcgccggatacatggaggggatatatgatgcttgcaggggggacagtggagggcctctcgtgacacgcgatctcaaggatacttggtacctgatcggaattgtgagctggggtgacaactgcgggcagaaggataaacctggagtctatacccaggtgacgtattatcgtaattggatcgcttctaagaccggcatctag

SEQ ID NO: 244762 - DNA, 1257 bp, Artificial Sequence
  Description of Artificial Sequence: Synthetic coding sequence
atgatgtacagaacagttggctttgggacaagatccagaaacttgaaaccctggatgatcgccgtgctgattgtgctcagtctgacagtagttgccgtgaccatcgggctgcttgtccactttctggtgttcgaccaaaaaaaggaatattaccacggctcctttaagatcctggaccctcaaatcaataataatttcggacagtctaatacttatcagctgaaggatttaagggaaaccacagaaaatctcgtggacgagatcttcatcgactccgcatggaagaagaattacataaagaaccaggtggtgaggctgacacctgaggaggatggggtaaaggtggacgtgatcatggtattccagtttcctagcacagagcagagggcagtgagggagaagaagattcaaagtatattgaaccagaagatccgcaatctcagagcgctaccaattaatgctagttccgtgcaggtgaacgcaatgtcctcttccactggcgagcttacagtgcaagcaagctgtggaaagcgggtcgtccccctaaatgtcaaccgaatagcatcaggtgtgatcgctccaaaggccgcatggccctggcaagcatctctccagtatgataacattcaccagtgtggggcaacactaatcagcaatacctggctggtgacagccgctcactgtttccagaagtataagaaccctcaccagtggaccgtgtcatttggaacaaaaataaatccaccactgatgaagcgtaacgtccggagattcatcatacatgaaaagtaccggtcagctgcccgtgagtacgacatcgctgtcgtgcaggtgtcgagtcgagtcaccttcagtgacgacatcaggcagatttgcttaccggaggcaagtgccagctttcaacctaatctcacggtgcacattacaggattcggcgcactttactatggaggggaatctcaaaacgaccttcgcgaggcacgcgtgaagattatttccgatgatgtctgcaaacaaccgcaagtgtatggcaacgacatcaaaccgggtatgttctgtgccggatatatggagggcatttatgacgcatgccgtggggattcggggggtcccctcgtgacaagagatttaaaagacacctggtacctaattggcatcgtgagctggggagataactgcgggcagaaagacaaaccaggggtgtatacacaagttacctactatagaaattggatcgcttcaaaaaccggtatctag

SEQ ID NO: 244763 - DNA, 1254 bp, Artificial Sequence
  Description of Artificial Sequence: Synthetic coding sequence
atgtaccggacagtagggttcggcactcgcagccgtaacctgaaaccttggatgatcgcggttctgatcgtgctgtccttgacagtcgtggctgtcacaatagggttattggttcattttctggtgttcgaccagaagaaggaatactatcatggctcattcaaaatcctcgaccctcagatcaacaacaactttggccaaagcaacacctatcagctaaaagacctccgagaaaccaccgagaaccttgtggatgaaatcttcatcgattctgcttggaaaaagaactacatcaaaaatcaagtggtccggctgacccccgaagaggatggtgtcaaggtggatgttattatggtttttcagttcccctctaccgagcagagggctgttagggagaaaaagatccaaagtatcctcaatcagaaaatccggaacctgcgcgcactgcctatcaacgctagctctgtccaggtgaatgcgatgagctcctccaccggggaactgaccgtccaggcaagctgcggcaaaagagtcgtgccgcttaatgtgaataggatcgccagcggcgtgattgctcccaaagccgcatggccctggcaggcaagcctgcagtacgacaacattcatcagtgcggagctaccctgataagtaacacctggcttgttaccgccgcacactgcttccagaagtacaaaaacccacatcagtggacagtaagctttggcacaaagattaaccccccattaatgaaacggaacgtgcgcagattcataattcacgagaaatacagaagtgctgcacgcgagtatgatatcgctgtggtacaggtgtcatcaagggtgaccttctctgacgatatccgacagatttgccttcctgaagcatccgcctcctttcagcctaatctcactgtccacatcaccggattcggcgcactatactacggcggtgaatctcagaacgacctgagggaagctcgtgttaagattatttcagacgacgtctgtaaacagcctcaggtgtacgggaacgacatcaagccagggatgttttgcgcagggtatatggaaggcatttatgatgcctgcaggggcgactctgggggtcctctggtgaccagggacttgaaagatacctggtaccttattggaattgtcagctggggcgacaactgtggacagaaagacaagccaggcgtgtacacccaagttacatattatcgcaattggatcgcaagcaagacaggcatctag

SEQ ID NO: 244764 - DNA, 1689 bp, Artificial Sequence
  Description of Artificial Sequence: Synthetic coding sequence
atggaaagggacagtcatgggaatgcgagtccagcacgcacgccctccgcgggagctagccctgctcaggcatcgccagcagggacgccaccagggagggcaagtccagctcaggcatcccccgctcaggcttctccagccggtactcccccaggtagggcttctcctgcacaggcaagccctgccggaactccccctggcagggcttctcccggacgtgcatcccctctccaggcttccccagctcgggcttctcctgccttggccagcctttcccgcagctcatcagggcgatcatctagcgccagatccgcatctgtgaccaccagccccacgcgagtttatctagtgcgggcaacacccgtaggagctgtgcccatccggtcctctccagctcgaagcgccccagcgactagggcaacccgggagagtccaggaactagcctacccaaatttacgtggcgggaagggcagaagcagttacccttaatcggctgcgttttactgttaatcgcccttgtcgtgtctctcatcatcctgttccagttttggcaggggcacaccggcataaggtataaagaacagcgggagagctgtccaaaacacgccgtaagatgcgatggggttgtcgactgcaagttgaaaagcgatgagctgggttgcgtacggttcgactgggataagtctttactgaagatttattctggaagcagtcaccagtggctgcccatctgctcatcaaactggaatgactcttactccgaaaaaacgtgccagcagctgggcttcgagagcgcccaccgtacaaccgaggtcgcgcacagggacttcgccaattccttctctattttgcgttataactcgaccatccaggaatcgttacatagatctgagtgtccctctcagaggtatatcagtctccagtgcagccactgtgggcttcgcgcaatgacgggcaggatcgtgggcggagccttggcctcagactcaaagtggccttggcaggtttcactgcacttcggcaccacacacatttgtgggggaacattaatcgacgcccagtgggtgctgaccgcagcacactgcttcttcgtcacacgcgaaaaggtgctagaaggctggaaggtgtatgcaggcacctctaaccttcatcaattgccagaggcagcctccatcgccgaaattataattaattccaactatacggatgaggaagacgattatgatatagccctgatgcggctgagcaaaccactgacactgtctgctcacattcatcctgcctgcctccccatgcacggccaaacattctccttaaacgaaacttgttggatcacaggctttggaaaaacccgtgaaacagacgataaaacttctccctttcttagggaagttcaagttaacttgatagattttaagaagtgtaatgattaccttgtgtacgattcctacctcacccccagaatgatgtgtgctggagacctgcgtggtggcagggactcatgccagggtgacagcggcggaccgttggtctgcgaacagaataatcgctggtacctggcgggtgtaacaagctggggcactggctgtggacagcgcaacaaaccaggagtgtataccaaggttactgaagtgctcccatggatctacagcaaaatggagtctgaggtgaggtttcgcaaatcatag

SEQ ID NO: 244765 - DNA, 1761 bp, Artificial Sequence
  Description of Artificial Sequence: Synthetic coding sequence
atggaaagagactcacacggtaatgcctcccccgcaagaaccccctcggcgggagcaagcccggcacaggcaagtcccgctggcacaccccctggcagagcaagcccagcccaagcatctcccgcacaggcctccccagctggcacacctcctggccgagccagtcctgcccaagccagcccagcaggcacaccccctggcagggccagtcctggtcgcgcttcccccgctcaggcaagccctgcccaagcttcccccgctagagcctccccagcactggcctctcttagtcgcagctcctccggcagaagcagttctgcaagatcagcctctgtgacaacaagcccaaccagggtgtaccttgtgcgcgctactccggtgggtgccgtacccattaggtcctcacccgcacgctccgcccctgctacaagagcaacaagggaatcccccggtacttctcttcccaagtttacctggcgtgaaggtcagaagcagctaccattgattggatgcgttctgctgctgatcgccctagtggttagcctgattatcctttttcagttttggcagggacacaccggcatcagatacaaggagcaacgggagagctgcccgaagcacgccgtgaggtgtgacggtgttgtagactgtaagcttaaaagtgatgagcttggttgcgttcgctttgactgggataaatcgctgcttaagatttactctggcagcagccaccagtggctgcccatatgtagctcaaattggaatgattcttactcagagaagacctgccagcagttgggcttcgaatccgcacatcgaacaacagaggtggctcatcgtgattttgcaaatagtttctccattctgcgatataattcaactattcaggaaagcctccacaggagtgaatgccctagtcagagatatatcagccttcagtgctcccactgcggactgcgtgctatgaccggcaggattgttggcggtgctctcgcctccgactcaaaatggccttggcaggtgtccttgcactttggcactacccacatctgcggaggcactcttattgacgcacaatgggttttgaccgcagcgcactgcttttttgtcaccagagagaaagtattagaagggtggaaagtttacgccggaacttccaaccttcaccagctgcccgaggcagcctcaatagccgaaatcattatcaatagcaactatactgacgaggaagatgattatgatattgccctcatgcgcctgtcaaaacctctcacactgtccgcgcatatccacccagcctgtctaccaatgcacgggcagacattctccctgaacgagacctgttggatcacgggctttgggaagactcgggagacagacgacaaaacttcaccatttctgagggaagtacaggtgaatctgattgacttcaaaaaatgcaacgactacctcgtctatgactcatatctcacaccacggatgatgtgtgccggtgatctgcggggtggccgtgactcatgtcagggtgatagcggaggtcccctcgtttgcgaacagaataacaggtggtaccttgcaggggtaacatcttggggaaccgggtgcgggcagcgcaataagcccggagtttatactaaggtcaccgaggtgcttccctggatctatagcaagatggaggtaagaagtctgcagcaggacactgcaccctccaggcttggcacttcgtcagggggagacccagggggtgcacctcggctctag

SEQ ID NO: 244766 - DNA, 1704 bp, Artificial Sequence
  Description of Artificial Sequence: Synthetic coding sequence
atggagagagactctcacggaaatgctagtccagcacgtacacccagcgccggtgcctcccccgctcaagcgagccctgctgggaccccccctggaagagcaagccccgctcaagccagtcccgcacaggcttcacctgccggaaccccacccggaagggcatcccctgcccaggctagcccagctgggacacctccaggtagagcctcacctgggagggccagccccgctcaggcctctcctgctcaggcatctcctgctcgggcatcccccgctctcgcaagcctgagtagatcatcttccggaagatcatcctctgccaggtccgcatcagtgacaacatcgccaacgcgggtataccttgttagagccactccggtgggagccgtgccaatacgctcctcgcctgcaagatccgccccagccacgcgagcaacgagagaatccccaggtacttccctccccaagttcacctggcgggaggggcagaaacaactcccactgattggatgtgtcctcttactgatcgcgctcgtagtttcactgatcatccttttccagttctggcagggccatactggcatcagatacaaggaacagcgggagtcctgcccaaagcatgctgttcgttgtgatggagtagtggactgcaagctgaaaagcgatgagctgggatgtgtcaggtttgactgggacaagtcactgttgaagatatacagcgggagtagccaccagtggttgccgatatgttcttccaactggaatgattcgtacagcgagaaaacctgccaacagctgggctttgagtcagcccatcggacaactgaggtggcccaccgcgacttcgccaactctttctctatccttcgatataactcgactatccaggaaagtttgcataggtcggaatgcccttcccagcggtatattagcctgcagtgtagtcactgcggcctccgggcaatgaccggacgcattgtcggcggagcactcgctagtgactcaaaatggccctggcaggtgtccttgcatttcggaactactcacatctgtggtggaaccctgatcgatgctcagtgggtactgacagcggctcattgtttctttgtcacccgagaaaaggtgctcgagggatggaaagtgtatgcgggaacaagcaatctgcaccaactcccagaagccgcatcgatagccgaaatcatcattaactcgaactatactgatgaggaggatgactacgatattgccttgatgaggctttccaagccccttacattgtccgcgcacatccaccccgcatgtctgcctatgcacgggcagaccttcagtctcaatgaaacctgctggatcacagggttcggaaagacacgcgagacggacgataaaacatcgcctttcctgcgagaggtgcaagtgaacctgatcgattttaagaagtgtaacgactacctggtgtatgattcttacctgactcctcggatgatgtgtgcgggagacctccgaggagggcgtgattcatgtcagggagacagcggaggaccactagtatgcgagcagaataaccgctggtacttagccggagtgacaagctggggaaccggatgtggccaaagaaataagccgggtgtctacactaaagtgacagaggtcctgccctggatttactcaaagatggagtcagaggtgcgttttcgcaaatcatag

SEQ ID NO: 244767 - DNA, 1476 bp, Artificial Sequence
  Description of Artificial Sequence: Synthetic coding sequence
atggagcgggacagtcatgggaacgcttcccccgcaagaacgcctagtgccggtgcctctccagcgcaggcttcccctgcagggacacctcctggaagggcatcacctgcccaggcctctcctgctcaggcatccccagctgggacaccccctggacgcgcttctccagctcaggcaagccccgctggcacaccccctgggagggccagcccgggacgggcttcccccgcacaagccagtccagcacaggcatctccagccagggcttcgcccgctctcgcttccctcagtaggagttcctctggtcggagttcgtccgccaggagtgcctctgtgacgacttcacccactcgggtctaccttgtgagagctacaccagttggagctgtgcctatccgctcttcccctgccaggtcagccccagccacccgagcaaccagagagagccctggtacaagtcttcctaagtttacctggagggagggccagaagcagcttcccctgataggctgcgtgcttcttctgatagccctcgttgtgtcccttatcatcttattccagttctggcagggccacactgggatccggtataaggaacaaagggaatcctgtccgaaacatgccgtccgctgtgacggtgtggtggactgcaagttgaagagcgacgaactcgggtgcgtgagattcgactgggacaaatctctgctcaagatttacagcggctcttcccaccagtggctgcccatctgcagcagtaactggaatgactcctacagcgaaaaaacttgtcagcaattaggatttgaatccgcgcaccggaccacagaagtagctcatagagacttcgccaattctttcagtatcttacgctacaacagcacaattcaggagagcctgcatcgctcggagtgcccctctcagaggtacatatcgcttcaatgcagccattgcggtctgagagccatgaccgggaggatcgtcggaggagccctggccagtgactctaagtggccttggcaagtgtccttgcactttgggaccactcacatctgtggaggcacactgattgacgcccagtgggtcctgactgccgctcattgttttttcgtgacccgcgaaaaggtgctggaagggtggaaagtctatgctggcacttctaatttgcatcagctgccagaggctgccagcatcgccgagattatcattaacagcaactataccgatgaggaggatgactacgacatcgctttaatgcggttgagcaagcctctgaccctttccggcgagggcatttgcacaccgagatcccctgcccctcagcctcagcatcctctccagccatctcacctttcagcttctgtgaatagctatccaggacccaaagctagcgcagggcagaagtccaagactctgaaagatccttatatggagcatttttgttttatcattagagaaacagaggcgcaagggctttag

SEQ ID NO: 244768 - DNA, 1599 bp, Artificial Sequence
  Description of Artificial Sequence: Synthetic coding sequence
atggagcgggactcccacggcaatgcatcgcccgctcgcacaccttccgcaggtgccagcccagcgcaggcatcaccagcaggcacaccgccaggcagagcaagccctgcccaagcgtccccagctcaggccagcccagcaggcacacccccaggacgggcttctcctgcacaagccagtccagctggcacaccgcctggccgagcaagtccaggtcgggcttcaccggcacaggccagtccggcacaggcatctcctgcccgagcctccccggcactagcatcactttcgaggtcaagttcaggaagatcctcctccgctcggtcagcctcagtcacaacttcaccaaccagggtgtacctggtccgcgctacgcctgttggagctgtgcccattagatctagcccagccaggagcgcgcctgcaacgagagccaccagagaatccccagtacaattttggcaaggtcacaccggaatcagatacaaagagcagagagaatcttgcccaaaacatgcagttcgctgcgacggggtggtcgactgcaaactgaagtcagacgaattaggctgtgttcgattcgactgggataaaagccttcttaagatctacagcggcagctcacatcagtggctgccaatttgttccagtaattggaacgattcatattcagaaaagacctgccagcaattgggctttgaatccgcgcaccgtactacagaagtggctcaccgggacttcgcaaactccttcagcattttgcgttacaattccacaatccaggaaagcctacaccggagtgaatgcccgagtcagaggtacatcagtctgcagtgttcccactgtgggctgcgtgccatgacaggtaggattgttggcggagccctggctagcgactctaagtggccctggcaggtgtcccttcacttcggcaccactcatatctgcggaggaacccttattgacgcacaatgggttctgaccgctgcacattgctttttcgtgacaagagagaaagtactggagggatggaaagtttacgccggaactagtaatttgcaccaattgcctgaggctgcatccattgcggaaatcatcataaactccaattataccgatgaagaagatgattatgatatcgctctcatgcgtctttctaagcctctgacactcagcgctcatatccatccagcctgcttgcccatgcatggacagacgtttagtctgaatgaaacatgctggattacaggttttggtaagacccgggaaacagatgataagacttctccttttctgcgcgaagtgcaagtcaacctcattgatttcaaaaaatgtaatgattatttagtttatgatagctatctgacaccaagaatgatgtgcgccggagatcttagaggaggaagggatagctgtcaaggagactctgggggtccattagtgtgtgagcagaacaacaggtggtatttagccggagtaactagctggggcaccggatgcggtcaaaggaataaaccaggggtctacactaaggtgacagaagtacttccttggatttatagtaaaatggaaagtgaggtaaggttccgtaaatcatag

SEQ ID NO: 244769 - DNA, 1365 bp, Artificial Sequence
  Description of Artificial Sequence: Synthetic coding sequence
atgggcgagaatgacccgcctgccgtggaagcccctttctctttccgcagcttgtttgggctagatgatttgaaaatcagccctgtcgcccctgacgctgacgccgtcgctgctcagatcttaagcctgctgcctctcaagttcttccccattatagtcataggaatcattgctctgatcctcgctcttgccatcggcctcggaatacattttgattgttccgggaaataccgctgtcgttcctcttttaaatgtatcgagttgattgcaaggtgtgacggcgtgagcgactgcaaggatggggaggatgaatatcggtgcgttagagtaggcggtcagaacgcggttcttcaggtgtttactgcagcttcatggaagacgatgtgcagcgatgattggaaggggcactatgcgaacgtagcctgtgcccagcttggattcccaagttatgtgagttctgacaaccttcgggtctcgtctcttgagggacagttccgggaagaatttgtatctatcgaccatctcctgcccgacgataaagtgacagcgcttcaccattcagtgtatgtgagagagggatgcgcctccggacacgtggtcacattacaatgcactgcatgcggccaccgcagaggatattcttctcgcattgtgggcggtaatatgtctcttctgtcccaatggccttggcaagccagcctgcagttccagggctatcatctctgcggagggagtgtcatcacaccgttgtggattatcactgccgcacactgcgtctatgacctctacttgccgaaaagctggacaatacaggttgggcttgtatctcttttagataaccctgctccttcccatctcgtcgaaaagatcgtttaccactccaaatataaacccaagagactgggcaacgacattgccctcatgaagctggccggaccgctgacatttaacgaaatgattcagcctgtctgcctgccaaacagtgaagagaatttcccggacggaaaggtgtgttggacttccggctggggagcaaccgaagacggagcaggcgatgctagtcctgtactaaaccatgccgctgtgccccttatctctaacaaaatctgtaaccacagggacgtgtacggcggaatcatcagcccctcgatgttatgcgccggttatctcaccggcggagtagactcctgtcagggcgacagtggtggacctttggtatgccaggaacgcagactgtggaaactggtgggcgctacatcctttggaatagggtgtgccgaagtcaataaaccaggcgtgtacaccagagtgacttcattcctcgactggatccacgaacagatggaaagagacctgaagacatag

SEQ ID NO: 244770 - DNA, 1617 bp, Artificial Sequence
  Description of Artificial Sequence: Synthetic coding sequence
atgcaggctgtggggccaaagcccctgccaaccctgctgtgcgggggacgtaccggtcaccgcaccgctcgggtgctcagctttctgattaggtcctgcccatgcgagccaggcaaagggtgcgtttatggtaagccagttacactctggccaacaatctctagtgtcgtgccctctactttcctgggactcggcaactatgaggtagaggttgaggccgaaccagacgtgagaggtccagaaatagtaacaatgggggaaaacgatccccctgcggtcgaggctcccttcagtttccggtccttgtttgggctagatgacttgaagatttctccggttgctcctgacgccgacgcggtggcggcacaaatactgtcactgctgccccttaagttctttccaatcatcgttatagggattattgctcttattcttgcactcgctatcggactcgggatccattttgactgctcagggaaatacaggtgtcggagctccttcaaatgtattgaactaattgcgagatgtgatggcgtctccgactgtaaggacggagaggacgaataccgctgtgtacgagtcggcggacagaacgccgtgctacaagtgttcacagctgcatcatggaaaaccatgtgcagcgatgactggaaggggcactacgccaacgtggcctgcgcccagcttggttttccttcatatgttagttccgataatctccgcgtgtcatcgctggaggggcagttcagagaggaatttgtcagcatcgatcacctgctgccagatgacaaggttactgccctacaccacagcgtgtatgtccgggagggttgcgccagcgggcacgttgtaaccttgcagtgcaccgcatgtgggcaccgtagaggttactctagcagaatcgtaggcggaaacatgagcctgctctcacaatggccttggcaggctagcctccagttccagggctaccatctgtgtggcggatctgttatcacccccctatggatcatcaccgcagctcattgcgtatacgatctttatttgcctaagtcctggacgattcaggttgggttggtgagcctgctggacaaccctgcccctagccacctcgttgaaaagattgtctaccattcgaaatacaagcccaaacggttaggtaatgatatcgcgttaatgaagctcgccggaccactcacctttaatgagatgattcagcccgtctgcctccccaactccgaggagaattttcctgacggaaaggtgtgttggaccagtggctggggcgctacagaagatggtgctggggacgcttccccagtactcaaccatgccgcagttcctttgatctccaataagatatgcaaccaccgggacgtttatggcggaatcatcagcccctcaatgttgtgtgcaggatatttgactggaggtgtcgactcatgtcagggagatagtggaggcccactggtctgtcaggagaggcggctgtggaagctggttggcgctacctctttcggtattggctgtgcagaagtcaacaagcctggtgtatacactagggtcacttcatttctcgactggatccatgaacagatggaacgggaccttaaaacctag

SEQ ID NO: 244771 - DNA, 1035 bp, Artificial Sequence
  Description of Artificial Sequence: Synthetic coding sequence
atgggagagaatgacccgccagctgtggaagcacctttttccttccgttccctctttgggttggatgaccttaaaattagcccagtggccccagatgctgatgcggtggcggcacagatcctatctctgctgcccctgaaattttttcccatcatcgttatcggcatcatcgctctcatcctggcccttgccatcggactcggtatccattttgattgttccggtaagtacagatgtcgctccagcttcaagtgcattgaactgatcgcccgttgcgacggggtttctgactgtaaggatggcgaggacgagtaccggtgtgttagggtgggtggtcagaatgctgtactgcaagtgtttactgcagctagttggaagactatgtgttccgatgactggaaggggcactatgccaatgtcgcatgcgcccagctggggtttcccagctacgtttcatccgacaacctgcgagtcagctctctggaaggccaattcagagaagaattcgtgagcattgatcacttgctgcccgatgacaaggtcactgcactgcatcattctgtctacgtgcgcgagggctgcgcctccgggcatgtcgtaacgcttcaatgtactgcctgtggccaccggagggggtatagttctcgcatcgtgggaggaaatatgtccttactttcgcagtggccttggcaggcctctttgcagtttcagggctaccacctgtgtggcggttccgttattacacccttatggataatcactgccgctcattgtgtgtacgatctttaccttccaaagtcatggacaattcaggttggtctggtaagtcttctcgataaccccgctcctagccatctcgtcgaaaagattgtatatcatagtaagtacaagccgaagcgtttaggcaacgacatagctttaatgaaattggccggtccactcacgtttaacggaacttccggcagcctctgcgggtctgctgccctgccactgtttcaagaagatctccaacttctaatcgaggccttcctgtag

SEQ ID NO: 244772 - DNA, 1362 bp, Artificial Sequence
  Description of Artificial Sequence: Synthetic coding sequence
atgggggagaatgatcccccagccgtggaggccccttttagttttaggtccttatttggtcttgatgatctgaagatctctcctgttgcccctgatgcagacgcggttgccgctcaaattctctccctgctccccctcaaattcttccccataattgtcattggcataattgctctgattcttgccttagctatcggccttggtattcactttgattgtagcgggaagtatcgatgccgcagctcgtttaagtgcatcgaactgattgctaggtgtgacggggtctctgactgtaaggacggcgaagatgaataccgctgcgtgcgggttgggggtcaaaatgccgtgctccaggtattcacagcagccagctggaaaaccatgtgctcagatgactggaaaggccattacgcaaacgtcgcctgtgcacagcttggctttcccagttacgtatcttccgacaatctccgcgtgtcatcactcgaagggcagttccgggaagaatttgtgtccatcgaccacctgctaccagatgataaagtgactgccctgcaccacagcgtctacgtaagagagggttgcgcatcaggccacgtggtgacccttcaatgcactgcttgcgggcaccgaagggggtattcctcacgcatagtcggcggtaacatgtctctactctctcagtggccctggcaagcaagtctacagtttcagggctatcatctgtgtgggggttcagtcatcactcctctctggatcatcactgctgcccactgcgtgtatgacctgtatcttcccaaaagctggacgatccaggtcggcctggtgagtcttctggacaacccggcacctagtcatctggttgagaagatcgtctatcactctaagtacaagcctaaacgcttagggaacgacatcgcgctgatgaagcttgcgggtccgctaaccttcaacgaaatgatccagcctgtttgccttcctaactccgaggagaatttcccagatgggaaggtgtgctggacctctgggtggggtgcgacagaagacggaggggatgcctcacccgtgttgaaccatgccgcagtccctttgatctccaataagatttgcaaccatagggacgtctacgggggaatcatctcaccttcgatgctgtgtgctggttacctgactggaggggtcgactcatgccagggcgactccggcggaccactggtatgccaggagcggaggctgtggaagctggtgggagccacatcgtttggtatcgggtgtgctgaggtcaacaaaccaggcgtttatacccgggtgaccagctttcttgactggatccatgagcaaatggagcgcgacctgaaaacctag

SEQ ID NO: 244773 - DNA, 1314 bp, Artificial Sequence
  Description of Artificial Sequence: Synthetic coding sequence
atgctccaggacccagacagcgaccaaccgcttaactccctcgacgttaaacctctgaggaagccccgaattccaatggaaaccttccggaaggtgggtatcccaattattattgctctgctgtcgctggcaagcatcattatcgtggtggtgcttatcaaagttattcttgacaaatattatttcctgtgcggacaacccctccacttcatccccagaaagcagctctgtgacggggagttggattgcccgctcggagaggatgaggagcattgcgtgaagagtttccctgaagggcctgccgtagctgttaggctctctaaggatagaagcactttacaggtgctcgattcagctaccggcaattggtttagcgcgtgctttgacaacttcacggaggctttggctgaaaccgcctgtaggcaaatgggctactcaagtaagcctaccttccgggctgtggaaattggccctgatcaggacctggatgtggtggagattacagaaaattctcaagagctccgcatgcgcaattcctctggcccatgcctgtcaggaagtttagtgagccttcattgcctggcctgcggaaagtctttaaagacacctagggtcgtaggggttgaagaggcatctgttgactcatggccctggcaggttagtatccagtacgacaagcagcacgtgtgcggaggatcgattctggaccctcactgggtcctgacagccgcacactgtttcaggaagcataccgacgtgttcaattggaaggtgcgggcaggctccgacaagcttggctcatttccctcattggccgttgctaaaataataatcatcgagttcaaccccatgtaccccaaggataatgacattgccctgatgaaacttcagtttcccctgacgttcagcgggaccgtccggccaatctgcctccctttctttgatgaggagctcacccctgcaacacccctttggattatcgggtggggctttaccaaacagaacgggggaaagatgtcagatatcttactgcaggcgtcagtccaagttatcgactcaacacgatgcaatgccgacgatgcctaccagggggaagtgactgaaaagatgatgtgcgccggaatacccgaagggggagttgatacttgtcaaggcgactcaggaggccctctcatgtaccagtccgatcagtggcacgttgttggcattgtttcctggggatacggttgcggaggaccatccactcccggagtctatacaaaagtgtctgcctatctgaattggatatataatgtgtggaaggccgagctctag

SEQ ID NO: 244774 - DNA, 1299 bp, Artificial Sequence
  Description of Artificial Sequence: Synthetic coding sequence
atgctccaggatccagatagtgaccagccactcaattcccttgacgtcaagcctctgcggaagcccaggatccctatggagactttccggaaagtaggcatccctattattattgccttgctgtcactcgcttcaattatcatcgtggtcgtcttgatcaaagtgatactggacaaatattatttcctctgcggtcaacccctgcactttatccctcgcaaacaactgtgcgatggagagctagactgccctctgggggaggacgaggagcattgtgtcaagtcgtttccagaaggcccagccgtggcggttagactgtccaaagataggagcacactgcaggtgctcgactctgcaacaggcaactggttctccgcctgctttgataatttcaccgaagccttagccgagacagcatgccgtcagatgggttacagccgcgctgttgaaatcgggccagaccaggatctggatgtggtggaaataacggaaaattcccaggaactaaggatgagaaattccagtgggccatgtctaagtggctccctggtgagccttcattgcctggcatgtggcaaatctttaaaaacaccacgggtcgtgggggtggaggaagctagcgtcgactcttggccatggcaggtctccatccagtatgataagcaacacgtgtgtgggggttcaattctggacccccactgggtgctgacagctgcccattgtttcagaaagcacaccgatgtgtttaattggaaagtacgcgctggaagcgataagctgggcagcttccccagtctggctgtggctaaaattattatcatcgagtttaaccctatgtatccgaaagacaacgacattgcgctaatgaaactccagttcccactgacttttagtgggaccgtgcgccctatttgccttccattctttgacgaagagttaaccccggcaacacccctctggattattggatgggggttcaccaaacagaacggagggaaaatgtccgacattttactccaggctagcgtgcaagtgattgactctacacgttgcaacgccgacgatgcctaccaaggggaggtgaccgaaaagatgatgtgtgccggaattccagaagggggagtggatacatgccaaggcgactccggcggtccgcttatgtaccagtcagaccaatggcatgttgtggggatcgtgtcatggggctatgggtgcggcggtccaagcacacccggagtctatacgaaggtgtccgcgtacttaaattggatttacaacgtttggaaggctgagctgtag

SEQ ID NO: 244775 - DNA, 1308 bp, Artificial Sequence
  Description of Artificial Sequence: Synthetic coding sequence
atggaccccgacagcgaccagccacttaactcactggacgtaaaaccattacggaaacccagaataccaatggaaacatttcgtaaagtaggaatccccattattatcgcgctcctgtcgctggcttccataattatcgtggtggttctgataaaagtgatccttgacaaatattacttcctgtgtggccagcccctgcactttatacctagaaaacaattatgtgatggcgaacttgattgccctctgggcgaggacgaggaacactgcgtaaagagttttccagagggccctgccgtggctgtgagactatccaaagacagaagtacactgcaggtgctggatagcgccacaggcaactggttttcagcatgtttcgacaacttcactgaggccttagccgaaactgcctgcagacaaatgggatactctagcaagccaacgtttagggcagtcgagatcgggccagaccaagatcttgacgtggtagagatcactgaaaacagtcaagaactcaggatgcgcaatagcagcggaccatgtctgtcgggaagcctcgtgtcactgcattgccttgcctgtggaaagtctctgaaaactcccagggtggtgggggtcgaagaggcctccgtagattcgtggccctggcaggtttccatccaatacgataaacagcatgtgtgcgggggatcaattctggaccctcattgggtcttgaccgccgctcactgttttcggaagcacaccgacgtgttcaattggaaggtgcgagccggaagtgataagctcggatctttcccctcgttggccgtggctaagataattatcatcgagttcaacccgatgtatccaaaggataatgatattgctttgatgaaactccagttccctctgactttcagtggtaccgtaagaccaatttgcctgccattctttgacgaggagcttactcctgccactcccctgtggataatcgggtggggatttaccaaacagaacggcggaaagatgtccgatattttgttgcaggcgtcggtgcaggtgattgactctacccggtgtaacgcagatgatgcctaccaaggggaagtgactgagaaaatgatgtgtgccggtatccccgagggcggtgtggacacttgccagggtgatagcgggggtcccctcatgtatcagtccgaccagtggcacgtggtgggcatcgtgtcttggggttacggctgcggaggtccctccacacctggagtctacaccaaagtgagcgcataccttaactggatatataatgtttggaaagccgagctgtag

SEQ ID NO: 244776 - DNA, 1374 bp, Artificial Sequence
  Description of Artificial Sequence: Synthetic coding sequence
atgtctctaatgctcgatgaccagccaccgatggaggcacaatatgcggaggaaggtcctgggcctggcattttccgcgcagagcccggagatcaacaacatcctatttcacaggccgtgtgctggaggagtatgcgacgcggatgtgccgtacttggcgcactcgggctgctggctggcgctggtgtgggcagttggttgctcgtgctctatctttgcccagcagcctctcagcctatcagcggcacactgcaagacgaagaaattaccctctcctgctcagaggctagtgctgaggaagcattgctcccagccctccctaagacagtcagcttccgaatcaattcagaggacttcttactggaggcacaggtaagagatcaacctcgatggctactggtgtgccacgaggggtggagtccagctctcggtctccaaatatgctggtcactcggccatcttagacttactcatcacaagggagtgaatcttacggacatcaaactaaactcatctcaggagtttgctcagctgtccccaaggctcggaggcttcctggaggaagcttggcagccccgaaacaattgtacaagcggccaagtggtgtcgctgcgttgctccgaatgcggagctcgccctctggccagtagaatagtcgggggacagtccgtcgccccaggccgatggccttggcaagcttccgtggctctcggattcaggcatacttgtggaggtagcgtgttggctcctcggtgggttgtaacagcagcgcattgtatgcattctttccgcctagcccgactcagtagttggagagtgcatgcaggactcgttagtcatagtgcggtgcgtccccatcagggcgctttggtggagcggattatccctcacccactgtacagcgcccagaatcatgattacgacgtggcacttctgcgcctgcagactgcccttaacttttcagacactgtgggagccgtctgcctcccagccaaggagcaacattttccaaaaggatccaggtgctgggtgagtgggtggggccacactcatcctagtcatacttactcaagtgacatgctgcaagacaccgtggtgcccctattttcgacccagctctgcaacagttcctgcgtttacagtggcgcactgaccccaagaatgctgtgcgctgggtacttggacggacgtgccgacgcttgccagggcgattccggtggcccactcgtgtgccctgacggtgatacctggagactggttggcgtagtgtcatggggaaggggctgcgctgaacctaaccaccctggggtgtacgccaaagtggctgaatttctcgactggatccatgacacagctcaggattcattactatag

SEQ ID NO: 244777 - DNA, 2436 bp, Artificial Sequence
  Description of Artificial Sequence: Synthetic coding sequence
atgctgctactcttccacagtaaacgcatgcctgttgctgaggcgcctcaggtggctggcggtcaaggagatggaggagacggagaggaagccgaacctgaaggcatgtttaaggcctgcgaggattctaagaggaaggctcggggatacctccgtttagtgccattattcgtcctgctggctctcctcgtgttggcctcagctggagttctgctgtggtacttcctcggatataaggcggaggtgatggtaagccaggtgtatagcgggagcctacgcgtcctaaataggcacttctcccaggacttgacccggagggagagctccgccttccgttctgaaaccgccaaggcgcagaaaatgcttaaggagctgattaccagcacccggcttggcacgtactacaatagctcttcggtgtacagtttcggtgagggccctcttacatgttttttctggtttattctccaaattcctgagcaccgacgcctgatgttgtcccctgaggtggttcaagccctgctcgtcgaggagctgttgtcaaccgttaattctagcgccgcagtgccatatcgtgccgagtatgaggtggatcccgaaggcctcgtgatcctagaggcatctgttaaagatattgccgcactgaacagcaccctggggtgctataggtactcttacgtcggccaaggtcaggtcctcaggttaaaggggccagaccatctcgcaagttcatgtctctggcatctccagggacctaaggacctgatgttgaagctacgcttggagtggacgttggctgaatgccgagatcgtctggcaatgtacgacgtagcgggacccttggaaaaaagattgatcacatctgtgtatggctgcagtcgccaggaacccgtggtggaggtcctcgcatctggggcaattatggccgtggtgtggaaaaaggggctgcacagctattacgacccctttgtactgagtgtgcaacctgtggtctttcaggcctgcgaggtgaatctgactttggacaaccggctggactctcaaggcgtgttgagcacaccatattttcccagttattatagcccgcagacgcactgttcttggcacttaactgtgccctctctggattacggcctggccctctggttcgacgcatacgctctcaggaggcagaagtacgacctcccctgtactcagggccaatggacaattcagaatcggaggctctgtggccttagaattctacagccatatgcggaacggatcccagtggtggctactgctgggattactatcaatttcacgtctcaaatctctctgacggggccaggtgtgcgagtgcattacgggctgtacaaccagtcagacccttgccccggtgagtttctgtgttcagtgaatggtctgtgtgtgcccgcttgtgacggcgttaaggactgccccaacgggctcgatgagcggaattgcgtctgtagagccacattccagtgcaaagaagatagtacatgcattagtctgccaaaagtctgtgatggtcagccggattgtttaaatggctccgacgaagagcagtgccaggagggggtgccttgtggaacatttacattccagtgtgaggataggtcatgcgtgaaaaaaccaaatccccaatgcgatgggagaccagactgccgggacgggtctgacgaggaacactgcgactgcggattgcagggaccttcaagcagaatcgtcggcggagcagtaagttccgagggcgagtggccttggcaagccagcctccaggtaagaggccgtcacatctgtggcggagccctgattgccgaccggtgggttatcaccgcagctcattgttttcaggaagatagcatggcatctactgttctctggaccgtctttctcggcaaagtttggcagaacagtagatggccaggggaggtttcctttaaggtctccagattgcttctgcatccgtaccacgaggaagacagtcatgattacgacgttgccttattgcaactggaccaccctgtggttaggtctgccgcagtgcgccctgtgtgcctcccggcaaggtctcacttcttcgagccagggctccactgctggattaccggctggggagcgctgcgggagggcggacctataagcaatgccctgcaaaaggtcgatgtgcagctgatcccccaggatctgtgtagcgaggtttatcgttatcaggtaaccccaagaatgctgtgcgcaggctaccgaaaaggtaagaaggatgcctgccagggggatagcggcggacctctggtgtgcaaggccctctctggtaggtggtttctggctggacttgtaagttggggcctgggatgcggcagaccaaactattttggggtatatactagaattacaggtgtgatctcttggatccagcaggtagtgacgtag

SEQ ID NO: 244778 - DNA, 2475 bp, Artificial Sequence
  Description of Artificial Sequence: Synthetic coding sequence
atgcccgtggcggaagccccacaggtcgccggtgggcagggcgacgggggagatggagaggaggcagaacccgagggtatgttcaaagcctgcgaggacagtaaacgaaaggcacggggttatctcagattagtccctctgttcgtcctgctcgcccttctggtccttgcttccgccggagtgctgctgtggtattttctcggttataaggctgaagttatggtgtctcaggtgtacagtggttctctgcgggtgctgaataggcatttcagccaggacctcaccaggcgagagtcctcagcctttagaagtgagactgctaaggcccagaaaatgttgaaggagctgattacatccactcgcttaggcacatactacaactcatcctccgtgtactcttttggcgagggcccactcacatgttttttctggtttatcttgcagatccctgaacaccggaggctgatgctatctcccgaggttgtgcaggctcttctggtggaggagctgctgtctactgtgaattcctctgctgctgttccttaccgcgctgagtacgaagtggatcccgagggcctggtcatattggaagcttctgtgaaagatatagcggcattaaactctacgctgggatgttatagatacagttatgtcggacagggccaggttctgcggctgaaagggcctgatcatcttgccagcagctgcctttggcacttacagggccctaaagacctcatgctgaagctcaggctggaatggaccctcgccgaatgtagggaccgattggcaatgtatgatgtggctggccctctcgagaagcgtttaatcaccagcgtgtatggatgctcgaggcaagagccagttgttgaggtgctagctagcggggcaattatggccgtagtttggaagaagggactccattcatactatgatccgttcgtcctttctgtccagccagttgtctttcaggcgtgcgaggtgaaccttactttagacaatcgactcgattcgcagggggtgctgagcacaccttattttccgtcctactattctccacagactcactgctcatggcacctgacagtgccatctctggactacggactagccctatggttcgacgcttacgctctgagacgccagaaatacgatctaccttgcacccagggtcagtggacgatccaaaaccggcgattgtgtggtttgcgcattcttcagccatacgccgaacggatcccagtggtcgccacagctggtataaccattaacttcacatctcagatctccctgactggcccaggggtgagggtccactatggcctctacaatcagagcgatccgtgcccaggtgagtttctctgttccgttaacgggctgtgcgtgcccgcttgtgatggtgtgaaagattgcccaaatgggctggatgagaggaattgcgtgtgccgggcaacattccagtgcaaggaggactcaacatgtatatccctcccaaaggtgtgtgatggacagcctgattgtctcaacgggagcgacgaggagcagtgtcaggaaggagtcccttgcgggacctttacgttccagtgtgaagatcgatcctgtgtgaaaaaaccaaacccccaatgtgacggtagaccggactgtagggatggaagtgacgaggagcactgtgattgcggacttcagggcccatccagccgcatagtcgggggagcagtctcctcggagggtgaatggccgtggcaggcatccctccaagtgcgcggtaggcacatctgcggcggtgctctaattgcggatcgatgggttattaccgcagctcactgcttccaagaggactccatggcaagtactgtactctggaccgtcttcctcggtaaggtgtggcagaattcaaggtggcccggagaggtgtcgttcaaggtcagtcgactgctgctgcacccttaccacgaggaagatagccatgattacgacgtagccttgcttcaattagaccaccctgtcgtgaggtccgccgctgtgaggcctgtatgtcttccagcgagatcacacttttttgaacctggccttcactgttggattacgggctggggggctcttagagagggcgctttacgtgcggacgctgtcgccctgttttatgggtggcggaaccaaggttccgagacatgctgctgtcccatttcaaatgcgcttcagaaggtagacgtacagctaatcccccaagacttgtgcagcgaggtctatcggtatcaggtcacgccacgaatgctgtgcgccggatataggaagggcaaaaaggatgcgtgccagggtgattccggaggcccactcgtgtgcaaggcactgtctggtaggtggttcctggccggtctcgtgtcctggggcctgggctgtgggaggcctaactacttcggggtgtacacgcgtatcactggggtgattagctggattcagcaggtggtgacttag

SEQ ID NO: 244779 - DNA, 2409 bp, Artificial Sequence
  Description of Artificial Sequence: Synthetic coding sequence
atgcccgtggccgaagcgcctcaagtggctgggggacagggcgacggcggagacggggaggaagccgagcccgaaggtatgttcaaagcctgcgaagatagcaaacggaaggctcggggttacctccggctggtccctttgtttgttttactcgctttgctcgtcctggcatctgcaggggtactgctctggtattttctgggatacaaagctgaggttatggtgtctcaagtctatagcggaagcctcagagtgctgaaccgccacttcagtcaggacctgactcggcgtgagagcagcgcattcagatctgagaccgccaaggcccaaaagatgttgaaagagcttatcacctctaccaggttagggacctactacaactcctcctctgtctatagcttcggtgaaggccctcttacttgcttcttttggttcatcctgcaaattccagaacacaggcgactaatgctgagcccagaagtggtccaggcactccttgtagaggagcttctatccacagttaacagctctgccgctgtgccttaccgggctgagtacgaagtcgatccagaagggctcgttattctggaggcatccgttaaggatatcgcagctctgaacagcactctgggctgctacagatattcctatgttggtcagggtcaggttcttcgcctcaaaggcccagatcacttggcaagctcctgcctgtggcacctgcagggccctaaagatttgatgctgaaactccgactggagtggactttggccgaatgccgagatcgtctggccatgtacgacgtggccggacccttggaaaagcggcttatcacaagtgtgtacgggtgctcacgtcaagaaccagtcgtggaggtactggcgtccggggctattatggccgtggtgtggaaaaagggcctgcacagttattatgacccattcgtgctaagcgtccagcccgttgtctttcaggcctgtgaagttaacctgaccctggacaatcgtttggatagtcagggagttctttccacgccatattttccatcctattactcaccgcaaacacattgttcatggcacctgacagtgcctagtctagattatggactagctctgtggttcgacgcatacgccctgaggcggcagaaatacgatctgccatgcacacagggccagtggacaatccagaaccggcgtctttgtggactcagaatcttgcaaccatatgctgagcggatccccgtggtcgcgacagcaggaataactattaactttacaagccagattagcctcacagggcctggtgtgagggtgcactacgggctatataatcagagcgatccgtgccctggagagttcttatgcagtgtgaatggcctttgtgtgcccgcttgcgatggagtgaaggattgccccaacggcctggatgagaggaactgcgtgtgtagagcaacttttcaatgtaaggaagattcaacttgcatttcccttccgaaggtatgcgatggccagcccgattgcctgaatggaagtgatgaggagcagtgccaggaaggagtgccttgcggtacctttacttttcagtgcgaagataggagttgtgttaagaaacccaacccacagtgcgatgggagacccgactgtagggacgggagcgacgaagagcattgcgattgtggcctgcagggccctagctcaagaattgtgggtggtgctgtgtcttccgagggagaatggccttggcaagcctcgctgcaggtgaggggtcggcacatctgtggaggggcactcatagctgacaggtgggttattaccgccgctcactgtttccaagaggattcgatggcatctaccgtgctttggacagtcttcctaggaaaagtttggcagaattcacgttggcccggagaggtgtcattcaaggtgagccgattgcttctgcacccttatcacgaggaggattctcacgactacgatgtggccctgctgcagctcgaccacccagtcgtcagatctgccgctgtacggccagtgtgtctgcccgctcgtagccattttttcgagcccggtctccactgctggattactggttggggagcgctcagagaggggggaccaatcagcaatgcccttcagaaagtggatgtacagttgatcccccaggacctttgtagcgaggtgtaccggtatcaggttactcctcgcatgctatgcgctggctaccgtaaaggaaagaaggacgcttgccagggagactccggtggtccactggtgtgtaaagcgctgagcggaaggtggtttctggctgggcttgtctcctggggtctgggctgcgggagacctaattattttggtgtgtacacgagaatcacaggtgtaatctcttggatccaacaagtcgtgacctag

SEQ ID NO: 244780 - DNA, 2475 bp, Artificial Sequence
  Description of Artificial Sequence: Synthetic coding sequence
atgccagtggccgaggcaccacaggtcgcgggagggcagggggacggcggagacggcgaggaggcggaacccgaaggaatgttcaaggcatgcgaagactccaagcgcaaggccaggggctacctgcgtctcgtgccactgtttgtcctcctcgccttactcgtcctggccagcgccggtgtgctgctgtggtacttcctggggtacaaggcggaggtgatggtttcgcaggtgtacagtggaagtttgcgggtgcttaaccggcatttctcacaagaccttacgcggagagaatccagcgcattccggagcgagacggccaaagcccagaaaatgttgaaggagctcatcacctctacacgtctgggaacctattacaactcctccagcgtgtattctttcggggaagggccactcacctgttttttctggtttatcctgcagattccagagcatcgacgcctcatgctttcccccgaggttgtccaggctctgctcgtcgaagagttacttagcacagttaatagctcagcagccgtgccataccgtgcagagtatgaggttgaccccgagggactggtgattctggaggcctccgttaaagacatcgccgctcttaactctacactgggatgttaccgttacagctatgttggacagggacaggtactgagattgaagggcccagaccatctggcctcgtcatgcctgtggcacctgcagggtccgaaagacttgatgttaaagctgaggctggagtggacccttgcggaatgccgagatcgtctcgcaatgtacgatgtggccggaccgttggaaaagagactgattacctcagtgtacggatgctcccggcaagagcccgtggtcgaggtcttggcttctggcgctatcatggcggtggtgtggaagaaggggctgcattcttattacgatccattcgttctgtcggtgcaaccagtggtcttccaggcttgcgaggtgaacttgacactagataatcggctggacagtcagggcgtgctgagcaccccatacttcccctcctactattcccctcagacgcattgctcctggcacctgactgttcctagtttagactatggcctggcgctctggttcgatgcttatgcacttaggaggcagaaatacgacctgccttgtactcaggggcagtggactatccagaatcgtcgactgtgtgggctccggatactgcagccatatgctgaaagaatacctgtggtggccacggcaggtataactattaattttacgagccagatctctctgacgggcccaggggtgcgggttcactatggcctatacaaccagagtgatccctgcccaggcgagttcctctgctccgtcaatggactgtgtgtgccagcctgcgacggcgtgaaagactgtcctaatggactggacgagaggaactgcgtttgccgcgcaacctttcagtgcaaggaagattccacttgcatctctttgccaaaagtctgtgacggccagcccgattgcctgaatggtagcgatgaggagcagtgccaagagggagtgccatgcggcacttttactttccaatgtgaagacagatcctgtgtcaaaaaacctaatccgcagtgcgatggcaggcccgactgccgagacggctccgacgaggagcactgcgattgcggtcttcagggcccaagctcacggattgtgggtggcgcagtgagctcggagggcgaatggccatggcaggccagcctccaggttagaggcaggcatatttgcggaggcgcactgatcgcagacaggtgggttattacagccgcacactgcttccaggaggattctatggcgtccacggtcttatggaccgtctttctgggcaaggtgtggcagaactcccgatggcccggtgaggtctccttcaaagtgagcaggctgctgctgcacccttaccacgaagaagattctcacgattatgacgtagcattgctgcagctggatcatcctgttgtccggagcgcagcagtccgtcccgtgtgcctaccagcacgcagccacttctttgaacccggtcttcactgctggattactggttggggagctttaagggagggggctctgagagctgacgctgtggccctgttctatgggtggcgcaaccaaggtagcgagacttgttgttgtcccatctctaatgcactccagaaggtagacgttcaattgattccccaggacctatgttctgaagtctacagataccaggttacaccaagaatgttgtgtgctggataccggaaaggcaaaaaggatgcgtgccagggggactccggaggaccactggtttgtaaagcccttagcggtcgatggttcttggcgggactggtttcatggggcctgggatgtggccgacctaactactttggcgtgtacactagaattaccggagtgattagctggattcagcaggtcgtaacatag

SEQ ID NO: 244781 - DNA, 426 bp, Artificial Sequence
  Description of Artificial Sequence: Synthetic coding sequence
atgccagtggctgaagcacctcaggtcgccggagggcaaggggatggcggagatggtgaggaggcagagcccgagggcatgtttaaggcctgtgaggatagcaaacgtaaggctcggggttatctgcgtctggtgccactcttcgtgctgcttgcgttgctggttctcgcctctgctggagtcttgctgtggtactttctaggatataaagctgaagtaatggtgtcacaagtctattcaggtagcctacgtgttttgaatcgccacttttcccaggacctaacacgaagggagagtagcgcttttcgctccgaaacagcgaaggctcagaagatgctaaaggaactgataacttcaactaggttgggtacctattataactccagttctgtctactcttttggagagggccctctgacatgttag

SEQ ID NO: 244782 - DNA, 1386 bp, Artificial Sequence
  Description of Artificial Sequence: Synthetic coding sequence
atgcttttgttattccactcaaaaaggatgccggtcgctgaagcgccacaggtggcgggtgggcagggcgatggcggtgatggggaggaagctgagccggaaggcatgtttaaagcctgcgaggatagcaaacgaaaggcaaggggttacctaagactagttccactgtttgtgctgctggccttactcgtgttggcctcagccggtgttctgctgtggtattttctgggctacaaagctgaggtcatggtgagccaggtctattccggttccttacgcgtgctgaatagacacttctctcaagacctgactcggagagaatcgtccgccttcagatcagagactgccaaagcacaaaagatgctaaaggagctcataacatcaacacgtctggggacatattacaactccagtagtgtttattccttcggagagggcccactgacttgcttcttttggtttattctacagatccctgaacacaggcggttaatgttatcaccggaggtggtgcaagctttgctggtggaggaactgctgtccaccgtcaacagtagcgcagcagtcccctatagagctgagtatgaagtcgacccagagggccttgtcattctcgaggcctccgtcaaggatattgccgctctgaacagcacactgggttgttatagatattcatacgtcggccagggacaggttctgagactcaagggtccagatcatcttgccagcagctgtctgtggcacctacagggcccaaaggacctgatgttgaagctccgcctcgaatggacactcgctgagtgcagggatagactggccatgtacgacgtcgccggaccgctggagaaacgtctcattaccagcgtgtacgggtgctctcgacaagagcccgtggtggaggtgttggctagcggcgcaatcatggccgtggtgtggaaaaaagggcttcacagttactatgacccattcgtcctgtccgtacagccggttgtttttcaagcttgtgaggttaacctaactcttgacaaccgcctggattcccagggtgttcttagcacgccatacttcccttcctactattcacctcagacgcattgcagctggcatttgacagttccaagcctggactacggacttgcactgtggtttgacgcctacgccctgcggagacaaaaatacgatcttccatgtacccagggccagtggactatccaaaataggaggtatcactttctgtccagtctctggttacctttcttgccgccacctccctctcttccctcttctatcgtaacaccttctctagaggctcaagtcccaaatctgcggggagctgctcgcggtgctagtcgtgggtggggctggtgtcaggcttgttgtccgtag

SEQ ID NO: 244783 - DNA, 1527 bp, Artificial Sequence
  Description of Artificial Sequence: Synthetic coding sequence
atggctagcgccgtgtggggtagtgccccatggtgggggcctcctcctccagcccctgcgagaccactcactgatattgacttctgtagtggagcacaattacaggagctgacgcagctcattcaggagctcggcgtgcaggaatcttggtcggacgggccaaaacccggagctgatctgctgcgcgctaaagactttgtcttttccctccttggcctggtccaccgcagagatcccagatttccccctcaggccgagctcctactgctgcggggaggaatacgggagggttccctggatcttgggcacgcccctctcggcccttacgcgcgaggaccgcattacgatgctgggttcactctcttagtgcccatgtttagcctggacggtaccgaactccagctggatcttgaatcgtgctacgcgcaggtatgcctgcccgaaatggtatgtggaacacccattcgggagatgtggcaggattgtctcggcccaccggtgccaggcgcacgcgatagcattcacaggacagaatcagaggagtcgagcaaggactggcagagttccgtagatcagccccattcttatgtgaccgaacacgaggcaccagtgtccttagaaaagtctccttcagacgtgtccgcgagtgagtctccccaacatgatgtagtcgatttgggtagcactgcccctcttaaaaccatgtcctctgatgtcaccaaagcggctgtggagagccctgtgcccaagccgtcagaagccagagaggcgtggcctactctctgtagcgctcaggttgctgcatggttttttgcaaccctggcagccgttgcagaatctttaattcccgtgcccggtgcaccaaggctggtgcatgccgcacggcatgcaggattcacaactgttcttctcgctactcccgaacccccaagacgtcttttgctgttcgatcttatccccgtcgtgtctgtcgccggatggccagaaggggctagaagccatagctgggccggtccacttgcctcagagagcgcatccttttaccttgtgcctggtggaggaacggagagaccttgcgcatcagcatggcaactctgctttgcaaggcaagagctggccctaaaggctaggatacccgctccattgctgcaggcccatgccgctgctcaggctctgctgaggccattggtggctgggaccagggccgctgcaccttatctgctgaggaccttgctgtattgggcttgtgaaagactccctgcgttgtatctcgccaggccagagaacgctggcgcatgttgcctgggacttctagacgagctagggagagtgcttgaagccggaacactacctcattacttcctgaacggacggcagttgagaacaggagacgattccgccgcacttctgggtgagttggcgagactgaggggcgaccctgcgagggccctccgcgctgcagttgaggaagctaaagttgcgagaaagggcggagggttggctggggttgggggtggggcacactag

SEQ ID NO: 244784 - DNA, 1527 bp, Artificial Sequence
  Description of Artificial Sequence: Synthetic coding sequence
atggcgagcgcagtgtggggctcggccccttggtggggcccaccaccaccagccccagcaaggccccttactgacattgacttctgtagcggcgcacaattgcaggagctgacacagctgatccaagagctcggcgtgcaggaatcttggagcgatggcccaaagccaggcgcagacttgctgcgcgctaaggacttcgtgttttccttactcgggctcgttcatcgcagggacccgcgattcccaccccaagccgagttgctactccttaggggcggtatcagagaggggtccttggatctcgggcacgcccctctcggcccatatgcacggggaccccattacgatgccggttttactctgctcgtaccgatgttttcactggatggtaccgaactgcagttggacctggaatcatgctacgcacaggtgtgcttgccagagatggtctgcggcacccctattcgggagatgtggcaggactgtcttggacctcctgtcccaggtgcacgcgacagcatccatagaactgagtcggaagaatccagcaaggactggcagtcctccgttgatcagccccacagttatgttacagagcacgaagccccagtgtccctggagaagtccccgagcgacgtgtccgccagtgagagcccgcagcatgacgtggtcgacctcggctccacagctcctctgaagaccatgtcttctgacgtcacaaaagctgctgtcgagtctcccgtgccgaagccgtctgaggccagggaagcctggccaacactatgctctgcccaagtcgctgcttggttctttgcgacactcgcagcagtggccgagagtctcattccggtgcctggcgcacctcgtctggttcatgccgcacggcatgctgggtttactactgtgctgctggcaactcctgagcctccccgaagattgctactattcgatttgatccctgttgtcagcgtcgcgggttggcctgagggcgctagaagccatagctgggcaggacctttggccagcgagtccgcttctttttatctcgttccaggaggaggaacagaaagaccctgtgcatctgcatggcaattgtgtttcgcaagacaggaactggccctcaaagcgagaattcccgcaccactgctccaggctcacgccgctgcccaagcattgctgagacccctggttgctgggactcgggcagccgctccctatctgctcaggacactactgtattgggcctgcgagcggctgcctgctttgtatctggcccgacccgaaaacgctggcgcttgctgtctgggtctgttggatgagctgggacgtgtgttggaggctggcacacttccacactacttcttgaacggaagacagttgcgcactggggatgactccgctgccttacttggggagctggccaggttacggggagatcctgctcgggctttacgggcagcggtggaggaagctaaagtggccaggaagggagggggactcgcaggagtcggtggaggggctcattag

SEQ ID NO: 244785 - DNA, 825 bp, Artificial Sequence
  Description of Artificial Sequence: Synthetic coding sequence
atgggaaaatctctgtcccatctgcccctacacagctcaaaggaagatgcttatgacggggtcactagtgaaaacatgaggaacggtttagtgaactcggaggtgcataacgaggacggacggaacggagatgtctcacagtttccctacgtcgagttcaccggcagggactcggttacctgccccacctgtcagggtaccggtcgcatcccgagaggacaggagaaccaactggtcgctctgatcccctattcggaccagagactgcggccaagaaggacaaaactttacgtgatggcgagcgttttcgtgtgcctgctgttgtccgggcttgccgtcttcttcctgtttcctaggtcaatcgatgtgaaatacatcggcgtaaagtctgcctacgtgtcgtacgacgtacagaagcggactatttatttaaatattacaaacactctcaatatcacaaataataattattatagtgtcgaggtcgaaaacatcaccgcacaggtgcaatttagcaagaccgtaatcgggaaggctcgacttaataacatcactattatagggccactcgacatgaaacagatcgattacacagtgccaaccgttatagcggaagagatgagctatatgtacgatttttgcactctgatatctataaaagttcataacatagtcctgatgatgcaggttacagtgacgacaacctacttcggacacagcgaacagatctcacaggagaggtaccaatacgtggattgcgggaggaacaccacctaccagctgggccagagtgagtatttaaacgtgctgcagcctcagcagtag

SEQ ID NO: 244786 - DNA, 825 bp, Artificial Sequence
  Description of Artificial Sequence: Synthetic coding sequence
atgggcaaatccctcagccatctgccgctgcactcctcaaaagaggacgcttatgacggcgtgacatcagagaatatgaggaacggactggtaaactctgaggtgcataatgaagatggacggaatggagacgttagccagtttccctatgtagagtttactggtagggacagtgtaacgtgtcctacatgccaggggacagggaggatcccacgcggtcaggagaatcagctcgtcgccctgatcccttatagtgaccagaggttgaggcctcgccgaacaaaactttacgtgatggcatccgttttcgtatgtctgcttctgtcagggcttgccgtcttcttcctgtttcccaggtctatcgacgtgaagtatatcggcgtgaaaagcgcctacgtttcgtatgacgttcagaagcgcactatatacctgaatatcaccaatactcttaacatcaccaataataattactattctgtcgaagtagaaaatataacggcccaggtgcagttttccaagaccgtgattgggaaggctcgcctcaataatatcacaatcattggccctctggatatgaaacaaattgattacaccgtaccaacagttatagccgaagaaatgagttacatgtacgatttctgtacactgattagtatcaaagttcataatattgtccttatgatgcaggtcaccgttactaccacatattttggtcactctgaacagatttcccaggaaaggtaccagtatgttgactgcggtaggaacactacataccaactgggacagagtgagtatcttaacgtgctccagcctcaacagtag

SEQ ID NO: 244787 - DNA, 78 bp, Artificial Sequence
  Description of Artificial Sequence: Synthetic coding sequence
atgggcaagagtctcagccatcttcccctgcattccagcaaagaagatgcctacgacggcgtgacatccgagaattag

SEQ ID NO: 244788 - DNA, 333 bp, Artificial Sequence
  Description of Artificial Sequence: Synthetic coding sequence
atgggtaagtctctatcacatctgccattacattcatctaaggaagacgcttacgacggagtgacctccgagaatatgcgaaacgggttggtgaactctgaagtgcataacgaggatggaaggaacggggacgtgagtcagttcccctatgtggagtttaccgggagggatagtgtcacctgccccacctgccagggaaccggcagaatccctcgcggacaagaaaaccagctggtcgcactgatcccctattccgatcagagactccgacctcgacggacaaagctgtacgtgatggccagtgtcttcgtctgcctgctactgtcgggctag

SEQ ID NO: 244789 - DNA, 369 bp, Artificial Sequence
  Description of Artificial Sequence: Synthetic coding sequence
atgcatggaacttttgtgattctgctccctctgtcactgattctgatggtgttcgggggaatgaccggattcctctcattcttactccaggcctatctcctgttgctgctcaccgggattctatttctcttcggcgcaatggtaacattagcgggaattagtgtgtacatcgcctacagtgccgcagccttccgagaggcactctgtttgctcgaagagaaggcactgttggaccaggtggacataagtttcggatggtctctggcactggggtggatcagcttcatagctgaactgctgaccggagctgccttccttgccgcagcgagggaactgtcccttcggcgtcggcaggaccaggccatctag

SEQ ID NO: 244790 - DNA, 570 bp, Artificial Sequence
  Description of Artificial Sequence: Synthetic coding sequence
atggggcttggggctcgcggagcatgggctgcgctccttctgggaaccctccaggttctggctctcctcggggcagcccatgagtctgccgctatggcagagacactccaacacgtgccatctgaccatacaaacgagacgtcaaactccaccgtgaagcctcctaccagcgttgctagcgactcttctaacaccaccgttactacgatgaagccaaccgccgcttccaacacgacaactcctggcatggtgtctactaatatgacaagcacaactctaaagagtaccccgaaaaccactagcgtgagccagaacacgtcacaaatctcaacatcgacaatgaccgtcacccacaacagcagtgttacctccgcggcaagctccgtgaccatcactaccaccatgcacagcgaagccaagaagggctcaaagttcgataccggaagctttgtcggcggtattgtcctgactctaggagtgttgagtatcttgtatattggttgcaagatgtactatagcaggagagggattcggtatcggaccatcgacgagcacgacgctatcatctag

SEQ ID NO: 244791 - DNA, 627 bp, Artificial Sequence
  Description of Artificial Sequence: Synthetic coding sequence
atggggttgggggcacgtggcgcatgggcggcacttcttctggggacactgcaggttcttgccctcctaggggctgcacacgagtcggccgcaatggcggcatctgccaatatcgaaaactctgggctgccccataattcctcagccaatagtacagagaccctccaacatgtgccctcagaccataccaacgaaacttctaattcaactgttaagccaccaacttctgtggcttcagacagctcaaacaccaccgtgactactatgaagcccaccgcagcctccaatacgactacgccgggaatggtaagcacaaatatgacgtctactacactcaagtccacccccaagaccacgtcagtgtcccaaaatacctcccagatcagcacttctaccatgaccgtaactcacaattcaagcgtcacttcagccgctagttccgtaactataaccaccacgatgcatagcgaagccaagaaggggtctaagtttgatactggaagtttcgtcgggggtattgtgctcaccctgggcgtgttatccatcctgtacatcggttgtaaaatgtattactctcgaagggggatcagatacaggaccatcgatgaacatgatgcaattatttag

SEQ ID NO: 244792 - DNA, 588 bp, Artificial Sequence
  Description of Artificial Sequence: Synthetic coding sequence
atggagaatcataaatctaacaataaagagaatatcaccatagtcgacatctcacgaaagattaatcagctgcccgaagctgaacggaatctattggaaaatggaagcgtctatgtaggccttaacgcggcactctgcgggcttattgcgaattccctgtttcggcgaatattgaacgtgacaaaggcgagaatcgccgcaggacttccaatggctggtattccatttctcacgacagacctcacatatagatgcttcgtgagttttcccctgaatactggcgatctggactgtgagacatgcaccattacaaggagcggcctcacagggctagtcataggcggtctttaccccgtcttcctggccatccccgtgaatggtggcctggccgcacgataccagtccgcactcctgccccataagggaaatatcctatcgtattggatccgaacatccaaacccgtgtttaggaagatgttgtttccaattctgctgcaaactatgttcagcgcctatctcggcagtgagcagtataaactgctgatcaaggcgctccagctctctgaacccggaaaggagatccattag

SEQ ID NO: 244793 - DNA, 378 bp, Artificial Sequence
  Description of Artificial Sequence: Synthetic coding sequence
atggccggtatcccctttctgacaaccgatctgacttatcgatgctttgttagcttcccccttaacacaggagacctggactgtgaaacgtgtactattactcggtccggcctcaccggcctggtcatcggaggtttgtaccccgtgttcctcgctatcccagtgaacggaggtcttgctgctcgataccagagcgcactgttgcctcacaagggtaatatcttatcctattggatacgaacttctaaacctgtcttccgtaagatgctgttcccaatacttctccagacaatgttctccgcctacctgggctcagagcaatacaaattgctgataaaagccttgcagctgtcagaacccggtaaagagatccattag

SEQ ID NO: 244794 - DNA, 489 bp, Artificial Sequence
  Description of Artificial Sequence: Synthetic coding sequence
atgttacagactagcaattactctttggtgctctcattgcagttcctcctgctttcctacgatctctttgtcaatagcttctctgaactgttgcagaagacacctgtgattcagctcgtcttgttcatcatacaggatattgccgttctcttcaatataattatcattttcttgatgttctttaatacgttcgtatttcaagcgggtctcgtcaacctcctgtttcacaaatttaaaggaaccattattttgactgcagtatacttcgcactgtcgatttctctacatgtgtgggttatgaatttgcggtggaagaatagtaattcattcatctggaccgacgggctgcagatgctctttgtatttcagcggttggccgctgtcctctattgttatttttacaaaaggaccgctgttcgcttaggagacccccacttttatcaggacagtctatggctgagaaaggaattcatgcaggtaaggcggtag

SEQ ID NO: 244795 - DNA, 318 bp, Artificial Sequence
  Description of Artificial Sequence: Synthetic coding sequence
atgctgcagacttccaactatagcctcgttctcagtctgcagtttctgctattaagctacgatttgttcgtgaactcttttagtgaacttctgcaaaagactcccgtgatccagcttgtgctatttatcatacaagatattgctgtgctttttaacatcatcatcatcttccttatgttctttaacacctttgtgtttcaggcagggctggtaaatctgctgttccacaagttcaagggtaccatcattttgaccgccgtgtacttcgcgttgagtattagtctgcacgtttgggttatggtcagggttgctgtatag

SEQ ID NO: 244796 - DNA, 1140 bp, Artificial Sequence
  Description of Artificial Sequence: Synthetic coding sequence
atgccccacagctcattgcatcccagtattccctgtcctcggggacatggagcccagaaggctgcgctggtgctgctgagtgcgtgtttggtcacactatggggcctaggcgaaccaccagaacacactctgcgttatctggtgcttcacttagcaagtttgcaacttggccttctgctcaatggagtgtgttccctcgcagaggagctccgccacatacactcacggtacaggggctcctattggcgaaccgttcgggcatgtctgggttgcccgctgaggagaggggcacttttacttctgagcatttatttttattattcccttccaaatgccgtgggaccgcctttcacttggatgctcgctctcctgggactgagtcaagccctgaacatcttgctgggacttaagggccttgctcccgctgagataagtgctgtttgtgagaagggaaactttaacgtggcacacggattagcatggagctactacatcggatatctccggctgattctgccagagctgcaggcccgtatcagaacctacaaccagcactacaataacctgctgaggggtgcagtgtcccagcggttatatatccttttgcccttggactgcggggtgccagataatcttagtatggctgatcccaatatccgcttcctggacaagctcccccaacagacgggtgaccatgctggaatcaaagacagagtgtactctaattctatatatgaattattggaaaatgggcaacgagcaggcacttgtgtgctggagtatgccaccccactgcagacactcttcgccatgtcccagtactcacaggccggattttctcgtgaggatcgattggagcaggcaaaactgttctgtaggacactggaagatatcttagcggatgctcctgagagccaaaataattgccggctgattgcataccaggagccagcggacgattcgtccttctccttgagccaggaggttctacgccatcttcggcaagaggaaaaagaagaggttacagtcggctcactcaaaacttccgctgtcccttcaacttctacgatgtcccaggagccagaactccttatctcggggatggagaaacctctgcccctgcgaacagatttttcgtag

SEQ ID NO: 244797 - DNA, 762 bp, Artificial Sequence
  Description of Artificial Sequence: Synthetic coding sequence
atgccccattcttctctgcatccatcaattccttgtccgaggggacacggggcacagaaagcagccttagtgctgcttagtgcttgtttggtgacgctctggggcctgggggaacccccagagcataccctgagataccttgtcctgcacctggcaagcctgcagctaggtctgttgctaaacggcgtttgtagtctggccgaggaactgcggcacatccactcgcggtatagagggagctattggcggaccgtcagggcatgtctcggctgccctctgaggaggggcgctctcctcctcctgagcatctacttctactattccttacctaacgccgttggcccaccttttacttggatgctcgcccttctgggtttgtcccaggcccttaacatcttgctcgggctgaagggtctggctcccgcagaaattagtgcagtgtgcgagaagggaaactttaacgtcgcacacggactcgcctggtcttactatataggatacctgcgactcatattacctgaattgcaagccaggatccgcacgtacaaccaacattataataacttgcttcgtggcgctgtgagccaacggctttatatcttgttgccactagattgtggagtgcccgataacctatctatggccgatccgaacatccggttcttagacaaactaccccaacagactggagatcacgccggtattaaggaccgagtctattctaattcaatctatgaattattagagaacgggcagagatag

SEQ ID NO: 244798 - DNA, 423 bp, Artificial Sequence
  Description of Artificial Sequence: Synthetic coding sequence
atgccttctgctttctccgtttcttcctttcccgtgtcaattcccgctgtgctgacccagacagactggactgagccctggcttatgggcttggcaacttttcacgccctgtgcgttctgctgacgtgcttaagtagccgcagctaccgcctgcagatcggccactttctgtgtttggtcatcttagtttattgtgcggagtacatcaacgaagcggctgctatgaattggcggctgttctctaaataccaatactttgactctagggggatgtttatctctatagtgttctccgcgccactgttggtgaacgcaatgattatcgtcgtgatgtgggtctggaaaactctcaacgtcatgaccgatctgaaaaatgcgcaggaaaggcgaaaggagaaaaagcggaggaggaaggaggattag

SEQ ID NO: 244799 - DNA, 384 bp, Artificial Sequence
  Description of Artificial Sequence: Synthetic coding sequence
atgcttagtggctatctccagacagactggaccgaaccatggctgatgggcctcgcaacttttcacgccctgtgcgttctgctcacgtgcctgtcatctcgcagttataggctgcagattgggcactttctctgcctggtgatcttggtctactgcgcagaatacattaatgaggcagccgcaatgaactggcggctgttttctaaataccaatattttgacagtcgaggcatgtttatttctattgtcttctccgccccactcctggtcaatgcgatgatcattgtggttatgtgggtgtggaagactctcaatgtgatgacagatctgaagaatgctcaggaacggcgaaaggagaaaaaacgaaggcggaaggaggattag

SEQ ID NO: 244800 - DNA, 1560 bp, Artificial Sequence
  Description of Artificial Sequence: Synthetic coding sequence
ggaccagcacagcgtgcctcatcccccatcccaagcgcagggcgtcgagagggtgctcaggctgcaacacagagagtggaaaggagagatagggaccctggtggttgtgccgcatggacaccaagcacactgcccctttcccctcgcagcgctgcctccagcagtacctgcgccggagggtgcgggaagaggactgcttcctctagacggactagccgtccgagccgcatgacagctacaaccgggcctaaggttatccagacttccgctgctaactttagtctgaacaattccaagaaactgaaacctatccaaatactgagcaaccccctctctacatacaatcagcagctttggctgacctgcgtggtggagttggaccagtccaaagagacttcaatcaaaaccagcttccctatgactgtcaaagtggatggtgtggcacaggatggaacaaccatgtatatccacaataaggttcataatagaacgaggactctcacctgtgctggtaaatgcgccgagattatagtggcacatctcggttatctcaactacacccagtatacagtgatcgtgggatttgaacacctcaaattgcctatcaaaggcatgaattttacctggaagacttacaatcccgctttctcgagacttgaaatatggtttagattcttttttgttgttcttactttcatcgttacctgcctgttcgctcactccctgaggaagttcagtatgagggactggggcattgagcaaaagtggatgtcagttctgcttcccctgctgttactttacaatgaccctttctttccactcagctttctcgttaattcctggctgccagggatgcttgatgacctgtttcaaagcatgttcttgtgtgccctcctgctgttctggttatgcgtgtaccatggtatcagagtccaaggtgagagaaagtgtctaactttttatctacctaaattcttcatcgtaggactcctttggctggcttctgtgacactcgggatatggcagacggtgaacgagttgcatgacccaatgtaccagtatagagtcgatacaggcaatttccagggcatgaaagtgttcttcatggttgttgcggctgtatatatactgtacctgctgttcctgattgtgagagcgtgttccgagttgcgacatatgccttacgtggatcttcggctgaagttcttaaccgccctaacctttgtggtgcttgtgatatccatcgccatcctgtacctgagattcggtgcccaggttcttcaagacaatttcgttgcggaactttcaacccactatcagaagcccgctgaattcctgtcattctatgggctcctgaatttttatctttatacactagcctttgtgtattccccatccaaaaacgccctatatgagagccaactaaaagataatcctgcattctctatgctgaatgacagcgacgacgacgtgatctatgggtctgactatgaagaaatgcccctgcagaatgggcaggcaatcagggcgaaatataaggaagagtccgattctgattag

SEQ ID NO: 244801 - DNA, 1839 bp, Artificial Sequence
  Description of Artificial Sequence: Synthetic coding sequence
atgggggcagctccctctcccacacaggcatcttcccgtggcggtggtccaggccctcccgcaccaacccgcgctgtttccagtagctcccgcgctcggggaggggcactgtcggcactgggaccaagtcctgccaggcctctgacaacgtccccagcaccagcaccacccccaagaagtcgccctgcccgacagcagcctgacccacagtgctgggaaaaaagagggggtgcaggcggagatacgaagggaggggcagccggaccagggcctggaagacttagaggtatggacgcagagtatcctgcatttgagccacctttgtgctccgagcttaaacacctctgtaggagattgcgggaggcctaccgagaactgaaggaagacctgaccccatttaaggatgaccggtattataggctcgccccaatgcgcctgtatacactctccaagcggcactttgtcctcgtttttgtcgtcttctttatatgttttggtttaaccatttttgtaggaatccgcggtcccaaagtgatccaaacttccgccgcaaatttttccttgaataatagcaagaaattaaagcccatccagatattatccaaccctctgagcacctataatcagcaactttggctaacctgcgtggttgagctggaccagagcaaggagacttctataaaaacgtccttccccatgacagtgaaggtggatggcgtggctcaggacggcacgaccatgtacattcacaacaaagttcacaatagaacacggacactgacctgtgctggaaagtgcgcagagatcatcgtggctcatttgggttacctgaattacacccagtacaccgttattgtgggttttgaacacctcaagttgcccatcaagggcatgaacttcacatggaagacttacaatcctgcctttagcaggctggagatatggttcaggttcttcttcgtcgtgctcactttcatcgtgacttgcctcttcgcacattcactgcggaaattttctatgagagactggggcatcgaacaaaagtggatgagtgtgcttctaccgctgttgttactgtacaacgacccatttttccctcttagctttctggtcaactcgtggctgcccggaatgctggacgacctgttccaatccatgtttctgtgcgcattgctgttgttttggctgtgcgtctatcatggaatcagggttcagggagaaagaaagtgtcttacgttctacctgccaaagttcttcatcgtcggcctcctttggcttgcctccgtgactctgggaatctggcaaacagtcaatgaacttcatgaccctatgtaccaataccgggttgacacaggtaacttccaggggatgaaggtgttctttatggtcgtggcagcggtgtatatcctgtatcttctttttctcatcgtccgcgcttgtagtgaacttcgccacatgccatatgtggacctgcggctgaagttcttgaccgcgctgactttcgtggttttggtgataagcatcgctattctatacttgaggtttggtgcccaggtactgcaggacaactttgtggctgaactttctacacactaccagaacagcgccgagttcttgagcttttacggccttttgaatttttatctctacactctagccttcgtttattcaccctccaagaacgcattatatgagagccagctcaaggataacccagcattctctatgttgaacgactccgacgatgacgtgatctatggaagcgattatgaggagatgccattgcagaatgggcaggctatcagggccaagtataaggaggaatctgacagcgactag

SEQ ID NO: 244802 - DNA, 1317 bp, Artificial Sequence
  Description of Artificial Sequence: Synthetic coding sequence
atgccctgtacgtgtacatggcgaaactggcgccaatggataagacccctggtcgccgtgatctacctcgtgtctatcgtcgtggctgtgcccctctgcgtctgggagctgcagaaactcgaggtcggtatccataccaaggcatggttcattgccggaatcttccttctgctgaccatccctatcagcctatgggtcatcttgcagcatttagtccactacacacagccggaactgcaaaaacccatcatcaggatcctctggatggtgccgatctacagcttagacagctggatcgcccttaagtacccgggtattgccatctacgtggatacgtgtagagagtgctacgaggcttatgtcatttacaacttcatgggcttcttgaccaactacttgacaaaccgttatcccaaccttgtgctaattctggaggccaaggatcagcagaaacacttccccccattgtgttgctgtccaccctgggcaatgggggaagttctactgttcagatgcaagctcggcgtgctgcagtatacagttgtccgcccattcaccacaatagtagccctgatctgtgaacttctggggatttatgatgaaggcaatttttcttttagcaacgcttggacttatctcgttatcatcaacaacatgagtcagcttttcgctatgtactgccttcttcttttttacaaggttctcaaggaggagttaagccctattcagcctgtaggaaaatttctatgcgtgaaactcgtagtctttgtgtctttctggcaggctgttgtgatagctctcctcgttaaggtgggtgttatatccgagaagcacacgtgggagtggcagacggtcgaagcagttgcaacgggacttcaggatttcattatttgcatcgagatgtttttggccgctattgcccaccactatactttctcttataaaccctacgtgcaggaagccgaagaagggtcgtgtttcgactccttcctggccatgtgggacgtgagtgacattagagatgacatcagcgagcaggttaggcacgtcggacggaccgtgcgcggacaccccagaaaaaaactattcccagaggaccaggaccagaacgaacatacgtcactgctcagtagttctagccaagacgcaatctccattgcctctagcatgccccctagcccaatggggcattaccagggctttggtcacactgtaacacctcagactacaccaactacagccaaaatttcagacgaaattctgagtgatacaataggcgaaaaaaaagaacccagcgataaatctgtcgactcatag

SEQ ID NO: 244803 - DNA, 4152 bp, Artificial Sequence
  Description of Artificial Sequence: Synthetic coding sequence
atgtatgccacagacagtaggggtcactcccccgcatttctccaaccccagaatgggaacagtagacacccatctggatatgtgcctgggaaagtcgttccattacgcccacccccaccccctaagtctcaggcctctgcaaaattcacatcaatccgtcgcgaggacagagctacatttgcattttctccagaagaacagcaggctcagcgggagagccagaagcagaagcgccacaagaatacatttatctgctttgccatcaccagcttcagtttctttattgccttggccataattctgggtatctcaagtaaatatgcgcctgatgagaattgcccggatcaaaacccacgcctgcggaactgggatcccggtcaggatagcgcaaaacaagtggtgatcaaggagggcgacatgctaagacttacgagtgacgccacggtgcactcaatcgtaattcaggacggagggctgctggtgtttggcgataataaggatggttcacgaaatattactctgcggacacattacattctaattcaggatggtggggcactacacatcggagcggaaaagtgcagatacaaatctaaggcaaccatcactctgtatgggaagagcgacgagggtgagtcaatgccaacctttggcaaaaagttcataggcgtagaagcagggggaaccttggagctgcacggcgcacgcaaggcatcgtggaccctgcttgccaggactcttaactcctcaggcctgcccttcgggtcctatacgttcgagaaggacttctcaagaggccttaacgttagggtaatcgaccaagacactgcgaaaatcctcgaatctgagaggttcgacacgcacgaataccgaaatgagagtcggagactccaggaatttttgcggtttcaggacccaggacggatcgtggctatcgcagtaggcgacagcgccgctaagtctctcctacagggcactatacagatgattcaagagcgcctgggaagcgaactaatccaggggctggggtaccgtcaggcctgggcactcgtgggcgttatcgatggcggatctacatcgtgtaacgagtctgtgaggaattacgagaatcacagttccggaggcaaagctcttgcacagagagaattttatacagtggacggtcaaaaattttccgtgaccgcatatagcgaatggatcgaaggggtttctctgagcggctttcgagttgaggttgtagacggcgtcaagctgaatctgctcgatgacgtttcctcgtggaaacccggtgatcagatagtggtggcatctaccgactattccatgtatcaggccgaggagtttacactgttgccttgtagtgaatgcagtcacttccaggttaaggtgaaggagactccacagttcctgcatatgggggagataattgatggagtggatatgagggctgaggtcggcatcctgacgaggaacatcgtgatccaaggcgaggtggaggactcctgttatgcagaaaaccaatgccagttttttgattacgatacatttgggggacacataatgatcatgaaaaacttcacaagtgttcatctgagctacgtcgagctcaagcatatggggcagcagcagatggggagatacccagtgcatttccacttgtgcggcgacgtggattacaaagggggataccggcatgccacattcgtcgacggcctctctatccatcattccttctcaaggtgtatcacagttcatgggaccaatggtctgctgattaaggacacgattggcttcgacacacttggccactgctttttcctcgaggatggcatcgagcaaaggaacaccctgtttcataacctaggactcttaactaagcccggaaccctattgcctaccgataggaacaattctatgtgcacgactatgcgggataaagtgttcggtaactatatcccagtgcctgcaacagattgtatggccgtgagcacattctggattgctcatcccaacaacaacttgattaacaacgctgctgctggctcacaagatgccggaatctggtatctgttccacaaagagccgacaggggagtcatccggtctgcaactgctggccaagcccgagctaacacctttggggattttttataataatcgggtgcatagcaacttcaaggctggcttgtttatcgataagggagttaagacaacaaattcttccgccgcagacccacgcgagtacctgtgcctagacaattccgctcgcttcaggcctcatcaagacgccaacccggagaaacccagggttgcagccctgattgaccggctgattgcattcaagaacaacgataacggcgcttgggtccgcggaggcgacattattgtgcagaatagcgccttcgccgacaacggtatcgggctaacatttgcatctgacggcagcttcccatcagatgaagggtcaagccaggaggtttcggagtccctgtttgtcggcgagtcgcgcaattacggctttcaggggggacagaataagtatgtaggtaccggcggaatagatcagaaacccagaaccctcccacgtaatcgcacatttccaatccggggattccagatttatgatggcccaatccacctgacaagatctacgtttaagaaatacgtgcccacaccagatcgatattcatctgccattggtttcctgatgaagaacagttggcagatcacacccagaaacaatatatcgctggtaaaattcggtccacacgtgtcactcaacgtgttcttcggcaagccagggccttggttcgaggactgcgaaatggatggcgataaaaactcgatcttccatgatatagacggatccgtcacgggctacaaggatgcttacgtcgggaggatggataactacctgatccgacatccgtcttgcgtgaacgtatctaaatggaacgccgtgatctgtagtggtacgtacgcacaagtttatgttcagacgtggagcacccagaacctttctatgactattacgagagatgaatatccatccaaccctatggtgttgcgcggaatcaaccagaaagcagctttcccccagtaccagccagtcgtcatgttagagaaagggtacacaatccattggaacggacccgctcctcgcactacctttctgtacctggtgaactttaacaaaaacgattggattcgtgtaggattatgctaccccagtaacacaagtttccaggtgacttttggatatctgcagagacagaacggttccctgtctaaaatcgaggagtacgaacccgtgcacagcctagaggagcttcagcggaaacagagcgagcgcaaattttacttcgactcctctaccgggctcttgttcctgtacctgaaggcaaaatcgcaccgccacggccatagctactgttcctctcagggctgtgaacgggtgaaaatacaggccgctactgacagcaaggatatcagtaattgtatggcaaaggcttatccacaatactatcggaagccaagcgtcgttaaacgcatgcctgccatgctcaccggattgtgtcaaggatgtggcactcggcaagtggtgtttacttccgaccctcacaaaagttatttaccagttcaatttcagagcccagacaaggccgagacacagagaggagacccatcggtcatctcagtgaacggaactgacttcaccttcaggtcagccggtgttctgctgctcgttgtggacccttgttccgtcccatttaggctgactgagaaaacggttttccctttggccgatgtcagcaggattgaagagtatctcaaaacgggaatcccacccaggagcattgtacttttatccacacggggtgagataaaacagctaaacatctctcacctgctggttcctctcggcctggctaaacctgcccacctgtatgacaaagggagtaccatctttcttgggtttagcggaaatttcaagccatcgtggacaaaactctttacgagtcccgctggccaggggcttggtgtgcttgagcagtttattcccctgcagctcgacgagtacggctgccctcgggctactactgtgaggcgaagggacctggagctgcttaaacaggcctctaaggctcactag

SEQ ID NO: 244804 - DNA, 3963 bp, Artificial Sequence
  Description of Artificial Sequence: Synthetic coding sequence
atgtacgccaccgattcacggggacactcccccgcattcctacaaccccagaatggtaactcacgacatcccagcgggtatgtgcctggcaaagtagttccactgaggcctcccccacccccaaagtctcaggccagtgccaagttcactagtatacgcagagaagatcgagccacctttgcattctctccagaagaacagcaggcccagagagaaagccagaagcagaagcgacacaagaatacattcatctgcttcgccataacctcattcagttttttcatcgccctcgctataatcctggggatttcttccaagtatgcccctgatgaaaactgtccagatcagaatccccgtctgcgcaactgggatcccggtcaagacagcgcaaaacaggtggtgataaaagagggagacatgttgcggctcacctccgacgcaactgttcattcgatagtcattcaggacggcggtctgctggtgtttggggacaacaaagacgggagccggaacatcacgcttcgaacccactatattctgatccaggacgggggagcgctccacataggagcagaaaagtgtaggtataaaagcaaagcaaccattacactctatgggaaatcagatgagggcgagtccatgcctaccttcggtaagaaattcatcggagtcgaagccggaggcaccctggaactgcacggcgcacgcaaagcttcatggacgctgctggccaggactcttaacagctcaggtctgcccttcggctcctacacttttgaaaaggattttagcagaggcctgaatgtgagggtgatagaccaagatactgctaagattcttgaatcggagaggtttgatacacacgagtaccggaatgaaagccgcagacttcaggaatttctgcgcttccaggatcctggtcggatcgtggcaatagcagtcggcgattccgcagccaagtccttactgcaggggaccattcagatgattcaggaacgcttgggatccgagctgatccagggtctcggctacaggcaggcctgggctctcgtgggcgtgattgacgggggatctactagctgtaacgaatccgtgagaaattatgagaatcactccagtggcggtaaggcactggcgcagagggagttttacacagtcgatggccagaaattttctgttacagcttacagcgagtggattgaagaaaccccacagttcttgcacatgggcgaaatcatcgacggagttgacatgcgggcagaagttgggattttaacaagaaatattgttattcagggagaggttgaggactcttgttacgccgaaaatcaatgccagttcttcgactatgatacctttggtggccacatcatgatcatgaaaaacttcacgtcggtgcacctttcttatgtggagctgaagcatatgggacagcagcagatgggtcgttacccagtgcactttcacctttgcggcgatgttgactacaaaggtggctatcgtcacgccacgttcgtcgatggtctctctattcaccacagtttttccagatgtatcactgtacatggcacaaatggactcctgattaaagatacgatagggtttgatacactgggacactgcttcttcttggaagatggaattgagcagagaaatacactgtttcacaacttaggcctccttaccaagccagggactctcctacccacggacagaaacaattccatgtgtactaccatgcgggataaagtgttcggaaactatatcccagtgcccgcaacggattgtatggccgtttccacattctggatagcccaccctaacaacaacttaatcaataacgcggctgccggatcgcaggacgcaggcatctggtacctcttccacaaggagccaacaggagagagctcgggactgcagttgctagccaagccagaattgacaccactgggtatattttacaacaacagagttcattccaattttaaggcaggcctgttcattgataaaggggtcaaaaccaccaatagttctgcggcagacccccgagaatatctgtgtcttgacaattcagcaagatttaggccgcaccaagatgccaatcctgaaaaaccgagagtcgccgctctcattgacagattgattgcgttcaagaacaatgataatggggcttgggtccgcggaggcgatataatagtgcagaatagcgcttttgcggacaatggaatcggcctgacctttgccagtgatggatcgtttccaagtgacgagggctcttctcaggaagtgtcggagagtctgtttgtcggagagtccagaaattacggctttcaggggggacaaaataagtatgttggcactggtggaatcgatcagaagcctaggacgttgcctagaaacagaaccttccccatcaggggtttccagatttatgacggaccaatccatttaactagaagtacttttaaaaaatatgtgccgacgcctgatagatactctagtgctattggctttctaatgaagaacagttggcaaatcaccccacggaacaatatctctctggtgaagttcggtccacatgtgtctttgaatgttttcttcgggaaacctggaccctggtttgaggactgcgagatggatggagataaaaattctatttttcatgatattgacggctccgtgacggggtacaaggatgcctacgtgggcagaatggacaactacctcatacgccacccctcctgtgtcaacgtcagcaaatggaacgccgtcatatgttccgggacatatgcccaagtgtacgttcaaacatggagtacccagaatctgtcgatgacaatcacccgagacgaatatccttctaatcccatggttttaagagggattaatcaaaaggcagcgttcccgcagtaccagcccgtggtcatgctggagaaagggtacaccatccattggaacggcccagctcccaggacgaccttcctgtatttggtgaacttcaacaaaaacgattggatcagagtcgggctgtgctacccctccaacacctcctttcaggtcacgttcggctatctgcagcgacaaaacgggagcctttccaaaatcgaggagtatgaacctgtccatagtctagaagaactacagaggaagcagtccgagcgaaaattttactttgattctagcacaggcctgctgtttctgtatcttaaggctaagagccatcgtcacgggcacagctactgcagctctcagggctgtgagcgcgtgaagatacaggccgcaactgactccaaggacatcagtaactgcatggccaaggcctatccacagtactacagaaagcctagtgtcgtgaagaggatgcccgcaatgctgaccggattatgccaaggatgtggcacaagacaggtcgtcttcaccagcgatccccataagtcgtatctgcccgtgcagtttcagtctccagataaagcagaaactcagagaggggacccatcagtgatttcggtgaatgggaccgactttactttcaggtcagcaggcgtcctcctgttggtcgtcgatccctgctctgtgccctttaggcttactgagaagactgtctttccattagctgacgtctcacggatcgaagagtacctaaagacagggatccctcccagaagtatagttctcctaagcacaagaggtgagattaagcagttgaacattagccacctgctcgtaccgttggggctcgccaagcctgcacatctttacgataagggctcaacaatcttcctggggtttagcggaaatttcaagccctcttggacgaagttatttaccagcccggctggtcaagggctgggggtcctggaacagttcattccgttgcagttggacgaatacgggtgtccgcgagcaactaccgtgagaaggcgggacctcgagctgctcaagcaggcatcaaaagcccattag

SEQ ID NO: 244805 - DNA, 1131 bp, Artificial Sequence
  Description of Artificial Sequence: Synthetic coding sequence
atgaccattactcgtgacgaatacccatccaacccaatggttctgcgagggatcaaccagaaagccgcattcccgcagtaccagccagtggtaatgctggaaaaaggttacactattcattggaacggcccagcacccagaaccacctttctctacctcgtcaattttaacaagaatgattggatccgggtaggcctttgctacccgagtaatacctctttccaggtgacatttggttaccttcaaaggcagaacgggagtctctcaaagattgaggagtacgaacccgtacactcccttgaggagctccagcggaagcagtcagaaagaaagttctattttgactcctctactggactgttattcttgtacttaaaagctaagagccaccggcacggccacagctattgttccagccagggttgcgagcgcgtgaaaattcaggccgctactgattcaaaagatatctcaaactgcatggcaaaggcatacccgcagtactaccgaaaaccttctgtagtaaagcgcatgcccgctatgctcactggcttatgccaggggtgtggcacacgccaggtggttttcacatctgacccgcataagtcatacttacccgtgcaatttcagagccctgataaagctgaaacccagcgcggtgatccatcagtgataagtgtcaacgggacggactttacgttccgatcagcaggggtacttctgctggtcgttgatccctgcagcgttcctttccgtctgaccgagaagactgtctttccccttgctgacgtctctcgcattgaggagtatctcaagacaggcatcccgcctaggtcaatagtgttgttgtctactcggggagagattaaacagctgaacatttctcatctgctggtccctttaggcctggccaaaccagctcacctgtatgataaaggcagcactatcttcttaggcttttcaggcaatttcaaaccaagctggacgaaattgtttacctccccagccggacaagggcttggggtcttggagcagttcattcctctgcaactagatgagtacggatgccctcgggctactactgttcgacggcgtgaccttgagttgttgaagcaggcaagcaaggcgcattag

SEQ ID NO: 244806 - DNA, 57 bp, Artificial Sequence
  Description of Artificial Sequence: Synthetic coding sequence
atgtacgctaccgattccagagggcattctcccgcatttcttcaaccccaaaactag

SEQ ID NO: 244807 - DNA, 570 bp, Artificial Sequence
  Description of Artificial Sequence: Synthetic coding sequence
atggaggaggggggaaacttgggtgggctgatcaaaatggtccatcttctcgtcctgagcggcgcatggggcatgcagatgtgggtgacctttgtgtctggcttcctattgtttagaagcctcccgagacatacctttgggctcgtgcagtccaaactcttccctttctactttcacatctccatgggctgcgccttcatcaatctgtgtattctagcctcgcagcatgcatgggcacaacttaccttctgggaggccagccagctctatctcctcttcctctcactcactctggcaaccgtcaacgctcggtggcttgaacccagaacaacggcagctatgtgggctctccaaactgtggagaaggaaagggggctcggcggagaagtgcccggatctcaccaggggcctgacccataccggcagttacgggagaaagatccaaaatactctgcactgcgccagaatttcttcagataccacggcctgtcctccctctgcaatttaggatgtgttctgtcaaatggactatgtcttgctggcctggccctggaaattagatctctctag

SEQ ID NO: 244808 - DNA, 570 bp, Artificial Sequence
  Description of Artificial Sequence: Synthetic coding sequence
atggaggagggtgggaatttgggaggattaataaaaatggtccatctgctcgtgctctctggggcatgggggatgcaaatgtgggtgacatttgtgtctgggttcctcctttttcgatccttgcctcggcatacgttcgggctggtccaatccaaattattccccttttattttcacatcagtatgggctgtgccttcattaacttatgcattttagctagccagcatgcctgggcacagctgacattttgggaggcctcccagttatatttgcttttcttatcattgaccttagcaaccgttaacgccaggtggctggagccgaggaccacagccgcaatgtgggctttgcagaccgttgagaaggagcggggtcttggaggggaggtgcccggttcccatcagggtcccgacccatacagacagcttagagagaaagacccaaagtatagtgcgctacggcagaatttttttaggtatcatggtctgagttctctgtgtaatctagggtgtgtgctgtccaacggcctttgccttgccggtctggccctggaaattcgttctttgtag

SEQ ID NO: 244809 - DNA, 570 bp, Artificial Sequence
  Description of Artificial Sequence: Synthetic coding sequence
atggaagaggggggtaacctcggcggattgataaagatggtgcacctgctcgtcctgtctggagcgtgggggatgcagatgtgggtcactttcgtcagcggtttcctgctgtttcgttccctgcctcggcacacctttgggctggttcaatccaaactgttccctttctattttcacatcagtatgggatgcgcgtttatcaacctgtgtattttggcctcccagcatgcgtgggctcagctgaccttttgggaggccagtcagctgtacttattgtttctgagcttgaccttagctacagtgaatgcacgatggttagagccccgtactactgcagcaatgtgggccctgcaaacagtggaaaaagagcggggtttgggtggagaggttcctgggagtcaccagggaccggacccctaccggcagctgcgcgagaaggaccccaaatattcagcccttcgtcagaatttcttccggtaccacgggctgtcttcactgtgtaacttgggttgtgtacttagtaatggcctgtgccttgcaggcttagccttggagattaggagtctgtag

SEQ ID NO: 244810 - DNA, 447 bp, Artificial Sequence
  Description of Artificial Sequence: Synthetic coding sequence
atgctcccgaggggcctaaaaatggctcctcggggtaagcgtttatctagcaccccccttgaaattcttttctttctgaatgggtggtacaacgctacctacttcctgctggagctctttatttttctatataaaggtgtcctgctcccttacccaacagcaaatctcgtcctggacgttgtgatgctgctgttgtacctgggtattgaagtcatccgtctgtttttcggcacaaaggggaacctgtgccaacgcaagatgccgctgtctataagcgtcgccctcacttttccgtcagctatgatggcctcatactacttactgctccagacttatgtgctcagactggaggcaataatgaatgggatcttgctgttcttttgtggctcagagctccttttggaggtccttaccttagctgccttttcatctatggatcggatttag

SEQ ID NO: 244811 - DNA, 438 bp, Artificial Sequence
  Description of Artificial Sequence: Synthetic coding sequence
atgctcccccgtgggctcaagatggctccgagaggcaaaagactaagcagcacaccactagagattttattctttctcaacggatggtataacgccacctacttcttactggagctgtttatcttcctctacaaaggcgttttgctcccttaccctacagccaatctcgtcttagatgtagtcatgctgctgttgtatttgggcattgaggtaatcaggctattcttcggtaccaagggaaatctgtgtcagagaaagatgcccctgtcaatctcagtggcactgacctttcccagcgcaatgatggcatcttattacctgctgcttcaaacatatgtgctgcggctggaggctataatgaacggcatactgctgttcttctgcggatcagagctgctccttgaagttcttacactagcagccttttctcggatctag

SEQ ID NO: 244812 - DNA, 942 bp, Artificial Sequence
  Description of Artificial Sequence: Synthetic coding sequence
atgaggacagattccggagccaggctggaagaggggcatctgcgccctccgagagccctacctccagtaccctcaatcgatgatattcctctgagccggcctaaaaagaaaaaaacccagcctgctgaactccagtacgcgaacgaactgggagtggaagacgaggatattataactgatgagcagactacagttgagcaacagtcggtgttcacagcgccaacggggataagtcagccagtcgggaaagtgtttgtggagaagagtcgcaggttccaggccgctgatagaagtgagctgatcaagactactgagaacattgacgtatcaatggacgtcaagccgagctggaccactcgggacgtggccctcacagtgcatagagccttccggatgattggcctattttctcacggatttcttgcagggtgcgccgtatggaacatcgtggttatttacgttctggccggagatcagttgtctaacctatcaaacctactgcagcagtataagactcttgcataccccttccaaagtctcctgtacctcttattggctcttagcacaataagcgcttttgaccggatcgacttcgctaaaatatccgttgcgatccgcaattttctcgccttggaccctaccgctctcgctagcttcttatactttacggcgctcatcctctcactgtcccagcagatgactagcgaccgcatacatctgtacactcccagtagtgtaaacggttccctgtgggaagccggtattgaggagcagattctgcaaccttggatcgtcgttaacctcgtcgttgcactccttgtcggcctttcgtggcttttccttagctatcgcccaggcatggaccttagcgaagagctgatgttctcgtccgaagtcgaagaataccccgataaagagaaagagatcaaagcttcctcctag

SEQ ID NO: 244813 - DNA, 1203 bp, Artificial Sequence
  Description of Artificial Sequence: Synthetic coding sequence
atgggcaagaatcccgtgaggccaccgcgtgcgctgcctcccgtgccaagccaggacgatatccccctgtctcgtcccaaaaagaagaagccacgcactaagaacacccccgcaagtgcctcactggagggactggcgcagactgctgggagaaggccttcagagggaaacgagccttccacgaaggagcttaaagagcaccctgaggcacccgtgcaacgtagacaaaagaaaacacgcctgcccctcgaactggaaacatcctctacccagaaaaaaagctcctcaagctccctgctaaggaatgagaacggtatagacgccgaacccgctgaagaagccgtgatccaaaaacctcggaggaagactaagaaaacccagccagcggagctccagtacgcaaacgagttgggtgtggaggacgaagacatcatcacggatgagcagacaacggtggagcagcagagcgtttttactgctccaaccgggatcagccaacccgtgggtaaggtcttcgtcgaaaaaagtaggcgcttccaggcggctgatcgatccgaacttatcaagacgacggagaacatcgacgtgtctatggacgtgaaacctagttggacaacgcgtgacgttgctttaacggtacatcgcgctttcaggatgatcggcctgttctcacacggcttccttgcgggttgtgccgtgtggaacatagtcgtgatctacgtcctggcaggcgatcagttgtccaatctatcaaatctgcttcagcagtacaagaccctcgcctatccgttccagtctttactgtatcttcttctcgctctgtctacaatctccgcctttgatcgtatcgacttcgccaaaatatctgtggctataaggaactttctcgcattagacccaacagccctcgccagcttcctctattttacagcacttattttaagtcttagtcaacagatgacctcagaccgcattcatctgtatactccttcctcagtcaatggatccctttgggaagcgggaattgaggagcagatcctgcagccttggatcgtagtgaacctggtcgtggctttattggtgggactgtcctggctctttctctcctacagaccgggaatggaccttagcgaggagctcatgttcagctcagaggtagaggagtacccagacaaggagaaggagattaaagcttcctcttag

SEQ ID NO: 244814 - DNA, 1227 bp, Artificial Sequence
  Description of Artificial Sequence: Synthetic coding sequence
atgaggaccgattccggagctaggctggaagagggacacctgcggccaccacgtgctctgccacctgtaccctctcaagacgacattcctctgtcccgccctaagaaaaagaagcccaggactaaaaatacccccgcaagcgccagtctggagggcttggcccaaacggcaggacgaaggccctcagaggggaatgagccaagcacaaaagagctgaaggagcaccctgaggcacctgtgcagcgtaggcagaagaagaccagactacctctcgagctggaaacctcctctacgcagaagaaaagttcaagttcgtctttactgcggaacgaaaacggcattgatgccgagccagctgaagaggccgttattcagaagccacggagaaagacaaaaaaaacacagcctgccgagctccagtatgccaatgagctgggggttgaagacgaggacatcatcactgacgaacagaccacagtcgagcagcaaagcgtgtttaccgcaccaacaggcatcagtcagccagttggcaaagtcttcgtcgaaaagtcccgcaggtttcaagcagctgatagaagtgaattgattaaaacaacagaaaatattgacgtgagcatggatgtgaagccctcatggacgaccagggatgtagccctgacagttcacagggccttcaggatgatcgggttgttttcgcatgggtttctggccggttgtgccgtgtggaacattgtagtgatatacgtcctggccggtgaccagctctcgaacctttcaaatctgctccagcagtacaagaccttggcatatcccttccagtctctgctttatctgctgctggcactgtctacgatctctgcgtttgacagaattgacttcgcgaagattagcgtagcgattaggaactttttggccttggacccaacagctctggcgagcttcctatattttacggcattaatcctgagcttatcacagcagatgactagcgaccggatacacttatatacaccttctagcgtgaatggatcactgtgggaggccggaattgaggagcagatccttcaaccatggatcgtggtaaatctggtcgtggcactcctagtgggtttatcctggttattcctgtcctaccgcccaggaatggatctaagtgaagagcttatgttttctagtgaggtggaagaataccctgataaggagaaggagatcaaagcatcatcctag

SEQ ID NO: 244815 - DNA, 1293 bp, Artificial Sequence
  Description of Artificial Sequence: Synthetic coding sequence
atgactcattgcgcttgcgcaagagataggagagaaggatggggagctaggtgtctgggccgaaggcccccacgtcccgcaaagagacgcatggggaaaaatcctgtgcgaccaccacgggcacttccccctgtaccctccatcgatgatatacccctcagccgccctaaaaaaaaaaagcctaggactaagaatacccccgcttccgccagtctggagggattggcgcagacagccggacggcgaccctcagagggcaatgaaccctctacaaaggaattaaaagagcacccggaagcaccagtccagcgcagacaaaaaaagacacggcttcctttggaactagagacttcatcaactcagaagaaaagctcctcctcctcgttgctcaggaatgaaaacgggattgacgctgagcccgctgaagaggcagtgatccaaaaacctcgcaggaagaccaagaaaacacagcctgcagaattacagtatgcaaatgagctgggtgtcgaggacgaggacatcatcaccgatgagcagacaacagtggaacagcagtccgtctttacagcaccgaccgggattagccagccagttggaaaagtcttcgtcgagaagagtagaaggtttcaagcagccgaccgatccgagcttatcaaaaccacagaaaatatcgatgtttctatggatgttaaaccttcatggactacacgtgatgtcgctcttacagttcacagggccttcagaatgatcggcctattttctcatgggttcctggctggctgcgcagtgtggaacattgtggtaatctatgtcctggccggagaccagcttagcaacctctctaatctgttgcagcagtataagacattagcttatccttttcagagtctactctatctgctacttgctctgtcaacaatcagcgccttcgataggatagactttgccaaaattagcgtagccattcgaaacttcctcgccctggacccaaccgcccttgcctcattcttgtactttaccgcgctgatcttgagcctcagccaacagatgacatcggaccgaatccacctctacaccccatcttctgtcaatggcagcctgtgggaggctggcattgaagaacagatactgcagccttggatcgtggtgaatttggtagtggccctactcgttggactttcatggctgtttctctcctatcggcctgggatggatctgagcgaggagctgatgttcagcagcgaggtagaagaataccctgacaaagaaaaggaaattaaggcttcaagttag

SEQ ID NO: 244816 - DNA, 1227 bp, Artificial Sequence
  Description of Artificial Sequence: Synthetic coding sequence
atgaggacagattccggagccaggctggaggagggacatctccggccacccagggcattaccacctgtcccttctatcgacgacattccactctcgcggccaaagaagaaaaagccgagaaccaaaaacacacctgccagcgcctcacttgaaggattagcacagacagctggtaggagaccaagcgagggtaacgagccttcaacaaaagaactgaaggagcaccctgaagccccagttcagcgccgacagaaaaagacaagattgcctctggaattggaaactagctccactcagaagaagtcttcgtcctcatctttactgcgtaacgaaaacggcatcgacgcggaacctgccgaggaagccgtgatccaaaaacctaggcgaaagaccaagaagactcaacctgccgaactccagtacgccaacgagttgggagtggaagatgaagatattattacggacgaacagactacggtagagcaacagagtgtcttcactgccccaaccggaattagccagcctgtcggcaaggtgttcgtcgaaaagtcaagacgattccaggctgcagataggtccgaattgattaaaaccactgaaaatatcgacgtgtcgatggacgtgaaaccttcatggaccacccgggatgtggcgttgactgtgcacagggctttccgtatgatcggtctcttcagccatgggtttctcgcaggatgtgcagtgtggaacattgttgttatctacgtgcttgccggtgaccaactgtctaatctgtcaaatttgcttcagcagtataagactctggcctacccttttcagtctctcctttacctcctcctggccctctccactatctcagcatttgaccgcattgacttcgcaaaaatctctgtggccatcaggaacttcttggcactcgaccctacggccctggcatcttttctgtatttcactgctctgatcctgagtctgtctcagcagatgacaagcgacagaattcatctgtacacgccaagttctgtgaatggttccttgtgggaggcaggaattgaagagcagatacttcagccgtggattgttgttaacctggtggtggccctgctagtgggcttatcgtggttgttcctttcctatcgacccggtatggatctctctgaggaactcatgttctctagcgaggttgaagaatatcccgataaagagaaagaaatcaaagcatcctcttag

SEQ ID NO: 244817 - DNA, 1101 bp, Artificial Sequence
  Description of Artificial Sequence: Synthetic coding sequence
atggcactgcctcccggtccagcagcccttcgccatacactcttgctgcttcctgcgctcctttcgtcaggatggggggagttagagccccaaattgatgggcagacatgggccgagagagcactgagagagaatgaacggcatgctttcacctgtcgggtggcgggtggtcccggtacaccgcgattggcctggtatctcgacggccagctgcaggaagcttccacttccaggctgctctctgtcgggggagaggcctttagtggcggaactagtaccttcaccgtgacagcccatcgcgcacaacacgagctcaactgttctctccaggacccaagatccggcagaagcgccaacgccagcgtcatcctgaacgtgcaattcaagcctgaaatcgcccaggtcggagcaaaatatcaggaagcacaaggccctggactcctggtcgtactgttcgcactagtccgcgctaacccacccgctaacgttacctggattgaccaggatggccctgttacagtgaatacgtccgactttctggttctggacgcacagaattacccatggctcactaaccacactgtacagctgcagctccgaagcctcgctcataatctgagcgtggtcgcaacaaatgacgtgggggtgacctccgccagcctcccggcacccggattgctggccacgcgagtggaagtcccacttcttggaattgtcgtggctgctggcctggccctgggcacactggttgggttcagcacactcgtggcctgcttggtatgtaggaaagagaagaagacaaagggccctagccgccacccaagcctgattagctccgactctaataatctgaaattgaataatgttcgtctgcctagggagaatatgagtctcccctccaacctccaacttaacgatctaacacccgactcccgtgcagtcaaacctgcagatcgccaaatggcccaaaacaattcacgtcctgaactgttggatcctgaaccaggcggtctgttgacatctcaaggattcattcgactgcctgtactaggctatatctaccgcgtatcttctgtaagttcagacgagatttggctttag

SEQ ID NO: 244818 - DNA, 657 bp, Artificial Sequence
  Description of Artificial Sequence: Synthetic coding sequence
atggctcttccccctggcccagctgcgctcagacacactttactcctgcttccagccctactgagtagtgtgaaacctgagattgctcaagtgggggctaagtaccaggaggctcagggtccaggcttgcttgtagtgctgtttgctttagtgagggcaaatcctcctgcaaacgtcacttggatcgatcaggatggaccagtgacggtcaatactagtgattttttggtattagacgcgcagaattatccttggttaacaaatcacactgtgcagctgcagctgcgcagtctggcccacaacctgagtgttgtggcaactaacgatgtcggcgtgacaagcgcctccctgccagccccagggccatctcgtcaccccagtctgatttcttcggattccaataacctgaagttgaataacgtgagactcccccgagagaatatgtccctgccttccaacctccaactgaacgacttgacccctgacagccgcgctgtaaaacctgccgatcgccagatggcgcagaacaatagccgtcctgaattattggatcctgagcccggaggacttctaacgagccaggggtttatccgcctgccggttcttggctatatttatagggtttcgagtgttagcagcgacgaaatctggttgtag

SEQ ID NO: 244819 - DNA, 1056 bp, Artificial Sequence
  Description of Artificial Sequence: Synthetic coding sequence
atggccttgcctccaggaccagccgctcttcggcatactttgttactgcttcccgcactgttatcttccgggtggggagagttggagccacagatagatggccagacctgggctgaaagggcacttcgcgaaaacgagaggcacgccttcacctgcagagttgccggtggcccaggtacgcctaggctggcttggtatctcgacggacaacttcaggaggcgagtacttctagactgttgagtgttgggggtgaggctttctcaggaggcacctccacatttaccgtaacggcgcacagggctcagcacgaactgaactgtagcctgcaggacccgaggagcggcaggagtgctaacgcttcggttattctaaacgtgcagttcaaaccggaaatcgctcaggttggtgcgaagtaccaggaagcgcagggaccgggtttactggtagtgctgtttgccttggtcagggccaatccacccgctaatgtaacatggatagatcaggacggccctgtgacagtaaatacctccgactttctcgtgttggacgcccagaattatccttggttgactaatcatacggtgcagttacagttgcgaagcctggcacacaaccttagcgtagtggctactaacgacgtgggcgtaacatccgcatccctgccagctcccggactgttagcgacccgggtagaagtacccctccttggcatcgtagttgcagccggtctggccctgggcacactagttgggttttctacattggtggcctgtctggtttgccgcaaagagaagaagacaaaaggacctagtcgtcatcccagcctgatatcatcagactcaaataacctgaagctaaacaacgtgcgtctgcccagggaaaacatgtctctgccgagtaatctgcaacttaacgacctaacacccgatagccgagccgttaaacctgccgatcgccagatggcccagaacaattcccgacctgaactgctcgaccccgagccaggcggactgctgacgagccagggtcgtagaaaccaggataaggatgcctag

SEQ ID NO: 244820 - DNA, 969 bp, Artificial Sequence
  Description of Artificial Sequence: Synthetic coding sequence
atggcactaccacccggtcccgcagctttgcggcacacactgctcttgctgcccgctttgcttagctctggatggggcgagttagagccccagatcgacggccagacgtgggcggaacgggctctgagagagaacgaacggcacgcatttacgtgtcgtgtcgcaggtggaccagggacacctcggctggcgtggtacctcgacggacagcttcaggaagcctctacgagtcggctattgtcagtcggaggtgaagccttttcaggtggcacaagcacatttaccgtgaccgcgcacagggcccagcatgaactgaactgtagtctgcaggaccctaggagcggccgttcagccaatgccagcgttatcttgaatgtgcagttcaaaccagagattgcccaggtcggagcaaagtaccaggaagcacagggcccagggctcctggtggtcctctttgcattggtgagggccaacccgccagccaatgttacatggattgaccaggacgggcctgtcaccgtgaacacttctgattttctggttctggacgcacagaactatccttggctgaccaatcacactgtgcagctgcagctcaggtccttagcccacaacctgagcgtggtggccacaaacgatgtgggcgttaccagtgcatccttgccagccccagggcctagtagacatccttctcttatttccagtgacagcaacaatctgaaattgaataatgtgaggttgccgagggagaacatgtcactgccatcaaatctccagctgaatgatttgaccccagatagcagggccgttaagccagctgaccgccagatggctcagaacaactcccgaccagagctgttggatcccgagcccggaggccttttaactagccagggctttattcgcctgccagttctggggtatatctatcgggtctcatccgtcagctcagacgagatttggctctag

SEQ ID NO: 244821 - DNA, 969 bp, Artificial Sequence
  Description of Artificial Sequence: Synthetic coding sequence
atggctctgccccctggcccagccgctctcaggcataccttgctgctcctgccagccttattgtcttccggatggggagagttagagccccaaatcgacggtcagacatgggccgaacgggcactgagagagaacgagcggcatgccttcacatgccgagtggcaggcggacccggtaccccaagactggcttggtacctggatggccaacttcaggaagcctctacatcacgcttgctgagtgtgggcggagaggcgttttccggcggaacttcgacttttaccgtgacagcccaccgcgctcagcatgagttgaactgttccctgcaggatccccgttccggacggtccgctaatgcctccgtgatcttaaatgtgcagttcaaaccagagatcgcccaggtgggggctaaatatcaagaggctcagggcccaggcctgttggtcgttctcttcgcactggtcagggctaatccacccgcaaatgttacttggatagaccaggacggccctgttactgttaacacttccgacttccttgtcctggacgcgcaaaattacccatggcttacaaaccacacagtacagcttcagctacggagtttggcacacaatctgagcgtagtggcgacaaatgacgtgggtgtgaccagcgctagtctgccggctcctgggcctagcagacatcccagtctcatctcctcagacagcaataatctgaagcttaataacgtgcgattgcccagagagaatatgagtctgccctccaacctgcagctgaatgacttaacccctgacagcagagccgtgaaacctgccgataggcaaatggcgcaaaataactctcgccctgaacttctggatccggagccaggcggtcttctgacgtcccaaggctttattaggttgccagtgctgggttatatttatcgggtcagcagcgtgagtagtgacgaaatctggctatag

SEQ ID NO: 244822 - DNA, 921 bp, Artificial Sequence
  Description of Artificial Sequence: Synthetic coding sequence
atggcattaccacccggtccggctgcactgagacacacactgttactgctgcctgccctcctgagcagtggatggggggagctggagccccagatcgatgggcagacatgggctgagagagctctgcgcgagaatgagcgacacgccttcacgtgcagggtggcaggcggtcctggtacaccacgactagcctggtatctcgatggccagttgcaggaggcttctacaagcagactgctctcagtgggtggggaagcttttagcggcggaactagcactttcaccgtgacggcgcacagggctcagcatgaactgaattgtagcctgcaggatcctcgaagtggacgctctgctaatgcttccgtcatacttaacgtgcagttcaaacccgagatcgcacaggtgggtgccaaataccaggaggcacagggtcccggactcttggtggtgctgttcgccttagtgagagctaaccccccagccaacgtgacctggatcgaccaggacggtccagtcacagttaatacgtctgattttctcgtcctggacgctcagaattacccatggctgactaaccacaccgtgcagttgcagctgagatcgctggcccataacttatccgtggtggccactaacgacgtgggcgtgacctccgcctcactcccggctcccggaccaagtcgacatccctccctgattagcagcgactctaacaacctgaagttgaataacgtgcgtttacctcgagagaacatgtcactgcccagcaacttacagctgaacgacctgacccccgactctagagttaagccagccgaccggcaaatggctcagaacaactcccgaccggagctgctggatccagaaccaggcggactcttgactagccaggggagaaggaatcaagataaagacgcgtag

SEQ ID NO: 244823 - DNA, 1146 bp, Artificial Sequence
  Description of Artificial Sequence: Synthetic coding sequence
atggcgttacccccaggcccagccgcattacggcacaccctgctattactgcctgcactcctgagcagcggctggggggaactagaaccacagattgacggccagacgtgggccgaacgcgcactccgggaaaatgaacgacatgcatttacatgtagagtcgccggaggccctggaacaccgaggctggcgtggtatctcgatggccaactccaggaggcgtcaacctcccgcctattgtctgtcgggggagaagcattcagcggcggaacgtcgacgttcacagtgactgctcatcgtgcccagcacgagttgaactgctctcttcaggacccgaggtccgggaggagtgcaaacgcttccgtaatcctgaacgtccagttcaagccagagatcgctcaggtaggcgcaaagtatcaggaggcacaaggccctggcctgcttgtggttttattcgcccttgtcagggccaatccaccagccaatgtgacctggatcgatcaggatggccctgtgaccgtgaatacttcagattttctcgttctagatgctcagaactacccctggctcaccaatcacactgtccagctccagctgagatctctggcacacaacctcagtgtggtggctaccaatgacgtgggcgtgacgagtgccagtttgcctgcacctgggttactggcaacacgtgtggaagtgcctttgctggggatagtggtggccgctggacttgccctgggtaccctagtagggttctcaactctcgtggcgtgcctggtgtgtagaaaagaaaagaagacaaagggtccatctaggcatccgagtctgattagtagtgactcgaacaacctcaaactgaacaatgtgagactccccagagaaaatatgtctctgccttccaacttgcagctcaatgacctgacaccagatagccgagtcaaacccgcagatcggcagatggcccagaataactctagacctgagctattggatcctgagcctgggggactcctgacatcgcaagcatgcttgctgcaccatggtacaccagctctcacaaatccctggctgccccatcagcaggaaggggcactgccaggcggatggtcaccgcaggcccataacagtactgtatggaagctttag

SEQ ID NO: 244824 - DNA, 810 bp, Artificial Sequence
  Description of Artificial Sequence: Synthetic coding sequence
atggcactgccgcctggcccagccgctctcaggcatacgcttctcctgctgcccgcactgttgagcagtggatggggggagctagagccacagatcgatgggcagacatgggctgagagggcactccgtgaaaacgagcggcacgcatttacgtgtagggtcgctggaggcccaggtacgccaaggcttgcgtggtacctcgatggccaactccaagaagcctcgacctctaggctgttgagcgttggaggtgaagcctttagcggcggaacctccacatttaccgtgaccgcccatcgcgctcagcacgagttgaactgttctctgcaagatccaagatccggcaggtctgccaacgcctctgtaatcttaaacgtgcaatggttactggctacccgagtggaggtccccctgctggggatcgtggtggcagcaggactcgcccttggtacccttgttgggttctcaacactagtagcttgtcttgtctgtcggaaagagaaaaaaacaaagggcccaagtcggcatcccagcctcataagcagtgactcaaacaacttaaaactgaacaatgtgcggctcccccgtgagaatatgtcactcccatctaacctgcagttgaatgatcttacgccagattcacgggcagttaagccggctgataggcagatggcgcagaacaactctcggccagagttactcgatcccgaacccggaggcctgctgacttcacaggggttcattcgtctgcccgtgctggggtacatttatcgggtgtcttcagttagcagcgacgagatctggttgtag

SEQ ID NO: 244825 - DNA, 669 bp, Artificial Sequence
  Description of Artificial Sequence: Synthetic coding sequence
atgttatggctcctgttctttctagtcaccgccatccatgctgagttgtgccagcccggtgccgaaaacgcctttaaggtgcgcctctctataagaaccgccttaggcgataaggcatacgcatgggacacaaacgaggagtatctatttaaggccatggtggccttttcaatgaggaaggttcctaatagagaagccaccgaaatctctcatgttttgctctgtaacgtaacccaaagggtgtctttttggtttgtagtcacagatcctagcaaaaaccacaccctgcccgctgtggaagtgcagtctgccattagaatgaacaagaaccgcatcaacaacgcttttttcctcaacgaccagacactcgaattcctcaagatcccttcaaccctggctccccctatggatccgtccgtgccaatctggatcataatatttggggtgattttttgcatcattatcgtcgccattgcccttctgatcctctctgggatttggcagaggcggagaaagaacaaagaaccctccgaagtggacgacgcagaagacaaatgtgaaaacatgataactatcgagaatggaatcccaagcgatcctctggatatgaaaggaggtcatattaatgacgcttttatgaccgaggatgagaggttgactcctctctag

SEQ ID NO: 244826 - DNA, 252 bp, Artificial Sequence
  Description of Artificial Sequence: Synthetic coding sequence
atgctgcgcaatttgctggcgcttcgccagattggccagcggactatctcgactgcatctcgcagacattttaaaaacaaagtcccagagaaacagaaactttttcaggaggatgatgagatcccattgtacctaaagggcggtgtggccgacgccctgctgtatagggccaccatgatccttacagtcggcggaaccgcctacgccatttatgagctcgccgtcgcctccttccccaagaaacaggaatag

SEQ ID NO: 244827 - DNA, 729 bp, Artificial Sequence
  Description of Artificial Sequence: Synthetic coding sequence
atgtattacgggctcagcaacttttatcagaatcaccggaggtacgtcaaatctagagacgatagtcagctgaatggcgattcctctgccctcctcaacccgagtaaggaatgcgagccttatagaaggaacgaagataagccgattgcgccatgtggcgcaatcgcaaatagcatgttcaatgacactctcgaacttttcctcattgggaacgactcttacccgattccaatcgcactcaaaaagaaaggaatcgcctggtggacagacaaaaatgtcaaatttcggaatccacccggaggtgataatctggaagaacgctttaaaggaacaacaaaacccgtgaactggctcaagcctgtatatatgctggacagtgatcctgacaataacggatttataaacgaggacttcatcgtttggatgcggacagccgctctccctactttcagaaagctttaccgtctgatcgaacggaagtccgatctccaccctacattgccagccggaagatattctctcaacgttacctataattacccagtgcactatttcgacggaaggaagcgtatgatactttccacaataagttggatggggggaaagaatccattcctgggtattgcgtatatcgctgttggctccattagttttcttctcggtgtggtgctgctggtgatcaatcacaagtaccgcaactccagcaacactgctgatatcaccatttag

SEQ ID NO: 244828 - DNA, 978 bp, Artificial Sequence
  Description of Artificial Sequence: Synthetic coding sequence
atggcgatgaactacaatgctaaggatgaggtagacgggggtccaccctgtgcccctggcggtacagccaagactagaaggcctgacaatacagccttcaagcagcagcggcttcctgcctggcagcctatcctgaccgcaggcaccgtgctgccgattttcttcattattggactgatatttattccaatcgggatcggaatattcgttacgtccaacaacatccgggagatcgagggtaacgtattcatgtattatgggctgtctaacttttatcagaatcacagaaggtatgtgaagagcagggatgattctcaactcaacggcgattcatcagctttgttgaaccctagcaaggaatgcgagccttatcgcaggaacgaagataagccaatcgcaccctgtggcgcaattgccaattccatgtttaatgatacactcgagctatttcttatcgggaacgacagctaccccatcccaattgccctaaagaaaaagggaattgcctggtggacagataaaaacgtgaagtttaggaacccacccggtggtgataatcttgaagaacgcttcaaagggactaccaagcctgtgaattggctcaaacctgtttatatgctcgactctgacccagacaataatggcttcattaatgaagactttatcgtatggatgagaacagccgctctcccaactttccgaaagttatacaggcttatcgaaaggaagtccgacttgcaccctacgctcccagcgggaagatatagcctcaatgtgacttacaactaccctgtccactattttgacggcagaaaaaggatgattctaagcaccatctcttggatgggtggcaaaaaccccttcctggggatcgcgtacatagctgttggatccatctcattccttctgggagtggtgttactggttattaatcataagtatagaaacagctcaaatacagctgacatcacaatctag

SEQ ID NO: 244829 - DNA, 234 bp, Artificial Sequence
  Description of Artificial Sequence: Synthetic coding sequence
atgtactacggcctatcgaatttttatcagaatcatcggaggtatgttaaatcccgagacgactcgcagctgaacggagatagctcagccttgctgaaccctagcaaggaatgtgagccataccgccgtaatgaggataaacctattgcaccatgcggtgcgattgccaattctatgtttaatgacactcttgagctgttcctcattggtaatgattcttatccaattccatag

SEQ ID NO: 244830 - DNA, 1038 bp, Artificial Sequence
  Description of Artificial Sequence: Synthetic coding sequence
atggccatgaattataccgccaagactaggcgccctgacaatacagccttcaagcagcaacgcctccctgcctggcagcccattctcacagcaggaaccgtgctacccatttttttcatcatagggctcatcttcatcccgattggaataggcatattcgtcacaagcaataacattcgcgaaatcgagattgattatacaggaactgaaccctcaagcccatgcaataagtgtctgtcgccggacgttactccctgcttttgcaccatcaacttcaccctcgagaaatccttcgagggaaacgtgtttatgtactatggactgtccaatttctaccagaatcaccgtaggtatgtgaaatcgcgtgatgattctcagttaaacggggattccagtgcactgcttaacccctccaaggagtgcgaaccctacagacgtaacgaggataagcctattgccccttgtggagccatcgctaactcgatgtttaacgatacgctggagctgtttctgatcggcaacgactcataccccattcccattgcactgaagaaaaaaggtatagcttggtggaccgacaagaatgtgaaattcaggaatcccccaggaggggacaacctggaggaaaggtttaagggaaccactaagcctgttaattggcttaaacccgtgtatatgctggattccgacccagataacaatggatttatcaacgaagatttcatcgtttggatgcgcactgcagctctaccaacttttcgcaaactgtaccggctcatcgagaggaagtccgacctgcatcccacgcttccagcagggcgttattccctgaatgtgacttacaattacccggtgcactacttcgacggccgaaagaggatgatcctgtcaacaatctcttggatgggagggaagaaccccttcctcggtattgcgtatattgcagtcggatccatttctttcctcctgggggtagttctgttggtaattaaccacaagtaccggaattcctctaatacagcagacatcaccatctag

SEQ ID NO: 244831 - DNA, 1056 bp, Artificial Sequence
  Description of Artificial Sequence: Synthetic coding sequence
atgacttggtccgctacagcaaggggagcccatcagccagataatacagccttcactcagcagcgtctgccagcgtggcagccgcttctctcagccagtatcgctctgccactgttcttttgtgctggtcttgcctttattggattgggcctgggcctctactacagcagcaacggtatcaaagaactggaatacgactacacaggggacccgggaactggaaactgtagtgtatgtgccgctgccggtcaaggtagggctctgcctcctccttgctcatgcgcctggtacttctccctgcctgaacttttccagggccctgtgtacctttactatgagctcaccaatttttatcagaataatcgacgttacggtgtctcgcgggatgacgctcagttaagcgggctcccgtctgcccttaggcaccccgtgaacgaatgcgccccatatcaacggtctgccgcagggttaccaattgctccgtgtggcgcaattgcgaatagtctctttaatgactcctttagcctgtggcatcagagacagcccggagggccttacgtggaggtgccactcgaccgttcgggcatagcatggtggacagattaccatgtgaaattccggaatcccccacttgtcaatggaagtctcgccctggcatttcaaggcacggccccaccccctaattggaggcggccagtgtacgagctgtcacctgatccaaataacactggattcatcaatcaggacttcgtggtttggatgaggaccgccgcactgcccactttcaggaagctgtacgccaggattcggcagggaaattactctgccggattgcccagaggggcatatagagtcaatatcacctacaactatcccgtgagggcgtttgggggacacaagctgctaatcttttcttccattagctggatgggcggtaagaaccctttcctcggcatagcatatttagtggtcggcagcctgtgcatcctcaccggctttgtaatgttagttgtgtatatcaggtatcaggaccaggacgatgatgatgaagagtag

SEQ ID NO: 244832 - DNA, 1056 bp, Artificial Sequence
  Description of Artificial Sequence: Synthetic coding sequence
atgacatggtcagcaactgcgagaggagcccaccagcctgataacactgcctttacacagcaaagactgccagcctggcaaccacttctgtcagcttcaatcgctctgccccttttcttctgcgcaggtctggctttcatcggactcggccttggcctgtattattccagcaatggaatcaaggaactcgagtacgactatacgggtgatcccggaacggggaattgctcagtctgtgcagccgcaggccagggcagggcacttccgcctccatgttcctgtgcgtggtatttctccctgcccgaactgttccaagggccagtgtacctgtactatgagctcaccaatttttaccagaacaatcgcagatatggggtgtccagggatgatgctcagctcagcgggcttccatcagcactccgccacccggtgaatgagtgtgccccataccagagatccgccgctggtctgccaattgccccatgcggggctatcgcaaatagcttgttcaacgattcattttcactctggcatcagcgtcagcccggtggaccctatgttgaggtgcctttggatagatccgggatagcatggtggacagactatcatgtgaagttcagaaatccacccctcgtcaatggaagtctggctctcgcctttcaggggaccgcacccccacctaattggcgtaggccagtttatgaattgagtccggacccaaacaacactggatttattaaccaggacttcgttgtgtggatgagaaccgctgcgttacctacattcagaaagctgtatgcccgtatcagacaggggaattattccgctgggctacctcggggtgcatacagggtgaacataacgtataattaccccgtacgggcatttggcggtcacaagctgcttattttctcttccatcagctggatgggaggaaaaaatccatttctcggtattgcctacctggtcgtgggatctctatgtatactgacgggtttcgtaatgttggtagtttatattcgttatcaagaccaagacgacgacgatgaggaatag

SEQ ID NO: 244833 - DNA, 342 bp, Artificial Sequence
  Description of Artificial Sequence: Synthetic coding sequence
atggaagagcgagcacagcattgtctgagccgcttactagacaattccgcacttaagcaacaggaactccccattcaccgactgtattttacagccaggcgcgttctgtttgtgttcttcgcaaccggaatattctgcttatgtatgggaatcatcctgattctaagtgccaggtccacacaggagatcgagataaattatacgcgcatttgtgccaactgcgcaaaactgagggaaaatgccagtaacttcgataaagaatgtacctgcagcattcctttctacctgtccggtaagatgatggtgggcgaaattcaggaaactcgcctcacgttacattag

SEQ ID NO: 244834 - DNA, 207 bp, Artificial Sequence
  Description of Artificial Sequence: Synthetic coding sequence
taattatgtatgggaatcatcctgattctttcggctaggagcactcaggaaattgaaattaactatacccgaatctgcgctaattgcgccaagctccgggagaacgccagtaattttgataaagagtgcacatgtagcatccctttttatctgtccggaaaaatgatggtgggggaaatccaagagactcggcttaccctccattag

SEQ ID NO: 244835 - DNA, 1203 bp, Artificial Sequence
  Description of Artificial Sequence: Synthetic coding sequence
atggccgctaattacagctcaaccagtaccaggagagaacatgtcaaggttaagacctcctctcagccagggtttctcgagcgcctctcagagaccagtgggggaatgtttgtggggttgatggccttccttctgtcattctacctgatattcactaacgaaggacgagccctgaagacagccacttccctagccgaggggctgtcactggtggtctccccagattctattcactcagtcgcccctgaaaacgagggcaggctcgtgcatattattggtgctcttcgcacaagcaagctgctctccgaccctaactatggcgtgcacctccccgctgtgaagctccgccgtcatgtggagatgtatcagtgggtcgaaacagaggagtctcgcgaatataccgaggatgggcaggtgaaaaaagaaactcggtacagctacaatacagagtggcgcagcgagattattaactccaaaaactttgacagagaaatcggacataaaaatccttcggccatggctgtggaaagtttcatggcgacagcccctttcgttcagatcggcaggttcttcctatcaagtggcttaatcgacaaggttgataacttcaaatctctctcgctttccaagcttgaggaccctcatgttgacattataagaagaggggacttcttctaccactccgagaatcccaagtacccagaggtgggggacctgcgggtgagctttagttacgctggattgtcaggggacgacccagacctgggacccgctcatgtagtcaccgtgattgcaaggcaacggggagatcaactcgtccccttctccacaaagtcaggggacaccttactgctgttacatcatggagacttttcagctgaagaggtttttcaccgcgaattgaggtctaattctatgaagacatggggtctcagggctgccggttggatggcaatgtttatgggattgaatctgatgacgagaattctgtacacgctggttgactggtttccggtctttagggatctggtaaatatcggactgaaggcattcgccttttgcgtggctaccagcctcactctgctgaccgtggccgctgggtggctgttctacagaccattatgggcactgttaatagccggattggctctggtacccatcctggtggctagaacccgtgtgcctgcaaagaagctcgagtag

SEQ ID NO: 244836 - DNA, 546 bp, Artificial Sequence
  Description of Artificial Sequence: Synthetic coding sequence
atggcttcagccggatccggaatggaagaggtgagagtatctgtcctcacgccgctcaagttagtgggcctcgtttgcatcttcttagccctgtgcctggatctcggagccgtcttgagtcctgcctgggtcactgcagaccaccagtactaccttagtctatgggaatcttgtagaaagcctgcttcactggacatctggcactgcgaaagcaccttgtcatctgactggcagatcgcaaccctcgccctgctgctagggggtgcagcaataatcctgatcgcattcttggtgggactgatcagcatctgtgtgggttcaaggcgccgattctacagacctgtggccgtgatgctctttgcggctgttgtccttcaggtgtgcagtctggtcctctacccgataaagtttattgagaccgttagcctgaagatttatcacgagttcaattggggctatggactcgcatggggcgctaccatcttctcttttggtggcgcaattttgtactgtttgaacccaaagaattacgaggactattattag

SEQ ID NO: 244837 - DNA, 2745 bp, Artificial Sequence
  Description of Artificial Sequence: Synthetic coding sequence
atggggccttttaaatccagcgtgtttatcctgattctgcacctcctggaaggagccctgagtaactcgctgattcagctgaacaataacggctacgaaggcattgtggtagccattgaccctaacgttccggaggatgagacattaatccagcagatcaaggatatggttactcaggcctccctctacctgcttgaagccacaggaaaacgcttctactttaagaatgttgctattttgattcctgagacctggaagacaaaggccgactacgttcgaccaaagctggagacatataagaacgctgacgtgttggtcgctgagtcaacccccccaggaaacgatgagccatacactgagcagatgggcaactgtggcgaaaagggggaacgtattcacctgacccctgacttcatagccggaaaaaagctggccgaatacggtcctcagggcagagctttcgtccacgagtgggcacacctgcgatggggagtgtttgatgaatacaataacgatgaaaagttttatttgtccaacgggaggatccaggcagtcagatgttcagctgggatcaccggaactaacgttgtgaagaaatgccagggcggatcttgttacactaaaagatgcacctttaataaggtcaccggcttatatgagaaggggtgcgagttcgtcttacagagcaggcaaaccgagaaagcctctatcatgtttgcccagcatgtcgactcaattgtcgagttctgcacagagcaaaaccataacaaagaggcccctaacaagcagaaccaaaagtgcaacctacgatcgacctgggaggtcattagggatagcgaggattttaagaaaacaacccctatgaccacgcagccacctaatccaaccttttctcttttgcagataggccaacgcattgtgtgcctcgtgctggacaagtccggatccatggcaactggcaatagactaaacagactgaaccaggctggccagctgttcctcctccagaccgtggagttaggatcatgggtgggaatggtgacttttgacagcgctgctcatgtacaaaacgagctgatccaaatcaatagcgggagcgaccgggacacgctcgctaaaagactgcccgctgccgcaagcggtggcaccagcatctgctcagggcttcgcagcgcctttactgtgattcggaaaaagtatcccacagatggatctgaaattgttctcctgacagatggcgaggacaatactattagtgggtgtttcaacgaggtcaagcagtcgggggctattatccataccgtagctcttggcccaagcgctgcccaggagctggaggagctgagcaaaatgactggaggactccagacctatgcgtcagatcaggtgcagaataacggtctgatcgatgcctttggcgctttaagttccggcaatggcgcagtgtcccagcggagcatacagttggaatcgaaaggccttactctccagaacagccaatggatgaacgggacggtaattgtggactccaccgtcggcaaggatactttgtttctgatcacttggaccatgcaacctccccagatcctgctgtgggaccctagcggacagaaacaggggggatttgtggtggataagaacaccaagatggcctacctgcagattcccggtatcgctaaggtcgggacctggaaatactcactgcaagcttccagccagacccttactttaacggtcaccagtcgcgcatcaaacgcaactctaccaccaatcacagtcacttcaaagactaataaagacaccagcaaatttccctctcccctcgtggtgtatgccaacatcaggcagggcgcttctccgattctgagagcaagcgtcacggccctgatcgagtccgtcaatgggaaaaccgtgacactggagcttttggataacggagccggagcagatgcaacaaaggacgatggcgtgtattctagatattttacaacgtacgacaccaatggacgttacagcgtgaaagtcagggctctcgggggtgtgaatgccgctagacggcgtgtaatacctcagcaaagcggcgcactatacattcctgggtggatcgagaatgatgagattcagtggaatccccctagaccggaaatcaacaaagacgacgtgcagcataagcaagtttgttttagcagaactagctcaggtggatccttcgtcgcctccgacgtacctaatgctccgattcccgatctattcccccctggccagatcacagacctgaaagctgagattcatgggggaagcctcatcaatcttacgtggacagcccctggagatgactatgatcacggaaccgcccacaaatatattatcagaatctccacatctattctcgacctgagggacaaatttaatgagtctttgcaggtcaacactactgctttgattcctaaggaagccaactctgaggaagtctttctgttcaaacccgagaacattaccttcgagaacggtaccgacctgttcatcgctatacaggcagtggacaaagtggatctgaaatccgaaattagtaatattgcgagagtatccctgttcatccctccgcagacgcccccagagacccccagtccggacgaaacaagcgccccatgcccgaatatccatataaactccacaattcctgggattcatattctgaagattatgtggaagtggatcggggaactgcagctgagcatagcttag

SEQ ID NO: 244838 - DNA, 1674 bp, Artificial Sequence
  Description of Artificial Sequence: Synthetic coding sequence
atggccaccgcagtatctaggccctgcgcagggaggtcaagagatatactgtggagagtgctgggatggaggatcgtggctagcattgtgtggagtgttttgttcctgcctatctgcaccacagtgttcatcatcttctccaggatcgatctcttccatccaattcagtggctgagcgattctttcagcgacctttactcttcctacgtgatattttactttttactgttgagtgtagtgatcatcatcatctcaatcttcaatgtagagttctacgctgttgtgccatccataccatgcagccgactggccctgatcggtaagattattcacccccagcagctcatgcatagtttcatacacgctgccatggggatggtcatggcttggtgcgcagcagtgataacccagggccagtattcctttctggtggttccgtgcactggaaccaactcttttggaagtcccgctgcacagacttgtctcaatgaataccacctttttttccttctcacaggcgcttttatgggatattcatacagtcttctgtatttcgtgaacaatatgaactacctgccatttccgataatccagcaatacaagtttcttcgctttagacgctcactcctgctcttagtcaagcactcatgcgtggagtcgttgtttttagtgaggaacttttgtattctctactacttcctggggtatatacccaaggcctggatcagcacagcaatgaacctccatatcgatgaacaggtccataggcctctagacacggtctccgggctgctgaatttatcgctcctctaccacgtctggctgtgcggagtcttcctgctgactacctggtacgtgagttggatactcttcaaaatttacgcaaccgaagctcacgtgtttcccgtgcagcctcccttcgccgaggggtctgacgagtgtcttcccaaagtgctcaattcaaacccacccccaataattaaatatctcgccctgcaggacctgatgttgctgtcccagtacagcccatctcggaggcaggaggtgttctccttatcccagccgggagggcacccacacaattggactgcgatatctcgggaatgcctgaacctcctcaatgagatgaccgagttcagtaatccatccccttccacatcaatcagtgccgaaggaaaaaccatgcgacagccaagcgtgatttactcttggattcagaacaaaagggagcaaatcaaaaacttcctgtctaaacgcgtgctgataatgtacttttttagtaagcaccccgaagcaagcatccaggctgtcttttctgatgcacagatgcacatttgggcactggaggggctgtctcatctcgtagccgcatcctttaccgaagatcgtttcggagtggtacaaacgacgctgcccgctatcctcaatacactacttactcttcaggaggcagtggataagtactttaagctgccccacgcaagcagcaagcctccaagaatcagtggttctctggtagatacgtcatataaaactctgaggttcgcctttagagcttcccttaagacggctatttatcggattaccaccacatttggcgaacacctgaatgcagttcaggcctccgcggaacaccagaagaggttgcaacaattcctcgagttcaaagagtag

SEQ ID NO: 244839 - DNA, 2025 bp, Artificial Sequence
  Description of Artificial Sequence: Synthetic coding sequence
atggcaaccgctgtctcccgcccatgcgctgggcgatctagggacatcctgtggcgtgtccttggttggcgcatcgtcgcttctattgtgtggtccgtgttatttcttcctatttgtaccactgtcttcatcattttctccagaatagacctcttccaccctattcagtggctctccgatagcttcagcgatctatactccagctatgttatcttctacttccttcttctgtctgtggtgatcatcataattagtatatttaatgtcgaattttatgcggtggttccatcaattccatgctcaaggctggctctgatcgggaagatcatccatcctcaacagcttatgcacagcttcatccacgccgctatgggaatggtgatggcctggtgcgcagctgtcattacccagggccagtacagctttctggttgtgccttgcaccgggacaaattcttttggttccccggctgcacagacttgtcttaatgagtatcacttattctttcttttaaccggggctttcatggggtacagttacagtcttctttactttgttaacaatatgaattatctgccattccctatcatccagcagtacaaattcttaagatttcggaggagcctgctccttctggtgaaacactcctgcgttgagtcactcttcctcgttcgtaatttctgcatcctgtattacttccttggatacataccaaaggcctggatctctaccgccatgaacctgcacatcgatgaacaggtacaccggcctcttgacaccgtgtctggactcctgaatctgagtctgctgtatcatgtgtggttgtgcggggtatttctcctcacgacctggtacgtttcttggatattattcaagatatatgctacggaggcccacgtgtttccagtccaaccccctttcgcagagggctctgatgagtgcctgcccaaagtgctgaattctaaccccccaccaatcatcaaatacctggccttgcaagatctgatgttgctttcccagtatagtccttcgaggcgccaggaagttttcagcctgtctcaacccggaggccatccccacaattggacagcaatttcccgagaatgtcttaaccttttgaatggcatgacccagaagctcatcctttaccaggaggccgcagcaaccaacggcagggtaagcagcagttaccctgttgagcccaaaaaactaaattctccggaagagacagcatttcagacacccaaatccagccaaatgcccaggcccagtgtgcccccactcgtgaaaacatccttgttttccagcaaactctcgacgccggatgtggtaagcccttttggcacgccgttcggctcctcagtgatgaaccgaatggctgggatttttgatgtaaacacctgttatggatccccccagtccccgcagcttatccgcagagggccaagactgtggactagtgccagtgatcagcagatgaccgagttctcaaatccttccccaagcacatctatcagtgcagagggaaagacaatgcggcagcccagtgttatttatagctggattcaaaataagagagaacagatcaagaatttcctatccaagcgggtcctgataatgtacttttttagcaaacaccctgaggccagtatccaggcggtgttttccgacgcccagatgcatatttgggccttggagggattgagccacctggtggcagccagcttcacggaggacagatttggcgtagtacaaaccactctcccagccattctcaatactcttttgactttgcaggaagccgtggacaagtattttaagctcccacacgcatcatcaaaaccacctagaattagcggatctcttgtagatacctcctataaaacactgcgattcgcattccgtgcaagcttaaagactgccatatatcgaataactacgacctttggtgaacatttaaacgctgtgcaggcctctgccgagcatcagaagcggctgcagcagttcctggagtttaaggaatag

SEQ ID NO: 244840 - DNA, 1020 bp, Artificial Sequence
  Description of Artificial Sequence: Synthetic coding sequence
atgctactctcccagtactccccgagcaggcgtcaagaagtgttcagcctgtcacagcctggcggtcacccccataattggactgctatcagccgggaatgcctgaatctgttaaatggaatgacccagaaactgatcctttaccaagaggcagcagctaccaatggcagggtcagctcatcttatcctgttgagcccaaaaaactgaatagtcccgaagagaccgccttccagactccaaaaagttcccagatgcccagaccttccgtaccccctctggtcaagacttccctgttcagctctaagcttagcacaccggacgttgtaagtccatttggtaccccatttggctcttcagtgatgaataggatggcaggtatttttgacgtgaacacatgctacgggtcaccccagagtccgcagctgattcgcagaggacctcgcttgtggacttccgctagtgaccagcagatgacggaattctccaaccccagtccctccacatccatcagcgccgaaggaaagaccatgagacagcccagcgtgatctacagctggatccagaataagcgcgagcagattaaaaatttcctgtccaagcgtgtgctcataatgtacttcttctccaaacacccagaggcatcaatccaggccgtttttagcgacgcacaaatgcacatttgggcactcgaaggactcagtcacttggtggcggcttcgtttaccgaagacagattcggggtggtgcaaaccaccctgccagcaatcctcaacaccctcttgacccttcaggaagctgttgataagtatttcaaactgccgcacgccagttctaagcccccacgcatctcaggttcattggtagatacatcttataagacgctccggtttgcttttcgggcatctttaaagaccgctatctacagaattaccactacattcggggagcatctaaacgcagtgcaggcgtccgccgaacatcagaaacgactgcagcagttcttggaatttaaagagtag

SEQ ID NO: 244841 - DNA, 1629 bp, Artificial Sequence
  Description of Artificial Sequence: Synthetic coding sequence
atggctacggcagtgtcaaggccttgtgctgggaggtccagagatatcctttggcgagtcctcgggtggcgcattgtggcttctattgtatggagtgtgctgtttctcccaatctgtacaacagtgttcatcattttctcacggatagatttgtttcatcccattcagtggttgtctgactcttttagtgacttgtatagttcctatgtgatcttttacttcctgctactgtccgtagtaatcataattatttcaatcttcaacgtagaattttacgccgtggtgccaagtatcccatgctcccgattggcactaatcggaaagataatccacccccagcagctgatgcactcctttatccatgctgccatgggtatggtgatggcctggtgtgctgcagtgattacacagggacaatatagcttcctggttgtgccttgcacaggtacaaactccttcggatcacccgctgcacagacctgcctgaacgaatatcacttgttcttcctgctgaccggcgcttttatggggtattcgtactcactgctttactttgtcaacaatatgaactacctgccttttcctattattcaacagtataaattcctgagattccgccgtagccttctgctgctggtgaaacacagctgcgtcgagtctctgttcctagtgcggaatttttgtatcctctattacttcctcggctacattcccaaagcttggattagcaccgccatgaacctacatatcgacgagcaggtccatcgtcccctggacaccgtgagtggcctgctcaatctgagcttgctttatcatgtatggctgtgtggtgtgttcctactgaccacctggtatgttagttggatcctgttcaaaatctatgccaccgaggcccatgtttttcccgtgcagccaccctttgccgaaggctccgacgaatgtctaccgaaggttcttaattctaacccgcctcccatcattaagtatctggcccttcaggacctcatgctcctgagccaatacagcccaagcagaagacaggaagtgttttccctctctcagcctgggggtcacccgcacaattggacggccatctcacgagagtgcttgaatttattgaatggcatgacacagaaactcattctgtaccaggaggccgcagccactaacgggagagtgagctcttcctatcctgtcgaacccaagaagttaaattcgcctgaagaaaccgcctttcagactccgaaaagcagtcagatgcctcgcccttctgtaccacccctagtaaagacctccctgttttcctccaaactttctaccccagacgtggtgtctcctttcggaactccattcgggtcttcagtgatgaatcgtatggccggaattttcgatgtgaacacctgttacggctctcctcagtctccccagctaatacgtcgcggtcctcgcctgtggacttccgctagcgatcagcagatgacagagttctcaaacccgtcgcccagtaccagcatttctgccgaagctcccagaggcctccactctggatgcttttttcggtgtcctaatgcatacctcggtattcgccgatccgttgctctgtcatccagcattatctaccgtggatag

SEQ ID NO: 244842 - DNA, 1332 bp, Artificial Sequence
  Description of Artificial Sequence: Synthetic coding sequence
atgaggctgacccgcaaacgactttgcagttttctgatcgctctatactgccttttctccctttacgcggcttatcacgttttcttcggcaggagacggcaagctccggctggctctccgcgaggcctgcgaaagggcgctgcgcctgccagagagagacgaggaagagaacagagtacacttgagtcagaggagtggaatccctgggagggggatgagaagaatgaacagcagcacagatttaagactagcctacagatactcgataaaagcaccaaggggaaaaccgatcttagcgtgcaaatctggggcaaagccgcaattggactttacctgtgggaacatattttcgagggactactggaccccagcgatgtcacagcccaatggcgggaggggaaaagcatcgtgggaaggacacagtatagcttcattacgggcccagccgtgatccccggatacttcagcgttgacgtgaacaacgtggttctgattctgaacggacgggaaaaggccaagatcttctacgctacacagtggctgttgtacgcacagaatttagtgcagatccagaagttacagcacctagcagtggtgcttctgggaaacgaacattgtgacaacgagtggatcaacccgtttttaaaaaggaatggagggtttgtggaactgctgtttatcatctatgattccccatggataaacgacgtagacgtgtttcaatggcccttgggagtggcgacctacaggaatttcccagttgtggaagcctcatggagtatgcttcatgacgagcgcccatacctgtgtaactttctggggaccatctacgagaactccagccggcaggcactcatgaacatcttgaaaaaggatggaaatgataagttgtgttgggtatccgctcgggagcactggcagccccaagagaccaatgaatctttgaagaactatcaagacgcattgctacaaagtgatttgacgctgtgccccgttggggtgaatactgaatgttatcgtatatatgaggcttgttcctatggcagtattcctgtggtcgaagatgtcatgacagccggaaattgcgggaatacgtcggtccatcatggggctcccttacagctgctgaagtctatgggtgcgccattcatctttatcaagaattggaaggagctgccagccgtactggaaaaggaaaaaaccatcattctccaggagaagatcgaaaggcggaaaatgctcctgcaatggtatcaacatttcaagaccgaacttaagatgaaattcactaacattctcgaatcttcctttctcatgaataacaagtcctag

SEQ ID NO: 244843 - DNA, 774 bp, Artificial Sequence
  Description of Artificial Sequence: Synthetic coding sequence
atggcagccgacggagtcgacgaacggagccctttgctgtccgccagccattctgggaacgtgacaccaacagccccaccctacctccaagaaagctcccccagagccgagttgcccccaccctatacggctattgcctcccctgacgcatcaggaattccggtgatcaattgtcgggtttgtcagtcactcataaatctagatggtaaactccaccaacacgttgtgaagtgtacggtgtgcaatgaggctacccccattaaaaacccgccaaccggcaaaaaatatgtgagatgtccttgtaattgcctactaatctgtaaggataccagcaggcgaattggatgccctaggcctaactgcaggcgaatcattaatctgggtcccgtgatgttaatctctgaggagcaacccgcacagcccgcactccccattcagccggaagggacacgtgttgtgtgcggccactgcggcaacacattcctgtggatggagctgagatttaatactctcgccaaatgtcctcactgtaagaagatatcttccgtcggatccgcactgccacggcgacgatgctgcgcttacatcaccatcggcatgatctgcatatttataggagtaggtctgactgtaggcactccagattttgccaggagatttcgggcaacttatgtaagctgggcaatagcatatctccttggactaatctgcttgattagggcgtgttattggggtgccatacgcgtctcatatcctgagcattcatttgcatag

SEQ ID NO: 244844 - DNA, 2745 bp, Artificial Sequence
  Description of Artificial Sequence: Synthetic coding sequence
atgagcctgagccattggccatactttcggctggtcctgaatttccgtccacaggttatctgtctacctcaaccaccgaaggttctgggatataggctcgaacctccgcaccttaccttggcttgtacactcgaggggatgtacaacataatagaggagatcctggagagggacattaacggtaccctgttgagtcaagctacctgtgaactttgtgacggcaacgaaaatagttttatggtagtcaatgcactgggggataggtgtgtcagatgtgagcccacttttgtgaatacaagccggtcatgcgcttgttccgaaccaaatatcctgacagggggtctgtgcttctcaagcacaggtaactttccactgagacgcattagcgcagccagatacggggaggtgggaatgtccttgacatctgagtggtttgcaaaatatctccagagttcagcggcagcttgctgggtgtatgccaacctgacgtcttgtcaagctttgggaaacatgtgtgtgatgaacatgaactcttacgatttcgcgacctttgacgcttgcggattattccagtttatatttgaaaacaccgctggattgtcaaccgtgcatagtatttccttctggcggcagaatctaccatggttgttctacggggaccagctgggcctcgctccccaggtccttagctccactagtttaccgaccaacttttccttcaagggcgagaatcaaaacaccaagctcaagttcgtggctgcatcttatgacatccgtggaaactttctgaaatggcaaacccttgagggcggagtgcttcagctctgtccagataccgagactaggctgaacgccgcatattcgtttggtacaacttatcagcagaactgcgaaattcccatttcaaagatcttgattgactttcccactcccatcttctacgatgtgtacctggaatacactgatgaaaaccagcaccagtacatactggccgtgcccgtgttgaatttaaacctccagcataacaagattttcgtgaatcaggacagcaactccggtaagtggttattaactcgacggatctttctggttgacgccgtgagcggccgagagaatgatttgggcactcagccccgtgtgatccgagtagcgacccagatttcactgagtgtccacctggtgccaaatactattaacggaaatatctaccctccactaatcacaattgcttacagcgacatcgacatcaaagacgctaactctcagagtgttaaggttagtttttccgttacctatgagatggaccacggtgaggctcatgtgcagactgacatcgccctgggcgtacttggcggtttggctgtcctggccagcttgctcaagacggcaggctggaaaaggcggattgggtcgcccatgatcgacctacagactgtggtaaaattcttggtgtactacgctggagacctggcaaatgtttttttcattattaccgtcgggacgggtttgtattggctgatcttcttcaaggcgcagaagtccgtttccgtgttattaccaatgcctatccaagaggagcggtttgtgacctacgttggttgcgctttcgctctaaaggccttgcagtttctgcataagctgatctcccagattaccatagacgtgttcttcatcgactgggaacggcctaaaggaaaagtacttaaagccgtcgagggcgaggggggtgtgcgttccgctaccgtacccgtgtccatatggaggacatacttcgttgcaaatgaatggaatgaaatccagacagtgaggaagatcaactcattgtttcaggtgctgaccgtgctgttcttcttggaggtggtcgggtttaagaacctcgccctgatggactcatcttcctccctcagccgtaacccgccatcctacattgcgccatacagctgcatcctgcggtatgcagtctcagccgcactttggttagcgattggaataatccaagtggtcttcttcgctgttttctatgaacgcttcatcgaagacaagattcgccagtttgtagatctgtgcagcatgagcaatatctctgttttcctcctttcccataagtgttttgggtattacattcacgggaggagtgttcatgggcatgctgatactaacatggaggaaatgaacatgaacctaaagcgggaggctgaaaatttatgttcacagagaggccttgttccgaatacagatggacagaccttcgaaatcgcaataagtaatcaaatgaggcagcactacgaccgtattcacgaaactctgatccgcaaaaacggtcccgcacgactgctctcttcatccgcctccacctttgagcaaagcatcaaggcctaccatatgatgaataagtttctcggcagtttcattgaccacgtacacaaagaaatggactattttatcaaagacaaattgcttttggagcggatattgggcatggagttcatggaacctatggagaagtcgatcttctataacgacgagggctatagtttctccagcgtcctttactatggaaatgaggccaccctcttgatattcgacctcttgtttttttgtgtagtggatcttgcttgtcagaactttatcctcgctagttttctaacctatctccagcaagaaatatttagatacattcggaacacagtaggtcagaaaaacctggcctccaaaacgctcgttgatcagagatttctgatttag

SEQ ID NO: 244845 - DNA, 2988 bp, Artificial Sequence
  Description of Artificial Sequence: Synthetic coding sequence
atggcaacgcgaggaggagccggagtcgccatggccgtatggtccttgctgagtgccagggccgttacagccttcctgctgttattccttcctcgctttctgcaggcacaaaccttttccttcccatttcagcagccagaaaaatgtgataataatcagtattttgatattagcgcattgtcatgcgtaccatgcggtgcaaatcagcggcaggacgcacggggaacttcctgcgtctgtctaccagggtttcagatgatttccaataacgggggacccgcaatcatttgcaaaaaatgccctgagaacatgaaaggggtcacggaagatggctggaactgcatttcctgtccatccgacctgaccgccgaggggaaatgccattgccccattggccacattctggtggaaagggatatcaacggcactctcctgtctcaagcgacctgcgaactctgcgacggaaatgaaaattcctttatggtggtgaacgcattaggggacaggtgtgttcgctgtgaacctaccttcgtgaacacatctcggagttgtgcctgttctgaaccaaacattctgactggaggactctgtttttcgagtactggaaattttcctcttaggagaatttctgccgctagatatggagaagtaggaatgtccttgactagcgagtggtttgcaaaatacctgcagtccagtgcagccgcatgctgggtgtatgcgaatctcacgtcctgccaggccctggggaatatgtgtgtcatgaatatgaacagctatgactttgccacttttgacgcctgcggcctttttcaattcatatttgagaataccgccggactgtctacagttcattcaatctccttttggcggcagaacctgccgtggcttttctacggggaccaactaggattggcccctcaggtgctttcgtcgacatcactccctacaaacttttcgttcaagggggaaaatcagaatacaaaactaaaatttgtggctgcatcatacgacatcagaggcaacttcttgaagtggcagactttggagggaggcgtactgcagctgtgcccagacacagaaacccgtttaaacgcagcctactccttcggcacaacctaccagcagaattgtgagattccgatcagtaaaatactaatcgatttccccactccgatcttttacgatgtgtaccttgagtacaccgacgaaaaccagcatcaatatatattggctgtgcccgttctgaaccttaaccttcagcataacaaaattttcgtgaaccaagactctaattcggggaagtggttactgacccggaggatctttctggtggatgccgtcagcggccgtgagaatgaccttgggacccaacctcgggtgatcagagtggctacacaaataagcctgagcgtccatcttgttcccaatacaatcaacggcaatatatatcctccgcttatcactatcgcttatagcgatattgacataaaggatgctaacagtcagagcgtgaaagtcagtttttctgttacatatgagatggatcacggtgaggcccatgtgcagacagatatagccctgggcgtgctcgggggacttgctgtgttggcgtcactactgaaaaccgcgggttggaagcgtagaatcggcagccctatgatagatctgcaaacagtcgtaaagtttttggtgtactatgcaggggatctagcaaacgtgtttttcatcattaccgtcggcaccggactgtactggctgatattcttcaaagcacagaaatccgtgagcgtgctcctcccaatgccaatccaagaagagaggtttgttacttacgtgggctgcgcatttgctcttaaggccctgcagtttctgcacaagcttatctcccagatcactattgatgttttctttattgactgggagcggccaaaaggaaaagttttaaaagctgtggagggggagggaggtgtgcgatctgccacagtgccagtaagcatctggagaacatattttgtggccaacgagtggaatgagatacaaaccgtgagaaagataaactccttgtttcaagtgcttacggtgctgtttttcctcgaggtggttgggtttaagaacctggcgcttatggactcaagttcttccctgagtcgcaatccaccgtcttacatcgccccatactcctgcatcttgcggtatgccgtgtccgcagctctgtggctcgccattggcattatccaggttgtgttttttgccgtattttatgaacgttttattgaagataaaatccgacagttcgtagacttatgcagcatgagcaatatctcggttttcctcttgtctcacaaatgtttcggatattacattcacgggcgttccgtgcacgggcatgccgataccaatatggaggaaatgaacatgaacttgaagcgcgaagcggaaaatctctgttcccagcgcggactggttcctaataccgacggccaaacattcgagatcgcgatctccaaccaaatgcgccagcactacgacaggattcatgaaacactgattcggaaaaatggcccagctagattgctcagctcttccgcatccacgttcgaacaatcaatcaaggcatatcacatgatgaataagttcctgggcagctttattgaccatgttcacaaggagatggactacttcatcaaagacaagctgctgctcgagagaatcctcgggatggaattcatggagccgatggagaagagtatcttctataatgatgagggctattcgttttcatccgtcctatattatggtaatgaggccacattgctgatattcgacctgctcttcttctgcgttgtcgaccttgcctgtcagaatttcatcctggcgtccttcttgacatatctgcagcaggagatctttcgatatatcagaaatactgtgggccagaaaaatttggccagtaagacactggtggaccagcggttcctgatctag

SEQ ID NO: 244846 - DNA, 783 bp, Artificial Sequence
  Description of Artificial Sequence: Synthetic coding sequence
atgctattccttgctcttggcagcccatgggccgtggagctgccactctgtggacgcagaacagccctgtgtgcagcagccgcactgagaggcccacgggctagtgtctctcgggcatcctcgagtagcggcccttcagggccagtggccggatggtcaaccggacccagcggcgcagccaggttgctgcggaggcctggcagagctcaaatacccgtctattgggaaggttatgtccgattcctcaatacgcctagtgataagtctgaagacggaaggttgatttacactggaaacatggcacgggctgttttcggtgtcaaatgtttcagttacagcacaagcctcatcggattgacctttctcccatacatcttcacacaaaacaatgccatctccgagagtgtacctcttccaatccaaatcatcttctatgggatcatgggatcctttacggtgatcactcctgtgctgctgcatttcattaccaaaggctacgtgattcgtttgtatcatgaagctactacagatacgtacaaagctatcacctataatgcgatgctcgcagagacttctaccgtattccatcagaatgacgtaaagatcccagacgctaagcacgtgtttaccacattttatgccaagactaaatcgctcctggtaaaccccgtcctattcccgaacagggaggactacatccacctcatggggtatgataaagaggagtttatcctctatatggaggagacatctgaagaaaagcgccataaggacgataagtag

SEQ ID NO: 244847 - DNA, 324 bp, Artificial Sequence
  Description of Artificial Sequence: Synthetic coding sequence
atgctgttcctggctttaggctccccctgggcagtggaactgcccctgtgcggacggaggacagctctgtgtgcggctgcagctctgaggggacctagagctagcgtgtctagggccagctcatcaagcggcccatctgggcctgtcgccggatggtctactggaccctccggtgctgccaggttattgagacgccctgggagagcacaaatacccgtgtactgggaggggtacgtccggttcctaaatacaccttctgacaaaagtgaggatggccgactgatttataccggaaatatggcgcgtgctgtctttgggaaatag

SEQ ID NO: 244848 - DNA, 918 bp, Artificial Sequence
  Description of Artificial Sequence: Synthetic coding sequence
atggagctgcactacctggccaagaagagcaatcaggcggacctgtgcgatgcgcgagactggtctagtaggggtctgcctggcgatcaggccgacaccgcggctaccagggctgccttatgctgccagaagcaatgtgcctctaccccacgcgcaacggagatggaagggtccaaactgagctcctctccagcatccccatcgtctagcttacagaactcaaccctgcagcctgacgcgtttcctccgggtctcttacacagtggtaataaccagatcaccgctgagcgaaaagtgtgtaactgttgcagtcaggagttagaaacctcattcacctacgtggataagaatattaacctggagcagcgaaaccgatcatcccctagcgcgaaaggccacaaccaccccggagagctcggctgggagaatcctaatgagtggtcccaggaagcagccatctcccttatttcagaagaggaagacgatacctcctcagaagctacctccagcggcaaatcgatcgactacggctttatctcagcgatactattcctggtaactgggattctcttagtcataatttcatatatagtgcccagggaggtgactgttgatcccaacacagtggccgcacgagagatggagcggttggagaaagaatctgcgagactgggcgcacacctggatcgctgcgtcatagccggattgtgcctattgacgcttgggggagttatcctctcttgtcttcttatgatgagcatgtggaaaggggagctgtaccgcagaaacaggttcgcctcttcgaaggaatccgccaaactctatggtagcttcaactttcggatgaagactagcaccaacgagaacacccttgaactctctctggtggaagaagacgccttggccgtccagagttag

SEQ ID NO: 244849 - DNA, 951 bp, Artificial Sequence
  Description of Artificial Sequence: Synthetic coding sequence
atgtcaggagatacgtgtttgtgtccagcatcaggagccaaaccaaagctcagcgggtttaagggcggaggattgggtaataagtatgtgcagctgaacgtcggtggcagcctgtattataccacagtgagggctttgacgagacacgacactatgctcaaggcgatgttttccgggaggatggaagtcctcaccgataaggagggttggatactgatcgaccgatgcggtaaacactttggaaccatcctcaactacttgcgcgacgacactatcactctgcctcagaaccggcaagagatcaaggagcttatggcagaagccaaatactatctgatccaggggctcgttaatatgtgtcagtccgctttacaggacaagaaggactcgtaccagccagtttgcaatattccgatcatcacctccctgaaggaagaggagcggctgattgaaagctctactaaacctgtcgtcaaacttttatataatagaagtaataacaaatactcatacacaagcaactccgatgatcacttattgaagaacatcgagctgtttgataaactgtcactgcggttcaacggccgtgtcctgttcatcaaagacgttattggcgacgagatatgttgttggtcgttctacggacaaggccgaaagctggctgaagtttgctgtacaagtatagtgtacgcaaccgagaagaagcagacaaaggtcgaattcccagaagcacggatctacgaggaaactctgaacgtgctcttgtacgagactccaagagtccctgacaactctctgctcgaggcgacctcccgttcacgcagtcaagcatcaccttccgaggatgaagagactttcgaacttcgcgatcgggtgcgtcggattcacgtgaagcgctacagtacctacgacgacagacaactgggccatcagtccacacacagagactag

SEQ ID NO: 244850 - DNA, 210 bp, Artificial Sequence
  Description of Artificial Sequence: Synthetic coding sequence
atgacgacactaatacccattctgtcaacctttctgtttgaggacttctcaaaagccagtggcttcaaaggacaacgacctgagacattgcacgaaaggttaacactcgtatccgtgtacgccccatacctgttgatcccctttattctcctgatttttatgctccggagtccgtattataagtacgaagaaaaacggaaaaagaaatag

SEQ ID NO: 244851 - DNA, 1125 bp, Artificial Sequence
  Description of Artificial Sequence: Synthetic coding sequence
atggtgctgtgggagtcacccaggcaatgtagcagctggactctgtgtgagggattctgttggttgcttctcctacctgtgatgctactgatcgttgcgagacctgtgaaactggctgcctttccaacaagtctgtccgattgccaaacaccaacaggctggaactgctctgggtacgacgacagagagaacgacctatttctctgtgacaccaacacatgcaaattcgatggcgagtgcctcaggatcggcgatactgtcacctgtgtgtgccaatttaagtgtaataacgattacgttcccgtgtgcggctcaaacggtgagtcataccagaacgagtgctatctacgtcaggccgcttgcaaacaacagtccgaaatcctcgtagtttccgagggtagctgcgcaacagacgcaggcagcggttccggagacggtgttcacgaggggtctggcgagacgagccaaaaggagacttccacctgcgacatttgccaattcggagccgagtgtgatgaggacgcggaggatgtctggtgtgtgtgtaacatcgattgtagccaaacaaacttcaatcccctgtgcgccagcgatgggaagtcatatgacaacgcctgtcagattaaggaggcgtcctgccaaaaacaggagaagatagaagtgatgagtttggggcgttgtcaagacaacactaccacaaccaccaagtctgaggatggccattatgccaggaccgattacgctgaaaacgctaacaagttggaggagtctgccagagagcaccatattccttgcccagaacattacaacggtttttgcatgcatgggaagtgcgaacacagcatcaacatgcaggaaccatcctgtcgatgcgacgccggttacacaggccagcactgtgaaaagaaagactatagcgttctgtacgttgtcccgggacctgtaaggtttcagtacgtgctgatcgccgctgtaattggcactattcagatcgctgtcatctgtgtcgtggttctgtgtatcacccggaagtgtccacgctccaaccgcatacaccgccagaagcagaatacaggacactactcctcagataataccacacgagcttctacaaggctcatctag

SEQ ID NO: 244852 - DNA, 528 bp, Artificial Sequence
  Description of Artificial Sequence: Synthetic coding sequence
atggtactgtgggaaagcccgaggcagtgttcttcctggacactatgcgagggattctgctggctgctcctgttgcccgtgatgctgctgatcgtcgccagaccggtgaaactggccgcattccccacctccttgtcggactgccagacgcctaccgggtggaattgttccggctatgacgaccgcgagaacgatttgttcctatgcgacactaacacttgtaagttcgacggcgagtgtctgagaatcggggataccgttacctgtgtctgtcaattcaagtgcaacaatgactacgtgccggtgtgtggcagcaatggcgaatcatatcaaaatgaatgctacttgcgacaggccgcttgcaagcagcagagcgagatcctggtggtgtccgaagggtcctgcgctaccgacgcagggtcagggtcaggcgacgggggacggtcctgcctatttacttaccttaaaatttattggtggattctgctgtgcatcttcacctatgtatgctccatcagcgacatatag

SEQ ID NO: 244853 - DNA, 2427 bp, Artificial Sequence
  Description of Artificial Sequence: Synthetic coding sequence
atggccgaattgctggcatcagcaggctccgcctgttcctgggacttcccaagggcacctcccagtttccctccacctgctgcttccagagggggattgggaggcaccaggagctttaggccccacagaggcgctgagagcccgagacccggaagagatcgcgatggggttcgcgtccccatggcctcatccaggtgtccagctccacgaggatgtcgctgcttgcccggagccagccttgcctggctgggaacagtcttgctgctgctcgcagactgggttctgctacggacggcactccctcgaatcttcagtcttctggttcctactgccctccctctgctgagagtctgggccgtgggcctttcgaggtgggccgtgctgtggctcggcgcttgtggagtattgcgcgctaccgtcggaagtaagtccgagaatgccggagcccagggatggctggccgcactcaagcctctggctgccgctctggggttagcacttcctggcctcgccctcttcagggagctgatatcctggggggctcccggatcagctgacagtaccaggctgttacactggggttcccaccccactgcattcgtggtgtcgtacgcggctgctctccctgcggctgccctctggcacaaactagggtctctgtgggtcccaggaggccaggggggatccggaaaccctgtgaggcggctcctcgggtgcctaggcagtgagaccaggcgactgtctctgtttttggttctcgttgtgctctcatctcttggcgagatggccatcccttttttcaccggacgcctgacggactggattctgcaggacggaagcgccgatacatttacccgcaatctgactctaatgtccatactgacaatcgcctcagccgtgcttgaatttgtgggtgatggcatatacaacaacacaatgggacacgtgcacagtcacctgcaaggagaggtgtttggcgctgtcctgcggcaggagactgagtttttccagcagaaccagactggcaatattatgtctagggtaaccgaagacactagcactctttccgattcactcagtgagaatctttccttgttcctttggtatttggtaaggggtctctgtctgctgggcattatgctatggggtagtgtgtccctcaccatggtgactcttatcactctccccctgctcttcttactccctaaaaaggtgggcaagtggtaccagctgttagaggtgcaggttagggagtcactcgctaagagctcccaggtggccattgaggccctctcagcaatgccaaccgtgcgctcttttgctaatgaggaaggtgaagcccagaagttccgtgagaagttacaggagatcaagaccctgaatcagaaggaggctgtggcttatgccgtgaatagttggactacttcgatatctggcatgttactgaaggtcgggatcttgtacatcgggggtcagttggtgacttccggggctgtaagctctgggaatcttgtcactttcgtactataccagatgcaattcacccaagcagtggaagtcctgttgagtatctaccctcgagtccagaaagccgttggctcctccgaaaagattttcgagtatctggataggacaccacgttgccccccatccgggctcctgacacctctgcacctcgagggacttgtgcaattccaggatgttagcttcgcgtacccaaatcgcccagacgtcctcgtattgcaaggcctcacgtttactcttcgccctggagaggttacagccctagttggcccaaacggatccggcaagtcaaccgtggccgcattactacagaatctgtaccagccaaccggcggtcaactgctgcttgatgggaaacctcttcctcagtatgaacatagatatctccatcgccaggtggcagcagtgggacaagagccacaagtgtttgggaggtccctgcaggagaatatagcctacgggctcacccagaagcccacaatggaggaaattacagcagctgcagttaagtctggcgcacattcttttatctcgggacttccccagggctacgataccgaagtggacgaggccggttcccagctgtccggcggtcaacgccaggcggtcgccctggcaagggcgctgattaggaagccttgcgtcctcatcctggatgatgcaacgtctgcactcgatgcaaactcccaacttcaggtggaacagttattgtacgagtctccagagcgatactcccgcagtgttctgctaattactcagcacctgagcttagtggaacaggctgaccatatcctgttcctggagggcggtgctattcgggaaggaggaactcatcagcaactcatggagaagaagggttgttactgggctatggtgcaggctccggcagatgcccctgagtag

SEQ ID NO: 244854 - DNA, 2427 bp, Artificial Sequence
  Description of Artificial Sequence: Synthetic coding sequence
atggctgagctactggcatccgctggttccgcctgcagctgggactttccccgagcaccaccctcctttccgcctcccgcagcttccagggggggactcggcggaaccaggagcttccgacctcataggggagccgaatcccccaggcctggcagggaccgtgacggagtgagggtgcccatggctagctctcgatgcccagcaccccgtggatgtcggtgcttaccgggagctagcttggcctggctgggcaccgtcctgctgcttttggccgattgggtgctgctccgtaccgccctgcctagaatcttttccctcctggttcccacggccttgcctttgctgagggtctgggcagtgggcctatcgcgctgggccgtcctgtggctcggcgcttgtggcgttctgagagcaaccgtgggctccaagtcggaaaacgccggtgcccagggttggctggccgctctcaagccgctggctgcggctctgggattggccctgccagggctggcactctttagagaactgatctcatggggagctcctggatctgccgacagcacgcgcctgctgcactggggcagtcatcctaccgcctttgtggtctcttacgccgcagccctcccggctgccgcactttggcacaagctagggagtctatgggtgcccggagggcaagggggatccggcaatcccgttcgccgactgttggggtgcctgggatcagaaacaagacgcttgtccctgtttcttgttttggtggtgctcagctcactgggggaaatggcaatcccttttttcactggccgtctgactgattggatcctccaggacggatccgctgacaccttcactaggaacctgacgctcatgtccatcttaacaattgcctctgccgtactcgaatttgtgggtgatgggatctacaataacactatgggccacgtccattctcaccttcaaggcgaagtgtttggcgctgtcctgaggcaggaaaccgagttcttccagcagaatcagaccggtaacattatgagccgggttacagaggataccagtactctaagcgattccctatcagaaaacctcagcctgtttctctggtacctggtgcgaggtttgtgcttactgggcatcatgctgtggggatcagttagcctgaccatggtaacgctgataactttgccactcttgtttctgctgcccaaaaaggtggggaagtggtaccagctgctagaagttcaggtgagggagtccctggcgaagtcctcgcaggtggccatcgaagctctgagcgctatgccaactgttcggagcttcgccaacgaggaaggcgaggcccagaagttccgcgagaagttgcaggaaataaaaacactcaaccagaaggaggctgtggcctatgctgtcaactcgtggacgaccagcatctctgggatgttgctcaaggtgggtattctctatattggcggacagctcgtgacttcaggcgctgtctcgtccggcaacctggtgacatttgtactgtaccagatgcagtttacacaggccgtcgaagtgttactcagtatataccctagagtgcaaaaagcagtggggagctccgaaaaaattttcgagtacctggataggaccccacggtgtcccccaagcggcttgttaacaccactccatcttgaaggcctggttcaattccaggacgtgagtttcgcctaccccaaccgccctgatgtcctggtgctccagggactcacgttcactctgagaccaggagaagtaactgctctggttggcccaaatggaagtggtaaatccaccgtcgccgctctactccagaatctctaccagcctactgggggacagttgcttttagatgggaagccattgccccagtacgagcaccgatatctccaccgacaggttgctgccgtgggccaggaaccacaggtcttcggacggagtctccaggagaatatagcatacggacttacccagaaacctacaatggaggagatcacagctgcggctgtgaagagcggagcacacagctttataagcgggcttcctcagggctatgataccgaggtggatgaggccggttcccaactttctgggggtcaacggcaagccgtcgccctcgctagggccctcattaggaaaccatgtgtattgatcctcgatgacgctacctctgcacttgacgcaaactctcagctgcaggtggagcagttgctttacgaaagcccagagcgatattcacggtccgttctcctgatcacccagcacctgagtctggtggagcaagcagaccatattctgttcttggaaggtggcgctatcagagagggagggactcaccagcagctcatggagaaaaagggctgctactgggccatggttcaggctcccgctgacgcacctgaatag

SEQ ID NO: 244855 - DNA, 2427 bp, Artificial Sequence
  Description of Artificial Sequence: Synthetic coding sequence
atggctgaactcctggcatctgcgggttcagcctgtagttgggacttccccagggctcctcccagcttcccaccccctgctgcttcacggggaggtctgggaggaaccaggtcattcaggccgcacagaggggcagagtcaccgagaccgggaagagacagggatggggtgagggtcccaatggcttcctcgagatgtcctgctcccaggggctgtcggtgtttgcccggagcctcactggcctggctggggacggtgctccttctactcgccgattgggtgcttctgcgaacagccttaccaaggatcttcagcctgcttgtccctaccgctctcccccttctccgggtttgggcagtgggcctgtctcgctgggccgtgctctggctgggagcctgtggagttctgcgagctacggttggaagcaagagtgagaacgccggagcccagggttggctggcggctctcaagcccctggctgctgccctgggccttgcactacccggtctggcgttgttccgggaactgatttcttggggcgctccaggctctgcagattcgacacgcctcctccattggggctctcacccaacggcctttgtagttagttatgctgcagcgctccccgcagccgctctgtggcataaattgggcagcctttgggtgcctgggggtcagggcggatcagggaaccccgtgcgccgtcttttggggtgtctcggatccgaaacacggaggctcagtctttttttggtgctggtggtgctctcctcgctgggagaaatggcgattccattcttcactggcaggttgacagattggatcctgcaagacggctccgccgatacgttcactcggaatctgaccctgatgtcgatcctaactatcgcttccgccgtcttagaattcgtcggcgatgggatctataataatacaatgggacatgtccactcccatttacagggggaagtgtttggcgcagtgcttaggcaggagactgagttctttcagcagaatcagacagggaatatcatgagcagagttacagaagacacgagcactctctccgactcgctttccgagaatctttccctgttcctctggtatctcgtgcggggtttgtgcctgctgggaattatgctctgggggagcgtgagtttgactatggtcactttaattaccctcccacttctgttcctcctcccgaagaaggtcggaaaatggtaccagttgcttgaagtccaggtgagggaaagtttggctaaatcatctcaggtcgccatagaagctctctccgccatgcctacagttcgttccttcgcaaatgaagagggtgaggcacagaaattcagagaaaagttgcaggagattaaaactcttaatcaaaaagaagctgtggcctatgccgtcaattcatggactacctctatctcggggatgttgctgaaagtcggcattttatacatcggcggacagctggtgacctccggcgcagtgtccagcggcaaccttgtgacctttgtgctataccagatgcagtttacgcaggctgtcgaggtactcctgtccatctatcctcgggttcagaaagccgtggggagctccgagaagatatttgagtacctggacagaacccctaggtgtcccccttctgggctattgaccccgctccatcttgaaggccttgtgcagttccaagacgtgagctttgcctaccccaaccggcctgatgtcctggtattacaaggcctcacctttacactacggcctggtgaggtgacagcattagtcgggcctaacggaagcggaaagagcacagttgccgctctgctgcaaaacctgtatcagccaactggagggcagctgctgttggatggtaaaccactgccacagtatgagcaccggtatctccatcgccaggtggcggctgtcggacaggaaccccaggtgtttggaaggtcactccaggaaaacatcgcatatggccttacacagaagcctacaatggaggaaattacagctgctgcggtgaagagcggcgctcactccttcatctccggcctgccgcaggggtacgataccgaagtcgatgaagccggttcacagctttctggtggtcagagacaggccgtggctctagctagggcgctcattcgtaaaccgtgcgtgttaattctggacgacgccacatccgcccttgacgcgaactcacagctccaagtggagcagcttctttatgaaagccctgaacggtattcaagatcggtcctccttatcactcaacacctctctttagtggagcaagcggaccacatactgttccttgagggaggagccattcgcgaaggtggcacccatcagcaactcatggagaaaaagggttgctattgggcgatggtgcaggcacctgccgatgcaccagagtag

SEQ ID NO: 244856 - DNA, 2427 bp, Artificial Sequence
  Description of Artificial Sequence: Synthetic coding sequence
atggctgagctcttagcgtccgcgggatccgcctgctcctgggattttcccagagctcccccatcgtttccaccccctgctgcatccagaggaggattgggcggtactagaagcttccgaccacacaggggcgcagagtcgccccgtccgggtagagatagggacggggtccgggtgcctatggcctcctcccgatgccccgcaccccgtggttgtcgctgtttgcctggagcctccctagcgtggctgggcactgtcctgctgctgctcgcggactgggtgctgctgcggacggcacttccgagaatctttagcctgctcgtacccacagctttgccgttgctgcgggtgtgggccgttgggctgagtcggtgggccgtcctttggctgggcgcatgcggagtcttgcgagcgactgtcggctccaaatccgaaaatgcaggggcacagggctggttggctgctctgaagcctctggccgctgcattgggactcgccctgcccggactagcactttttcgcgaactgatatcctggggcgctccgggaagcgcagatagtacgagactactgcactggggttcacacccaacggccttcgttgtttcatatgccgcagccctcccggcagccgcactgtggcacaagctcggcagcctgtgggttccgggtgggcaagggggttccgggaatcccgtacgacggctcctcggttgtctcggctcggagaccaggagactgagcctgttcctggtgttggtggtcctatcatctctgggagaaatggctatcccattcttcacaggcagattgaccgactggatcctgcaggacggatctgccgatactttcactcgtaacctgactctgatgagcattcttaccatagcttccgctgttctggaattcgtcggtgatgggatctataacaatactatgggccacgtgcacagtcacctgcagggggaggtctttggagccgtcctgagacaggaaacagaattcttccagcagaatcaaaccgggaatatcatgagcagagtgacagaagacacatctacactcagcgattcactctccgagaacctaagtctgttcttgtggtacctagtccgtgggctttgtcttctcggaatcatgctgtggggtagcgtgtcccttactatggtcacactcatcacactccctttgctctttcttctacccaaaaaggtgggcaagtggtaccagctgttagaagtgcaggtgcgcgaaagtctggcaaagtcttcccaggttgccattgaagctttgtccgccatgcctaccgtgcggtccttcgccaatgaggagggagaagcccagaaattccgagagaaattacaggaaattaaaacactgaatcaaaaagaggccgtggcatatgcggtgaactcttggaccactagtattagcggcatgttgttgaaagtagggattctatatatcgggggacagctagttacctcaggggcagttagcagcggtaatctggtcacattcgtcctttaccagatgcagtttacacaggccgtggaagttcttctcagtatctaccctcgcgttcaaaaggctgtgggctcttccgagaaaatttttgaatacctggatcgcactcccagatgtcccccatccggactgctcacgcccctccatctggagggcctagtacagttccaggatgtctctttcgcctatcctaatcggcctgacgtactggtcctgcagggactgacttttacactgcgcccaggagaagtgaccgctctagtgggcccaaacggttctgggaaatccaccgtggccgctctgcttcagaatctctatcaaccaactggcggacaactgcttctcgatggcaagcccctcccccagtatgagcacaggtacctgcaccgccaggtggctgcggtggggcaggagccgcaggtcttcggacgaagtctgcaggagaatattgcctatggattgactcagaaacctacgatggaagagatcaccgctgccgcagtgaaaagcggcgcacacagctttatcagtgggctaccccaaggctatgataccgaggtggacgaagccggatctcaattgtccggcggtcagcggcaagctgttgccctcgccagagctctcatccgcaaaccttgcgtacttatcctggacgacgcaacatctgcccttgacgctaatagccagttgcaggtggagcaattgctctatgagtctcccgaaaggtacagcagatcagtgcttctcataactcaacacctgtccttggttgaacaggctgatcatatcctgtttctggaaggtggagccattcgcgagggaggcacacatcagcagttgatggagaagaagggctgctactgggccatggtccaggcacctgctgatgcccctgaatag

SEQ ID NO: 244857 - DNA, 2427 bp, Artificial Sequence
  Description of Artificial Sequence: Synthetic coding sequence
atggccgagctgctggcttcagccggatccgcctgttcctgggattttccaagagcaccaccatcttttccacctcccgcagcatctcgcggaggcctgggcggaactcgcagctttcgaccccataggggggcagagtccccaagacctggcagagacagagatggggtgagagttccaatggcgagttcacggtgcccagccccacgcggatgtcgatgcctgcccggagctagcttggcctggctcggaactgtcctcctgctcctcgcggattgggtgcttctgcggacggctctgcccagaatcttttcgctgctcgtgccaacagccttaccgctattgcgggtgtgggccgtgggtctgagccgctgggctgttctgtggttgggtgcgtgcggggtgctcagagctaccgtcggatcaaaatctgaaaatgctggtgctcaaggctggctcgctgctctgaaaccgctggccgctgccttaggcctcgcactaccgggtctggctctctttagagaactgatcagttggggggctccaggatccgccgacagcacaagattgttacactggggctctcatccaaccgccttcgtcgtgagctacgcagcggcactgcccgctgctgccctgtggcacaaactgggtagtttatgggtccccggtggccagggcggatcgggtaatcccgtccgccgattgctgggatgtctaggttccgaaacaaggaggttgagcctgtttttagtcttagtggtgctcagcagcttgggggagatggctatccccttttttactggtagactgacagattggattctacaagatggttcagctgatactttcaccaggaatcttaccttaatgtcaatcctcactatcgcaagcgctgtactagaatttgtcggggacgggatatataacaataccatggggcatgtgcatagtcacctccaaggagaggtgtttggggcagtgctccgacaggaaacggaattttttcaacaaaatcagactggcaacataatgtcgcgagtgactgaggacacaagtaccctgagcgattccttgagcgaaaatctgtccctgttcctgtggtatctcgtccgcggattatgtctactggggatcatgctgtggggctctgtgtctctgactatggtgacattaatcacacttcccctccttttccttctgcctaaaaaagttgggaagtggtatcaactcctcgaagtgcaggtacgggagtccctcgccaagagttcccaggttgccatagaagccctttccgcaatgcccacggtgcgctcctttgccaatgaggagggcgaagcccagaaattccgagaaaaacttcaggagatcaaaaccctgaatcagaaagaagcagttgcatatgcggtgaatagctggaccacttcaatttcaggcatgctgctgaaagtggggatcctgtacattgggggtcagttggtaacgagcggagctgtaagcagcggtaatcttgtgacatttgtgctgtaccagatgcaattcacccaggccgtagaggtgttactatctatctatcctagggtccagaaggcagtcggcagctctgaaaagatttttgagtatctagatcgcacccctagatgccccccatcaggcctgctcacaccactgcatctcgaaggtctcgtccagtttcaggatgtgagctttgcctaccctaatagacctgatgtcctggtgctgcagggcctcacctttaccttgaggccaggagaagtcacagctctagtcgggccaaatgggagtggaaagtccactgttgcagccctgctgcaaaatctgtaccagcccacaggaggacagctcctgctcgacgggaaaccactgccacagtatgagcatcggtatctgcaccggcaggtggccgcagtggggcaggagccacaggtgttcggcagatcactgcaagagaatatagcttacgggctgacccaaaaaccaaccatggaggaaatcaccgccgctgccgtgaagtctggcgctcactcatttatctctgggcttcctcaaggctatgatacagaagtggacgaggccggatcacagctgtcagggggacagagacaggctgtcgccctggctcgtgccttaataagaaaaccctgcgtgctcatcctcgatgatgcaacctcggcacttgatgcaaactcgcagctccaagtggaacaattgctgtacgaaagcccggaacggtactcacggagtgttctgctgataacccagcatctgtccctcgtcgagcaggccgaccacatcctgttcttggagggaggcgcaatccgagaaggcggaacccatcagcaactcatggaaaaaaaaggctgctactgggctatggttcaggcccctgcggatgccccagagtag

SEQ ID NO: 244858 - DNA, 1644 bp, Artificial Sequence
  Description of Artificial Sequence: Synthetic coding sequence
atggcaattccctttttcacaggacgcctgacagattggatcctgcaggacggaagtgctgacactttcacgagaaaccttacccttatgtccattctaaccatagcttcagccgtgcttgaatttgtaggagatggtatctataacaacacaatggggcacgtccatagccatttacagggcgaggttttcggagctgtcctccgccaagaaactgagttttttcagcagaaccagacaggaaacatcatgagccgagtgaccgaggatacgtccaccctttccgattccctgagtgaaaatctgagtctctttctgtggtacctggtgcggggtttgtgtctgctgggcatcatgttatggggctctgttagcctcaccatggtgacgttgataaccctgcctctcctgtttttattgcctaagaaagtggggaagtggtatcaactgctggaggttcaagtcagagaaagtttggcaaaaagctcccaggtggcaatcgaagctcttagcgctatgccgaccgtgagatccttcgcaaacgaggagggggaagcccagaagttccgcgaaaagctccaggagatcaaaacccttaaccaaaaggaggcagtcgcatatgccgtgaattcttggacaacctcgatctccggcatgctcctaaaggtgggtattctgtatatcggcggacagctggtgacaagcggcgctgtgagctccggaaatttggtgacattcgtgttgtatcagatgcagttcacccaggcagtggaagtcctgcttagcatttaccccagagtccagaaagccgtcggctcatctgagaagattttcgaataccttgacaggaccccaaggtgcccccctagcggactcttgacacccttgcacctggaaggcctcgtgcagtttcaggacgtgtctttcgcttacccgaacaggccagacgtactcgtgctccagggcctcacctttactctgcgtccaggggaagtgacagcgctagtcggaccaaatggaagcggtaaatctacggtagcagcgctgctgcagaacttatatcagccgactggcggacaattattgcttgacggaaagcctttgccccagtatgagcacaggtacctacaccgacaggtagccgctgttggtcaagaaccccaggtttttggtcggagtttgcaagagaacattgcgtatggcttaacacaaaagcctactatggaggagatcaccgccgctgccgtaaaaagcggggcacattcctttatttcaggcttgccccaaggctacgatacagaggtggatgaagccggatcccagctgtcaggcggtcaacggcaggctgtcgctttagccagagcattgataagaaagccttgtgtcctcatcctcgacgacgccactagcgctttggatgctaacagtcaactgcaggtggagcagttactctacgagtcacccgagcggtattctcgcagcgtgctgctgataacacagcatctatccctcgtggagcaggctgaccacattctcttcctagaggggggagccattagggaagggggtacacatcagcagctgatggagaagaagggttgctactgggctatggtacaagctccagccgacgcacctgagtag

SEQ ID NO: 244859 - DNA, 2427 bp, Artificial Sequence
  Description of Artificial Sequence: Synthetic coding sequence
atggccgagcttctggcgagcgccggatctgcatgtagttgggatttccctcgggcacctccatccttccccccacccgctgcttcgcgcggtggcctcgggggaacgaggagtttccgtccccatagaggggctgaaagcccccgacccggtagagatcgggacggcgtacgcgtgcctatggccagcagcaggtgcccagctcctcggggatgccgatgcctgccaggtgcatccctcgcttggctggggaccgtgctactactcctggcggattgggtgctgttgagaactgcccttcccagaattttctctttactggtaccaaccgctttaccactgctgagagtttgggctgtgggcctgtcccgctgggccgtcctgtggttaggcgcatgcggtgtgctgagggcaacagggggaagtaagagcgagaacgcaggcgctcaaggctggctcgcagctctcaagcctctggctgcggctttaggacttgccctgccaggactcgcactgttccgggaacttattagttggggagcgcctggaagtgctgacagcactcggctgctacattgggggtcccacccaaccgcattcgtcgtgtcttatgccgctgctctgcctgcagccgcattatggcacaagctcgggtcactgtgggtgcccggaggacaagggggatcgggaaatcctgtgagacgtcttctgggctgtcttggatccgagaccagacgcctctccctgtttctggtgttagtggtgttgtcttctctgggggaaatggcgatccctttctttaccggcaggctgaccgattggatcctccaagacggaagcgctgatactttcacccggaatctgactttgatgtccatcctgaccatagccagtgcggttcttgagttcgttggggatggaatttacaacaatacaatggggcacgttcatagccacttgcagggcgaggtgtttggcgcagtgctacgccaggagaccgagttttttcagcaaaaccagacagggaacattatgagccgggtaaccgaggatacctcaacactgtccgactcactgagcgaaaacctatccctgtttctatggtatctcgtcagaggactgtgcctcctggggataatgctgtggggctccgtgtcattaactatggtgactctcataaccttgccattgttgttcctcctgcctaagaaggtaggaaaatggtatcaactattggaggtgcaggtcagggaatcactggcaaagtctagtcaggtggctattgaggctctctccgccatgcccaccgttaggagttttgcaaacgaggagggtgaggcccagaaatttcgcgagaagcttcaggaaatcaaaacactcaaccagaaggaagcggttgcttatgcagtcaactcatggaccacatccatcagcggaatgctgctgaaagtagggatcctgtatataggtggccaactggtcaccagtggtgccgtgtcaagcggtaacctagtcacttttgtgctgtatcagatgcaattcactcaagcagttgaagtgctattaagtatctaccctagggtccaaaaggctgttggatcttccgaaaagatctttgaatatctggacaggacacccagatgtcctccttctgggttgcttactcctctgcacttggaaggcctggtccaattccaagatgtgtcattcgcataccccaaccgccctgatgtgctggtgttgcagggcttaactttcaccctccgtcctggagaagtgactgccctggtaggccctaacgggagcggcaaatccactgtcgccgctttgctccagaatctctaccagccaactgggggtcagttactgctggacgggaaaccgcttccacagtacgagcaccgctatttgcataggcaagtggctgcagtcggacaggagccccaggtgtttggccgatccttgcaagaaaacatagcctacggactgacccagaagcctaccatggaggaaatcaccgcagccgcagtgaagagcggagcacactcctttatttcagggctcccccagggttacgataccgaggtcgatgaggccggatctcagttgtcaggcggacagagacaagctgtcgcgctggcccgagcattaatacgcaagccttgcgttttgatactggatgacgccacctccgcattggacgctaactcgcagctgcaggtcgaacagctgctgtacgaatctccagagcgctacagcaggagtgtgctcctgatcacacagcatctgtcactcgttgagcaggcagaccacattctgttccttgaaggcggagccatacgcgaggggggaacacaccaacagttaatggagaagaaaggctgctattgggctatggttcaggcccctgcagatgctccggagtag

SEQ ID NO: 244860 - DNA, 2427 bp, Artificial Sequence
  Description of Artificial Sequence: Synthetic coding sequence
atggcagagctcctggccagcgcaggaagcgcttgtagctgggatttccccagggcacccccaagtttcccacccccagccgctagtagagggggtctaggtggaacacggtcttttcgacctcataggggagctgaaagtccccgacctggcagagaccgcgacggggtccgagtcccaatggcctcctctaggtgcccggcacctcgcggatgcaggtgtctgccaggtgcctcgctggcgtggctcggcaccgtcctactgttgctcgcagattgggtgctgctcagaactgccctgcccaggatcttttcgcttcttgtgcccacggctttgcccctcctcagagtgtgggccgtgggcctgtccagatgggccgtgctgtggctcggggcttgcggcgtgctgagggccaccgtcggcagtaagtcggaaaacgcgggagcgcaaggctggctggcggcactgaaacctttggccgctgctctgggacttgccctgcccggactcgccctgtttagagagctgatcagttggggcgctccaggatctgccgattctacacggcttctgcactggggtagccatccgacagcctttgtggtttcttatgccgcagcacttccagcagccgcattgtggcataagctgggcagcctgtgggtccccggaggtcaggggggatctggaaaccctgtgaggcgcctcttgggatgcctcgggagcgaaacccggcgtctgtccctgttcttagtgctcgtcgtgctgagctccctcggtgagatggccattccattctttaccgggaggctgaccgactggatcctgcaggatgggagtgctgacacattcacaagaaacctgacattgatgtccatcctcactatcgcctccgcagtgctggaattcgtcggggatggtatctataacaacaccatgggacacgttcactcccacctgcagggggaggtgtttggcgctgtgctgaggcaggaaaccgaattttttcaacagaaccagactgggaacataatgagccgcgttacagaagatacctctaccctgtcagacagcctttctgagaacctatccctttttctctggtacctggtcagaggcctgtgcctcctcggtatcatgctgtggggaagcgtatcgctcactatggtaacgcttatcaccctgcctctgttatttctcctgcctaagaaagtgggaaaatggtatcagctcctggaagtgcaggtgagggagagcttggccaaaagttcccaggtggccattgaggcactttccgccatgcctactgtccgctctttcgctaatgaggagggggaggctcagaagttccgtgagaagctgcaggagataaagaccttaaaccagaaggaagccgtcgcttacgccgtcaattcctggactaccagcatttccgggatgctcctcaaggttggcatcctgtacatagggggacagttagtgaccagtggggctgtgagctccggcaatttggttaccttcgtcctctatcagatgcaatttacccaggctgtggaagtactgttatccatataccccagggtccagaaggccgtgggaagttccgagaagattttcgagtatctggaccgcactcccaggtgccccccttccggccttcttacccccttgcatctggagggcctggtgcagttccaagatgtgagttttgcgtaccctaaccgaccagatgtcctggttcttcaagggctgacatttactctccggccaggcgaagtgactgccctggttggccctaacggatctggtaaatcaactgtggccgcacttctccagaacctatatcaacccactggaggccaactccttcttgacggaaagccactaccccaatacgaacaccgctacctgcaccgccaggtggccgctgtgggtcaggagcctcaagtgttcggaagatccctgcaggaaaacattgcatacggcttaactcagaaacccacgatggaagagatcaccgctgctgctgtcaaaagcggagctcattcattcatctccggcctcccccaggggtatgacactgaggtggacgaggcaggatcccaactgtctgggggacaacggcaggctgttgccctcgccagagcccttattagaaagccgtgcgttctcatcttggatgacgccacctcagctttggacgcaaactctcaattgcaggtcgagcagcttttgtacgaaagtcctgaacgctactcccgctccgtcctcctgatcactcaacacctgtcacttgttgagcaagctgatcatattttgttcctagagggaggagcaattcgagagggcggaacccatcagcagctcatggagaaaaagggttgttattgggccatggttcaggctcctgccgacgccccagagtag

SEQ ID NO: 244861 - DNA, 2427 bp, Artificial Sequence
  Description of Artificial Sequence: Synthetic coding sequence
atggctgaactgctggcctcagccggttctgcctgttcttgggacttccccagagccccaccatcgtttccccctcctgccgcatcccgcggaggcttgggtggaacacgaagttttaggccccacaggggtgccgagtccccgaggcccggacgagaccgagatggcgtcagggtgcccatggccagtagtcgctgtccagccccacgcggatgcagatgtttacctggtgcctcgctggcctggctgggtacggtgctgttactactcgcggattgggtgcttcttcgtacagctctgcctcggatcttcagcttgctcgtgccgaccgcgctgccattactacgcgtttgggcagttggcctctctcgctgggctgttctgtggctgggcgcttgtggagtcctccgcgctacagtgggctcaaaaagcgagaacgccggagctcaaggctggcttgccgctctgaagccgctcgctgcggctctcggtctggcgcttccaggcttagctctctttcgggagctgattagctggggcgcacccggaagcgctgattcaacgcgcctgttgcattgggggtcacatcccactgctttcgtggtgtcatacgctgcagcgttgccggcagcagccttgtggcataaactgggatctctgtgggtgccaggtggccaaggcggtagcggaaacccagtgaggcgcctcttgggctgtttggggagcgagacgcgacggttgagcctgtttctcgtactggtggttttgtcttcacttggtgagatggccatccccttctttaccggacggctgaccgattggattttgcaggacggctcggctgatacattcacacgaaacttgaccctgatgtccatcctaaccatcgcaagtgctgtgttggagtttgtgggcgatgggatctacaataatactatgggtcatgtacactcacacctccagggagaggtcttcggagctgtcctgcgtcaagagactgagttcttccaacagaatcaaactggaaatatcatgtccagagtcactgaggacacatctactctgagcgattcgctctctgagaatctgtccctgttcctgtggtatctggtccgcggtttgtgtcttttgggaattatgctctggggatcagtgtccctgactatggttacccttattacactcccgctccttttcttactcccaaagaaggtgggtaagtggtaccaactccttgaggtgcaggtgagggagtcactggccaaatcctcacaggtcgctatcgaagccttgagcgccatgccaactgtacgctccttcgctaatgaagaaggcgaggcccagaagtttagagaaaagctccaggaaattaagactttgaaccagaaggaggccgtggcctatgccgtcaatagctggacaactagcatttctgggatgctgctcaaggtggggattctctacatcggcggacagcttgtgacgtccggggcagtcagcagcggcaaccttgtgacttttgtgctgtaccagatgcagttcacccaggctgtggaagtgctcctctctatctatcctagagtccagaaagctgtcggttcctctgaaaagatcttcgaatatctggaccgtactcccagatgccctccttccgggctcctaaccccactccatctagagggactggtacaattccaggatgtttcctttgcatatcctaaccgacctgacgtcttagtgttgcagggcttaaccttcaccctgcggccaggcgaggttaccgccttagtggggcctaatggaagcggcaagtctacggtagcagcactcctccagaacttgtaccagccaacaggcggtcaattattgctggatgggaagccactgccccaatacgagcatcgctacttacatagacaggtcgccgctgtcggacaggagccccaggtttttgggcgatctcttcaggaaaatattgcgtacgggctcactcaaaagccaaccatggaggagattacagcggctgccgttaagagcggtgcccacagcttcatcagcggactgccccagggatacgacacggaagtggatgaggccggaagtcagctttcgggaggccagcggcaagcagtggctctggctcgggctttgatcagaaagccctgtgtattgatcctggacgatgccacatcagcccttgacgcaaatagccagttgcaagttgagcaattgctctatgagtcaccagagcgttatagtcgctcagtcctgcttataactcagcacctgtcgctggtggagcaggcggaccacattctctttcttgagggcggagcaatccgggagggcggaacccaccagcagctcatggagaagaagggatgttactgggccatggtccaagcccctgctgatgccccagagtag

SEQ ID NO: 244862 - DNA, 1644 bp, Artificial Sequence
  Description of Artificial Sequence: Synthetic coding sequence
atggctatcccctttttcacagggagattaacagactggattctccaggacggctctgcagacacttttacccggaacctcacattaatgagcatcctgactattgctagcgcggttcttgagtttgttggggatgggatctacaacaacactatgggccatgtgcactcgcacctgcagggagaagttttcggggctgtgctgcgtcaggaaacagagttctttcagcagaaccaaacagggaacatcatgtctagagtaactgaagatacatctaccctgtcggacagcctcagcgagaacctaagcttgtttctgtggtacttggtgaggggtctatgcttactggggatcatgctatggggtagcgtcagcctgacaatggtgacgctgatcacgttgcctctgttgttcctgcttccaaagaaggttggaaagtggtaccagctcctggaagtccaggtgagagagagcttggccaaaagctcacaggtcgctatcgaagcgttatctgctatgccgaccgttcgatcattcgctaatgaggaaggcgaagcacagaagtttcgcgaaaaactgcaggagattaagaccctgaaccagaaggaagctgttgcctacgcagttaattcctggaccacatcaatttcaggaatgttactcaaggttgggatcctatacatcggcggacagctcgtgaccagcggagccgtctcctccgggaacctggtgacctttgtgttgtatcagatgcaattcacacaggccgtcgaggtcttgctgtcgatttacccacgggtgcagaaagcagttgggtcttccgagaagatcttcgaatatctggataggacaccacggtgcccaccttctgggttgctgacccctttgcacctggaaggattggtgcaatttcaggacgtgagctttgcatatcccaaccggcctgacgttctcgtactccagggccttacatttactctcagaccaggtgaggtcactgctctcgtcggacctaacggatctggcaaaagcactgtagcagcactcctgcagaatctttaccagcccactggaggccagcttctgctcgacggcaaacctctgccacagtacgagcatcgctacctgcatcgccaagtggctgccgtaggccaagagccccaggtgttcggtaggagccttcaggagaatatcgcttacggcctgacacagaagcccacaatggaggagatcacagcggctgctgtcaagtcaggggctcactccttcatttccgggctgccccagggctatgacacggaggtggatgaagctggcagccagctaagcggagggcagcgccaggccgtcgcactggcccgagccctgattcgaaaaccgtgtgtcctgatattagatgatgcaacatccgctctggacgcaaattcccagctgcaggtggagcagctcctgtacgaatccccggagcgctattcccgtagtgtcctgttgatcactcagcacctgtcgctagtggaacaggctgatcatatcctatttttggagggaggggcaatccgggaaggagggacccaccagcagctcatggagaaaaaaggttgttattgggctatggtgcaggcacctgccgacgcacctgaatag

SEQ ID NO: 244863 - DNA, 1644 bp, Artificial Sequence
  Description of Artificial Sequence: Synthetic coding sequence
atggctatcccttttttcaccggaagactcaccgactggattctacaggacggcagtgcggatacattcaccaggaaccttacccttatgtcaattctgacaatcgcctcggccgtcctggaatttgtgggagacggaatctacaataataccatggggcatgtgcactcccacttacagggggaagtgtttggtgctgtgctgaggcaggagacagaattttttcagcagaaccagaccggaaatatcatgtccagagtcacggaggacacgagcacactgtccgattcattgtcagaaaacctgtccctttttctgtggtacctcgttagaggcctgtgcctgttgggaattatgctgtgggggtccgtgtcacttactatggtcacgcttatcactctccccctgctgttcctactgccgaagaaggtgggcaaatggtatcaactcctcgaagtccaggttcgggagtcactcgctaaaagttcgcaggtggctatcgaggctctgagcgccatgcccaccgttaggtccttcgccaacgaggagggcgaagcacagaagtttagggaaaagctgcaggagatcaaaactctgaatcagaaagaggccgtggcatatgctgtgaattcctggaccacctctattagtggcatgcttctgaaagttggcattctgtatatcggcggacagctggtgacctctggggctgtctcgtcgggcaatctcgtgaccttcgtgctataccagatgcagtttacacaggctgtggaggtgctcctgagcatctatcccagagtacagaaagccgtgggatctagtgaaaagattttcgagtacctggacaggacaccgcgatgccctccctctgggctcctgacccccctgcatctggaggggctcgtacagtttcaggacgtgtcatttgcatacccaaatcggcctgacgtcttggtattgcaaggccttacgtttaccctgcgccctggtgaagtaaccgccttagtaggaccgaatggatccggtaaatcgacagtcgcagccctcctacaaaacctgtatcaaccgactggcggacagttgctcctggatggaaaaccccttccccagtacgagcataggtacttgcaccggcaggtcgcagccgtggggcaggagccccaagtgttcggaagatcgttacaggaaaatattgcttacgggctaacccagaaaccgacgatggaagagatcacagccgcagcagtaaagtcaggagcccattctttcatcagtggcctgccgcagggctatgacaccgaggtggacgaggccggaagccagctttctggcggacagagacaggctgtcgcattggccagagcactgatccggaaaccctgcgttctgatactggacgatgcaacctctgcactagacgccaactctcaactccaggttgagcagctcctgtatgagtcccccgaacgctattcccgttcggttctcttgatcacacagcatttgtccctcgtggaacaagccgaccacattctgtttctggagggaggtgccattcgcgagggaggcacccaccagcaactgatggagaaaaaagggtgttactgggcaatggtgcaggccccagcagacgcaccagaatag

SEQ ID NO: 244864 - DNA, 1644 bp, Artificial Sequence
  Description of Artificial Sequence: Synthetic coding sequence
atggccattcctttcttcactggccgactgacagactggatcctgcaggacggcagcgcagatactttcacgcgcaacctcacattaatgagtatcctgactatagcaagcgccgtgttagaattcgtgggggatggtatctacaataacaccatgggacatgtccacagccacttgcagggcgaagtgttcggcgcagtcctgaggcaggagactgagttcttccagcaaaatcagacaggcaatattatgagtcgagtaacagaggatacgtctactctgagcgattctctctcagaaaaccttagtctctttctctggtatctagtcagaggcttatgcttactgggcatcatgctgtggggttctgtttctttgactatggtgacactgatcactctgcctctgctgttcctcctgcctaaaaaggtggggaaatggtatcagctcctagaggtccaggtgagggaaagtctggctaagtcgagtcaggtggctatagaggcattaagtgcaatgcccaccgtgcggtctttcgcaaacgaggaaggcgaggcccaaaagtttagagagaagctgcaggagataaagacgttgaatcagaaggaagcagtcgcgtacgccgtcaatagctggacaaccagtattagcggaatgctgctgaaagtgggaattctgtatatcgggggacagttagtcacctccggtgccgtgagctctggcaacttggtgacattcgtgctgtatcagatgcaattcacccaggcagtcgaggtcttgctgtccatatatcctagagtgcagaaggccgtgggctcctccgagaagatatttgagtacctggaccggacccccagatgtccgccatctggcctgttgactccccttcatctggagggcctggttcagttccaggacgtctctttcgcgtacccgaaccggcctgacgtgctggtcttacagggcttgacgtttacgctacgacccggtgaagtgacagctctcgtaggcccaaacgggtcaggaaagagcacagtcgctgcattgctgcagaatctttatcaacccaccgggggacagctcttgttagacggcaagccactcccacagtacgagcaccgctacttacacagacaggtcgccgcagttgggcaggagccacaggttttcgggcgttcattgcaagaaaatattgcatatggtttgactcagaaacctaccatggaagaaatcacagccgctgccgtcaaaagcggcgctcattccttcatatctggcctgccccagggatacgacacagaagtcgacgaggccggaagccagctgagcgggggtcagagacaggccgtggcgctcgcccgagcccttatcaggaagccctgcgttctcatcctggatgatgctacatccgctctggatgctaattctcaactccaggtcgaacagctgctctatgagtctcctgagagatattccagatctgtgctgctcataactcagcatctgtctctggtggagcaggccgatcacatactgtttctggagggaggggctataagagaagggggtacccaccagcagctcatggagaagaagggctgttattgggcaatggtgcaggccccagccgacgcacccgaatag

SEQ ID NO: 244865 - DNA, 1644 bp, Artificial Sequence
  Description of Artificial Sequence: Synthetic coding sequence
atggcaatcccattcttcaccggcaggctgaccgactggattctgcaggatggttctgccgacaccttcactcgcaaccttacactgatgagcattttaaccatcgcctccgctgtgctggagttcgtgggcgatggtatctataataacacaatggggcacgtccattcacatcttcaaggggaggtgttcggcgctgtgctacggcaggagacagagttctttcagcagaatcagaccggcaacatcatgagcagggtcaccgaagatactagcaccctgagcgacagcctaagtgagaatctgagtctttttctgtggtatctcgtcagaggcctgtgcctgcttggaatcatgctttggggcagtgtgtccctcaccatggtgactctgatcacactccccctcctcttcctgctccccaaaaaagttggcaagtggtatcaactattggaggtccaggtccgggaatcgctggctaagagcagccaagttgccatagaggcacttagtgcaatgcctactgtgcgctcgtttgccaatgaggagggggaggcccaaaaattcagggaaaaattgcaggagattaagaccctgaatcagaaagaggcagtggcctacgcagtcaattcttggacaaccagtatctccggcatgctgcttaaagtaggcatactgtatatcggagggcagctcgtgacttcaggtgccgtatctagcggtaacctagtgacatttgtgctgtatcaaatgcaatttacacaggctgtggaggtgttgctatccatatacccacgggtccagaaagcagtcgggtccagtgaaaaaatcttcgagtaccttgacaggacaccccgttgccctccaagtggcctgctgacccccttgcacctcgaaggacttgtacagtttcaggacgtgagctttgcctatcctaacagaccagatgtcctggtgctgcaaggactcacattcaccctgcgacctggagaagttactgccctggtgggcccaaacggtagtgggaaatctaccgttgctgctctcttgcagaatctatatcagccgactggtggccagcttctccttgatggcaagcccctgccgcagtacgaacatcgctacctgcaccggcaggtggccgctgtgggtcaggagccccaggtgtttggccgatcgctgcaagagaacatagcttatggtctcacccagaaacctacgatggaagaaattactgccgctgctgtgaagagcggggcacactcattcatctctggattaccccaggggtatgatacggaggtagacgaagctggttctcaactctcggggggacagagacaggcagtggcactggcaagggccttgatcagaaagccgtgtgtgctcatcctcgatgacgcgacctccgcccttgacgccaactctcagcttcaagtggaacagctcttgtatgaatcccccgaaaggtacagcagaagcgtactgttgattacccagcacctgagtcttgtcgagcaggcggatcacatcttgttcttggaagggggagctatccgcgaaggcggaacccatcaacagctgatggagaagaaaggctgttactgggcaatggtgcaggccccagcagatgccccagaatag

SEQ ID NO: 244866 - DNA, 1644 bp, Artificial Sequence
  Description of Artificial Sequence: Synthetic coding sequence
atggccattccattttttacagggagactcactgactggatactacaggacggctccgccgacaccttcacgcggaatcttacattaatgtcaattctgactatcgcatccgccgtattggaattcgttggagacgggatttacaataatacaatgggacacgtacatagccacctgcagggcgaggtcttcggtgccgttctgcgacaggagacagagttctttcagcagaatcagacaggaaatatcatgtctagggtgacagaggacacttctacgctgagtgacagcctctctgagaatctcagtctgttcctgtggtaccttgtgagaggtctgtgcttacttggcatcatgctgtggggatccgtgtctctgacaatggtgaccctcatcacactgcctctactttttcttctcccaaaaaaggttggcaagtggtatcagctcctcgaagtccaagtgagagagagtctggctaagtcctcccaggtcgcgatagaggcattgagcgcaatgcccacggttagatccttcgcgaacgaggaaggcgaggcccagaagttccgggagaagctgcaagagataaaaacactgaaccagaaagaagctgtggcctatgcagtgaactcttggacaacttcaatatccgggatgctgctgaaagtggggatcctctacataggagggcagctcgtaacatccggggcagtgagctcaggaaatcttgtcacttttgtcttgtaccagatgcagtttactcaggcagtggaggtgctgctgtctatctaccctcgcgtccagaaggccgttggctcctctgaaaagatttttgaatatcttgaccgcacacccagatgcccaccatcaggcttgcttactcctctgcatctcgaaggcctggtgcaatttcaagacgtgtcgtttgcataccccaaccggcctgatgtgttggtcctccaagggctcactttcaccctgcggcctggggaggtcacagccctggtgggcccaaacggaagtggaaagtctacagtcgcggcactgctccagaatttgtaccaacctacgggaggacagctgctgcttgacgggaaacctctgccccagtacgaacacaggtatctgcaccgacaagtcgccgctgtcgggcaggagccacaagtgtttggacgatctttgcaggagaatatcgcttatgggctcacacaaaaacccaccatggaggagataactgccgcagctgtgaagagtggagcgcattccttcatcagcgggctaccgcagggctacgatacggaagtggatgaagcagggagtcagttgtccggcggtcagagacaggccgtggccttagctcgtgctctcatccgaaaaccatgtgtcttaattttggacgatgctacgtctgctctcgacgccaacagccaattgcaagtcgagcaactgttatacgagagcccggagcgatattccagatccgtccttctgattacccagcatctgtcactagttgagcaggcagatcatatactgttcttggaaggcggagccataagagaagggggtactcaccagcagctaatggagaagaaaggctgctactgggccatggtgcaggccccagccgatgccccagaatag

SEQ ID NO: 244867 - DNA, 1644 bp, Artificial Sequence
  Description of Artificial Sequence: Synthetic coding sequence
atggccatccctttctttactggcaggttgactgactggatcctccaggatggctctgctgataccttcacacgaaacttgacccttatgagtatcttgaccattgcgtcagcagtgttggaatttgttggagacggaatctacaataacactatgggccacgtccatagccacttacagggagaagtgttcggggctgtcctgaggcaagaaacagaattctttcagcaaaaccaaactggcaacatcatgtctagagttaccgaagatacatctacactgtccgatagcctgtctgaaaacctgtccttgtttctgtggtacctggtgcgcggtttatgcctgctcggaattatgttgtggggatccgtatctctgactatggtgacactgattacgttgccactcctgtttctgctacctaagaaagtcggaaaatggtaccaattgctcgaggtacaggtgcgggagtccctcgctaaaagcagtcaagtggctatagaggcgttgtctgctatgccaacagtacgttcatttgccaacgaagaaggggaggcacaaaagttcagagaaaagcttcaggagattaaaactctgaaccagaaagaggccgtggcatatgcagtcaattcatggaccaccagcatatccgggatgctgctcaaggttggcatcctgtatatcggtggtcaactggtgacctctggcgcagtatcttccggcaacttagtgacctttgtattgtatcaaatgcagtttacgcaggcagttgaggtcttgttgagcatttatccgagagtgcagaaggcagtaggctccagtgaaaaaattttcgagtatttggatcggaccccccgatgccctccatcagggttattgacccctctgcatctggaaggcctcgtgcagtttcaagatgtttctttcgcctatccaaaccgcccagacgtgcttgtattacaagggcttacctttacattgaggccaggggaggtgacagcgctggttggccctaatggtagcggcaagtccaccgtggctgcactgctgcaaaatctgtaccagcctacggggggtcagctgctcctggatggcaaaccgttgccccagtatgaacaccggtatttgcatcgacaggtcgctgcggtgggccaggagccacaggtctttggccgatcattacaagaaaacattgcctatgggctgacccaaaaacctacaatggaagaaatcaccgctgctgccgtgaagagtggagcccactcgttcatctcaggactgcctcagggatatgatacagaggtggacgaagcaggatcacaactgagcggtggccaaaggcaggccgtggccctcgcccgagcgctcattagaaaaccctgtgtcctgatcttggacgatgccacttcagccttagatgctaacagccagctgcaagtggaacagctgctgtacgagtcgccagagcgctacagccgatccgtgctgctgattacccagcatctgtcccttgtggaacaggctgatcatatactgttccttgagggcggagctatacgggagggtgggacacatcagcagttaatggaaaagaagggttgctattgggctatggttcaggctcccgcagacgccccagaatag

SEQ ID NO: 244868 - DNA, 1644 bp, Artificial Sequence
  Description of Artificial Sequence: Synthetic coding sequence
atggctatcccatttttcacgggtcggctcacagactggattcttcaggatggctctgctgacactttcactcgcaacctgacactgatgtcaattctcactatcgcttccgcagttcttgaattcgttggagatggaatttacaataacacgatgggccatgttcacagtcaccttcaaggcgaggtctttggtgccgtcctgcgtcaggaaacggagttctttcaacagaatcagaccggcaatattatgtctagggtgacggaggatacctccacattaagcgacagcctgagcgagaatctgagtttattcttgtggtacttagtgcgcggactctgcctactcgggatcatgctgtggggatctgtttctctgacaatggtaaccctaattactctccctcttctgttcctgctgcctaagaaggtgggcaaatggtatcagttgctggaggtgcaggtgcgcgagagcctagcaaagagttcccaggtcgccatcgaggccctcagcgccatgccaactgtcagatctttcgcaaatgaggagggagaagcacagaaattcagggaaaaacttcaggagatcaaaacactgaaccaaaaggaggctgtggcctacgctgttaatagctggacgacttcaatcagcgggatgttgctaaaagtcgggatcctctatatcggaggacagctcgtgacgtctggagccgtgtcatcaggcaatcttgtgaccttcgtgctctatcaaatgcagttcacacaggccgtggaggtgcttctttctatttacccccgagtacagaaagcagttggatcttctgagaaaatctttgagtaccttgatcggactccacgctgtcctccatcgggccttctcacacccttacaccttgaaggtttagtccaattccaggatgtaagttttgcctaccccaataggccagatgtcctcgttttgcaagggctgacttttaccctgaggccaggtgaagtgactgccttggtcggacctaacggttccggcaaatccacagttgccgcattgctgcaaaatctctatcagcctaccggcggacagctcctactggatggtaaacctctgccccaatacgagcataggtacctgcaccgacaggtggctgccgtgggccaggagcctcaggtttttggccgaagtcttcaggaaaacatcgcatatgggctgacacagaaacccacaatggaggagatcactgcagctgcagtgaagtccggagcccactcttttatcagcggactgcctcagggatatgacactgaagttgacgaggcaggcagccaactctcagggggtcaaagacaggccgtcgccctggcaagagctctgattcgcaagccttgcgtgctcatcctggatgacgccacctccgcacttgacgctaactcccagctgcaagtcgagcaattactctacgaatcccccgagagatattcacggtccgtactcctcatcacacagcacctcagcttagtggagcaggctgatcacatcctgttccttgagggcggagctattagagaaggaggtacccaccagcagcttatggaaaaaaaaggatgctactgggcaatggtgcaggctcccgctgatgccccagaatag

SEQ ID NO: 244869 - DNA, 2061 bp, Artificial Sequence
  Description of Artificial Sequence: Synthetic coding sequence
atgagactgccagatctcaggccgtggacaagtctgttgctggtggatgccgctctgctgtggctcctccagggcccactgggaaccctcttaccacagggtttgcctggcctgtggcttgagggaaccctcaggctcgggggactctggggcctgcttaagctcaggggcttactgggtttcgtgggcacactgcttctgcccctctgtctggccacaccactaactgtcagcctaagagccctggttgctggcgcatcccgagcaccgccagctcgagtagcttctgccccatggtcctggttattggtggggtacggggctgccggactctcatggtccctgtgggctgtactttctcctccgggagcccaggagaaggagcaagaccaggtgaacaataaggtgctgatgtggcgcttactcaagcttagtcggccagaccttccccttttagttgcagcattctttttcctggtgcttgcagtattaggcgagacattgatacctcattacagtgggagagtgatcgatatactcggcggtgacttcgatcctcacgcattcgctagcgccatcttctttatgtgcctgttctcattcggctctagcttgtccgccggatgcaggggaggatgttttacttataccatgagtagaatcaacctccgtattagggaacagctgttctctagcctccttagacaggacctggggttctttcaggagaccaaaacaggcgagttaaacagccgcctttcgtccgacactactctgatgagcaattggctgcccctaaacgcaaatgttttattgaggagcctagtcaaggtggtgggcctctatgggtttatgctttctatttcgccgagattaacccttctgagcctcctccacatgccctttactatcgccgcagagaaagtctacaacacccgccaccaggaagtgctccgcgaaattcaggacgccgtggccagggctggccaggtcgtacgtgaagccgttggtgggctgcaaaccgttcgatccttcggcgcagaggagcacgaggtatgccgctataaggaggcattggagcagtgtcggcaactgtattggagaagagatctggaacgcgcactatacctcttagtgaggcgggtcctgcacttaggggtgcaaatgctgatgctcagttgtggactccaacagatgcaggatggggagctgacgcaggggtccttgctgtcttttatgatttaccaggaatctgtcggatcttatgttcagacattggtctatatttacggcgatatgttgagcaatgttggtgcagcggagaaggttttcagctatatggaccgccagccaaacttgcccagtccaggtacgttagccccaacaacgttacagggggtcgtcaaatttcaagacgtcagtttcgcttatcctaataggcccgatagacctgtcctcaaagggctgacgtttactttaagacctggcgaggtaacagccctggtcggacctaatggatcaggaaaatcaacggtggcagctctgttacagaacttgtaccaacccacaggcggacaagttctgttggacgagaaacccatctcacagtatgagcactgctacctgcactctcaggttgtgagtgtgggacaagagccagttcttttttcaggctcagtgaggaacaatatcgcctacggtctgcaatcctgcgaagatgacaaggtcatggctgctgctcaagctgcccacgcagacgatttcatccaggagatggaacacgggatttataccgatgtgggcgagaaaggctcacagctggccgctggacagaagcaacgccttgccatcgcaagggctctagtgcgcgacccaagagtgctgattcttgacgaggctacctcagctttggacgtccagtgcgaacaggcgctgcaggactggaatagtcgcggagatcggactgtgttggtgatcgcccacagactgcagaccgtgcagcgggctcatcagattctggtgcttcaagaaggcaaattgcagaaactggcccagctgtag

SEQ ID NO: 244870 - DNA, 1962 bp, Artificial Sequence
  Description of Artificial Sequence: Synthetic coding sequence
atgcgcttaccggacctgaggccttggacatctctgctgcttgtggatgccgctctactctggttactgcaaggacctctgggaaccttgttgccgcaggggctgcccggactgtggttggagggaaccctgaggttgggaggactgtggggtctcctgaaacttaggggattattggggttcgtgggcactctcctgcttcccctgtgtctcgcaacacccttaactgtctctttaagagctttggtcgccggtgccagtcgagcccctccagccagggtcgcgagcgccccatggtcttggttgctcgtcggttacggggcagcagggctgagctggagtctgtgggccgtcctgtcccctcctggtgcccaggaaaaggaacaggatcaggtgaataataaggttctcatgtggcgcttgctcaagctcagccggccagatcttccactgctagtggctgcattttttttcctggtcctggctgttctgggagaaactctgataccgcattacagcggacgcgtaatcgacatattaggcggagactttgaccctcacgcattcgccagcgcgatttttttcatgtgccttttctcattcgggtctagtctgagtgccggatgcaggggcggatgcttcacatacacaatgagtaggatcaacctgcggatccgcgagcagttgttcagctcactcctgcgccaggacctcggcttttttcaggagaccaaaacaggcgagctcaactcgaggctctcatcagatacaactctgatgagcaattggctgccactgaatgctaatgtgctgctgcggagcctcgtaaaggtcgtcggcttatatggatttatgttatcaatttctcccaggcttactctcttaagcctgttacacatgccgtttactatcgccgcagagaaggtctataatactaggcaccaggaggtgctacgggaaatacaagatgctgtcgcccgagctggacaggtcgttagagaggccgtgggtggcctgcaaactgtccgaagctttggcgcagaggagcacgaggtctgtcgctacaaggaagctttggaacaatgcagacagctctattggaggagagatcttgagcgggcactgtacctccttgtgagacgggtgctacaccttggtgttcagatgctgatgttatcttgcggcctgcagcagatgcaggatggcgagcttacgcaaggcagcctcctctccttcatgatatatcaggagagtgttggcagctacgttcaaacactggtgtatatttatggagacatgctatcgaatgttggagccgctgaaaaagtgttttcttatatggaccgacagccgaacctcccctcgcctggtacactcgcccctactacgctgcagggggtggtcaagtttcaagatgtgtcctttgcctatcccaatcgcccagacaggcccgtgttaaaaggcctgacttttaccctgagacctggagaagtgacagcactggttggaccaaacggcagcgggaagtcaacagtcgccgctctattacagaacttgtaccagccaaccgggggacaggtgctcctagatgagaaaccaatcagccagtatgaacactgttaccttcactcccaagttgtgtcagtaggccaggaacctgtcctgtttagtgggtctgtgcgtaacaacatcgcttatggcctccagagctgcgaagacgacaaggtaatggccgcagcacaggcagcacatgcggacgactttatccaggaaatggaacatggaatatatacagatgtgggggagaaagggtctcaactggctgctggacagaagcagcgcttggctatcgcaagggccctcgtgagggatcctcgtgtactgattcttgatgaggcaacatctgccctggatgtccaatgtgagcaggccaaaactctttggaaatttatgatcttttag

SEQ ID NO: 244871 - DNA, 2061 bp, Artificial Sequence
  Description of Artificial Sequence: Synthetic coding sequence
atgcgactccctgatttaagaccctggacaagcctcctcttggtagacgcagcactgctgtggcttcttcaagggcctctcggcactctgttgcctcagggactgcctggtctgtggttggagggcactctccggctcggcggactgtggggcctcctaaagctcaggggtctcctaggttttgtgggcacccttcttctccctctgtgcctggctactcccttgacagtgagtcttagggccttggtggccggtgccagtcgggctcctccagcaagagtagccagcgcaccctggagctggctgctggtcgggtacggggcagcgggactaagttggagcctgtgggcagtgcttagtcccccaggagcacaggagaaggagcaagaccaggtgaacaataaagtgctgatgtggcgcctgctcaaactgagtagaccagatttgcccctccttgtggccgcattctttttcctggttttggccgttttgggggagacactcattccacactactcaggtcgcgtcattgacatactgggcggtgatttcgatcctcacgcatttgcttcagctatctttttcatgtgtttattcagctttggctccagcctgtccgccggatgccgtggaggatgcttcacgtacacaatgagtcggattaacttaaggatcagggagcagctttttagctccttactccgtcaagacctcggctttttccaggagaccaaaacgggcgagttaaactcgcggttgtcatctgacaccaccctaatgtctaattggctcccattgaacgctaacgtactcttaagaagtctggttaaggtcgtaggcctgtatggtttcatgctctccatctcccctaggctaacacttcttagcctgctccatatgcccttcaccatagccgctgagaaggtttacaacacccgacaccaagaggtgcttagagaaatccaggacgccgtggctcgcgcaggacaggttgtccgggaggcagtgggcggactgcaaacagtccgatcctttggcgcagaggagcacgaagtgtgcaggtacaaggaagccctcgagcagtgccgccagctatactggcgcagagatctggaacgtgctttgtatttactggtgcggcgagtgctgcacctgggggtgcagatgttgatgctctcctgtggcctgcagcaaatgcaggacggagaactcacccaggggagcctgctgagttttatgatttaccaggagagcgtggggtcttatgtgcagacgttagtctacatctatggggatatgctctccaacgttggagctgccgaaaaagtgttttcctacatggatcgtcagcctaatctgccctccccgggaacactcgccccaactacccttcagggagtagtgaagttccaagacgtttccttcgcctaccctaaccgcccagataggcccgtcctcaaaggcctgacttttaccctccgaccaggcgaggtgaccgctttggtgggtcccaatgggtcaggcaagagtactgtagccgcattactgcagaatctttatcagcccacggggggtcaggttctcttggacgagaagccgatctcacagtacgaacattgttacctgcactcacaggtagtgtcagttggtcaggaacccgtgctgttctctggttccgtgcgcaacaatatagcctacggcctccaatcttgtgaagacgacaaggttatggcggcagcacaggctgcccacgcagacgatttcatccaggaaatggaacatgggatatacaccgatgtgggagaaaaaggaagtcagctcgctgcagggcagaaacagagacttgctatcgcacgggcactcgtgagagatcccagagtactgatccttgatgaagcaacatctgctctcgatgtgcaatgcgaacaagcgttgcaggactggaattctcggggtgacagaaccgtacttgtgattgcacaccgtctgcagacggtccagagagcacaccagattctggtgctgcaggagggaaagcttcagaaactggctcaattgtag

SEQ ID NO: 244872 - DNA, 1962 bp, Artificial Sequence
  Description of Artificial Sequence: Synthetic coding sequence
atgcgactgccggatctgcgcccttggacatcgctgttattagtagatgcggctctcctgtggttactccaaggacccttgggaacactgttgccacagggcctgccaggcctgtggcttgaagggacactcaggctggggggactgtggggtcttctgaagctgcgaggcctgctcgggttcgtggggacactgttgctgcccttatgcctggctacacctctgaccgtgtctttgcgggcacttgtggccggtgccagcagggcgcctccagccagggtcgcctctgccccttggtcctggttgctagttggctacggcgctgccggattatcatggtccctctgggccgtcctgtctcccccaggcgctcaggagaaggaacaggatcaggtcaacaacaaagtgctcatgtggaggttacttaagctctcgcggcctgacctgcccctcctcgttgccgcattcttcttcctagtcctggctgtgctgggagaaacccttattcctcattactccgggagggtcattgatattctcggtggggactttgacccacacgcattcgcgagtgctatcttcttcatgtgtctgtttagtttcggctcttctctgtcagccggatgtaggggaggctgctttacctacactatgtcacggataaacttgcgaattcgggagcagcttttcagttcccttctccggcaagatcttggtttcttccaggaaacgaaaaccggtgaacttaactcgcggttaagctccgacactacattgatgtccaactggctgccactgaatgctaatgtcctgctgaggtcactggtcaaagtggtgggcctctatggctttatgctgagtatcagtccacgactgacacttctgagcctgttgcacatgcctttcactatcgccgctgagaaagtctataacacccgacatcaggaggttctacgagagatacaggacgccgtagccagggctgggcaagtggttcgggaagccgtggggggtctgcagacagtgcggtcctttggagccgaagaacacgaggtgtgccgctataaagaagcccttgaacagtgtcggcagctttactggaggcgcgatctggagagagctctgtatctgctagtgagacgggtcttacacctcggcgtgcagatgctaatgcttagctgcgggctgcaacagatgcaggacggcgagttgacacaaggcagcttgcttagtttcatgatttatcaggagagtgtcggcagctatgtgcagacactggtctatatatatggagacatgttatcaaatgttggcgcagctgaaaaagttttttcatacatggaccggcagccaaacctgccatctcccggaacactggcacccacaactctccagggagtggtaaagttccaagacgtgtcctttgcctatccaaatagaccagataggccggtcctgaagggactaacttttactctgcgtcccggtgaggtgaccgcacttgtcggtcccaacgggtctggaaagtctactgtggccgcactgcttcagaacctgtaccaacccacaggagggcaggttctgcttgatgaaaaacccatctctcaatacgaacattgctacctgcacagtcaggtggtgtctgtggggcaggagcccgtcttgttttccggaagcgttcgcaacaatatcgcgtatggcttgcagtcatgcgaggatgacaaagtgatggctgccgctcaagcagcccacgccgatgacttcattcaggagatggaacacggaatttacactgacgtaggcgagaaggggagccaattggcggcaggccagaagcagcgcctggctattgcacgagccctggtaagggatccacgggttctcatcctagatgaggccacatctgctcttgatgtccagtgtgagcaggccaagacactgtggaagttcatgatcttttag

SEQ ID NO: 244873 - DNA, 2061 bp, Artificial Sequence
  Description of Artificial Sequence: Synthetic coding sequence
atgagactcccagacctgcgcccttggacgtccctactactggtggatgctgcattactgtggctgctgcaagggcctctgggcacgctgcttccacaaggattgcccggtctttggctcgagggtacactacgcctgggcggactgtggggtcttctgaagttgaggggtcttctgggattcgtggggactctgctgctcccactgtgcctggctactcctctgactgtgtccttacgggctctagttgcgggtgcttcccgggctccgcctgccagggttgctagcgccccatggagctggcttctggttgggtatggagccgcagggctgagctggagcctctgggccgtgctgtctccccctggcgcacaggagaaagagcaggaccaagtgaataacaaagttctgatgtggaggctcctaaagctgtcacgccctgacctccctctcctggtcgctgcttttttcttcctggtgctagcggtactgggagagacattgattccacactacagtggaagagtgatagatatacttggtggtgactttgacccccacgcattcgcttctgcaatatttttcatgtgtctcttcagtttcgggagcagtttaagtgctgggtgccgcggaggatgtttcacctacaccatgtccagaatcaaccttaggatcagggaacagttgtttagtagtctgttgaggcaggatcttggctttttccaagagactaaaactggcgagcttaacagccggctgtcctcagacactaccctgatgtctaattggctgcctctcaacgccaatgtcttgctgcgtagtctagtgaaggtggttggactgtacggcttcatgctttcgattagccctcggctcacactgctcagtttgctgcatatgccattcaccatcgccgctgaaaaagtttataatacaaggcatcaggaggtgctgagggaaattcaggacgccgtggcgagggcaggacaagtggtaagggaagcagtgggcggactccaaacagtgcggtcattcggagcagaagagcatgaggtttgcagatataaagaagccttggagcagtgcagacaactctactggcgcagggatctggagagagctctatatctgttagtccggcgagtgttacacctgggggttcagatgttaatgttgtcctgtgggctccaacagatgcaagacggggagttaacacagggatcccttttatcttttatgatctatcaggagagtgttggcagctatgtccagaccctcgtttacatctatggcgacatgctgtccaatgtaggcgctgccgaaaaggtgttctcctatatggaccggcagcctaacctgccctcccctgggacactggcacccactacgcttcagggagttgttaaatttcaagatgtttcctttgcctacccgaataggccagataggccagtgctgaaaggcctcacgttcacattgcgacctggggaagtcactgcattagtcggtcccaacggtagcggcaagagcactgtagctgctctgctccaaaacctctaccagcctactggtggacaggtgctgttagacgagaaaccaataagtcagtatgagcattgttacctgcatagccaagtggtcagcgtgggacaagaaccggtgctgttcagtggaagcgtcaggaacaacatcgcctatggccttcaatcttgcgaggacgataaggtcatggcggcagcgcaggcagctcacgccgatgactttatccaagaaatggagcacggcatctacacagatgttggcgagaaaggaagccagctggccgctgggcagaaacagcgcctagctatcgctcgcgcattggtccgggacccccgagtactgattctggatgaagccaccagcgccctggacgttcagtgcgaacaggcattacaggactggaatagcagaggcgatcggacagtcttagtgatcgcccaccgcctgcagaccgtgcagagagctcaccagatcctggtcttgcaggaaggcaagttacaaaaacttgcacaactgtag

SEQ ID NO: 244874 - DNA, 1962 bp, Artificial Sequence
  Description of Artificial Sequence: Synthetic coding sequence
atgaggttgccagacctcagaccatggacctctcttctactggtggatgcagctctgctgtggttactccaagggcctttaggtacactgctcccccaagggcttcctggcctgtggctcgagggcacactgcgcttaggcggactttgggggttactcaagctgcgcggtctgcttggattcgtgggcacattactactacctctgtgtcttgcaacacccctcacagtgtccctgcgagcactcgtggctggagccagccgcgctccacccgctagagttgcttccgctccatggagctggctcctggttgggtatggagccgctggcctgagttggagcctgtgggcggtgctgtctccaccaggggcacaggaaaaagagcaggaccaggttaataataaggtcctgatgtggcggctgctcaagctcagccggccagatctgccattacttgtggcggcatttttttttctggtgctcgctgtgctgggagaaacgctgattccccattattccggcagggtgattgatattcttggcggagatttcgaccctcacgcttttgcatccgcaattttcttcatgtgtctgttcagtttcggtagttccctttctgcaggctgcaggggcggatgctttacatacacaatgtcaaggataaatctacgaattagagagcagttgtttagctcactcctcagacaagatctggggtttttccaagaaacaaagacaggcgagttgaactcccgtctgtcatcagatacaacacttatgagcaactggctacctctgaacgctaatgtgctgctacggtccctcgtgaaagtggtgggcctttatggatttatgctgtcaatttcacccagactcaccctgctgagtttgctgcacatgccgtttacaattgctgctgaaaaggtttataacacacgccatcaggaggtgctacgagagatccaggacgctgtggcccgagcaggccaggtagtgcgggaggccgtggggggtttgcaaacggtgcgctcattcggggcagaggagcacgaagtctgccgatataaggaagccttggaacaatgccggcagctctactggcgaagggatctggagagggccctctacctgctggtgaggcgagtcctccatttgggcgttcagatgttgatgttgtcatgcggcctgcaacagatgcaggacggtgaactgacccagggttcattgctttccttcatgatctaccaggaatcagtgggatcttacgtccagactctggtctatatctacggggacatgctgtctaatgtgggtgctgcagagaaagttttcagctacatggacagacaacctaatttgccaagccccggtaccttggcccctactaccttgcagggggtggtgaagttccaggacgtctccttcgcttaccctaaccggccagacaggccagtcctgaaaggactgacctttacgctgcggcctggggaggtcaccgccctggtgggccctaacgggagcggaaaaagcaccgtcgctgccctgctgcagaacctttaccaaccaaccggaggacaggtgctgttagacgagaagcccatctctcaatacgagcactgttatttgcactcacaggttgtttccgttggacaggagcctgtgctcttctcgggctctgtccggaacaacatcgcttatggcctgcagtcatgtgaggatgataaggtgatggccgctgcacaggcggcacacgccgacgactttatacaggagatggagcatggaatctatacagatgtgggcgaaaaggggtcacaactggctgcaggacaaaaacaaaggctggccatcgcaagggccctggtcagggatccccgtgtgctgatcctggatgaagccactagtgcactggatgtgcaatgcgagcaggcaaagacactctggaaattcatgatcttttag

SEQ ID NO: 244875 - DNA, 1962 bp, Artificial Sequence
  Description of Artificial Sequence: Synthetic coding sequence
atgcgtctgccagacctgcgcccatggacatccctcttgctggtggatgctgccctattatggctgcttcaaggccctttaggcaccctcctccctcagggcctgccaggcctttggttggagggaaccctgaggcttgggggactgtggggcctcttgaagctgagagggcttctgggcttcgtaggcactctgctactgccgttgtgtctggccaccccactcacagtgagtctgagggccctagtggcgggtgcctctagggcccctccagctcgggtagcttctgctccatggagttggctgctcgttggctatggggctgcaggactaagttggagcttgtgggcagtgctcagccccccaggcgcacaagaaaaagagcaggatcaggtcaataataaggtgctgatgtggcgtctgctgaaattgtcccgccctgatttgcctctgctggtcgccgcttttttcttcctggtcctggctgtgctcggcgagaccctcattccgcattactcggggagagtgatcgacatcctggggggtgactttgatccccacgcttttgcgtctgccattttcttcatgtgcttgttttccttcggatccagtctgtctgccggatgtcggggaggatgctttacttacaccatgtccaggataaacctccgcatcagagagcagctcttcagctcgctgctgcggcaagacctcggattcttccaggagacaaaaacaggagagttgaattccagactctccagcgacacgacccttatgtcaaattggctaccactgaatgccaatgtcctcctacgctcactggtcaaggtggtagggttgtatgggttcatgctgtccatctccccacggctcaccctgctttccctgctacacatgccattcaccatcgcagccgagaaagtatacaacacacggcatcaggaggtcctgcgggaaatccaagatgctgtggcccgagctggtcaggtggttagggaggctgttgggggactccagacagtgcgatccttcggtgcagaggaacacgaggtgtgccgctacaaagaagccttagaacaatgccgtcagttatactggcgcagggatttggagcgcgcattgtaccttctggtgcggcgtgtcctccacttgggtgtgcagatgctaatgctctcttgtggtctgcagcagatgcaggacggggagctgacacaggggagcctgctgtctttcatgatctatcaagaatccgtggggtcatacgtccagacactcgtctacatttacggcgacatgctgtcaaatgtgggagctgctgaaaaagttttctcttacatggaccgccagccaaatctgcctagccctggaacactagcacctactacacttcagggtgtggttaaattccaggatgtgagcttcgcatacccaaacagacccgacagaccagtgctgaaaggcctaaccttcaccctgcggccaggagaggtgacagctctggtgggcccaaatgggtctggtaaatcgacagttgctgccttgctccaaaacctatatcagccaaccggcggtcaagtactgttggatgagaagcccataagtcagtatgagcattgttacttacactctcaggtggtgagcgttggacaggagccagttttgtttagtggttctgtcagaaacaacattgcttatggcctccagtcctgtgaagacgataaagtgatggcggcagctcaggcagcccacgccgatgacttcatccaggagatggaacatggaatttatactgatgtcggtgagaagggtagtcagctggcggcaggccagaagcagcgcctggctattgccagggctctggtgagagacccacgcgtgctgattttagatgaggcaacctcagccctcgacgtacagtgtgaacaggctaagaccctctggaaattcatgatattttag

SEQ ID NO: 244876 - DNA, 2061 bp, Artificial Sequence
  Description of Artificial Sequence: Synthetic coding sequence
atgcggttgccggatcttcggccatggacctccctattgctggtagacgcagccctcctctggctgcttcagggcccactcgggactctcctgcctcaaggcctgcccggtctatggctggaggggaccctcagactcgggggtctgtggggcctgttgaaacttaggggattgctggggttcgtcggaacactcttgttacctttgtgcctggcgaccccgctgaccgtgtccctacgtgctctcgttgctggagcaagtcgtgccccaccggctcgagtggcatccgcaccctggtcgtggctcctggtagggtacggcgcagccggattgagctggagcctatgggccgtgctcagccccccaggggcacaagagaaggaacaggatcaggttaataacaaggtcctaatgtggcgtctcctgaagcttagtcgacccgatctgcctttgctcgtggccgcttttttttttctggtcctcgcggtcctgggcgagactctgatcccccattatagcggccgagtaatcgacatcctcggtggagactttgatccgcatgcatttgcctcagcaatctttttcatgtgcctatttagcttcggatcatcactgtcagccggttgcagagggggttgttttacctatactatgtcccgcattaatctgaggatccgtgaacagcttttttcgtcactattgagacaggatctggggttctttcaggagactaagacaggcgagctcaactctcgcctgagttctgatactactttgatgtctaattggctcccactgaatgctaacgtgttactgcggagcctagttaaggtagtcgggctgtatggctttatgctctcaatctctcctcggctcacactcttatcgctcctgcatatgcctttcaccattgctgccgagaaagtgtataatactaggcaccaggaagtcctgagagaaatccaggacgccgtagctcgcgctggccaagtggtcagggaggctgtgggcggacttcagaccgtccgcagttttggtgccgaagaacacgaggtgtgccgctataaagaagctctggagcagtgtcgacagctatactggagacgtgatttagagcgtgccctgtacctgctcatcagaagagtgctacacttgggcgtgcagatgctgatgctctcatgtggtttacaacagatgcaggatggggagttaacgcagggtagcctattgtccttcatgatatatcaggaaagcgtcggctcctacgtacagaccctggtgtacatctacggagacatgctgagcaatgtgggggcagcggaaaaagtattcagctacatggaccgacagcctaatcttccttccccaggaacattagccccaacaacattgcagggcgtagtgaaatttcaggacgtgagtttcgcctaccctaatcgacccgatcggcctgtcctgaaggggctgacattcaccctccgaccaggcgaagtaactgcactcgtgggccctaatggttcgggaaagtcaactgtcgccgctctgctgcagaatctgtaccagcccacaggcggacaggtattgctcgacgagaaaccaattagtcagtacgagcactgttacctccacagtcaggttgtgtctgtgggccaagaaccggtgttgtttagtggaagcgtgcggaataatattacatatggactgcagtcatgcgaagacgacaaggtgatggccgctgctcaggcggcacatgctgacgattttattcaggagatggaacatggtatttataccgacgtgggtgaaaagggttcccagctcgccgcaggccagaaacaacgccttgcgattgccagggccctcgtccgggatccccgagtgctcattttagacgaagccacttcagctcttgatgtgcagtgtgaacaggcgttgcaggattggaactctcggggagaccgtaccgtgctggtgatcgcccaccggttgcagaccgttcagcgcgctcaccagatcctggtgctccaggaggggaagttgcaaaaactggctcagctgtag

SEQ ID NO: 244877 - DNA, 1962 bp, Artificial Sequence
  Description of Artificial Sequence: Synthetic coding sequence
atgcgcctgcccgatctacggccatggactagcctgttactggtcgacgcggcactgttatggctgctgcaaggacccttgggcacactacttccgcagggattgcctggcctttggctagaaggtactcttaggctgggcggtttgtggggactgctcaaactaagggggctcctcggattcgtgggtacccttctgctgcctctgtgtctcgccacccctctgaccgtttcacttcgcgctttggttgctggcgctagtcgggcaccacctgctagggttgcaagcgctccctggagctggctgctagtcggctacggggctgccggactgagctggtccctttgggccgtgctgtcacccccaggtgcacaggagaaggaacaggatcaagtcaacaacaaggtgttgatgtggagacttttgaaactgagccgcccagatctgcctctcctcgtggccgcattcttcttcctcgtactcgctgtgctcggcgaaaccttgataccgcactacagcggtcgggtcattgacatactgggcggagatttcgacccacatgcatttgcatccgcaatcttttttatgtgcctcttctcttttggatcgtctttgagtgcgggttgcagaggtggctgttttacctacacgatgagcaggatcaacttgaggatcagggagcagctttttagcagcctgctgcgccaggatctgggcttttttcaagagactaagaccggagaattgaactctcgcctttccagcgacacaacactgatgagcaactggcttcctctgaacgcaaacgtgctgctgaggtctcttgtgaaggtcgtcgggctgtatggcttcatgctcagtatcagtcctagattaacgctcctgagtctgttgcatatgccttttactattgcagctgaaaaagtgtacaacacacgccaccaggaggtgctgagagagatccaagatgcagtggcgagggccggacaagtggtcagggaggctgttggagggcttcagacagtacggtcattcggggctgaggagcacgaagtgtgtcgctataaggaggctttggaacagtgtagacagctttattggcgccgagatttggagagggcgttgtatttgttggtaagaagggtgctgcatctcggcgtacagatgttgatgctgtcgtgcggtctgcagcaaatgcaggatggggagctgactcagggttcacttctctcgttcatgatctatcaggaatcagttggtagttatgttcagactttagtatacatatatggggatatgctgtccaacgtcggcgctgcagaaaaggtgttcagttacatggacaggcagccaaatctcccatctcctggcacacttgccccaacaactctgcaaggtgtggtgaagttccaggacgtgtccttcgcatatcccaacagacccgataggcccgtactgaagggcctcacattcacactccgccctggcgaagtgacagcgcttgtgggtccaaacggatccggtaagagtacagtcgctgccctgctccagaacctgtatcaaccgactggtgggcaagtgctgcttgacgagaaaccaatatcccagtatgagcattgttatctgcacagccaagtcgtctccgtaggtcaggaacctgtcttattttctggctccgtccgcaacaatattgcgtacggtcttcagtcctgtgaggacgacaaagtcatggccgctgcgcaggccgcacacgcggacgatttcatacaggagatggagcacgggatttacaccgacgtaggtgagaaagggagccagctcgccgcagggcagaaacaacgcttggcaattgccagggcacttgtccgcgatcctcgcgtgctgattctcgacgaggcaacgtctgctctggacgtgcagtgtgagcaggcgaagaccctgtggaaattcatgatcttttag

SEQ ID NO: 244878 - DNA, 1962 bp, Artificial Sequence
  Description of Artificial Sequence: Synthetic coding sequence
atgcgcttgcctgacctacggccttggacctcgctactgttggtggatgcagcactcctttggctgctgcaaggtccactggggactctgctgccccagggtctacctggcctgtggctggagggaacacttaggttaggcggactatggggcctgctgaagctcagaggcctgcttgggttcgtggggacactattgctgccactgtgcctcgccacccccttgaccgtgtccctgcgcgcactcgtcgcaggtgcttctcgagctccacctgctagagtcgcgtctgcaccctggtcttggctgctggtcggctacggagccgctgggctaagctggagcctgtgggcagtgctgtctccccctggggctcaggagaaggagcaggaccaggttaacaacaaggtactgatgtggagactcttaaagctctcacgtccggatctgccacttctggtggcagccttctttttccttgtgctggcagtgctcggggaaacgctgatccctcactacagtggccgagtaatcgacatcctcggtggcgacttcgacccacacgcttttgcctccgccatcttcttcatgtgcctgtttagcttcggttccagcctgagtgcaggatgcagggggggatgctttacctacacaatgtcacgtatcaatttgaggattcgagaacagctcttcagcagtcttctgcgccaggatttgggattcttccaggaaactaagactggcgagctcaactcccgtctgtctagtgacacaacattgatgtccaactggctgcccctaaacgcgaacgtcctgctccgcagcctggtgaaggtggtgggattgtacggtttcatgctctcgataagtcctcgactcactctgctgtccctgctgcatatgccatttaccatcgcagctgagaaagtctataataccagacatcaagaggtcctgcgggaaatacaggatgcggtggcccgagctggacaggttgttagagaggccgtgggcggactccaaaccgtccgttccttcggcgcagaggagcatgaggtctgcagatataaagaagccctggagcagtgtcggcaactgtactggcggagggatctggagagggctctctatctgctggtacgacgtgttctacatctgggcgttcagatgctcatgctttcatgtggacttcagcagatgcaggacggtgaactcacccagggctcccttttaagttttatgatctatcaggaatccgttggatcctatgtgcagaccttggtatatatttacggtgatatgctctccaacgtgggcgctgctgagaaggtgttcagttatatggacaggcaacccaacctcccctcacccggaactctggccccaacaacgttgcagggagtggtcaaattccaggatgtgtcatttgcatatccaaatcgccctgatagacctgtgctgaaagggctgacatttaccctcagacctggcgaggtgacagccctggtcggtccaaacggctccggcaagtcgaccgtggcggctcttctacagaatctgtatcagcccaccgggggacaggttttactggacgagaaaccaatctcccagtatgagcactgttatctgcacagccaagtggtgtctgtcggccaagaaccagttctttttagcgggagcgtccgcaacaacattgcctacggattgcagtcctgcgaggacgataaggtgatggccgcagcccaggctgctcacgcagatgactttatccaggaaatggagcatggaatctacacagacgtcggcgaaaagggctcccagctggctgcagggcaaaaacaacggctcgctattgctcgagctcttgtcagggaccctcgcgtgctgatccttgatgaggccacatcagccctggacgtgcaatgcgagcaggctaaaactctgtggaagttcatgattttctag

SEQ ID NO: 244879 - DNA, 2061 bp, Artificial Sequence
  Description of Artificial Sequence: Synthetic coding sequence
atgcggttgcccgatctgcggccttggacctccctgctgctggttgatgcggcactgctttggttactgcagggccctcttggtacacttcttccccagggactacctgggttgtggctcgaagggactctgcgactgggaggcctctgggggcttctgaaactccgtggactgctcggctttgtgggcaccttgctgctccccctctgtctggcaaccccactgactgtttccctgagagctcttgtagctggtgcttcgagagccccacctgctagggtggcatcagcaccatggtcatggctccttgtaggatacggagcggcaggcttgtcctggtctttgtgggccgtgctgtctccgccaggggctcaggaaaaagaacaggaccaggtgaataacaaagttctgatgtggagactgctaaagttatcccgcccagatttgcctctgttagttgccgcttttttttttcttgtccttgccgtgctgggggaaactctcattcctcactattctggacgcgtcatcgatattctggggggagattttgatccacatgccttcgccagtgcgatctttttcatgtgtttgtttagttttggttcgagtctgtccgccggttgccggggtggatgttttacctacaccatgagccggatcaacctgaggatccgcgaacagttgttttcctcattactgaggcaggatctgggcttcttccaggaaacaaagactggtgaactgaactccaggctgagctcagacactacgcttatgtctaactggttgccactgaatgcgaacgtgctcttgcggagtctagtgaaggtggtaggcctgtacgggttcatgctgtcgatcagcccccgactgacactgctgtccctgttacacatgccatttaccattgccgctgagaaggtctataatacaaggcaccaagaagtgctgcgggagatccaggatgccgtggctcgggcaggccaggtagtgcgtgaggcagttggaggtctgcagactgtgaggtcattcggcgcagaggagcatgaggtatgcagatacaaagaagctctggagcagtgtaggcagctatattggagaagggacttagaacgggctttgtatctgctcgtcagacgcgtcctgcacttgggagtgcagatgctgatgctaagttgcggccttcaacagatgcaggacggtgaactgacacagggaagcctgctgagttttatgatttatcaggaatccgttggctcttatgtccagacattagtatatatctatggtgacatgctgagcaatgtgggggctgccgagaaggtcttctcttatatggataggcagcctaatctgccctcccctggaactctggctcccacaacactacagggtgtggtcaagttccaggacgtctcatttgcctatccgaatcgtcccgatcgacccgtattgaagggcctcactttcacacttagaccaggggaagtgacagcattggtgggaccaaacgggagcgggaagtccacggtggcagctctactacaaaacttgtatcagccaaccggcggacaagtgctgctggacgaaaagcccataagccagtacgagcattgctatctgcacagccaggtggtgtctgtgggtcaggagcctgtgctctttagtggatctgtcaggaacaacattgcttacgggttgcagagttgcgaggacgataaggtgatggcagctgcacaagccgctcatgctgacgactttattcaggagatggaacatggcatctatactgacgtgggcgaaaaaggcagccaactggccgcaggtcagaagcagcggctggctatagctcgagcattggtccgagaccctcgtgtccttatccttgacgaggccacctccgccctcgacgtacagtgcgagcaggcccttcaggactggaattcacgcggtgatcgcactgtcttggttattgctcaccgcctgcaaactgtgcagcgtgcacaccagatactggtcctgcaggaaggcaagctgcagaaactcgcgcagctctag

SEQ ID NO: 244880 - DNA, 1962 bp, Artificial Sequence
  Description of Artificial Sequence: Synthetic coding sequence
atgcgcttacccgatcttagaccctggacatctcttctcctggtggacgctgcactactgtggctactgcagggcccacttggaactctattaccacaaggtctccccggtttgtggctggaaggcacactgcgcttaggaggactctgggggcttcttaaactgcgaggactgctgggattcgtcgggactctcctgctgcctctgtgcctggccacacctctcaccgtgtcactacgagcgttagtcgcaggtgcttctcgtgcccctccagcccgagtggcctctgcaccgtggtcctggctactagtaggctacggagctgctgggttatcgtggagtctctgggccgtgttaagccccccaggggcacaggaaaaagaacaggatcaggtgaataataaagttttaatgtggaggcttctgaagctctctcggcctgatttacccctgctggttgccgcattcttcttcctcgtgctagccgtcctgggtgagaccctaatcccacattattcaggacgcgtgatcgacattttgggcggagattttgacccccacgcgttcgcttcagctatctttttcatgtgcctgttctcctttggtagcagccttagtgcgggatgtcgcggtggctgttttacgtatactatgagcaggattaatttgagaattcgagagcagctttttagctctctgttgagacaggacctaggcttttttcaggaaactaagacgggcgagctgaattctaggctgagctctgacacgactttaatgagcaactggcttccccttaatgccaacgtcctcttaagaagcctggtgaaagtcgtcggtctctacggcttcatgttgagcattagtccacggttgacactgctgtccctgttgcatatgccttttaccattgctgccgagaaggtatataatactcgtcaccaggaagtgttgcgcgaaatccaagatgccgttgctcgagccggacaggtggttcgcgaggcagtcggaggcttgcaaaccgtacgaagttttggtgctgaggagcacgaggtatgcagatacaaggaggcacttgagcagtgcagacagctgtattggcggcgtgaccttgagcgggctctgtacttgctcattagaagggtgctccacctcggcgtgcaaatgctcatgttatcatgcggtctacagcaaatgcaagatggcgagctgacccagggcagcttactgagctttatgatttatcaagagtcagtgggctcttatgtgcagacacttgtgtatatttatggggacatgttatcaaacgtgggtgccgctgagaaggtcttttcctacatggatcgacaaccaaatctccctagcccaggtacgttggccccaacaactttgcagggtgttgtgaagttccaggatgttagtttcgcgtatcccaaccgtcctgataggcccgtactaaagggcttgacctttacacttagaccaggagaggttaccgcactcgtcgggcctaacggcagtgggaaaagcaccgtggccgctttgctccagaatctgtaccagcccaccggaggacaggtcctgctcgatgagaaacccatctcccagtatgagcactgctatttgcactcacaggtagtgtcagtcggccaagaacccgtattgttcagtgggagcgtgcgaaacaacattacatacggcctgcaatcatgtgaagatgacaaggtgatggctgccgctcaggccgctcatgccgacgactttattcaagagatggaacacggcatctatacagacgttggggaaaaaggcagtcagcttgccgcaggccagaagcagcggctcgctatcgctcgtgctctcgttcgagacccacgtgtcttgatcctggacgaagccacatccgcgctggatgttcagtgtgaacaggctaagacgctgtggaagttcatgattttctag

SEQ ID NO: 244881 - DNA, 1962 bp, Artificial Sequence
  Description of Artificial Sequence: Synthetic coding sequence
atgcgactcccagatctgcggccatggacatctctcctgctagttgacgcagctcttctttggctgctacagggtccactcggaacactgctcccccagggccttccaggcttgtggctggaggggaccttgaggcttgggggactgtggggcctgcttaagctccggggactgcttgggtttgtcggcacattgcttctccccctatgtctggctacaccgttgaccgtgagtttgcgagcactggtggccggagcatccagggcgccacctgctcgagtggcctcagccccatggagctggctgctcgttggatacggggcagcgggtctgagttggtcactgtgggctgttttgtccccgccaggcgcacaggaaaaagaacaggaccaggtcaacaacaaagtgctgatgtggagactcctgaaactgagtcgccctgacttgccgcttcttgtcgcagcgttctttttcctcgtgctggccgtgttaggtgaaacactcattcctcattactctggcagggttatcgatatcctggggggtgacttcgatccacacgcctttgccagcgccatcttttttatgtgtttgttttccttcgggagtagtctcagcgccggatgcaggggcggttgctttacgtacactatgagcagaattaatctaaggattcgagagcagctcttctcctccctgctgagacaggacttgggatttttccaggagactaaaactggcgagctgaacagtcgcctcagtagcgataccactttgatgagcaattggctgcccctgaatgctaatgttttgctaagatcacttgtaaaggtggtggggctctatggttttatgctgtccatatccccccgactcaccctactgagcctgctgcacatgccatttaccatagccgctgagaaggtgtacaatactaggcaccaagaggtcctacgcgaaattcaagacgccgtggctcgggctgggcaagtggtgcgtgaagcagtgggaggactgcagaccgtcagaagcttcggagccgaagaacacgaggtgtgccggtacaaagaggccctcgaacaatgtagacagttgtactggaggcgggatctggaacgcgcactctatctcctcgtaagacgagtgctgcatttgggcgtgcagatgctaatgttaagctgtggcctccagcaaatgcaggatggcgagcttactcaggggtcacttctgagttttatgatctatcaagaatccgttggatcctacgtacagaccctagtgtacatctatggagatatgctctcaaacgttggcgctgctgagaaagtgtttagctatatggacagacagccaaacttgccctctccgggaacactcgccccaaccaccttgcagggcgtcgtgaagtttcaggacgtttcattcgcataccctaatcggcctgacagaccagtgctcaaaggcctgactttcactcttaggcccggtgaggttactgccctcgtggggcctaacggttctgggaagtccactgtagctgcactcttgcaaaacctttaccagcccactgggggacaggtactgttggacgaaaagcccatctcccagtacgagcattgttatttgcactcacaggtcgtttcagtcggccaagaacctgttctctttagtggttccgtcagaaacaatatcgcgtacggcttgcagagttgcgaggacgacaaagttatggccgcagctcaggctgcacatgccgatgatttcattcaggaaatggagcatggcatttataccgacgttggggagaaggggtcccagctagcagcaggacagaaacagcgattggcaatcgccagggctctggtgcgagaccctagagtgctaattctcgatgaggctacatctgcgcttgatgtgcagtgcgagcaggctaaaactctctggaaattcatgatattttag

SEQ ID NO: 244882 - DNA, 2112 bp, Artificial Sequence
  Description of Artificial Sequence: Synthetic coding sequence
atgcggctgccagatctcagaccctggacgtccctgttactagttgacgccgctctcctgtggctgctgcagggccctctcggcactctcctgcctcaggggctgccaggtctgtggctggaaggaacattaagactgggaggattatggggcctgctgaaactgagaggacttctcggcttcgtcggcacattgctgctgcccttatgtcttgccaccccactgacagtgagcctgcgggctctggtggcgggtgcctcccgggctcctcctgcaagagttgcatccgcgccatggtcatggctcctggtcggctacggcgctgcaggtttgagctggtcactctgggcagtgctctcccctccaggtgctcaggagaaagagcaggaccaggtgaataataaagtcctgatgtggagactactcaaacttagcaggccagacctgcccctgctcgtggcagcctttttcttcttggtactcgctgtgctgggggagaccctgataccccattactctgggcgtgtcatcgatatcctggggggagattttgatccccacgctttcgcaagcgccattttttttatgtgcctgttttcgttcgggagctccttgagtgctggctgtcgcggaggttgttttacatacacaatgtcaagaattaatctgcgcatccgggaacagcttttcagctccctgttgcgccaagacttgggattttttcaagagacaaagacaggtgagctgaattcaagattgtccagcgatactactctcatgagtaactggctcccccttaatgccaacgtgctgctgagatccttggtaaaagtagttgggctctatggattcatgctgagcatttctcctcgactgaccctgcttagtttgcttcacatgccatttactatagcagctgagaaagtgtataacacaaggcatcaggaggtgctgagggagatccaggacgccgttgctcgcgctggacaagttgtgcgagaggcggtgggcggtctgcaaactgtacgctcctttggtgccgaagaacatgaggtgtgtcgatacaaggaggcactcgaacagtgtagacagctgtattggcggcgtgatctggagcgcgcactttacctcctcgtccggagggtcttgcatctgggtgtccagatgcttatgttgtcctgcggcctgcagcagatgcaggacggcgagctgacgcaggggagcttactttctttcatgatttatcaggagagtgtgggatcttacgttcagactctggtctatatttacggcgatatgctatcaaatgtgggcgcagccgagaaggttttcagttacatggaccgtcaacctaatctccccagtcctggtaccttagcacccactacgttgcaaggcgtcgtcaagtttcaggacgtaagtttcgcttacccaaatagacctgatcgcccagtccttaagggcctgactttcactctaaggccgggagaggtgaccgcattggtgggaccaaatggctcaggaaagtccacggtagctgcgctcctgcagaacctttatcagcctactggaggtcaggtgctactcgacgaaaagcctatcagccagtacgaacactgttatcttcacagccaggtggtatccgtggggcaggaaccggtgctcttttccggttccgtgcgcaacaatatcgcttacggcctacagtcttgtgaagacgataaagtcatggcggctgctcaggcggctcatgcagacgactttatccaagagatggagcatgggatctacaccgatgtcggagagaaaggttcacagctggccgcagggcaaaagcagagactggccattgcacgcgctctggttcgggaccctcgggtgctgattctcgatgaggccacatcggcgctggatgtccagtgtgagcaggcgctgcaggattggaacagtagaggagacagaaccgtgctcgtaatcgcccatagactgcaggctgttcagagggcccatcagatcctagtcctgcaggaggggaagctccaaaaactcgcacagcttcaggaaggtcaggatctctatagcaggctcgtgcagcagcgcctgatggattag

SEQ ID NO: 244883 - DNA, 2112 bp, Artificial Sequence
  Description of Artificial Sequence: Synthetic coding sequence
atgcgcctcccagatttgagaccatggacctccctgctgctggtggatgcagccttactgtggctcctgcagggtccactcggcactttgttaccacagggtctgcccggactgtggcttgagggcaccctgaggctcggaggcctctggggtcttctgaagctgagggggttgttggggtttgttgggacccttctccttcctctgtgcctggccactcctctcaccgtgtcccttcgggctcttgtcgcaggagcatcaagggccccaccagcacgagtggcatccgccccatggagttggctgttagttggctacggggctgccggtctatcatggtcactgtgggccgtgctcagccctcccggagcacaggaaaaggagcaggaccaagtcaataacaaggtacttatgtggaggctgcttaaactgagcagacccgacctgcccttgctggttgccgctttcttctttctcgttttggcagtgctcggtgagaccttaatccctcattattccggccgtgtcatcgatattctcggcggtgatttcgacccccacgcttttgcaagcgcaatattcttcatgtgcctttttagtttcggttcatctctttcagccggatgtcggggaggctgctttacatatacgatgagccgcattaatcttcgaattcgtgaacagttgttctcctcactactgcggcaggacctaggctttttccaggagaccaagacaggggaactgaatagccggctgtcttcagatacaacgttgatgtccaactggctgcccttaaacgccaacgtgcttctgcgttctctggtgaaggtcgtgggcctgtacggttttatgcttagcataagtcccagattgaccctgctgagcctcctgcacatgcccttcacgatagctgctgagaaagtgtacaacactaggcaccaggaggtgctccgggaaatccaggacgcggtagccagagcaggtcaggtagtgcgggaagcggtcgggggactgcagacggtgcgttcttttggagccgaggagcacgaagtctgccgctacaaagaggctctggagcaatgtaggcaactgtactggcgtcgcgatttagaacgggctctttatctgcttgtgcggagagtgcttcacttgggtgtgcaaatgttgatgctgtcctgtggcttacagcagatgcaggatggagagttgacacaggggagccttctgtcattcatgatatatcaggaaagtgtcggctcctacgttcaaacactagtgtatatctacggcgatatgttgagcaacgtgggcgcagcagaaaaggtctttagctacatggaccgccaacctaacctgcctagtcctggcaccctggctcctaccactctacagggcgtggtgaagtttcaggacgtgtccttcgcctaccccaataggccagaccgaccagtcctgaagggcctgacatttacacttaggccaggcgaagtcaccgccttggtcggccctaacggtagcggcaagtcaactgtggccgctctattgcagaacctgtaccagcctaccggcggacaggtgctcctcgacgaaaaaccaatctcacagtacgagcattgctatctacactctcaggtcgtgtcggtggggcaagagccagtgctgttcagtgggagcgtgagaaataacattgcatacgggctccagtcctgcgaagacgacaaggtgatggcggctgcacaggcagcacatgctgacgattttatacaggaaatggagcatggaatctacactgacgtgggagagaaggggtcccagctcgcggctgggcaaaagcagcggctggctattgctcgcgcactcgtgcgcgatccacgagtgctcatcctcgacgaagcaacttccgccctggacgtgcagtgtgagcaagcactccaggattggaattcacgcggagataggacagtgctcgttattgctcacagactgcaggccgtgcaacgcgcacatcagatccttgtgttgcaagagggcaagctgcagaaactcgcacaactgcaggagggacaggatctttactctagactggtgcagcagcgtctaatggactag

SEQ ID NO: 244884 - DNA, 2112 bp, Artificial Sequence
  Description of Artificial Sequence: Synthetic coding sequence
atgagactgcctgatctaagaccttggaccagtctgttgcttgtcgacgcagccctactgtggctactacaggggcctctgggtactctactccctcagggcctgccgggactgtggctggaagggacgctcagactcggtggactgtggggccttctgaagcttagaggattgctcggcttcgtaggcactctcttgctgccactctgtctcgccactccactgacagtctcactcagagcactggtggctggcgcttccagggcaccccctgccagggtagcatccgcgccatggtcatggttgctggtgggttacggagcggcaggtcttagctggtccctgtgggctgtcctaagtccccctggcgctcaggagaaagagcaggatcaggttaataacaaggtgcttatgtggcgtctgctgaaactgagccgaccagacctgcctctgctggttgccgcttttttctttctggtgctggccgtgctgggcgagacccttattccacattattccgggagagttatcgacatcttaggcggtgatttcgacccacacgcttttgcgtctgctattttctttatgtgcctgtttagctttggcagttctctcagcgctggttgcagaggaggctgctttacatataccatgtcacgtatcaacctacgtatccgagagcaactgttctcctcgctcctgcgccaggacctgggcttcttccaggagaccaaaacgggagagttgaacagtagactgtcttcggacaccactctgatgagtaattggctgcctctgaatgcgaacgtgctgctgagatctctggttaaggttgttggtctatacggcttcatgctctctatatctccacggcttactctgctgtctctgctacatatgccgttcactatcgctgctgagaaagtgtataacacgaggcatcaggaggtattaagagaaatacaagacgccgtggcgagggcgggtcaggtggtgagagaagctgtggggggtctacaaactgtgcggtcattcggggctgaggaacacgaagtctgtaggtacaaggaagccctcgagcagtgcagacaactttactggcggagagacctggaacgtgccctgtacctccttgtcagacgcgtcctgcacttgggcgtccagatgctgatgctttcgtgtggcttgcaacaaatgcaggatggcgaactgacacaagggtcacttctgagttttatgatatatcaggaatcagtaggctcgtacgtccagaccttggtgtatatatacggggatatgctgagcaatgtcggagcagctgagaaagttttctcttatatggacaggcagccaaacctacccagtcccggtaccctggctcctacaaccctgcagggagttgtcaagtttcaggacgtctcttttgcataccccaatagaccagatcgtcccgtactgaaggggctcaccttcacgctccgtcccggagaagtgactgccttagttggacctaatggatccgggaagtccaccgtggccgctctgctccaaaatctttaccagccgacgggtggccaggtactgttagatgaaaaacctatttctcagtacgaacactgctatctccacagccaggtggtgagtgtggggcaggagccagtcttgttttcaggatccgtgcggaataatatcgcgtacgggcttcagtcctgcgaggatgataaggtgatggcagcagcccaagccgctcacgccgatgactttatccaggagatggaacacggtatttacaccgatgtaggcgagaagggctcacaactggccgctgggcaaaagcagaggctcgcaatcgctcgggctctcgtgcgtgatcctagagtcctgatattggacgaggccacatcagcgctggacgtgcagtgcgagcaagccctccaggattggaatagccggggtgaccgcaccgtcttggtcatcgcccacaggctccaggccgtgcaacgcgcacatcagatacttgtcctacaggagggcaaactccagaaactggcgcaactgcaagagggccaggatctctattcacggctcgtgcagcaacgactcatggattag

SEQ ID NO: 244885 - DNA, 2310 bp, Artificial Sequence
  Description of Artificial Sequence: Synthetic coding sequence
atgagactgcccgacctgcgtccgtggacaagtcttctgttggtggacgcggcattgctgtggctgctacagggacccctggggactctgttaccacagggcctgcccggactatggctggaaggcacacttagactgggcggactttgggggctgctgaaactccggggactgttggggtttgtcggtaccctgttactgcccctgtgcctagctactccactcactgtatcccttcgggctcttgttgccggagcatctagggcaccccctgctcgggtagcctcagcaccttggtcttggttgctggtagggtacggagcggcagggttgagctggagcctttgggccgtcctgtctcccccaggggctcaggaaaaagagcaggatcaagtgaacaataaggtgctgatgtggcgtttgttgaagctatcgcgcccagatttgcctctcctggttgccgcatttttctttctggtactggctgtcctgggggaaactctgatccctcactactccgggagagtcattgatatcttgggtggagactttgatcctcacgccttcgcatcagccatattttttatgtgcctattctcatttggatcgtcactgtctgctggttgcagggggggatgttttacctatactatgtccagaatcaacctgcggatcagagagcagctctttagttccctgctgaggcaagatctcggctttttccaagagaccaaaactggtgagctgaactccagactctcatcagacaccaccctgatgtctaactggctgcccctgaacgccaacgtcctgctgaggtcactggtcaaggtagtcgggctatacgggttcatgttgtccatcagtcctaggctcaccttgctttctctcttgcacatgccttttacaattgccgcagaaaaggtttataacactaggcaccaagaggttctacgcgaaattcaggacgccgttgcaagagcgggacaggttgtgcgggaggccgtcggagggctccagacagtccgaagctttggggctgaagagcatgaagtttgtcgatacaaggaggctctcgagcagtgcagacagctatactggaggcgagatctggagcgcgctctgtatctgttggtccgaagggttctacacctgggtgttcagatgttgatgttatcgtgtggcctccagcagatgcaggatggggagctgacccagggtagtttgttgagctttatgatttaccaagaatctgtcgggtcttacgtgcagaccctagtttatatttacggggacatgctgagcaatgtgggcgctgcagaaaaggtgttttcatatatggacagacagcctaaccttccttcacccggaactctcgccccaacaaccttacaaggggtggtgaaattccaagacgtatcctttgcctatcctaatcgccctgaccggcctgtgttaaagggtctcacctttaccctcaggccaggggaagtcactgcactggtgggaccaaatggaagcggcaaatcaactgttgccgctctgttacagaatctataccagcctaccggtggtcaagttctgctggatgaaaaaccaatctcacaatacgagcattgttatcttcactcccaggtcgtgtcagtgggccaagagcccgtgttgtttagcggatcagtgcgaaacaacatcgcctatggtctccagtcctgtgaggatgataaagtgatggcagccgctcaggccgcacatgcagatgactttatccaggagatggagcacggtatttacacagatgtcggggaaaaaggatcacagctcgccgctggacagaaacagcggctggcaatagccagggctctcgtcagagatcccagagtcctgatcctggacgaagcaacttccgctctcgacgtacagtgcgagcaggcaaacggattttgggtgggcccactcgggggtgggtcggctagcgagtcagacccaactggctttctccatgactctcgtcacagacttagttccgacgtgggaatgtttgtggccctgaccaagcttggccagcccgatgcagagcagtggaattcaagattagatttactggagagatcccgtcaggctgtcgatggtgtgtgccggcacaactataggctcggggctcccttcacagtgggacggaaggtgcagcctgaggtaaccgtctatcccgagcgtaccccccttttgcaccagcataatctcctgcactgcagcgtgactggattttatccaggtgatataaagataaaatggttcctcaatggccaatag

SEQ ID NO: 244886 - DNA, 2310 bp, Artificial Sequence
  Description of Artificial Sequence: Synthetic coding sequence
atgcgactgcccgacctgcgcccatggacaagccttcttttagtggatgcggctctgctctggttgctgcagggtcctctcggtaccttgttacctcaggggctgcctggtctctggcttgaagggacgttgcgcctagggggtttatggggcctacttaagctgcgaggacttctagggtttgtagggacgttgctcctgccactgtgcctggcaacccccttaacagtttctctcagggccttggtagcaggggcttcacgggctcccccagctagagtggcctcagcaccctggagttggctgttggtggggtacggagcggcagggctctcatggagcctgtgggcagtattgtcccccccaggcgcacaagagaaggaacaggatcaggtgaacaacaaagtactgatgtggaggctgttaaagttgtctcgcccagacctcccactgctcgtggcggctttcttctttttggtgctggctgtgctgggagagaccctgatacctcactactccggcagggtcatcgacatcctggggggtgacttcgatcctcacgcctttgcctcggccattttctttatgtgcctgttttccttcggctcctccctcagtgctggatgccggggaggttgttttacgtacacaatgtcacgcatcaacctcagaatcagggagcagctgtttagttcactcttgcggcaggatctgggtttttttcaggagactaagaccggagagctgaattccaggctctcaagcgatacgacactgatgtctaattggctgcccctcaacgccaacgtccttttgcgatcactagttaaggtagttggtctatatggatttatgctcagcatcagcccacggctgacattgctgtccctcttacatatgccctttactatagcagccgagaaggtgtacaacacacgccaccaggaggtgctgagggagattcaggacgcagtcgcgagagccggtcaggtagtccgcgaggctgtcggcggtcttcagactgtgcggtccttcggagctgaggaacacgaggtttgtaggtataaggaagccctcgaacagtgcaggcagctctattggcgccgagatttagagagggcactgtacctactggtacgcagagtgctgcacctcggcgtacagatgcttatgctgagttgcggcctgcagcagatgcaggacggagagttgacccagggcagtctgctctcttttatgatttaccaggaaagcgtcggctcttacgtgcagactctcgtgtatatatatggagatatgctcagtaatgtgggcgcagctgaaaaagtgttttcttatatggatcggcagcccaacttgccatccccaggtacactggcgccaactactttgcagggggttgtgaaattccaggacgtttcctttgcttaccctaacagaccggatcgccctgtgctgaaagggcttacctttactctccgaccaggcgaagtgacggctctcgtcgggcctaacggttcggggaagagcactgtggctgcccttttgcaaaacctttaccaacccaccgggggacaagtgctgcttgacgaaaagccaattagccagtacgaacactgttatctccattcacaggttgtatccgtgggccaggaacctgtgctatttagcggatccgtgcgtaacaatattgcgtatggcctacagtcgtgcgaggacgataaggttatggccgcagcccaagccgcacatgccgatgacttcatacaggagatggaacacggaatctatactgacgtgggtgagaagggcagccagcttgcggcagggcagaagcagcgcctggccatagctagggcacttgtgcgggacccaagagtccttatcttggacgaagcaacctcagccctggacgtgcagtgcgagcaagctaatgggttctgggttggccctttaggtgggggatccgccagcgaatccgatcccactggcttcctgcatgactcgcgacaccgactttcttcagatgtgggcatgtttgttgcactcaccaagttagggcagcctgatgctgagcaatggaattcgagactcgacttgcttgaacgaagccgccaggccgttgatggggtctgtcggcacaattacagactgggagcacctttcaccgttggaagaaaagttcagccagaagttacagtctaccctgaacgcactcccttacttcaccagcataacctccttcactgctctgtgaccgggttctaccccggagatatcaagatcaagtggttcctgaacggacaatag

SEQ ID NO: 244887 - DNA, 2310 bp, Artificial Sequence
  Description of Artificial Sequence: Synthetic coding sequence
atgcggctgccggatcttagaccttggacaagcctgctgctggttgatgcggctttgctgtggctgctgcaagggcctttagggacgctgctgccgcagggactgcctggcctctggctggagggaactctgaggctgggtggcctatggggtcttttgaagcttagaggtctgttaggatttgttggcacccttttgctgcccctgtgcctcgccaccccgcttaccgtgtctcttagggcgctggttgccggtgctagcagggcaccaccggcacgagtggcgagcgcaccctggagctggctgttagtcggttatggcgctgccggattgtcatggtcactctgggccgtccttagccctccaggtgcacaagaaaaagagcaggatcaagtcaataacaaggtactgatgtggagactgctgaaactttcccgcccagacttgccgctcctggtggcggctttcttcttcctagtactggccgttctgggagaaacactgattcctcactattccggccgtgtgattgatatcctgggaggggattttgatccccatgcttttgcctcagctattttcttcatgtgtctcttttccttcggctcctcgctcagcgccggatgcaggggtggatgtttcacttataccatgagtaggatcaacttaaggatccgggaacaactgttctccagtcttctacgacaggatcttggtttctttcaggagactaagaccggtgagctaaattcacgcctgtcgagtgacacgacgttgatgtccaactggttgcccttgaacgccaatgtcctcctgaggtctttggtgaaagtggttggcctgtacggtttcatgctgtccatttctccacgactcacattgttatcactcctgcatatgccctttacgatcgcagccgaaaaagtttacaacactcggcaccaggaagtgttgagagagatccaggacgccgtggctagagctggccaggtggtacgggaggccgtcggaggattgcaaactgtgagaagttttggcgcagaagagcacgaagtttgtcgctataaggaggctctagagcagtgccggcagctatattggaggagggaccttgagagagctctgtatctgctggtgcgccgagttctgcacctcggagtccagatgctcatgctatcctgcgggctgcagcagatgcaggacggcgagctcacccagggaagccttctgtcctttatgatatatcaggaatcggtggggagctatgtgcagactcttgtgtacatctatggagatatgttgtccaatgttggggctgcagagaaggtatttagctatatggatcgtcagcccaacctcccctctcccggaactttggctcctaccactcttcagggagtggtgaagtttcaagatgtgagttttgcctacccaaatcggccagatcgtcccgtgttgaaggggctaactttcaccttgcgacctggtgaggtgactgcactggtaggacccaacgggtcagggaaatcgacggtggccgcactgctgcagaatctctatcagcctaccggtggccaagtcctgctggacgagaagccaatctctcagtacgagcattgctatctgcacagccaggtggtttccgtcgggcaggagcccgtgctgttctcagggtcagtgcgaaataatatagcgtacggtctccagtcttgtgaagatgacaaggtaatggctgccgctcaggctgctcacgccgatgattttattcaggaaatggagcatggaatctacacagatgttggagaaaagggctcccagctcgccgctggccagaaacagcggctggctattgcgcgagcactggtcagggaccctcgcgttcttatattagacgaagcgacctcagctcttgacgtgcagtgcgaacaggccaacggattttgggtgggccctctgggcggaggctccgcttcagagagcgatccgaccgggtttctgcatgatagccgccatcgtttgagttcggacgtgggtatgttcgtggccctgaccaagcttggccagccggacgccgaacagtggaactcacgactagatctgctggagcgctcccggcaggcagtagacggcgtctgtagacacaactaccggctcggggctcctttcaccgtgggaaggaaagtccagccagaggttaccgtctatccagagagaacccccttacttcaccaacataacttactgcattgctctgtgaccgggttctacccaggcgacattaagattaagtggtttcttaatggtcagtag

SEQ ID NO: 244888 - DNA, 2310 bp, Artificial Sequence
  Description of Artificial Sequence: Synthetic coding sequence
atgcggctgccagacctgcgcccttggacatccctgctgttggtagatgcggcactgctttggttgctgcaaggacctctagggacattacttccccagggactccccggtctgtggctcgaggggaccttaagattggggggattatggggacttctgaaactccgaggtttacttggatttgtgggcacactattgctgccactgtgtctcgccacgcctctaaccgtctccctaagggcccttgtagccggtgcgtcccgagcccctcctgcaagggtcgcctctgctccatggagttggctgttggtgggttatggggctgctggcctgagctggtccttgtgggccgttctgtctccacccggtgcgcaggagaaagagcaggatcaagtgaataacaaggtcctaatgtggagattgctgaaactgagccgaccggatctgcctcttttagtggcagcctttttcttccttgtcctcgccgtcctgggggagactctgataccgcactatagcggtagagtgatcgatatcctgggtggggatttcgatcctcatgcctttgcttcagccattttctttatgtgccttttctcctttgggtcatctctctccgcaggctgtagaggtggatgttttacatacacaatgtcccgcatcaatctgcggatccgcgaacagctttttagcagtctgttacgacaggacttgggtttcttccaagaaacaaaaactggggagctgaatagcagattgagctctgacactaccctcatgagcaattggctccctttaaatgctaacgttctccttcgctccctagtgaaggtggtggggctatatggattcatgctgagcataagtccgagactcacacttctgtcacttctgcacatgccctttaccatcgctgcggaaaaggtctacaacactcggcatcaggaggtgctgagggaaattcaggacgccgtagcccgtgcgggacaggtcgtgagggaagctgtggggggtctccaaaccgtccggtcgtttggagctgaagaacatgaagtctgcaggtataaggaggccctggagcagtgccgacagttatactggaggcgcgacctcgaaagagccctttacttactgattcggagggtgctgcacctcggggtacagatgcttatgctcagttgtggtctccagcagatgcaggatggtgagctgacccagggttcactattgagtttcatgatctaccaggaaagcgtgggatcctacgtgcaaaccctggtgtacatatatggggatatgctgtccaatgtcggcgcagccgaaaaggtattttcctacatggataggcagcctaacttaccatcaccaggcacactggcacccacgaccttacaaggcgtggtgaagttccaggacgtcagtttcgcttatccaaatagacctgatcgacccgtgttgaaggggctcaccttcaccctgcggccaggggaagtgaccgcactggtcggaccaaacggcagcggcaagtcaacagtagccgcacttctgcaaaacctgtatcagccaacggggggacaagtgctattggatgaaaaacccatttcccagtatgaacactgctatctgcattcacaggtggtgagcgttggtcaggagccagtgctgttcagcggaagtgtgcgtaataatatcacttatggcctgcagtcttgtgaagatgacaaagttatggcagccgcacaggcagcgcacgctgatgacttcatccaagagatggagcatgggatttacactgatgtaggcgagaagggatcacaactagcggcaggacagaaacagagactcgccatcgcaagagctcttgtcagggatcctagagtgctgatactggatgaagcaaccagtgccctggacgtacagtgcgaacaggctaacggtttttgggtcgggccactgggcggtggttccgcatccgaatccgaccccacaggttttctgcacgattcgaggcatcggctgtcctctgacgtagggatgttcgtggccctcacaaaactcggacaaccagacgcggaacagtggaatagcagattagacttactggagcggtcacgccaagcggtggacggggtctgcagacacaattatagattgggtgcacctttcaccgtgggaagaaaagtgcagcctgaggtgaccgtttaccccgaaagaaccccattactgcatcagcacaacctcctccactgtagcgttaccggtttctatccaggcgatatcaaaatcaagtggttccttaatggtcagtag

SEQ ID NO: 244889 - DNA, 2310 bp, Artificial Sequence
  Description of Artificial Sequence: Synthetic coding sequence
atgcggctgcctgaccttaggccctggacaagtttacttctggtagacgctgctctgctgtggctgcttcaaggccctctgggaacgctcctgccccaagggctgccaggcttatggctggaaggcacattacgcttaggaggcttatggggcttgttgaagctgagaggcttacttgggtttgttggcacattgctgctgcctctgtgcttggctactccacttaccgtgtccctgcgggcactggtggcaggggcttcccgagccccacccgctcgcgtcgcttcagccccatggagttggctgctggtgggctatggagctgccggattatcatggagtctgtgggccgtgctaagcccacctggggctcaggaaaaagagcaggatcaggtgaacaacaaagtcctcatgtggcggctgcttaagctgtcaagacctgatttgccactgttggtggcagcctttttttttttagttttggccgtcctaggtgaaaccctaattccacattattccggccgagtgatagacatcctgggcggagatttcgacccccacgctttcgcttctgctattttctttatgtgtctgttctctttcggatctagcttaagtgcgggttgcagaggcggatgctttacgtatacaatgtctcgtatcaacctgcgtatccgtgagcagttatttagcagccttcttcgccaggatctcggcttcttccaggaaaccaagacaggggagctcaattcgaggctgtcatctgatactactctcatgagcaattggcttcctctcaatgctaacgttctgctgcgatctctggttaaggtggtagggctgtacggtttcatgctctccattagccctcgcctcactttgcttagcctcctgcacatgccctttaccattgcagctgagaaagtatataacaccagacaccaggaggtgcttcgggagatccaagacgcagttgctcgcgcaggccaggtggtgagggaggctgtgggaggcctccaaaccgtgagatcattcggtgccgaggaacacgaggtttgtcgttataaggaggctcttgaacagtgcagacagctttactggcggagggatctggaacgtgcactgtatctgctggtgcgtagagtgctgcacctcggtgtccagatgctaatgctcagctgtggactgcagcagatgcaggacggagagctgactcagggcagtctgctcagcttcatgatctatcaggagagcgttggttcatatgtgcagacacttgtctacatctatggagacatgctgtccaacgtcggagccgctgaaaaagtgtttagttatatggatcgccagcccaatctgccctcacccggaaccctggcgcctaccacactccagggtgtcgtgaagttccaagatgtcagcttcgcatatccaaaccgaccggacagacctgtgttaaagggcctcacctttacactgcggccaggcgaggtgacggcactggtcggccctaatggctccgggaaaagtacagttgccgcattactccagaatctgtaccagcccactggaggacaggtgctcctcgacgaaaagcctatctcgcagtatgagcattgctatctgcactcacaggtagtgtctgtcggccaggaaccggtgctgttctcaggatctgtacgaaacaatatcgcatacgggctccaatcctgtgaagacgataaagtaatggcagcagcacaggctgcacatgctgacgacttcatccaggaaatggagcacggtatctataccgatgtaggagagaagggatcccagctggcagccggtcagaagcagcgcttggcaatcgcacgagctctggtgcgcgatcccagagtcttgatcctggacgaggccacaagcgccctagacgttcagtgcgaacaagctaatgggttctgggttggacccctggggggtggctcagcctctgagtctgacccaactgggtttttgcatgattcccggcatcgtttaagttctgacgtgggcatgtttgtagcactgacaaaactggggcagccagacgcggagcagtggaattcgcgcttagacctcctggaaagatctcgccaggcagtagatggggtctgccgccataactacagactcggtgcaccattcacagttggtcgaaaagtgcagcccgaggttactgtgtatcctgaacggaccccattgctacatcagcacaatcttctgcactgttctgtgacaggcttttaccccggtgatattaagatcaagtggttcttgaatgggcagtag

SEQ ID NO: 244890 - DNA, 2310 bp, Artificial Sequence
  Description of Artificial Sequence: Synthetic coding sequence
atgaggttacccgaccttcgaccctggacaagtctgctgctcgtggatgcggctctgctgtggctgttacaggggccactgggcacccttttgcctcagggtctacccggtctgtggctggaaggcacactaaggttaggcggtctctggggcctgttaaagctccggggtctcctggggttcgtcggaacccttctgttgcccctctgtctagctactcctctgaccgtgtcccttagagccctggtggccggtgcaagccgcgctcctcctgccagggttgccagcgcgccttggtcctggcttcttgtggggtacggagctgcgggactgtcatggtccctgtgggcggttctcagccccccaggcgcacaagaaaaggagcaggaccaagtcaacaataaagtgctgatgtggcggctgcttaaattaagtagacctgacctgcccctgctagtcgctgcatttttcttcctcgtgttggccgtgctcggcgagactcttatcccccattacagcggaagagttattgacatcctcggcggagattttgatccgcacgcgtttgccagcgccatttttttcatgtgcctgttctcgtttggcagcagcctctctgcaggttgcagagggggttgcttcacctacactatgtcccgtatcaatttgcggatccgggaacaattattctccagcctgctgcgacaggacctgggattctttcaggagacaaagacaggggagctgaacagccggcttagctctgataccacgttgatgtccaattggttgcccctgaatgcaaatgtgctgctgcgttctcttgtaaaggtggttggcctctatggatttatgctgagcatttcacctcgtttgacgttgctctctctgctccacatgcccttcaccattgctgcggagaaagtgtacaacaccaggcatcaggaggtactaagagaaatccaggacgccgtggcccgagctggccaggtggtccgagaggccgtggggggtctgcagacagtccgatcattcggggctgaggaacacgaagtttgtcgttacaaggaggcgttagagcaatgtaggcagctatactggaggcgagatctggagcgggcactctaccttttagtgcgaagggtgttgcacctcggcgttcagatgcttatgttatcatgcggactgcaacaaatgcaggatggagagttaacccagggctccctcctctcgtttatgatttatcaagagtccgtcggatcatacgtgcaaacactggtctacatctatggggatatgttgtctaatgtgggcgctgccgagaaggtgttttcatatatggatcgtcaacctaaccttccctctccagggaccctggcacctactaccctgcaaggcgttgtgaagttccaggatgtgagtttcgcgtaccctaatcggccagatcgacctgttctgaaaggcctgacgtttactctaaggcccggtgaggtgactgctttggtaggacctaatggatccggaaaatctacagtagcagctctcctccagaatttataccagccaaccggaggacaagtgcttctggatgagaagcctattagtcagtatgaacattgttatctgcacagccaagtggtttcggtcggacaggaacctgtgctgttttcaggctccgtgcgcaataatatcgcctacggcctgcagagctgtgaagacgacaaagtgatggctgccgcacaggccgcacacgcagatgactttatccaagagatggaacacggcatttacaccgatgtcggtgaaaagggatcccagctagccgcaggccagaagcagcgattggccatcgcgagagccctggtgagggaccccagggtccttattctggatgaggctacctctgccctggatgtgcagtgtgagcaggcaaatggcttctgggtgggacccctgggaggcggttcggcatctgagagcgacccaactggctttttacatgattccaggcaccgcctgtcctcagacgttggcatgttcgtggcactgacaaagttgggtcagccagacgccgaacaatggaattctcggctggacctcctagagcggagcagacaggccgtggacggggtgtgtcgtcataactatagattgggagcaccatttacagtgggacgaaaggtgcaaccagaggtaacggtgtaccctgaacggacgcctcttctgcaccaacacaatctcctgcactgctctgtgactgggttctatcccggagatatcaagatcaagtggtttctaaatggacagtag

SEQ ID NO: 244891 - DNA, 2697 bp, Artificial Sequence
  Description of Artificial Sequence: Synthetic coding sequence
atggtgtgggaccggcaaaccaagatggaatacgagtggaaaccagacgaacagggcctgcagcagattctgcaattgttaaaggagtctcagtctcctgataccaccatccaacggactgtccaacaaaaactggagcagctcaaccagtatcccgatttcaacaactacttaatttttgtgctgaccaaacttaaaagcgaggatgaacctacccgctcgttgagtggactaatcttaaaaaacaatgtcaaagcacacttccagaattttccaaacggcgttacagactttattaagtctgaatgtctgaataacattggtgattcctcacccctaataagagcgactgtgggcatcctgatcactacgatcgcatctaagggagaactccagaactggcctgatttactacccaagctgtgctcattactggacagcgaagattataatacctgcgaaggcgctttcggagcactccagaagatctgcgaggattccgccgaaatcctggatagcgacgtgctcgacagacccctgaatataatgattccaaaattcctgcaattcttcaagcactcttcccccaagattcggagccatgctgtggcatgtgtgaaccaatttattattagccgtacgcaggcactgatgctgcatatcgactcgttcatcgaaaacctcttcgcgctagcgggtgatgaggaacccgaggtacgaaaaaatgtttgccgggcattggtgatgttactagaggtgagaatggataggctgttaccgcacatgcataacattgtcgagtatatgctgcaacggacccaggaccaggatgagaacgttgccctcgaggcttgcgaattctggctcaccctcgcagagcagcccatctgcaaggacgtcctggtgagacatctgccgaaactgattcccgttctggtaaacggaatgaaatatagcgacatcgacataatccttctcaagggagacgtagaagaggacgaaacaatccccgattccgagcaggatatccgacccagattccaccgctctagaaccgtggctcagcaacacgacgaagacgggatcgaagaagaagatgatgacgacgacgagatagacgacgatgataccatctcagattggaacctgaggaagtgctcagccgctgccctggacgtgctggcgaacgtgtatagggatgaactgctgcctcacatcttgcccctgctcaaagagttactgttccatcacgagtgggttgtgaaagagtccggcattctcgtcctgggggctatcgccgaaggatgtatgcagggaatgatcccatacttgcccgaactcatcccccacctaatacagtgtctttctgataagaaagctctggtccggtcaattacttgttggaccctttctcggtacgcgcattgggttgtgagtcaacccccagacacatacttaaagccgctcatgaccgagctacttaaacgaatactggacagcaacaagagggtgcaggaggccgcatgttcggccttcgccaccctggaggaggaggcctgcaccgaactcgtaccctatttggcttacattctggatacccttgtgttcgctttcagtaaataccagcacaagaacctgctcatactgtacgatgccattggcacattagccgattcagtgggtcatcacctgaacaagccggaatatatccagatgctaatgccaccattaattcaaaaatggaacatgcttaaggatgaggacaaggaccttttcccactgctggaatgtctatcttcggtcgcgactgcgttacagtcaggcttcctgccatattgcgaaccagtttatcagagatgcgttaatttggtccagaagacactggcccaggcaatgcttaataatgctcagccagaccaatatgaggctcctgacaaagatttcatgatcgttgccctcgacctcctatctggcctggcagagggattgggcggaaatatagaacagttagtagccagatctaacatattgacgttgatgtaccagtgtatgcaggataaaatgcccgaggttcggcagagttccttcgcactcttaggggacctaaccaaggcctgcttccagcatgtcaaaccatgcatcgcagactttatgccaatcttgggtaccaatctaaatcctgaatttattagtgtctgtaataacgccacctgggccatcggcgaaatttcgattcagatgggaatcgaaatgcagccctacattcccatggtgctgcaccaactagtcgagattatcaacagaccaaacacacctaaaacgcttctagaaaatactgccatcactatagggagactcggttatgtgtgccctcaggaagtggcaccaatgctccagcagttcatcagaccctggtgcacatcacttcgaaacatccgggataatgaagaaaaagatagtgcctttcgtggaatctgtaccatgatttcagtgaacccatcaggtgtgatacaggacttcattttcttctgcgacgcggttgcatcttggatcaatccaaaggatgaccttagggatatgttttgtaagatcctgcacggatttaagaatcaagttggcgacgagaactggcgcagatttagcgatcagttccctcttcctctcaaagaacgtctcgctgccttctatggcgtgtag

SEQ ID NO: 244892 - DNA, 387 bp, Artificial Sequence
  Description of Artificial Sequence: Synthetic coding sequence
atggagtatgagtggaagcctgacgaacagggtcttcagcagatcctacaattgctgaaggaatctcagtctcccgacaccactatccagaggacagtgcagcagaaactggagcaactcaaccagtacccggacttcaataactacctgatctttgttctgactaaactcaagtcagaggacgagcccaccagatctctgtccggtctgatcctgaagaacaatgtcaaggcacactttcagaactttcccaatggcgtgaccgattttatcaagtccgaatgcttaaataatatcggcgatagttctccccttattagggcaacagtgggcctcactctattgcacgtgagtatctctctgtcatctgtcggcttaaaactctag

SEQ ID NO: 244893 - DNA, 2547 bp, Artificial Sequence
  Description of Artificial Sequence: Synthetic coding sequence
atggtgtgggataggcagacaaagatggaatacgaatggaagccagatgagcagggattgcagcaaattctgcagctcctgaaggaatcacagtcccctgacaccaccatccagcgcaccgtccagcaaaagctggagcagcttaaccagtatcccgattttaataattatctgatctttgtgctcaccaagctgaagtccgaaggaatcctaattacaactatcgcctcgaagggagagctgcaaaattggccggacctgctgcctaaactttgtagcttactcgactcagaagattataatacgtgcgagggcgcattcggagccctgcagaaaatctgtgaagacagcgctgagattttggattccgacgtactggacagacccctgaacatcatgatcccgaagtttctgcaattcttcaagcattcatcacctaagattagaagtcatgccgtggcttgtgttaaccagtttatcataagcagaacccaggccctgatgctgcacatcgatagctttattgagaacttatttgctctggcaggcgacgaggaacctgaagttcgcaagaacgtgtgtagagctttggtcatgctgttagaggtccgtatggatagactcctgccacatatgcataacatcgtggagtacatgctgcagagaactcaggatcaagacgagaacgtggccctcgaggcttgtgaattttggttaactctcgccgagcagccaatctgcaaagacgttctggtccgccatctgcccaagctgatacctgttctggtgaatggtatgaagtactcagatatcgacattatcctgctgaaaggggatgtggaagaggatgaaacaatccccgattccgagcaagacatccgtccaaggtttcacagaagcaggacagtagcccagcagcacgatgaggatggaatagaggaggaagacgatgacgacgatgagatagacgacgacgataccatatccgactggaacttgagaaagtgctcagccgcagcgcttgatgttttagctaatgtctatagggacgaactactgcctcacatcctcccgcttcttaaagagttactctttcaccatgaatgggttgtaaaagaatccgggatcctggttctaggcgctatcgccgaaggctgcatgcagggaatgataccttacctacccgaattgattcctcatctgattcagtgcctttcggacaaaaaggcactggtcaggtccataacctgctggacactcagcagatacgcgcactgggtggtttcacaacccccagatacatacctcaaacctttgatgaccgagctgctaaagcggatcctggactccaataagcgggtccaagaggcagcgtgttcggcttttgctacactggaggaagaggcttgcactgaactagttccatacttagcttacattttggacaccctggtttttgcattctccaaatatcagcataagaacctgttgattctctacgatgccatcggcaccttagcagactcagtcggacatcatctgaataagcctgagtacattcagatgcttatgcctccgctgattcagaaatggaacatgcttaaggatgaagacaaggacctgttccctttgctggagtgcctatcctcggtcgcaactgccctgcagagtggttttctgccctattgtgagcccgtgtaccaacggtgcgtaaatcttgtgcagaaaacccttgcccaagcaatgcttaataacgctcagccagatcaatacgaagccccagacaaagacttcatgattgttgctctggatctgctttccggactggccgaggggctggggggaaacattgagcagcttgtggccaggtccaatattcttaccctcatgtatcagtgcatgcaagacaaaatgccggaggtgcgccagtcttcttttgcgctgctgggcgatctgaccaaggcctgtttccagcacgttaagccctgcattgccgactttatgccaatcttgggcactaacttgaaccccgagttcatctctgtctgtaataatgcgacatgggccatcggtgagataagtatccaaatgggcattgagatgcagccatacatccctatggtactgcatcagctggtggagattataaaccgaccaaatacaccaaagaccctcctggaaaacacagctatcaccatcgggaggttgggttatgtttgcccgcaagaggtggcgccaatgttgcagcaattcattcggccatggtgcacaagcctcagaaacattagggataatgaagagaaagattctgctttcagaggcatttgcacaatgatttctgttaacccctcaggtgtgattcaggatttcatcttcttttgtgatgccgtggcctcctggatcaatcccaaagatgacctgcgagacatgttttgcaaaatcttacatggctttaagaaccaagtgggcgatgaaaattggcgcaggttcagcgaccaattccctctgcccctcaaggaaaggctggccgctttttatggtgtgtag

SEQ ID NO: 244894 - DNA, 2673 bp, Artificial Sequence
  Description of Artificial Sequence: Synthetic coding sequence
atggagtatgaatggaaacctgacgagcagggattgcagcagattctgcagctcctgaaggaatcccagagcccagatacaacaattcagcgcaccgtgcagcagaaactggaacagctcaaccagtatccggatttcaacaattacctcatattcgttctgacaaagctaaagtcggaggatgagccgacgcgaagcctgtctggccttattctcaagaacaatgttaaagcccacttccagaacttccccaacggtgtgacagacttcattaagtcagaatgcctgaataacataggtgatagctcaccattgattagggctaccgtggggatccttatcaccaccattgccagcaagggtgagttgcaaaactggccagacttgctcccaaaattgtgttccctgcttgatagcgaggactacaatacttgtgagggcgctttcggagcgttacagaagatttgcgaagatagcgccgaaatcctagatagcgacgttctcgaccgaccgctgaacatcatgatacctaagtttttacagttcttcaaacacagcagccccaaaattagatcacatgccgtggcttgtgtcaatcaatttattatatctcgaacccaggccctgatgctccatatcgattcctttatagagaatctattcgccttggccggagatgaggaacctgaagtccggaagaatgtctgtcgggcactggtcatgctgctagaggtgcgtatggatcggctgctgccccacatgcacaatattgtcgagtacatgctgcagaggactcaggatcaggacgagaacgtcgcgctggaggcttgcgaattttggctgacactagccgagcaaccaatctgtaaagatgtcctggtacgccacctgcctaagctaattcctgttctggttaacggaatgaagtacagtgatattgacattatcctgttgaagggtgatgtggaggaggatgagaccatccccgactccgagcaggacattcgcccaagatttcaccgtagccggacggtggcccaacagcacgacgaggacggcatagaggaggaagacgacgacgatgacgaaatcgatgacgatgataccatatctgactggaatctgcggaaatgttccgccgctgccctggatgtattggccaatgtgtaccgggacgaattgctaccccacatcctccctttgttgaaagaattgctgtttcaccacgagtgggtagtaaaagaatcaggcattctcgtgctcggggcaatagctgagggttgcatgcaggggatgatcccatacctcccagaactgatcccacatcttattcaatgtttgtccgataaaaaagcactggtacgaagcattacctgctggacactctctcgctacgctcactgggtagtgtcacaaccacccgacacatacttaaagccgcttatgacagaactcctcaagcgcattctggattcaaacaaacgagtccaggaagcggcatgttctgcatttgcgaccttggaggaagaagcctgcacagagctggtgccttatcttgcatacattctagatacgttggtctttgccttctccaaataccagcacaagaacctgctcattctgtacgacgcaataggtacactagctgactcagtggggcaccatctgaacaaacccgagtacatccagatgcttatgcctccgttgattcagaagtggaatatgctgaaggacgaggataaagatttgtttcctctcctggagtgtctgagttccgtggcaacggccttgcagagcggcttcttaccgtactgcgaacctgtgtatcaacggtgcgtcaacttggttcaaaaaactctcgctcaagcaatgctgaacaatgcacagccagaccagtacgaggcgcctgataaagatttcatgatagttgcactcgatctcttgtcaggacttgctgagggtctgggcggaaatatcgaacagctagtagcccgatcaaatattctcaccctaatgtatcagtgcatgcaagacaagatgcctgaggtacggcagagttcgtttgcactcttgggcgatctcaccaaagcctgttttcaacatgtgaaaccttgcattgccgacttcatgcctattctgggtactaatcttaatccggagtttatcagtgtttgcaataatgctacctgggctatcggtgagatcagcattcagatggggatcgagatgcagccctacattccaatggtcctgcaccagctggtcgagattataaatcggcctaataccccgaagaccttgctggaaaacactgcaatcactataggtaggctgggatatgtgtgtccccaagaggtcgccccaatgctccaacagttcattcgaccctggtgcacgtcattgcgcaacatcagagataatgaagaaaaagacagcgcctttcgcggaatctgtacgatgatttctgtgaaccctagtggcgtcatccaggactttatctttttttgcgatgccgtagcctcctggataaaccctaaggacgatctgagggacatgttctgtaaaatcctacatggattcaaaaaccaggtcggcgatgaaaactggcgtcgcttttctgatcagtttcctttgccccttaaagagagactggccgcattctatggagtatag

SEQ ID NO: 244895 - DNA, 2664 bp, Artificial Sequence
  Description of Artificial Sequence: Synthetic coding sequence
atggactggcagcccgacgagcagggcctgcagcaggtacttcagctgctaaaagattcacagtctcctaacacagccactcagaggattgtacaggataaactcaagcaacttaaccagttccccgatttcaacaactacttgatatttgtattgactcgattgaagtccgaagacgagccgactagatcactcagtgggctgatacttaagaataacgtgaaagcccactaccagagctttcctccccctgtggccgactttattaagcaagagtgcttgaacaatattggcgatgctagttctttgatcagggccaccatcgggattctgatcacgacaatagcatccaaaggagagttacagatgtggccagagctactgccccagctgtgcaatctgcttaactccgaggattataatacctgcgaaggagccttcggcgctctgcagaaaatttgcgaagactcgagtgagctccttgattcagatgccttgaaccgccctctgaatataatgatccccaagttcctgcagttctttaagcactgttctcctaaaatacgctcccacgcgattgcctgcgtgaatcagtttatcatggatagagcacaggcccttatggataatatcgatacgtttatcgagcatttgtttgctctggcagtggacgatgatccagaggttcgcaaaaatgtgtgccgtgccctggtgatgctgctggaagtcaggatagatagattgatcccacatatgcactcaatcattcagtacatgctgcagcggacacaggatcacgacgagaacgtcgccctggaagcctgcgagttctggctaacactcgcggagcaaccaatctgcaaagaagtgctggcttctcatctggtacagttgataccaattctggtaaatggaatgaagtactccgagattgatattatactgctcaagggagatgtcgaagaggatgaagccgttcctgattcagagcaagacattaaaccacgattccataagtcccgaactgtcaccctgccgcatgaagcagaacgacctgatggtagtgaggatgctgaagacgatgacgatgatgacgctttgtctgattggaacctgcggaaatgcagcgcggctgctctggatgtactcgccaacgtgttcagggaggaactgctcccacaccttctaccacttttaaaagggctgttatttcaccccgagtgggtggtgaaagagagtggcattctcgtgctaggagccattgctgaagggtgtatgcagggaatggttccttatcttcctgagctcattccacacctaattcaatgcctcagcgacaagaaagcactggtacggagtatcgcttgctggacattgtcccggtacgctcactgggtggtcagccagccaccagacatgcatttgaaacccctgatgacagaacttctgaagcgaatattggatggaaacaagagagtgcaagaggccgcatgctctgcctttgctacactggaggaggaagcttgcaccgaactggttccttatttatcttacatccttgacacactcgtgttcgcctttggaaagtaccagcataagaacctgctcattctctatgacgcaatcgggactctagccgactctgtggggcaccacctgaaccagcccgagtacattcaaaaactgatgccaccgctgattcaaaaatggaatgagctaaaggatgaagataaagacctgttcccactgctggagtgcttgtcatctgtggcaacagccctccagtctggattcctcccctactgcgaaccggtttatcaaagatgtgtgacacttgtgcaaaagacattggcccaagccatgatgtacacccagcatcctgagcagtatgaagctcctgacaaggatttcatgatcgtggccttggacttgttgtccggtctcgcagaggggcttggaggccatgttgagcaactcgttgccaggagcaacattatgactttgctgtttcagtgtatgcaagactctatgcccgaagtgcggcagtcttcttttgctctgctgggtgatctcacaaaggcttgcttcatccacgttaagccctgcattgccgagtttatgcccattctaggcactaacctcaaccccgaattcatttcagtgtgcaacaacgctacatgggccattggagagatctgtatgcaaatgggtgccgaaatgcagccttatgtccagatggtcctgaacaacctagtggaaattatcaataggccaaacactccaaaaaccctgctcgagaataccgcaataacaatcggcagactgggctatgtatgtcctcaagaagtagcgcctatgctgcagcaatttattcggccttggtgcacctcgctacggaacatccgagacaatgaggagaaagactctgcgtttcgcggaatctgcatgatgattggcgttaatcctggaggggtcgtgcaggatttcatctttttttgtgacgctgtggcctcatgggtgtcaccaaaggacgatttgcgtgatatgttttataagattctacacgggttcaaggatcaagtcggagaggacaactggcagcagttttccgagcagtttcctcctcttttgaaggaaaggctggccgctttctacggagtatag

SEQ ID NO: 244896 - DNA, 2100 bp, Artificial Sequence
  Description of Artificial Sequence: Synthetic coding sequence
atggattggcagccagacgagcagggccttcagcaagtgcttcagctgctgaaggattcgcagagcccaaataccgccacccagcgaatcgtgcaggacaagttgaaacagctgaaccagttcccagattttaacaactacctgatcttcgtcctgacgcgtctgaagagcgaggacgagcccacacgtagtctgtctggccttatattgaaaaacaacgtgaaagcacattaccagtcatttccaccccctgtggcagacttcatcaaacaggaatgcctaaataatatcggagacgctagcagtctgattcgagccacaatcggaatactgattacaacaattgcaagtaaaggagagctccagatgtggcctgaactactaccgcagctgtgtaaccttttaaacagtgaggactacaatacgtgtgaaggggcattcggagccttgcagaaaatatgtgaggattcatctgagttacttgatagcgatgctctgaacaggccccttaacattatgattccgaaattcctccagttttttaagcactgttcaccaaagatccgttcacatgctatcgcatgcgtaaaccagtttattatggatcgcgctcaggcactgatggataacattgacacctttattgagcacctgtttgcactggccgtggatgacgacccagaggtgaggaaaaatgtttgccgcgctttggtgatgcttctggaggtacgaatagatcggctgatccctcacatgcactcgataatccagtatatgcttcagagaacacaagaccacgatgaaaatgtggccttggaagcatgcgagttctggctaactctggccgagcaaccgatttgtaaggaggttttagcttcacatttggtgcaactcattccaattttggtgaatggtatgaaatatagtgagattgacatcattttgttgaagggcgacgtggaggaagacgaggcagtcccggactctgagcaagatataaagcccagatttcataaaagcaggaccgtgaccttaccacacgaggccgaaagacctgacggatccgaggacgctgaagatgacgacgatgatgatgctctgagcgactggaacctgagaaagtgcagtgccgctgccctggacgtcttggcgaatgtatttcgcgaggagctcttaccccaccttttgcccttgctgaaaggcttactttttcatcctgaatgggtggttaaagaatcaggaattctggtgctgggggctattgctgagggctgtatgcaggggatggtgccatacctgcccgaattgatcccacacctgatccagtgtctctctgacaagaaggccttggttaggtccattgcctgttggaccttgagccggtacgctcattgggttgtcagccagcctcctgacatgcatctgaagccattaatgaccgaactgctgaaaaggatacttgatggtaacaagagagtccaagaggctgcgtgttccgctttcgctaccctggaagaagaagcttgcacagagctggttccctatctctcatacatattggataccctcgtatttgcgttcggcaaatatcaacacaagaatttactcattttgtatgatgccataggaacgttggctgacagcgttggccaccatcttaatcagcctgagtacatccagaagctgatgccaccactcatccagaagtggaatgagctgaaagatgaggataaggatttgttccctctgctagaatgtctaagctctgtcgccacagccctccagagcggattcctcccctattgcgagcccgtatatcagaggtgcgtgacccttgttcagaaaacattggcacaggctatgatgtatacacaacaccccgaacaatacgaggctcccgataaagactttatgattgtagccctcgatttacttagcggcctggcggagggcctgggcggacatgtagagcagttggttgctcactccccaagctttcctccccaccctctgcctcccgcaggaagccgagtctgtcccttcgtgactgttctttgttgggggctggcccctagatggcgcgaaatccccctggtgtag

SEQ ID NO: 244897 - DNA, 2694 bp, Artificial Sequence
  Description of Artificial Sequence: Synthetic coding sequence
atggactggcaacctgacgaacagggcctccagcaagtgttgcagctgctcaaagatagccagtcccccaacactgccacacagagaattgtgcaggataagttgaagcagctgaaccagttccccgacttcaacaactacctcatctttgtactgacccggctgaagtctgaagacgagcccacgcgaagcctgagtggcttgatcctaaagaataacgtgaaggcccactaccagagtttccccccacccgtagccgattttattaagcaggagtgcctcaataatatcggagacgcctcttcattgatccgcgctacgatcggaatcctcataaccacaatagctagcaaaggggaactgcaaatgtggcctgagttgcttccacagctctgtaatctgttaaatagcgaagattataatacatgtgagggcgcttttggcgctttgcagaaaatttgtgaagactcaagcgagttgctcgattctgatgcactgaaccggcctctgaatataatgatccccaagtttctgcagttcttcaaacactgcagccctaaaattagatctcatgccatagcttgcgtgaaccagtttattatggacagagcgcaggccctgatggataacatagacacttttatcgaacacctgtttgcgttggctgtggatgatgatcctgaggttcggaagaatgtgtgtcgcgcactagtcatgctcctcgaggtcagaatcgacaggctaatcccccacatgcatagcataattcagtatatgctgcagcgcactcaggaccacgatgagaatgtcgctctggaggcttgtgaattctggctgactttagcagagcaacctatctgtaaagaagttctggcttcccacctagtccagttaattcccatcctcgtgaatggcatgaaatatagcgagatagatattattctgcttaaaggggacgtggaagaggatgaggccgtccccgactcagaacaggacatcaagcctcgcttccacaagtcacgcaccgtgacactcccccacgaggcagagagacctgatggttctgaggacgctgaagatgatgatgacgatgacgcactcagcgattggaacctgcgcaaatgttccgctgccgctctggatgtgctggcaaatgtttttagagaagagctgctgccccacctcttgcctcttctgaaggggctgctttttcatcccgagtgggtcgtaaaagagagcggcattctggtcttgggagctattgcagaagggtgtatgcagggtatggtgccctacctgcccgaactcattccgcatctgatccagtgtctgtcagataagaaagcgcttgtgaggagcattgcttgctggacactctcccgctacgcgcattgggtcgtgagccagcctcccgatatgcatttgaaacctttaatgacagagttgctgaagagaatattagacggaaataagcgcgtgcaggaggcagcctgctccgcctttgctactcttgaagaggaggcttgtaccgagcttgtcccttatctgagttacatcctggataccctggtgtttgcatttggaaagtaccagcacaaaaatcttctgatcctgtacgatgcaatcggaaccctggctgactccgtcggacaccacttaaaccagccagaatatattcagaaactgatgcctcctttgatccagaaatggaatgagctgaaggacgaggataaagatcttttccctctgcttgaatgcctcagctcggtcgcaaccgcacttcagtcaggttttctgccttactgcgagcccgtttatcaaagatgtgtgacattagtccagaagacactggctcaggcgatgatgtacactcagcaccccgagcagtacgaggctcctgacaaggacttcatgattgtcgcactggaccttctgtcggggctggctgagggcctagggggacacgtggagcagttggtggcgagatccaacattatgactttactgtttcagtgtatgcaggactctatgcctgaagtgcgtcagagctccttcgcactgttaggagaccttactaaagcatgcttcatccacgtgaaaccgtgcatcgcagagtttatgcccattttaggaactaatctaaacccagaattcatttccgtctgtaacaacgcgacatgggcgataggagaaatctgcatgcagatgggagcagaaatgcaaccatacgtccaaatggttctgaataatctcgtggaaatcattaacaggcccaacacacccaagactttgttagaaaataccgggagacttacgtcaccaagcgcgatccctgccatcacaattggacggctgggatacgtctgtccccaagaggtagccccaatgctccagcagtttattaggccttggtgcacctctctacgaaacattcgcgacaacgaggagaaggacagcgcatttaggggcatctgtatgatgatcggcgtgaatcccggtggtgttgtccaggatttcatattcttctgtgatgcagtcgcctcctgggtcagccccaaggatgatttaagggatatgttctacaaaattcttcacggcttcaaggatcaggtgggggaggacaattggcagcaattcagtgagcagttcccccctctgctaaaggaaagacttgcagctttttatggagtgtag

SEQ ID NO: 244898 - DNA, 2664 bp, Artificial Sequence
  Description of Artificial Sequence: Synthetic coding sequence
atggactggcagcctgatgaacaggggctccagcaggtactccagttgctcaaggactcacagtctcccaataccgccacccagcggatcgtgcaggataagttgaagcaattaaaccaattccccgacttcaataactacctgattttcgtgctaaccaggctgaagtctgaggacgaaccgacccgctcacttagtggcctgatcctgaaaaataatgtgaaggctcactatcaaagctttcctccacccgtggccgactttatcaaacaggagtgcctgaacaacattggcgacgcttcaagcctgattcgggctaccattggtatactgatcacaaccatagccagcaaaggggagctccaaatgtggccagaactgctcccacaactgtgtaatctgctgaattccgaggactataatacatgcgaaggcgctttcggagctcttcaaaagatatgcgaggattcaagcgagctactggactcagatgcattaaaccgacccctgaacatcatgatacccaaattcctgcagttttttaagcattgcagccctaaaatcaggagccacgctatcgcgtgtgtgaaccagtttattatggatcgcgcacaagcactcatggacaatatagacactttcattgagcatctgtttgcgttagcggtggacgatgatccagaagtgcgaaagaacgtgtgtcgcgctctggtcatgctgctggaagttaggattgatcggttaatcccccacatgcactcaatcattcagtatatgctgcagcgtactcaggaccatgatgagaatgtggcactcgaagcctgcgagttctggttgactctcgcagagcaaccaatttgtaaagaagtcttggcatcacacctggttcaacttatcccaatacttgtcaatgggatgaaatatagcgaaatcgacatcatcttactgaagggagacgtggaagaggacgaggccgttcctgatagcgagcaggatattaagccgaggtttcacaaatcaaggacagtaaccttacctcatgaggcggagcgcccagacgggtctgaggatgcagaagacgacgatgacgacgacgccctgtcagattggaatctcaggaagtgttcagccgctgctttggacgtgttagcaaatgtttttcgggaggagctgctcccccacctacttccacttctcaaaggcctgctgttccaccccgagtgggtggtgaaagaatcgggaatcctggtgctcggagccatcgccgagggctgcatgcaaggcatggttccttatctccccgagctgatccctcacctgattcagtgcctgagtgacaagaaagccttggtgagaagcatagcttgttggacgttgagccggtatgctcactgggtggtcagtcagccaccggatatgcatttgaagcccttaatgaccgaactgttaaagcggatcctggacggcaacaagcgagttcaggaggcggcttgctcagcatttgccaccctcgaggaggaggcgtgcactgagctggtaccgtatctcagttacattctcgatactctggttttcgccttcggtaagtaccagcataaaaatctgctgatcctttacgacgcaatcggaactttggccgactcagtcggtcaccacttgaaccaacccgagtacatacagaagctgatgccaccactcattcagaagtggaatgaactcaaagatgaggacaaagatctgttcccactgctggaatgtctgagctccgtcgctaccgcattacagtctggatttctcccctactgtgagcccgtgtaccagagatgtgtaacgctggtccagaagaccctagcccaagctatgatgtacacccagcacccagaacagtacgaggccccagataaagactttatgatagtagctcttgacctgctgtccggtctggccgagggcctgggcggacatgtggaacagcttgtggcacggtctaatattatgactctgctgtttcagtgcatgcaggattccatgccagaagtgcgtcagagctcattcgcactactgggcgatctgactaaggcatgcttcatacatgttaagccatgtatagccgagtttatgcccatccttggaacaaacctgaaccccgagtttatcagtgtttgtaataatgccacttgggcgattggcgagatatgcatgcagatgggtgccgagatgcagccttacgtccagatggtgctgaacaatctcgttgaaatcattaacaggcctaacacacctaaaaccctcttggagaacactgctatcaccataggccgattggggtacgtttgtcctcaggaagttgcccctatgttgcagcagttcatcaggccttggtgcacgtccctcagaaatatccgagacaatgaggagaaagacagtgcattcagagggatctgcatgatgatcggagttaatcctggaggggtggtacaggactttatctttttttgcgatgccgtagcctcatgggtgtcgcccaaagacgatttgagagacatgttctacaagatcctgcacggcttcaaagatcaggtcggggaagataattggcagcagttctccgaacagttcccacctctcttgaaggagcgcctcgccgcattttatggcgtgtag

SEQ ID NO: 244899 - DNA, 2694 bp, Artificial Sequence
  Description of Artificial Sequence: Synthetic coding sequence
atggattggcagccggacgagcagggcctacaacaggtgctgcagttgctgaaagattcccagagcccgaatacagccacccagagaatagtgcaggataagctgaagcaacttaatcagttcccagatttcaataattatttgatattcgtcctgactcggctgaaaagcgaagacgagcctactaggtccctgtctggcttaatcctgaagaacaatgtcaaggctcactaccagtcgttccccccacccgtcgctgattttatcaagcaggagtgcctgaataatattggggatgcttcctctctcatacgcgctactatcgggattctcatcaccactatcgcctcgaaaggcgagctgcaaatgtggcccgagctactcccccaactgtgcaacctgctcaattccgaggactataatacctgcgagggtgcattcggcgctctccaaaagatctgtgaggactccagcgaactattagacagcgatgccttgaatcggcctttaaatataatgatccctaagttcctgcagttttttaaacactgcagtcctaagattcgatctcacgctattgcgtgcgtcaatcaattcattatggacagggcccaggcacttatggataacatcgacacttttatcgagcacctgttcgcattggccgttgacgatgatccagaggtcaggaaaaatgtgtgccgggcacttgtgatgctcctagaggtgagaattgaccggctgattccacatatgcactcaattatccagtacatgttgcagaggactcaagaccatgacgagaacgtggcgctcgaggcttgcgagttttggctgacgctggccgagcagcccatctgcaaagaggtcctcgcttctcacctggtgcagctgattccaatccttgtcaatggtatgaagtactcggaaatagatatcattttactgaaaggagacgttgaagaggacgaggctgtcccagatagcgaacaagacatcaaacccaggttccacaagtccaggacagttacactgccccatgaggccgaacggcctgacggttctgaggacgccgaggatgatgacgatgatgacgcattgagtgactggaatctgagaaaatgtagtgctgcagccctggacgttctggctaacgtcttcagagaggaactgctgccccacctgctgcctctattgaaaggcttactattccatcccgagtgggtggtcaaggagagcggcattctcgtactcggggctatcgcagaaggctgcatgcaagggatggtgccctacctacccgaacttattccacacctgatccagtgcctgagtgataagaaagcgttggtgagatcgatcgcatgctggaccctgagcaggtacgcccactgggttgtgtctcagcctcccgatatgcacctgaagccgctgatgacagaactgctgaagcgaattctggacggcaacaaacgtgtgcaggaggctgcctgttccgcctttgccacgctggaggaagaggcctgtactgaactcgtgccatacctcagttacatattggacacgcttgtttttgcctttgggaaataccagcataaaaatctcttgatcctgtacgacgccatcggcacattggcagatagcgtcggacaccatttaaatcagccggagtacatccagaaactaatgccacccctgatccaaaaatggaatgaactcaaggacgaggataaggacttgtttcccctgttggagtgtctgagcagtgttgccaccgcactccagagcggctttctgccctactgcgagcctgtttaccagagatgcgttacattggtgcagaagaccctcgcgcaggccatgatgtatactcagcatcctgagcagtatgaggctcctgacaaggattttatgatcgttgccctggacctgctgtcaggcctggctgaagggcttggagggcatgtggaacagctggtggcccgatcaaacattatgactcttctgttccagtgcatgcaggactcaatgcccgaggtgcgccagtcgtcctttgcacttctcggcgatctgactaaggcgtgttttattcacgtgaagccctgcatcgctgaattcatgccaatccttggaaccaacctgaatccagagtttatatcagtgtgcaacaatgcgacttgggctatcggagagatatgtatgcaaatgggagctgagatgcaaccatatgtgcagatggtcctgaataatttagtcgaaattataaatcgaccaaatactcctaagacactcctggaaaacacaggtagacttacctctccttcagctatcccagccatcactattgggaggttggggtatgtatgtccacaagaggtggctcccatgttgcagcagtttatcaggccatggtgtaccagcctgaggaatattagggataatgaggaaaaggactcagcctttcggggtatttgtatgatgatcggtgttaacccaggaggagtagtccaagatttcatctttttttgcgacgctgtggcctcgtgggtgtcaccgaaggacgacttacgcgatatgttttataagattttgcatggattcaaggatcaggtgggggaagataactggcagcagttcagcgagcagttccctccactgctgaaggagagactcgccgcattctatggagtgtag

SEQ ID NO: 244900 - DNA, 3156 bp, Artificial Sequence
  Description of Artificial Sequence: Synthetic coding sequence
ggccagagcgtggggggaagggggctttttagagactgcgcatgtatagaagagactacaggtgccggagctctgagcaggtcaggcgcaggcccattggatgtagaggccgcaggtcctagcccaagccggtgtgagggcggagggtctctgcgagcgaggagccggggtcagaggcacggacccccatgggacgaggggtcatctctcgggcctatgcgtatacgtcgagcaccgcctccacccccagtggcgagattccatatcccacctccggcactgccctctcctaggctgcgagggagggggtggaggtcatggcggggaccccgtacttgggccggtgtggaccggcgaccgccacccgtcaggagaggccgttctcgtcgccacgccgcaacagcagctagcggagccccacccggttcacataccgagccgcagcggccatctgcggacccaggcccataccttcgttcgttgccttgcgcaatggactggcagccggacgaacagggcctgcagcaggtgctccagctgcttaaagatagtcaatcacctaatacagccacccagaggatcgtgcaggacaaactgaagcagctcaaccagttcccagattttaataactacctgatttttgtgcttacaagattgaagtccgaggatgaacctacgaggtctctgagtggactgatcctgaagaataatgtcaaggcccactaccagtcattcccaccaccagtcgctgatttcattaagcaggagtgcctcaataatattggagacgcctcttctcttatccgggctactataggaattttgatcacaacaattgcctccaaaggtgaattgcagatgtggcctgaattgttaccccaactgtgcaatctgctgaactctgaggattacaacacttgtgagggcgcttttggcgctctgcagaagatctgcgaggactccagtgaactcctggatagcgacgcactgaatcgaccattgaatataatgattcccaaatttctgcagtttttcaaacactgttctccaaagattcggagccacgcaattgcctgcgtcaatcaatttatcatggaccgggcacaggcactgatggacaatatcgatacttttatcgagcacttgttcgcgctcgcagttgacgatgaccctgaagtgagaaaaaacgtttgccgggcattggtaatgctgttggaggtgcgtatcgacagattaatacctcatatgcacagcattatacaatatatgctccaaagaacgcaagaccacgacgaaaatgtagccttggaagcgtgcgaattttggctgacactcgctgagcaaccaatctgcaaggaggtcttagccagtcacctggttcagctgattcccattttggtgaacggaatgaaatatagcgaaatagacataattttacttaagggcgatgtggaagaggacgaagcagttcccgattccgagcaggatatcaagcctagatttcacaaaagccgcactgttactctgccccatgaagccgagcgacccgacggcagcgaggacgctgaagacgacgacgatgacgacgcactcagcgactggaacctaagaaaatgtagcgctgcagcccttgatgtgcttgctaacgtgttcagagaggagcttcttccacatctgcttccactactgaaaggcttgctcttccacccagagtgggtggttaaggagagtggaattttggttctcggcgctattgctgagggctgcatgcagggcatggtcccctatctgccagagctgatcccgcacctcatccagtgtctctccgacaagaaggctctggtgaggtcaatcgcctgttggaccctcagccgttatgcacactgggtggttagtcagccaccagatatgcatcttaaacccctcatgaccgagctgttgaaaagaatcttggacgggaacaagcgagtgcaggaagcagcctgttctgctttcgctactctggaggaagaagcttgcactgaactggtcccatatctatcatacatcctggacaccctcgtttttgccttcggtaaatatcagcacaagaacctattgatcttatacgacgctatcggcaccctagcagactcagtcggccaccacctgaaccagcctgaatacatacaaaagcttatgccccctttgattcaaaagtggaatgagttgaaagatgaagacaaagatctctttccattacttgagtgtttgagctctgtggccactgcactgcagtcgggcttccttccttactgtgagccagtgtaccagcggtgtgttaccctggtgcagaagactctggcccaagccatgatgtacacacagcaccctgagcagtacgaggctccagacaaggattttatgatagtcgctttagatctgctcagcggactcgcagaaggtctaggaggccacgtcgaacagctggtggcgagaagtaatataatgaccctgttgttccaatgcatgcaggactcaatgccagaagtgaggcagtcaagcttcgctctgctgggcgatttgacaaaggcttgctttattcacgtgaaaccctgcatcgcggagttcatgccaattttgggcacaaacctaaacccggaatttatcagcgtctgtaacaacgctacatgggccattggcgagatatgcatgcaaatgggcgcagaaatgcaaccatacgtgcagatggtgttgaacaacctagtggaaatcatcaacaggcctaataccccgaagaccctgttagaaaatacagcaatcacaataggacgcctcggctacgtgtgtcctcaggaggtcgctccaatgttacagcagtttatccgaccttggtgcacgagtctccgtaacataagagataacgaagagaaagatagcgcatttcggggtatctgtatgatgatcggtgtgaatccagggggtgtggtacaagacttcatatttttttgtgatgccgtggcgtcttgggtgagcccgaaggatgatctgagagatatgttttataaaatcctccacggattcaaggaccaggtgggtgaggataactggcagcaattcagtgagcaattcccacctttgctgaaggaaaggctggctgcattttatggtgtttag

SEQ ID NO: 244901 - DNA, 2316 bp, Artificial Sequence
  Description of Artificial Sequence: Synthetic coding sequence
atggactggcagcctgacgaacagggtctgcaacaagtactgcagctcttaaaggacagccagtctcccaataccgccacacaaaggatcgtacaggacaagctcaagcaactaaaccagtttcctgacttcaacaactacctgattttcgttttgacccgcctaaaatccgaggatgagcccacccgcagtctgtcgggcttaatccttaagaacaacgttaaagcacattaccaaagttttcccccacctgttgctgacttcatcaagcaggaatgtctaaataatatcggggacgcctcgtcccttattcgggctacaatcggtattctgatcacaacaatcgcaagcaagggcgaactccagatgtggccggaacttcttcctcagctctgtaatcttctgaacagcgaggattataatacttgcgagggcgctttcggagccctgcagaaaatttgtgaagatagttctgaactgctggatagcgacgcactgaatagacccttgaatattatgatccctaagttcttgcagttttttaagcattgcagccccaaaattcgctcccacgccattgcttgcgttaatcagtttattatggaccgcgcacaggccctcatggacaacattgacacattcatcgagcatttgttcgcactcgccgtggatgatgatcccgaggtaagaaaaaacgtgtgccgtgcccttgtgatgctgctcgaggtgcgtattgaccgcttaatcccgcacatgcactctatcatccagtacatgctccagcgtacccaagatcacgatgagaacgttgcgctcgaagcttgcgaattctggctcactctggcagagcagcccatctgtaaagaagttctagcttctcatctggtccaacttatcccaatcctggtgaacgggatgaagtactctgagattgatatcatactcctcaaaggagacgtggaagaagacgaagcagtgccagattcagagcaggatattaaacccaggttccataagtctaggactgtgaccctgccccacgaggccgagaggcctgacggttctgaggatgcagaggacgatgacgacgacgatgccttatccgactggaacctcaggaaatgttccgccgctgcacttgatgtcctggcaaatgtattcagagaggagctccttccccacctattacctcttctgaagggattacttttccatccagagtgggtcgtaaaggaaagcgggatcttagtgctcggggctattgccgaagggtgtatgcagggaatggtgccatacttgccggagctgatacctcatttgatccagtgtttatccgacaagaaagctctggtgcgctcaatcgcctgttggacacttagccgttacgctcattgggttgtgtcccagccccctgatatgcatctgaagccactcatgacagagcttttaaagagaatcctggacggtaataaaagagtccaggaggcagcctgcagcgcttttgcgacccttgaagaagaggcctgtaccgagctggtcccttacctttcctacattctggacacactggttttcgcttttggtaagtaccaacataaaaacttgttgattctgtatgatgccatcggtacactagcggatagcgttggacaccacttgaaccaaccagagtacatacaaaaacttatgccgcctctcatccaaaaatggaacgaactgaaggacgaggataaagacctctttcctctgctggagtgccttagctctgtcgcgaccgccctgcagtctggcttcctcccttactgcgaaccagtgtaccaacggtgcgtgacactggtccaaaaaactctcgcccaggccatgatgtacacacagcatccagaacaatatgaggccccagataaagattttatgattgtagccctggacctcctgtcagggttagcggaaggactggggggtcacgtagagcaattggtcgcaaggtcaaacataatgactctgctctttcagtgtatgcaggattcgatgccagaggtgagacagtctagtttcgcgcttctgggcgatctaactaaggcctgtttcatccatgtcaagccttgtattgccgagttcatgccaatcctgggaacgaatttaaatccggagttcataagcgtgtgcaacaatgccacctgggccatcggggaaatctgtatgcagatgggagcagagatgcagccttacgtgcagatggtcctcaataacctggtagagattatcaacaggccaacacctagccagaagcagaacaagaccaagaaaaataaatag

SEQ ID NO: 244902 - DNA, 2772 bp, Artificial Sequence
  Description of Artificial Sequence: Synthetic coding sequence
atggagggagccaagcctacactccagttggtgtatcaagctgttcaggccctttaccacgatccagatccctcaggaaaggagcgtgcttcattttggcttggcgagctccaaagatctgtccacgcatgggaaatttccgaccagctgctgcagattcggcaggatgtagaatcatgctatttcgctgcgcagactatgaaaatgaaaatccaaacaagtttctacgagcttcctactgactctcacgcgagtctgcgggacagtcttctgacacatattcaaaacctgaaggacctctcaccagtcatagtgacacaattggctctggctattgcagacctcgcccttcaaatgccatcttggaagggctgtgtgcaaacacttgtcgaaaaatacagcaatgatgtgaccagtcttcctttccttctcgagatcctgactgttctccccgaagaggttcactcgcggtctctgaggattggtgctaatcgacgcaccgagattattgaagatctcgccttctactcatctacagttgtcagtttgctgatgacatgcgtggagaaggcaggcactgatgaaaagatgctgatgaaggttttccgatgcctcgggtcctggttcaaccttggagtcttggatagcaacttcatggcaaataataaattgctggcccttctgtttgaggtgttacaacaggataagacgtccagtaatctccatgaagcagcctctgactgtgtctgctctgctctgtacgccatcgagaatgtagagaccaatctgccgcttgctatgcagctgttccagggcgtgctgactcttgagactgcgtatcatatggccgtggctcgcgaggatttagataaggtgcttaattactgtcgcatctttactgagttgtgcgagaccttcctcgaaaaaatagtgtgtacgcctggccaaggtctgggggatctccgcactctggagctcctgctgatctgcgccggacacccccaatatgaagtggtggagattagtttcaacttctggtataggttaggggagcacctgtacaagaccaatgatgaagtgattcacggtatctttaaggcttacattcaacggctgctccatgccttagctcgccactgtcaacttgaacccgatcatgagggtgttcccgaggagaccgacgactttggagagttccgtatgcgcgttagcgacctggttaaggacctgatcttcctgatcggttccatggagtgttttgcccagctgtactcaacactgaaggaagggaatcccccttgggaggtgactgaagccgtgctgtttatcatggcggcaatagctaaatccgtggaccctgagaacaatccaacccttgtggaggtgctcgagggcgtggtccgccttccggagacagtgcacaccgccgttcgctacacatctatcgagcttgtaggcgaaatgtcagaagtcgtggaccggaatccccaattcctggatcctgtgctgggatatctcatgaagggcctttgcgagaaaccattggcatcagctgctgctaaggccattcacaatatctgcagcgtctgcagagatcacatggctcagcacttcaacggtctgctggagatagctcgaagtctcgactcctttcttttatcgcccgaggctgctgttggactcctcaagggaaccgccctggttttagccagattgccactggacaagataactgagtgcctgagcgagctgtgcagtgtgcaggtgatggctctcaagaaattgctgtcccaagaaccctctaacggcatcagtagtgatcccaccgtgtttttagatagacttgccgttatttttcgacacacaaaccccattgtggaaaacggccaaacacacccgtgccaaaaagtgatccaagagatatggcccgtcctttctgagactctgaataagcacagggctgacaacaggatcgtggaacgttgttgtcgctgtttacgctttgcagtgcgctgcgtgggtaaaggatccgcagccctgttgcagccattggtcacgcagatggtaaacgtctaccatgtccaccagcacagttgctttctgtatctgggttcaatcttggtagatgagtacgggatggaagagggctgtcgccagggcctattagacatgctccaggctctttgtataccaactttccagcttctagaacagcagaatggcctgcagaatcacccagacactgtggatgatctcttcaggttggccacacgctttattcaaagatcacccgtgaccctcctgcgttcccaggtagttatccccatcctccagtgggccatagcttccaccactctggatcacagagacgccaattgttccgtgatgcgattcctacgtgatctcattcacacaggggttgctaacgaccatgaagaggatttcgaactgagaaaagagctgatcggccaggtcatgaaccagttgggacagcaactagtgagtcaactcctgcacacctgctgcttttgtctccccccttacaccctgccagacgtagccgaggtactgtgggaaatcatgcaagttgatcgacccacgttttgcaggtggttagagaattcccttaagggccttcctaaggaaaccacagtgggagctgtcaccgtgactcataaacaactgacagattttcataaacaggtgacttcagcagaggaatgtaagcaggtctgctgggcactaagggacttcaccaggttgttcagatag

SEQ ID NO: 244903 - DNA, 2874 bp, Artificial Sequence
  Description of Artificial Sequence: Synthetic coding sequence
atggagggagccaagcctaccctccagctggtgtatcaggccgtacaggctctgtatcacgatcctgaccctagcggcaaagagcgtgctagtttttggctgggtgagctgcagcggagtgtgcacgcgtgggaaatttccgaccagcttttacaaatccgccaagacgtggaaagctgttacttcgcggcacagaccatgaaaatgaagatccagacgagtttctacgagctacccaccgactctcacgcctctctgagagacagcctgctcactcatatccaaaacctgaaagacctgtcacctgtgattgtgactcagcttgctctggccatagctgacttggcactgcagatgcccagctggaaaggatgtgtccagacccttgtggagaagtacagcaatgacgttacctcgctaccgtttctgcttgagattctgacagtcctgcctgaggaggtccactctagaagcttaaggattggagctaaccgacggaccgaaatcatcgaggacctcgccttctactcttctacggtggtcagcctccttatgacctgcgtcgaaaaggcgggtacagatgagaagatgttaatgaaagtgttcaggtgcttggggtcatggtttaatctgggggttctcgattccaattttatggcaaataacaaactgctggccctgttgtttgaagttctgcagcaggataaaacgagcagtaatcttcacgaggccgcttcggactgtgtatgcagcgcgctgtatgcaatcgagaatgtggagactaacctgccgttggcaatgcagctgtttcagggagtcctgactctggaaacagcctaccacatggccgtggcccgtgaggacctagataaagtgctgaattactgccggatttttactgagctatgcgagacattcttggagaaaatcgtttgcactcccggtcaaggtctgggcgatctgcgaactttagaattgctgctgatatgcgccggacacccacagtatgaggtggtggaaatcagcttcaacttctggtatcgtctgggcgagcatctgtacaaaactaatgacgaagtaattcacggtattttcaaggcttacattcaacggctcttgcacgccctagctcgccattgccagctggaacccgatcacgagggcgttccagaggagaccgacgactttggtgaatttaggatgagggtgtccgacctggtcaaagatcttatttttcttattggatccatggagtgcttcgcgcaactgtactccacactcaaggaagggaaccctccatgggaggtcacagaggccgtcctgtttatcatggctgctattgccaagtctgtagatcccaaaaagcccttctctaacgcggtctgtcggcacagtttgctgtttggtcagaatatcacgtccgaaatttcaaactgtgaatatctcccccctgttctcagggaaaataacccaaccctagtggaagtgctggagggagtggttcgactgcccgaaacggtgcatacagccgtgagatatacaagcatcgagctcgtgggcgagatgtcagaggttgttgataggaatccacagttcctggatcctgtgctggggtatctcatgaaaggactctgcgagaagccactagcctcagctgctgcaaaggccatacacaatatctgctcagtgtgccgtgaccatatggcacagcacttcaacggccttctggagatcgctagaagcctggattcctttttgctgtccccagaggccgcagttggtttgcttaaggggacagccctggtgttggctcggcttcccctcgacaagattacagaatgcctgagcgaactttgcagcgtgcaagtgatggctttgaaaaagctgctgtctcaggagccttccaacggtattagtagcgacccaacagtatttctggataggctggcagtgatcttccgacacacaaatcccatcgttgagaacggccagacacatccctgccagaaagtgattcaggagatatggcctgtgttgtctgagacactgaacaagcatagagccgacaaccggatcgtcgaacgctgctgtaggtgcctgcgctttgctgtgcgctgtgttggcaaaggctcggccgctctgctacagccgttggtcacacagatggttaacgtgtaccacgtccatcagcacagttgttttctctacctcggatcaatactggtcgacgagtacggtatggaggagggatgccgccaggggctgcttgacatgctgcaggccttgtgcatccctacgttccaactgctggaacagcagaacggcctgcaaaaccatcccgatactgtcgacgacctgttcagacttgctacccggttcattcagcgcagtcctgtcacactgcttcgcagccaggtagtgatccctatcttacagtgggcgattgcctctaccacgttggaccatagggatgccaattgctccgtcatgaggttcctgcgcgatctgatccatacgggagtcgcgaacgatcatgaggaagactttgagctccgaaaagagcttatcggtcaggttatgaaccagcttggccaacaactggtgtctcagctgctccatacatgttgtttttgcctcccaccctacactttacctgacgtcgcggaagtcctctgggagataatgcaggtcgaccgccctacgttctgtagatggttggagaactccctaaagggactgccgaaggagaccactgtgggagctgttactgtcacccacaagcagctgaccgactttcacaagcaagtcacatcagccgaggaatgcaagcaggtgtgctgggcacttagggactttactagactgtttcgatag

SEQ ID NO: 244904 - DNA, 2874 bp, Artificial Sequence
  Description of Artificial Sequence: Synthetic coding sequence
atggaaggggcaaaaccaactctgcaattggtttatcaggcagttcaggcactgtatcacgaccccgaccccagtggcaaggagcgcgcatccttttggctaggcgaactgcagcggagtgtgcacgcctgggagattagtgatcagctgctacagattcgtcaggacgtggagtcatgctactttgccgctcagactatgaagatgaaaattcaaacctctttctatgagttgcccactgactctcacgccagcctcagggattcacttttgacccatattcagaatttgaaagatttaagccctgtcatcgtcacgcagttagctctggcaatcgccgatcttgctctgcaaatgccttcttggaagggatgtgtacagaccttggttgagaaatattctaacgatgttactagccttcctttcctgctcgaaatcctgactgtgctgcctgaggaagtccactcacgaagcttgagaatcggtgccaatagacgcaccgagattatagaggacctggcattttacagttccactgtggtgtcacttctgatgacctgtgtagaaaaggcgggaactgatgaaaaaatgctcatgaaagtgttccgttgcttgggaagttggttcaatctaggcgtgttagactctaattttatggcaaataataagcttctggctctgctttttgaggttctgcagcaggacaaaacttcgtcaaatctgcacgaggctgcatccgactgtgtgtgtagcgcactgtacgcaatcgagaacgtcgagacgaatctgcccctggccatgcaactgttccagggagtgctgacactggagacggcctaccacatggcagtggcccgagaagatctggacaaggtgcttaactattgtcgcatctttactgagctgtgtgagacgttcctggaaaagattgtgtgcactcccggacaggggctcggcgatctgaggacactggagctgcttctaatctgcgctggacatccacagtacgaagtagtcgagattagctttaatttctggtataggctgggtgagcacttatataaaaccaacgatgaggtgattcacgggatattcaaggcatatattcagcggctgttacatgctctcgcgagacactgccaactggaacccgaccatgaaggggtgccagaagaaacggatgacttcggagaatttaggatgcgcgtttctgacctagtcaaggatctgattttcctgatcgggtctatggagtgcttcgcccagttgtattccactctcaaggagggtaaccccccatgggaggtgactgaagcagttttatttatcatggctgccattgctaaatccgtcgaccccaagaaaccttttagtaatgctgtgtgtcgccactcccttctgtttggccagaatattactagcgagatttctaactgcgagtacctgcctcctgtactgagagagaacaatccgacccttgtcgaggtgcttgagggcgtggtgcggctccctgaaacagtccacaccgctgttaggtataccagtatcgaactggtaggggaaatgtcagaagttgtggaccgcaatccccagttcctcgaccccgtgcttggatatctgatgaaggggctgtgtgaaaagccattggcctcagccgctgccaaggctattcacaacatctgttcagtctgccgtgatcatatggcccaacacttcaatggcctcttagaaattgcaagatcactcgactccttcttgctcagcccagaggcggctgtgggtcttctaaagggaacagccctggtcctcgctcgattacctctggacaagatcaccgagtgcctgagtgagttgtgttcagtgcaggtcatggccctgaaaaaacttctctctcaagagcctagcaacgggattagtagcgacccaacagtgtttctggacaggttggccgtgatcttccgccatacgaatcctatagttgaaaatgggcagacgcacccatgccagaaggtgatccaggagatttggcctgtccttagcgaaacacttaacaaacaccgggcagacaaccggatcgtggaacgctgctgccgctgtttgagatttgcggtacggtgcgtcggtaaagggagcgcagccctcctccaacctctcgtcacgcaaatggtgaatgtctaccatgtgcaccagcattcctgcttcttatacctgggttcaatccttgtcgacgaatacggtatggaggagggctgcaggcagggtctcctagatatgctgcaggccttatgtatccccacattccagctcctcgaacaacagaacggattacaaaaccacccagatactgtcgacgacctgtttaggctggccacacgttttatccagcggagtcccgtgacattgctcaggtctcaggtggttatacctattttgcagtgggctatcgcctccactaccttggaccatagagacgccaactgctccgtgatgcgtttcctacgcgatctcattcatacaggtgtggccaacgatcatgaagaagacttcgagctgaggaaagagctgatcggccaggttatgaatcagctgggccagcagctcgtgagtcaactgcttcacacatgctgcttctgtctccctccctatactctgcccgacgttgcagaggtgctgtgggagataatgcaggttgatcgcccaacattttgtagatggttggaaaactccctcaagggactgcctaaagagacaacagtcggggctgtgaccgtgactcacaaacagctcacggacttccacaagcaggttacaagtgcagaagagtgtaagcaggtttgttgggcactgcgggactttacaaggctgttccgctag

SEQ ID NO: 244905 - DNA, 2580 bp, Artificial Sequence
  Description of Artificial Sequence: Synthetic coding sequence
atggagggcgcaaaaccaaccctacagttggtttaccaggccgtccaagccttgtaccatgatccagacccctccggcaaggagcgcgcatccttctggttaggcgagctgcaacgctcggtgcatgcctgggagatctcggaccagcttcttcaaatccgtcaggatgttgagtcgtgctacttcgccgcacagacgatgaagatgaagattcagaccagcttctacgagctgccgaccgatagccatgcctcactcagggacagcttgttaactcacatccagaatctcaaggacctttcccctgtgatcgtcactcagttagctttagcgatcgctgacctggccctccagatgccatcatggaagggctgtgtccagaccttggtggaaaagtacagtaacgatgtcacttctctgccatttctgctggaaatcctgaccgttctcccagaagaagtccatagtaggtcgctgagaataggtgctaatagacggacagaaatcatcgaggacctcgcgttttacagcagtactgtggtctcgttgctaatgacatgcgtggaaaaagctggtacagatgagaaaatgcttatgaaagtgttccggtgcctgggatcttggttcaacctcggagtgctggactccaacttcatggctaataacaagctcctcgctttgctattcgaggtgctgcagcaagacaaaacttccagcaacctgcatgaggccgcatctgactgtgtctgctccgcgctctatgcaatagagaacgtcgaaactaacctcccactcgccatgcaactgtttcaaggcgttctgacgttagagacagcctatcacatggctgtggctagagaggatttggataaggtgttaaactattgccggatctttaccgaactctgtgagacatttcttgagaaaatcgtttgcacacctggtcaggggttaggcgacctgcgcactttggagctcttgctgatctgcgcaggtcacccccagtacgaagtagttgagataagttttaacttctggtaccgcctgggggagcacttatataagactaatgacgaggtcatacacgggattttcaaggcatatatacagcgcctgctccatgcccttgcacggcactgccagctggagcctgaccatgagggggttcctgaggaaacggatgactttggcgagtttaggatgagagtgtccgacctcgtgaaggatttgatattccttatcggatctatggagtgttttgcccagctttattctactctcaaggagggaaacccaccttgggaggtcacagaggccgttctgtttatcatggctgcaattgccaaatccgttgaccccgagaataatccaacactggtggaggttctggagggggtcgttcggctgcctgaaacagtgcatacggccgtgaggtacacaagtatagagctcgtgggtgagatgtccgaggtggtagaccgcaacccccagttcttagggacagcactggtcctggctagactgccccttgataaaattaccgagtgtctgagtgaactctgtagcgtccaagtaatggcccttaagaaactgctgagccaggaaccctctaacggcatttcaagcgatccgacagttttccttgatcgcttggcagtgatctttcggcatacaaacccgattgttgaaaatggccagacccacccgtgccaaaaagtcatccaagagatttggccagtgctgtctgagacactgaataagcatcgggctgacaatagaatcgttgaacgctgctgcagatgtctgcgctttgcagtgcgctgcgtgggcaaggggagtgccgcattgctgcaacctcttgtgacgcagatggtgaacgtctaccacgtgcatcaacactcgtgtttcctttacttgggttcaattcttgtcgacgagtacggaatggaggaggggtgcagacagggccttctcgacatgcttcaggccctctgtattcccaccttccaactcctggagcaacaaaatggtctgcagaaccatccagacactgtggatgaccttttcaggctagccacgaggtttatccagaggtcccctgtaacactactgcggagccaggtcgtcatacccatcctccagtgggccattgccagtactaccctcgaccaccgtgatgcgaattgctccgtgatgagattcctgcgcgatcttattcacaccggcgtggcaaacgatcacgaggaagattttgaactccggaaggagcttattggtcaggtcatgaaccaactgggtcagcagttggttagtcaactcctgcacacatgttgcttttgtcttcccccttacactttgccagatgtggccgaggtgctttgggagatcatgcaggtggaccgaccaacattttgccgctggttggagaacagtttgaagggcctgcccaaagaaacgactgtgggggctgtcaccgtcacacataaacagttgaccgatttccacaagcaggtgacttccgccgaagagtgcaaacaggtctgctgggcccttagagacttcactaggctgttccggtag

SEQ ID NO: 244906 - DNA, 4236 bp, Artificial Sequence
  Description of Artificial Sequence: Synthetic coding sequence
atggcagaagccaggaagaggagggagctcctccctctgatctaccatcatcttctgagagctgggtatgtgcgggctgctcgcgaagtcaaagaacaaagtggccaaaagtgcttcctggcccagcccgtcacccttctggacatatatacccactggcaacagacctccgagctcggccgtaagaggaaggccgaggaggatgctgcactccaggcaaagaagaccagggtttccgaccccatatccacctccgagtcatcggaggaggaggaagaggctgaggcagaaacagcaaaggctaccccacgactcgcaagcactaatagctccgttttgggcgctgacttgccaagctctatgaaggaaaaagccaaggccgagaccgaaaaggccggtaagaccggaaactctatgccccaccctgcaacaggaaaaaccgtggccaaccttctgagtggaaagtcccccaggaagtcggcggagcctagcgctaacaccactctcgtgtccgagaccgaggaggagggctctgtgcccgcatttggtgccgctgcaaagccaggaatggtgtccgccggacaagccgactccagttccgaggacactagctctagcagcgatgagacggacgtggaggttaaagccagcgagaagatactccaggtccgggctgcaagcgctccagccaaggggacccctgggaagggcgcaacaccagctccacccggtaaagccggtgctgtagcatctcagaccaaggctggaaagccagaggaggactccgaatccagtagcgaggagtccagcgacagtgaggaagaaacgcccgcagccaaggccttactgcaggctaaggccagtggaaaaacatctcaggtgggtgccgcaagcgccccagctaaagaatccccacgaaaaggcgcagctcctgccccaccaggaaaaactggaccggcagtcgccaaagctcaggccggaaaacgcgaggaagattcccaaagcagcagcgaagagagtgactccgaagaagaggccccagcacaagctaaaccttccggcaaggcccctcaggtgcgggcagcctcagcacccgctaaggaaagtcccaggaaaggagccgctccagcacctccccgaaagactggccctgctgctgcccaggtccaagtcggcaagcaggaagaggattcccggagttccagcgaggagtctgactctgatcgagaggcgctggccgctatgaatgcggctcaggtcaagcccttggggaagtccccacaggtcaagcccgcttccactatggggatgggacccctcggaaaaggtgcaggccctgttccacccggtaaggtggggccagccacgcccagcgcacaggtgggaaaatgggaggaggacagcgaatcgagcagcgaggaatctagcgacagttccgacggggaggtgccaacagcggtggcgccagcccaagagaaatcactgggaaacattctacaggctaaacctacatcgtccccagccaaggggcctccccagaaagctggcccagtggccgtgcaggtgaaggctgagaagccaatggacaactccgagtcgtcggaagagtcgtccgacagcgcggactcagaggaggcgcctgcggctatgaccgctgcccaggccaaaccagctctcaaaatcccacagacgaaagcctgtcccaagaaaaccaatactaccgccagcgctaaagttgctccggtgagggtgggaacacaggctccaagaaaggctgggactgcgacttctcctgcgggatcttcgccagctgttgccggtggtacccagcgcccagccgaagacagctcctctagcgaggaaagtgacagtgaagaggagaaaactgggctggccgtcacagttggccaggcgaagagtgtggggaagggcctgcaagtgaaggcagcatcggtccctgtcaaggggtccttggggcagggaacagcccctgtgctacctggcaaaacaggccctaccgtgacacaggtgaaggcagaaaagcaggaggactccgagtccagcgaagaggagagcgacagcgaggaggccgctgctagcccagctcaggtgaagacctctgtgaagaaaactcaggccaaagccaacccagcagctgcaagggccccatccgcgaaaggcacgattagcgctcctggcaaagtagtgactgcggctgcacaggcgaaacagcgctctccttctaaagttaagccccctgtgaggaatccccagaactcaactgttctggcaagagggccagcttccgttccctccgtcggcaaagccgtggcaacagcagcacaggcccagaccggcccagaggaagactctggctcatccgaagaagaatcagattccgaggaagaggccgaaactctcgcgcaggtgaagcccagcggaaaaactcaccaaatccgcgcagcattagcgcctgccaaggagagcccaaggaagggagcagctcccacacctccagggaaaaccggcccttccgctgcccaggctgggaaacaagatgactcaggctcctcaagtgaagagagtgacagtgacggcgaggctcccgctgcagtcacttccgcgcaggttatcaagccccctcttatcttcgtggatcccaaccggagccctgccggtccagccgcaacccctgcacaggcacaggccgcaagcacaccaaggaaggctagagcgagcgagagcaccgccaggtcgtcgtcttccgaaagcgaggatgaagacgtgatccctgcaactcagtgtttaacccccggtatcaggactaatgtggtaactatgcccacagcccatccgcgtattgcacctaaggcctcaatggccggagccagctccagcaaggagtccagccgcattagtgatggcaaaaaacaggagggacctgcgacacaggtgagcaagaaaaaccctgcatctctcccgttgacccaagccgctcttaaggttctggcacagaaagcaagcgaagctcagccccctgtggcacgtacccagccaagctccggggtggacagcgccgtcggcacactgccagccacatcgccccaatctacaagcgttcaggccaaggggactaataaactccggaaacctaaactgcccgaggtgcagcaggcaacgaaggctccagagtcttccgatgacagcgaggactccagcgatagttcaagtggtagcgaggaagatggagaggggccacagggtgccaagtcagcacataccctggggcctacgccgagcaggaccgaaacgctggtcgaagaaactgctgccgaatcttctgaggacgacgtcgtagcccctagccagagcctgcttagcggatacatgacaccagggctgacacccgcaaatagccaggcctctaaggctacaccaaagctggatagctccccaagtgtgtctagtacgctggccgctaaggacgatcccgatgggaaacaggaagctaagccgcagcaggccgcaggaatgttatcacccaaaaccggcggtaaggaggcagctagcgggactacaccccagaagtctagaaagccaaagaagggggcaggtaatccccaagcctccactctggcgctgcagagtaacataactcagtgcctgctcgggcagccatggcccctgaacgaagcccaggtgcaggcatcggtggtgaaggtgttgacagagctgctggaacaggagagaaagaaggtggtcgatactaccaaggagagctctcgaaagggctgggagtcacgcaagcgtaaactctctggcgaccaacccgctgctcggactcctcggtctaaaaagaagaagaagttgggcgcaggggaaggcggtgaggcttctgtgtccccggagaagacaagcaccaccagcaaaggaaaggcaaagcgggataaggcgtcaggcgatgtgaaggaaaagaagggcaagggctctctgggtagccaaggtgcaaaggacgagcccgaagaggagctgcagaagggcatggggaccgtggagggaggcgaccagtctaatccaaagagtaaaaaagagaaaaagaaatccgataagaggaaaaaggataaggaaaaaaaagaaaagaagaagaaagctaaaaaggcctccaccaaagattcggaatcccctagccagaaaaaaaagaaaaaaaagaagaaaacagccgagcagactgtgtag

SEQ ID NO: 244907 - DNA, 4470 bp, Artificial Sequence
  Description of Artificial Sequence: Synthetic coding sequence
atggcagaggcgaggaaacggagagagctgctgcctctaatttaccaccaccttctccgcgctggctacgtacgtgccgcaagagaggttaaggagcagtctggacagaaatgcttccttgcgcaacccgtgactctgctggatatttatactcactggcagcaaacttctgaattgggcagaaagagaaaagcagaagaggacgcagccctccaggcaaagaagactcgcgtatcagacccaatctccacatcagaatcaagcgaagaggaggaagaggctgaagcagagacagcaaaggccacccctcgcctggcctctacgaattcttcagtgcttggagcagacctgccttcctccatgaaggaaaaggccaaagccgagactgagaaagctggcaaaacgggaaacagcatgccacaccccgctaccgggaagacagttgccaatctgctgagcggaaagagcccccgaaaatctgcagaaccatcggccaacaccacactagtgagcgaaacggaagaggagggatccgtcccagctttcggcgctgctgccaaaccagggatggtttccgccggacaagctgattcttccagtgaagacacaagctcctcctccgacgaaactgacgtcgaaggtaagcctagcgttaaaccggctcaggtcaaggcttcctctgtcagtaccaaagagagtcccgcacgcaaagccgctccggcaccagggaaggtcggtgacgtcacccctcaggttaagggcggagcccttccccctgcaaagcgcgctaaaaaacccgaggaagaaagcgagagttccgaggaaggaagcgaaagtgaggaggaggcacccgctggtacacggtcacaggtgaaggctagcgaaaaaatccttcaagtgcgagcggctagtgcccctgctaaagggacacctggcaaaggcgcaactcctgccccaccaggcaaagccggtgctgtcgccagccagactaaagctgggaagcccgaagaagactccgaaagctcttcggaagaaagcagtgatagcgaggaagagacccccgctgcaaaagccctgttgcaggctaaggccagcggaaagactagccaggtgggggctgccagcgccccagctaaagaatccccacggaaaggggctgcacccgcacccccagggaaaaccggcccagctgtggcgaaggcccaggccggtaaacgggaggaggacagtcagtcatcctccgaagagtccgactcagaagaagaagcccctgcccaggcgaagccaagtggcaaggcccctcaagtgagagctgcatccgcccctgccaaagaatccccgagaaagggcgctgcccctgcacctcccagaaaaacgggtcccgcagccgcacaggtccaggtggggaagcaggaagaagactccaggagcagctccgaggaaagcgatagtgatcgggaagcactagctgcaatgaacgctgctcaggtgaaacctctgggcaagtcaccccaggtcaaacctgcttctactatgggtatgggtccactgggtaaaggtgcaggacccgtacccccagggaaagtcggacctgcaaccccctccgcccaggtgggcaaatgggaggaggactcagagtcatcgtcggaggagtcctccgattcttcggacggagaggtgcctacggccgtagccccagcgcaggaaaagtcattgggcaacatcctgcaagcgaagcctacctcatcccctgccaagggccctccccaaaaagctggccctgtcgctgtgcaagtgaaggctgaaaaacccatggacaattcagaatcttctgaagagtcctccgatagtgcagattcggaagaagccccagccgcaatgactgctgcgcaggcgaaacctgctctcaaaataccccaaaccaaggcttgccccaaaaagacgaatacaactgcctccgctaaggtggcccctgtgcgggtcggaacccaggctccccgaaaggctggcaccgccaccagtcctgctggttcttctcctgcagtcgctggaggcacacaacggcctgcggaagatagctcaagcagcgaagagagtgactccgaagaggagaaaacagggcttgctgtcaccgtggggcaagccaagagtgtcggaaagggcctccaagtcaaggcagcttccgtccccgttaagggcagtcttgggcaggggacagcgcctgttctgccaggaaagactggcccaaccgtaacacaggtaaaggccgagaagcaagaggattccgagagctctgaagaggaatcagattccgaggaggctgccgcatctcctgctcaggtcaaaacttccgtgaagaagacacaggcaaaagcaaatcctgctgccgcacgagcgccttccgcaaagggcactatttcagcccctggcaaggtggttacagctgccgcacaggccaagcagaggtctccatccaaggtgaaaccccctgtgaggaaccctcaaaattcaacagtgctcgcaagaggtcccgcttctgttcctagcgtgggaaaagccgtagccactgccgcacaggcccagaccggaccagaggaggacagtggcagctcagaggaggagtccgactccgaggaagaagcagagacgctggcccaggtgaagcctagcggcaagacacatcagattcgcgcagccctggctccagctaaagagtccccgaggaagggggcagctcctacgccccctggaaagactggcccaagtgccgctcaggcaggaaaacaggatgattctgggtccagctccgaagaatccgactctgatggggaagcccctgccgctgtaacaagcgcccaagtgattaaaccacctttgatttttgtggatcccaatagatcccctgctggaccggctgccacccctgctcaggcgcaagcagcatccacgcctaggaaggccagagcctcagagtcaacagctagaagctctagcagtgagtctgaagacgaagacgtgatcccggcaacccagtgcctgactcccggtatcaggacaaatgtggttaccatgccaaccgcccaccctagaatcgcacctaaggcatcaatggccggtgccagtagttccaaggaatctagcaggatcagtgacggcaagaagcaggaagggcctgcgacccaggtctcgaaaaagaacccggcttctctccctcttacccaggctgctctgaaagtgctggcgcagaaggcttccgaagcccaaccgcctgttgcaaggacccagccatcttccggagttgacagcgcggtcggcacactgcccgcaacatctccccaaagcaccagcgtgcaggcaaagggaaccaataagcttcgcaagccgaagttaccggaggtgcagcaggctacaaaggctccagagtcatccgacgactccgaagatagttctgatagcagctccggcagcgaagaggacggggaaggccctcagggtgctaagtcggcccacaccttggtggggccaactccttcacggaccgagactctggtggaggaaactgctgccgagtcctccgaagatgatgtcgttgccccatctcaaagcttgctttctggctacatgactcccggtctcacaccggctaattctcaggccagtaaggctacacccaagctggacagtagcccctccgtgtcatccacattagccgctaaggacgacccagatggaaaacaggaggctaaaccccagcaggcggcaggtatgctaagtcccaaaacaggtgggaaggaagctgcttcaggcactactcctcagaagtcacgcaaaccaaagaagggcgctggcaatccacaggcttccacgttggcactccaaagtaatattacacaatgcttactgggccaaccctggcctctcaatgaggcccaagttcaggctagcgtggtgaaagtgctcaccgagttactggagcaggagcgcaagaaagtggtcgacacaaccaaggagtcctctcggaagggttgggaatcccggaagcggaaactgtcgggtgatcaacccgctgctcggactccgcgatcaaaaaaaaagaagaaactgggcgctggtgaaggtggagaagcttcggtgagcccggagaaaactagcacaaccagcaaggggaaagctaaaagagataaggctagtggggacgtgaaagagaagaaaggcaaaggcagtctgggcagtcaaggagctaaggacgaacctgaggaggaactgcagaagggtatgggcacagtggagggtggagaccagtcaaaccctaagagcaaaaaggagaagaagaagagcgataagaggaagaaagacaaagagaaaaaagagaaaaaaaagaaagcgaagaaagcatcaactaaggactccgaaagtcctagccagaagaagaaaaaaaaaaaaaagaaaactgctgagcaaaccgtgtag

SEQ ID NO: 244908 - DNA, 2877 bp, Artificial Sequence
  Description of Artificial Sequence: Synthetic coding sequence
atggccgaagccaggaagaggagggagctcttgcctctgatataccaccatctacttagagccggatatgtcagggcggctcgggaggtcaaggaacaaagcggacagaaatgctttctcgctcaacctgttactcttctggatatttacacccattggcagcagacttctgaactcggaagaaagcggaaggcagaagaggacgcagcactacaggccaagaaaacgagggtctctgatccaatcagtacatccgagtccagtgaagaggaagaagaggcagaggccgaaacagcaaaggccacgccaaggctcgcttcaactaactcaagcgttctgggagcagatctcccatcctcaatgaaagagaaggcgaaagctgagacggaaaaggccggaaaaactggtaattccatgccacatccagcgacagggaaaactgttgccaatttactgtccggcaaaagcccgagaaagagcgctgaaccttcagctaacaccaccttagtaagtgagacagaagaggaaggctccgtgcccgcattcggcgctgccgcaaaaccaggcatggtgtctgccggacaggccgatagctcttccgaagatactagctctagctctgatgaaaccgacgtggagggaaagccctcagttaaacccgctcaagttaaggcttcgtccgtcagtaccaaagagtcccccgctcgtaaggctgcccctgcccctgggaaggtgggtgatgtgacccctcaagtgaaaggtggggcactccccccagctaagagagctaaaaagcccgaggaggagtcagagagcagcgaagaagggtcagagagcgaagaggaagctccagccggaactagatcccaggttaaggctagtgagaagattctgcaggttcgcgctgcgagtgctcccgcaaaaggaactcccggaaagggggctactccagccccacccggtaaggcgggagctgtggcttcccagactaaagccggaaaaccggaggaagactccgaatctagtagtgaagagtcttccgatagcgaagaggagacgcccgcagctaaagctctgttacaagccaaggcatccgggaaaacttctcaggtcggtgctgcctcagcccctgccaaggagagtccaaggaagggcgcagctcctgctcctcccggtaaaacaggcccagctgtcgctaaagcacaagccggaaaacgggaagaagatagtcagtcctcatccgaagagagtgacagcgaagaggaggcgcctgctcaggctaagccatcaggtaaagctccacaggtccgggctgcctctgctcccgctaaggaatcccccaggaaaggtgccgcacctgcaccccctaggaaaacgggaccagctgcagcacaggttcaggtgggaaagcaggaggaggattctagatcctcatccgaagagtccgattcagatcgtgaagccttggccgctatgaatgcagcacaggtgaaaccgctggggaagagtcctcaagttaagcccgctagtaccatgggcatggggccacttggcaagggggcaggacctgtgccccctggtaaagtgggacccgcaacccccagcgcccaggtgggcaaatgggaagaggactctgaaagcagtagcgaagagtcttcagatagcagcgacggggaggtaccgacagctgtggcccctgctcaggagaaaagcctgggaaacattctgcaggccaagcctaccagcagccctgcgaaagggcctccacagaaggccggtcccgtggccgtccaagtaaaagctgaaaaaccaatggacaatagcgaaagctctgaggagagtagcgacagtgccgactctgaagaggcacctgccgcaatgaccgcagctcaggcgaaacctgcactgaaaatcccacagactaaagcttgcccaaagaaaaccaacacaaccgcctctgctaaggtggctcccgtgagagtaggaacccaggcccctagaaaagccggaaccgcaacatctcccgctggtagctctcccgctgttgcgggtggaacacagcgccctgccgaggattccagcagttctgaagaaagcgactcagaggaagagaaaactggcctcgcagtcaccgtaggtcaggcaaagtccgtgggcaaaggcttgcaggtcaaagcggctagcgtcccagtgaaaggctcattaggccagggtacagctccggttctgccgggaaaaaccgggcctaccgtgacacaggtcaaagccgagaaacaggaagacagcgaatcaagtgaggaagaatcagacagtgaggaagcagccgcttctcctgcccaggtgaagacctccgttaagaagacccaggccaaggccaatcctgctgcagccagggcaccctccgcgaaaggcaccatttcagctccaggaaaggtggttacagccgctgcacaggccaagcagcggagtcccagcaaagtgaaaccaccagtgagaaacccccagaactccacggtgctcgccagggggcctgcgagtgttccttccgtggggaaggcagtggccacggccgcacaggcgcagactgggccagaggaggatagcggcagcagcgaggaggagtctgattcagaggaggaggcggagaccctggcccaagtaaaaccatccggtaagacccaccagatccgggctgcgctcgccccagctaaggagagccctagaaaaggcgcagcccctactccaccagggaagaccgggccatctgcagcccaagccggaaaacaagatgatagcggaagctcttctgaggagtccgacagtgatggagaggctccagctgcagttactagcgcccaggaccaagagtcaagttag

SEQ ID NO: 244909 - DNA, 4245 bp, Artificial Sequence
  Description of Artificial Sequence: Synthetic coding sequence
atggctgaagcgagaaagcgcagagagttacttccattaatctaccaccacttactgcgcgcagggtatgtccgggctgcccgtgaagttaaggagcagagtggtcagaaatgctttcttgcccagcccgtgactctactcgacatctatacacactggcaacagacctctgagttgggtagaaaacgcaaggccgaggaggatgccgcactacaagctaaaaagacaagagtcagtgaccctatctctacctccgaaagtagcgaggaagaggaggaggcggaggcggagactgcaaaggcgactccaagactggccagcaccaattcttcggttctcggcgctgacctgccatcttcgatgaaggagaaggcaaaggctgagactgagaaggccggaaagacagggaactccatgccacacccagctacagggaaaaccgtggccaatttgttgtcggggaaatcgccccgaaaatccgcggaaccatccgcaaacactaccctggtgagcgaaaccgaagaggaaggctccgtccccgcttttggggcagccgcaaagccaggaatggtttccgccggtcaggctgactcaagttccgaagacacatcctcctcttcagatgaaacagacgtcgaaggcaagccttccgtgaaaccagcacaagtaaaagccagttccgtcagcaccaaggagtccccagcacgtaaggctgcacccgcaccagggaaagtgggggatgttaccccgcaggtaaagggcggagctctgcctcccgcaaaacgggcaaagaagccggaggaggaaagtgaatcgtcagaggaaggtagcgagagtgaggaggaagcacctgcgggaactcgctctcaggtgaaggcgagtgagaaaatcctgcaggtcagggctgcatcagccccagcaaaagggacgccaggaaaaggggcaactccagcacctcccggaaaggccggagccgttgcatctcagacgaaagccggaaagcccgaagaagactcagaatctagctctgaagaatcttcagattctgaggaggaaacacctgcagccaaagctctgctccaggccaaagctagtggtaagacatctcaggttggcgcagcttcagctcccgctaaagagagcccccgtaaaggcgcagctcccgcaccccctggaaagaccggccctgcagttgcaaaagctcaggcagggaagagggaggaggactctcagtcatcaagcgaagagtctgacagcgaagaggaggcgcctgcgcaggctaagccttcaggcaaagcgccacaggtacgagccgcttctgccccagcaaaagagagccctcgtaagggagctgctccagcgccaccacgtaagactggccctgccgctgctcaagtccaggtcggcaagcaggaagaagactcccggtctagttcggaggagtcagattccgatcgcgaggccctagcagcaatgaacgccgcacaggtgaagcccctggggaaatcccctcaagtgaaacccgcaagtacaatggggatggggcctctgggcaagggagccggaccagttccacccggtaaagttgggcctgcaacgcctagcgcgcaggtagggaaatgggaagaggacagcgagtcatctagcgaagagtctagtgactcttccgatggtgaggtgcccacagccgtggcccctgcgcaggaaaaatcccttggaaacattctacaggcaaaacctacttcatcaccggcaaagggtcccccacaaaaggcaggccctgtggcggttcaggttaaagctgagaaacccatggataactcagagagctccgaggagtccagcgactctgctgactccgaagaggcgcctgctgccatgactgcagctcaagccaagcctgctctcaagatccctcagaccaaggcgtgccccaagaagaccaacacaacggcaagcgcaaaggtggccccagtgagggtaggtacccaggcgccaaggaaggctggtactgctacatcccccgcaggcagtagccctgccgtagctggaggaacacagagacccgctgaggatagctcaagctcggaggaatccgactccgaagaggaaaagaccggtctcgctgtaacagtcgggcaggccaaaagtgtgggcaaagggcttcaggtgaaggcagccagtgtaccggttaaaggaagcctggggcagggaactgccccagtcttgcctgggaagactggaccaacagtcactcaggtcaaagccgaaaagcaagaggactccgaatcgagtgaggaggagtcggacagcgaagaagctgcagccagcccagcccaggtcaagacctcagtgaagaaaacccaagctaaagccaacccagcagcagccagggctccaagcgcaaagggtacaatcagtgccccaggcaaggttgtgacggcagccgcacaggccaagcagcggtcacctagtaaggtcaaacccccagtccggaatccacagaactccaccgtattagccaggggcccagcgagtgtgcctagcgtcgggaaagcagttgcaactgctgcccaggcccagacagggccagaagaggattctggaagcagtgaagaggaatctgactcagaagaagaggctgaaactctggcacaggtcaagcccagcgggaagacacaccagattcgtgccgctctcgctccagcaaaagaatccccccgaaagggcgctgccccaaccccgccaggcaagacaggccctagcgcagcccaggctggtaaacaggacgattcgggcagctcatcggaagagtctgactctgatggtgaggccccagctgctgtcacatcagcgcaggtcataaagccacccctgatttttgtggaccctaaccgcagtcccgcagggcctgccgcaacccccgctcaggcccaggccgctagtacaccacgaaaagcacgcgcttccgagtccactgctcgatcctcctcttccgaaagcgaggatgaggatgttatcccagctacgcagtgcctaacgcctgggatccggaccaacgtggtgaccatgcctactgcccatccccgtatcgccccaaaggcgagtatggctggcgcaagcagtagcaaggaaagttcccgcatctcagacggaaagaagcaggaaggtccagccacccaggtagattccgctgtcggcacactcccggctacctccccacagtccaccagtgtacaagctaagggaaccaacaagttaaggaagccgaagcttccagaggtccagcaagcgacaaaggccccagagtctagcgacgattctgaagactcgtccgactccagcagcgggtcagaagaggacggcgagggaccccaaggagcaaagagcgcacacaccttgggcccaacccctagcaggacagagactttggtcgaagaaactgctgccgagagctctgaggacgacgtggtggccccaagccaaagcctgctgtccgggtatatgacgccaggactcactcctgcaaactcccaggcctctaaagccacaccaaagctggattcctcccctagtgtttccagcacactcgcggcaaaagatgatcctgacggcaagcaggaagcaaaaccacagcaggcagccggtatgctctcgccgaaaaccggcggtaaggaagccgcttctggaacaacaccccaaaagtctcgaaaacccaaaaagggtgcaggcaaccctcaggccagtactctagctctgcaatctaacataactcagtgtttgctggggcaaccatggcctttaaacgaagcacaagttcaagctagcgtggtgaaagtgctgacggagctgctcgaacaggaaagaaagaaggtggtcgatactacaaaggaatcctccaggaagggctgggagagccggaaaagaaagttgtccggcgaccagcccgctgccagaactccgagatccaagaaaaagaaaaaactgggtgccggtgaaggtggagaggctagcgttagcccagagaagacctctactacgtctaaaggcaaggcaaaaagggacaaggctagcggtgatgttaaggaaaagaaaggcaagggttccctcggtagccagggggcaaaagacgaacccgaagaggagcttcagaaaggtatgggcaccgtagaggggggagatcaaagcaatcccaaatccaagaaggagaagaagaaatcagacaaacgcaagaaggataaatag

SEQ ID NO: 244910 - DNA, 4356 bp, Artificial Sequence
  Description of Artificial Sequence: Synthetic coding sequence
atggccgaagctcgcaagaggcgcgaactcttgcctctgatttaccaccatctgttgagggctgggtatgtgcgcgctgcgcgagaggtgaaggaacaatccggccagaagtgcttcctcgcccaaccggtgacacttttagacatatacacacactggcagcagaccagtgagcttgggagaaagaggaaggctgaagaggacgcagccttgcaggctaaaaagacgcgagtctccgacccaataagtaccagcgaaagcagcgaggaggaagaagaggcagaagccgagacagccaaagccaccccccgactcgcttcaactaactcaagtgtgctcggagccgacctgccctctagcatgaaagagaaagcgaaggccgagactgagaaggcaggaaaaaccggcaactccatgccacacccagccaccgggaagactgtggcgaacctcctgtctggaaagagcccaagaaaatccgcggaaccatcggcaaacacaacacttgtgtctgaaactgaggaagagggaagcgtccccgcttttggcgctgccgcaaaaccagggatggtcagcgcgggtcaggccgatagctccagcgaggatacttcctctagcagtgacgagacagacgtcgagggcaaaccttctgtcaagccagcccaggtgaaggcttctagcgtaagcactaaagagtctcctgctcggaaagcagccccagcgcctggtaaagtgggagacgtaacaccccaggttaaggggggagcactgccacccgctaagcgcgctaagaaaccagaggaagaaagcgagtcctccgaggaaggctcggaatctgaggaagaagcgcctgccggaactcggtcacaagttaaggcaagcgagaaaatcctgcaggtgcgggcagcatctgccccagccaaggggacccctggtaaaggtgccactcctgccccaccgggaaaggccggagcagtggcgtcacagaccaaagcaggcaagccagaggaagattccgagtcctccagcgaagagagcagtgactccgaggaggaaacaccagccgctaaggcccttttacaggcaaaggcgtccgggaaaacatcccaggttggagcagcttccgctccggctaaggaatccccacgtaaaggggctgctcccgcacccccaggcaagactggacccgctgtcgccaaggcgcaagcaggcaaaagagaagaggacagccagtcaagctccgaggagagcgattccgaggaggaagctccagcccaggccaagccatcaggtaaggcgccacaggtgagggctgcgtcagctcccgctaaggaatccccccgaaagggagcagctcccgcacctcctcgaaaaaccggccctgcggcagcccaggtccaagtagggaagcaagaagaagactctcggtcgtcaagtgaagaatctgattctgatcgcgaggcactggctgccatgaatgcagcccaggtaaaaccactgggaaagagtcctcaggtcaagccggctagcactatgggcatgggtcctctcggaaaaggtgccggtccagtgcctcccggaaaagttggacccgctaccccctccgcccaagtcggaaagtgggaagaagactccgagtccagttctgaggaatcatccgatagttccgacggtgaagtccccaccgccgtggctcccgctcaggagaagtcactcgggaacatcctccaggccaaacccacgtcaagtcctgcgaagggccctcctcagaaggcaggacctgtggccgttcaggtcaaggctgaaaagcctatggataattcagaaagcagtgaggagtcttcagattctgccgacagtgaggaagcccctgctgccatgacagcggctcaggcaaaacccgctcttaaaattcctcaaacgaaggcttgtcccaaaaaaaccaacacaaccgcgtctgcaaaggtggctcccgtgcgcgttggcacgcaggctccgagaaaagccggaactgctactagccccgctggttccagtcctgccgtggctgggggtactcagaggcctgccgaagattccagctcatccgaagagtcggactctgaagaggagaaaacaggcctggccgttacggtcggccaggctaagagtgtgggtaaaggtttacaagtgaaggccgcatccgtgccagtgaaggggtctcttggccaaggtaccgcacccgtactgcctggtaagaccggacctaccgttactcaggtgaaggccgaaaaacaggaagacagcgaaagctctgaggaggagagtgacagcgaggaggctgctgcttccccagcacaggtgaagacctctgtgaagaaaacacaagccaaggccaatcctgctgcagcacgcgcaccttcagccaagggtactatatccgcaccagggaaagtcgttacagctgccgctcaggctaaacagcgaagcccaagcaaagtgaagccccctgtcaggaatccccagaattcaaccgtattggccaggggacccgcatctgtcccctctgtcggcaaagccgtcgctactgctgcgcaggcccagacaggaccagaggaagatagtgggtcctccgaggaggagtccgactcagaagaagaggctgagacactcgcccaggtgaaacctagcgggaagacgcatcagattcgggctgctctcgcccctgcgaaagagtctcctaggaagggtgccgctccgacccccccaggaaagaccgggccatctgctgcccaagcaggaaagcaagacgatagtggttccagttctgaggaaagcgactcagacggcgaagctcctgctgctgtgactagcgcccaggtgataaaaccgccattaatatttgtggatcccaataggagcccagccggacctgcagccacccctgcacaggcgcaagctgcctcgactccacgcaaggcccgagcctccgagagcaccgctaggtcttcttcatctgaatcagaagatgaggatgttatcccagccactcagtgcttgacaccaggcatccgcactaatgtggtcactatgccaacagcccaccccagaatcgccccaaaagcctctatggccggagcttcgtcttctaaggaaagttctcgcattagtgatggaaaaaaacaagaaggtccagcaactcaagtggacagtgccgtgggtacactgcccgcaaccagtccgcagtctaccagcgtgcaggctaaaggcaccaataagctgcggaagcctaagttgcctgaggtgcaacaagccactaaagcacccgagtcaagtgacgactccgaggacagttctgacagttccagtggatccgaagaagatggagagggtccccagggggcaaaatctgctcatactctggtcggaccgaccccttcacggaccgaaaccctggttgaagaaacagccgctgaaagctcagaggacgatgtcgtagccccttcccagagcttgctcagcgggtatatgaccccagggctgaccccagctaattcccaagctagcaaggccaccccgaagctagattcctcacccagcgtctccagtactttggccgctaaagatgacccagatggcaagcaggaagcaaaaccccaacaggctgcgggaatgctgtccccgaagacggggggtaaggaagctgccagcggtaccactccccagaaaagcagaaagcctaaaaaaggggctgggaacccacaagcaagcaccctcgcattacagagtaatattacccagtgcctgctgggccaaccttggcccctgaacgaagctcaagtacaggcctctgtcgtgaaagttctgacagagctcttagagcaggagagaaaaaaagtcgttgataccaccaaagagtcgagcaggaagggctgggagtccaggaagagaaagctgtctggcgatcagccagccgcaagaacgccacgcagtaaaaaaaaaaagaaactgggagccggagaggggggtgaagcctcagtgtccccagagaagactagtaccacgtctaaaggaaaggcgaaacgcgataaagcctcaggagacgtgaaggaaaagaaaggcaagggatccctgggtagtcaaggggcaaaggacgaaccggaagaggaactgcagaagggtatggggactgtggagggcggtgaccagtctaatcccaaatctaagaaagagaagaagaaatccgacaaacgtaagaaggacaaggagaagaaagaaaaaaaaaagaaagccaagaaggcatccacaaaagattctgaatcgccctcacagaaaaagaagaaaaagaagaagaagacggccgagcaaactgtctag

SEQ ID NO: 244911 - DNA, 4239 bp, Artificial Sequence
  Description of Artificial Sequence: Synthetic coding sequence
atggctgaagccagaaagagacgcgagctcctgcccctcatttaccaccacctgctaagggcaggctacgtaagagctgcccgagaagtaaaagagcagagcggccagaaatgcttcctggctcagcctgttactttactggacatttacactcattggcagcagaccagtgagctggggcgaaagaggaaagctgaggaggatgccgcacttcaggctaaaaaaacaagggtgagtgatcccatatccaccagcgagagctctgaggaggaagaggaggccgaggctgagacagctaaggccacccctcgcttggcgtcaacaaattccagtgtgttgggagccgatctcccctcctctatgaaggaaaaagctaaagcggagactgaaaaggctggaaagacgggaaactctatgccacatcccgctaccggcaagacagttgccaacctcctttcagggaagtcgccaagaaagtccgccgagccctcagcaaacactactctagtaagtgagaccgaggaggaaggttcagttccagccttcggggcagccgcaaaacccggtatggtgtccgctggtcaggcggatagctcctcagaggatacctccagctcatccgatgaaaccgatgttgaagtcaaagcatctgagaagattctgcaggtgcgagcggcatctgctccggctaaggggactcccggaaagggtgcgacgcccgctccgccaggaaaagccggagcagtcgcaagccaaaccaaggcgggtaagccagaagaagatagtgagtcttcctcagaagagtcatctgactcggaggaggaaacccctgccgcaaaggctctgctgcaagcaaaagccagtggcaagacctctcaggtcggggctgcatcagctccggcaaaggaatcacctcggaaaggggctgctccagctcctccgggaaagaccggcccagcagttgccaaggcccaggccggtaagcgcgaggaggactcccagtcgtcctcagaggagagcgactctgaggaggaggcgccagctcaagctaagccaagtggaaaagcccctcaggtgagagctgcctctgccccagccaaagagtcacctcggaagggagctgcgccagcacctcctaggaaaactggcccagcggcagcgcaggtccaggtgggcaaacaagaggaagattcgaggtcttccagtgaagaaagcgatagcgaccgggaagcattagcagccatgaatgccgctcaggtcaagcccctcggaaaaagcccccaggtgaagcccgcatccactatggggatgggacccctggggaaaggcgcaggtcccgtgccccctggtaaggtcgggcctgcaaccccctcagcccaggttgggaagtgggaggaagatagcgaatctagtagtgaggaatcctccgattcctcagatggcgaagttcccactgcagtcgctcccgctcaagaaaaaagcttgggtaacatcctacaggcaaagccaacatcaagcccggctaaggggccaccgcagaaggctggtcccgtcgcagtgcaggttaaggctgagaaacccatggacaactccgaatcttcagaagagtcttccgattccgcagactctgaggaagctcccgcagctatgacagctgcccaagctaagccagctttaaaaatcccgcagaccaaagcttgcccaaagaagaccaataccaccgcttcagctaaagtcgcacctgtgcgggttggcacccaagcacctaggaaagcaggcaccgctacaagtcccgcagggagtagccccgcagtggctggcggaacgcagagacctgcagaggattccagttcttcggaggaatccgattcggaggaggagaaaaccggactggcggtcaccgtgggacaggccaaaagtgtgggaaaagggttgcaagtcaaagctgcttcagtacccgttaaaggtagtttagggcaggggaccgcgcctgtgctgccagggaagacaggccctacagtcacccaagtaaaggctgagaagcaggaggactcagagagcagcgaagaggagagcgatagtgaagaggccgcagcctcgcctgcccaggtgaagacatcagtgaaaaaaacccaggctaaagccaatcccgctgcagctagagcaccaagcgctaaagggacaatcagtgcccctggcaaggtggtcactgccgctgctcaggcgaaacagcgcagccctagcaaggtgaagcctcctgtgcgcaacccacagaattccactgttctcgccagaggccctgcatctgtgcccagtgttggtaaggcagttgccaccgccgctcaggcccagaccgggccagaggaggactccggtagctctgaggaagaatctgatagcgaagaagaggcagagacgttggcccaggtgaaaccttccggaaagacacaccagattcgcgctgcactggctcccgcaaaagaatcacctcgcaagggagctgccccaacacctcctggcaagacggggccatctgccgctcaggctggtaagcaggacgacagcggctcatcatccgaagagagtgactcagacggagaagccccagcggcagtaacatccgcacaggttattaaacctccattaatttttgttgaccccaatagatcacctgctggaccagcagcaacaccagcacaggcacaggctgctagtactccaaggaaggccagggcctcggaaagtactgcgcgatcctcatcttcagagtccgaggatgaggatgtgataccggcaactcagtgcctgacccctgggatccgcactaacgtggtcactatgcccaccgcccaccctcggatcgccccaaaggcctccatggccggtgccagttcctccaaagagtcaagcaggatttctgatgggaagaagcaagaagggcctgcgacacaggtgtctaaaaaaaatcccgcaagcctgccactgactcaggcagcgctcaaggtcctggcacagaaagcttccgaagcccaaccaccagtggccaggacccagccctcctcgggagtggatagcgctgtcggcacattacctgccacttctccacagagcacgtctgtgcaggctaagggcacaaacaagctgaggaagcccaaactgccagaagtgcagcaggcgacaaaagcgccagagtcatctgatgatagcgaagactcatcagactcgagttcaggctctgaggaagatggtgaggggcctcaaggggcaaagtccgcccacacgctggtgggtccaactccttctcgtaccgagactctggtagaagaaacagccgctgagtcatctgaggacgatgttgtcgccccttctcagagcctcctgtccggctacatgactcctgggctgactcccgcaaacagccaggcgtctaaggcgacgcccaagcttgactcctccccttccgtcagcagtaccctggctgcaaaggacgatccggacgggaagcaggaagccaaacctcaacaggccgctggaatgttgtcaccgaaaacgggaggcaaggaggcagcctcaggaacgacgccccagaaaagtaggaaaccaaagaaaggcgctggcaatcctcaagctagcaccctcgctctccaaagtaatatcacacagtgtcttctgggtcaaccttggcccttgaatgaggctcaggtccaggcctctgtagttaaagtcctaacagagctgttagaacaggagcggaaaaaggtggtagacaccactaaggaatcctcgcggaaaggctgggagtccaggaagcgaaagctgtcgggggatcagcccgctgccaggaccccgcgatcaaaaaaaaaaaagaagctgggtgccggagagggcggagaggcgtccgtctcacccgaaaagacgtccaccacttcaaaaggcaaagccaaacgggacaaagcgagcggcgatgttaaagagaagaaaggtaaggggtctctgggtagccagggcgctaaagacgagccagaagaggagctgcagaaggggatgggaactgtggagggcggagaccagtccaatccaaagtctaaaaaggaaaagaaaaaatccgataaacggaagaaagacaaggaaaagaaggaaaagaaaaagaaggctaaaaaggcatctacaaaggatagcgagtccccctcgcagaaaaaaaaaaaaaagaaaaaaaagaccgccgaacagaccgtgtag

SEQ ID NO: 244912 - DNA, 4578 bp, Artificial Sequence
  Description of Artificial Sequence: Synthetic coding sequence
atggcagaagctagaaagcgcagggagctgttgccgctgatctaccaccacctgctgcgtgcagggtacgttagagctgccagagaagtcaaggaacagagcggacaaaaatgtttcctggctcaacccgtgacccttctggatatatacacccattggcagcagacaagcgagcttggacgcaagcgaaaggccgaggaggacgctgccctgcaggctaaaaagaccagagtgagtgacccaatctcaactagcgaaagtagtgaagaggaagaggaggcagaagctgaaaccgcgaaagcaactccacgactagcgagcacaaactcgtccgtgctaggcgcagacctgccttcttcaatgaaggagaaagctaaagcagagacggaaaaggccggtaaaaccggaaactctatgccccaccccgcaaccggcaaaaccgtggccaacttactgagcgggaagagcccaaggaaaagcgccgagcccagcgcaaacacaaccctcgttagtgagaccgaggaagagggatctgtgcctgcctttggcgcagccgctaaacccggaatggtgtcagcgggacaggccgactcgtctagcgaagataccagcagctcttctgatgagaccgacgtggagggtaagccctctgtgaaacctgcacaggtgaaagcctcctccgtctctaccaaggagagcccagccagaaaagcagctcccgcaccaggaaaagtcggcgatgtcacaccccaggtgaagggtggtgctcttccccctgcaaaaagggcgaaaaagcctgaagaggagagtgagtcgtctgaggagggatcagagagtgaagaagaggcgccagcgggtacacgaagccaggttaaagcatcggaaaaaatcctgcaggtgcgcgctgcctccgcccctgcaaaggggacccccggaaaaggggctacgcccgctccccctggcaaggccggagcagtggcatctcagaccaaggctggaaagccagaagaagactctgagtcaagcagtgaggagtcctcagactctgaggaagagacccctgccgctaaggcgctgcttcaagctaaagcttcaggaaagacttcccaggtgggggctgcttccgcccctgccaaagagagtccacgaaagggcgctgcacctgcacctccaggtaagacaggacctgccgtggcaaaggctcaggccggaaaacgtgaagaggactctcagtcgtcaagtgaagaaagtgatagtgaagaagaggcacctgcccaggcgaagcccagtggcaaggctccacaagtccgcgcagcctccgccccagccaaggagagtccacgcaaaggtgctgctccagcaccgccacggaaaacgggacccgcagcagctcaggtgcaggtgggaaagcaggaagaagactcaaggtccagttctgaagagagcgactcagatcgcgaagcgctcgcagccatgaatgctgctcaggtgaagcctctcggaaaatctccccaagtcaagcctgcctccactatgggcatgggaccattggggaagggggcaggtccagtccctccgggaaaagtcgggccagccacccccagcgcccaggtaggcaagtgggaggaagatagtgagtcgtcctcagaggagtcttccgacagtagcgacggggaagtgcctactgccgttgcacccgctcaggagaagagtttgggcaatatcctgcaagccaaacccacgagtagccccgctaaaggccctcctcagaaggcaggtcccgtggcagtccaggtgaaagctgagaaacccatggataattctgagtcttctgaagagtcatcagatagtgctgattccgaagaagcaccagccgcaatgactgcagcgcaggctaagccggctctgaaaatacctcagacaaaggcctgccctaagaaaactaatactacagcatccgcgaaagtcgcgccagtgcgtgtcggaacccaggccccacggaaggccggtacagcaacctcccccgcaggctcatcacctgctgtagctggtggaacacaacgacctgcggaggattccagcagtagcgaagaatccgattctgaggaggaaaaaacggggctggccgttaccgtggggcaagcgaagtccgtgggcaaggggctgcaggtgaaagccgctagcgtccccgtgaagggaagtctggggcagggcaccgcccctgtcctgccaggaaagacaggacctaccgtcacacaagtaaaagcggagaaacaggaagacagcgaatcaagtgaagaagagagcgactccgaagaagccgctgcgagtcccgcacaggtcaagacgagcgttaagaagacgcaagccaaggcaaaccccgcagcagcgagagctccgagcgcaaaaggcactatatccgcgccaggaaaggtggtcaccgctgctgcgcaggcaaaacagagatcccctagtaaagtcaaacctccagtgcgaaatccacaaaacagtaccgtgctggcgaggggtccagcaagcgtgccaagcgtgggaaaggctgtggccaccgctgctcaagctcagaccggcccagaggaggattcaggctcctccgaggaagagtctgattctgaggaagaagccgaaacattagcacaggtgaagccctcaggcaaaacacaccagatccgtgcagccctcgcgcctgctaaagaatcaccccgtaaaggcgctgcccctactccccctggaaagacaggcccttcagcagcacaggcaggtaagcaggatgattcgggaagttcttccgaggagagtgattcagacggtgaggcccctgcagccgttacaagcgcacaaaaagatagcaacagcaagccggctagatcaaaaacactagcaccagcccctccggaacggaatactgaggggtccagtgaaagctccgaggaggaactcccactaacacaggtcatcaaacctccgctcattttcgtggaccctaatagatctcccgctggacccgcagccaccccagcccaggcccaggcggcatccactccacgtaaggcgcgtgccagcgagagtactgctagatcctcaagcagcgagtcggaggatgaggacgtcatcccagctacacaatgccttaccccagggatccgtaccaatgtcgtgaccatgcccacagcccatccgaggatcgcccctaaagcaagcatggctggagcaagtagcagcaaggagtccagtagaatctctgacggtaaaaagcaagaagggccagctacccaagtttctaaaaaaaatcctgcttctttacctttaactcaggctgctctgaaagttctggcgcagaaggcttccgaggcccaacccccagtggcccgaacacagccctcaagtggggtggattctgcagtgggaaccctgccggcaacctccccccagagcacttcagtccaggcaaagggtacaaacaagttaaggaaaccaaaattgccagaggtgcagcaggccactaaggcacccgagagttcagacgacagcgaagactctagcgactcatcatcaggaagcgaggaagacggggaaggtcctcaaggagcaaagagcgcacatacactggggcctactccttctcgcactgaaaccctagttgaagagacagctgctgagagctcagaggatgacgtggttgccccttctcagagcctcctgagcggatacatgaccccagggctcacgcccgctaactcccaggcttctaaagccacgccaaaactcgacagcagcccgtcagtgtccagcacactggctgccaaggacgatccggacggaaagcaggaggcaaagcctcaacaggccgctggtatgctgtcccccaaaaccggtgggaaagaggctgcttccgggacgaccccacagaaaagccgtaaacctaaaaagggagccggaaatcctcaggcttctactttggcccttcagtctaacataacacaatgtcttctggggcagccctggccattgaatgaggctcaggtccaggcttccgtggtcaaggtcctgacagaactgctggagcaggagagaaaaaaggtagtggacacaacaaaagagagctcgcgcaagggttgggagagtaggaaaagaaaactttccggtgaccagccagcagccaggacaccaaggtctaagaaaaaaaagaagttgggtgctggcgaggggggagaagcttccgtctcaccggagaagactagcaccacttccaaaggcaaggccaagagagacaaagcctccggcgatgttaaagagaagaagggaaaaggcagtttgggcagccaaggcgcaaaggacgagcccgaggaggagctgcagaaaggcatgggtactgtggaaggcggagaccagagtaatccgaagtctaagaaggagaagaaaaagagcgacaagcgaaaaaaagataaagagaaaaaggaaaagaaaaaaaaggccaagaaagccagtaccaaggattctgagtcaccctcacagaaaaagaagaagaagaagaaaaagactgctgaacagaccgtgtag

SEQ ID NO: 244913 - DNA, 4467 bp, Artificial Sequence
  Description of Artificial Sequence: Synthetic coding sequence
atggctgaggccaggaaacgcagggagctgttacccctcatctatcaccaccttctgcgcgcaggctatgtgcgcgctgccagagaggtcaaggaacagagcggccaaaaatgcttcctggcccagcccgtgaccctgcttgacatctacacacactggcagcagacatctgaactgggcagaaaaagaaaagccgaagaagatgcggctctgcaggcgaagaaaactagggtgtccgacccaatttcaacctccgagtcctcagaggaagaagaggaagcggaggccgaaacagccaaagctacccccaggctggcgagtacaaattcaagtgtcctgggcgcagacctgccatccagtatgaaggagaaagcaaaggctgaaacagaaaaggcaggaaagacaggcaacagtatgcctcatccagccacaggcaagacagtggcgaacctcctgtcaggaaaatcaccgagaaagtccgccgaaccgagcgccaacacaactttagtctccgagacagaggaggaaggatcagtaccagctttcggagccgcagctaagccaggcatggtttcagctggacaagctgacagttcttccgaagatactagttcatcaagtgatgagaccgacgtcgagggaaaaccctccgtgaaacctgctcaagtcaaggcatcgagcgtgtctactaaagaatcccctgctagaaaggccgcacctgcacctggaaaggtgggagacgtcactccccaggtcaaaggaggggctctgccccctgccaaacgcgcaaaaaagcccgaagaggagagcgagtccagcgaggaaggatctgagtcagaggaggaagcccctgccggaacacgctcacaagtgaaggcctccgagaagattttacaagtcagagccgcatccgcgccagccaagggcactccagggaagggggcaacacctgccccacccggtaaagcgggtgcggtggcgtcccagactaaggctggcaagcctgaggaagacagcgagtccagtagtgaggaatctagtgactccgaagaggaaactcctgcggctaaagccctgctccaagcaaaagcaagtggtaagaccagccaggtgggagctgcttccgcaccagcgaaagagtcccccagaaaaggggctgcacctgcacctccgggaaagaccggacccgcagttgccaaggcccaggcaggaaaacgggaagaggactcacaaagctcatccgaagaatcggacagcgaagaggaagcgccagcacaggccaagccctccggaaaagccccacaagtgcgtgccgcaagtgcccctgccaaggaatctcccagaaagggagctgcccctgcgcctcctcgtaagacaggccctgctgccgcacaggtgcaggtaggtaagcaagaggaggactcccggtcttcatctgaagagagcgactcagacagagaagcactggccgctatgaatgctgcccaggtaaaaccgctagggaagtcgccgcaggtgaaaccagctagtaccatgggcatgggtcccttgggaaagggggctggcccagtgccaccagggaaagtgggcccagcaactccgagcgcacaggttggcaagtgggaggaagactccgagtcttcctccgaggaaagctctgacagctcagatggggaggtgccaacagcagtggcacccgcacaggagaaatcgctggggaatattctgcaagcaaaaccaacaagctctcctgccaagggaccaccccaaaaagccggacctgtagcagtgcaggttaaagccgagaaacctatggataattccgagtccagtgaagaatcttcggacagcgccgactccgaagaagcacccgcagctatgaccgctgcacaggcaaaaccagccctcaagatcccacagacgaaggcatgcccaaaaaaaactaatactacagcctctgccaaagtggccccagtccgggtgggaactcaggcgccaagaaaagctggcacggcgacctctcctgcgggatctagccctgctgtggccggtggcactcagaggccagctgaagactcctcctcgtctgaagaaagcgacagcgaggaggaaaaaaccggcctcgccgtcacagtggggcaagctaagtccgtcggcaagggcctgcaagtgaaggcggcatccgtgcccgtgaaaggcagcctcggacagggcactgcacctgtcctccccggaaagaccggccctacagtgacccaggtaaaggccgagaagcaagaggactcagagtcatcagaggaggaaagtgacagcgaggaggcagcggcttcgccggctcaggtgaaaacaagcgttaaaaagacccaagctaaagctaatcctgcagccgcaagagcgccaagcgcaaagggcactatatcggctccaggcaaggtggtgacagctgctgctcaggcaaaacaacggagcccgtccaaagtgaaacctcccgtgaggaatccacagaacagcactgtattagccagggggccagcttcggtcccatccgtcggcaaggctgttgccactgccgctcaggcacaaacaggacccgaggaggactctggcagctccgaagaggagagcgattccgaggaggaggccgagacactggcgcaggtgaaaccaagcggaaagactcatcagattcgagctgctttagccccagccaaggaaagcccaagaaagggcgcagcccctacgccgcctggtaagactgggccttcagccgcacaggccggaaaacaagatgattccggatcatcctctgaggagagcgatagtgacggcgaagctcctgccgcagttacatccgcccaggtcattaagcctccgctgatctttgtggaccctaatagatctcccgcaggcccagcagcaactccagcgcaggctcaggccgcatcgaccccgaggaaagctcgggcatccgaaagtaccgccaggtcgagctctagcgaatctgaagatgaggacgtgattcctgcaactcaatgcctgacccccggaattcggactaatgtggtgactatgcccaccgcacaccctcgcatcgccccaaaggcttctatggctggcgcttcaagctcaaaagagtccagtcggatcagtgatggcaagaaacaggagggaccagccacacaggtgagtaagaaaaatccagcttctctgcccctgacccaggccgctcttaaagtgctggctcagaaggctagcgaggcccagccgcctgtcgctcgcacacaaccatcatccggcgtcgactccgccgtgggaaccctgcccgctacctcacctcagtccaccagcgttcaggctaagggcactaacaagttgcgcaaaccgaaattgccggaagtacagcaggcgaccaaagctccagaatcctcagacgacagcgaagacagtagcgatagctcgagcggtagcgaggaggacggagaggggcctcagggggctaaaagtgcacacaccttaggaccaacaccttctcgtacagagactctggtggaagagactgcagcagagtcttcagaagacgatgtcgtggctccctcccagtcactacttagtggctatatgacgcccggactcacccctgctaatagtcaagcttccaaagccacgcccaagctggactcgtctccctcagtttccagcactctcgctgctaaagacgatccagacgggaagcaagaagccaagccccagcaggctgcgggaatgttgagtccaaagaccggcggaaaagaagcggcttccggcacgacacctcaaaagtctaggaagccaaagaaaggagctggaaatcctcaggcctctactttggcccttcagtctaacatcacccaatgtcttcttggccaaccctggcctcttaatgaggcacaggttcaggcatcggtggtaaaggtgttgaccgaacttcttgaacaggaacgcaagaaagtggtggacactacgaaggagagttctcgcaaggggtgggagagtaggaaacggaaactctctggtgatcagcccgctgcacgcacacctcggagcaaaaaaaagaagaaattgggtgccggagagggcggagaggcatcagtctcaccagagaaaaccagcacgacaagtaaagggaaggctaagagggataaagcatctggtgatgtcaaagaaaagaagggcaaaggatcccttggatctcagggggctaaagatgaacccgaggaagaactgcagaaaggcatgggtaccgttgagggaggcgaccagtccaacccaaagagcaagaaggaaaagaagaagagcgacaaaagaaaaaaggataaagagaagaaggagaagaaaaagaaggctaagaaagcctccactaaagatagtgaatctccttctcagaaaaaaaagaagaagaagaagaaaaccgcggagcagacagtctag

SEQ ID NO: 244914 - DNA, 255 bp, Artificial Sequence
  Description of Artificial Sequence: Synthetic coding sequence
atggctaccatggagaataaggttatctgcgctctcgttctggtgagtatgcttgcgctgggaactctggctgaggctcagacagagacctgcactgttgcgcctcgggaacgccaaaactgtggtttccccggtgtgaccccctcccagtgtgcaaataaaggttgttgttttgacgacacagtacgcggagtgccttggtgcttctatccgaatactattgatgtgccgccagaagaggagtgcgagttttag

SEQ ID NO: 244915 - DNA, 390 bp, Artificial Sequence
  Description of Artificial Sequence: Synthetic coding sequence
atggggaggcgggacgctcagctgttggctgctcttcttgtgttaggcctttgcgctctcgcaggctcagagaaaccatcgccctgtcagtgctcccggttgagcccgcataacaggaccaattgcggttttccaggtatcacaagtgatcagtgctttgacaacgggtgttgcttcgacagttccgttactggtgtcccatggtgttttcaccctctgccaaaacaggagtcggatcagtgtgtgatggaggtaagtgatcgacgcaactgcggttatccaggaatcagcccagaagagtgcgcgtcacgaaagtgctgtttttctaatttcatcttcgaagtgccctggtgttttttccccaaatctgtggaggactgccactattag

SEQ ID NO: 244916 - DNA, 1749 bp, Artificial Sequence
  Description of Artificial Sequence: Synthetic coding sequence
atgccagggagaacttgggagttgtgtctgctgttgctgttgggcctgggcttgggaagccaagaggcgctcccacccccttgcgagagcgagatctactgccacggggagctcctaaaccaagtacagatggccaaactctaccaggacgataaacagtttgttgatatgcccctgagcattgcccctgaacaggttctgcagacgtttaccgaactgtcgcgagaccacaatcactccattccacgcgaacagctccaggcctttgtgcacgagcatttccaggcgaaagggcaagaattgcagccgtggaccccagccgattggaaggattccccccaattcctgcaaaagattagtgatgcaaagctcagggcgtgggccggtcaattgcaccaactgtggaaaaaactcggaaaaaagatgaaacctgaagtcctgtcgcacccagagaggttcagcctgatttactcagagcatcctttcattgttccgggagggagattcgtggaattttactactgggacagctattgggtaatggaaggactgttactgagtgagatggcggagacagtcaaagggatgctgcagaactttcttgatctcgtcaaaacttacggccacgttccgaatggaggacgcgtgtactacttacagcgcagccagccaccactcctgacattaatgatggattgctacctgacacatactaacgataccgcctttctgcaggagaacattgaaaccctcgcgctcgaactggacttttggacaaaaaatcgaactgttagcgtcagtctggaagggaaaaattacttgttaaatcgctactacgtgccatatggagggcctagaccagagagctactctaaagatgttgagctggcagatacactcccggagggcgatagggaggccctgtgggcggagctcaaggcaggcgctgaatctggctgggatttttcaagcaggtggctgattggcggaccgaatcccaattccctgtccggcatccgaactagcaagcttgtgccagtagacctgaatgcgtttctgtgccaagccgaggagttaatgagtaatttctattcacggctcggaaacgactcacaggccaccaagtacagaatcctacgcagccaaagactcgctgccctgaataccgtactgtgggatgaacagactggagcctggtttgactacgacctggaaaaaaaaaaaaagaaccgcgaattctatcccagcaatctgacgccgctgtgggccggatgcttttccgacccaggggtcgccgacaaggctctgaagtacctggaggataatagaattctcacttaccagtacggcattcccaccagtctgcaaaaaactgggcagcagtgggatttcccaaatgcctgggctccccttcaggatctggtgatccggggtttggccaaagccccactccgccgagcgcaagaagtagcattccagctcgcacagaattggatcaggacaaactttgacgtatattcccagaaatctgcaatgtacgaaaaatatgatgtgtctaatggcggacagccaggagggggtggggagtatgaagtgcaggagggatttggctggacgaatggagtggtgctcatgctacttgatcggtacggcgaccggctgacctccgggccaaagctgccctttctggagccacactgcttggccacattactgccatccttgctgcttagcctcctcccttggtag

SEQ ID NO: 244917 - DNA, 1656 bp, Artificial Sequence
  Description of Artificial Sequence: Synthetic coding sequence
atgcccggaaggacatgggagttgtgcctacttttgctgctggggctgggactagggtcccaggaagccttgccccctccatgcgagtccgagatctactgtcatggtgagctgctgaaccaagtccaaatggccaaattgtaccaggacgacaaacaattcgtggacatgcccctgagcattgcccctgaacaggttttgcaaactttcactgagctgtcaagagaccacaatcacagtattccgagggagcagttacaggccttcgtgcacgagcacttccaggccaaagggcaggagctgcagccttggacccctgctgattggaaggattctccgcaattcctccagaagatctctgatgctaagctacgcgcatgggccggacaactccaccagctctggaaaaagctgggcaagaagatgaaacccgaggtgctgtctcatcctgaaaggttctcccttatttactccgagcaccccttcattgtgcccggaggcagattcgtggaattctactactgttatggccacgtgccaaacggaggaagggtctattacctgcagagatcacagccacctcttctgacccttatgatggactgttacttgactcacaccaacgacactgctttcctccaggaaaatatcgagacattggcacttgagctggatttctggaccaagaatcgcacggtatctgtgagtctcgaggggaagaactatctgttgaatcgctattatgtgccatacggcggtcctcgacctgagtcctattcaaaagatgtagagctagcagacaccctgccagagggagatcgggaagcactgtgggccgagctcaaagccggagccgagtccgggtgggatttctcatctcgatggcttatcggtggcccaaatccgaatagtcttagcggaataagaacctccaagctggtgccagtggacttgaatgctttcctttgtcaggccgaggaactgatgtccaacttttattctcgcctgggaaacgatagtcaggctaccaaataccgaatacttcggtcccaaaggctagccgcactgaacactgtcttgtgggacgagcaaactggcgcatggttcgattacgacttggagaaaaagaaaaagaaccgggaattttatcctagcaatctgactccgctttgggctggctgttttagtgatccgggtgttgctgataaagctctaaaatacctcgaagacaacaggattctgacttatcaatatggcatcccgacatcactccagaagaccgggcagcaatgggacttcccgaacgcctgggcccctcttcaggacttggtcatcagaggtttggcgaaagcgcctctccggcgtgcgcaggaagtggctttccaactcgctcaaaattggattagaacaaattttgacgtttattcccagaagtctgctatgtatgagaagtacgatgtgtctaacggcggacagccaggcggtggcggtgagtacgaggtccaagaagggtttggctggactaacggcgtggtcctgatgctcctcgaccgttacggtgaccgtctcacttctggccctaaattaccattcttggagccccactgcttggctacactgctgccgtcactccttctgtccctcctcccatggtag

SEQ ID NO: 244918 - DNA, 1380 bp, Artificial Sequence
  Description of Artificial Sequence: Synthetic coding sequence
atgccaaattgtgtgccagggcaaggttcttgcatctcgtctggacggtcctggggccgacgctaccagagaccaggacccgcacagggcctgactaaaggtaccgaagagcgcaatgtgccaggagcccactccgtgtttggagcccagatacgcgacagctattgggtgatggagggcttacttctctcagaaatggcagagacggtgaaggggatgctgcagaactttcttgatctcgttaaaacttatggccatgtccccaacggtggaagagtttactacctgcagcggtcccagccccctctactgaccttgatgatggactgctaccttacgcataccaacgacacagctttcctccaggaaaacatagaaaccctggctctagaactcgatttttggacaaagaatagaaccgtctctgtctcattagaggggaaaaattacctcttaaaccgatactacgtgccctacggcggaccccgacctgagtcctattcaaaagatgtcgagctcgccgacacgctccccgagggggatagagaagccttatgggccgaactgaaagccggtgccgaatctggttgggacttttccagccgatggctgatcggtggtcctaatcccaacagcctatccggcatacggacctctaaactcgttcccgtggatttgaatgccttcctatgtcaggcagaagagttgatgtctaacttctacagccggctgggcaatgattcacaggcaacaaagtacagaatactaagaagtcagagattggcagcccttaacaccgtgctttgggacgaacagacaggcgcatggttcgattatgatctggagaagaagaagaaaaatcgggagttttacccctcaaatctcacacccctctgggcgggatgttttagcgatccgggagtcgccgacaaggcactgaagtacctggaggataaccgcattttgacctaccaatacggaattccgactagccttcagaaaaccggacagcagtgggattttccaaatgcatgggcccctcttcaggatctggtgatccgaggacttgccaaagcccctcttagacgagcacaggaggtggcatttcagctggcccaaaactggatccgcaccaattttgatgtttacagccagaagtccgccatgtatgagaagtatgacgtttcgaacggcggtcagcctggagggggaggcgagtacgaagtgcaggagggctttggctggactaatggagtagtgctcatgcttttggatagatatggcgatcggctgacgagtggtcccaagcttccatttctggaaccccattgccttgcaacgttgctgcctagtctgctcctcagtctactgccctggtag

SEQ ID NO: 244919 - DNA, 1641 bp, Artificial Sequence
  Description of Artificial Sequence: Synthetic coding sequence
atgccgggtcggacctgggaactatgcctgctgcttctgctggggttgggcctgggatctcaggaggcattgcctcctccttgcgagtctgagatttattgccatggagagctgttgaaccaggtacagatggcaaaactatatcaggacgataaacaatttgtcgacatgcccctttcaattgcccctgaacaagtgttgcaaacgtttaccgagctatctcgcgaccataaccactctattccaagagaacagctgcaggcatttgtgcatgagcacttccaagccaagggacaggagctgcagccatggacacccgctgattggaaagactccccccagtttctccagaagatctctgatgccaagctacgggcatgggctggccagctccaccaattatggaagaaacttggtaaaaaaatgaaacccgaagtgctctcccatccagaacggtttagcctaatttattctgaacatccttttatagttcccggtgggcgtttcgtcgaattttactattgctacggacacgtaccaaatgggggtcgcgtttactacctgcagaggtctcagccgccactgctgacactgatgatggactgctacctcacccatacaaacgataccgcatttcttcaggaaaacatcgaaaccctggctttggagctagacttctggacaaagaaccgtaccgtgtccgtctccctagaggggaaaaactacttgctgaatcgatattacgtcccatacggaggacctagaccggagtcgtacagcaaagacgtagaactggccgatactttacctgaaggagatagggaagcgctttgggccgaactgaaggccggagctgaaagtgggtgggacttttcttctaggtggctgatcggcggacctaaccctaacagcctctctggcatacggacgtcaaaattggtgcccgtggatctcaatgcgttcctgtgccaggcagaagaactcatgtctaatttttactcccgcctggggaacgattcccaggccacgaaatatcgcattctgagatctcagagactcgctgcccttaacacagtgctctgggatgagcagaccggtgcctggttcgactatgacctggagaagaaaaaaaagaaccgcgagttttacccaagcaaccttacccccctctgggccggttgttttagtgatccgggtgtcgccgataaagccttgaagtacctcgaggacaacaggattcttacttaccaatatggcatacccactagcctgcagaagaccggccagcagtgggattttcccaacgcatgggctcccctgcaggatttggtcatcagaggactggcaaaggcgccactcagacgagctcaggaagttgctttccagctcgcccaaaattggattaggacaaattttgatgtttatagtcagaagtccgccatgtacgagaagtacgatgtgagcaatggaggccagccgggaggaggtggggagtatgaagtgcaagaggggttcggatggactaacggtgtcgtactaatgctgctcgatcggtacggcgatcgacttactagcggcccaaagctcccctttctagaacctcattgtcttggcccacccttctgcccggcttcttgttag

SEQ ID NO: 244920 - DNA, 1734 bp, Artificial Sequence
  Description of Artificial Sequence: Synthetic coding sequence
atgcctgggcgtacttgggagttgtgtctcctgctacttttggggctcggtctcggtagtcaggaggctctgcccccaccgtgcgagtctgagatttattgccacggggaacttctcaaccaggtacaaatggccaagctctatcaggatgacaagcagtttgtggatatgccactttcaatagctcccgagcaggtccttcagacattcaccgaacttagccgcgaccacaatcacagtatcccgcgtgaacaattgcaggctttcgtgcatgagcactttcaagcaaagggccaggagctccagccttggacaccagctgattggaaagacagcccccagttcctgcagaagatctcagacgcgaagcttagagcttgggccggacaactgcatcagctttggaagaaattagggaagaaaatgaagcccgaggtcctatcccacccagaacgtttttcactcatatactccgagcatccttttatcgtgcctgggggtcgcttcgtggaattctattactgggattcatattgggtgatggaaggattattgctgagcgaaatggctgagacagtgaaaggcatgctccagaacttcctggatcttgtaaagacctacggccacgtgcccaatgggggaagggtttattacctgcagagatcacaacctcccctcctgacactgatgatggactgctatctgacacacactaacgataccgcctttttacaggagaacatcgagaccttggccctcgagctggacttttggacaaagaacagaactgtatcggtgagcttggaaggtaaaaattatctcctgaataggtactacgtaccatatggcggtccaagacccgagagctattccaaagatgtcgaactggcagacacccttccagagggagacagagaggccctatgggccgagttgaaggcaggagcggagtcaggatgggatttcagctcccgttggctcataggtggacctaatcccaatagcctttcaggaatcagaacatctaagctggttcccgtggacctcaacgcattcctgtgtcaggctgaggaacttatgagcaacttctactctcgactagggaacgattctcaagcaactaaatatcggattctacgcagccagagactggcggcactcaatacagttctgtgggacgagcagaccggcgcatggtttgattacgacctagaaaagaagaagaagaacagggagttctatcccagtaacttgacccccctgtgggccggatgtttctccgatcccggagttgctgataaagctctcaagtacctggaagataataggattctcacttaccagtacggaatccccacctcccttcagaaaactggtcagcaatgggactttcccaacgcatgggctcccttacaagatctggtgattaggggtctggccaaggcccctctgagacgggctcaggaggtggcttttcagcttgctcagaattggattcgaaccaacttcgatgtgtatagtcaaaagtcggctatgtacgagaagtatgatgtgtctaacggcggacaaccaggaggcggaggagagtatgaggtccaagaaggcttcggttggacaaatggcgtggtgctgatgctactagaccggtacggggatcggctgacttctggacctaagctgcctttcctggagcctcactgcctcggtcccccattttgtcccgcatcttgctag

SEQ ID NO: 244921 - DNA, 273 bp, Artificial Sequence
  Description of Artificial Sequence: Synthetic coding sequence
atggaagagaccactgactggatttatggtttcttttcccttctctcagatattatcagctcggaagacgaagaagatgatgatggagacgaggatacagataagggggagatcgatgaaccacccttgcgaaagaaggagatccataaagacaagacggagaagcaagagaagcccgagcggaagatccaaaccaaagattggtcggctaactcctctactatccgaacactcaagttgacccagctgaagcccatatacatttgtacttag

SEQ ID NO: 244922 - DNA, 654 bp, Artificial Sequence
  Description of Artificial Sequence: Synthetic coding sequence
atggaagaaacaactgattggatctatggattcttctcgctgctcagcgacataatttcctccgaagatgaagaggacgatgacggggatgaagatactgataaaggcgaaatagacgagccgcctctccgtaaaaaagaaatccataaggacaagacagagaagcaggagaagcccgagcggaagattcagacgaaggtcacacacaaggaaaaggaaaaaggtaaagagaaggtccgcgagaaagaaaagcctgaaaaaaaagctacgcacaaggagaaaattgaaaagaaagagaagcctgagacgaagaccctcgccaaggagcagaagaaggccaagacagccgaaaaaagtgaggagaagacaaagaaggaggtcaaggggggaaaacaggagaaggttaaacaaaccgcagcgaaggtgaaggaagttcagaaaacacccagcaaaccgaaagagaaggaggataaggaaaaggccgctgtgagtaaacacgagcaaaaaggattcccaggaccaggaatcaggaatagcagctattactgtcagtatattaaaggccagatcaatgcctggaacgacctgcgtacttcactgctgccaataccatacctgagctgcgggaagatgtgctccaatttcaacaactag

SEQ ID NO: 244923 - DNA, 2166 bp, Artificial Sequence
  Description of Artificial Sequence: Synthetic coding sequence
atgaccgagattactgccgagggaaatgcatctacaacaacaacagtgatcgatagcaaaaatggctctgtcccgaagtcgccgggtaaggtcctcaaacgcaccgtgaccgaagacattgttaccaccttctcttcaccagccgcatggcttctggtgatcgcactgatcataacctggagcgcggtggcgattgtgatgttcgatctggtagactacaaaaactttagtgctagttcaattgcaaagattggctcagaccctctgaagttggtgcgcgacgccatggaggagaccacagactggatttacggcttcttcagcctgctgagcgacattatctcttccgaggacgaagaggacgatgacggtgatgaagacacagacaaaggagaaatcgatgaaccacctctgaggaagaaggagatccataaagacaagaccgagaaacaggagaaacctgaaaggaagattcagacaaaggtgacacacaaagaaaaggaaaagggcaaggagaaagtaagagagaaagagaaacccgagaaaaaggccacccacaaggagaagatcgagaagaaagagaaacctgagaccaagaccctggcaaaggagcaaaagaaggccaaaaccgctgagaaaagcgaggagaaaaccaaaaaagaggtgaaggggggaaagcaagagaaagtgaaacagactgctgctaaggtgaaggaggttcagaaaactccttccaagcctaaagaaaaggaagacaaggaaaaagctgccgtttccaagcatgagcagaaagatcaatatgcattttgtagatacatgattgatatctttgtgcacggcgatctaaagccaggacagagccccgcaatccctccacctctgcccacggagcaggccagccgacccactcctgctagcccagcccttgaagagaaggaaggagagaaaaagaaggctgagaagaaagtaacctcagagacaaaaaagaaagaaaaggaggacataaagaagaagagtgaaaaagagaccgcaattgatgtggagaagaaagagccaggcaaggcatcagaaaccaagcaggggaccgtgaagattgctgcacaagctgcagcaaagaaggatgagaaaaaggaagactccaaaaaaaccaaaaagccagccgaagtggaacagcccaaagggaaaaagcaagaaaagaaggaaaagcacgtggaacccgctaagtcacctaagaaagaacactctgtgccctcagataagcaagtcaaagcgaagaccgagcgcgcaaaagaagagatcggcgctgtgagcatcaagaaggctgtaccagggaaaaaggaagagaaaactactaagacggtagaacaagagattaggaaagagaaaagcggcaagacgtctagtatactgaaggacaaagaacccattaaggggaaggaagaaaaagtccccgcatcactcaaggaaaaggagcccgaaaccaagaaggatgaaaaaatgagcaaggcagggaaggaggtgaagcccaagccccctcagttacagggtaagaaggaggagaagccggaacctcagataaaaaaggaggccaagcccgcaatcagcgaaaaggtgcagatccataagcaagatatcgtgaagcctgaaaagaccgttagccacggaaagcctgaggaaaaggttcttaaacaggtgaaggctgttacaatcgagaagaccgctaagccgaagccaactaaaaaggcagagcaccgcgagcgagagccaccgagcattaagacagataaacctaaacctacacccaagggcacttccgaggtgactgaaagcggcaagaagaagaccgaaatatccgagaaagagagcaaggaaaaggctgatatgaaacatttgagggaagagaaggtgtccacacgtaaggagtcccttcagcttcacaacgtgactaaggaggacgtagaagatgttcccgctagcaagaaggctaaggaaggtacagaggacgtgtcccccactaagcagaagtcacctatttcatttttccagtgcgtctacctcgatggctacaacggatacggatttcaattcccctttaccccagccgaccgaccgggtgaatccagcggccaggcaaactccccagggcagaaacagcagggccaatag

SEQ ID NO: 244924 - DNA, 81 bp, Artificial Sequence
  Description of Artificial Sequence: Synthetic coding sequence
tgaatccataaagataaaaccgagaaacaagagaagccagagcgcaaaattcagactaaggaagtgggtcactcctcctag

SEQ ID NO: 244925 - DNA, 456 bp, Artificial Sequence
  Description of Artificial Sequence: Synthetic coding sequence
tgaacacataaggaaaaagagaaagggaaggagaaagtaagggaaaaggagaaacctgaaaaaaaagcgacgcacaaggagaagattgagaaaaaagagaagcccgaaactaaaacactggctaaagagcaaaagaaggctaagacggctgaaaagtctgaagaaaagaccaagaaagaggtaaaaggcggtaagcaagaaaaggtgaagcagaccgcagcaaaggtgaaggaggtacagaaaaccccatctaaacccaaggagaaagaagacaaggaaaaggcagctgtgagcaagcatgagcagaaaggctttccaggtccagggattcggaatagttcctactactgtcaatatatcaagggccagatcaacgcctggaacgacctgcggacatccctgttgcctattccttacctatcctgtggcaagatgtgctctaacttcaacaactag

SEQ ID NO: 244926 - DNA, 2196 bp, Artificial Sequence
  Description of Artificial Sequence: Synthetic coding sequence
atcgtcgagatctatcctcagggcaacgcttctacaaccaccactgttatcgacagcaagaatggttccgtccctaaatctcccggaaaggtgttaaagcgtactgtgaccgaggacatcgtcaccaccttttccagcccggctgcctggctgctggtgattgctttaattataacctggtccgctgtggccattgtcatgtttgatctagtcgactacaagaacttctctgcttctagtatcgccaagattgggagcgacccactgaagctcgtccgcgatgctatggaagaaacaaccgactggatttatggatttttttcactgctctctgacattatctcttccgaggacgaggaagacgacgatggggacgaggatacagataagggtgagatcgacgagcctccccttcggaaaaaagagattcataaggataaaacagagaaacaggagaagccagagagaaaaatccagactaaagtcactcacaaagaaaaagagaagggaaaagagaaagtgcgcgaaaaagagaaacctgagaaaaaagccacccacaaagagaagatcgaaaaaaaagagaaacctgagaccaagaccctagcaaaagaacagaagaaggctaaaaccgcggagaagagcgaagagaagaccaagaaggaggttaagggaggcaaacaggagaaggtgaaacagacagccgctaaagtaaaagaggtacagaaaactccttccaaacctaaagagaaagaagataaagaaaaggccgctgtcagtaagcacgagcagaaggatcaatacgcattttgcaggtatatgatcgacatctttgtccacggcgatctcaaaccgggtcaaagcccagccattcctcccccactccccacagagcaggccagcagaccgactccagcaagccccgctctcgaggagaaggaaggggaaaaaaaaaaggccgagaaaaaggtcacttccgagactaagaagaaggagaaggaagacatcaaaaagaaaagcgagaaggaaactgctatcgacgtcgaaaaaaaggtgcaggagcctggtaaagcctccgaaacgaagcagggtacagtaaaaattgcagcacaggcggctgccaaaaaggacgagaagaaagaggactccaagaagaccaagaagccggcagaggttgaacagcctaagggcaaaaagcaggagaaaaaagaaaaacacgtagaacccgctaaatcacctaagaaggaacacagcgttccctccgataagcaggtgaaagcaaagaccgaacgtgcaaaggaagagatcggcgctgttagtatcaaaaaggccgtccctggtaagaaggaggaaaagacaacaaaaaccgtagagcaggagatacgtaaagaaaagagtggaaagacatcaagcatactcaaagacaaggagccaatcaaaggcaaagaggagaaagtgcctgctagcttaaaagagaaagagccggagaccaagaaggacgaaaagatgtctaaagccggaaaagaagtgaagccgaagccaccacagctgcagggcaaaaaggaagagaagcccgagcctcagatcaaaaaggaggccaaaccagccatatctgagaaagtacagatccataaacaggacatcgtgaaacccgagaaaactgttagccacggaaaacctgaggagaaggttctgaagcaggtgaaagcagtaactatagagaaaaccgctaagccaaaaccgaccaagaaagcagagcaccgcgaaagagagccaccaagcatcaaaactgataagccaaagcccacacccaaaggcacaagcgaggttacggagagcggtaagaaaaagactgaaatttccgaaaaggagtctaaggaaaaggcggatatgaagcacctgcgggaagaaaaagtgtccactcgcaaagaatctctgcagctccacaatgtgaccaaggcagaggaagtcgattcgaccttggaggacgtggaggacgtcccggcaagtaaaaaggccaaagaagggaccgaagatgtgtccccaacaaaacagaagagcccaatctctttcttccagtgcgtgtatctggatggatacaatgggtatggcttccagttcccctttacacctgcggacaggcccggtgagagttcaggccaggccaactcaccaggacaaaaacagcaaggacagtag

SEQ ID NO: 244927 - DNA, 2190 bp, Artificial Sequence
  Description of Artificial Sequence: Synthetic coding sequence
atgactgagatcactgcagaggggaacgcctctacaacaaccaccgtgatcgattccaagaacggcagcgtgcctaagtctcccggaaaggtcctcaaaagaacagtgacagaggacattgtcaccaccttctcatctccagcagcgtggctgcttgtgatcgccctaataataacatggtctgcagtcgccattgtcatgtttgacctcgtcgattacaaaaatttttcagcaagtagtatagcaaaaatcgggtcagacccgctaaagctcgtgagagatgcaatggaagagaccactgattggatttacggcttcttttcactgctgtccgacatcattagttccgaggatgaggaggacgatgatggggatgaagacaccgacaagggggaaatcgatgaacccccactccgtaagaaggaaatccacaaagacaagaccgagaaacaagagaagcctgagcggaagatccagaccaaggtgacgcacaaggagaaagagaaaggcaaagagaaggttcgggagaaagaaaaaccagagaaaaaagccacgcacaaagagaagatagaaaagaaagagaagccagagaccaagaccttggctaaagagcagaagaaggctaagaccgctgaaaaaagcgaagagaaaaccaaaaaggaggttaagggagggaagcaggagaaggtaaagcagacggctgcgaaggtgaaggaagtgcagaaaactccatctaaacctaaagagaaggaagacaaggagaaagccgctgtttccaaacacgaacagaaagaccagtacgcgttctgcagatacatgatcgatattttcgtccacggcgatttgaaaccaggtcagagcccagccattccacctccactcccgacggagcaggcctcccgcccaacccctgctagccctgccctggaagaaaaggagggagaaaagaaaaaggccgagaagaaggtcacctcagagaccaagaaaaaagaaaaagaggatatcaaaaaaaagtccgaaaaggaaaccgcaatcgatgtcgagaagaaagaacccggaaaggcatctgaaaccaagcagggcacagtcaagattgcggcacaggccgctgccaagaaagacgagaaaaaggaggactccaaaaagactaagaaaccggctgaggttgagcagcctaagggcaaaaaacaggaaaaaaaggagaagcacgtcgaacctgctaagtctccaaagaaagaacacagtgtgccgtctgataaacaggttaaggcaaagaccgagcgggcaaaggaggaaattggagcagtaagtatcaaaaaggccgtccccggaaaaaaagaggaaaaaaccactaagactgtggaacaagagattcgaaaagagaagtctggtaagacctcgtccatcttgaaggacaaagagccaattaaaggcaaggaggagaaggtcccggcaagtctcaaagagaaagaacccgaaactaagaaagacgaaaaaatgtccaaagccggaaaggaggtgaaacccaaacctcctcagctgcagggaaaaaaggaggagaagcccgagcctcagattaagaaggaagctaaaccagccatatccgagaaggttcagatccacaaacaggatattgtgaaacccgagaaaaccgtttcacacggtaaaccggaggagaaagtgctaaagcaggttaaagccgtgacgatcgagaaaaccgctaagcccaaaccaaccaaaaaagccgaacatagagaacgagagccccctagcatcaaaaccgacaaacccaaaccaacgcccaagggcactagcgaagtgacagaatccgggaagaagaaaactgaaatttcggagaaagagagcaaagaaaaagccgacatgaaacacctgcgggaagagaaagtgtcaactcgcaaggaaagcctgcagttgcacaatgttaccaaggctgagaaaccggctcgcgtctcgaaggacgttgaggacgtgcctgctagtaagaaagcaaaggaggggactgaagacgtgtccccaacaaagcagaagagccccattagcttttttcagtgtgtatacctcgatggatacaatggatatggcttccaattcccattcactcctgctgaccgaccaggggaatcctctggccaggctaactcccctggtcagaaacaacaagggcagtag

SEQ ID NO: 244928 - DNA, 135 bp, Artificial Sequence
  Description of Artificial Sequence: Synthetic coding sequence
tgaatccataaggataaaaccgagaaacaagagaagccagagcggaaaattcagacaaaagactggtccgccaactcatccaccattcgcaccttgaaacttactcagctgaaaccgatttatatatgtacatag

SEQ ID NO: 244929 - DNA, 1038 bp, Artificial Sequence
  Description of Artificial Sequence: Synthetic coding sequence
attgtagagatatatccacagggtaacgcctcaactaccactaccgtgatcgattccaaaaatggatctgtgcccaagtcccctggaaaagtgctgaagcggaccgtgactgaagatatagtcaccacattcagctcacccgcagcctggcttttggttatagcactcattataacctggtccgccgtcgctattgtgatgttcgacctggtggattataagaatttcagtgcgagctcgattgccaagattggatctgacccactgaaattggtcagagacgctatggaggaaacaaccgactggatatacggctttttctcgctcctaagcgatataataagctcagaggatgaggaagacgatgatggcgatgaggacacagacaagggagaaatcgacgagcccccactgaggaagaaggaaattcacaaggataaaacggaaaaacaggagaaaccggagaggaaaattcaaaccaaagtgacgcacaaggagaaagagaaaggaaaggaaaaggtgcgggagaaagaaaagcccgaaaaaaaagctacacataaagaaaagatcgagaaaaaagagaagcctgagacaaaaaccctggcgaaagaacaaaagaaagccaaaacagccgaaaagtcagaagaaaaaaccaaaaaggaggtgaagggcggtaagcaggagaaagtcaaacaaaccgccgctaaagtgaaggaagtacagaaaacccctagtaagcccaaggaaaaagaggataaggagaaggctgcagttagtaaacacgaacagaaagatcagtatgctttctgccgttatatgatcgacatctttgttcatggcgatctcaagcctgggcagtctccagcaatacctccacccctgccgacggagcaggcttccagaccaactccggcatctcccgctctcgaggagaaggaaggcgagaagaagaaagccgaaaagaaggttaccagtgaaacaaagaaaaaggaaaaggaggatataaagaagaaaaaaaagaaaaagaagaagaagtag

SEQ ID NO: 244930 - DNA, 504 bp, Artificial Sequence
  Description of Artificial Sequence: Synthetic coding sequence
atgacagagattactgccgagggaaacgcttccactaccacgactgtgatcgactctaagaacggttccgttcccaaaagcccaggcaaagttctcaaacgcaccgtgaccgaggatatagtcacgacctttagcagccccgctgcttggctgttggttatcgcccttataattacgtggtctgccgttgctatcgtcatgtttgacctggtggattacaagaacttttccgctagttctatagccaaaataggaagcgatcctctgaaacttgtccgggacgcaatggaagagactacagactggatttacggatttttctctctcctgagcgatattatttcttccgaggacgaggaagatgacgacggtgatgaggatacggacaagggcgagatcgatgagccgcctctcagaaagaaggaaatacacaaagataagacggaaaaacaggagaaacctgaaaggaagatacagaccaaggaggttggacacagctcctag

SEQ ID NO: 244931 - DNA, 987 bp, Artificial Sequence
  Description of Artificial Sequence: Synthetic coding sequence
atgaccgagattacagcggagggaaatgcttctaccacaaccacagttatcgatagtaagaacgggagcgtgcctaaaagtcccggtaaggtgcttaagcgaactgttactgaagacatagtgacaaccttttcgtccccagctgcttggctcctggtaattgccctcatcatcacttggagcgctgtggcaatcgtgatgtttgacttggtggactataaaaatttttctgcatcatctattgccaagattggttccgaccccctaaaactggtcagggacgctatggaagagaccacggattggatttacggatttttttctttgctgagtgatatcatctcatcggaggatgaggaagatgatgacggcgacgaagatacagataaaggcgagatcgacgaacccccattacgcaagaaggaaattcataaggataaaactgaaaaacaggagaaaccagaacggaagatccagacaaaggtcactcacaaagagaaagagaagggcaaggaaaaagtgcgagaaaaagaaaaacccgaaaagaaagctacccacaaggaaaagatagaaaagaaagaaaagccagagaccaaaacgctggctaaggagcaaaagaaggctaagaccgcagaaaaaagcgaggagaagaccaaaaaagaggttaaggggggtaaacaagagaaggtcaaacagaccgcggctaaggtgaaggaggtacaaaagaccccttctaagccaaaagaaaaagaggacaaggagaaggctgccgtgtccaaacatgaacagaaggaccagtacgcattttgccggtatatgatcgatatattcgtgcatggggacctgaaacctggccaatcacctgctatccctcctcctctccctacagaacaggcatctagacccacccccgctagtcccgctctcgagggggacaaggcctccaaagaaaagaaacgtaaaatgaaacgtatgagtgaaaaatag

SEQ ID NO: 244932 - DNA, 894 bp, Artificial Sequence
  Description of Artificial Sequence: Synthetic coding sequence
atgaccgagattactgcagagggaaacgcttccaccaccaccactgtgattgacagcaagaacggaagcgtacccaagagccctgggaaagttttgaagcgtacagtaaccgaggatatagtgaccacctttagttcacccgctgcatggcttctcgttattgctctcatcattacatggagcgccgtggccatcgttatgttcgatctcgtcgattataaaaacttctcggcttcaagcatcgcgaagatcggaagtgatcctcttaagctcgtgcgcgacgccatggaagagacaactgattggatttacgggtttttttcgctcctgtcagatatcatatcaagcgaggacgaggaggacgacgatggcgacgaagatactgataaaggggaaatcgatgagcctcctctgcggaagaaagaaatccacaaggataaaacggagaagcaagaaaaacctgaacgaaagattcagacaaaggtgacacacaaggaaaaagaaaaaggcaaggagaaggtgagagagaaagaaaaacccgaaaagaaggcaacccacaaagaaaagattgaaaagaaagaaaaaccagagacaaagactctcgcaaaggaacagaaaaaggcgaagactgcagagaagtccgaagaaaaaaccaaaaaagaagtgaaggggggtaaacaagaaaaggtcaaacagacagcagctaaggtgaaagaagtccagaagacaccttctaagcctaaagaaaaggaggataaagagaaggccgcagtgagcaagcacgagcagaaaggacagagtcccgcaatccctccacctcttcctactgagcaggcttctagacccacacccgcatctccagccctcgagggaaaatatttttttttctcttag

SEQ ID NO: 244933 - DNA, 5831 bp, Artificial Sequence
  Description of Artificial Sequence: Synthetic coding sequence
atgtctcctcttttacgaagcatctgcgacattaccgagatcttcaatcagtatgtgtcacacgactgcgatggggcagcgctcacaaagaaagacctgaaaaacttgttagagcgcgagtttggggctgtgctgagaagacctcacgacccaaaaactgttgacctcattctggagctgctcgacttggacagcaacggccgagtcgacttcaatgaattcctgctgttcatattcaaggtcgctcaggcatgctattatgccctgggccaggccactggccttgacgaagagaaacgcgcaaggtgtgacgggaaagagtctctgctacaggatcgcaggcaggaggaagaccagcgtcgattcgagccacgagaccggcagctggaggaggagccaggccagcggcgtagacagaagaggcaagagcaggaacgcgagctggcagagggggaggagcagagtgagaaacaggaaaggctcgagcaaagagatagacagcgcagagatgaggaattgtggaggcagcgacaggaatggcaggagagagaagagaggcgcgctgaggaagaacagctgcaaagctgtaagggacacgagactgaagagtttcccgatgaagagcaattgcggaggcgggaactgcttgaattgcggaggaaaggccgtgaagaaaaacagcagcagagaagagaacgacaggaccgcgtttttcaggaggaagaggagaaagagtggcgtaagagggagactgtcctccgtaaagaggaggaaaaactgcaggaagaagagccacagagacagcgagagctacaggaggaggaggaacagcttcgcaagcttgagcgacaggagctcaggcgcgagcggcaagaagaagagcagcaacaacaacgtcttagacgcgagcagcaactccggcgaaagcaggaagaggagaggcgtgagcagcaagaggagaggcgagagcaacaggagcgtcgggaacagcaggaggagcgcagggagcagcagctgcgccgagaacaggaggaacggagggagcaacagcttcggcgagagcaggaagaagagcgcagagagcagcagttgaggcgcgagcaagaggaggagcgacgggagcagcagctgcgccgagagcaacaactcaggcgcgaacaacagctgcggagggaacaacagctgagacgtgagcagcagctccgcagggagcagcagctgagacgggagcagcagctgaggcgcgaacaacaactacgaagggaacagcagctgaggcgcgaacaggaggaggagcgccatgagcagaaacatgaacaggagagacgcgaacagcgcctaaagcgtgaacaggaagagcggcgagactggctcaaaagagaagaggagaccgagagacatgaacaggagcggaggaagcaacagctaaagagggatcaggaagaagagcgcagggagagatggctaaaattagaagaggaagaacggcgtgagcagcaggaaaggagggagcagcagctgaggagagagcaagaagagcggagggagcaaaggctcaagaggcaggaagaggaagagcgactgcaacagaggctccgaagcgaacaacagctgaggcgggaacaggaagaaaggagggaacagctcttgaagagggaagaggagaagcgtctggaacaggagagaagagagcaacgcctgaagcgagagcaggaggagaggcgcgaccagctccttaagcgtgaggaggaacgcaggcagcaacggctgaaacgcgagcaggaggagcggctagaacaaagactgaaacgagaagaggttgaaaggctcgagcaggaagagagaagagagcagagactcaagcgggaggagcctgaagaggagagacggcagcagctgcttaagagcgaagagcaggaggagagaaggcagcaacaattaagacgggagcagcaggagaggcgcgagcagagattgaaacgcgaggaagaggaggagaggctggaacagcgactaaaacgggagcacgaggaagagcgacgcgagcaggagttagccgaagaggagcaggagcaagcaagagaacgtattaagagccgcatccctaaatggcagtggcagctcgaatctgaagcagacgctaggcagtccaaggtttattcacggccacgcaaacaggagggacaaagacgccgacaggaacaggaggaaaaaagaagacgtagagaatctgaactccagtggcaggaagaggagcgcgctcatcgacagcagcaggaggaggaacaaaggcgtgacttcacatggcagtggcaggctgaggaaaagagcgagcgtggccgtcagaggctgtcagcaagacctcctctgcgagagcagagggagcggcagctccgcgcagaagagcgacagcagagagagcagcgcttcttacctgaagaagaagaaaaagaacaaaggcgcaggcagcggcgagagagggagaaagaattacagtttctggaggaggaagaacagctccagaggagggagagggcccagcagttgcaggaagaggaagatggcttgcaggaagaccaagagcggaggcgctcgcaggagcagcgcagagaccagaaatggcggtggcagctggaggaggagagaaaacgacggagacataccctgtatgccaaacccgctttgcaggaacagctcaggaaagaacaacaacttctgcaagaagaggaagaagagcttcagagagaggagcgggagaaaagaagaaggcaggagcaggagagacaatacagggaggaggagcagctgcagcaagaggaagaacagttactccgcgaggaacgcgaaaaacgtcgtagacaagaacgggaacggcagtatagaaaagacaagaaactgcagcagaaggaggagcagctgctgggcgaagagcctgagaagcggagacgtcaagagagagaaaaaaaatatagagaagaggaagagctgcagcaggaagaggagcaactcctccgcgaggaacgagaaaagcggagacgacaagagtgggagcgccagtacaggaagaaggacgaactgcagcaggaggaggagcagcttctaagagaggaaagagagaagaggcgattgcaggaacgggaacggcagtatcgcgaggaagaagagctgcaacaggaggaggagcaattgctgggcgaggaacgtgagaccaggcgacggcaggaactggagaggcagtataggaaagaggaggaattgcaacaggaggaggaacagctgctgcgggaggagccggagaagcggagaagacaggaacgggaacgtcagtgtcgcgaagaggaagagctgcagcaggaagaagaacagctgctcagggaggaaagagagaaaaggagaagacaggagcttgaacggcagtacagagaagaggaagaggttcaacaggaagaggagcagcttctgcgcgaggagcccgaaaagcggagaaggcaagagctggaaagacagtatagggaggaagaagagctgcagcaggaagaggagcagctccttagagaggagcaagaaaaacgtcgtcaagagagggagcggcagtatcgagaagaggaagaattacagcgccagaagaggaagcagaggtaccgggatgaagaccaacgttccgatctgaagtggcaatgggaacctgagaaggagaatgcggttcgggacaataaggtatactgcaaaggcagagagaatgagcagttcaggcagctggaggattcacagcttagagaccgtcagtctcagcaggacctgcaacatctgcttggggagcagcaagaacgagaccgagaacaagagaggcgacgatggcagcagcgcgatcgccacttcccagaagaagaacagctggagagagaggaacagaaggaagctaaaaggcgggaccgaaagagtcaggaagaaaaacagctcctacgtgaggagcgggaggaaaagaggaggagacaggagaccgatcgtaagtttagagaggaagaacagcttctccaggagagagaggagcagccgttgaggcgacaggagcgcgaccgaaagttcagggaagaagagctgcgccaccaggagcaagggcgtaaatttttagaggaagagcagcggcttaggaggcaggagcgcgaaagaaaattcctcaaggaagagcagcagctgcgctgccaggagcgcgagcagcaactccggcaggacagagatcggaagtttcgtgaggaggaacagcaattaagtagacaagaaagggacaggaaatttagagaagaagagcagcaggtcagacggcaggagagggagcgaaaattcctggaagaggagcagcaactccgccaggagcggcacaggaaattccgcgaggaggaacagctcctacaggaacgggaggagcaacagctccaccggcaggagagagaccgcaagttcttggaggaagaacagcagctgagaagacaggaaagagatcgcaagtttcgagagcaggaattaaggtcacaggaacctgagagaaaatttctcgaagaagagcagcagctccaccgccagcagagacagaggaagttcctacaagaggagcagcaactgcgccgacaggagagggggcagcaacgtaggcaagatagggaccggaagttccgggaagaggagcagctgcgtcaggagagggaagagcagcaattgtcaaggcaggagcgcgatcgcaaattccggctggaagagcagaaggtccgcaggcaagaacaggagaggaagttcatggaggacgaacagcaactccgcagacaggaggggcaacaacagctgaggcaggagcgcgataggaaattcagggaagatgaacaactactgcaggagcgcgaagagcaacagctacataggcaagagagagaccgcaagtttctggaagaagagccccagttgcgtaggcaggaacgagagcaacagctcagacatgaccgcgatagaaagtttagagaggaggagcagctactgcaggaaggagaggaacagcaactgcgccgacaggagcgggataggaagtttcgggaagaggagcagcagcttcggcgacaggagagagaaagaaaatttctgcaagaggaacaacagttaaggcggcaggagctggaaaggaagttccgtgaggaagaacaactgaggcaggagacggaacaagaacaactaagaagacaagagagatacagaaaaattctggaggaagagcagctgcgacccgagcgtgaggagcagcagctgcgccgacaagagcgtgatcgtaagtttcgcgaggaagagcaattaaggcaggagagagaggaacagcaactgaggtctcaggaatccgatcgcaaatttagggaagaggaacagctccggcaggagagggaagagcagcagctgcgtccccagcagagagatgggaagtataggtgggaagaggagcaactgcagttggaggagcaggagcagaggctccggcaggagcgcgacagacagtacagggccgaggagcagttcgccacacaagaaaagagccgtcgggaggaacaggagttgtggcaagaagaggaacagaaacggagacaagaaagggagcggaagttacgggaagaacatatcagaagacaacaaaaggaggagcagcgccaccggcaagtgggagagataaagtcccaggaggggaaaggacatggcaggctgctcgaacctggaacccaccaattcgcatccgtacccgtgagatctagccctttgtatgaatatattcaagaacagagatctcagtacagaccata

SEQ ID NO: 244934 - DNA, 540 bp, Artificial Sequence
  Description of Artificial Sequence: Synthetic coding sequence
atggcgaagaccgccatggcttacaaagaaaagatgaaggaattatccatgcttagtctgatctgttcttgcttttaccccgagcccaggaacattaacatttacacctacgatgacatggaggtcaagcagattaacaagagggcttctgggcaggcgttcgaactgattttaaagccaccctcacccatcagtgaggctccgaggacattagcatctcccaagaaaaaagatctttcgctcgaagaaattcagaagaaactggaagcagccgaggaacggagaaagagccaggaggcacaagtgttaaagcagctcgccgagaaaagagagcacgaaagagaggtactgcagaaggcactggaggagaataataacttctcaaagatggccgaggagaagctaatcctgaagatggaacagatcaaggaaaatcgcgaggctaacctggcagctataatagagcggctgcaagaaaaggagagacacgccgcagaggtccggagaaataaagagctgcaggtcgagctttccggatag

SEQ ID NO: 244935 - DNA, 3885 bp, Artificial Sequence
  Description of Artificial Sequence: Synthetic coding sequence
atgccttatgaagtgaacgccggttatgactttaccaacatggtgcgcaaaaagaatcctcccctccgtaatgtggctagcgagggagaaggccaaattctcgaacccatcggtacggagagtaaggtttccgggaaaaacaaggaatttagcgctgatcagatgtcagagaacaccgaccagagcgatgctgctgagctgaatcacaaggaagagcattcactgcatgttcaggacccttcgtcctccagtaagaaagacctgaagagcgccgtgttaagtgaaaaggctggattcaactacgagtcaccctccaagggcggaaatttcccaagtttcccccacgacgaagtgactgacagaaacatgctggccttctcttctccggctgcgggaggcgtgtgcgaaccactaaagtcacctcagcgggctgaggccgacgacccccaagacatggcttgcactccatctggagatagtctggaaactaaagaagatcagaaaatgagccctaaggccactgaagaaaccggccaggcccagagcggacaggcaaactgccagggactgagccctgtgagcgtggcctccaagaatcctcaagtgccatcagacggtggagtccgtttgaacaagtctaagacagacctcttggtaaacgataatcctgatccagcacccttatctcctgaactccaggacttcaagtgcaacatttgcggttacggttactatggaaacgaccctacagatctgatcaagcactttcggaagtaccatctgggtttacataacagaacccggcaggacgccgaactggatagcaaaatacttgctttgcataatatggtgcaattcagccactcaaaggacttccagaaggttaaccgcagtgtattttcaggtgttctccaagatataaactcctcccggccagtactcctcaacggtacatatgacgtccaggttacaagcggcggaactttcattgggattggcaggaaaacgcctgattgtcagggcaacaccaaatattttcggtgcaagttttgtaactttacatatatgggtaacagctccactgaactcgaacaacactttctccagacccatccaaataagatcaaggccagtcttccttcctcggaggttgcaaaacccagtgagaagaactctaataaatctatcccagctcttcaatccagtgacagcggagacctcggcaagtggcaggataagattacagtgaaggctggggatgatacccctgtcgggtacagcgtgcccattaaaccactggactcgtccaggcagaacggaacagaggccacctcatactattggtgcaaattctgcagtttcagctgcgagtcttctagctcattaaagcttctggagcactacggaaaacagcacggggcagtacaatcaggtgggctcaatcctgaactaaatgacaaattgtcacggggatcggttataaatcagaatgacctcgctaaaagctcagagggcgaaactatgaccaagactgacaagagttctagcggcgctaaaaaaaaagatttttcttccaaaggtgctgaagacaatatggtgacatcctacaattgccagttttgtgactttcggtatagcaagtcccatggcccagatgtcattgtggtgggccctctgctcagacactatcagcagctccacaatattcacaagtgtaccattaaacactgcccattttgccctcgcggactctgttcccccgagaaacatctgggcgagatcacatatccatttgcctgtagaaaaagcaattgtagtcattgtgctctgcttttactgcatctctctccaggagcagctggttcttccagggtgaagcatcagtgccaccagtgttcatttactactccggacgtggacgtcctgctttttcactatgaatccgtgcacgaatcccaagcttccgacgtcaaacaggaggctaaccacctccaaggcagcgacggccaacagtctgtcaaagagagtaaggaacactcctgtacaaaatgtgactttattacccaagtagaagaggaaatctctaggcactaccgacgggctcactcatgctacaagtgcaggcagtgtagttttactgcggctgatacccagagtcttctggagcattttaatacagtacattgccaggaacaagatattactacagccaatggtgaagaagacggtcacgcgatcagcaccattaaggaggagcccaagatagacttcagagtttataatctcttgacaccagatagcaaaatgggcgaacccgtgagcgaaagcgtggttaaacgggagaagcttgaagagaaggatggcttgaaagaaaaggtctggacagagtcaagttccgacgatctgcgaaacgtaacttggcgaggagctgatattttaaggggatcccccagctacacacaggcctccctcggcctgttaacaccagtgagcgggactcaggagcagacaaaaacacttcgggacagcccaaacgttgaggccgcacacctagcaaggccgatctacggcctcgccgtggagacgaagggcttcctgcagggagctcccgctggcggagaaaagagcggggctcttccccaacagtaccccgcttctggcgagaacaaatccaaggatgagagtcagagtctgctgcgccgtcgcagagggtccggcgtcttttgtgccaattgcctgacaactaaaacgtccctgtggaggaagaacgcgaacgggggttatgtgtgtaacgcctgtggactctaccaaaagctgcactcgacccccagacccctcaacatcatcaagcagaacaacggcgagcagattatcaggcgcaggactagaaagcgcttgaaccccgaggcattgcaggccgaacaattgaataagcaacaacgtggaagtaatgaagagcaagtgaacggttccccactagagagaagaagtgaggatcatctgacagaaagccaccaaagggaaattccccttccctcattgagcaagtatgaagcacaggggtcgctgacaaaaagccacagcgcgcagcagcccgttctggtgtcacagacccttgatatccataagcgcatgcagcccctgcacatccaaataaagtctccccaggagagcacgggggatcctggtaacagcagtagcgtctccgaagggaagggctcctcagaaaggggttctcctatcgaaaaatacatgagacctgccaagcatcccaactactctccacccggtagcccgattgaaaaataccaatacccactgtttggcttgcctttcgtgcataatgattttcagtctgaggccgactggctgaggttctggagcaagtacaagctcagcgtacccggtaacccccactacttgtcccatgtgccagggctcccaaacccgtgtcagaactacgttccgtacccgaccttcaatttgccgcctcacttttcggccgttggatcagataacgatatacccctagatctggcgatcaagcactctcgccctgggcctaccgctaacggcgcttctaaggaaaaaacaaaggccccaccgaacgtcaaaaacgaaggtcccctcaacgtggtgaaaaccgagaaggtcgaccgatcaacccaggacgaactctcgacaaaatgtgtccactgcggcattgtattccttgacgaggtcatgtatgcgctgcatatgtcctgtcacggagattcaggcccattccagtgttctatatgtcaacacttgtgtaccgacaaatatgattttaccacccatatccagcgaggtttgcaccgcaataacgcccaggtggagaagaatggaaagcccaaggagtag

SEQ ID NO: 244936 - DNA, 3858 bp, Artificial Sequence
  Description of Artificial Sequence: Synthetic coding sequence
atgcagagtaatatggtgcggaagaagaaccctccgctgcgcaatgtcgcttcggaaggcgagggtcagatattagaaccgattggtactgaatctaaggtgagcggcaagaataaagagttctccgccgatcaaatgtccgagaacactgatcagtctgatgctgcagagcttaatcacaaggaggagcactcactgcacgtgcaggaccccagctcatctagcaaaaaggatctgaaaagcgctgtcctctccgagaaagcagggttcaattacgagtccccgtctaagggtggcaattttccatccttcccgcatgacgaggtgaccgatagaaatatgctggcctttagctctcctgccgcaggtggagtttgtgagccgttaaagtccccccaacgcgcagaggcagatgatccccaggatatggcatgtacaccctctggggacagcctcgagactaaggaagaccaaaaaatgagcccaaaagcaacagaggagacagggcaggctcagtccgggcaggcgaactgccaggggctctccccggtatctgtcgctagtaaaaatcctcaggtcccttctgatgggggtgtccgtctaaataaatctaagacggacctacttgtcaatgataaccccgatcctgcccctctgtcccccgagctgcaggacttcaagtgtaacatctgcggatacggttactatggcaacgaccctactgacctgatcaagcactttcgaaagtatcacctaggactgcataaccggacccggcaagatgcagaactcgatagtaaaatactggctctccacaatatggtacagttctctcacagtaaagattttcagaaagtgaaccggagtgtgttctcaggtgtactgcaggatattaactccagcagacctgtccttctaaacggaacctatgatgttcaggtgacctccggaggcacatttattggcattgggaggaagacccccgattgccagggaaatactaaatattttcgttgtaagttctgcaacttcacctacatgggaaactcaagtactgaactggaacagcactttctgcaaacccatccgaataagataaaagcttccctgccatcttcagaagtggcaaaaccttcagaaaagaactctaacaagagcataccagctctgcagtcgagtgacagcggtgatctcgggaagtggcaggacaagatcaccgtgaaagcaggagacgacaccccggtagggtatagcgttccaatcaaacctctggacagttcaaggcagaatggtaccgaggcaacttcttactattggtgcaaattctgctcctttagctgcgaaagtagcagcagcctgaaactgctagagcattacggcaaacagcacggggctgtccagtccgggggactgaaccccgagctgaacgataaactgagccgagggtcggttattaatcagaacgacctcgctaagtccagcgaaggagaaactatgacgaagactgacaagtcctccagtggtgccaaaaagaaggactttagctccaagggcgcagaagacaacatggtaaccagctataactgccagttctgtgacttccggtatagtaagtcccatggcccagatgtcattgtggtggggccattgcttcgccactatcaacagttacataacatccacaaatgcaccattaagcactgccctttctgccctcgcggattatgctcacctgaaaagcacctgggcgagatcacctacccgttcgcttgcaggaagagcaattgcagccattgcgcccttctgctcttgcacctttcccccggtgcggcagggagtagtagagtaaagcaccagtgccaccagtgctcctttactacacctgatgtggatgtgcttctattccattacgagtcggtccacgagagccaggcaagcgacgtgaaacaggaggccaatcacctccagggaagcgacggtcagcagagtgtgaaggagtccaaggagcattcatgcaccaagtgcgacttcatcactcaggtggaggaagaaatctcccgtcactatagaagagcccattcatgctataagtgccgccagtgtagcttcaccgccgctgatacacagagtctcctagaacattttaataccgtgcactgtcaggaacaggacataactacagccaacggtgaggaggacggccacgctattagcactatcaaagaagaacctaagatcgattttcgcgtgtataacctccttacccctgattctaagatgggtgagccagtgagcgagtcagtggtgaagcgcgagaagttggaggaaaaagacgggttaaaagagaaggtgtggacagagtcttcctcggacgacctccggaatgtcacttggaggggagccgacatcttaagaggtagccccagctacacgcaggcatcactgggcctgctcaccccagtttccggcacccaggagcagacaaagactttgagggattcccctaacgtggaagccgctcacctggccaggccaatttacggactggcggttgagacaaaaggcttcctgcagggcgctccagccggtggggagaaaagcggggctttgcctcagcaataccccgcttcgggtgagaacaaaagcaaggatgagtcacaaagcttgctccggaggcgccgaggtagtggcgtgttttgcgcaaactgtctgaccacaaaaacctcattatggaggaagaacgcaaatgggggttatgtgtgcaatgcatgcgggctctatcaaaaactgcacagcacacccagacccctgaacatcattaaacagaataacggcgagcagatcatcagacgcagaacaaggaaacgccttaatccagaggctctgcaggccgagcagcttaataaacagcagaggggctccaatgaggagcaggtgaatggttcccccctggagcgcagaagcgaagatcatttgaccgaaagtcaccagcgtgagatacccttgccatcactctctaaatatgaggcacaagggagtctcactaagtcccactctgcacaacagccggttcttgtctctcagacccttgacatccacaagagaatgcaaccgctccatatacagatcaaatctcctcaggagtccaccggggatcctggaaactcctcttctgtgtccgaggggaagggatcttcggaaagaggttctcccattgagaaatacatgcggccagcaaagcatcccaactactctcccccaggctctcctatcgaaaaatatcagtacccactatttgggctcccctttgtgcataatgacttccaatcagaagctgactggttgcggttttggtccaagtacaagctttctgtgcccggaaacccccattatctcagccatgtgcctgggctcccaaacccctgtcaaaactacgtcccttatccgacttttaatctcccacctcactttagcgctgtaggtagtgacaatgacattcccctggaccttgcaattaaacattcccgcccaggaccgaccgccaatggcgcaagcaaagagaaaaccaaggcccctccaaacgttaagaacgagggtcctcttaatgttgtaaaaactgagaaggtggaccgaagtacacaggacgagctgagcacaaagtgcgtgcactgtgggatagtctttctggatgaggtaatgtacgccctgcacatgtcctgccacggagactcaggccctttccagtgttccatctgtcagcatctgtgtactgataagtacgatttcacaacgcatatccaacgcggactgcacagaaataacgctcaggttgaaaaaaatggcaaaccaaaagaatag

SEQ ID NO: 244937 - DNA, 705 bp, Artificial Sequence
  Description of Artificial Sequence: Synthetic coding sequence
atgcggaagacgcgactttggggtctgttatggatgctgttcgtctctgagctgagagccgcaacgaagctgaccgaggaaaagtatgagctgaaggagggccaaaccttggacgtaaaatgcgattacacattagaaaagttcgcgtcttcccaaaaggcatggcaaattatccgtgatggagagatgcccaaaacattggcatgtactgagcggccttccaaaaactctcaccccgtgcaggtgggcagaattatcctggaagattatcacgaccacgggctgctacgtgtgcgtatggtgaatctccaggtcgaagattccggactgtatcagtgcgtcatttaccagccaccaaaggagccccacatgttgtttgatagaatcagactggttgtgactaaggggtttagcgggacgcccggatcaaacgaaaactcaacgcagaatgtgtacaagattccaccgacaacaacgaaggccctttgtcccctttatacctctcccagaacagttacccaagcgcctcccaagtcaactgctgacgtttccacacccgacagtgagatcaacctaaccaacgtcacggatatcatccgagtccccgtcttcaatatcgtgatcctgctcgccggagggtttttgagcaaatccttggtgtttagcgttctctttgcagtgacattgcgctctttcgtcccctag

SEQ ID NO: 244938 - DNA, 453 bp, Artificial Sequence
  Description of Artificial Sequence: Synthetic coding sequence
atgcggaaaacaaggctatggggactactgtggatgctgttcgtaagcgagcttcgggcagccactaagttaaccgaagagaaatatgaactcaaagaagggcagactttggatgtaaaatgtgactacactctggagaaatttgcttcttctcagaaggcttggcagattataagagacggcgagatgcctaaaactctggcttgcacagagcgaccttccaagaatagtcaccccgtgcaggtgggccgtattatacttgaggactaccatgatcacggcctactgagagtccgtatggtgaatctgcaggtggaggattctgggctctaccagtgtgtgatttaccagcctcccaaagaaccccacatgctctttgaccggatccgcctcgtcgttacaaaggggtttcggtgcagcacactaagcttctcctggctcgtggatagttag

SEQ ID NO: 244939 - DNA, 678 bp, Artificial Sequence
  Description of Artificial Sequence: Synthetic coding sequence
atgagaaaaaccaggttgtggggcctcctctggatgctgtttgtctctgaactgagggctgccaccaaactgactgaagaaaagtacgagctgaaggaaggacagaccttggatgtaaagtgtgattacacacttgaaaaatttgcgagcagccagaaggcgtggcagattatccgcgacggcgagatgcctaaaacattggcctgtacagaacgaccctcgaagaatagtcaccctgtccaagtaggtcgtataatccttgaggactaccatgaccacggtttactgagggtccgcatggttaacttgcaggtagaggattcaggcctctaccagtgcgtgatttaccagccgccaaaagaaccccacatgctgttcgatcgaattcgcttagtggtcaccaaaggcttctcaggaacaccgggatcgaacgaaaactcaacccagaacgtttataagattccacccacaaccacgaaggcactgtgcccactatacacctctccgaggacagttactcaagcccctccgaagtcaactgcagatgtctcaactcccgatagcgagataaatctgactaatgtcacagatatcatacgatacagctttcaggtgcccggacctctcgtatggaccttaagtcccctatttccctccctgtgcgccgagcgcatgtag

SEQ ID NO: 244940 - DNA, 501 bp, Artificial Sequence
  Description of Artificial Sequence: Synthetic coding sequence
atggagccgctgaggctactgattctgctatttgtgacagaactttctggagcccacaatactaccgtttttcaaggcgtagccggtcagtcgctgcaagtgtcctgcccatatgacagcatgaaacactggggcaggaggaaggcctggtgtcggcagctcggcgaaaaaggaccatgtcagagagtggtatctacgcataacctgtggctactgagcttcctgcgtaggtggaacggttccacagctatcactgacgatactctgggcggtacacttacgatcactctgcgcaacttacagccacatgacgctggcctctaccagtgccagtcgctgcatggctccgaagccgatacactcagaaaggtccttgtggaagtcctagccgacccactggaccacagggatgcgggagacctgtggtttccaggcgaaagtgagagcttcgaggacgcacacgtcgagcatagtatttctagagctgaaagacacgtgtag

SEQ ID NO: 244941 - DNA, 693 bp, Artificial Sequence
  Description of Artificial Sequence: Synthetic coding sequence
atggagccgctgcgcctcctgatactcctgttcgtgacagaactgtctggggctcataacactacggtgttccagggagtagccggacaatcgctgcaggtgtcatgcccttacgactcaatgaagcactggggcagacggaaggcgtggtgccggcagctcggagagaagggaccttgtcaacgagtggtctcaacgcacaatctgtggctgctaagcttcctgcggaggtggaatggttccactgccataacagatgacactttagggggaacactgaccatcacgctaaggaatcttcagcctcatgatgcgggattataccagtgtcagagtttgcacggctctgaagccgataccctgagaaaagtcctagtggaggtactggcggatcccctcgaccacagagacgctggagatctgtggttcccaggcgagtccgaatccttcgaggatgctcatgtggagcacagcatcagtaggtcactccttgagggcgaaattccattccccccaaccagcattctcttactccttgcgtgtatctttcttattaagatcctggctgctagcgctctgtgggcagccgcttggcacggccagaaacccggaacccaccccccaagcgagcttgactgtggtcacgaccccggataccagctgcagacgctgcccggactgcgcgatacctag

SEQ ID NO: 244942 - DNA, 660 bp, Artificial Sequence
  Description of Artificial Sequence: Synthetic coding sequence
atggaacctttaagactgctgatcttattattcgtcacggagttgagcggagcacacaacaccaccgtgtttcagggtgtggctggccagagccttcaagtgtcctgtccttacgactccatgaagcattgggggagaaggaaagcctggtgcaggcaactcggcgaaaaagggccttgtcagagagtggtgtcgacgcataatctttggttactttctttcctacggagatggaacgggtctacagccatcactgacgacactttgggcggtaccctgacaatcacactccggaaccttcaaccacatgacgcgggtctgtatcagtgtcagtctctgcatgggtccgaggccgataccttaagaaaagttctggttgaagtgcttgccgatcctctcgaccatcgagacgcaggtgatctgtggtttcctggcgaatcagagagctttgaagatgcccacgtcgagcattcaattagcagagccgagcgtcatgtaaaggaggacgatggcagaaaaagtcccggtgaagtacccccaggaacgtcaccagcttgcattctggctacgtggccaccaggactgctcgtgctgctttggcaggaaaccacactgcccgagcactgtttcagctggacacttgaagccggaaccggctag

SEQ ID NO: 244943 - DNA, 936 bp, Artificial Sequence
  Description of Artificial Sequence: Synthetic coding sequence
atgggtttgaccctcttactactcctgttactcggactcgagggccagggcatagtcgggagtctgcccgaggtcctgcaggctcccgttggctcatctatcctcgtgcagtgccactatcgactgcaagacgttaaggcccagaaggtgtggtgccgctttcttccagaaggctgccagccacttgtctcaagcgccgtcgatagacgggcaccagcaggcaggcgcacatttctgacagatctcgggggaggtcttctgcaggtggagatggtcaccctccaggaagaagacgcaggagagtatggatgtatggtagacggcgcacggggacctcagattctacaccgcgtgtctctgaatattctccctccagaggaggaagaagaaacacataagattggaagcctggctgagaacgccttcagcgacccggctggatccgcaaatcccttggagccttcacaggatgagaaatcgatacccctgatttggggcgctgtgctcctagtcggtttgctagtggcagcggtggtgttgtttgctgtcatggctaaacgaaaacaggggaacagactgggcgtctgcggcaggttcctgagtagccgggttagtggcatgaacccaagtagtgtggttcatcacgtctctgactctggtcctgctgcagaactgcccctagacgtgccccacattagactggattctcccccttctttcgataatacgacctacacctcactacctctggattccccttccggcaagccatcactgccagcgccttcctctctcccacctctccctcctaaagtgctagtgtgtagcaagcccgtaacatacgccacagtgatattccctggaggaaacaagggcggtggcactagttgcgggccagcccagaatccccctaacaatcagacaccttcaagctag

SEQ ID NO: 244944 - DNA, 600 bp, Artificial Sequence
  Description of Artificial Sequence: Synthetic coding sequence
atgggactgacacttctgctcctgctcctgttgggcttagaagggcaaggcatagtaggaagcctgcctgaagtactgcaggcacctgtgggttcctctatcttggtgcagtgtcactaccgcctacaggacgtcaaggctcaaaaagtctggtgccgattccttcctgaagggtgtcagcccttagtgagcagtgccgtggatcgcagggcacctgccggacggaggacatttcttaccgatctcggcggtggccttctgcaggtggagatggtgactctgcaggaggaggacgcaggcgagtatggttgtatggtcgatggcgctcgcggaccacaaatactgcaccgcgtgagtctgaatatcttgcctcctgaggaagaggaggagacccacaaaatcggctcactggccgagaatgctttcagcgatcccgcaggctctgcaaatcctctggagcctagccaagatgagaaaagcatacctcttatctggggtgccgtgctgctagtgggtttgctcgtggccgcagtcgtcttgttcgcagtaatggctaagagaaagcaggagagcctgctctcagggccacccagacagtag

SEQ ID NO: 244945 - DNA, 603 bp, Artificial Sequence
  Description of Artificial Sequence: Synthetic coding sequence
atggggcttacattgctactgttgctcttgctggggctcgaagaggaagaggaagagactcataagattggatccttggctgagaatgctttcagcgaccctgcgggaagtgccaaccctctggagccaagtcaggacgagaaatcaatcccactgatctggggagccgtgctgttggttggattgctggttgccgctgtggtgctgttcgccgtgatggctaagagaaagcagggcaaccggctgggagtgtgcggcagattcctctcttctagggtgagcggcatgaatccaagctctgtcgtccaccacgtgtctgattctgggccagccgctgaactccctctcgatgtgccccacatccgtttggattcgcctccttctttcgataatacaacgtacacgagcttgccgctagacagcccgagcggcaagcctagcctgccagcgccatcaagcttaccaccactgccccctaaagtacttgtttgtagtaagccagtgacttacgccactgtcatatttcctggcggaaataagggagggggaacctcatgtgggccagcgcaaaacccacctaacaaccaaacgccctcttcatag

SEQ ID NO: 244946 - DNA, 966 bp, Artificial Sequence
  Description of Artificial Sequence: Synthetic coding sequence
atggcccctgcattcttattgctgcttctactctggccccagggttgcgtgagtgggccttctgccgattctgtctataccaaggttagactgcttgaaggggaaactctctctgtccagtgctcctacaaaggctataaaaacagggtggaaggcaaggtgtggtgtaagatcagaaaaaagaagtgcgagcctggctttgctcgagtgtgggtgaaagggcctagatacctgttgcaggacgacgctcaagccaaagtggtgaacatcaccatggtggcactcaaattacaagactcaggtcgctactggtgcatgcggaacaccagtggcatcctgtatcctcttatgggtttccagctggatgtctctcccgctccacaaactgagagaaatattcctttcacccatctggataatatattaaagtccggaacggtgacgacaggacaggcaccaaccagtgggccagatgccccattcacgactggtgtgatggtgttcactcccggactcattacccttccaaggctgctcgcaagtaccagacctgcttctaagaccggctattcatttacagccaccagcacgacatcacaaggtccaagacgtaccatgggcagccagacagtaaccgccagcccttccaacgctcgcgatagttctgcagggccagaaagcatcagtaccaagagcggtgacctgagcacacgatcacccacaaccggcctgtgcttgacctcccggtctctgttaaatcgactcccctctatgcctagcatcaggcaccaggacgtgtactcaacagtactgggggtggtgttgacgctgttagttctgatgctcatcatggtctatggtttttggaagaagaggcacatggccagctatagcatgtgctcagatccctctacgagagatcctcccggtagaccagagccatacgtggaggtttatttaatttag

SEQ ID NO: 244947 - DNA, 2562 bp, Artificial Sequence
  Description of Artificial Sequence: Synthetic coding sequence
atgtgttgcgagaagtggtccagggtcgctgagatgtttctttttatcgaggaacgcgaagattgtaagattctgtgcttgtgttcccgggcatttgtagaagacaggaagctgtacaacttgggccttaaaggatactacattagggattcaggtaacaattcaggagaccaggccaccgaagaagaagagggcggatactcttgcggaactgcagagagtcacgactctaagggtattggattggatgagagcgaactggattctgaggctgagttaatgaggagtatgggcctgccactccagtttggacgaattaccgcacataaggactttgaagttagcatgaacactagaaacaaggtgaagattaagaagaagaagcaccaaaagaaatacctggacgaaattgtccaagagagttggaggaaagaatatgaggaagacgatattctagcctctgatgacccctcgtccattgagcagtatgaaaatacccgaacttacgagctgcagagtaagaaggataccgagactgagaaccctccagtcgagaatacattatccccgaagctggagattaccgaaaaatgggagaagtactggaatgagtacggaggcggactgctgtggcagtcttggcaggaaaaacaccccggacaggctctgtcttctgagccatggaactttccagacactaaggaagagtgggagcagcattacagccaactgtattggtattacctcgaacaattccagtactgggaagcccagggatggacgtttgatgcttctcagagttgcgacacggatacctataccagcaagaccgaggcagacgataaaaatgacgaaaagtgcatgaaagtggacctcgtttcctttccatccagtccaattatggtggataatgactcttccggtacctctgacaaagaccattccgagattctggacgggatttctaatatcaagcttaactctgaagaggtcacccaatctcaactggacagttgtacgagtcacgacgggcaccagcagctgtctgaggtttcgagtaaaagggagtgtcctgctagcggtcaatctgagcctcgtaatggtgggacaaacgaggagtcaaactcttctgggaataccaatacagatccaccagccgaagattcccagaagtcttccggtgcaaatacctcaaaggaccggccacacgcatccggtacagatggcgacgagtctgaggaggacccccctgagcacaagccttcaaaactgaaaaggagtcatgaactggacattgacgagaaccctgcatcagattttgacgacagtggctcactgctgggcttcaaatatggttccggccagaagtacggaggaatccccaacttcagtcataggcaggttcggtacctggaaaagaatgttaaactcaaatccaagtacttggatatgcggagacagatcaaaatgaagaataagcatatttttttcacaaaagagagtgaaaagcctttctttaagaaatctaaaatcttgagtaaagtagagaagtttctcacctgggtaaataagccaatggatgaagaggcttctcaggagtcctcatcccacgacaacgtgcacgacgcctccacctcatctgatagcgaggaacaagatatgtccgttaagaaaggcgacgatctcctggaaaccaacaatcccgaaccggaaaagtgccagagcgtctctagcgcgggagagttggaaaccgaaaattatgaaagagactcactcctggctaccgtgccggatgaacaggattgtgtgactcaagaggtccctgacagcaggcaggcagagaccgaggctgaagtcaaaaagaagaaaaataaaaagaaaaacaaaaaagtaaacggcctgcctccagagatagctgccgtgccagagctggcgaagtactgggcacagagatatcgactcttttccaggtttgacgacgggattaaattagatcgcgagggttggttttccgtgacaccggaaaagatcgctgagcacattgcaggcagggtgagtcagtcctttaagtgtgacgttgtagtggacgctttctgcggagtgggcggaaacaccatccagtttgctctgaccggaatgcgggttatcgcaattgacatcgaccctgtgaagattgcattggccagaaacaacgctgaggtgtacgggatcgctgacaagattgagtttatctgcggtgatttcttgctcttggcaagctttcttaaggcagatgtggtgtttctatcccctccttggggaggcccagattatgccaccgcagaaacattcgatattaggaccatgatgtctccagacggattcgagatcttccgcctgtcaaagaaaatcacaaataacatcgtctatttccttccgaggaacgcagatattgaccaggttgcttcactggccggtcccggaggccaggtagagattgagcagaattttctcaataataagttgaagaccatcactgcctatttcggggatctgatcaggcgacctgctagcgaaacctag

SEQ ID NO: 244948 - DNA, 1266 bp, Artificial Sequence
  Description of Artificial Sequence: Synthetic coding sequence
atgtggtatcaccgactctcccacctccacagcaggctgcaggatctgcttaaggggggtgtgatctaccctgcccttcctcaacccaatttcaaaagcctcttaccactggccgttcactggcaccacaccgcttcaaaatcacttacatgtgcctggcagcagcatgaagatcactttgaactgaagtacgcaaacactgtgatgcgctttgattacgtgtggctgcgcgatcactgtcggtcagcttcctgctataacagcaagacgcaccagcgctccctggacaccgccagtgtagatctttgtatcaagccaaaaaccattagactggacgaaactactctattctttacgtggcccgacggacacgtaacaaaatacgacctgaattggctagtgaaaaactcgtacgaagggcaaaaacagaaagtgatccagcctcggattctctggaatgccgagatttaccagcaagcgcaggttccttcagtcgactgccaaagctttttagagactaatgaaggtctgaagaagtttctgcagaacttcctcctgtacggaatcgcattcgtcgaaaacgtaccacccacacaggagcacaccgagaagttagccgagaggattagtctgatcagagagacaatttacggaagaatgtggtattttactagtgacttcagccggggagacacagcctacaccaagctggccctggatcggcatacggataccacctacttccaggagccttgtggcatacaagttttccactgtctgaagcacgagggtacaggcggtaggaccttgctggtcgatgggttctacgctgccgagcaggtactacaaaaagctccggaggaattcgaattgctctcaaaagtccccctgaaacacgaatatattgaagatgtgggggagtgccataatcacatgattggcatcgggccagtgttaaacatctatccatggaacaaggagctataccttatacggtacaacaattatgatagggccgttattaacacagtgccttatgacgtcgtgcatcgctggtacactgcccataggacgctgacaattgaactccgacgaccggagaatgagttctgggttaagctgaaaccaggcagagtgctgttcattgacaattggcgggtgctgcacggcagggagtgtttcaccgggtatcgccagctgtgcggttgctacctgacccgggacgacgtcctgaataccgctcggttgctggggttgcaggcctag

SEQ ID NO: 244949 - DNA, 1131 bp, Artificial Sequence
  Description of Artificial Sequence: Synthetic coding sequence
atgtggtaccacagactttcccacctccattcaaggctgcaggacctgctgaagggcggtgtaatttacccagctctcccacagcccaacttcaagagtcttcttcccctagcggtgcactggcaccatacggctagcaaaagtctgacttgcgcttggcaacaacacgaggaccacttcgaactgaagtacgcaaacactgtgatgcggtttgattacgtctggctgcgcgaccactgccgctctgctagctgttataactccaaaactcatcagaggtcattagatacagccagtgtggatctttgcatcaaacccaagactatcaggttggacgagactaccctgttctttacatggcctgatggtcacgtcaccaagtacgaccttaattggttagtcaaaaattcatatgaagggcaaaagcagaaggtgatccaacctcgaatcctttggaacgctgaaatttatcagcaggcccaggtgccctcagtggactgccagtcttttcttgaaaccaatgaaggcctcaagaagttcctccaaaattttctcctgtacggcatagcatttgttgaaaatgtgccccctacccaagagcatacagagaagctcgcggagcgcatcagcttaatccgcgaaaccatttatggtcgcatgtggtactttacatccgacttctcacgtggggacaccgcctacaccaaactcgcactggacagacatacggacacaacatactttcaggagccctgcggcattcaggtcttccactgcctgaaacatgaggggacaggaggaaggacgttgctcgtggacgggttttacgccgcagagcaggtgctccagaaggcgcctgaggaatttgagttgctttcaaaggttccgttaaagcacgagtacatcgaggatgtcggggagtgccacaaccatatgattggcataggccctgtgttaaacatctacccttggaataaagagttgtatctgatccgtctcttcaaggaaaagcagaatacagtaaatcgtcagtggaactcctcattacaatgtgacatacctgagagaatcctgacctatcgccactttgtgagtgggacatccattgagcatcgcggttcgttaatctag

SEQ ID NO: 244950 - DNA, 5889 bp, Artificial Sequence
  Description of Artificial Sequence: Synthetic coding sequence
atgagagaactagaagcaaaggcaaccaaggacgttgagaggaatctcagccgagatctggtgcaggaagaagagcagttgatggaggagaagaagaagaagaaggacgataaaaagaaaaaggaggccgctcagaaaaaggctactgaacaaaaaattaaggttcccgagcagattaagccctcagtgagtcagccccagcccgcaaattccaataacggtacctccaccgccacctccacaaataacaatgcgaagcgggcaaccgctaataaccagcagccccagcaacaacagcagcagcagcagccccagcaacagcagccccagcagcaaccccaaccacaaccacagcagcaacaaccccagcagcagcctcaagctctgcctaggtatccaagagaggtcccacccagatttagacatcaggagcataagcagttgctgaaaagaggtcagcacttccctgtgatcgccgctaatctggggtccgccgttaaagtgctgaactctcaaagcgagtcaagtgcattaaccaatcagcagcctcagaacaacggcgaggtgcagaatagtaaaaatcagagtgatattaaccatagtactagtggatctcattatgagaactcgcagcgaggtcccgtgtcttctacctccgattctagtaccaattgcaagaatgcggtcgtttctgatttgtctgagaaagaggcttggcccagtgcgccaggttccgatccggaactggcttccgagtgcatggatgcagacagtgctagtagctctgagtctgaaaggaacattacaatcatggcctcgggcaacactggcggtgaaaaggacggtctacgtaactcaacggggcttggaagccaaaacaagttcgtggtaggaagtagtagcaacaatgtcggccacgggagtagtacaggaccatggggattctctcacggcgcaatcatctcaacttgccaggtgtccgtagatgcaccagagagcaagtccgagtccagcaataataggatgaacgcgtgggggaccgtgagttcaagtagcaatgggggacttaatcctagcactctgaatagtgcatccaatcacggagcgtggccggttttggagaataacggcctcgcactgaagggcccagttggcagcgggtcatcaggaatcaacatacagtgctccacaatcggacaaatgcccaataaccagagcattaattccaaagtctccggcggtagcacccatgggacctgggggtctctgcaggagacctgtgagtctgaggtcagcgggacgcagaaggtgtctttctccggccagccccagaacataacgaccgaaatgacagggcctaataacaccactaatttcatgactagttctctccccaacagtggaagtgtacaaaataatgagctgccgtcgtccaacaccggagcctggcgagtatccactatgaatcacccccaaatgcaggcgccatccgggatgaacggcacgtcactgtcccacctcagtaacggcgagagcaagagtggaggaagctatggcacaacatggggagcctacggcagcaattactctggagataagtgctctggaccaaatgggcaggcaaatggtgacactgtgaatgccactttgatgcagcccggagtgaacggtccaatgggaacaaatttccaggttaacacaaataagggcggaggcgtctgggagtccggggctgcaaacagccaatcaacaagctgggggagtggcaacggagccaactctggaggcagtaggcggggttggggcacgcccgctcagaacacaggaacaaatctgccaagcgttgagtggaacaaattgccctcgaaccagcatagcaacgactctgctaacgggaacgggaagaccttcactaatgggtggaaatctaccgaggaggaggaccaagggagtgccacgtcgcagacaaatgagcagtccagcgtatgggccaagactggcggaacagtggaaagcgacggttccactgagagtaccggtcgcctggaagagaagggtactggggagagccagagccgtgaccgtcggaaaatagaccagcacaccctgttgcagtcaattgtaaatcggactgacttggatcctagggtgttatctaatagcggctggggacagacacccattaaacagaacaccgcttgggacactgagacttcccctagaggtgagcggaaaaccgataacggaaccgaggcctggggcagcagcgccacacaaaccttcaactcaggggcttgcatagacaaaactagcccaaacggcaatgatacttcatccgtgtctggctggggcgacccaaaaccagcgttacgctggggggacagcaaaggctccaactgccagggaggatgggaggatgactccgccgcaaccggcatggtgaagagtaaccagtggggcaattgcaaagaagaaaaggctgcctggaatgatagccaaaaaaataagcaggggtggggggacggccaaaaaagcagccagggctggagtgtatctgctagtgacaactggggagaaacaagccgcaacaaccattggggggaagctaacaagaaaagctcatctggtggctcagactctgatcgcagcgtaagcggctggaatgagcttggaaagacctccagctttacatgggggaataatataaaccccaacaacagcagcggatgggacgagtcttctaaacctactccaagtcagggatggggggaccccccaaaaagcaatcagtctttgggttggggggatagctccaaacccgtgtcttcacctgactggaacaaacagcaagacatcgtcggatcttgggggatccctcctgccacaggcaaaccgcctggcactggatggttggggggacctattcctgccccagcaaaagaagaagaaccaactggctgggaagaaccatctccagaatccattcgacgtaagatggaaatcgatgatggtacctccgcctggggcgatccctccaaatacaactacaagaatgtgaatatgtggaataagaacgtacctaacggaaactctaggtcagatcagcaggcacaagtgcatcaactgctgaccccagcaagtgctatatcaaataaggaagcatcttccggctcgggatggggggaaccttggggtgaaccgagcaccccagccacaacagtcgacaatggaacctccgcgtggggtaaacctatcgactcgggcccaagctggggcgaacctatcgcagcagcttcttccacaagtacctggggttcctccagcgtcggtcctcaggcactttccaagtcaggacctaagagcatgcaggacggatggtgcggcgacgatatgccattgcctggcaacaggcctacaggatgggaagaggaagaggatgtggagattgggatgtggaattccaattccagccaggaattgaactcaagccttaattggcccccttacacgaagaaaatgtcaagcaaggggctatcagggaaaaaacggcgacgcgagagaggaatgatgaaggggggaaacaagcaagaggaggcttggattaacccatttgtcaaacaatttagcaatatcagcttttcccgggatagccccgaggagaacgtgcagtcaaataaaatggatctttctggcggaatgctgcaggataaacggatggagattgataagcacagcctgaacattggggattataaccggaccgtcggaaaggggcctgggagtagacctcaaataagcaaagagtcctctatggagagaaatccatacttcgacaaagatggtattgttgccgacgagtctcaaaatatgcagttcatgagctctcagagtatgaaactgcccccttccaattccgccctgcctaatcaggcattaggttctatagcaggcttgggcatgcagaacctcaactcggtccgtcagaatggcaacccgagtatgttcggggtgggaaatacagctgcccaacccagaggcatgcaacagcccccagcacagcccttaagctcttcccagcccaatctgcgagcccaggtgcctccccctttgctgtcccctcaggtgccggtctcactcctgaagtatgctcctaataacgggggactgaacccactgtttgggcctcagcaggttgcgatgttgaatcagctttcccagctcaatcagctgagccagatttctcaattacagaggctgttggcccaacagcaaagggcacagtcacagcgctctgtgccaagtggaaaccggccacagcaggatcaacaggggaggccactgtcagtgcaacagcagatgatgcaacagtcccgtcagttggaccccaacctgctggtgaaacagcaaacaccacccagccaacaacagccattgcatcagcccgcaatgaagtcgttcctggacaatgtaatgcctcacactaccccagagctacagaagggcccttccccaatcaacgcattcagtaactttccaattggcttgaatagcaatctcaacgtaaatatggatatgaacagtataaaagagccgcagtcacggctgcgtaaatggaccacagtcgacagcatttcagtcaacacctccttggatcaaaacagcagtaagcacggagctatcagttccggcttcagactcgaagaaagtcccttcgtgccttatgactttatgaattcaagcacgtctccggcttctccccctggtagtatcggggacggttggcccagagccaaaagcccaaatggatctagttcagttaattggccaccggagttccgtcctggagagccctggaaaggctacccgaacattgatcctgagacagacccctacgtgacacctgggagtgtaataaataacctatctatcaatactgtccgggaagtggatcacctacgggacaggaatagtgggagtagcagctcactaaatacaaccctgccgtctaccagcgcttggtcaagcattcgggctagcaactacaacgtccctctgagcagcacagcgcaatctacttcagccagaaactcagattcaaagctgacctggtcaccgggatcagtgaccaacacatcgttggcgcatgagctgtggaaggtccctctgcccccaaagaacattaccgccccatcccggcctccgcctggcttgacggggcaaaagccccctcttagcacttgggacaatagtcccctgcggatcggcggaggttggggcaatagtgatgccaggtacactcccggtagttcatggggagagagttcttccggcaggatcacaaactggctcgtgttaaaaaacctgactcctcagatcgacggcagcacgttgagaacgttatgcatgcagcatggaccactcatcaccttccacttaaacctgcctcacgggaatgcgctggtgagatattcctccaaggaggaggtcgtgaaagcgcaaaaatcccttcacatgtgcgtgctgggtaacacaaccatcctcgctgaatttgcaagtgaagaggaaataagcagattttttgcacagagtcaatcgttaacaccctctcccggatggcagtccctcggctccagccagtcccgcttggggagcctagactgttcccacagtttttcctctaggacggatctgaaccactggaacggagcgggattatccggaaccaattgcggagacttgcacggcacttcattatggggaaccccacactattccacttcactctggggcccacccagtagcagcgaccccaggggaatcagctcacctagcccgatcaatgcctttctgagtgttgatcacttaggagggggaggggagtctatgtac

SEQ ID NO: 244951 - DNA, 1323 bp, Artificial Sequence
  Description of Artificial Sequence: Synthetic coding sequence
atggatatgaattccattaaggaacctcagagcaggctgcggaaatggaccactgtcgacagcataagcgtcaacacaagcctcgaccagaattcctctaagcacggcgctatctcatctgggttccggcttgaagagtcaccattcgtgccctatgatttcatgaattcaagtacttcccctgccagtccgccagggtccattggagatggatggccaagagctaagtcccccaacggatcatcatcagtaaactggcccccagaattcagaccaggggagccgtggaagggttaccccaatattgatccagaaaccgacccttatgtcacccctgggagcgtgattaacaacctgtctattaatacggtcagagaagtagatcacctgcgtgataggaatagcgggagcagcagcagtctaaataccacactgccatcaacatctgcttggtcctcaatccgggctagcaactacaacgtaccccttagtagtacagcccaatccacatcagccagaaatagtgacagtaagttaacttggagcccaggtagtgtgacgaatacttcgctggcacacgagctgtggaaggtccccctgccaccaaaaaacattaccgccccaagtcgccctcctccaggacttactgggcaaaaacccccactgtcgacatgggacaattccccactgcgaatcgggggaggatggggaaatagtgacgccagatacacccccggttctagttggggggaatctagctctggaagaattaccaattggctggtgttgaaaaatcttactccccagattgacggaagcactctgagaacactttgtatgcagcatggcccattgatcaccttccacttgaatctgccgcatgggaatgccctggtgcgatattcctcgaaagaggaggtcgtgaaggcccagaagtcactgcatatgtgcgtgctaggtaatactacaattttagccgaattcgcctctgaggaggagatcagtaggtttttcgcccagagccagtcacttaccccttcacccggttggcagtcattgggaagcagccagtccaggctggggtcactcgactgtagccatagtttcagctctagaacagacctcaatcattggaacggagcaggtttgtctggaacaaattgtggtgacctccacgggacctctctatggggaacgccccactatagcacttccttatggggtcctccatcctcttccgatccgagaggcatttcttcaccaagtccaattaatgctttcctatccgtagatcacctcgggggagggggtgagagcatgtag

SEQ ID NO: 244952 - DNA, 5072 bp, Artificial Sequence
  Description of Artificial Sequence: Synthetic coding sequence
atggctaccggcagtgcacagggcaacttcactggtcatactaaaaagacaaacgggaataacggcacaaacggcgcactggtccagtccccatctaaccaaagcgctctgggcgctggcggtgccaacagcaatgggtccgctgctagagtgtggggtgtggccaccggaagctcaagcggtctggcccattgctctgtcagcggaggggacgggaaaatggatactatgataggggacggtagaagccaaaattgctggggagcatctaactccaacgcagggatcaatcttaacttaaatcccaacgctaatccagccgcttggcccgttctgggacacgaagggaccgtggctacaggtaatccgtctagcatatgcagccccgttagcgcaattgggcaaaacatgggtaatcagaacggcaatccaactggtacgttgggcgcatggggcaacctcctcccacaagaatccacggagccacagacttccacctctcagaatgtttcattttcggcacagccacagaacctaaacacagacggccctaacaataccaaccctatgaactcctcgcctaatcctatcaacgccatgcaaacaaacggtctacctaactggggaatggctgtcgggatgggggctatcatcccacctcacctgcagggattgcccggtgcaaacggctcaagcgtgtcacaggtgagtggtggatcggccgaagggatttctaattcagtgtgggggctgagtcctggtaaccctgctaccggtaattcaaactcaggcttctcccaagggaatggggatactgtgaattctgctttgtccgccaagcagaacgggtcttcttctgccgtgcagaaggaagggtcaggaggaaacgcatgggattctggaccacccgctggccctggcatcttagcatggggcagaggcagtggaaacaatggggttggcaatatccattcaggtgcctggggtcatcccagccggtcgaccagcaacggggtgaatggggagtggggaaaacccccaaaccagcacagcaactcagacatcaacggaaagggctcaacaggatgggagagcccttcagtgacaagtcaaaacccaacagttcagcccggaggggagcatatgaactcgtgggctaaggccgcaagttctggcacaacagcttcagagggcagttccgacggcagcggaaaccataacgaggggagcacaggcagggagggcaccggcgaggggaggcggcgagataaaggaataatcgatcaggggcacatccagctaccacgcaatgacttagaccccagagtgctgagcaataccggatggggacaaactcccgttaagcagaataccgcttgggagtttgaggagagccccagatcagagaggaagaatgacaacgggaccgaagcctggggctgtgccgctacccaagcctccaactccggcggaaagaatgatgggtccataatgaatagcaccaacacaagctccgtgtcaggctgggtgaacgctcccccagctgccgtaccggctaatacagggtggggtgattctaataacaaagctccatcagggccaggcgtctggggcgactccatttcctccactgcagtgtctacagcagctgcagccaaaagcggccacgcctggtccggcgctgctaaccaggaggacaaaagtccaacgtggggcgagcctccaaagcccaaatcacaacactggggggatggccagaggtccaacccagcctggagcgccggaggaggcgactgggccgatagttcttctgtactcgggcatctgggtgacgggaagaaaaacggatcaggctgggacgccgattcaaaccggtcaggttctgggtggaacgatacaacacgcagcggaaactctggttggggtaatagtacaaatacaaaagcaaatcctggcactaattggggcgagacattgaagccgggaccacagcagaactgggcctctaagccccaggacaataacgtgagtaattgggggggagctgcctctgttaagcaaactgggaccggctggattggcggtccagtccctgtgaaacaaaaagatagctcagaagccacagggtgggaagagccaagccccccttccattagaaggaagatggagatagacgacggcacgagtgcttggggagatcctagcaattataataacaagactgttaatatgtgggacagaaataacccagtgatacagtcatccacgaccacaaataccacgaccacaaccacaaccacgacttccaacactactcacagggttgagaccccacctcctcatcaagccggaactcagctgaatcgcagtcctctgttgggtccgggtaggaaggtgtcgtcaggttggggggaaatgccgaacgtacactctaaaacagagaattcatggggggaaccaagcagtccatcaaccctagtagacaatggcacagccgcttggggaaagccacccagttctggatccgggtggggagatcatcctgctgaaccccctgtggcatttggtcgggcaggtgctcctgttgcagcgtctgcactgtgtaaacctgctagtaagtctatgcaggaaggctggggttcaggcggagacgaaatgaatctcagcaccagccaatgggaggacgaggagggagatgtgtggaataatgccgcatctcaggagtcaacatctagctgcagttcatggggcaacgctcctaagaagggtctgcagaagggcatgaagacgtccgggaaacaggacgaggcatggataatgtcacggctcatcaaacagttaacggacatgggcttcccgagagagcctgccgaggaggccctgaagtctaataatatgaaccttgatcaggccatgagcgccctgctggagaagaaagtagacgtagataaacggggacttggggtcactgaccataatggaatggccgctaaacctctgggatgtcggccacccattagcaaggaatcgtctgtcgacagacccaccttccttgacaaggacggcggactggtcgaagagccaaccccatcccccttcctaccaagcccatctctaaaactgccgctatcccactccgctcttccatcccaagccctggggggtattgcttccgggttaggcatgcagaatttgaacagctcgcggcagattcctagtggcaacctcgggatgtttggtaactccggtgctgctcaagccaggacaatgcaacaacccccacagccacccgtccagccgcttaattcctcccaaccctcactccgggcacaggtcccacagttccttagcccgcaagtacaagcacagctcttgcaatttgcagccaaaaatattggcctgaaccctgcgctcctgacctcgccaataaacccccagcacatgactatgctcaatcagttgtatcaactccaactcgcctaccaaaggctccaaatccagcagcaaatgttgcaggcccagcggaatgtgtccggtagcatgaggcagcaggagcagcaagtggcaaggacaatcacgaacctgcaacagcagattcaacaacaccaaagacagttggcccaggcactcttggtgaagcagcctcctccaccacccccaccccctcacctatccttgcatccctctgccggaaagagtgcaatggattctttcccatcccatccccagactcctggtcttccagacctgcagacaaaagaacagcagtcatctccgaatacatttgccccttatcccttagccggtttgaacccgaacatgaacgtcaacagcatggacatgacaggtggcttgtcagtgaaggatccttcacagagtcagtcacgactcccacagtggacacaccccaattccatggacaatctgccatccgctgcctctcctctggaacagaatccctccaagcacggggctatccccggtggtctgagcataggccctcccggtaagagctccatcgatgattcctacggcagatacgacctcattcagaatagcgagtctcctgcttctcccccagtcgctgtgcctcattcttggagccgcgctaaatctgattccgacaagatctctaacggctcatccatcaattggccacccgaattccatcccggagtgccctggaagggattgcagaatatcgatccagaaaatgatcctgatgtcaccccgggttccgtgcctactggaccaactatcaataccacaatccaagatgtcaatagatacttactcaaatcaggcggtaagttatccgacattaagtccacatggtcctctggtcccacctcccacacccaggctagcctgtcacacgaactgtggaaggttcccagaaacagcactgcaccaacacgcccacccccaggccttacaaacccaaagccaagctccacctggggggcttcccctctggggtggaccagtagctattcttctggatccgcctggtcaaccgacacaagcggccgaacttcttcttggttagttcttcgcaatctcactcctcagattgacgggtcgacactgagaactctgtgtctgcagcacggaccccttattacgttccatctgaatcttacgcaggggaatgcagttgtaagatacagctcaaaggaggaggctgccaaggcccagaaatcactacatatgtgtgtgttgggtaatacgactatactggccgagtttgccggagaagaagaggtcaatcggttcctcgcccaagggcaagccctcccccctacttcctcctggcaatcatctagcgcttcatcacagccgaggcttagcgccgctggatcgtcgcatggcctggtgagatctgacgcaggccattggaatgcaccttgtctgggcggaaaaggcagctcggagctgctatgggggggagtcccccagtatagctcttcactatgggggccaccatccgccgacgatagtcgcgtgattggaagtcctacccccctgacaacactcttgccaggagatttgctgtctggggaatctctgta

SEQ ID NO: 244953 - DNA, 5180 bp, Artificial Sequence
  Description of Artificial Sequence: Synthetic coding sequence
atggcaactggcagcgcccagggaaacttcaccggtcacacaaaaaagaccaatgggaacaatggaaccaatggtgctctggtccagtctccttccaatcagagcgccttgggagctggaggagcaaattctaacggtagcgcagcaagagtttggggagtcgccactgggtcctccagtggcctggcccactgtagcgtgtcgggcggagatggaaagatggacactatgatcggagacgggcgaagtcagaattgttggggggcatctaactcgaatgcaggaattaacctgaacttaaatcccaacgcgaaccctgctgcttggcccgtcctggggcatgaaggaactgtcgccaccggtaacccatcgtctatctgtagtccagtatcggcgataggccaaaacatgggcaatcaaaatgggaatccaacaggcactcttggtgcgtggggtaacctgctgcctcaggagagcactgagccccaaacttcaacatcacagaacgtcagtttttcagcccagcctcagaacctgaacaccgatgggcctaacaacaccaaccccatgaattcttcaccaaatccaattaacgcgatgcagacaaatggcctgccaaactggggcatggcggttggcatgggtgccataatccctcctcatctgcaagggctgcccggagccaatggaagcagcgtaagccaggtctctggcggtagcgccgaaggcattagcaactccgtgtggggactgtcccctggcaatcccgctactggaaacagtaatagtggcttctcacagggtaacggggatacagtcaactccgccctctcagccaaacaaaacgggtccagtagtgcagttcagaaggaagggtctggtggcaatgcctgggatagcggtccacctgccggacccggtatcttagcctggggcagaggcagcggcaacaatggggtgggaaacatacacagcggcgcatggggacaccccagcagatccacatctaacggcgtgaacggggagtggggtaaacccccaaatcaacattctaatagcgacattaacggaaaagggtctactgggtgggaatccccgtccgtgactagccaaaaccccactgtgcagcccggaggtgagcacatgaactcatgggccaaggccgcaagctccggcacaactgcctcagagggctcctcagatggcagtgggaatcacaacgaaggaagcacagggagggagggcactggcgagggcagacggagagacaagggaatcatcgatcagggccacatacagttaccaagaaatgatctggaccccagagtcctgtctaacaccggatgggggcagacacccgttaaacagaatacggcctgggagtttgaggagagtccgagatccgagaggaagaacgataacggaacggaggcttggggttgcgcagctactcaggctagcaatagcggcggaaagaacgacggctcaatcatgaactccacgaacactagctcagtatcaggatgggtcaacgctccccctgccgctgtgccagcgaacactgggtggggcgactctaacaataaagccccatcaggacccggagtttggggcgacagcatctcttcaactgccgtctctacggcagcagccgctaagtccggacacgcttggagtggagcagcgaatcaagaggacaagagcccaacttggggcgaacctccaaagccgaagagtcaacattggggggatgggcaacggtcaaatcccgcatggtccgccggagggggtgactgggccgattcctcgagtgtgctcggccatctgggagacggtaaaaagaacggttcagggtgggacgcggactctaaccgatcaggcagtggctggaacgatactacccgaagcggaaatagtggatggggaaatagtaccaataccaaagccaatccagggaccaactggggggaaactctcaagcccggtccgcagcagaactgggcgagcaagccccaggacaataacgtgagtaattggggcggtgcagcctcagtgaagcagactgggactggatggattgggggtccagtgcctgttaagcagaaggacagctcagaagctaccggctgggaggagccgagcccacctagtatccgcaggaaaatggaaattgacgacggtactagtgcatggggtgatccttccaactataacaataagactgtaaatatgtgggacaggaacaatcctgtgattcaatcctccactaccaccaatacgacaacgactactacgacaacaacatccaacactactcatcgggtcgagacccctccccctcatcaggctggtacccagctcaatcgcagtccactgctgggccctgtgagctcaggatggggcgagatgccaaacgtgcacagcaaaacagagaattcatggggcgaacccagttcacctagcactctggtcgacaacggcacagcagcctggggcaagcctccgtctagtggctctggatggggggaccatccagcagagccccctgtcgcctttggacgggctggtgcaccagtggcagcgagcgcgttgtgcaagcccgcatcaaagagtatgcaggagggctgggggtcaggcggagatgagatgaacctgtcaacatctcagtgggaggatgaggaaggcgacgtctggaataacgcagcctcccaagaatccacttctagttgtagctcctggggcaacgctcctaaaaagggcttacagaagggcatgaagacatcagggaaacaggatgaggcctggatcatgagccgccttattaaacagctgaccgacatggggtttcctcgagagccagcagaagaggcccttaaatccaataacatgaatctagatcaggccatgagcgcactcctggaaaagaaagtcgacgtggataagaggggcctgggagtgacagaccacaacggaatggccgctaagccactgggatgtcggcctccaatctccaaggagtcctctgtggaccggcctaccttcctcgacaaggacggcggactcgttgaggaaccaacccctagcccattcttgcctagtccaagtctcaagctgcccttaagccactccgcactgccatcccaggcattaggtggcatagccagcggccttgggatgcaaaatcttaattcctctcggcagatcccatcagggaatctgggcatgttcggcaatagtggggcagcccaggccaggactatgcagcagcctccgcagcctccggtgcaaccacttaacagcagtcagcccagcctgcgggctcaggttccacagttcttgtcgcctcaggtccaggcacaactgctgcagttcgcagcaaaaaacattggtctgaacccagcacttcttaccagtcctatcaatccacagcatatgacaatgctgaaccagctctaccagctccaattggcgtaccaaaggttacaaatccagcagcagatgctgcaggctcagcgtaacgtctcaggttctatgaggcagcaggagcagcaagttgccaggaccattacgaatcttcagcagcaaatccaacagcaccaaagacagctcgctcaggccctccttgtgaagcagcccccacctcctccaccccctccgcacctgagtttacatcctagcgcgggaaaatcggcaatggactccttcccctcccacccacagacccccggtctcccagacttacagaccaaggagcaacagagcagcccaaatactttcgctccttaccccctggccggattaaatccaaatatgaatgttaatagcatggatatgactgggggtctctctgtcaaagaccctagccaatcccagtcccggctgccccagtggactcatcctaacagcatggataaccttccctctgccgcttcccccttagagcagaatccatccaagcatggagccattccagggggtttgtcgattggacctcccggtaaaagctctatcgatgacagctacggcagatatgatctaattcagaatagcgaaagccccgcaagtcctcccgtggcggtgccccacagctggtcaagagccaagagtgattcagataagatttcgaatggtagttccatcaactggccaccagagtttcacccaggcgtaccttggaagggcctgcagaatattgaccctgagaatgacccagacgttactcccggtagcgtacccacaggaccaacaataaacacaacaatccaagacgttaaccgctatttgctcaaatccggtggctcctctccacctagctcacagaatgcaactctcccaagttcatctgcctggcctctgagcgcctcagggtacagcagctctttttcctctatcgcatctgcaccctcagtggctggaaagctcagtgacattaagtccacctggagctcggggccaacctcacacacacaagcgtcattgagtcacgaactttggaaggttccgcgaaattccactgctcccacaagacctcccccaggcttaaccaaccctaaaccttcttccacttggggcgctagtccactggggtggacctcttcctactcgtccgggagcgcctggagtaccgacacaagtgggaggacctcctcttggctagtcctgaggaacttaacacctcagatcgatggatctactctgagaacattgtgcttacagcacgggcctctgatcacattccatctcaacttgacccagggcaatgctgtcgtgagatacagctctaaggaggaggccgcaaaagcacagaagagcctacatatgtgcgtcttaggaaacactacaattctggccgaatttgccggtgaggaggaggtaaacagatttctggcccagggccaggctttaccccctacaagcagctggcagtcatcatctgccagcagccagcctaggttatccgccgctggctcctcacatggtctggtgaggagtgacgcgggacattggaacgctccctgcctgggtgggaagggatcttcagaactgctgtggggaggagtcccacagtactctagctctctgtggggaccgccatcagccgacgactcaagagttatcggttcgccaaccccactcaccactctgcttccaggtgacctgctctcaggagaatcattgta

SEQ ID NO: 244954 - DNA, 5180 bp, Artificial Sequence
  Description of Artificial Sequence: Synthetic coding sequence
atggccactggctccgcccaagggaactttacaggacataccaaaaaaactaatggtaataacggaacaaatggggctttagtccagtcgccctctaatcagtccgccctgggagcaggaggcgcaaactctaacggaagcgcagccagagtgtggggcgttgcgaccggaagctcctccgggttggcacactgttcagtctctggcggagacggaaaaatggacactatgatcggggatggaagaagccagaactgctggggcgcaagtaattctaacgcaggcatcaatctgaacttgaacccaaacgccaacccagctgcctggcccgttctagggcatgaaggtacagtggctacgggaaacccgagtagtatctgctcccccgtgtctgcaatcggacaaaatatgggaaaccagaatggaaaccccacaggaacattgggagcttggggcaacctgctccctcaggagtctacagaacctcagacatcaaccagtcagaatgtgtcatttagtgcccaaccccagaacttaaatactgatggccctaacaatacaaatccaatgaactcaagcccgaacccgattaatgcaatgcagaccaacggcctgcctaattggggcatggctgtcggcatgggcgcaatcattcctccacacctgcagggtctgcccggagccaacgggtcatcggtgtcacaagtaagcggcggaagcgctgaaggcataagcaacagcgtgtggggactgtctcccggtaacccagctactggcaattccaacagcgggttttctcagggtaatggagatacagtaaatagcgctttaagtgccaagcagaatggcagctccagtgccgtacagaaggaaggttccgggggaaacgcctgggacagtgggccaccagctggtcctgggatcctcgcctggggaaggggctccggtaataacggagtcggtaatatacattctggcgcttggggccatccttcacgttccacctcgaacggagtgaacggcgagtggggaaagcccccaaaccaacactccaactcagatatcaatggcaagggctctaccggttgggaatcccccagtgtcacaagccagaacccgaccgtccagccgggaggtgagcatatgaacagctgggccaaggcagcttcttcaggcacaacagcctctgaggggtcctcagacggcagtggcaatcataatgagggcagtaccggtagggaggggaccggcgagggtcggaggagggacaaaggtataatcgatcaaggccatatccagttaccgcgaaatgacctcgacccccgtgtcctctctaatacagggtggggacagaccccggtcaaacaaaatactgcgtgggaatttgaagagtctcccagatccgagcggaagaacgataacggcacagaggcctggggctgtgcggcaacccaggccagcaactctgggggtaaaaacgacgggagcattatgaatagcacgaacaccagctccgtgtcaggctgggttaacgcgcctcctgccgctgtacctgcaaacaccgggtggggcgactccaacaacaaagctccgtctggcccaggtgtgtggggagactctattagctctactgctgtcagcacagccgctgctgccaaaagcggccacgcttggtccggcgcagcaaatcaggaggataaatcaccaacctggggggagccaccaaagcctaagtctcagcactggggcgatggtcagcgaagcaaccccgcttggtcagctggcggtggagactgggctgatagctcgtccgtcttagggcacctgggagatggtaaaaagaacgggtctggctgggatgccgatagtaaccgctccgggagtggttggaacgacaccacacgctctggtaatagtggctgggggaatagcactaacacaaaggccaatcccggtacgaattggggggaaacattaaaacctggcccacaacagaactgggcttcgaagcctcaagacaataacgtttcaaactggggaggagctgcctcggtgaagcagaccggaacagggtggatcgggggacccgtgccagtgaaacagaaagacagcagcgaagcaacaggatgggaagaaccaagccctcccagcattaggcggaaaatggagatcgacgatggaacttctgcctggggcgacccaagtaattacaataacaagacagtcaacatgtgggatcggaataatccagttattcagagcagtactactaccaacacaaccactaccaccacaactaccacttccaacacaacccacagggtggaaacaccaccccctcatcaggccggaactcagctgaacagatctcctcttctggggcctgtcagtagcggctggggtgagatgccaaacgtccacagcaaaactgaaaactcctggggtgagccatctagtccttcgactctggtggacaatggcactgccgcttggggcaagcccccaagttcaggaagtggatggggagatcatcctgcagagccacccgtggcattcggccgagcgggagctcctgtcgcggcatccgccctctgcaagcccgcaagtaaatccatgcaggagggctggggctcaggcggtgacgaaatgaatctctctacatcgcagtgggaggacgaggaaggagatgtatggaacaacgccgcttctcaggaaagcacttcttcttgttcttcatgggggaacgccccaaaaaaggggttgcagaagggaatgaaaaccagcggcaagcaggatgaggcctggatcatgagccgactgataaagcaattgacagacatgggatttcctagagagcccgcagaagaggctctgaagtccaacaatatgaatctggatcaggccatgtcagctctgctagagaagaaagtggacgtggataagcgcggactcggagtgacggaccataacggtatggccgctaaaccactgggctgtcgaccacccatttccaaggagagcagcgtggatcgcccaacgttcctggataaggacggaggacttgtggaggagcctacaccctcaccattcttaccctcaccctcgctcaaactacctctcagccacagtgctctgcctagtcaggccttaggcggaatcgcctccggactcgggatgcagaatctgaatagcagccgtcagatcccctcaggcaatctcggcatgttcggcaactccggtgcagcccaggcaagaaccatgcagcaaccaccacagcccccagtccagcccctcaacagctcccagccaagcctgagggcccaagtgccacagtttctaagcccccaggttcaggcccagttactacaattcgccgctaagaatatcggcttgaatcctgctcttcttaccagcccaatcaatcctcagcatatgacaatgctcaatcagctctatcagctccagctggcctatcagcgactccagattcagcagcagatgctgcaggctcaacgcaacgtgtccggcagcatgaggcagcaagaacagcaagttgccagaacaattaccaatctgcagcagcagatccagcagcaccagcggcagctcgctcaggcactcctggtgaaacagcccccaccacctccacctcctccacatctctcactacatcctagcgctggaaaatccgccatggactccttcccatctcatcctcagaccccaggcctgcccgatctacagacaaaagagcagcaatcatctcccaataccttcgctccctaccccctggccggattgaaccccaacatgaatgtcaacagtatggatatgaccggtggcctgtccgttaaagatccttcccagagccagagtcggctgcctcagtggactcaccctaattccatggacaatttaccctccgccgcatccccactggagcagaacccctcaaagcacggtgcaatccccggaggattatccattggtcctcctggaaagagtagcattgacgattcttacggcagatacgacctgattcagaacagcgagagcccagcttcaccccctgtagctgtgccccactcttggagccgagccaagtctgactcagataagatctccaatggatcatctatcaattggcccccagaatttcatcccggtgttccttggaaaggcctgcaaaatatcgacccagaaaacgatcccgatgtcactccagggagcgtcccaactggcccaaccatcaacacgacaatccaggacgtgaaccggtatctcttgaaatctggaggatcttcaccaccgtcctcgcagaacgctacgctgccatcatccagtgcctggccactgagtgcttctggttatagcagctcattctcttcgatcgcctcagctccttccgtagctgggaagctgtcggacataaagagtacctggtcctccggccctacatctcatactcaagcttcactgagtcatgagctgtggaaggtaccaagaaactctactgcacctactcggcctcctcccggtctcactaacccaaagccgagcagtacatggggcgcttcacccctcggatggacctcttcttactctagcggttcagcctggtcgaccgatacctctggcagaacttcaagctggctcgtccttagaaacctgacaccccagatcgatggatcgactctgagaactctatgccttcagcacggcccattaataaccttccaccttaaccttactcaggggaacgctgtggtgcgttattcttctaaagaggaggctgctaaggctcagaagtctctgcacatgtgtgttctaggcaacacaactatcctggccgagtttgccggtgaagaagaggtgaatagatttctcgcacagggacaagccctcccaccgaccagttcctggcagtcttcttcggcctcatcccagccacggcttagcgctgcaggcagctcccacggactcgtgaggtccgacgcgggacactggaatgcaccctgcctcggaggcaaggggagctctgagctattgtggggaggcgtccctcaatacagtagctcactatggggccctccgtctgcagacgactcccgcgtcatcggctccccaacacctcttacaactctgctgccgggtgacctgctctccggcgagagcctcta

SEQ ID NO: 244955 - DNA, 5073 bp, Artificial Sequence
  Description of Artificial Sequence: Synthetic coding sequence
atggccacgggaagcgcccaaggaaacttcacaggtcacacaaaaaaaacaaatggcaacaatgggaccaacggcgcactagtccagagcccatcgaatcagagtgcattaggcgctggcggagccaactcaaatgggtctgctgccagagtctggggcgtggcaacagggtccagcagtggccttgcccactgcagcgtgtctggtggggacgggaaaatggataccatgattggcgatgggagaagtcagaattgctggggcgcttctaacagcaatgcgggtataaacttgaatctgaatcccaatgccaaccctgctgcctggcccgttcttggacacgagggaactgttgccactggtaatccctcatccatctgcagcccggtgtctgccatcggccaaaatatggggaaccagaacggcaaccccactggtacccttggggcttggggcaacctcttgccacaggagagcaccgagccccagactagcactagccagaacgtgtcgttcagcgcccaaccacagaacctgaacaccgatgggccaaacaacacaaacccaatgaattcttctccaaatccaatcaatgccatgcagactaatggattacccaactggggtatggcagttggtatgggtgcgattattccccctcatttgcagggcttgcctggggcaaacgggagttctgtgtcccaggtctctggtggatccgccgagggcatcagtaactccgtgtggggtctgtctcctggtaaccctgcaactggtaattcgaatagtggcttctcccagggtaacggggacacagtgaactcagcgttaagcgcgaagcagaatggaagctcttctgccgttcagaaggagggctccgggggtaatgcttgggattcaggccctcctgcgggtcccggtattctcgcgtggggtcggggttccgggaataatggcgtggggaacattcactctggcgcttggggacatcccagccgaagtacatcaaacggtgtgaacggtgagtggggaaagccccctaaccagcatagtaattctgacatcaatggtaaaggtagtaccggttgggagagccctagcgttacaagtcaaaatcccacagtgcagcctggaggagagcacatgaatagttgggccaaggccgctagttccggtacgacggcgtccgaaggctcctcggacggcagcggaaaccacaacgaggggagtacaggtcgcgagggaacaggagaaggtcggcgacgcgacaagggcatcatcgaccaaggccacatccagctccctagaaatgacctggatcccagggtccttagtaatactggctggggccaaacacccgttaagcagaacacagcctgggaatttgaagaaagccccaggtcagagcgaaaaaacgacaatgggaccgaggcatggggctgcgccgctacccaggcctcgaactctgggggaaagaacgatggtagcatcatgaattccaccaacacctcgagcgttagcggttgggtgaatgcgcctccagccgcagtgcccgctaacactggctggggcgactccaacaacaaggcgccaagcggaccgggagtttggggcgattctatctcatccacggcggtctcaaccgctgcggctgccaagagtggccacgcttggtcaggcgctgccaaccaggaagacaagagtcccacgtggggggagccgccaaagccaaagtctcagcactggggcgacgggcaaagatctaacccagcatggtcagccggaggaggggattgggctgattcctcttcagtgcttggtcacctaggcgacggcaaaaaaaacggttccggatgggacgccgatagcaataggtcgggttctgggtggaacgatactacccggtcaggtaattccggctggggtaactccaccaacactaaggcaaatccgggaacaaattggggggagacactgaaaccaggccctcagcagaattgggcctcgaagcctcaggataacaacgtcagtaattggggtggcgcagcatccgttaagcaaacaggaactgggtggattggcggaccagttcctgtgaagcaaaaagatagttccgaagcgactggctgggaagaaccctcccctccaagtatcaggaggaagatggaaattgatgacgggacctcggcttggggggatccctccaactataataataagacagtcaacatgtgggaccgcaataaccccgtgatacagagctctaccactaccaataccactactaccaccacaaccaccactagcaacaccacccatcgagtcgaaacccccccaccccaccaagctgggacccaattgaaccgatctcccttgctgggacctgggaggaaagtaagctctggatggggcgaaatgcctaacgttcactcgaaaaccgagaattcctggggggagccctcctccccttctacgctggtggataacgggactgccgcttgggggaagcccccaagctctggaagcggctggggtgaccaccctgccgagcccccagttgccttcggtagagcgggtgcaccggtagccgcttctgccctgtgcaagcccgcttcaaagtccatgcaggagggatgggggtctgggggagacgaaatgaacctcagtactagccagtgggaagacgaagagggcgatgtgtggaacaacgccgcttctcaagagagcacatcttcatgctctagttggggaaatgcccctaagaagggtctgcagaaaggcatgaagacaagcggcaaacaggatgaagcatggatcatgtcccgcctcatcaagcagctcaccgatatgggattcccgcgtgagccggctgaagaagcactaaagtcaaataacatgaatctggaccaggcaatgtctgcactcttggaaaaaaaagttgatgtcgacaaaaggggtttgggagtgactgatcacaacgggatggccgctaagcccctaggctgccggccaccgattagcaaggagagctcggtggaccgccctaccttcttagacaaggatggaggcctcgttgaagagcccacaccatcccccttcctgccttcgccatccttgaagctgcctctctctcacagcgcacttccatcacaggctctaggtggcattgcgagcggactcggaatgcagaacctcaattcatccagacaaattccaagtggaaacctcggcatgttcgggaactcaggagctgcccaagctagaacaatgcaacagcctcctcagccccctgtgcaaccacttaattcctctcagccctcactgcgcgctcaggttccccagtttctgagtccccaggtccaggcacagctgctgcagttcgccgcaaagaacatcggcctgaaccctgcccttctgacttctccaattaacccccagcatatgactatgctgaatcagctctatcagcttcagcttgcttaccaacggctgcagattcaacaacaaatgctgcaagcccagagaaacgtgagtggctccatgaggcaacaggagcagcaggtggctcggacgatcactaatctgcagcaacagattcagcagcatcagcgtcaactggcccaagcactgctggttaagcagcctcctcctccgccaccaccccctcacctaagtctacacccgtcagcgggaaaaagcgccatggattcctttccgtctcacccccagacccctggactccctgatctccagaccaaggaacagcaatcaagccctaacactttcgccccttaccctctggctggacttaatcctaacatgaacgtgaattccatggacatgaccggcggtctatctgtaaaggacccatcgcagtctcagtctaggctcccgcaatggacgcacccaaactctatggataacctgccgagcgctgcttctcccctggaacagaaccctagcaaacacggggctattcccggaggcctgtccattggcccaccaggtaaaagcagcatcgacgattcatacggtcgatacgatctcatccagaactccgagtcccctgctagtccacctgtggcagtgccacactcctggagtagggccaaatcagactccgacaaaatttccaatggcagttctatcaactggcctcctgaattccatcctggagtaccttggaaaggactccagaatattgatcccgaaaacgacccggacgtgacccctggatccgtgccgacagggcctacaattaatactaccatacaggacgtgaacaggtatctgctcaaaagcggtggcaaactctctgacatcaagtccacttggtccagtggtcccacatctcatactcaggcctcgctctctcacgagctgtggaaagtacctaggaactcgaccgcacctacccgtcccccacccggactcacaaaccccaaaccatcttctacctggggggctagcccactgggctggacgagttcctacagctccggttccgcctggagtacagacacttccggacgtacgtccagctggctggttctgcgtaaccttactccccaaattgacggctccaccctccgaaccctgtgtctgcaacacgggccactgattactttccaccttaaccttacacagggaaacgcagtagtgagatattccagcaaggaggaggccgcaaaggcccagaagagtctgcatatgtgtgtacttggaaacactacgatattagccgagtttgccggtgaggaagaagttaaccggttcttagcacagggacaagccttacccccaacaagctcctggcagagcagcagcgccagcagtcaaccacggttgagcgcggcaggaagcagccatggtttagtgcggagcgatgcaggccattggaatgccccttgcttgggcggtaaaggaagttctgaattgctgtggggcggtgtaccgcagtattcctccagcctctggggacctccatctgcagatgactccagagttatcggatccccaactccactcacgacactgcttccaggcgatcttctctcgggtgagtccctgtac

SEQ ID NO: 244956 - DNA, 5073 bp, Artificial Sequence
  Description of Artificial Sequence: Synthetic coding sequence
atggctacaggaagcgcccagggcaatttcaccggtcataccaagaagactaatgggaataacggtaccaatggcgctctggtccagtctccttcaaatcagtcagccttaggagcaggtggtgccaactcaaacggcagcgcagctcgggtttggggggtggccaccggctccagttctggccttgcccattgctcagtgtctggcggagacggcaagatggataccatgattggcgatgggagatcccaaaattgttggggagcaagcaactcaaacgccggaattaacctcaatcttaaccccaatgcaaatccagcagcctggcccgttctcgggcacgagggcactgttgccactggaaatccctcatctatctgcagcccagtatctgccattgggcagaacatggggaaccagaacggcaatcctacgggaaccctcggcgcatgggggaatctgctcccccaggaatctactgagcctcagactagcacctcccagaatgtgtcgttctctgcacagcctcagaatttgaacacagacggacccaataatacaaaccctatgaactcctcacccaatcctatcaacgcaatgcagacaaatggtttacctaattgggggatggctgtgggtatgggggctattatcccaccccacctgcagggccttcctggcgctaatggtagctcagtctcacaagtctccggtgggagtgctgaggggattagtaatagcgtttgggggctgagtccaggaaatcccgctacaggtaacagcaactccggtttttctcagggtaatggagataccgttaattctgccctttctgctaagcagaatgggtctagttccgccgtgcagaaggagggctcaggcggaaacgcctgggattctggccctcccgcaggtcctgggatactcgcttggggacggggttccggcaataacggcgttggtaacattcatagtggcgcttggggtcatccttcccggtcaacttcaaatggggtgaacggcgagtggggcaagccgcctaaccaacactccaatagcgatatcaacggaaagggaagtaccggctgggagtccccatccgtgacaagtcagaacccgactgtgcagcccggaggtgagcatatgaactcatgggctaaggccgcttcctccggtaccaccgcctctgaggggtcatcggacgggtctggaaaccacaacgaaggtagcacgggccgtgaagggacaggcgaaggcagaaggagggataagggcattattgaccaggggcatatccagctgcctagaaatgacctggatccccgagtgctgagtaatacagggtggggccaaacacctgtcaaacagaatactgcatgggaattcgaagaaagtcccaggtctgagcgcaaaaacgataatggtactgaggcatggggctgcgctgctacacaggcctctaactcaggcggtaagaacgacggtagcatcatgaactcaacaaatacttccagcgtgtccggatgggtgaacgcccctccggcagctgttccagctaacactggttggggagattccaataacaaagccccatccgggcctggggtttggggagattccattagcagcaccgccgtgtctacagccgctgccgctaaaagcggtcatgcatggtccggcgctgccaatcaggaggacaaaagcccaacttggggggagccccctaaacccaaaagtcagcattggggagacggccagaggtcaaatccagcatggagtgcaggaggcggtgactgggcagattcatcatctgtgctggggcaccttggggatggcaaaaagaatggatcggggtgggacgccgattcgaatagaagtggctcaggctggaatgatacaacaagaagcggaaattcagggtggggtaatagtacaaataccaaggctaacccgggtaccaactggggggagacactgaagccgggacctcagcaaaactgggcatccaaacctcaggataacaacgtgtcaaactgggggggagccgcaagcgttaagcagaccggaaccggctggattggtggccctgtgcccgtaaagcagaaagacagttctgaagctaccggatgggaggagccgagtcctccttctattagacgcaagatggaaatcgacgacggcacctccgcctggggagacccctccaactacaacaacaaaactgtgaatatgtgggataggaataacccagtaattcagtcctctactacaacgaatactactaccacaaccacaacaacaacttctaataccacacaccgggtcgaaaccccaccccctcatcaggcagggacccaactcaatagatctcccttactgggcccaggcagaaaagtctccagcgggtggggagaaatgccaaacgtccattcgaaaaccgagaactcctggggagaaccatcgtccccttctacattggtagataatggcactgcagcttggggcaaacccccaagttccggttctgggtggggagaccaccctgccgaaccgcctgtcgctttcggcagggctggtgcccctgtcgccgcatcagccctgtgcaaaccagccagcaagtccatgcaggaagggtggggaagcggcggtgatgagatgaacttgtctaccagccaatgggaggacgaagagggagacgtgtggaataacgcagcgtcccaggagagcactagctcttgctcttcctggggaaacgctcccaagaagggactgcagaagggaatgaagacatcaggcaaacaggacgaggcctggatcatgtctcggctcataaaacagctaaccgatatggggttccctagggaacccgcagaagaggccctgaagtcgaacaatatgaatctcgaccaggctatgtccgctctcctggagaagaaagtcgatgtggacaaaagaggtctgggagtgaccgatcataatggcatggctgcaaagcctctggggtgtagaccacccatcagcaaagaatcgtctgtcgaccgcccaacctttttggataaagacggcggactcgttgaagagcccactccctcacccttcctcccttccccaagcctcaaactgccactatcccatagcgccctcccgagccaggccctgggagggatcgcttcaggattaggtatgcaaaaccttaacagcagccggcagattccatcggggaacctgggcatgttcggcaactcaggcgcagcacaggctcggaccatgcagcagcctccccagccgccagtccagccactcaactcttcacagccatctctgagagcccaggttccacaatttttaagccctcaagtccaagcccagctgttacagttcgccgctaagaacattggtcttaatcccgctctgctcacttctccgatcaacccgcagcacatgacgatgctgaatcagttataccagctgcagcttgcctatcagcgcctccagattcagcagcagatgctccaagcccagcgaaacgtaagtggaagtatgcgccagcaggagcagcaggtagccaggaccatcacaaacctgcagcagcagatccagcagcaccagcgccaacttgcacaagccctactcgtgaagcagccgccaccgccacccccacccccacacttgagcttacatccctctgctggaaagtccgcaatggatagctttccatcccacccacaaactccgggactgccggaccttcagactaaggaacagcagtccagtcccaataccttcgccccataccctcttgccggattgaatcctaacatgaacgtcaactcaatggatatgacagggggactctccgtgaaggatcctagccagtcccagtctagactcccacagtggacacatcctaactctatggataatctgccatccgccgctagtccgttagagcagaaccccagcaaacatggagcaatacccggaggactctcgatcgggcctcccggaaaaagttcgatcgacgactcctatggtcgatacgatcttattcagaattctgaaagccccgcaagtcccccagtggctgtcccacattcttggtcacgagctaaaagcgattcagataagataagtaacggcagctccataaattggccgccagagttccatccaggcgtgccctggaaaggtctgcaaaatatcgaccctgaaaacgatcccgacgttacccccggttctgtgcccactggccctacaatcaatacgaccatacaagacgtgaacaggtatttacttaagtctggcggaaaactgagcgacatcaaatctacttggtcctccggccctaccagccacacgcaggcgagcctgagccacgaattgtggaaggtgcccagaaatagtactgccccaacccgccctcccccaggcctgaccaatcctaagccaagttcaacatggggggcatccccgctgggctggacgagcagttattcgtcagggagtgcttggtcaaccgatactagtggccgtaccagcagctggctagtgctccgcaatctgaccccccagatagacggatctaccctgaggaccctgtgtctgcagcatggaccacttatcaccttccatttaaatcttactcagggcaacgcagtggtgcggtattcctcaaaagaagaggcggctaaggcccagaagagccttcatatgtgcgtgctaggcaataccaccatcctggcagagtttgctggggaagaagaggttaatagatttctggcgcagggccaggctctccctccaacctccagttggcagtctagctcggccagtagtcagcctcggctgtccgctgccggaagctctcatgggttggtgagaagcgacgctggacattggaacgcaccctgcctaggcggtaagggctctagcgaactcctgtgggggggagtcccccaatatagctcctctctctggggccctccaagcgccgatgattcccgggtcatcggtagtcctacccctttaaccacgctgttaccaggagatctgctcagcggcgagagcctctag

SEQ ID NO: 244957 - DNA, 5180 bp, Artificial Sequence
  Description of Artificial Sequence: Synthetic coding sequence
atggctaccggctctgcccagggaaacttcaccggacacacaaagaagacgaatgggaacaacggcacaaatggcgcactcgttcagtcaccgtcaaaccagtcagccctgggagcgggtggcgcaaattcaaacggaagcgccgctcgagtttggggagtggctacgggttcctcttctggacttgcccactgctctgtaagcggcggagacgggaaaatggacacaatgattggcgacggtcgatcacagaattgttggggagcctcaaactctaatgcaggcataaacctgaatctgaacccaaatgccaatcccgctgcatggcccgtgctcggacacgagggtacagttgccaccggcaacccatcatcaatttgctcccctgtttcagcgattgggcagaacatgggaaatcagaatggcaacccaacaggaacactgggtgcatggggcaatttgttgccgcaggagtctacagagcctcagactagcacaagccagaatgtgtcattctctgcccagccgcagaatcttaataccgatggcccaaacaacaccaatcctatgaattcctcccccaatcccatcaatgctatgcagacaaacggcctccctaactggggaatggccgtgggcatgggggctattattccacctcatctgcagggcctgcccggtgccaacggatcctcagtctcccaagtaagcggaggcagtgcagagggtatttccaactcagtgtggggcctgagtccaggaaaccccgctaccgggaactctaattcaggattcagccagggtaacggagacacggtgaacagtgctctttccgctaaacagaatgggtcctctagcgcagtgcaaaaagaggggtcaggtgggaacgcttgggattccggccctccagccggacccggtatccttgcctggggcagagggtctggaaacaacggcgtggggaatatacacagcggcgcttgggggcacccctctaggtctacatccaatggtgtgaatggcgagtgggggaaaccacctaaccagcatagcaactcagacattaatggcaagggttccaccgggtgggagtctcctagtgttacaagtcaaaatccaacagtgcagccaggtggcgaacatatgaactcatgggcgaaggcggcatcatcagggactacagcgagtgaggggagctctgatggctccggaaaccataacgaggggtccactggtcgggaaggaacaggggagggcagaagacgcgataaagggatcatcgaccagggccacatccaactgcctcggaatgacttggaccctagggtcctgagcaacacaggatggggtcaaactcccgttaagcagaacaccgcatgggagtttgaggagagccccagaagcgagcgtaagaatgataatggcactgaggcatggggatgtgctgcaactcaagctagcaactcaggtggtaagaacgacggtagcatcatgaattccacaaacaccagttctgtgtctgggtgggtcaatgcccctccagccgctgtccctgcaaacacaggctggggcgacagtaacaataaggctccctccggaccaggagtctggggtgatagcatttcttctaccgcggtgagcaccgcagctgcggcaaaatctggccatgcatggagcggtgccgcaaaccaggaggataagtcccctacttggggcgaaccccctaagcctaaaagccagcactggggcgacggacagcgaagcaatcccgcatggtctgccggagggggtgattgggccgattccagcagcgttctgggtcatcttggagacggcaaaaagaacggctctggttgggatgccgactctaatcggagtgggtcaggctggaacgacaccacacgttctggtaattctggctggggcaattctaccaacaccaaagcaaatccaggaaccaactggggtgaaaccctgaaaccaggtcctcaacaaaactgggcctcgaagccccaggacaacaacgtgtccaactggggtggcgctgcttccgtgaaacagaccggtaccgggtggattggcggtccagtgcctgtcaagcagaaggatagctctgaagccaccgggtgggaggagccttcccccccttccatccgccgaaagatggagattgatgatggtacttcagcttggggggacccttctaactacaacaataaaactgttaatatgtgggacagaaacaaccctgtcattcagtcatccaccactaccaatacaactaccacaactactacgactaccagcaacaccacgcaccgcgtcgagactccgcctccccaccaagctgggacccagctcaatcgatcccctttactggggccagtatcctccggttggggcgaaatgcccaatgttcactctaagaccgagaattcctggggcgagccctcttccccctcgactctcgtcgataacggtaccgcagcttggggcaaacctccttcttctggaagcggatggggcgaccacccagccgagccaccagtggcttttggaagggccggagcccctgttgccgctagtgccttgtgtaagcctgctagcaaatccatgcaagagggttggggtagcggcggtgacgagatgaatctcagcacatcccagtgggaagacgaagaaggcgacgtgtggaacaacgccgcaagtcaggagtccacatccagttgctcttcgtggggtaacgccccaaagaaaggcttacagaagggcatgaagacgtccgggaagcaggatgaagcatggatcatgtctagactgatcaagcagttgaccgacatgggttttcccagagaacctgctgaagaggccctcaaatccaacaatatgaaccttgatcaggccatgtccgctctgctcgaaaaaaaggtggatgttgacaagcggggattgggtgtgaccgaccataatggtatggcagccaaacccctcggctgtaggccccctatctcaaaggagagcagtgtcgacagacctacatttttggataaggatggcggtcttgtagaggaaccaaccccaagtccatttctgccatcaccgtccctgaaactgccgctgtcccattcagcgcttccgtcccaggctttgggtggcatagccagtggactggggatgcaaaatttaaacagctctcggcagataccctcaggcaatcttgggatgtttgggaattccggcgctgctcaggcaagaactatgcagcagcctccacagccacccgtacagccacttaattcttcccagccttccctgcgagcccaggtgccgcagttcctgtcgccccaggttcaagcgcagttgttgcagtttgccgctaaaaatatcggtcttaatcccgctctgctgacttcccccatcaacccccaacacatgaccatgctcaaccaactgtatcagctgcagttagcctaccagcggctgcagatccagcagcaaatgctccaggcccagcgcaacgtctctggttccatgcgccaacaggaacagcaagtggcccgtacgatcactaatcttcagcaacagatccagcagcaccaacgacagctggcgcaggcattactggtgaagcagccacctccccctccacccccaccgcacctgagtctgcacccatcggccggaaaatctgccatggacagctttccttcccatcctcagaccccaggacttcctgacctgcaaaccaaagaacaacagtccagccctaataccttcgcaccctacccccttgccggactcaaccccaacatgaacgttaatagcatggacatgaccggcggtctatccgtcaaagacccttcccaaagccaatctagactccctcaatggactcatcccaattctatggacaacctcccatccgctgccagcccgctagagcagaacccgtccaaacacggcgctatccctgggggtctctcaatcggccctcccggaaagagtagcatcgacgacagttacggcaggtatgatctcattcaaaacagtgaaagcccagcgagcccccctgtggccgtgccacattcatggtccagggccaagagtgactccgataagatctctaacggaagtagcatcaactggcctccggaatttcaccccggagttccctggaaaggactgcagaacattgatcctgagaacgatcccgatgtcacacctgggtccgttcctactggcccaacgattaatactaccatacaagacgtgaacagatatctgctgaagagtggcggaagctctcctccttcatcccagaatgctaccctgcctagttcatctgcatggcccttatccgcgtctggctatagcagctccttttcgtccatcgcgtccgcgcctagtgtcgccggaaaattgagcgatattaagagcacctggtcatcaggacctacgtcccacactcaggcatccctgtcacatgaactgtggaaagttcccagaaattccacagccccaactaggcccccacctggactgaccaaccccaagccgtcaagcacgtggggtgcctctccgcttgggtggacgtcaagctactcctccgggagcgcctggtcgaccgatacttcggggagaacttctagctggctggtcctgagaaatctaacaccacaaatagacggcagcacgcttaggaccctgtgtctgcaacacgggcctctcatcaccttccacttgaatctcacgcaaggcaatgcggtggtgaggtatagcagcaaggaggaggccgctaaggctcagaagtccttgcacatgtgcgtcctgggaaacaccactatattggccgaatttgccggagaggaagaggtgaatagatttctggcgcaggggcaggcgttgcccccaacttcctcatggcaaagttcttcagcctcaagccagcctagactctctgcagcaggaagtagtcatggtctggtgaggagcgatgctggccattggaacgccccttgccttgggggaaaaggctcatcagagctgctgtgggggggagttcctcagtacagcagctctctatgggggcctcccagcgccgacgattctcgggtcatcgggtctccaaccccgcttaccacactactgcctggcgatctgctgtctggggaatctttata

SEQ ID NO: 244958 - DNA, 1959 bp, Artificial Sequence
  Description of Artificial Sequence: Synthetic coding sequence
atgggcggatggaagggcccaggccagcgacgcggtaaggagggcccagaggcacggagaagggctgcggaacgtgggggaggcggaggtggaggaggtgttcctgcgcctaggagccctgctcgcgaacccaggcctaggagctgtctgcttctcccaccgccttggggtgccgctatgactcccgacctgttgaatttcaaaaaagggtggatgtccatccttgacgagcctggcgaaccacccagccctagcctgaccaccacgagcacttcacagtggaagaaacactggttcgtgctcacagattctagtctaaagtactaccgcgactcgaccgcagaagaggccgacgagttggacggcgaaatcgacctgcgttcttgtacggatgtcacggagtacgctgttcaaagaaattatgggttccagattcacaccaaggatgccgtttacaccctctccgcaatgactagtggtataaggcggaattggatagaagcgttacgtaaaactgtccggcctacatctgcacccgacgtaacgaagctgtctgattccaacaaagaaaacgcgttacattcctactcaacccaaaaaggccctctgaaagccggtgaacagagagccggatctgaggtgatttcacggggtgggccacgcaaggctgatggccaacgccaggccctggattatgtggagctgtctcccctcacccaagcaagtcctcagcgggctcggaccccggctaggacacctgaccggctcgcaaaacaggaggagctagaacgagacctcgcacagcggtcagaagagaggagaaagtggtttgaggcaacagattctagaactccagaggttccagccggtgaggggcctaggcgtgggcttggagcaccccttacagaggaccagcaaaaccgactgtccgaggaaatcgagaaaaagtggcaggaactcgagaagttgcccctccgagaaaataaaagggttcccctgacagctctgctgaaccagtctaggggggaaagaaggggtcctccatccgacggacacgaggcgctggagaaggaagtccaggcactcagggcccaactggaagcatggcgactccagggggaagctcctcagtcggccttgcgttcacaggaggacggccatataccccctggatacatttcacaggaggcttgcgagaggagtctggccgaaatggaatctagccaccagcaggttatggaggagctgcaacgccaccatgagagagaacttcagcgactacagcaggaaaaagagtggttgctggcagaggagacggccgctactgcgtctgccatcgaagcgatgaaaaaggcgtatcaggaggagctgtcccgagagctcagcaaaaccaggagcctgcagcagggcccagatggtctcaggaaacaacatcagtctgatgtggaagcactcaagcgcgagctgcaagtgctaagcgagcagtactcacagaagtgccttgagatcggagctctgatgaggcaagctgaggagcgggagcacactctccgaagatgtcagcaggagggacaggagttacttagacacaaccaagaactccacgggaggctgtcggaggagatagaccagttgagaggtttcattgcgtcccaggggatggggaatggatgcggcagatctaatgaacggtcctcctgcgaattggaggttcttctgagggtgaaagagaacgaactccaatatctcaagaaagaggttcagtgtctcagagacgagttgcagatgatgcagaaagataagaggttcacaagcggcaaatatcaggacgtctacgtagaattgtcccatatcaaaacccgttcagaaagggagattgagcagttgaaagagcatttgcgcctggcgatggcggctctgcaagaaaaagaatctatgcgaaattccctggcggagtag

SEQ ID NO: 244959 - DNA, 7097 bp, Artificial Sequence
  Description of Artificial Sequence: Synthetic coding sequence
atggaagaggtgccaggcgatgcactttgcgagcacttcgaagctaatatacttactcagaatcgatgccagaactgctttcaccctgaagaggctcacggggctcgctaccaagagctgcgttcaccgagtggtgctgaggtgccctactgcgatcttccgcgatgcccgcctgcacccgaggatcctctctccgcttccacctcaggatgccagtccgtggtagacccaggtctgagacccggacctaagcgcggaccttcacccagcgcaggtctccctgaggagggcccaaccgctgctccaaggtctaggagtcgggaactggaggccgtaccctacttagaagggttgaccacaagtctgtgtgggtcatgcaatgaggacccgggaagcgacccaacgtcttctcccgactccgctacccccgatgacacatctaatagctccagtgtcgattgggacactgtggagagacaggaggaggaagcaccctcctgggacgaactggccgtcatgattcctagaagacctcgggaaggcccaagagccgatagctctcaaagagccccttctctgctcacccgctccccagtcggcggagacgcagcgggtcagaagaaggaagacaccggcggtggcggtagatccgcagggcagcactgggccagacttagaggggagagcggcctgagcctggagcgacacagatcaacactgacacaggcctcttcgatgaccccgcactctgggccacggtcaactacctctcaggcttcccctgcgcagcgcgacactgcccaggcagctagcaccagagaaataccacgcgcaagctccccgcacagaataacccagagagacacgagtagggcatcctctacgcagcaggaaatatccagagcaagcagcactcaacaggaaacttcccgcgcatcctccactcaggaggacacacctagggcctcatctacgcaagaggacacaccacgcgcatcatccactcagtggaatacacctagggcctctagcccctcacgctccacccaactcgataacccaagaaccagcagcacacagcaggacaatccacagaccagtttcccaacgtgcacgccccagcgtgagaaccctcggacaccatgcgtgcagcaagatgaccccagggcctctagtcccaacaggactactcagagagagaactctcgcaccagctgcgctcagagggataacccgaaagctagccggacgtcttcccctaatagagctactcgtgacaacccgaggacctcttgcgcgcagagggacaacccgcgtgcaagctctccctcacgcgcaacacgggataaccctaccacatcttgcgcccagcgagacaaccccagagctagcagaacctcgagccccaaccgcgcaacccgggataatccaagaaccagttgcgctcagcgggacaaccctcgagcctcgagcccctcacgcgcaaccagagataatcccacgactagctgtgcacagcgcgataacccgagagccagcagaactagtagtcccaacagagctacacgcgataacccacgcacgtcctgtgctcagagagataatcctcgagctagctctcctaatagggctgccagagataatccgactacatcctgcgctcagcgtgacaaccctcgggcaagccggacgtcttcccctaacagagcaacgagggacaatccccgaaccagctgtgctcagcgtgataacccgcgagccagttcacctaaccgagcaacaagggataaccctaccacgagttgtgcccaaagggataacccacgggcatccagaacatcaagcccaaacagagcaaccagagataatcccagaacctcctgtgctcagcgggacaacccccgagcttccagccctaaccgcaccactcagcaggactctcctagaacatcttgcgctcgccgtgacgacccgcgagcctcatctccgaacaggacgatacagcaggagaatcctcgtacttcctgcgctctcagagataaccccagggcttccagtccatccagaacgatccagcaagaaaatcctaggacgtcctgtgcccagagagacgatcctagagcctcatccccaaacagaacgacacagcaggagaatcccagaacctcttgcgcccgtcgcgataatccgagggcctcttcacggaatcgcaccatccaacgagataatccgcgtacctcttgcgcacagagagataacccaagggctagttcccctaaccggacaatccagcaggaaaatcttaggactagttgcacacgtcaagataatcccaggacatccagcccaaacagagcaactcgcgacaaccctcgaacgtcatgtgcccaaagagacaacctgagggcatcctcacccattagagcaacccagcaggataaccctcgcacatgtatccagcagaatatcccccgttcctctagcacccagcaagataaccctaaaacaagttgtaccaaacgggataatctgcggccaacgtgcactcaacgtgatcgaactcagagctttagctttcagagagacaatcctggaacctcttcctcacagtgctgcacacaaaaggaaaatctccgtccttcctctcctcaccgcagcacccagtggaataatccacgaaacagtagtccacacaggactaacaaggacataccatgggcatcatttccattgagacctacacagagcgatggcccacggaccagttccccatcacgcagtaagcagagcgaagttccatgggcatcaattgcactgaggccaacgcagggagaccgaccgcagacttcctctccatctagacccgcacagcacgatccaccacagagctcctttgggccaacccagtacaacctcccttccagggcgactagctcttcccataatcctgggcaccagagcacctcccggaccagctctccggtctaccctgccgcttatggcgctccactgactagcccggaacctagccagcccccttgtgccgtctgtattggacacagggatgctccacgggcatcctcaccaccgagatacctgcaacacgatcccttcccctttttccctgaacctcgagcccctgaaagtgagccacctcaccacgaacctccttacatcccacccgctgtgtgcattggccacagggatgctccaagagcatcttcccctcctaggcatactcagttcgacccattcccctttctgcctgatacctctgatgccgaacatcagtgccagtctccccagcacgagccactgcagctgccggctcctgtttgcattggttacagggatgccccacgggcatcgtcacctccccgtcaggcaccggagccatcactgctgtttcaagacctcccacgagccagcacagaaagtcttgtgccgtctatggatagcctccacgagtgccctcacataccaactccagtttgcatcggccatagagacgcacccagtttttcatccccccctaggcaggcccctgaaccgtcattatttttccaggaccctcccggaacatccatggaatctctggccccaagtaccgacagcctgcacgggtctcccgtgttaatcccacaggtatgcattggccaccgagatgcccctagggcctcgtccccacccaggcatcccccttctgatttggctttcctcgcaccgagtcccagtcccggatccagcggcggaagtaggggctccgcccctcccggtgaaaccaggcacaacctggaacgtgaggagtacaccgtgttagcagatctgccgccacccagacgacttgcccagcggcaacctggaccgcaggcccagtgcagctctggcggtagaactcattcccctggaagagcggaggtcgaaaggctgttcggacaagaaagacgcaaatccgaggctgccggagccttccaggcccaggatgaggggagaagtcagcagccgtcccaaggacagtcacagcttctgaggcgccaatcctcacccgctccttcccgccaagtcactatgctcccagccaaacaagcagaattgacgcgcaggtctcaagccgagcccccacatccctggagcccggaaaaaagacccgaaggggacaggcagctacagggctctccgttgcccccaaggacttccgcaaggactcctgaacgggaactgcggacacagcgtcctctggagtctggccaggctggacccagacagccacttggagtgtggcagtcccaagaggagccacccggatctcagggaccccatagacacctagagagatcttggagcagccaggagggcggactggggccagggggttggtgggggtgtggggagccaagtctcggagcagctaaagctcctgagggagcctggggcggaacttctagagaatacaaggagtcatggggccagcccgaggcctgggaagaaaaacccacccacgagttacctagagaactgggcaagcgcagcccgctgacgagtcctcctgagaattgggggggaccagccgaatcttcacagagttggcactcaggaacaccgactgcggtgggctggggcgctgagggcgcatgcccctaccctcggggatccgagcggcgtcccgaattggactggagggacctcttaggcctgttaagggcgcctggagagggagtttgggctcgggttccaagtcttgactgggaaggcctgttagagcttctgcaagctcggttgccaagaaaagatcctgccggacacagggatgatctggccagggcgctggggcctgaactcgggcctcccggaactaatgatgtccccgagcaagaaagccactctcagcctgaggggtgggctgaagcaacccccgtcaacggccatagtcctgccctacagtctcagtccccagtgcaactgccatcccccgcttgtacatccactcagtggccaaagattaaagtcacccgcggacctgccaccgccacactggccggactggaacagacaggccctctcgggagcaggtccaccgctaaaggcccatctctgccagagctgcagtttcagcccgaagaacccgaagagtccgaaccgagcaggggacaggatcctctcacagaccagaagcaggccgattctgccgataagaggcccgctgaaggcaaagccggatccccccttaagggtcggctggtgacctcatggcggatgcctggggaccggcctactttgtttaatcctttcttgctttccctgggggtgctgagatggagacgcccagatttgctcaacttcaagaaaggatggatgtcaatcctcgacgaacccggagagccgccaagcccttcactcacaactacatccacttcccagtggaaaaagcattggttcgtcctcactgactcatcccttaagtattaccgagatagcaccgcagaagaagccgacgaacttgatggcgagatcgacttgaggtcttgtacagatgttactgaatacgcagtgcagcggaattacggcttccagattcatacgaaggacgctgtttacacactgtctgccatgaccagtgggattcggaggaattggattgaagcgctgaggaagacagtccgaccaacctctgcaccagatgtgaccaagctgtccgattcgaataaggagaacgccctgcacagttacagtactcaaaaaggcccactgaaggcaggtgaacagcgggctggcagtgaggtcatctcaaggggaggcccacggaaggcggatggccagcggcaggctctggactatgtggagctgagtcctctgactcaggccagtccccaacgcgctaggactcctgcgcgaacacccgatcgcctagcgaagcaggaagaactcgaacgcgacctggctcagcgttcagaggagcggagaaaatggttcgaggcaacagacagcagaactcccgaggtgccggctggagaggggccaagacgaggacttggagctccactcaccgaagatcagcagaaccgcctgagcgaggagatagagaagaaatggcaagaactggagaagctgccactgagagagaataaacgtgtgcccctcactgctctcctgaatcagtcacggggagaacgcagagggccaccttcggatgggcacgaagcactcgagaaggaagtacaggcccttagagcccagctagaggcatggcggctgcagggggaggctccacagtccgccctgaggtcacaggaggacggtcatattccgccagggtatattagccaggaggcgtgcgaaaggtcccttgccgagatggaatctagccaccagcaggtgatggaagagttgcagcgccaccatgagcgcgaactgcaaagattgcagcaggaaaaagaatggctcctcgccgaagaaactgccgcaaccgccagcgctattgaagctatgaagaaggcgtatcaggaggagctgtctcgagaactgagtaagaccaggtcacttcagcagggccctgatggactccggaaacagcaccagtccgatgtcgaggctctgaaaagagagctgcaggttctgagcgaacagtatagtcagaagtgtctggagatcggcgcactcatgcgacaggcggaggagcgggagcacaccctgcggagatgccagcaggaaggccaggaactgctcagacataaccaagagctacacggccgactgtcagaagagatcgaccagctccgcggtttcatagcctcccagggcatgggaaacggatgcggaaggtccaatgagcggtcatcttgtgagctggaggtgttactcagggtcaaggagaatgagctccagtacctgaaaaaggaagtgcagtgtcttagagatgagctgcaaatgatgcagaaggacaagcgtttcacatccggcaaatatcaggatgtctatgtggagctgtctcatatcaagacccgctccgagcgtgagattgaacagctcaaagagcatctgcgtctcgcaatggccgctcttcaagaaaaagaaagcatgcggaactccctcgcagagta

SEQ ID NO: 244960 - DNA, 1296 bp, Artificial Sequence
  Description of Artificial Sequence: Synthetic coding sequence
atgggtggctggaaagggcctggacaacggcgaggtaaagaaggacccgaggctcgccgacgggcagcggagcgcggtggcggtggcggaggtggtggagtgccagccccaagatctcccgcaagggagcctaggccgcgaagctgtcttctgctcccgcctccttggggtgcagctatgacacccgacctgctgaactttaaaaaaggatggatgtcgattctggacgaaccaggggagcctccctctccgagtctgacaacgacctccacatcccagtggaagaaacactggtttgtgctcaccgattcctcactgaagtactatagggactccacagctgaggaggcagacgagctagatggggagatcgatctgaggtcatgcacagacgtgactgaatatgctgttcagcgcaattacgggttccagattcacacaaaggatgcggtctacactctgtccgcgatgacttcggggattagacgcaactggattgaagctcttcggaaaacagtccggcctacctcggcaccggatgtcacgaagctctcagacagcaacaaggagaatgccttgcactcatactccacacaaaaaggaccactcaaagcaggggagcagagagccggatcagaggtgatatccaggggaggaccaaggaaggctgatggacaaagacaagccctggactatgtcgaactctccccgcttacacaggcctccccccagagggccaggacacccgcacggactcctgatcggcttgcgaagcaggaggagctggagcgggacctagctcaaagaagcgaggaacgtcgcaaatggtttgaggccacagactcccgaacccctgaagtgcccgctggcgaaggacccagaagagggctcggcgctccgctgacggaagaccaacagaataggctgagtgaagagatcgaaaaaaagtggcaagaactcgaaaagttgccccttagagaaaacaaaagagtaccactgacagccctgttgaaccagtcacggggagagagaagggggccacctagcgatggacacgaggcactggagaaagaggttcaagctctgcgggcacaactggaagcatggcgattacagggcgaggcccctcagagcgctctaagaagccaagaggacgggcatattccacccggatatattagccagctggtgggcgtgatcacagttccagtcctccagacgagacctttatcatccgagcgattatgtgacttgcctaaggttaccccccctgccggactgaaggggggaatctag

SEQ ID NO: 244961 - DNA, 5070 bp, Artificial Sequence
  Description of Artificial Sequence: Synthetic coding sequence
atggaagaggtaccaggcgatgccctgtgcgagcatttcgaagcgaacatacttacccaaaatcgctgtcaaaattgctttcacccggaagaagcgcacggagctcggtatcaggagctgcgtagcccctctggggctgaggtgccttactgtgacttgccacgatgtccccctgctcctgaggacccgcttagtgccagcacaagcggctgtcagtccgttgtcgacccgggactcagacccggtccaaagagaggcccaagtccaagcgctgggttgcctgaggagggtcctaccgccgcacctcgatcccgcagcagggagcttgaagctgtcccctatctggaaggactgactacgtctctgtgcggatcatgcaacgaagaccccggttctgatcccaccagctcccccgatagtgccacccctgacgatacctctaattcatccagtgtggactgggacaccgtggagcgccaagaggaggaggccccaagctgggacgagctcgctgtcatgatacccagaagaccacgggaggggccaagggccgacagtagccagcgcgcaccgtccctcctcactcgctccccagtaggcggtgacgccgctggacagaaaaaagaagataccggcggagggggtcgatcggcaggccaacattgggcaaggctcagaggcgagtcgggcctttcactagagaggcacaggagtaccctgacacaggcaagttcaatgacaccccactctggccctcgctctactacctcccaggcctcgccggctcagagggacactgcgcaagctgcttccactcgggaaatacctagggccagcagcccccacaggataactcagcgggacacttcgcgagcttcttctactcagcaggagatatctcgcgcttctagcactcagcaggagacaagtagggcctcctcaactcaagaggacactccccgagcctccagtacacaagaggatacccccagggcctcctcaactcaatggaatacaccacgcgcatcgtcacccagcagatctacccagctggataatccacggacatcttccactcaacaggacaacccccagacttcattcccgacctgtaccccgcaacgggagaaccctcgcaccccctgtgttcagcaggacgaccctcgcgcttcctcacccaatcgcacaacccagcgggagaacagccggacgtcatgtgcacagcgagataacccgaaggcgagccggacctctagtcccaatcgggcaacacgggacaatcctcggactagctgcgcccagcgtgacaatcccagggctagctctccaagcagggccacaagagacaaccctaccacaagttgtgcccaaagagacaatccacgagcttctaggacgagctcccccaacagggctacacgcgataatcccaggacatcgtgcgcgcagagagacaatccccgtgccagtagcccttccagggcgacacgcgacaacccgaccaccagctgtgcccagagagacaaccccagagcctctagaacaagttcgcctaaccgagccacccgggacaaccctagaactagttgcgcccagcgagataatccacgagcttcatcacccaacagggccgctagagacaatccaacaacttcatgcgcacaacgggacaaccctcgcgctagccgaactagctcgccaaaccgcgcaaccagggacaacccacggactagctgcgcacagagagacaacccacgagcttcttccccaaatcgagctacacgagacaaccccacaacctcctgcgcccagcgtgataacccccgtgcaagtcggacatcatcaccaaaccgggctacccgggacaacccaaggacgagctgcgcacagagagacaacccgagggccagcagcccaaacagaacaacccaacaagattccccgcgtactagttgcgccaggagggacgaccctcgcgctagttctcccaacaggactatacaacaggagaaccctagaacctcttgtgcgctgagagacaaccccagagcatcatcccccagccgaaccattcagcaggaaaatcctaggaccagctgcgcccaaagggacgatccacgggctagctcccctaacagaacgacgcagcaggagaatcccaggacatcatgtgctaggagggataatcctagagcctccagcagaaatagaacaattcaacgcgacaatcctcgaacgtcttgtgcccaacgtgacaatccaagagcgtcctcacctaatcgcacaatccagcaggagaaccttcgcactagctgcactaggcaagataatccgcgtacctcatcacccaacagggctacccgcgataacccacgcacaagttgcgcacaaagggacaacctcagagcaagttcgccaattcgagctacgcagcaggataaccctagaacctgtatccagcagaacattccaaggagcagtagcactcagcaggacaatcctaaaactagttgcacaaagcgagataacctgaggccaacatgcactcagagagatcgcacgcagtctttctcatttcagcgcgataatccgggaacctcttcaagccagtgttgtactcagaaagagaatcttcgtccatcctcgcctcaccggtcaacacagtggaacaaccccagaaattcttcaccccaccgtacaaacaaagatatcccgtgggcgtcctttcctcttcgccctactcagtcagatggtcctcgaaccagttcaccatctcgatccaagcagagcgaagtcccttgggcgtcaatcgccctccgtcccactcagggcgacaggccccagacatctagcccttctagaccagcccagcacgatccccctcagtcttctttcggaccaactcagtataacctaccttcacgagcaacttccagctcccacaatcccggtcatcagagcacgagtcgtacctcgagccctgtgtacccagctgcctatggcgcacccctgaccagcccagaaccctcccagcctccttgcgccgtctgtattggacaccgggatgcccctcgcgcatcgtcacctccaaggtacctccaacacgaccctttcccatttttccccgaacccagagcccctgagagtgagccaccccaccacgagcctccctacattccccctgccgtgtgcatcggtcaccgcgatgctcctagagcatcttcaccccctcgccacacgcaattcgacccgtttccgttcctgcccgacacaagcgacgccgaacaccagtgccaaagtccccagcacgagcccctgcagctccctgcaccagtgtgcattggctaccgcgatgctcctagggctagctcaccccctaggcaggccccagagcccagcctgctcttccaagacctgccaagagctagcactgagtccctggtcccgagcatggattccctacacgaatgtccccacattccgacgcccgtgtgcattgggcacagagacgcaccttccttctcctctccacctcgccaggcccctgaacctagcctctttttccaggatccccctggtacaagcatggagagtctggctccttcgaccgatagccttcacggctctcccgtgttaattcctcaggtgtgtattggacaccgggacgcacccagagcgtctagtcctccacgacatcccccttccgatttagccttcttagcccctagtccgtctcctgggtcaagcggcggaagcagagggtcagctcctcctggtgaaacccgacacaatctcgaacgggaggagtatactgtgctcgcggatcttccaccacctcgtcgattggcccagcgccaacccggtcctcaggcccagtgtagcagcggtggaagaacacatagcccaggacgtgccgaagtcgaacgactatttggacaggagagaaggaccatgctgcccgctaagcaggctgagctcacacggcgatcgcaagccgaaccgcctcatccctggagccccgaaaaaagaccagagggagatcggcagctgcaggggagcccattgcctccccgaacctctgccagaactcctgagcgagagctgcggacccagcgtccactcgagagcggtcaggcaggccctcgccaacctcttggagtctggcagtcacaggaagaacccccaggatctcaggggccacatcgccacctggagagatcttggtcctcccaagaaggtggcttggggccaggtgggtggtggggctgtggcgaaccaagtctgggtgctgccaaagcccctgaaggcgcatggggaggcacaagccgggagtacaaggagtcgtggggccaacctgaggcctgggaggagaagccgacacacgagcttccaagagagcttggtaaacgatcccccttaaccagcccacccgaaaactgggggggaccagctgagtcctctcagagctggcactcaggtacccctacagcagtgggatggggtgcagaaggcgcatgcccatacccacgtggatcggaaaggcgccctgagctcgattggagggatctcttaggactcctgcgggcaccaggcgaaggagtgtgggcaagggtgcctagtctcgactgggagggcctgttagaacttctgcaggctcggctccccaggaaggatccagcaggacacagagatgatcttgcacgcgctttggggcctgagctgggacccccaggcacaaacgacgtgcctgaacaagagtcccacagtcagccagagggatgggccgaggcaactcccgtaaacggacacagccctgctctccagtctcagagccccgtgcagctgcccagcccagcatgcacatccacccagtggcccaagataaaggtgactagaggaccggctaccgccacgctggctggactcgagcagactgggcctttgggaagtcgatctactgccaaaggaccctctttacctgagttgcagtttcagcctgaggagcccgaggagagcgaacctagcaggggccaggaccccctgaccgaccagaagcaagcagactcctag

SEQ ID NO: 244962 - DNA, 771 bp, Artificial Sequence
  Description of Artificial Sequence: Synthetic coding sequence
atgtccatactcgatgagcccggagagcctccgagccccagcctcacaactacatcaactagtcagtggaagaagcattggtttgtactcactgacagttctcttaagtactaccgcgactctaccgctgaggaggcagacgagctggacggcgagatcgatctaaggtcctgcacagatgttaccgagtatgcagtccagaggaattacggcttccagatccacacgaaagacgccgtatacaccctgagtgctatgacttctgggatccgtcgaaattggattgaggccctacgaaagaccgtccgtccgacctcagccccagatgtcactaagctgagtgatagcaacaaggagaatgctctccattcatattcgacccagaagggcccactaaaggccggagagcagcgcgcaggttccgaagtgatttcccgtggcggtccacgaaaagcagatggccaacgacaagcactcgattatgtagagctgagtcccctgacacaggctagtccccagagggcacgtacgcctgctaggacacccgatcggttagctaaacaggaggagctcgaacgcgatctggcacagaggtccgaggagagaaggaaatggtttgaggccaccgacagtcgaacacctgaagttccagcgggagaggggccacggagagggctgggcgcaccacttactgaggaccaacagaatcgtctatctgaagagatagaaaaaaaatggcaagaactggagaagctcccactgagagagtag

SEQ ID NO: 244963 - DNA, 252 bp, Artificial Sequence
  Description of Artificial Sequence: Synthetic coding sequence
atgtcaatcctggacgagccgggagagcccccttctccttctctgactacaacgtctacctcccagtggaagaaacactggttcgtcctaaccgacagtagtctcaagtactatcgcgatagtactgccgaggaggcggacgaattagacggtgagatcgaccttaggtcctgtacagacgtaacggaatatgccgtgcaaaggaactacggcttccagatccacaccaaagacgcagtatataccttgtag

SEQ ID NO: 244964 - DNA, 2577 bp, Artificial Sequence
  Description of Artificial Sequence: Synthetic coding sequence
atggctgaactgagcgaagaagcactgcttagcgttctccccacaatccgggtacctaaggctggcgatagggtgcacaaagatgagtgtgctttttcgttcgatacacctgagtctgaaggcggtctgtatatctgcatgaacacgttcctcgggttcggcaagcagtacgtcgaaaggcactttaataaaaccgggcaaagggtctacttgcacctgcgccgaaccaggagacccaaagaggaggaccctgcaacgggcacaggggatcctcccagaaagaagcctacaaggctggcaataggagtggagggcggttttgacctgagtgaggaaaaattcgaactcgacgaagatgtcaagatcgtaattctcccagactatcttgagatcgctagagacgggctcggcggactcccggatatcgtccgcgatagagtcaccagcgctgttgaagctctgctgtccgcggactcagcgtccagaaagcaagaggtccaggcgtgggacggcgaagtgaggcaagtgtccaaacacgccttctccctgaaacagcttgataacccggcacgaatacccccatgtggctggaagtgctccaagtgcgacatgagagaaaatctgtggctgaatctgactgatggctcaatcctctgcggcaggagatacttcgatggctccggcggaaacaatcatgcggtggagcactaccgagaaacggggtatcctctggccgtgaagctgggcacaattacgcctgatggcgctgatgtctactcctatgacgaggacgacatggttcttgatcccagcctcgcagagcatctaagccactttggcatcgatatgctcaagatgcaaaagaccgataagaccatgaccgaattagaaattgacatgaatcagcgcatcggggaatgggagctcatccaggagtccggtgtcccccttaagcctctcttcgggcctggatatactgggattcggaacctcgggaattcctgttaccttaactctgttgtccaggttcttttctccatccccgactttcagcgaaaatatgtggataagctagaaaagatctttcagaatgctcccacagaccctacacaggactttagcacacaagtcgcgaagcttggccacgggttgctctcaggcgaatattcaaagcccgtgccagagtctggagatggcgagcgggtgcctgagcaaaaagaggttcaggacggcatagcacctagaatgttcaaagctcttatcggcaaagggcatcctgagttctctacaaaccgccagcaggacgcacaggagttctttttgcacctgatcaatatggtcgagcgaaattgcaggtcaagcgagaatccaaacgaagtattccggtttctggtggaagaaaagattaagtgcctggccaccgaaaaggtgaaatacacccagcgggtcgattatataatgcagctgccagtgccgatggatgctgccctcaacaaggaggaacttctcgaatacgaggagaaaaaacggcaggcagaggaggaaaaaatggcccttcccgagctggtgcgcgcacaggtaccgttctccagttgtctggaggcttatggcgcacctgagcaggtggacgatttctggtctaccgcattgcaggcaaaaagtgttgccgtgaaaacaacaaggtttgcctcattccccgactacctagtgatccaaattaagaaatttacctttggcctcgactgggtgcccaaaaagttggacgtttccatcgagatgccggaagaattggacatctcccagctgcgtggaaccggactgcaaccgggtgaggaggagctgcccgatatcgccccacctctagtcacccccgacgaacccaaaggctcattaggattttacgggaacgaagacgaggatagtttttgcagccctcattttagttctccaacctctcccatgcttgacgaaagtgtgataatccagcttgtagagatgggattcccgatggatgcttgcaggaaggctgtttactatacaggcaactcaggggcagaagccgctatgaattgggtaatgagccacatggacgatcccgatttcgccaatccattgatcctcccaggaagttcaggtcccggaagtacgagcgcagccgctgacccccctcctgaggactgcgtcaccaccatcgtttctatgggtttcagtagagaccaggcgctaaaggctctgagggccacaaacaacagtctagagcgtgcggtggactggattttcagccacattgacgatttggatgctgaagcagcaatggacatctccgaggggaggagcgccgctgacagcatcagtgagagtgtgcctgtcggacctaaagttcgtgatggacccggaaaatatcaactgtttgcttttatttcgcatatgggaacttcaacaatgtgcggccactatgtctgccatatcaaaaaggagggccgatgggtgatctacaacgatcaaaaggtctgcgccagcgagaagccccctaaggacctgggttatatttatttttatcagcgggtggcctcgtag

SEQ ID NO: 244965 - DNA, 750 bp, Artificial Sequence
  Description of Artificial Sequence: Synthetic coding sequence
atggcaccgagcagaaagttttttgtagggggaaactggaagatgaatgggagaaagcagtctctaggtgaactgattggcactttaaacgcagctaaggtccccgcagacaccgaagtggtgtgcgcccctcctacagcctacatcgacttcgctcgtcagaaactagaccccaaaattgctgtcgctgcacagaactgctacaaagttaccaatggggcttttaccggagaaattagccctggaatgatcaaagattgtggcgctacctgggtcgtcttggggcattcagaaaggcgacacgtgttcggggagtccgacgagctcattggacagaaagtcgctcatgcactcgctgagggactcggcgtcatcgcctgtatcggagaaaagctcgacgagcgcgaggccggtataaccgagaaagtggtctttgaacagacgaaggtcatcgccgataacgtgaaagattggagtaaagtggtgttggcctacgagccggtgtgggccatcggaacgggtaagaccgccacacctcagcaggctcaagaggtgcacgagaagctcagaggctggctgaagtctaacgtgagcgatgctgttgctcaatcaacgcggatcatctacggcggatcagtgactggagcaacttgcaaggaactcgccagccagcctgacgtggacggctttctggtgggcggtgccagtcttaaacctgaattcgtagacattattaatgccaagcagtag

SEQ ID NO: 244966 - DNA, 504 bp, Artificial Sequence
  Description of Artificial Sequence: Synthetic coding sequence
atgatcaaagactgcggtgcaacctgggtggtcttgggacattcagagcgccgacatgtgttcggcgagtccgatgaactcattggacagaaggtcgcccacgcactggctgaggggctaggagtgattgcatgtattggcgagaaacttgacgaacgtgaggccggaattacagagaaagttgtgttcgagcagaccaaagtcatcgcagacaacgttaaagattggagcaaggtggttctggcctacgagcctgtgtgggccattggaacaggcaaaaccgcaaccccccagcaagcccaggaggtccacgaaaagcttcgaggctggttaaaatcaaacgtgtccgatgctgtcgcccaaagcaccaggatcatttatggtggttcggtgaccggtgctacatgtaaggaacttgcctcccaacccgatgtcgacggcttccttgtcgggggtgcgtctttaaagccggagttcgtggacataataaatgctaaacagtag

SEQ ID NO: 244967 - DNA, 1233 bp, Artificial Sequence
  Description of Artificial Sequence: Synthetic coding sequence
atggatgtgatggaactgttggaggaggatttaacgtgtcccatatgctgctctctgttcgatgatcccagagtcctaccgtgctcccacaacttttgtaaaaaatgccttgaaggtattttagaaggctctgtgcggaatagcctgtggaggccggctcctttcaagtgcccgacttgcagaaaggagaccagtgccacagggattaacagcctccaagttaactattccctcaagggcatcgtggaaaagtacaacaagatcaagatctctcccaagatgcccgtatgcaagggacacttaggccagcctttgaatatcttctgtttaactgatatgcagctgatttgcggcatctgtgccacgaggggagaacatactaaacatgtcttctgctcgatcgaggacgcgtatgcccaggaacgggatgcattcgaaagtctttttcagtctttcgagacctggaggcgaggcgatgccctgtcacgactcgacaccctggaaacaagtaagagaaagtcactacagcttctgactaaagattctgacaaagtgaaagagttcttcgagaaactccagcataccctcgaccagaagaagaacgagatcttgtctgactttgagacgatgaaactcgctgtaatgcaggcctatgacccggagattaataaactcaatactatcctgcaggaacagaggatggccttcaatattgccgaagcctttaaagatgtctcagagcccattgtgtttctccaacagatgcaggagttccgagagaagataaaagtcatcaaggagacaccgttgccaccaagcaaccttcccgcttccccgctgatgaaaaatttcgatacttctcagtgggaagacattaaactggttgatgtggataaattatccctgccacaagataccggtacctttatttccaagattccttggtctttctataaactgtttctgctgattttactcctcgggctggtgatcgtgttcgggccaacaatgtttcttgagtggtcgctcttcgatgaccttgccacctggaaggggtgcctgagtaatttttcttcttacctcacgaagactgctgacttcattgagcagtcagtcttttattgggaacaggttactgatggtttcttcattttcaatgagcgatttaagaactttacgcttgtagtgttaaacaacgttgccgagttcgtttgtaagtacaaactcctgtag

SEQ ID NO: 244968 - DNA, 1233 bp, Artificial Sequence
  Description of Artificial Sequence: Synthetic coding sequence
atggacgtaatggaattactcgaggaggatctcacatgtccaatctgctgctctctcttcgacgaccctcgggtgctgccttgttcccacaacttctgtaaaaaatgtcttgagggaatcttagaggggtcagtccgcaattctctgtggagacccgctccattcaagtgccctacctgccgaaaagagacatcagccacagggatcaattcactgcaagtcaattacagcttgaagggaattgtggaaaagtacaataagattaaaatcagtcctaaaatgccggtctgtaagggtcatctgggccaaccacttaatatcttttgtctgaccgatatgcagttgatatgtggaatctgcgccacccgaggggagcacaccaaacatgtgttctgcagtatcgaggacgcctatgctcaggagcgcgacgcatttgagagtttgttccagtcgttcgagacttggaggaggggcgatgcattgagccgactcgacacattagagaccagcaagcgaaagagcctgcaacttctgactaaagattctgataaagtcaaggaattctttgagaaactgcagcacaccctggaccagaaaaagaacgaaatattatccgattttgaaactatgaaactagcagttatgcaagcatatgatcctgagatcaataagctgaacacaattctccaggaacagagaatggcatttaacattgctgaggcctttaaagatgtgtcagagcccattgtgttcttgcagcagatgcaagagttcagggagaagataaaagtgattaaagaaactcccctaccgccatcaaacctgcctgcatcaccactgatgaagaactttgacacaagccagtgggaggacatcaagctcgtcgacgtagacaaattgtcccttccccaggacaccgggacattcatatccaagatcccttggtcattttacaaactgttcctcttgatccttttacttgggctagtcatcgtcttcggtcccaccatgtttctcgaatggagtctgttcgatgatttagccacatggaagggctgtctctccaatttcagctcctatctgaccaagactgccgattttattgagcaatctgtcttttattgggaacaagtgactgatgggttcttcatcttcaatgagcgattcaagaatttcacactagtggtgctgaataatgtcgccgagtttgtgtgtaaatacaagctgttgtag

SEQ ID NO: 244969 - DNA, 1224 bp, Artificial Sequence
  Description of Artificial Sequence: Synthetic coding sequence
atggaacttcttgaggaagatttaacatgcccaatttgttgctccctgttcgacgaccccagagtcctgccctgcagtcataatttttgcaagaaatgtttagagggcattttagaggggtctgtgcggaactccctctggcgcccagctccctttaaatgccccacttgccgtaaggagacttccgcaacgggtattaacagcctccaagttaactattcgctgaaggggatcgtcgagaaatacaataaaatcaaaatttccccgaaaatgcccgtctgcaagggccatttaggccaacccctgaatatcttttgtctgacagatatgcagctaatctgtggcatatgtgccacaagaggcgaacatacaaaacacgtattctgtagtattgaggacgcctacgctcaggagcgggacgcatttgaatcgttattccagtcattcgagacttggcgacgaggcgatgcgctttcccgtcttgatactttagaaacctctaagaggaagtccctgcagttgctcacgaaggacagtgacaaagtaaaggagttctttgagaagctacagcacacccttgatcagaaaaagaacgaaatacttagtgatttcgagacaatgaagttggccgtgatgcaggcttacgatcccgaaattaacaaactgaatacaatcctgcaggaacaaaggatggcctttaatatcgcagaagcttttaaagatgtcagcgagccaattgtttttctgcaacaaatgcaggagtttcgcgagaagatcaaagtcatcaaagaaactccccttcccccatccaatttgccagcgtcaccgctgatgaaaaattttgatacaagtcagtgggaggatattaaattggtcgatgtcgacaaactgtcactccctcaggataccggtacatttattagtaaaataccgtggtctttttacaagttatttcttctcatcctccttcttggcttggtgatagttttcggtcccactatgttcctcgaatggagcttattcgatgacctggctacctggaaggggtgcctgagtaacttcagttcttatctgaccaagactgcagacttcattgagcagtctgttttctactgggagcaggtaaccgatggcttttttatcttcaatgaacggttcaagaacttcacgttggtggtgttgaacaatgtggcggagttcgtgtgcaagtataagctcttgtag

SEQ ID NO: 244970 - DNA, 801 bp, Artificial Sequence
  Description of Artificial Sequence: Synthetic coding sequence
atggagcttctggaggaggatctaacctgccccatttgttgtagcctcttcgatgaccctagagttctcccctgttctcacaatttctgtaagaaatgtttagagggtattttggaaggaagcgtgagaaatagtctttggaggcctgcaccgttcaagtgtcccacctgcaggaaagagacctctgccacgggcatcaacagcctgcaggtgaattacagcctgaaagggatcgtcgaaaagtacaataagatcaagatatcccccaagatgcccgtttgtaaggggcatctcgggcagccccttaatatcttttgcttaactgacatgcagttaatttgcggcatctgtgccactcgcggagagcacactaaacacgtgttttgctcaatcgaggacgcatacgcgcaggaacgagacgcattcgagagcctgtttcagagctttgagacctggcggagaggggatgctcttagtcgactcgacacgctggagactagtaagagaaagagcctacagttgctgaccaaggatagtgacaaggtgaaagagttttttgagaaacttcagcacacactggatcagaagaagaacgagattttgagcgacttcgagaccatgaaacttgccgtcatgcaggcatatgatcccgaaatcaataagttaaacacaatattacaggaacagaggatggcattcaatatcgcggaagcatttaaagatgtgagtgagccgatcgtgttcctgcagcagatgcaggagtttagggaaaagattaaagtgataaaggagaccccctag

SEQ ID NO: 244971 - DNA, 1224 bp, Artificial Sequence
  Description of Artificial Sequence: Synthetic coding sequence
atggagttgctggaggaggatctgacctgccccatttgttgcagcctctttgacgatcccagggtactgccctgctctcacaacttttgcaaaaagtgcctggaaggtatcctggaaggttccgtgcgcaatagcctgtggcggcctgccccattcaagtgccccacctgccgcaaagagaccagcgccacgggtatcaacagcctgcaagtgaactactctttaaaaggaatcgtggaaaaatacaacaagattaagatctccccaaagatgcctgtgtgtaagggccatttgggccagcccttaaatatattttgcctcacggacatgcagcttatatgcggcatctgcgccacccgaggcgagcacaccaaacatgttttttgctccatagaggatgcttatgcccaggaacgggacgcgttcgagagtctattccagtcatttgagacttggagacggggagacgccctgtcacgcctggataccctcgagacctctaagaggaagtccctgcagctccttactaaggactccgataaggttaaagagttttttgagaagctgcaacatacactcgaccagaaaaaaaacgagattctgagcgattttgaaaccatgaaactggcagtcatgcaggcatatgatccggagattaataagctgaataccattttacaggagcagcgcatggcctttaacatcgccgaggcgtttaaagatgtgagtgaacccattgtgtttttacagcagatgcaggaatttcgtgagaagataaaggtgatcaaagaaactcccctgcctcctagcaacctcccggcttcaccccttatgaaaaactttgacacatctcagtgggaagacattaaacttgtggatgttgataaattaagccttccccaggacaccggcacgtttatctcaaagatcccctggtccttttacaaactgtttctactcattctgctgctgggactagtgatagtatttggtccaacaatgttcctggaatggtccctgtttgacgacctagccacatggaaagggtgtctttctaactttagctcttatctgacaaagaccgctgacttcattgagcagtccgtattctattgggagcaggttactgatggctttttcatatttaatgaacgctttaaaaacttcacacttgtcgtcctcaacaatgtggctgagtttgtatgtaagtacaagctgctgtag

SEQ ID NO: 244972 - DNA, 390 bp, Artificial Sequence
  Description of Artificial Sequence: Synthetic coding sequence
atggagctgctggaagaggacctgacgtgccccatatgttgctcactgttcgacgatccaagggtcctgccgtgttcacataacttctgtaaaaaatgcctggaaggaatcctcgagggctcagtgagaaattctctctggcggccagcaccttttaagtgccctacttgccgaaaggagacttcagcaacaggtattaattctttgcaggtgaattactctctgaagggcattgttgaaaagtataacaagatcaagataagtccaaagatgcctgtgtgcaaaggtcacctgggacagcccctaaacatattttgccttaccgacatgcaacttatctgtggcatatgcgccactcgaggcgagcataccaagcatgtgttttgctag

SEQ ID NO: 244973 - DNA, 1224 bp, Artificial Sequence
  Description of Artificial Sequence: Synthetic coding sequence
atggaactgttagaggaagatctcacgtgcccgatctgttgctccctgttcgatgaccctcgcgtgttgccctgcagtcataatttctgcaagaaatgtctcgagggtatcctcgagggaagcgtgcggaattcattgtggagacctgccccattcaagtgcccgacctgccgcaaggaaactagtgccaccgggattaacagcttgcaggtgaactatagcctgaaagggatcgtagaaaaatataataagatcaaaatatctcctaagatgccagtgtgtaaaggacatctgggacaacctctgaacattttctgtttgaccgacatgcaactgatttgcggcatttgtgcaacaaggggggaacacaccaagcatgtgttctgctcaattgaagacgcctatgcccaagagagggacgcttttgaatctctgttccagtccttcgaaacgtggaggcggggagacgcccttagtcggctggatactcttgagacttctaaacggaaaagcctccagctccttacaaaggattcggacaaggttaaggaattcttcgaaaaactgcaacacactttggatcagaagaagaatgagattctgtccgattttgaaacaatgaaactcgctgtgatgcaggcttatgaccctgagatcaataaacttaacaccattctgcaggaacaaagaatggcattcaacattgctgaggcatttaaggacgtgtcagagccgattgtcttcctgcagcaaatgcaggagtttcgagaaaagattaaggtcatcaaagaaacccccttacctccgtcaaatctgccagcaagtcccctcatgaagaactttgataccagccagtgggaggatatcaaactggtggatgtggataagttaagcttgccccaagacacgggtactttcatatctaagatcccatggagcttttacaagctatttctcttgatcctcttgttaggcttggtgatcgtctttggaccaacaatgttcctcgaatggtcactgttcgatgatcttgccacctggaagggctgccttagcaatttcagcagctatctcacgaaaacagccgacttcattgagcagtcagttttttattgggaacaggtcacagacgggttctttattttcaacgaaaggttcaagaacttcacactggtggtccttaataatgtcgctgagttcgtctgcaaatacaaactgctctag

SEQ ID NO: 244974 - DNA, 669 bp, Artificial Sequence
  Description of Artificial Sequence: Synthetic coding sequence
atgaatgacttgtctaaccgcgtttggtcgatcagccaggagccagatccggtccagagactccaagcctacactgccaccgagcaagagatgcagcagcagatgagcctgggggaactatgtcaccctgtgccgctttctttcgaaccagtgaagagcttttttaagggcctcgtggaagcagtggaatctacactacagactcctctggatattcgattgaaggaatctatcaactgccaacttagcgatccttcctccacaaaacctggcaccttactgaaaacctccccaagcccggagcgatcactgctactgaagagttgctgggccgcatggggcccatgtccctgttgtgggagtacacgaagcggcaagtgttggctggttacagctagcccacccgctgccaccacgggcaggcttacctgtcgccgacgcgctcccgcaggaggatgggcacgcccaacacccccattcggtgccgctgggccaaggccaccacctgcttgggccgctacggcctccccaggagcctcttccgctacaactttgagcactggcccttctacgacagcctccgcagctgcctgtgggccagccacaaccagcactggctctgccagttcctggacaacacggcctgctagctccccaagcaccacttag

SEQ ID NO: 244975 - DNA, 1329 bp, Artificial Sequence
  Description of Artificial Sequence: Synthetic coding sequence
atggcaggggctgccacagggtcacgaaccccgggtcgctctgagctcgtggaggggtgtggatggcgttgtcccgaacacggtgaccgcgtggctgagctgttttgccggaggtgccgtcgatgtgtctgcgccttgtgccccgtgctcggagctcatcgcggacatcccgtcgggttggcgcttgaagcggcagttcatgtgcagaaattgtctcaagagtgtctgaagcagctcgccatcaagaaacagcagcatatcgacaatatcacccagattgaggatgccaccgagaaacttaaagccaacgcagaaagctccaagacatggctgaaagggaagtttaccgagttgcgcttgctgcttgacgaagaggaggctctcgccaagaagttcattgacaaaaatacacagctgacattgcaggtttatagggagcaggccgactcttgtcgagagcagctcgacatcatgaacgacctgtcaaacagggtgtggtccatctcacaggaacctgaccccgtgcagagactgcaggcttataccgccaccgaacaggagatgcagcagcagatgagcctgggggagctttgtcatccagtcccgctctcttttgaacctgtgaagagcttcttcaaaggcctggtagaagccgtggaaagcactctgcagacccctcttgacattaggctcaaggaaagtatcaactgtcagctgtccgacccaagtagcaccaagccaggaaccctgctaaagacctcccccagcccagaacgctcactcctgttgaagtatgccaggacacctaccctggacccagatactatgcacgcaagacttcggctcagcgccgatcgacttaccgtccgctgcgggctattagggtcgctgggcccagtgcccgttctgcgctttgatgcgctctggcaggtcctcgccagggactgtttcgcaactggacgccattattgggaggtcgacgtccaagaggctggggcaggttggtgggtcggcgcagcgtatgcaagtcttcgtaggcgcggtgctagtgctgccgctcgcctcggttgcaatcggcagtcctggtgcctgaagagatacgacctcgagtactgggcattccacgatgggcaaaggtcccggttacggccacgagatgaccttgatcgccttggcgtctttctggactatgaggcaggcgtgctcgcgttctatgacgtcactggcggtatgagccaccttcatacctttagggccacctttcaagagcctctttaccctgctcttagattgtgggaaggagcgatttccatcccaagactgccatag

SEQ ID NO: 244976 - DNA, 1329 bp, Artificial Sequence
  Description of Artificial Sequence: Synthetic coding sequence
atggcaggagctgctacgggaagccggacacccggtcgttcagaactggtggagggatgtggctggcgatgcccagaacatggagatagagtcgcagagcttttctgtagacgctgtaggcggtgcgtctgtgccttgtgccctgtgctgggggctcatagaggtcatcccgtagggctggcactggaggccgcagtccacgtccagaaactgagtcaggagtgtctgaagcagttggccatcaagaagcagcagcatatcgataatataactcagatagaggacgccaccgaaaagctgaaagctaatgccgagagctccaagacttggctgaagggcaagtttactgaacttcgattgctgctcgatgaagaagaggcgctggctaaaaaatttattgataaaaacacacagctgacgttacaagtgtatagggaacaggcggattcctgtcgagagcagcttgatattatgaatgacctttctaatcgtgtttggtccattagccaggagcccgatcccgtgcaaaggctacaggcatacacagccactgagcaagagatgcagcagcagatgtcactcggcgagctgtgccatccggttcctctttcgtttgagccagtgaaatcatttttcaaaggacttgtggaggccgtagaatcgactctacagacacctttagatattaggcttaaggaatctatcaactgccaactgagtgacccttcctccactaagcccggaacattgctaaaaacttccccaagtcccgaacgcagcctgctgctaaaatatgcacggactccaacacttgatccggataccatgcacgccagactgcggttaagcgcggacagacttaccgtccgttgcggactcttgggaagcttggggccagtgcctgtactgagattcgatgccctgtggcaggtgctcgccagggactgcttcgccacaggcagacactattgggaagttgatgtacaggaagccggtgctggctggtgggtcggtgccgcatacgcaagcctacgaagaaggggcgcatcagccgcagccaggctggggtgtaataggcagtcctggtgtctcaagcgctatgatcttgagtattgggccttccacgacgggcaacggagccgtttgagaccacgggatgatctggatagattaggggttttcctggactacgaggctggagtcctcgccttttatgatgtgacagggggaatgtctcacctgcatactttccgcgcaacattccaggaacccctgtacccagctctgcgcctgtgggagggcgctatatctatccccaggctgccatag

SEQ ID NO: 244977 - DNA, 1221 bp, Artificial Sequence
  Description of Artificial Sequence: Synthetic coding sequence
atggctggcgcagcgacaggttctcggactccagggcgtagcgaacttgtcgaaggctgtggatggcgctgccccgaacatggggacagagttgcggagctgttctgtcggaggtgtcggaggtgcgtctgtgcactgtgtccagtactcggagcacatcgcggacaccctgtcgggctcgcactggaagccgcagttcacgtgcaaaagctgtcccaggagtgcctgaaacagctcgcaattaagaagcagcagcatatcgataatataacccagatcgaggatgccactgaaaagctgaaagcgaacgccgagagttctaagacctggctgaagggcaagtttactgagcttcggctcctgctggacgaggaggaggctctggcaaaaaagttcatagacaaaaacacccagttaacactgcaggtgtaccgcgaacaagctgacagctgtcgcgagcaactggacatcatgaatgatttgtcaaatcgggtgtggtcgatcagtcaggagcccgaccccgtgcagcgcttgcaggcgtacacagctaccgagcaggagatgcagcaacaaatgagcctcggagaactctgtcaccccgttcctctctcctttgagcccgtgaagagcttctttaaagggctggtcgaggctgttgagagtaccctccagacaccgttagacattcggctgaaagaatcgataaattgccagctgagcgatcccagctccactaagccagggaccctccttaagacctcaccaagtcctgaaaggtcccttctgctgaagtacgccaggacacccactctggaccctgacactatgcacgctcgcttgcgcctctccgctgatcgactgaccgtccgctgtgggttgctcggttccttaggtccagtgcctgtgttgcgtttcgatgcactgtggcaagtcctcgccagggattgcttcgccactggaagacactactgggaggtggatgtgcaagaggcgggagcgggatggtgggtgggggctgcatatgcctctttgcgtcgtaggggggcatccgccgcagccagactggggtgcaacagacaatcttggtgtctcaaacgctacgatctcgaatattgggcttttcacgacggccaacggtccgcctgcggaccggcaacaactagtacaggttctgcttcctcgtggacaacaagacccgcttcaagtcccagtacaacctag

SEQ ID NO: 244978 - DNA, 762 bp, Artificial Sequence
  Description of Artificial Sequence: Synthetic coding sequence
atggcaggagctgctacgggatcaaggacccctggtagatccgaactcgtggagggttgcggctggcggtgccccgaacatggcgaccgagttgccgaattattttgcagacgctgtagacgctgcgtgtgtgctctctgtccagtcctgggggcacatcggggacatcccgtgggcctcgctctggaggcagccgtgcatgtccagaaactgagccaagaatgcctgaaacagctggccatcaaaaaacaacagcacatagacaacatcactcagatcgaggatgccacagaaaagctaaaagccaatgccgagagtagcaaaacctggttgaagggtaagttcaccgaattgcgcctgctcctagacgaggaggaggcacttgctaaaaagtttattgacaagaacacccaactaacccttcaggtctacagagaacaggcagattcctgccgcgagcagctggatataatgaacgatctctccaacagagtgtggtctatttcacaagagccagatccagttcagcgcctccaggcctacaccgccactgaacaggagatgcagcagcaaatgtcactgggagaactttgccaccctgtcccactttccttcgagccagtgaagagcttctttaaaggcctggtggaggccgtcgagtcgactctacaaacaccactggatatccggcttagtcccacgaatcatgcctacagcgcccttaaggtcagctccccgaggctggtttccaatcgcccttag

SEQ ID NO: 244979 - DNA, 1329 bp, Artificial Sequence
  Description of Artificial Sequence: Synthetic coding sequence
atggccggagctgcaacaggatctcggactcccggaaggagcgagctggtggagggatgcgggtggcgttgtcccgagcacggagatagggtcgccgagctgttctgtaggagatgtaggcggtgcgtgtgcgcactgtgtccagtcctcggcgctcatagggggcaccctgtcggcctggcattagaagcagcagtgcacgtgcagaaactgagccaggagtgcctaaagcaactcgcaattaaaaagcagcaacacatcgacaacatcacccaaattgaagacgctacggaaaagctgaaggcaaacgcagaatctagcaaaacatggctgaagggcaagtttaccgaactcagattgttactggacgaagaagaggccctcgcaaagaagtttatagacaaaaatacgcagttaaccctgcaagtctatcgagagcaggccgattcttgccgggagcagttggatatcatgaacgatctttctaacagagtgtggagcatcagccaggagcctgatcccgtgcagcggctccaagcctacacagcgaccgaacaagagatgcaacagcagatgtctctgggcgagctctgtcacccggtgcccttgtcatttgaacccgtcaaatccttttttaaggggctcgtggaggcagtcgagagcacattacaaaccccactggatatccgcttgaaagagagcattaattgtcagctgagtgacccatcttcgacaaagccaggcactcttctgaagacgagtccttctcctgagcgatccctgctgctaaagtatgccagaacaccaaccttggatcccgacacaatgcacgcccgtctgcgactgagcgctgatcggctgaccgtgcgttgcggtctcctgggctccctgggcccagtgccagtattgagattcgatgcgctttggcaagtgctggctcgagactgcttcgcgacggggaggcattactgggaggtcgatgtccaggaggctggggcaggctggtgggtgggagccgcttacgccagtctgcgcagacggggagcgtccgcagcagcaaggctgggttgtaataggcagtcctggtgtctgaagcggtacgatttagaatactgggccttccacgatgggcagagatctagattgaggcctcgcgacgatctggacaggctaggtgtgttcctcgactacgaggccggagtgcttgccttctatgatgtaaccggcggaatgtctcacttgcatacttttagagctacctttcaggagccgctgtacccggctcttcggctgtgggagggtgccataagcattcccagacttccctag

SEQ ID NO: 244980 - DNA, 672 bp, Artificial Sequence
  Description of Artificial Sequence: Synthetic coding sequence
atgtcagccggatcagatggcggtggccgtcatttttgcgggggtattaactgtcagctgagcgatccatcctcgacaaagcctggaactctgttaaagacatcgcccagtcctgaacggagtctgcttctgaagtacgcgaggactcccaccctagatcctgacacaatgcacgcgcgattgagattatccgctgaccgcctgactgtgaggtgtggcctcctaggctcactgggccctgtccctgttcttcgcttcgacgctctctggcaggtgttggcacgtgactgttttgcaaccggaaggcactattgggaggtggatgtgcaggaggcaggcgctgggtggtgggtgggtgctgcctacgcctccctcagacgaaggggggcttcagccgctgcgagattgggctgcaacagacagagctggtgtttgaagaggtacgacttagaatattgggccttccatgacggccagcggtctagactgcggccaagagatgatcttgaccgcctaggggttttcttggactatgaagccggagtcctggctttttacgacgtgaccggagggatgagccacctgcatacctttcgcgcaacgtttcaggagcctctgtatcccgctctcagactgtgggagggtgccataagtataccaagactgccttag

SEQ ID NO: 244981 - DNA, 2316 bp, Artificial Sequence
  Description of Artificial Sequence: Synthetic coding sequence
atgcaccgaagtggaaggtacggtacccagcagcagagggcaggtagcaagactgctggccctccctgccagtggtcccgaatggcgtcagaaggcacaaacattcctagtcccgtagtccgacagattgacaaacaatttctgatctgcagcatttgtttagaacgctataagaacccaaaggtgcttccttgtcttcatacgttctgtgagcgctgcctgcaaaactacatccctgcccactcgctaactctgtcctgtccggtatgtcgccaaacctctatcctgccggaaaaaggcgtcgctgccttacaaaacaatttctttatcactaacctgatggacgtactgcagcgcactccgggttcaaacgccgaagagagcagtatccttgagacagtcacagctgttgcagccggtaagccattatcttgtcctaatcatgacgggaatgtgatggagttctactgtcagagttgcgaaactgccatgtgtagagagtgcactgagggggaacatgccgagcatccaactgttccactcaaggacgtggtggaacagcataaggcgtcgctccaagtgcagctagatgctgtgaacaaacgcctgccagagattgactcagcactacaatttatttccgagattatccatcaactgactaatcagaaggccagcatcgttgacgacatccactcaacattcgatgagttgcaaaaaactctaaatgtgcggaagtcagtcttactgatggaactggaggtgaattacggcctcaagcacaaagttctgcagagtcagcttgacaccctgcttcaagggcaagagagtattaagagttgctcaaattttactgctcaggccctgaatcatggaactgaaaccgaggtgctcctagtgaagaagcaaatgtccgaaaagctcaacgaactcgctgaccaagattttccactccatcctagagagaatgaccagctagatttcatcgtggagactgaaggactgaagaagtctattcacaacttgggaactattttaacgacaaacgccgtcgcaagcgaaaccgtcgcgaccggcgaaggactgaggcagacgataattgggcagcccatgtctgtgaccatcaccacaaaggataaggacggcgagctgtgcaaaactggaaacgcttacctgaccgctgaactgtccacccctgacgggtccgtggcagatggagagatattagacaacaaaaatgggacatatgaattcctatatacggttcaaaaggagggtgacttcacactgtctttgcggctctatgatcaacatattagggggtctccgttcaagttgaaagtcattagatctgccgacgttagtcctaccaccgagggcgtgaaaaggcgagtgaagagcccgggaagtggtcacgtgaaacagaaggcagtaaaacgtccagctagcatgtattccactggaaaacggaaagaaaaccccatagaagatgacctgatattccgtgttgggactaaaggacggaataagggggaattcaccaatctgcaaggagtggctgctagcacgaatggaaaaatcttgattgcagatagtaacaatcaatgtgtccagattttttcaaacgacgggcagttcaaaagccgctttggaattcggggtcggagcccgggacagctgcagcgacctaccggggtggcagtccacccatcaggggatatcatcatcgctgattacgacaacaaatgggtgagcatattttcttctgatggcaaattcaaaaccaaaatcggatctggtaagctcatgggtccaaagggtgtaagtgtagatcgaaatggacatatcattgtcgtggacaacaaggcctgctgtgtctttatcttccaacccaatggaaaaatcgtcacccgctttggatctcggggtaacggggacagacagtttgccggtccacactttgccgcagtgaacagcaacaacgagatcattattactgattttcataatcacagcgtgaaagttttcaatcaggagggcgaatttatgcttaaattcggcagtaatggagaaggaaatggccaatttaacgctccaaccggagttgccgtggactctaatgggaacattattgtcgccgattgggggaactctaggattcaggtgttcgatggatcgggaagcttcctgtcttacattaataccagtgcagatccattatacggcccacaggggctggctcttacatctgatggccatgtcgtcgtcgccgactctggaaaccattgcttcaaagtttatcgatatctccagtag

SEQ ID NO: 244982 - DNA, 2235 bp, Artificial Sequence
  Description of Artificial Sequence: Synthetic coding sequence
atggcttccgagggcacaaacatccctagtcccgtagtcaggcagatagacaagcagttcctcatctgttcaatttgccttgaaaggtataagaatcctaaagttctgccatgtttgcataccttctgtgagcgctgccttcagaattacatccccgctcattcactcactttgtcttgcccagtatgtcgacagaccagcatactaccagagaaaggggtggctgcactgcaaaacaatttctttatcacaaacttgatggacgtgctgcagaggacccctgggagcaacgctgaagaaagcagcatactcgagaccgtcacagccgtggctgcaggcaaacctctgagttgccccaaccatgacggcaatgtcatggagttctactgccaatcctgtgaaactgctatgtgtcgcgagtgcaccgagggggaacatgctgagcaccctacggtgccactgaaagacgtggtcgaacaacacaaggcctctttgcaagtacagctagacgccgtcaacaaacggctgccagaaatagacagcgcactgcagtttattagcgagatcatccaccaactcaccaaccaaaaagccagtattgttgatgatatccatagcactttcgacgagctgcagaagacccttaacgtgaggaagtctgtgctcttgatggaactggaggtcaattacggactaaaacataaagtgctgcaatcacagctggacaccctcctgcagggacaggaatctattaagtcctgttcaaatttcacagcccaggcactcaatcacgggacagagaccgaagtcctgctggtaaagaaacagatgagtgaaaagctcaatgagctggcagaccaggattttcctctgcatccaagagagaacgaccaactggattttatcgttgaaacagaaggtctgaagaagagcatccacaatctcgggaccatcctaaccaccaatgctgtggcctccgaaacagtggcgactggggaagggctcagacagactatcatcggacagccgatgagtgttaccatcactaccaaagacaaggatggagaactttgcaaaaccggaaatgcctatctcacagcggagctgtccactcctgacggaagtgtcgctgatggtgaaatcctagacaataagaatggtacctacgagtttctgtacaccgttcaaaaggagggggacttcaccttgagcctccgactttacgaccaacacatccggggaagtccctttaagttaaaagtaattcggtctgccgacgtttcaccgacgactgaaggcgtgaagcgccgagtcaagagccctggcagtggacatgtaaagcagaaggcggtgaagcgtcccgcatcgatgtattctacaggaaaacgaaaagagaacccgatcgaggatgacctgattttccgcgtcggcactaaggggaggaataaaggagagttcacaaatcttcagggagtagctgcaagcactaacggcaaaatcctgatcgccgactctaataaccaatgtgtgcagatctttagcaacgatggtcaattcaaatccagattcggtataaggggcaggtcccccggacagctgcaaaggcctactggcgtggccgtacacccctcaggtgacattattatagcggactacgacaacaaatgggtgagcattttctctagcgatggcaagtttaagaccaagataggaagtggcaaacttatgggccctaaaggggtgagcgtggatcgtaacggccatattatcgttgtagacaataaggcttgctgcgtgttcatcttccagcccaacggaaaaatcgtcactcggtttggctccagaggtaacggcgataggcagttcgcgggaccacattttgcagccgtgaattcaaataatgagataataatcaccgacttccacaatcacagtgtcaaagttttcaaccaggaaggggaattcatgctgaaatttggatctaacggcgaggggaacgggcaatttaacgctccaacgggggtcgcagtcgacagtaacggcaacattatcgtggcagattggggtaactctcggatccaggtgttcgacggcagcggctcattcctgtcctatataaacacaagcgccgaccccctctacgggcctcaggggctcgccttgacgagcgacggacacgtggtagttgccgactctggaaatcattgcttcaaagtataccgctacctgcagtag

SEQ ID NO: 244983 - DNA, 1428 bp, Artificial Sequence
  Description of Artificial Sequence: Synthetic coding sequence
atggcctctgcggctaggctgactatgatgtgggaagaggtaacatgtcccatttgcttggatcctttcgttgagccagttagcattgagtgcggccactcgttttgccaggaatgtatatctcaagttggcaaaggaggcggtagtgtgtgtcctgtatgcaggcaacggttcctgctaaaaaacctgagacccaatcgacagctggcaaatatggtcaacaatttaaaggaaatctcacaggaggccagagaaggtactcagggggaacggtgcgctgtgcatggagaacggttacatttgttctgcgagaaggatggtaaggctctgtgctgggtgtgcgcccagtcgaggaagcaccgcgatcacgctatggtcccacttgaagaagcggctcaggagtaccaggagaagctccaggtggccttaggagagctgcggaggaagcaggaacttgctgagaaacttgaagtcgagattgcgattaagcgggcagactggaagaaaaccgtggaaacacagaagagcagaatccatgcagaatttgtccaacaaaagaatttccttgtcgaggaggagcagagacagctgcaggaactggagaaggatgaaagggagcaactcagaatactcggggaaaaggaggcaaagctggctcagcagtctcaggccctgcaggaattgatctcagagttggatcgacgctgccactccagtgccttagaactgttgcaggaggtgataatcgtgctggagcggtccgagtcgtggaacctgaaggaccttgatatcacgagcccagaactcaggtctgtatgtcacgtgccaggactgaaaaagatgcttagaacgtgtgctgtacacattacgctggatcccgataccgctaatccctggctgatcctgagtgaggacagacggcaggttagactgggagacacccagcaaagtatcccgggaaacgaggagaggttcgactcataccccatggtactcggtgcccagcactttcactcgggcaagcactactgggaggtcgatgtcacgggaaaggaggcctgggatctcggagtgtgccgcgattctgtccgacggaagggccatttcctcctgtctagcaagagcggcttttggaccatttggttgtggaacaaacagaagtacgaggcaggtacatatccacagacccctctgcatctgcaggtacctccatgccaggtggggatctttctggattacgaagcgggaatggtgagtttctataacattacagaccacggtagtctcatctactctttctctgagtgtgcttttacaggccctctccggccattttttagccccggatttaacgatggaggcaaaaacaccgctccattgaccttatgcccactgaacatagggtcgcagggaagtaccgactactag

SEQ ID NO: 244984 - DNA, 1428 bp, Artificial Sequence
  Description of Artificial Sequence: Synthetic coding sequence
atggcctcagccgctcgtctgacaatgatgtgggaggaagtgacttgtccaatttgccttgatcctttcgtagaacccgtatcaatcgaatgcggtcatagcttctgtcaggagtgtatcagtcaggtcggaaaaggcggtgggtctgtatgcccagtatgtcgccaacgcttcctactgaaaaatctcaggcccaaccgccagcttgccaatatggtgaataatctgaaggagatatctcaggaagccagggaggggactcagggggaaagatgtgcagttcacggggagcgtctacatttattctgcgaaaaagacggcaaagctctatgttgggtttgtgctcagtctcgcaagcacagagatcacgccatggttcccctggaggaggctgcgcaggagtaccaggagaagttgcaggtcgccctgggggagctcaggcggaagcaggagctggccgagaagctggaagtagagatcgccatcaaacgcgctgactggaaaaaaactgtagagacccagaagtctagaatccacgcggagttcgtgcagcaaaaaaacttcctggtggaagaagagcagcgccaattgcaggagctggagaaggacgagcgggaacagctccgaattctgggggagaaggaagctaaactcgcacagcaatcacaggccctgcaggaactcattagcgagctagataggcggtgccattcatccgcactagagttattacaggaggtaatagtgctgggcccaaggtccgagagctggaacctgaaggacctggacattacttcacccgaacttaggtcggtgtgccacgtccccggtcttaagaaaatgctgagaacgtgcgctgtccatattacactggaccccgatacagctaacccatggctgattcttagcgaagacagacgacaggtgaggctgggggacactcagcagtcaattcccggtaatgaggaaaggttcgattcctacccaatggttctgggtgctcagcacttccactctgggaagcactattgggaggttgacgtgacaggtaaagaagcttgggatttgggcgtgtgtcgcgattccgtccggagaaagggacacttcctgttgagcagcaagagtgggttctggacaatctggctgtggaacaaacaaaagtatgaggctggcacatacccccagacacctctccatcttcaggtgcccccttgtcaagttgggatcttcctagattatgaggccggaatggtgtccttttataacatcacggaccacggcagtctgatctattcctttagcgaatgtgcattcactggcccactgcgacccttcttctctcccggattcaacgatggaggaaaaaacactgctccactcacactgtgccctcttaacatcggctcccagggcagtacggactattag

SEQ ID NO: 244985 - DNA, 1497 bp, Artificial Sequence
  Description of Artificial Sequence: Synthetic coding sequence
atggacttttcagtcaaagttgacatcgaaaaggaagttacttgccctatctgcttagagctgcttacagagcctctgtctttggactgtgggcactccttctgccaggcctgcatcacagctaaaatcaaggaatctgttatcattagtcggggagaatcgtcttgccccgtgtgtcagaccagattccagcctgggaaccttcggccaaatcgccacctggccaacattgtggaaagggtgaaggaggtgaagatgtccccacaggagggacagaaaagggacgtttgtgagcaccatggaaagaaattacaaattttttgtaaagaagatggtaaggtgatttgttgggtctgtgagttatcccaagagcaccagggccaccagacctttcgaattaacgaggtcgttaaggagtgccaggagaagctccaggtggctctgcagagacttattaaagaagatcaggaagcagagaaactcgaggacgacattaggcaggagcggacagcctggaaaaattatatccagatcgagaggcagaagatacttaaaggcttcaacgagatgcgcgtgatcctggacaatgaggagcagcgcgagttgcagaagttggaagagggcgaggtcaatgtcttggataacttggcagccgcaaccgatcaactggtccagcagaggcaggacgctagcaccttaatttcggaccttcagaggagacttcgcggttcctctgttgagatgctgcaggacgtgattgatgtcatgaaacgtagtgagagttggaccctaaaaaagcccaaaagtgtatccaagaagcttaaatctgtattcagagtccccgacctctccggtatgttgcaagtcctaaaagagctgacagatgtacaatattactgggttgatgtcatgctgaacccaggaagcgcaacaagcaacgtagctatcagtgtggaccagcgacaggttaagactgtgagaacttgcacctttaagaacagcaacccctgtgattttagcgcattcggcgtctttggttgccaatacttctcatcaggcaagtattattgggaggtagacgtctctggcaagatagcctggattctcggcgtgcactccaagatatcatctttgaacaaacgtaaaagtagcggatttgcctttgatcctagtgtgaactactcaaaagtgtactctaggtatagaccacagtacggctattgggtgataggacttcagaatacttgtgagtacaacgcatttgaggattcttcttcttctgaccccaaggtgttgacattattcatggctgtgcctccttgcaggattggcgtgttccttgactacgaagcaggaattgtgagtttcttcaacgtgactaaccatggagcactgatctataagttctctgggtgccgattttctcgccctgcgtatccgtatttcaatccatggaactgcttagtgccgatgactgtttgccccccaagtagttag

SEQ ID NO: 244986 - DNA, 684 bp, Artificial Sequence
  Description of Artificial Sequence: Synthetic coding sequence
atggatttctccgtgaaggtggacatcgagaaggaagtgacatgtccaatctgcctcgaacttctgactgagccgctgagcctcgactgtggccatagtttttgccaggcctgcatcaccgccaaaatcaaggaatctgtcattatcagccgaggtgaaagctcctgccccgtgtgccagacccggtttcaaccagggaaccttcggcctaacaggcatctagccaacatcgtcgagagagttaaagaagtcaaaatgagccctcaagaggggcagaagagggacgtgtgtgagcatcacgggaagaaactgcagatcttctgcaaggaagacggcaaggtgatctgctgggtttgcgaactctcccaagaacatcaaggccatcagacatttcgcattaacgaagtggtcaaggagtgccaagagaagctccaggttgccctgcagagactgattaaggaggaccaggaagctgagaaattagaagatgatatccgccaggaacgcacagcctggaaaaactatatccaaattgagaggcagaagatcctcaagggcttcaacgaaatgcgtgttatacttgacaatgaggagcagagagaacttcagaagctggaagaaggcgaggtgaatgtgctggacaatctagctgcagcgacagaccagctggtgcaacagaggtag

SEQ ID NO: 244987 - DNA, 612 bp, Artificial Sequence
  Description of Artificial Sequence: Synthetic coding sequence
atggactttagcgttaaagtcgacatagagaaggaggtgacctgcccaatctgcctggagctactgactgagcctctgtcccttgactgtggccactcattctgccaggcctgcatcacagcgaagatcaaggaatcagtcatcatttcacgtggagagtcctcttgtcctgtttgccagactcggttccaacccggaaacttgagaccaaatcggcatctcgcaaatatcgtggagcgcgtgaaggaggttaagatgtctcctcaggaggggcaaaaaagggacgtttgtgaacaccacggcaaaaagcttcagattttttgtaaagaggacggtaaagtgatttgttgggtctgcgagctgagccaggagcaccaaggccaccaaacctttcgaatcaacgaagtcgtcaaggagtgccaggagaaactgcaggttgcgctccagaggctcattaaagaggaccaagaagccgagaaactggaagatgacattcgtcaggagagaacagcttggaagaactatatccagatagaaagacagaaaattttgaagggcttcaacgaaatgcgggtaattcttgataacgaagagcagcgggagcttcagtag

SEQ ID NO: 244988 - DNA, 1263 bp, Artificial Sequence
  Description of Artificial Sequence: Synthetic coding sequence
atggacttttctgtgaaagttgacattgagaaggaggtgacctgtccgatatgtctggaactcttgacggaaccactgtccctggattgcggtcactccttctgtcaagcctgcatcacggctaagatcaaggagagcgtcattatttctcgcggtgagagctcctgtccagtgtgtcagaccaggttccaaccaggaaacttacgaccgaatagacacctggcaaatatagtggagagagtcaaagaagtcaaaatgagcccacaggagggccagaagagagatgtgtgcgagcatcacggcaagaaattacaaatattctgcaaggaggacggaaaagtaattttagataatgaggagcagcgcgaattacagaaacttgaagagggcgaagtgaacgttctcgataaccttgccgcagccacagaccagctggtgcagcagcgccaagacgccagcaccttaatctcagacttgcaaaggcgactgcgcggttcctcagtggagatgctgcaggacgtgattgacgtgatgaaacggtccgagagttggacgcttaagaagcccaaatcagtatcaaaaaagctgaagtccgtattcagggtgccggacctgtctgggatgctgcaagtgctgaaagagctcaccgatgtccagtattattgggtggacgtcatgttgaatccaggctcagcaacttccaatgtggccattagtgtcgatcagagacaagtgaaaaccgtaaggacctgtacctttaaaaactcaaatccatgcgatttctctgctttcggggtgttcggctgccagtacttctctagtggtaaatattactgggaggtggatgtgtctggtaagatcgcttggatattgggggtgcattcaaaaatatcctccctgaacaagcgcaagagttccggcttcgcattcgatccgtcagtaaactactcaaaagtctattcacgttatcggcctcagtacggatactgggtgatcggactgcagaatacgtgtgaatataacgcattcgaggacagttctagttctgaccccaaagtgctgactctctttatggctgttcctccttgtagaatcggagtcttcctggattacgaagctggaatcgttagcttttttaatgtgactaaccacggcgcactgatttataaattttcgggatgtcgcttcagccgacctgcatatccttatttcaatccgtggaactgtttggtccccatgaccgtctgtcctccaagctcttag

SEQ ID NO: 244989 - DNA, 930 bp, Artificial Sequence
  Description of Artificial Sequence: Synthetic coding sequence
atgagagtcatcctggacaacgaggaacagagagaattgcagaagttagaagagggcgaggtgaacgtactcgacaacctcgccgctgctacggatcagctcgttcagcagcggcaggacgcttccaccctgataagcgatctccagagacgcttaaggggcagcagcgtcgaaatgctgcaagatgtcattgatgtcatgaaaaggtccgagtcctggaccctaaagaaacccaaaagcgtctccaaaaagctgaagtcagtatttcgcgtgcccgacctatccgggatgctgcaggtgctgaaggaactgacagatgtccagtactactgggttgacgtgatgctcaatcccggttctgcgaccagcaatgttgctatctcagtggaccaacgacaggttaaaaccgttagaacatgtacatttaagaactctaacccttgtgacttttccgccttcggagtgttcggatgccagtacttctcatctgggaagtactattgggaggtggatgtgagtggcaagatcgcctggatcctgggcgtccacagtaagattagcagcctgaataagcgtaagtcatctggattcgcttttgacccgtccgtgaactactccaaggtgtatagcagataccggccacaatacggctactgggttatagggctccagaatacctgtgagtataatgcctttgaagattccagctctagtgatccaaaggtgctgaccctcttcatggcggttccaccctgtcgcattggagttttccttgattacgaagcgggtatcgtgtccttctttaatgtgaccaaccacggcgcactgatttacaaattctccggctgccgattctctaggccagcgtacccatacttcaatccttggaactgcctggtgcccatgactgtttgcccacccagtagctag

SEQ ID NO: 244990 - DNA, 1893 bp, Artificial Sequence
  Description of Artificial Sequence: Synthetic coding sequence
atggccgagttatgccctcttgccgaggagctgtcttgtagcatctgcctggagccgttcaaggagcccgtgaccaccccatgtggacacaacttttgtgggtcctgcctaaacgaaacttgggctgtgcagggatctccttatctttgtccacagtgccgagctgtgtaccaggcacgcccacagctgcataaaaacacagtattgtgcaatgtggtggagcagtttctccaggccgatctggctagggaacctcctgcagatgtgtggacccctccagcacgagcctctgccccatcaccgaatgcacaggtagcctgtgatcattgtctgaaggaagcggcagtgaagacctgcctcgtgtgcatggcctcattttgccaagagcaccttcagccccacttcgattctcccgctttccaggaccacccgctacaaccgcctgttcgcgacttactgcgcaggaaatgttcccagcataaccgcctgagagaattcttttgtcccgagcactcggagtgtatctgccacatttgtctagtcgaacataagacctgctcacccgcaagtctgagccaggctagtgccgacctggaagccaccttgaggcataagctgacggtaatgtacagtcagatcaatggcgcatctcgggctctcgacgatgtgaggaatcggcagcaggatgtccgcatgaccgctaaccgcaaagtcgagcagttacagcaagaatacacagaaatgaaggctttgttggacgcctcggagacaactagtaccaggaagatcaaggaggaagaaaaaagagtcaattctaagtttgatacaatctaccagattctcttaaagaagaagagcgaaattcagactttaaaagaagaaatagaacagtctcttacaaaacgagacgaatttgagttccttgaaaaggccagcaagctgagaggaatttcaacaaaaccggtgtatatacccgaagtggaactgaatcacaaattaatcaagggcattcaccagagtaccatcgatctcaagaacgagctgaagcaatgtatcggtcggctgcaggagcccaccccctctagcggggaccccggtgaacacgatccagcctcgacccataagagcaccaggccagtaaaaaaagtctcaaaagaggagaagaaatcaaaaaagcctcctcccgtgccggctcttccttccaaactccctaccttcggtgccccagagcaacttgttgacctgaagcaggccggactggaggctgcggctaaagctacgagtagtcatccgaacagcactagcctgaaagctaaggtcctcgaaacgtttctcgccaaaagcagaccagaactgctggaatattacattaaggtgatcctggattataacactgcccacaataaagttgctttgtccgagtgttatacagtagcatccgtagctgaaatgccccagaattaccgtcctcatccacagagatttacatactgctcacaagtcctggggctccattgttacaagaaaggtatacattattgggaggttgagctgcagaagaacaatttttgtggtgtgggcatttgttacgggagcatgaatagacagggccctgagagcaggctgggacgtaatagcgctagttggtgtgtggaatggtttaatacgaagatatctgcctggcacaataatgtggagaaaactctgccttccaccaaggcaactagggtcggcgtgcttttgaattgcgatcacgggtttgtcatatttttcgctgtcgctgacaaggtccacttgatgtataagttccgagtcgattttactgaggctctgtaccctgccttttgggtcttttcggccggtgccaccctgtccatttgcagcccgaaatag

SEQ ID NO: 244991 - DNA, 1893 bp, Artificial Sequence
  Description of Artificial Sequence: Synthetic coding sequence
atggcagaattatgtcctctagccgaggagcttagttgtagtatctgtctggaacccttcaaggagccagtgactacgccttgtggccataacttttgcgggtcctgtctgaatgagacatgggctgtgcagggatctccatacttgtgtccccaatgccgggctgtttatcaggctcgaccccagctccacaagaatactgtgctctgcaacgtggttgagcagttcctgcaggctgatctcgctcgggaaccgcctgctgacgtgtggaccccacctgccagagccagcgccccatcacccaacgctcaggtagcctgcgaccactgtcttaaggaagccgctgtgaagacatgcttggtgtgcatggcttccttttgccaggaacacctgcagcctcactttgatagccctgcctttcaggaccatccactacaaccgcctgtgcgtgatctgctgcgccgaaaatgttcccagcataatcggctgcgagagtttttttgtccagagcatagcgaatgtatctgccacatatgcctcgtcgaacacaaaacttgttctccagcatctttaagccaggcttctgcagacttggaggccacactccgccacaagctcaccgtaatgtactcccagatcaatggggctagtagggcgttggacgacgtgcgcaatcggcagcaagatgtccggatgacggcaaatcgcaaggttgagcagttgcagcaggagtatacagagatgaaggccctgctggacgctagcgaaacaacttccactaggaaaatcaaagaggaggagaagagggtgaattccaagttcgatacaatctatcagatactgttgaaaaaaaaatcggaaatccagactttgaaggaagagatagagcaaagtctcacaaaaagagacgagttcgaatttttggaaaaggcttcaaaattacgcggaatctccacaaagccggtgtacattcccgaagtagagttgaatcacaaactaatcaaaggaatacatcaaagcaccattgatctcaagaatgaacttaagcagtgcatcggacgcctgcaagaacccacaccttcaagtggcgatcctggtgagcacgaccccgcatcaacccacaagagcactagacccgtgaagaaggttagcaaggaggaaaagaagtctaagaaacctccacccgtacctgctctcccctccaaattgcctacttttggggcaccagagcaacttgttgacctgaagcaggcagggctcgaggctgccgcaaaggcaaccagcagtcatccaaattccacctcactgaaagccaaagttctggaaacattcctggccaagagcaggcccgagctgctggaatactacatcaaagtcattcttgattacaacacagcgcataacaaagtcgcattatctgaatgttatactgtggcaagtgtggccgaaatgcctcagaattacagacctcatcctcagagatttacttactgcagccaggttctgggtctgcactgttacaagaagggtatccattactgggaggttgagctgcagaagaacaatttctgtggtgtcggtatctgctacggtagtatgaataggcagggaccggagagcaggcttggtaggaacagtgctagttggtgtgtggaatggtttaataccaaaatttcggcctggcacaacaacgttgagaagacactcccctctaccaaagcaacgcgagtcggcgtcctgttaaattgcgaccatgggtttgtaattttctttgcggtggccgataaagtacacctgatgtataaattccgagttgacttcacagaggccctgtatccggctttctgggttttttccgcaggggctacactctctatttgctctcccaagtag

SEQ ID NO: 244992 - DNA, 1077 bp, Artificial Sequence
  Description of Artificial Sequence: Synthetic coding sequence
atggcctctggatctgtcgcagagtgcctgcagcaagaaacgacttgtccggtttgcctgcagtactttgccgaacctatgatgctcgattgtggccataacatctgctgcgcctgtctcgcccgatgttggggcaccgccgagaccaatgtcagctgtccacaatgtcgcgagactttcccacagcgacatatgagacctaaccggcacttggctaacgtaacccaactggtcaaacaacttcgaaccgagcggccatccggccctggaggggaaatgggcgtgtgtgagaaacatcgagaaccccttaagctctattgcgaggaggatcagatgcccatttgcgtggtctgcgatcggagcagagagcatagaggtcattcagttcttcccttagaagaggcggttgagggcttcaaggaacagatccagaaccaacttgaccacctgaagagggtcaaagacctaaagaagcggcgaagggcccaaggagaacaggcacgtgccgaactcctttccctgacgcagatggaacgagagaaaatagtgtgggagtttgagcagttgtatcactcactgaaagaacacgaataccgtttgcttgcacgcctcgaagagttagatctcgctatttataactctatcaatggggctatcacgcagttttcctgcaatatctcacacctgagtagtctgatagcccaacttgaggaaaagcaacaacagcctactcgagaactactccaagatataggggatacgctcagtagggctgagcggatccgcatacccgagccgtggataaccccgccagatcttcaggagaagattcatatcttcgcccagaagtgcctgttcctcaccgagagtctgaaacagttcactgaaaaaatgcaaagtgacatggagaagatacaagaactgcgggaagcacagctttacagcgttgatgtgacgctggatccagacaccgcctatccgtccctgatcttaagcgataacctccgccaggttcggtactcgtatctgcaacaggacctaccggacaatccagagcggtcacccagcacgacatag

SEQ ID NO: 244993 - DNA, 1542 bp, Artificial Sequence
  Description of Artificial Sequence: Synthetic coding sequence
atggccagtggatctgtggccgagtgtctgcaacaagaaactacatgtccagtctgcctgcagtacttcgcggagccaatgatgctcgattgcggacataatatttgttgtgcctgcctcgcccgttgttgggggaccgccgagactaacgtttcctgccctcagtgcagggagacgtttccacaacgccacatgaggcccaaccgacacttggccaacgtgacacaactcgttaagcaactccggaccgaacgcccaagcggaccgggaggggagatgggagtgtgcgagaaacatagagagcccctcaaactgtactgtgaggaggaccagatgcctatatgtgtggtctgtgaccgcagtagggagcacagaggccattccgtgctgccactggaggaggcggtggaaggcttcaaggagcagatccagaaccagttggatcacctgaaaagagtgaaggatcttaagaagcggagacgggctcagggagagcaggccagggccgagctgttgtcgctcacacaaatggagcgggagaagattgtgtgggagttcgagcagctgtatcattcacttaaggagcacgagtaccggctcctagccaggctggaggaactggacctcgcaatttataatagcatcaatggcgcaatcacccagttctcctgcaatatcagtcatctcagtagtctgatcgcacagcttgaagagaaacagcaacagcccacccgcgaactgctgcaggacataggcgatactctgagtcgagcggaacgcataagaatccctgaaccatggatcacacctcctgaccttcaggagaaaatccacatcttcgcacagaaatgtctgtttctgacagagtccttgaaacagttcacagagaaaatgcagtctgacatggaaaagattcaggagctgagggaggcgcaactttacagtgtggatgttaccctggatcctgatacagcttatccttccttgatcctttcagacaatttgcgccaggtacgctacagctatcttcagcaggatcttcctgataatcctgaaagattcaacttgtttccgtgtgtgttaggctcgccgtgctttatcgctggtagacactactgggaggtggaggtgggcgataaggcgaaatggaccatcggcgtgtgtgaggatagtgtgtgcaggaagggaggggtcacatctgcgcctcagaatgggttttgggctgtcagcctgtggtacggaaaggagtattgggccctaacaagccctatgacagccctcccgctaaggactcctctgcagagagtcggcatctttttagattacgatgccggagaagtgagcttctataatgttacagagcgctgccacacctttaccttttcccatgccactttttgcggccctgttcgcccatacttctctctctcttatagtggagggaaaagcgctgccccactgataatctgtcctatgtccggtattgatggattctcaggccatgtcgggaatcatgggcacagcatggaaacctccccctag

SEQ ID NO: 244994 - DNA, 1542 bp, Artificial Sequence
  Description of Artificial Sequence: Synthetic coding sequence
atggcaagtgggagcgttgccgagtgtcttcagcaagagactacctgccctgtatgcctgcaatattttgcagagcccatgatgctggattgtggtcacaatatctgttgtgcctgtctcgcacggtgctggggaactgccgagaccaacgtgtcatgcccccaatgcagggagacttttccacagagacatatgagaccaaatcgacaccttgccaacgtgacccagctggttaagcaactgcgaacggagcggccaagtgggcctggtggagagatgggggtttgtgagaaacacagggagccattgaaactgtactgcgaggaagaccagatgcccatctgcgttgtgtgcgataggtcgagggaacacagggggcatagcgtgctccccctggaggaggcagtcgaggggttcaaggaacagatccagaatcagttggaccacctcaagagggtgaaagacctgaaaaagagacggagagctcaaggtgagcaggcacgtgccgaactgctcagcctgacacaaatggagcgagagaagatagtttgggagttcgagcaattgtatcacagtttgaaagaacatgaatatcgcctgctcgcacgtctagaggaactggacttggcgatttataattctatcaacggcgcaattacccagtttagttgtaatatcagccacctttcgtctctgatagctcagttggaagaaaaacagcagcagcccaccagagagctgctccaggacatcggcgataccctgtcccgcgctgagaggattcggatcccagagccctggattactccccctgacctgcaggagaaaatccacatttttgcgcagaagtgcctcttcttgaccgagagtctcaagcagttcacagaaaaaatgcagtccgatatggaaaaaatccaggaactgagggaggcacagttgtactccgtcgatgtcacgcttgatcccgataccgcttatccaagtctcatcctctcggacaatcttcgccaggtccggtactcatacttgcagcaggatctgccggataaccctgagcgctttaatctattcccttgtgtcctgggatctccctgttttatcgcaggcaggcactactgggaagttgaagtgggggacaaagccaagtggaccattggcgtgtgtgaggactcagtgtgccgtaagggcggagtgacttccgccccacagaacggcttttgggctgtgagtctttggtacggtaaagaatactgggcattaacatcgcccatgaccgctctgcctctgcgcacccctctgcagcgggtgggaatctttctcgattacgatgcaggtgaagtgtcgttttacaacgtcaccgaaagatgccatacctttacattttcacatgctactttctgtggccctgttcgcccatattttagtttatcttacagcggcggtaagtccgctgctcctctgatcatctgtcccatgtccggcatcgatggcttttcaggacacgtgggaaatcacggccactccatggagacttccccctag

SEQ ID NO: 244995 - DNA, 1077 bp, Artificial Sequence
  Description of Artificial Sequence: Synthetic coding sequence
atggcatccgggagcgtggctgagtgtttgcagcaggagacgacatgccctgtctgcctgcaatatttcgcagagccgatgatgctagattgcggccacaacatctgttgcgcatgtctcgctcgctgttggggcaccgcggagacaaatgtgtcctgtcctcagtgtagagagacgttcccccaacggcatatgcgccctaaccggcatctagcaaatgtgactcagttggttaagcagttgcgaacagagcggccatctggccctggtggagagatgggcgtgtgcgaaaaacatcgggagcccctcaaactctactgtgaggaggatcagatgccaatctgcgttgtgtgcgatagaagcagggagcatcgaggtcacagcgtccttcctctggaggaagcggttgaggggttcaaggagcaaatccagaaccagctcgaccatctgaagcgggtgaaggaccttaaaaaaagacggagagcacagggcgaacaggccagagctgaactactatctctgacccagatggaaagagaaaagattgtctgggaatttgagcaactgtaccactcactcaaagaacatgagtaccggctgctggccaggctcgaggaacttgatcttgccatttataacagtataaacggagcgatcacacaattcagctgcaacattagccacctctcttcccttatcgctcagctggaggagaagcagcagcagcccaccagggagttgctgcaggatattggcgacacactgtcaagggccgaacggattaggatacccgaaccttggatcacccctccagatctccaagaaaaaatccacatcttcgcacagaagtgcctattcctaactgaaagcctgaagcagtttactgaaaagatgcagtccgacatggagaagatacaagaacttcgagaagcccaactatactccgttgatgtgacattagaccctgataccgcttacccatccctgatactcagtgacaatctgaggcaggtacgatacagctacctacaacaggatctgcccgacaatcctgagcggtctcccagtactacctag

SEQ ID NO: 244996 - DNA, 747 bp, Artificial Sequence
  Description of Artificial Sequence: Synthetic coding sequence
tgactcaaacagtttaccgagaagatgcaatcggacatggagaaaatccaggagagtgcagactctctagagggcggaattcttgatctgggctccgtcctatcacatatactccctgtgtccgagctgagggaagcgcagctgtacagtgtggatgttacgctggatccggacaccgcataccccagcttaatactcagcgataatctcagacaggtacgctattcttaccttcagcaagacttgccagacaaccccgagcgcttcaacctgtttccttgcgttttgggatctccctgtttcattgcaggcagacattactgggaggtagaggtaggagataaggccaagtggactatcggagtttgcgaagactctgtgtgtaggaagggcggagttacgtctgcccctcaaaatggattttgggctgtctccctctggtacgggaaagagtactgggcactgaccagccccatgaccgctttaccattgaggaccccccttcagagagtgggcattttcctggactacgatgccggagaggtatcattctacaatgttaccgagcgttgtcacactttcactttttcccatgcaaccttttgtggtccagtccgaccatatttttcactgtcgtactctggtgggaaaagcgcagccccattgatcatctgccccatgagcgggatcgatggcttctcaggacatgtcggcaaccacggccactccatggagacaagtccttag

SEQ ID NO: 244997 - DNA, 1077 bp, Artificial Sequence
  Description of Artificial Sequence: Synthetic coding sequence
atggcatcaggcagtgttgcagaatgcctgcagcaggagactacttgtccggtatgcctgcagtactttgcagagccaatgatgttggattgcggccacaatatttgctgcgcttgtcttgcgagatgctggggcactgctgagacgaatgtctcttgtcctcagtgtcgggagactttcccacagaggcacatgcgcccaaaccgccatctggccaatgtcactcagctggttaagcagctgcgcaccgaacggcctagtgggccaggcggtgagatgggagtgtgcgagaagcatcgggagccactgaaattgtattgtgaggaagaccagatgcctatatgcgtggtatgtgatagaagccgggaacatcggggtcattccgtgctgcctctggaagaggccgtggaggggttcaaagaacagattcagaaccagctggatcatctgaaacgcgtcaaggacttgaagaaaaggagaagggcccagggcgaacaagcccgtgctgaactgctctccctgacccaaatggagagagagaagatagtctgggaatttgaacagctgtaccactcgctgaaagagcacgaatatcgattgctggccaggttagaagagcttgacctggccatctacaacagcatcaatggcgcaataacccaatttagctgtaacataagccaccttagttcccttatagcccaactggaagagaagcagcagcagcccactcgcgagcttctgcaggacattggtgatacccttagccgagccgagagaatcagaatcccggaaccttggatcacgccgcctgatctgcaggagaagatccatatcttcgctcaaaaatgcctatttctgactgagtccttaaaacagtttacagagaagatgcaatctgatatggagaagatccaggaattgcgagaggcccagctgtattcagtggacgtgaccctagatccggacactgcttaccccagtttgatcctgtctgacaacctgcgccaggtcaggtatagctacctgcagcaggacctccccgacaaccctgagagaagccccagcacaacttag

SEQ ID NO: 244998 - DNA, 747 bp, Artificial Sequence
  Description of Artificial Sequence: Synthetic coding sequence
tgattaaaacagttcacggagaaaatgcagagcgacatggaaaaaattcaggagagtgctgattcactcgaggggggaatcttagacctcgggtctgttttatcacatatccttccggtgtcggaactgagggaggctcagctttactccgtggacgttaccttggacccagacacagcctacccgtccctaattctgtcagacaaccttaggcaggttcggtactcctaccttcagcaagatcttcctgacaatcctgagagattcaacctgtttccatgcgttctgggcagcccttgttttattgccggacgacactattgggaagtcgaagtgggggataaggctaagtggacaatcggcgtgtgtgaggattctgtgtgccggaagggaggagtgacaagcgcacctcagaacggattctgggctgttagcctatggtatggtaaggagtactgggccctgacctctcccatgactgctctccctctgagaactcccctgcagcgtgtcgggattttcctggactacgacgccggtgaagtgtccttctacaatgtgacggagaggtgtcatacatttacttttagccacgccaccttctgtggtccggtgcgtccctacttcagccttagctattccgggggtaaatcagctgcaccactgatcatttgtcctatgagcggcatcgatggtttcagcggccacgttgggaatcacggccactccatggagacatcaccctag

SEQ ID NO: 244999 - DNA, 1077 bp, Artificial Sequence
  Description of Artificial Sequence: Synthetic coding sequence
atggccagcggatccgtggcggaatgtctgcaacaggaaaccacgtgcccagtgtgcctacagtactttgcagaacccatgatgttggattgcggccacaacatttgttgtgcgtgcttggctcgctgttggggaacagcagagacaaatgtctcatgtccccagtgtcgggagacattcccccaacgacacatgagacctaaccggcacctcgcaaacgtcacacagctggtcaagcagctaagaaccgagcgaccaagtggtcccggtggagaaatgggggtgtgtgaaaagcaccgcgaaccactaaagctatactgcgaagaggatcaaatgcctatatgcgtcgtgtgcgaccgaagcagagaacataggggacactcggtgttgccactcgaggaggccgtggagggtttcaaggaacagatccaaaatcagctcgaccatctgaaaagagtcaaagacttgaaaaagcggagacgggcacaaggcgaacaggcacgagcggagctcttgtctttgacccagatggagcgtgaaaaaatagtgtgggaattcgagcagttgtatcactcacttaaagaacacgagtacagattgctcgctcgtctcgaggaattggacctagccatatacaactcaatcaacggcgcaatcacacagttcagttgtaacataagtcatctgagctcactgattgcccagctggaggaaaaacagcagcagcccacgcgcgaactcctgcaggacatcggagacacactgtcccgagctgaacgcatcagaatcccagaaccttggattaccccacctgacttgcaggaaaaaatccacatctttgctcagaagtgcttgttccttaccgagagcttgaaacagttcacagaaaaaatgcaatccgacatggagaagattcaggagttgcgagaggcgcagctatactcagttgatgtgaccctggatcccgatacagcctatccctctctgatcttatccgacaatctgagacaagtccggtattcttacctgcaacaggacctgcccgataatcccgaaaggtctcctagtacaacctag

SEQ ID NO: 245000 - DNA, 747 bp, Artificial Sequence
  Description of Artificial Sequence: Synthetic coding sequence
tgactcaagcagttcacagagaaaatgcaaagcgacatggagaagattcaggaaagtgccgactctctggaaggcggtatactcgatttgggcagtgtcctgagtcacatcctcccagtctcggagttgcgtgaagcccaattatacagtgtagacgtgactctggatcctgacacagcatatccttccctcatcctgtcggacaacctgagacaggtgaggtactcctacttgcagcaggacctgcctgacaacccagagcgtttcaatctgtttccctgtgtcctgggctcaccatgtttcatcgcaggaaggcattattgggaggtagaggtgggggacaaagcaaaatggacaataggcgtgtgtgaagacagtgtctgtcgaaaggggggtgtaacctcagcaccacagaatggcttctgggccgtgtccctgtggtatgggaaggagtactgggccctcacatcccctatgactgccctgcctcttagaacgccactacaaagggttggcatcttcttggactatgatgccggagaggtgtcattctacaatgtgactgaaaggtgtcacacatttaccttctcccacgcgaccttctgcggaccagtcagaccgtatttcagcctttcatattccggtggcaaaagcgccgcaccgctgatcatctgccccatgagtggtattgacgggtttagtgggcacgtgggcaaccacggccactctatggaaacgagcccatag

SEQ ID NO: 245001 - DNA, 750 bp, Artificial Sequence
  Description of Artificial Sequence: Synthetic coding sequence
atggcctcgggctctgtggcagagtgcttgcaacaggagacgacatgccctgtgtgtctccaatattttgctgaacctatgatgctggattgcgggcataatatttgctgtgcttgtctagcccgttgctggggcaccgcagagacaaacgtgagttgtccccagtgtagagaaacctttcctcaacgccatatgcgcccaaacaggcacctcgctaacgtcactcaactcgtgaaacagctgcgcactgaacggccatctggccctggtggcgaaatgggagtgtgcgagaaacatagagagcccctaaaactgtactgcgaagaggatcagatgccaatctgcgtggtgtgcgacaggagtcgcgagcatcggggacactcagtacttcctttggaggaggctgtggagggctttaaagaacagatccagaatcagctggatcacctgaaaagggtgaaagaccttaagaagaggcgaagggcacagggtgagcaggccagagccgaactgctcagcctgacccagatggaacgcgagaagattgtttgggagtttgagcagctgtaccattcactgaaagagcacgaatacagactgttagccagactggaagagctggacctcgctatctataactccattaacggtgctattacacagtttagttgtaacatatcacacttgagctccctgatcgctcagctagaggagaagcaacagcagccgactagagaattactacagtag

SEQ ID NO: 245002 - DNA, 1542 bp, Artificial Sequence
  Description of Artificial Sequence: Synthetic coding sequence
atggcctcgggttctgttgcagaatgcctgcagcaggaaactacctgtccggtgtgcctccagtattttgccgaacccatgatgctggactgtggtcacaacatttgttgcgcgtgcttggccagatgctgggggaccgctgagaccaacgtgagctgtccacaatgtagggagaccttcccgcagaggcatatgcgacccaatcgccatcttgctaatgtcactcaattggtgaagcaactgagaacagaacgcccaagtggtcccggaggggaaatgggagtctgcgaaaagcacagggagcctcttaagttatactgcgaggaggaccaaatgcctatctgcgtggtgtgtgatcgctccagggaacatcggggacattccgtactgcctctcgaggaagcagtggaaggatttaaagagcaaatccagaaccagctggaccatctgaaacgagtcaaagatttaaagaagagacgaagagctcagggcgaacaggcacgggcagaactgctgagtctcacccaaatggagcgcgagaaaatagtgtgggagttcgagcagctgtaccattccctaaaggaacatgaatacaggctgttggcccgactcgaagaactcgacttagctatctacaattccatcaatggtgccatcacacagttctcctgcaatatctctcatctgtccagtctgattgcccagctcgaggagaagcagcagcagcctacaagagagctcctgcaggacattggcgatacactctcccgcgcagaacgaattcgtataccagagccttggattactccccctgacttacaggaaaaaatccacatatttgcgcaaaagtgcttgttccttacagagtcacttaagcagttcaccgagaaaatgcaaagcgacatggagaagattcaggagctgagagaggctcagctgtattccgtcgacgtgactctagatccagataccgcgtaccctagtcttattctctccgacaacctacgacaagttaggtatagttatctacaacaggacttgcccgataatcctgaaaggttcaatcttttcccctgcgtactgggttcaccctgcttcatcgccggacgccattattgggaggtcgaagtgggtgacaaagccaaatggactataggcgtgtgtgaagatagcgtgtgccgaaaaggcggtgtgaccagcgctccacaaaacggcttttgggccgtgtccctgtggtatgggaaggaatactgggcactgacttctcccatgactgcgctccctctccgcacccccctgcagcgcgtgggcatcttcctggactatgatgccggagaggtcagcttctataatgtcacagagagatgccatacatttacattcagtcacgctactttttgcggccctgtcagaccgtacttttccctcagctacagtggcggtaagtctgctgcacctctcattatttgccctatgtctggtatagacggttttagcggccacgttggaaatcatggccactcaatggagacctctccatag

SEQ ID NO: 245003 - DNA, 1542 bp, Artificial Sequence
  Description of Artificial Sequence: Synthetic coding sequence
atggctagtggcagcgtggccgagtgcctgcaacaggagacgacttgtcctgtctgtctccagtactttgcagaaccaatgatgctggattgcggtcataacatttgttgcgcatgtcttgctcggtgctggggtaccgctgagacaaacgtatcatgccctcagtgccgggagaccttccctcaacgacatatgagacccaaccggcatctggcaaatgtaacccagctggtgaagcagctgaggacagaaagacctagtggtccgggaggagagatgggagtgtgtgaaaagcacagggagcccctgaagctctactgtgaggaggaccagatgccaatttgcgtggtatgtgaccgctcacgggaacatcgcggacactctgtgttaccgctggaggaagccgtggagggcttcaaagaacagattcagaatcagctggatcatctaaagcgggtgaaagatctcaagaagagacgcagagcccagggggagcaggcaagggcagagctgctgtctttgactcagatggaaagggagaagatcgtgtgggagttcgagcagttgtaccattcactgaaggagcatgaataccgcctactggcacggctggaagaactggacctggcaatctacaactctattaacggggctatcactcaattttcatgcaatatttctcacctttctagcttaatcgcacagttggaagagaagcaacagcaaccgacacgagaactcctgcaagacataggagatactctgtccagagcggagagaatcagaatccccgagccatggatcacacccccagaccttcaggaaaaaattcatatcttcgcccagaagtgtctcttccttaccgagtctctgaaacagttcactgaaaagatgcagagtgatatggaaaagattcaggaactgcgggaggctcagctttatagcgtggatgtgacactggacccagacacagcgtacccgtctctcattctcagtgacaatctgagacaagtgaggtactcttacttacagcaggatctgccagataacccagaacggtttaacctgttcccttgcgtgctgggttctccatgtttcatagccggaaggcattactgggaggtagaggtgggagataaagccaagtggacgataggagtatgtgaagattcggtgtgccggaaggggggtgttacttcagcaccccagaatggcttttgggccgtgagcctatggtatgggaaggagtactgggcactgacctcaccgatgactgctttgccactgcgtacgccactgcagcgcgtaggaatttttcttgattacgacgcaggcgaagtctccttctataacgttacagaaagatgccatacttttactttctctcacgctacattctgcggtcccgtccgcccttatttctcgctgagctatagcgggggtaagtcagcagcgcctctgatcatttgcccaatgagcggcattgacgggttcagcggacatgtgggcaaccatggacattctatggagacttcaccatag

SEQ ID NO: 245004 - DNA, 750 bp, Artificial Sequence
  Description of Artificial Sequence: Synthetic coding sequence
atggcatcagggtcagtcgcagaatgcttacaacaggagacaacgtgcccagtctgcttgcagtattttgctgagcctatgatgcttgactgcggccacaacatctgttgtgcctgtctggccagatgctggggaacggctgagactaacgtgtcctgcccacagtgcagggaaaccttccctcaaaggcatatgcgacccaacagacacttggctaatgtcacacagctcgtcaagcaactcagaaccgagcgtccaagcggacctggcggagaaatgggggtctgtgaaaagcatcgcgaaccgctcaagctgtactgtgaggaggaccaaatgcccatttgcgtcgtgtgcgaccgtagccgagagcatcggggacactccgtacttccactcgaggaagctgtcgagggtttcaaggagcagattcagaatcagcttgatcacctcaagagagtgaaggatctgaaaaaaagacgtcgggctcaaggcgaacaggcaagggccgaactcctatcactgactcaaatggaaagagagaagatcgtgtgggagttcgaacagctgtaccatagtctgaaggagcatgagtatagactattagcacggcttgaggaactagatctggccatatacaacagtatcaacggagccatcacccagtttagctgcaatatttcgcaccttagttcactaatcgctcagcttgaagagaaacagcagcagcccacgagggagctcctgcagtag

SEQ ID NO: 245005 - DNA, 1542 bp, Artificial Sequence
  Description of Artificial Sequence: Synthetic coding sequence
atggcctcaggttccgtggcagaatgtctccagcaggaaaccacctgccctgtttgtctgcagtatttcgctgagcctatgatgttagattgtggacacaatatctgttgcgcttgcctggcgcgatgctggggtaccgccgaaacaaatgtgtcttgccctcagtgccgggaaacttttccccagcgccacatgcggccaaacaggcatttggccaacgtgacgcagctggttaagcagctccgcacggaacgcccatccggtcctggcggtgagatgggggtatgcgagaagcatcgggaacctctcaagctctattgtgaggaggaccagatgcccatctgcgtcgtgtgtgatcggagcagagagcataggggccactctgtgctgcccctggaggaggcggtagaaggattcaaggagcagattcagaaccagcttgaccatctgaaaagagtaaaggacctgaagaagcgaaggagggctcagggcgaacaggcacgggctgagctcctttctcttactcaaatggagcgagagaaaattgtgtgggaattcgagcaactgtaccattctcttaaagagcacgagtatcgtctgctggccagacttgaagagctcgaccttgccatctataactctattaacggggctattactcagttctcttgcaatatctcgcacttgagttctttgatcgcccagttagaagagaaacagcagcagcctactcgtgagctgctgcaggatatcggagatacactaagcagggctgagagaatcaggatccccgagccttggattactccacctgacctccaagaaaaaatccatatctttgcacaaaagtgcctgtttttgacagaaagtctgaagcagtttactgagaaaatgcagagtgatatggaaaaaattcaggagctccgggaggcccagctgtactcagttgacgttaccctggatcccgacaccgcctacccttcccttattttatccgacaatctcaggcaagtacggtacagttacttgcagcaggacctacccgataacccggaaagatttaatctcttcccatgcgtcctcggttcgccttgttttatcgcaggccgacattattgggaagttgaggttggcgataaagccaagtggactatcggggtgtgcgaggatagcgtgtgtagaaagggcggagtgacaagtgcacctcagaacggcttttgggccgtctccctgtggtacggaaaggaatattgggcccttacgtctcctatgaccgcactgccgttaagaacgccgctgcaaagagttggaatattcctggattatgatgcgggtgaggtgtccttttacaatgtgaccgagcgctgtcacaccttcactttttcccatgcaactttttgcggcccagttcgaccgtacttttctctgtcatattccggtgggaagagtgccgcacctctaataatctgtcctatgtcaggaatcgatgggttcagcgggcacgtggggaatcacggtcattcaatggagacatccccatag

SEQ ID NO: 245006 - DNA, 744 bp, Artificial Sequence
  Description of Artificial Sequence: Synthetic coding sequence
ctcaagcagtttacggaaaaaatgcagtcggatatggagaagatacaagagtcagccgacagcttagaaggcggaattttggacctaggatcggtgctgtctcacatcctgcctgtgtcagagcttagagaagctcaactatactccgtggatgtgactctcgatccagatacagcttacccaagtctcattctgtcagataatcttaggcaggtgaggtacagttatcttcagcaggacctgccagataacccagagcgattcaatctgtttccatgcgtgctgggttcaccttgcttcattgccggtcgtcactattgggaggtagaagttggggacaaggcaaagtggaccatcggtgtgtgtgaggatagcgtgtgcaggaagggcggagtcacatccgcaccccagaatggtttttgggctgtcagcctgtggtatggcaaagagtactgggcgttgacgtcaccaatgacagctctgcccctgcgcaccccgctccaacgagtgggaatctttctcgattacgacgcaggggaagtgtcattttacaacgtcacagagcggtgtcacacttttaccttttctcacgcgactttctgtggccctgtgcggccttactttagcctcagctatagcgggggaaaatcagcagcccctctgattatctgccctatgagtggcattgatgggttctctgggcatgtcggtaaccacgggcattccatggagacttccccctag

SEQ ID NO: 245007 - DNA, 750 bp, Artificial Sequence
  Description of Artificial Sequence: Synthetic coding sequence
atggcttccggcagcgtggccgagtgtcttcaacaggagaccacatgccccgtttgtctgcagtacttcgcagagcccatgatgctggattgtggccataatatatgttgtgcttgtctggccagatgttggggcactgctgagaccaatgtttcttgtccacagtgccgcgaaacattcccgcagcggcatatgcgcccaaaccgacatttagctaacgtgacccagctggtgaaacagctcagaacagaacggccatctggcccaggcggagaaatgggtgtatgtgagaagcaccgggagccacttaaactctattgcgaggaagaccaaatgcccatttgcgtcgtctgcgaccggagtagggagcaccgcggacattctgtattacctctggaggaggcggtggaaggcttcaaggaacagatccaaaatcagcttgatcaccttaagcgcgtaaaggacctgaagaaacggagaagggcccagggcgaacaggctcgggctgagctgttgtccctgacgcagatggaaagagagaaaatcgtgtgggagttcgagcagttataccacagcctgaaggaacacgaatatagactgcttgccagattggaggaactggatctggcgatctacaatagcatcaacggcgctattactcagttttcgtgcaatatctcccaccttagctcactcatcgcgcaactggaagagaaacaacagcagccaacacgtgaactgcttcagtag

SEQ ID NO: 245008 - DNA, 159 bp, Artificial Sequence
  Description of Artificial Sequence: Synthetic coding sequence
tagctccgggaagcccagctctattccgtcgacgtgactcttgaccccgacactgcctacccctcgctaatcctcagtgacaacctccggcaagtcaggtattcctatctccagcaagatctgcccgataatcccgaacgtagtccatctacgacatag

SEQ ID NO: 245009 - DNA, 696 bp, Artificial Sequence
  Description of Artificial Sequence: Synthetic coding sequence
taatccgccgacagccttgagggaggcatcttagaccttggctcggtgttgagccatattctccctgtcagcgaactgagagaggctcaattgtattcagtagacgtgactttggaccctgatacggcttacccatcattaattctgtccgacaatctgaggcaggtaaggtatagctatctgcagcaagacctgccagataaccccgagagattcaaccttttcccttgcgttctgggctcgccctgttttatcgcaggacggcattactgggaggtagaagtcggcgataaggcaaaatggaccattggagtgtgtgaggactctgtctgccgtaaaggcggagtgacatccgcccctcaaaatggattttgggctgtctcactgtggtacggcaaagagtactgggctctgaccagcccaatgaccgcgctgcccctgagaacaccactacagcgagtaggcatctttttagattacgacgccggagaggtcagcttctataatgttactgagagatgtcacacattcacatttagccatgccacattttgtggcccagtgcgtccatacttcagtctgtcctactcaggcggtaagtccgctgctcccttaattatctgtccaatgtctggcatagacggattcagcggccatgtcgggaaccatgggcactcgatggagacttctccttag

SEQ ID NO: 245010 - DNA, 624 bp, Artificial Sequence
  Description of Artificial Sequence: Synthetic coding sequence
tagttgagggaggctcagttgtactccgtcgacgtgacactggatcccgatactgcttatccttctctgatacttagcgataatctcaggcaggttagatatagctacctgcaacaagatctcccagataatccagaaaggttcaacttgttcccctgtgtgttaggctccccatgcttcatcgcaggcaggcattattgggaggtggaagtcggagacaaggcaaagtggactatcggcgtgtgcgaagattctgtgtgtcgcaaaggtggcgtgacgtctgctccccaaaacggcttttgggcggtgtctttgtggtacgggaaggaatactgggctttgacctctcccatgacagctctgcctctgagaacaccgcttcagcgagtcggtattttcttggattatgatgcaggggaggtgtcgttttacaatgtgaccgagaggtgtcacacattcacatttagtcacgctaccttttgtggcccagttagaccgtacttctcgctctcatactcaggcggtaagagtgctgctccactaatcatctgccctatgtctggtatcgatgggttcagcggtcacgtcgggaatcatggacattccatggaaacatcaccatag

SEQ ID NO: 245011 - DNA, 1077 bp, Artificial Sequence
  Description of Artificial Sequence: Synthetic coding sequence
atggcatcaggctccgtagcagagtgtctccagcaggagacgacttgtcccgtgtgcttacaatattttgcagaaccaatgatgctggattgcggccacaacatttgttgtgcatgtctggccagatgttggggaactgctgagacaaacgtgagctgtccccaatgtcgggagaccttcccccagcgccacatgcgtcctaatcggcatctggctaacgtcacccaactggttaagcaactaaggacagagaggccttcagggcctggcggtgagatgggagtgtgcgaaaaacatagagagccactgaagctttactgcgaggaagaccagatgcctatatgcgtggtctgtgatcgctcaagagagcatcgcggtcactctgtgttacctttagaagaagctgtggagggcttcaaagaacagatccagaatcagctggatcatctcaagcgagtcaaagatttaaagaagcgtcgcagagctcagggcgaacaggcccgtgcggagctgttgagcctgactcagatggaacgagagaagatcgtctgggagtttgaacagttgtaccattcactaaaagaacatgaataccgacttttagcacgcctagaggagctggaccttgcaatatacaactccattaacggggctataacccagttttcttgcaacatttcccacctatcatctctgattgctcagctggaagagaaacagcagcagcccactcgagagttgctacaagatataggggatacccttagccgcgctgagcgcatccgcattcccgaaccgtggattacaccgccagacctccaggagaagatccatatttttgcccagaagtgccttttcctgaccgagagcttaaaacagtttacggagaagatgcagagtgacatggagaaaatacaggaactcagagaggcccaactgtactccgtggacgtcacgctggacccggacaccgcgtaccctagcttgatactgagcgacaacctgcgtcaggtgcgctactcttacctgcaacaggatctgcccgacaaccctgaacgcagcccttcgactacttag

SEQ ID NO: 245012 - DNA, 747 bp, Artificial Sequence
  Description of Artificial Sequence: Synthetic coding sequence
taacttaagcaattcactgaaaagatgcagtcagacatggaaaaaatccaggaaagcgctgactctctcgaaggaggtatcctggatctaggcagcgtgctttcacacatcctgcctgtgtccgaacttagggaggcccagctctattcagtggatgtgaccctagatcctgacacagcatatcctagcttgatcttgtctgacaatcttagacaagtgaggtactcctatcttcagcaagatctcccagacaatcctgagcgcttcaacctttttccgtgtgtcttgggaagcccctgcttcattgctgggaggcactactgggaggtcgaggtcggcgataaggcaaaatggactataggtgtgtgtgaggactcagtttgtcgtaagggaggcgtgacaagcgctccgcagaacgggttttgggcggtgtccctgtggtacggcaaagaatattgggccctcacaagcccaatgactgctctacctctgagaactcctctgcaaagagtcggaatctttcttgactacgatgcaggcgaggtgtccttctacaatgtaacagagaggtgccacactttcacctttagtcacgccacgttttgtggaccagtgagaccttacttttcgctgtcatattccggcggaaaaagcgcagcacctctgataatttgcccaatgtctggaatcgatggtttctcaggacacgtcgggaaccacggacactctatggagacctccccttag

SEQ ID NO: 245013 - DNA, 750 bp, Artificial Sequence
  Description of Artificial Sequence: Synthetic coding sequence
atggcatctggaagcgtggcagagtgtttacaacaggaaaccacctgcccagtttgtttacagtacttcgcggagcctatgatgctggactgtggtcacaacatctgttgcgcttgtcttgctcgatgttggggcactgctgagaccaatgtgtcatgccctcagtgccgagagacatttccccaacgacacatgcggccaaataggcatctggcgaatgtgacacaactggtcaaacagcttcggacagagcgcccatcagggccaggaggggaaatgggcgtgtgcgagaaacaccgcgaaccccttaagctatactgtgaggaggatcagatgcctatctgcgttgtgtgtgataggtcacgggaacacagaggccactccgtcctgcctctggaggaggcggtggagggcttcaaggagcagatacagaatcagttggaccacctgaagagggtgaaggatctgaagaagaggagacgcgctcaaggggaacaggctagggccgaactactctcactgacgcagatggagcgcgaaaagattgtttgggagtttgaacagctttatcactcattaaaagagcacgaatatagacttctcgctcgccttgaagaactggatctagctatctataatagcatcaacggggcaattacccaattttcatgcaacattagccatctgagttcactgatcgctcaacttgaggagaagcagcagcaaccaactcgcgagttattacagtag

SEQ ID NO: 245014 - DNA, 2202 bp, Artificial Sequence
  Description of Artificial Sequence: Synthetic coding sequence
atggccaagagggaggattcacccggtccagaagttcagcccatggataaacagtttttagtgtgctctatttgtctggatcgataccagtgtcccaaagttctaccctgcctccatacattctgtgagcgttgtttacagaactatatccccgcacagtccttaacgttgtcgtgtcccgtgtgccgtcagaccagtattctgcccgaacaaggggtctcagccctgcaaaacaatttttttatctcttctctgatggaagcaatgcaacaagcccctgacggcgcacatgatccagaggaccctcacccactgtccgtcgtcgctggccgaccactgagctgccctaaccatgaggggaagacaatggagttctactgcgaagcgtgcgagacagccatgtgcggagaatgccgcgcaggcgagcatcgtgagcaacacaaagctgcactgcagcgccagctcgaggccgttagagggaggctgccacaactgagtgccgcaatagctctcgtggggggaattagccagcaactgcaggagaggaaagcggaggcacttgctcagatctcagcagccttcgaggatctagagcaggcactccaacagcgaaaacaggcccttgtgagtgaccttgagactatctgcggagcgaagcaaaaagtcctgcaaagtcagctcgatacattgagacagggccaagaacacatcggctcctcctgcagcttcgctgagcaagcgctccggctcggaagcgccccagaggtcctgctcgtcagaaagcatatgagagaacgtctggccgctctagccgcacaggctttcccagagcgaccccatgagaatgcgcaactggaactggtcctggaagtggacggcctccggagatccgtgttgaacctaggcgctctgcttacaactagcgcgaccgcgcatgaaactgtggctaccggcgagggtttgcggcaggcccttgtcggacagccagcgtctctgaccgttacgactaaggacaaagacgggcgtctcgttcgaacaggtagtgctgagctaagggccgaaattaccggacccgatggaacacgcctccccgtgccagtcgtcgaccacaagaacggaacgtacgaactggtgtacacagctagaaccgagggcgaattgctcctgtccgtgctactctacgggcaaccggtgaggggatccccatttagggtgagagcgctacgcccaggcgacctgccccctagtcctgacgatgttaaaagaagggtcaagtctcccggaggacctgggagtcacgtgcgacaaaaagctgtgaggcggcctagcagcatgtattccacgggcggaaaacgcaaagataatcctatcgaggacgaactggtgttcagagtcggcagtcggggtcgagagaagggcgagttcaccaacctgcagggagtgagtgcagccagcagtggcagaatcgtcgttgcggattccaataatcagtgcatacaggtattttccaatgagggccaattcaagtttcgatttggtgtgaggggaaggagtcccggtcagcttcagcggcctacaggtgtcgccgtagatactaacggagacatcatcgtagctgattatgataatcgctgggtgtctatattttcacccgaggggaagttcaagaccaaaatcggagcaggcaggttgatgggcccaaagggagtcgctgtagacaggaatgggcacattatagtagtggacaataagtcttgttgtgtgttcacatttcagcccaacgggaaactcgtcggcagattcggcggacgaggagccaccgatcggcactttgccggaccacactttgttgccgtgaacaacaagaatgagatcgtggtaacagattttcacaaccactctgtgaaagtgtactccgctgacggagagtttctcttcaaattcggcagccacggtgaaggtaacggacagtttaacgcccctaccggggtggcagtcgattccaatgggaatattatcgtagctgattgggggaacagccgtatccaggtttttgatagttcggggtctttccttagctacattaatacctctgctgaacctctctatggccctcagggacttgcacttacaagtgacggccacgtggtggtggcggacgcaggaaatcattgctttaaagcctatcgctacctgcaatag

SEQ ID NO: 245015 - DNA, 2235 bp, Artificial Sequence
  Description of Artificial Sequence: Synthetic coding sequence
atggctaagcgggaagactcaccaggcccagaggttcagccaatggacaagcagtttcttgtgtgctccatttgtctggacagataccagtgtcctaaagtattaccttgtcttcatactttctgtgaacgttgcttgcagaattatatacccgctcaatctttgacattgtcatgtccggtttgtcggcaaacttctattcttccagaacagggggtgtcagcccttcagaacaatttctttatttcctcccttatggaagcgatgcaacaggcccctgacggggctcacgacccggaagacccacatcccttgagtgtggtggcgggaaggcccctcagctgtcctaaccatgaaggcaaaactatggaattctattgcgaagcctgtgaaaccgccatgtgcggcgaatgcagagccggagaacaccgtgaacatggaacagtgctcctgagggacgtcgtggagcagcataaagcagcattgcaaaggcagctggaggctgtgagaggcaggctcccccaactgtcagccgctatagccctggtagggggaatctcacagcagcttcaggaaaggaaggcggaggctctggcccagatcagtgcagccttcgaggatttggagcaggccttacaacagcgaaagcaggcgttagtgagtgatttggaaacaatctgtggagcaaagcagaaggttctgcagagccagctcgatactctccggcaagggcaggagcatatcgggagttcttgttccttcgccgagcaggctttgagacttggatccgcaccggaggtactgttggtccgcaagcacatgcgggaaaggctcgcagcacttgcggcacaggctttcccagaaaggccccacgagaacgctcaactggagctggtgctggaggtggacggattgagacggagcgtactcaacttgggagccctcctgacaacctctgccacagcccatgaaacagtcgccacgggggagggacttcgacaagctttggttggccagcctgccagcctgacagtcacaactaaggataaggatgggagactggtccggactggctccgctgagctccgcgctgagatcaccgggccagacggaaccaggctgcctgttcccgtcgtggaccataagaacggaacctacgaactggtttatacagccagaacagagggcgaactgctcctgtctgttttgctctacggccagccagtgcgcggttcaccgttccgggtcagggcactgaggccgggagacctccccccatcccccgatgatgtcaaaagaagagtgaaatcacccggagggccaggctcacacgtgaggcagaaggctgttcggaggcccagctcaatgtatagcacaggcggaaaacgcaaggacaatcctattgaagatgagctcgtgttccgcgtggggagtcgcggtagggaaaaaggggagttcacaaatttacagggcgttagtgcagcctcatccgggaggatcgtggttgctgacagtaataatcagtgtatccaggtgttctccaatgagggacagtttaaatttagatttggggttcgcggacggtcacctggtcagttacagagacctacgggagttgcagtggacactaacggtgatattatagtcgcagattatgacaaccggtgggtgtctattttttctccggaaggtaagttcaagacaaaaattggcgctggccgactgatgggccctaagggagtagctgtggaccgcaatgggcatattatagtcgtagacaacaaatcgtgctgcgtgttcacattccagcccaatgggaaactggtgggccgatttggcggacgaggagccacagataggcacttcgctgggccacacttcgtggcggttaataacaagaatgagattgttgtgactgattttcacaatcactcagtgaaagtgtattccgctgacggtgagttcctgtttaaattcgggtcccacggggagggcaatgggcagtttaatgctcctacaggagtcgcagtggacagcaatggtaacatcatagttgccgattggggaaattcgcgcatccaggtgtttgatagctcaggtagttttctgtcgtacatcaatacttccgccgaacccctctatggaccccagggactagcacttacctctgatggacacgtggtggttgccgatgctggtaaccactgtttcaaggcttacaggtaccttcagtag

SEQ ID NO: 245016 - DNA, 2235 bp, Artificial Sequence
  Description of Artificial Sequence: Synthetic coding sequence
atggccaagagagaggacagtccagggcctgaagtgcagccaatggacaaacagttcttagtttgttcaatatgtttagataggtatcagtgtcccaaggtgctgccctgtctgcatacattttgtgaacgatgtcttcagaattatattccagcccagagcctgacgctcagttgccccgtgtgtaggcagacatctatcctccctgagcagggggttagtgccttgcaaaacaattttttcatatccagtctgatggaggctatgcagcaggccccagacggagcccacgacccggaggaccctcatcctctgtcagtcgtggcaggacggcctctgtcttgccctaaccacgaaggtaagacaatggagttctactgtgaggcctgcgagactgctatgtgcggggagtgtcgcgctggggagcacagggagcacgggacagtccttcttcgagatgtggtcgagcaacacaaagcggctctccagcggcaactcgaggccgtgagaggacgattgcctcagttgagtgcagctattgctctggtggggggtattagtcagcaactccaagagcgtaaggctgaggcccttgcgcagatttctgccgctttcgaggacctggaacaggcactgcagcagagaaagcaggctttggtcagcgatctcgagaccatttgcggtgctaaacaaaaagtcttacagtctcagctcgacacgctgcgtcaaggacaggagcatattggaagtagctgctcattcgccgaacaggcacttagactcggttcggcacctgaggttctgctcgtgaggaagcatatgagagaaagactggcagcacttgcagcacaggcctttcccgagcgcccacatgagaatgctcagctggagctcgttctggaggtggatggccttcgcaggtccgttctcaatctgggggctttgctgaccacgtcggcaaccgcacatgaaacggtggcaacgggagaaggcctgagacaagcactagtaggacagccggcaagtttgaccgtcaccactaaagacaaggatggtagactagtgaggactgggagtgcagagcttcgcgctgaaattacaggtccggacggcactagactgccagtgcccgtggtggaccataagaacgggacctacgagctggtatataccgccagaaccgagggggagctgcttctctccgtgctgctttacggccagcctgttcgagggtcaccgtttcgcgtccgcgctctacgccctggagacctgccaccatcccctgatgatgtcaaacgcagggtcaaatccccaggtggaccaggttcacatgtgcgccaaaaggctgtgagacgcccatctagcatgtacagcaccggcggaaagagaaaggataaccctattgaagacgaactggtgttccgcgtaggctctcgtggacgagagaaaggggaatttaccaatctgcagggggtgtcggcggctagttctggtaggattgtagtcgccgactcaaataaccaatgcatccaggtgttcagcaatgaaggccagtttaaattccggttcggcgttagaggacgctctcccggacagttgcagcggcctactggggtggctgtcgacactaatggggacatcattgttgcagactacgacaaccgctgggtcagtatcttctcacctgaaggtaagtttaaaaccaaaattggggcagggcgactaatgggccctaaaggagtggctgtggataggaacggtcacatcatagtggtggataataaatcgtgctgtgtctttacgttccaaccgaacggcaagctagttggtaggtttggcggacgaggcgcaactgatagacacttcgcgggaccccacttcgtcgccgttaataacaagaacgaaattgtcgtaaccgattttcacaaccactccgtcaaagtctactccgctgacggtgaattcctgttcaagttcggctcccacggcgagggcaacggccagttcaacgcccctaccggcgtggctgtggattccaatggcaacatcatcgtggccgattggggcaactctaggattcaggtgtttgattcaagtggctccttcctgagctacataaacacgtcagctgaaccactttatggcccacagggcctggcgctcacgtctgatggccacgtggttgtggcggacgcgggtaaccattgcttcaaggcctatagatatctccagtag

SEQ ID NO: 245017 - DNA, 2235 bp, Artificial Sequence
  Description of Artificial Sequence: Synthetic coding sequence
atggccaagcgcgaagattcccccggtcctgaggtgcagcctatggacaagcaatttctggtgtgtagtatttgcctagatcggtaccaatgccccaaggtgttaccatgtttgcacactttctgcgaacgctgtttacagaactacattccagcccagtccttgactctgtcttgccctgtctgcaggcagaccagtatactccccgaacagggagtgtcagcactacagaataatttcttcatctcatcactgatggaggcgatgcaacaggccccagatggagctcacgatcctgaagatccccacccactgtccgtagtggccggtcgtccattatcctgcccgaaccatgaggggaagaccatggagttttattgcgaggcttgtgagactgcaatgtgcggggagtgtagggccggagagcatcgagagcacggaactgtattacttcgggacgtggtcgaacagcacaaagctgcactgcaacgtcagctggaagccgtgcggggacgtctgccacagcttagcgcagctatcgccttggtcggtggcatctcacagcagctccaagagagaaaggccgaagccctggctcagatatccgctgcattcgaagatctggaacaagcgctacaacaacgcaagcaggctctcgtgtctgacctggagaccatctgcggcgcaaaacagaaggtgctacagagtcaattagacacattgcgacagggacaggagcacataggctcctcatgtagctttgcggagcaagcactccgccttggcagcgcccctgaagtactgctggtcaggaagcatatgagagagcggttagccgctttggctgcccaggctttccccgaaagaccccacgagaacgctcagttggagctcgtcttagaagtggatggtctccgcagatccgtgttaaatctgggcgcactgcttacaacctccgcaacggcacatgagacagttgccaccggcgaaggcttgcggcaagcactggttgggcagcccgcttctctgaccgttaccaccaaggataaagatgggcgacttgttcgtacaggatcggctgagctgagagccgaaatcactgggcctgatgggacccgcctgcccgtgcccgttgttgatcacaagaatggcacatacgaattagtctacacagcccgtacagaaggtgaattactgctgtccgttctgttgtacggccagccagtgagggggtcccctttcagggtaagagccctaagaccgggagacctacctccctcaccagatgacgtgaaaaggagggtcaagagcccgggagggccaggctcgcacgtgagacaaaaagctgtccgacgcccaagcagcatgtactccaccggtggaaagagaaaggataatcctattgaagatgaattggtcttcagggtcggttcccggggacgcgagaagggagagttcaccaacttgcagggggtaagcgcggcatcctcagggcgaatagtagttgcagattctaacaatcagtgtatccaggtttttagtaatgaagggcagtttaagttcaggtttggggtgcggggacgcagtcctggacaattacagcgacccactggcgtcgccgtggataccaacggggatattatagtggccgattatgacaaccggtgggtgtctatcttttccccagagggaaagtttaaaacaaagatcggggctggaaggcttatggggccaaagggagtcgctgtcgatagaaacggacacataattgtggtggataacaaaagctgctgtgtttttacttttcagccaaatggaaagctggtcggtcgctttggaggtagaggggcaacagataggcacttcgccggtccacattttgtagccgtgaataataagaatgagatagtggtcactgatttccacaaccactcggtcaaggtatattctgccgacggcgagttcctatttaagtttggcagccacggagaggggaacggccaattcaatgcccctacaggggtggctgtcgacagcaatggcaatattattgttgctgattggggaaatagtagaatccaggtatttgactccagtgggagctttctgagctacatcaacacttcagctgagcccctctacggaccccagggactagccctgacaagtgacggccatgtggtggtcgccgacgctggtaaccattgttttaaagcctaccgctacctccaatag

SEQ ID NO: 245018 - DNA, 2229 bp, Artificial Sequence
  Description of Artificial Sequence: Synthetic coding sequence
atggctaaaagagaggattcgcctggaccggaagtgcagccgatggataaacagttcctggtgtgtagtatttgcctcgatcggtatcagtgtccgaaggtgctgccctgcctccacaccttctgcgagcgctgtctgcagaactatatcccagcacagtcactgactttgtcatgccccgtgtgtcgacaaacttccattctacccgagcagggggtttccgcactccagaataatttcttcatctcttccctaatggaagctatgcagcaggcacctgacggggcacacgaccccgaggatccacaccctctgagcgttgttgctgggaggcccctctcgtgccctaatcacgaaggcaagactatggagttctactgcgaggcctgcgagacggccatgtgcggtgaatgtagagcgggagaacaccgtgagcacggtaccgtgctgctgagggacgtggtcgagcagcacaaggcagccttgcagaggcagctcgaagcagttagaggaaggttgccacagctaagcgcagccatcgcgctggtggggggaatttcccagcaactgcaggaacgaaaagctgaggcactggcccagatctcggcggctttcgaagacctggagcaggctctgcaacagaggaaacaagctctagttagcgatctggagacaatttgcggtgccaaacagaaagtcctccagtcccagctggacactttgcgtcagggtcaggaacatattggcagcagctgtagttttgctgagcaggccctgagactcgggagtgctcctgaagtcctcctggtgcgtaagcacatgcgggaaaggttagcagccttggcagcccaagcgtttcctgaacgacctcacgaaaatgctcaactggagctcgtactggaagtcgatggtcttaggagatcggttctgaacttaggagccctgctgacaacatccgccactgctcatgagacagtggcaaccggggagggcttacgtcaggccttagtcggccagcctgcctctttgacagtaaccactaaagacaaggatggaaggctggttcgcaccggcagtgccgagcttcgcgctgagataacaggtccggatggcactagactccctgtgcctgtagtggatcacaagaatgggacctacgagctggtgtacaccgctcggacagagggggaactgctgctctccgttctgctgtatggccagcccgtgcggggatccccattccgcgtcagagctctgaggccgggagacctccctcccagtcccgatgacgtcaagcggagagtgaaatcacctggcggtccaggaagccatgtccggcaaaaagctgtcaggcggccatcatcaatgtacagtactggtggaaagcgcaaggacaatcccatcgaggatgagctagtgtttagagtgggaagccggggtcgcgaaaagggagaatttacgaatctgcagggagtctccgccgcttccagtgggaggattgtggtggccgacagcaacaatcagtgtatccaggtgttcagcaatgaaggacagttcaagtttagattcggagtcagggggagatctcctggacagctgcagcgccctactggtgtcgccgtagacacaaatggagacattatcgtcgcggactatgataatcggtgggtgagtatcttctcccctgagggaaagttcaagacaaaaatcggggcaggcaggctcatgggcccaaagggcgtggccgtcgaccgcaacgggcatattattgtggtcgacaacaaaagctgttgcgtttttactttccaacccaatggcaagctagtagggagattcggcggaaggggggcaactgacagacattttgcaggaccgcatttcgtagccgttaataacaagaatgaaatcgtggtgactgacttccacaatcactccgtgaaagtttactctgccgatggagagtttctgttcaagttcggctcgcacggagaggggaacggacagtttaacgctccgacaggcgttgcagtggattctaacggaaacatcatcgacgtgtgccgcgcttcaccttacccctcatacactcccccacacccctgtcaatcagctcctcacccccctgcctggggacagaactctctgccccaggatagaagccccagctcatgcttacccaccaccctgtacaccctcaccgaaactgccattccacacccaccttactag

SEQ ID NO: 245019 - DNA, 1878 bp, Artificial Sequence
  Description of Artificial Sequence: Synthetic coding sequence
atgaaaacgatggagttttactgtgaagcatgtgagaccgcaatgtgcggtgaatgtagagcaggtgaacaccgagagcacggaacggtgcttctgcgggacgtggtagaacaacacaaggctgccctacagcgacagttagaggccgtgagagggaggttgcctcaactgtcagctgcgattgcgttggtggggggaatatctcagcagctacaggaacgaaaggcagaagctctcgctcagatctccgcagcctttgaggatctggagcaggccctgcaacagcggaagcaggccctggtctcagacctggaaacaatatgcggcgcaaagcagaaggtgctgcagagtcaactcgacacgctcagacaggggcaggagcacattggatccagctgttcgttcgcagagcaagccctgaggcttggatcagctcctgaagtcctcttagtgcgcaaacacatgagggagcgtctggcagccttggctgcccaagcatttcccgaaaggccccacgaaaatgcccagctggaacttgtcctggaggtcgacgggctcagacgatcagtgcttaacttgggcgcactacttacaacttctgctacggcacacgagactgtggctaccggcgagggcctcaggcaggccctcgttgggcaacctgccagtctcaccgtgactacaaaggataaggatggccgactggtcaggaccggttcagctgagctacgcgcagaaattacaggccctgacgggacaaggcttcccgtccccgtcgtggatcataaaaatgggacttatgagttagtgtacactgcccgtacagagggcgaactgctcctgtcggtgttactatacggccagcccgtgcgcggttcccccttccgcgtcagagccctgcgcccaggcgatttacccccatcaccagacgacgtcaagagacgagtcaaatccccgggaggacctgggtctcacgtgcggcagaaagctgtcagaaggccctccagtatgtactcaaccggtggcaaaagaaaagacaacccaattgaagacgagctggtttttagagtgggtagtcgcggtcgtgagaagggcgaattcacaaaccttcagggagtgtctgccgctagcagcgggaggattgttgtcgccgacagtaacaaccagtgcatccaggtatttagtaatgaaggacagttcaagttccgctttggggtgcggggtcggagtccaggccaactgcagcggccaacgggcgtggccgtggatacaaacggcgacatcatcgtggccgactacgataacaggtgggtaagcatttttagccctgagggcaagttcaagactaaaatcggagccggacggctgatgggtccaaaaggggtcgctgttgatcgcaacggccacattatagtagtggacaataagagctgttgtgtgttcacctttcagcctaatggtaagttagtgggcagatttggaggcaggggagcgactgataggcatttcgctggccctcatttcgttgcagtcaacaataagaacgagatcgtggtcacagattttcacaatcatagcgtcaaggtctactcggcagacggtgaattccttttcaagtttggcagtcatggtgagggaaatggacagtttaacgccccaacaggggtagctgtggacagtaacgggaacataatagtggctgactggggaaactcacgtattcaggtctttgactcctccggcagttttctgagttacatcaacaccagtgcagaacctctttatgggccacagggcctggcactgaccagtgatgggcacgttgtggtcgccgacgccggaaaccactgctttaaagcctaccgatacttgcaatag

SEQ ID NO: 245020 - DNA, 2001 bp, Artificial Sequence
  Description of Artificial Sequence: Synthetic coding sequence
atggcgaaaagagaggatagccccggacctgaagtgcagcctatggacaaacagtttctggtgtgttccatctgcctcgatagataccagtgccctaaggtcctgccctgcctgcacacgttttgtgagcgatgcctgcagaactacatacctgcacagtcactgacactatcatgccccgtctgtaggcagacttctatcctgcctgaacagggcgtgagcgcattacaaaataattttttcataagctcgcttatggaagccatgcagcaggcccctgatggagcccacgatcctgaggatccgcatccattatccgtggttgccggacgccctctctcctgtcccaaccacgaaggcaagactatggaattttactgcgaggcatgtgagaccgctatgtgcggcgaatgcagggcgggtgagcatagggaacacggtactgttctgctgagggatgttgtcgagcaacataaggctgccctccaaagacagctggaggcagttaggggaaggttacctcagctgtcagcggctatagcccttgtagggggaatctcgcagcaactgcaagagcgcaaagccgaggctctggcccagatttcagccgcttttgaagacctggagcaagcattgcaacagaggaagcaagcgctggtatccgacctggttgacgggttgcggcgatctgtgttgaacctgggggcactgttgaccacttccgccactgcccatgagacagtcgcgaccggagaagggctgcggcaagccctggtggggcagcctgcgtcacttaccgttacaaccaaggataaggacggtagattagtgaggaccggcagcgctgaacttcgtgccgaaattacaggtcccgacggcacgaggttgccggtgcctgtcgtggaccacaagaacggcacttatgagcttgtgtacactgctcgcaccgagggagagctgcttctgtccgtcctgctgtatggacagcccgttagaggctccccattccgggttcgcgctctacgacctggcgacctcccgccaagtccagacgacgttaaacggagagtgaaaagtccaggaggaccgggatcacacgtccgccagaaagctgtaaggagaccaagtagcatgtactctacaggtggtaaacggaaggataaccccatcgaggatgaactcgtgtttagagttggtagccgtggcagagaaaagggggagttcacaaatctgcagggcgtttccgcagcgagcagcggtcgaatcgtggtggccgacagtaacaatcagtgcatccaggttttcagtaacgaagggcagtttaagttccgatttggagtgagggggagatctcctggacagttgcagcggccaacgggggtggctgtagacaccaatggtgacatcatcgtagccgactacgacaacagatgggtgagtattttctcccctgaaggcaagttcaaaaccaaaataggcgcaggccgactgatggggccaaaaggagtggccgtcgaccgtaacggccacataattgtggtggacaacaagtcctgctgcgtgttcacgttccagcccaatggcaaattggtcggtcgcttcggtgggcgaggagccaccgacagacacttcgctgggccacatttcgtggcagtgaataacaagaatgaaatcgtggtgacagattttcacaatcattcagttaaggtttacagtgctgatggggaatttctattcaagtttggctctcacggtgaaggcaacggccagtttaacgctccaactggagtcgcagtggactccaacggaaatattatcgttgcagactgggggaactcaaggattcaagtcttcgactcaagtggatcatttctctcttacattaatacttctgccgagcccctttacggcccacagggcctggcactcacatcagacggccacgttgtggtcgctgacgccggaaatcattgctttaaagcctacagatatctccagtag

SEQ ID NO: 245021 - DNA, 2226 bp, Artificial Sequence
  Description of Artificial Sequence: Synthetic coding sequence
atggcaaagcgcgaggatagcccgggtccagaggtgcaacctatggacaaacagttcctggtttgcagtatatgcttggaccgctatcagtgtccgaaggtactgccgtgtctccataccttttgcgagaggtgcttgcaaaactacatccctgcccagagtctcacgctcagctgtcccgtgtgtcgtcaaaccagtattctccccgaacagggagttagcgcccttcagaacaacttcttcatttcatcacttatggaggctatgcaacaagctccagatggcgcacacgaccctgaggacccccatcctctctcggtcgttgctggtcgtcctttgtcttgccccaaccatgaaggcaagacgatggaattttattgtgaagcatgcgagactgctatgtgcggcgagtgccgcgctggggaacaccgcgaacatggtactgtcctgctgagggacgtggtggagcagcataaagccgcactccaaagacaactcgaagctgtgagaggcaggttgcctcagctgagcgccgcaattgcactggtgggtgggatatcccaacagctccaagagcgtaaggctgaggccctcgcacaaattagcgccgcatttgaggacctggagcaagctctgcagcagcggaagcaggctctggtgagcgacttggagacaatctgtggcgcaaagcagaaagtcctgcaaagtcagctggacactctgcgacaggggcaggagcatatcggttccagttgctcttttgcagaacaggctctcaggctaggtagcgcgccagaggttctgctggtgagaaagcatatgcgagaacgattagctgctctggcggcacaggcctttcctgagaggccacacgagaatgctcagctggagctggttctagaggttgacggtctccgaaggtctgtactgaacctgggggcactgctcaccacgtcagctactgcacatgagaccgtcgcaacaggcgaaggcctgcgccaagccctcgtgggccagcctgcctcacttacagttaccacaaaggataaggatgggagactcgtaaggacaggtagtgcagaactgcgggctgagataactggcccagacggaactcgcctgcctgttccagtggtggatcacaagaacggcacatatgagcttgtgtataccgcccgaactgaaggtgaactgctattgtcagtactgttgtatgggcagcccgtaagggggtcccctttccgcgttagagccctgcggcctggggacctgccaccatcacctgatgacgtgaaacggagagtaaaaagcccaggtggcccaggaagtcatgtgagacagaaagctgtgcggagaccctccagcatgtatagcacaggtggaaagaggaaggataatcctatcgaggatgagctggtattccgggttggcagccgtggacgggaaaaaggggagtttaccaatctacagggggtgagtgctgcatcaagcggcaggatcgtggtcgcggactccaacaaccagtgcattcaggtgttctctaatgagggacagtttaagtttcgtttcggtgtccgcggaaggtctcccggacagcttcaaagaccgactggggtcgccgtcgataccaacggtgacatcatcgttgccgattacgataaccgatgggtgagcattttttcccctgagggtaagttcaaaacgaaaattggggctggcaggctcatgggccctaaaggagtagccgtcgatcgcaacggccatatcatcgtggttgataacaagtcctgttgcgtcttcactttccaacctaatggcaagttagtgggacggttcggcggacggggagccacggatcggcatttcgctggccctcacttcgtggccgtgaacaataaaaatgagatcgtggtgactgatttccacaatcactccgtgaaggtgtacagcgctgacggtgagttcctcttcaaatttggcagccacggggagggtaatggtcagttcaatgcaccgactggcgtggcagtggactctaatggtaacatcatcgtgtgccgggctagcccctatccatcctacacacctccacacccatgtcagtccgcccctcatcctcccgcttgggggcagaactcactgccccaggacagaagccccagcagctgcctccctacgacactctataccctgaccgaaaccgcaattcctcaccctccttactag

SEQ ID NO: 245022 - DNA, 1278 bp, Artificial Sequence
  Description of Artificial Sequence: Synthetic coding sequence
atggcaagcggccagtttgttaacaaacttcaggaagaggtgatctgtcctatctgtcttgacattctgcagaaacccgtgacgatcgactgtgggcataacttttgcttgaagtgcattacacagatcggcgagacgtcttgtggattttttaagtgccccttgtgcaagaccagtgtgagaaaaaacgccattaggtttaattcactactgcgaaacctggtggagaaaatacaggcacttcaggccagcgaagtgcagagtaagcgtaaggaggccacctgcccacggcatcaagaaatgtttcattacttttgcgaggatgacgggaagttcttatgcttcgtctgttgcgaatcaaaagatcataagagtcacaacgtgtctttgatcgaggaggctgcacagaactaccaaggtcagattcaggaacagatacaggtgctgcagcagaaggagaaggagactgtccaggtgaaagcccaaggagttcaccgcgtggacgtgttcaccgaccaggttgagcatgaaaagcaacgcattctgacagaatttgaattgctgcatcaagtgctcgaggaggaaaaaaacttcctcttgtctcgcatctactggctagggcatgagggcactgaggctggcaagcattacgtagcttccacggagcctcagctgaacgacctgaagaagctggtggatagcctgaaaaccaagcagaacatgccccctaggcagctcttagaagatattaaggtagttttgtgcaggtcggaagaatttcagttcctgaaccctacgcctgtgcccctggagctggagaagaagctctcggaggcaaaatcgaggcacgattctatcaccggttccctgaagaagttcaaagatcagctccaagccgacaggaaaaaggatgaaaaccggtttttcaaatctatgaacaaaaatgatatgaagtcttgggggttactccaaaagaacaaccataaaatgaacaaaacctccgaacccggttcttcgtccgcagggggtcgcaccacgtcgggaccccctaaccaccacagctcggcgccttcccatagcctgtttagggcttcatcagctggaaaagtgaccttcccagtttgcctgctggcatcatatgatgaaatctcaggccaaggggcatcttcccaggataccaaaacattcgatgtcgcactgtcagaggagcttcacgccgctctgagcgaatggctcactgccatcagggcatggttttgtgaggtaccatcttcctag

SEQ ID NO: 245023 - DNA, 1278 bp, Artificial Sequence
  Description of Artificial Sequence: Synthetic coding sequence
atggcctctggacagtttgtcaacaagctccaggaagaggtgatttgccccatttgccttgatatactgcagaagccggtaaccatagattgtggtcacaacttctgcctgaagtgtattacccagatcggcgaaacgtcgtgcggatttttcaagtgccccctctgcaagaccagcgtgcgcaaaaacgcaatcaggttcaactccctgctgcgaaatttggttgaaaagatccaggccttgcaggcctccgaagtccaatctaagcgcaaagaagcaacctgtcctaggcaccaggaaatgttccactatttttgtgaggacgacggcaaattcttatgctttgtttgtcgcgaatctaaagaccataaaagccataatgtcagtctgattgaggaggctgctcagaactaccagggacagattcaggaacagatccaggttctccaacaaaaggagaaagaaacggtgcaggtgaaagcccagggcgtgcaccgggttgacgtgtttacagaccaggtggaacacgagaaacaaaggattctgaccgaatttgaattgctccaccaagtgttagaagaagaaaaaaactttctcctctctcggatctattggctcggtcacgaaggcacagaggccggaaaacattacgtggcgtctactgagccgcagctaaatgatctgaagaagttagttgattcattgaaaaccaaacagaatatgcctcctcggcagctgctcgagcccgcacagccacatttgccaagatcagaagagtttcagttcctgaaccctacaccagtgcctctagagcttgaaaaaaaactctcagaggcaaagagccgccacgatagtatcaccggtagtcttaagaaattcaaggaccagctccaggccgataggaagaaagatgaaaaccggttttttaagtcgatgaataaaaatgatatgaaaagttgggggctgttacagaagaataatcataaaatgaacaaaaccagtgaacctgggtccagtagcgccggtggcaggacgacctcaggaccgcctaaccaccattcatccgcaccaagccattcactgtttcgggcttcctcagcaggaaaggtgaccttccctgtttgcctgctagcttcctacgacgaaatctccggacaaggtgcatcctctcaggataccaaaacgttcgatgtcgcactgagtgaggagctccacgccgctctttctgaatggctgacagcaatcagggcatggttctgtgaggtcccctcatcttag

SEQ ID NO: 245024 - DNA, 1278 bp, Artificial Sequence
  Description of Artificial Sequence: Synthetic coding sequence
atggctagcggacagttcgtgaacaaattgcaagaggaagtgatctgtcctatatgtttggacatactccaaaagcctgtgaccatcgattgcggtcataatttttgtctcaaatgtattacacaaattggtgagacttcctgtggcttcttcaaatgccccctgtgtaagacatctgttcggaagaatgcaatccggtttaactccttgctccgtaacttggttgaaaagattcaagcgctgcaagcaagtgaagtgcagagtaaacgcaaagaggccacatgccctcggcaccaggagatgtttcactacttttgtgaggacgacggtaagttcctatgctttgtctgccgcgagagtaaagaccacaagagccacaacgtgtcactcatagaggaagcggcacagaactaccaggggcagatccaggagcagattcaggtattgcagcagaaggaaaaggaaacagtacaagtcaaggcacagggtgtacatcgggtggatgtgtttactgaccaggttgagcatgaaaagcagcgaatcttgacagagtttgagctactccaccaggtgctggaagaggaaaagaattttctcctcagccgcatctattggctgggccacgagggcacagaagccggtaaacattatgtggcctctactgagcctcaactgaacgacttgaagaagctcgtggattcattgaaaaccaagcagaatatgccaccaagacagctcctggaggatatcaaagtggtgctgtgtcgctccgaagaatttcagttcctcaacccaacgccagtgccccttgagttagagaaaaagctctctgaggcaaaatctagacatgatagcatcacaggctctctgaagaagttcaaggaccaactccaagctgaccgtaaaaaggatgagaataggttcttcaagtcaatgaacaaaaatgacatgaaaagctggggattattgcaaaagaacaatcacaagatgaacaaaacttccgagcccggaagcagcagcgcgggaggtaggacgaccagcggaccgcctaaccatcatagcagcgctccatcccatagcctgttcagagccagctccgcaggaaaagtgaccttccccgtgtgtctcttggcttcctatgacgaaatatcaggccagggcgctagttcacaggacacaaagactttcgacgttgctctgagtgaggagctccacgccgcactgagtgaatggctgactgccatccgggcatggttttgtgaagtcccttcttcatag

SEQ ID NO: 245025 - DNA, 747 bp, Artificial Sequence
  Description of Artificial Sequence: Synthetic coding sequence
atggcaagcgggcagttcgtcaacaaactgcaggaagaggtgatctgccccatctgcttggatatcctccaaaaaccggtcacaatcgattgtgggcataacttctgccttaagtgtatcacccagatcggagaaacctcttgcgggtttttcaagtgcccattgtgtaagacgagcgtacgtaagaatgctattaggtttaactcactgctccggaacctggtggagaaaatccaggcactgcaggcatccgaagtccagtccaaacgtaaggaagccacctgccctcgccaccaggagatgtttcattatttttgcgaagatgacggaaagttcttatgtttcgtgtgcagagaatctaaggaccacaagtcccacaacgtgtctcttattgaagaagcagctcagaactaccaaggtcagatacaggagcaaatccaggttcttcagcaaaaggagaaagagaccgtccaggtgaaagcccaaggcgttcatagagtggatgtttttactgaccaagtcgagcatgaaaaacagcgcattctgacggaattcgaactgctgcaccaggttctggaggaagaaaaaaactttctgctaagtcgtatctactggttaggacatgaagggacggaagccggaaagcattacgtcgccagcacagagccacaattgaacgacctgaagaagttggtcgattctctcaagactaaacagaacatgccacccaggcagctcttagaatag

SEQ ID NO: 245026 - DNA, 1278 bp, Artificial Sequence
  Description of Artificial Sequence: Synthetic coding sequence
atggcctcaggccagttcgtcaacaaacttcaggaggaggttatctgtcctatttgcctcgacatcctgcagaaacccgtgacgatcgattgtggccataatttttgtctgaaatgcataacgcagataggggaaacctcttgtggtttctttaagtgcccgttgtgtaaaacctccgttcggaagaatgccatacggttcaacagtctgctgaggaacttggtcgaaaagattcaggccctacaggcaagcgaagttcagagcaagagaaaagaagccacttgcccgaggcaccaggagatgtttcattatttctgtgaagatgatggcaagttcctctgttttgtgtgtcgagagagtaaagaccataagtctcataacgtgtcacttatcgaagaggctgcccagaactatcagggccagatccaagagcagattcaggttctgcagcagaaagagaaagaaacagtccaggttaaggctcaaggagtacatagggtagatgttttcaccgatcaagtggagcatgagaagcagagaatcctgaccgaattcgagttgctgcatcaagtccttgaggaggaaaaaaatttccttctgtcgcgcatctattggttgggtcatgagggtactgaggctggaaagcattatgtggccagcacggagccccagctgaacgacttaaaaaagctagtggattcactgaagaccaaacagaacatgccccctaggcagctgctcgaggatataaaggtagtgctgtgcaggagtgaggaatttcagtttcttaatcccaccccagtccctcttgaattagagaagaagctgagcgaggccaagtctcggcatgacagcataaccggcagtctgaaaaaatttaaggatcagctacaggccgaccgaaaaaaagacgagaaccgttttttcaagtccatgaacaagaacgatatgaaaagttggggactcttgcagaagaacaatcacaagatgaacaagacgtctgagccgggtagcagtagtgccggtggtcgcactacctcgggcccacctaaccaccacagctcagcgccatctcacagcttatttcgggcatcctccgcgggtaaagtgacctttccggtgtgtctcctggcctcttatgatgagatctccggtcaaggggcaagttcacaggacaccaagactttcgacgtggccttgtctgaggagctccatgccgcattgagtgagtggctgacggccatcagagcctggttctgcaaagtcccatcatcctag

SEQ ID NO: 245027 - DNA, 1278 bp, Artificial Sequence
  Description of Artificial Sequence: Synthetic coding sequence
atggccagcggacaatttgtcaacaaactccaggaagaggtcatatgcccaatttgcctagacatactccaaaaacctgtgactatcgactgcggccacaacttctgcttgaagtgtattacgcagatcggcgagacctcctgtggcttttttaaatgcccgctttgcaagacgtctgttcgtaagaacgcgatacggtttaatagcctcctacggaacctagtggaaaagattcaagcccttcaggcatctgaggtacagagtaagaggaaggaagcaacttgtccaagacatcaggaaatgtttcactacttctgtgaagacgatggtaaattcttgtgttttgtgtgcagagaaagtaaagaccataagtcacacaacgtgtccctcattgaagaagctgcccagaactaccagggacagatccaagaacaaatacaggtattgcagcagaaggaaaaagaaaccgtccaggtaaaggcacagggagtgcatcgcgtcgacgtgttcaccgaccaggtcgagcacgagaagcagagaatcctcacagagttcgagttgttacatcaggtgttggaagaggaaaagaattttctgctctctagaatctactggctgggccacgaaggcacagaggctgggaagcactacgtggcctctactgagccccagttaaatgaccttaaaaaacttgtggacagtctcaagaccaaacagaatatgccccctagacagctcctagaggacattaaagttgtactctgtagatctgaagagtttcagtttttaaacccaacacccgtcccattagagctcgaaaaaaaattgtccgaagcaaaaagccgccatgattcaatcacagggagcctgaaaaaattcaaggaccagcttcaggctgaccggaaaaaagacgagaatcggtttttcaaatcaatgaataaaaatgatatgaaaagttggggtctgctccagaaaaataatcacaaaatgaataaaacatccgagcctggcagctcatcagctgggggtagaactacaagcggtcctccaaatcaccatagtagcgcacctagccactctcttttccgtgccagctctgccggaaaggtgaccttcccagtctgcttgctggccagctatgacgaaatttccggacagggtgcaagctctcaagacacgaagaccttcgacgtggctctcagtgaggagttacacgccgcactctctgaatggctaaccgctattcgggcatggttctgtgaggtgccctcctcatag

SEQ ID NO: 245028 - DNA, 1278 bp, Artificial Sequence
  Description of Artificial Sequence: Synthetic coding sequence
atggcctccggacagttcgtaaataagctccaagaagaggtgatctgtcccatttgcttggatatattacagaagccggtgacaatagattgtgggcacaatttctgtctgaagtgcattacgcaaatcggcgagacttcatgcgggttctttaagtgcccactctgcaagacatctgtccgcaaaaatgcaatccggttcaacagcctcctgaggaacctggtggaaaagatccaggctcttcaggccagcgaagtccagagcaaaagaaaagaggccacctgtccacggcaccaagaaatgtttcattacttctgcgaagatgacggaaaatttctgtgctttgtctgcagagaatctaaggatcacaagtcccacaatgtatcccttatagaagaggccgcacaaaactatcagggtcagatccaggaacagattcaggtgctccaacagaaagagaaagaaactgtccaggtcaaagcacagggagtccacagagttgatgtgttcacagaccaggtggaacatgagaagcagcggattctaactgagtttgagctgctgcatcaggtcttagaagaggagaaaaatttccttctgagtcgtatttactggctggggcatgagggaacggaagctgggaagcactatgtcgcatccaccgagcctcaactcaacgacctgaagaagctggtggattcactgaagacgaaacagaacatgcccccacgccagctgctcgaggacatcaaggtggttctgtgccggtctgaagagttccagtttctcaacccaaccccagttccattggagctcgagaagaagctgagtgaggctaagagtagacacgatagcattacaggttccctcaagaagttcaaggaccaactccaggcagatcgcaaaaaagatgagaatcggtttttcaagtcaatgaacaagaatgatatgaagtcctggggactcctgcagaagaacaaccacaagatgaacaagactagtgaacccggtagtagttctgccggaggtcggacgactagcggaccacccaaccatcattcaagcgcaccctcacatagtctgtttagagccagtagtgccggtaaagtcaccttcccagtctgtctcctggcctcttacgacgagatctccggacagggagccagcagtcaagataccaagacttttgatgtggccctgtccgaggagctgcacgccgcactgtctgagtggttgacggccataagggcctggttttgcgaggtcccaagtagctag

SEQ ID NO: 245029 - DNA, 1278 bp, Artificial Sequence
  Description of Artificial Sequence: Synthetic coding sequence
atggcatctgggcaattcgtgaacaaactgcaagaggaagtcatctgtcctatttgcttagatatcctgcagaagcccgtgaccatagattgcggccataacttttgcctgaagtgcatcacccagatcggggagaccagctgtggcttttttaagtgtccattgtgcaaaacgtctgtgagaaaaaatgcaatccggttcaacagcttactgagaaatttagtggaaaagattcaagccctgcaggcttctgaagtccaatctaagcggaaggaagcgacctgtcccagacatcaggagatgttccattatttctgcgaagatgacgggaaattcctgtgcttcgtgtgtcgtgaatccaaggatcacaagagtcataatgtgtctctgattgaggaggccgctcaaaactatcaggggcagattcaggagcaaatacaagtcctacagcagaaggaaaaggaaaccgtccaggtcaaggctcagggggtccatcgagttgacgtgtttactgaccaggtcgagcatgagaagcagcggatactcacagagttcgagttactccaccaggtgttagaggaggaaaaaaacttcttactgtctcgcatatattggctcggccacgagggaaccgaggcaggaaaacattacgtagcttccacggaacctcagctgaacgatttgaaaaagctggtggattcactcaaaactaagcagaatatgccccctaggcagctgcttgaggacattaaggtggtgctctgccggagcgaggagtttcaattccttaacccgacaccagtcccactggagttggagaaaaaactctccgaggctaaatcccgccacgactctattaccggctctttaaagaagtttaaggatcagctccaggctgatcgaaagaaggatgagaataggttcttcaagtccatgaacaaaaacgatatgaagagttggggactcctccagaaaaacaaccacaaaatgaacaaaaccagtgagccgggatcgtcttccgcgggagggaggactacgtccggaccaccgaaccaccactcgagcgcaccatcgcattcgctcttccgagctagctctgctggcaaggtcacctttcctgtgtgtctgctggcatcctatgacgagatttcagggcagggagccagttcacaggatacaaaaaccttcgacgtggccttgagcgaagagctccatgccgcactaagtgagtggctgacagcaatccgggcatggttctgtgaagtcccgagttcatag

SEQ ID NO: 245030 - DNA, 1278 bp, Artificial Sequence
  Description of Artificial Sequence: Synthetic coding sequence
atggcctcaggccagtttgtcaacaagctccaggaggaggtaatttgcccaatttgtctcgacattctgcagaagccggtcacgatcgattgcgggcacaatttctgtctcaagtgcatcacccaaattggggaaacctcttgtggatttttcaagtgtcctctttgtaagacctcagtgcgtaaaaatgcaatccgcttcaactctctgctccgcaacttggtagagaagattcaggctctccaggcatcagaagtgcagtctaagcggaaggaggccacatgcccacggcaccaagaaatgttccactacttttgtgaggacgatggcaagttcttatgcttcgtatgtagagagagtaaagaccacaaaagccataacgtctccctcatagaggaggcggctcaaaattatcagggacagatacaggaacagattcaggtgttacagcaaaaagaaaaggagactgtacaggtcaaagcgcagggagtgcaccgcgtggacgtttttaccgatcaggttgagcatgagaagcaacgaatcttaactgagttcgaactgctgcaccaggttttggaggaggagaagaatttcctgctaagcagaatatactggcttggccacgaaggtacagaagccggaaagcattatgttgcaagtaccgaacctcagttaaacgacttgaagaagctgatagattccctgaagacgaagcagaatatgcctcccaggcagctgctggaggatattaaggtggtgctctgccggtccgaggaatttcagttcctcaatcccacccccgtccccctagagctcgagaagaagctctccgaagctaagtctcgccatgattccattacaggctcgttaaaaaaattcaaggatcagttacaagcagacaggaaaaaagacgagaaccggtttttcaagtccatgaacaagaatgacatgaagtcctggggactgctgcagaagaacaaccataaaatgaataagacttctgaacccggatcctcaagcgctggcggacggacaactagtggcccacccaaccaccactctagcgctccctctcattcgctgtttagagccagtagcgccggtaaggtaaccttccccgtgtgccttctggcctcttacgatgaaatcagtgggcagggtgcctccagtcaagatacaaaaacattcgacgtcgccctgtctgaggagctccatgcagccctaagcgaatggttgactgctattagagcctggttttgcaaagtgccatcctcatag

SEQ ID NO: 245031 - DNA, 1278 bp, Artificial Sequence
  Description of Artificial Sequence: Synthetic coding sequence
atggctagcgggcaatttgtgaataaattacaagaggaggttatctgtccaatttgcctggacatattacagaagcctgtcaccatcgactgtggccataatttctgtctgaagtgtattacccagataggcgagacgagctgcgggttctttaagtgccccctctgcaaaacgtcggtgcgaaaaaatgccattcggttcaactcactcctccgcaatttagtcgagaaaatccaggcccttcaggccagtgaggttcagagtaagcgtaaagaggccacctgtcccaggcaccaggaaatgtttcattacttttgtgaggacgatggcaaatttctatgcttcgtgtgtagggagtccaaagatcacaagtcccacaatgtgtctttgatagaggaagcagcacagaactaccagggtcaaatccaggaacagatacaagttctgcagcaaaaagagaaagaaactgtgcaagtgaaagctcagggtgtgcatcgtgttgacgtgtttacagatcaagtcgaacatgaaaagcaaaggatactaacggagttcgaattgttacaccaggtacttgaggaggaaaagaatttcctccttagccggatctattggctggggcacgagggaaccgaggcaggcaagcactacgtagcctccacagagccccagctcaacgatctcaagaagctggtggactctttgaaaaccaagcagaatatgccaccacggcagctcctggaagatattaaagttgtgctgtgtcggtcagaggagtttcagttcctcaaccccacgcccgtccccctcgagcttgaaaagaagctttctgaggctaagtctcgacatgactctattaccggatctctcaagaagtttaaggaccaactccaggcggaccgcaaaaaggatgaaaatagattcttcaagtctatgaataaaaacgacatgaaaagctgggggctgttacaaaagaacaatcacaaaatgaataaaacatcagagcctggcagctcttccgctggaggacgcacaacttctggtccaccgaaccatcactcgtccgctccgtcgcactcattgttccgcgcaagtagcgccggtaaagtcacgtttcctgtgtgtctgctggctagctatgatgagatatctgggcagggagctagttctcaggacacaaagacctttgacgtggcgcttagcgaggaactgcacgccgctctgtccgagtggcttacagcgattagggcgtggttttgcgaagtgcctagcagttag

SEQ ID NO: 245032 - DNA, 1278 bp, Artificial Sequence
  Description of Artificial Sequence: Synthetic coding sequence
atggcatccggacagttcgtcaacaagctgcaggaggaagtgatctgtccaatttgcctcgacatcctgcagaagcctgttacgatcgattgtggccataatttttgtctgaagtgcattacccagattggcgagacctcttgcggtttctttaaatgccccctatgtaagacttctgtgaggaagaacgcgatccggtttaacagcttattaagaaacctggtggagaagattcaggctctgcaggcctccgaggtgcagagcaagcgcaaagaagcaacatgccctaggcatcaggagatgtttcactacttctgcgaagacgacggaaagttcctttgctttgtatgtcgggaaagcaaggatcataagtctcacaacgtgtcgctgatcgaggaggcagcccagaattaccaggggcagatccaggagcagatccaggtgctccagcagaaggagaaggagacggttcaggtgaaagcccaaggagtgcatcgggtcgatgtgttcaccgaccaagtcgaacatgagaagcagagaatcttaaccgaatttgagctcctgcaccaggtccttgaggaggagaagaactttttgttgtcacgtatttattggttggggcacgaaggtacagaggctggaaaacactacgtcgcaagcactgagcctcagctgaatgacctaaagaaactggtcgacagtttgaaaaccaaacagaacatgccccctaggcaattgttagaacccgcacagcctcatctcccccgaagtgaggagtttcagttcttaaacccaacccccgtccccctagaactcgagaagaaattgagcgaagccaaaagccgccacgactctataactgggtctttaaagaagttcaaggaccaactacaggcagatagaaaaaaggatgagaataggttttttaaatccatgaacaagaacgacatgaagtcctggggcctcctgcaaaagaacaatcataagatgaataaaacctcagaaccaggatcttcaagcgctggcggacgcacaacatcagggccacccaatcaccactctagtgcgcctagccactccttgttccgagctagtagcgctggcaaggtgacgttccccgtgtgtctcttggcttcctatgatgaaattagcggtcagggcgcatcgagtcaggacaccaaaactttcgacgtggccctctctgaagagctccacgcggcactgagcgagtggctcaccgctatcagggcctggttttgcgaagtaccgtcctcttag

SEQ ID NO: 245033 - DNA, 1278 bp, Artificial Sequence
  Description of Artificial Sequence: Synthetic coding sequence
atggctagcggtcagttcgtaaacaagttgcaagaggaggtgatttgccctatctgcttggatattctgcagaaacctgtcacgatcgattgtggccataatttttgcttgaaatgcataacacagatcggagaaacaagctgcggcttctttaaatgtcccctatgtaagacaagtgttcgaaaaaacgcaatccggtttaactcactactacgcaaccttgtggagaagatacaggcccttcaggcttcagaggtacaatccaaacggaaggaggctacctgtccgcgtcaccaagagatgtttcactatttctgcgaggacgatggaaagttcttgtgcttcgtctgccgggaatccaaggatcataagtcacataatgttagccttatagaggaggcagcacagaattatcagggacaaattcaggaacagatccaagtgcttcagcaaaaggagaaggagaccgtgcaggtaaaagcacagggagtgcacagggtcgatgtattcaccgatcaggtggaacacgaaaagcagagaattctaacagagtttgaactactgcaccaagtgttagaggaggagaagaactttttattatctcggatatactggcttgggcacgagggcactgaagcaggtaagcattatgtggcttccactgagcctcaattgaacgacctaaagaagctagtggatagtctgaagaccaagcagaatatgcctccaagacagcttctggaagatatcaaagtggtcctttgcaggtcagaagaattccagtttttaaaccccacaccggtaccgctggagctcgagaagaagctcagtgaggctaaatctcggcacgacagcatcactggcagcttgaagaagtttaaagatcagttacaggctgaccgtaagaaggatgaaaacaggttctttaagtccatgaacaaaaacgacatgaagagttggggcctgctacagaaaaacaatcacaaaatgaataagacatctgagcccggttcctcctctgccggaggccgaaccacctcagggccaccgaatcaccattcttcagctccttcccattcactgttccgcgcatcatccgccggaaaggtaactttccccgtctgtctgctcgcctcttacgatgagatctcgggtcagggtgcatccagtcaggatacaaaaacgtttgatgtcgccctgtctgaagagctgcatgccgctctgagtgagtggttaactgctatacgggcatggttctgcaaggtgccctcctcttag

SEQ ID NO: 245034 - DNA, 1278 bp, Artificial Sequence
  Description of Artificial Sequence: Synthetic coding sequence
atggctagcgggcagttcgtcaacaaactgcaggaggaagtgatttgtccaatctgtctggatatcttacagaaaccagtgactatcgactgtgggcacaacttctgtctgaaatgcatcactcaaatcggggaaacatcttgtggtttttttaagtgtcctctctgcaaaacatccgtccggaaaaatgctattaggtttaatagcctactcagaaatcttgtcgaaaagatacaagcacttcaggcttcagaggtccagtcaaaaaggaaagaagcaacatgtccaagacatcaggagatgtttcattacttctgcgaagatgacggaaagttcctgtgcttcgtatgtcgggaatccaaagaccacaagtctcacaatgtcagcctgatcgaagaggctgctcaaaactatcaggggcagattcaggagcagatccaggtgctgcagcaaaaggaaaaggaaaccgtacaagtgaaggctcaaggagtacatagagtcgacgtgtttactgatcaggtggagcacgagaaacagaggattttaaccgaatttgaattactgcatcaagtcctggaagaggagaaaaatttcctcctgagtagaatttactggcttggacacgaggggacggaggccggtaaacactacgttgctagcacagaacctcaactgaatgatcttaagaagttagtcgacagcctaaaaaccaagcaaaacatgcccccacgccaactcctcgaaccggcacagcctcacctccctagaagcgaagagttccagtttctgaatcctacaccagtgcctctagaattggagaagaaactcagcgaggccaagagccgacacgacagcattacagggtctctgaagaagttcaaggaccaattacaggccgacaggaagaaggatgagaacaggttcttcaagagcatgaataagaacgacatgaagtcttggggactgctgcaaaaaaacaaccataagatgaacaagacttccgaaccgggaagcagcagcgcgggtggaaggactacatccggtcctcccaaccaccactcgagcgccccatcccactccctctttagggcgagttctgcgggtaaggtgactttccctgtttgtctcctcgcttcttacgatgaaatctcgggccagggagcttctagccaggacaccaaaacgtttgacgttgctctatctgaggaactgcacgccgctctgtctgaatggttgaccgcgatcagggcttggttctgcgaggtaccctcctcatag

SEQ ID NO: 245035 - DNA, 1278 bp, Artificial Sequence
  Description of Artificial Sequence: Synthetic coding sequence
atggccagtgggcagttcgttaacaaacttcaggaggaggtcatctgtccaatctgcttggacatcttacagaaacccgtgacaattgactgcggccacaacttctgccttaagtgtatcacccagatcggagagacgagttgcgggttctttaagtgtcccctgtgtaagacttctgttcgcaagaatgccattcggtttaatagcctgctgcgcaacttggtggagaagatacaggccctgcaggctagcgaggttcagagcaaaaggaaggaggccacctgcccacgccatcaggaaatgttccactatttctgtgaggatgacggaaagtttctgtgctttgtgtgcagagaatctaaagaccataagtctcacaatgtgagcttaatagaggaggccgcacagaattatcagggacagattcaggaacaaattcaggtcctgcagcagaaagagaaagagacagtacaggtcaaagcacagggtgtccaccgtgtcgacgtttttactgaccaagtggagcacgaaaagcagaggatcctgacagaattcgagctgttacaccaggttctggaagaggagaaaaatttcttgctgtcccgcatctattggctgggacacgagggaacagaagccggtaaacattatgtggcctctacagagccccagctgaacgacctgaaaaagctcatcgactccctcaaaaccaaacagaacatgcctcctagacagcttcttgagcccgcacagccccatctgcctaggtccgaagaattccagtttctgaatccaacgcccgtgcctcttgagttggaaaagaagttgtccgaggcaaaaagccgacatgacagcattaccgggtctctgaagaagttcaaagaccagctccaggcagataggaagaaagacgagaacaggttcttcaagagcatgaacaaaaacgacatgaagtcttggggtctgctacagaagaacaaccataagatgaataagacatccgagcctggctcaagcagtgctggcggaaggactacgagtgggccacccaatcaccatagttccgccccttcacattctctgtttcgggcatcatccgcaggaaaagtgaccttcccagtctgtctcctggcctcctacgacgagatttccggccagggggcatcttcacaagatacgaaaacattcgatgtggccctgtcagaagaactacacgcagccctttcagaatggctgactgcaattcgagcctggttttgtaaagtgccgtccagttag

SEQ ID NO: 245036 - DNA, 1278 bp, Artificial Sequence
  Description of Artificial Sequence: Synthetic coding sequence
atggcctcaggccagttcgtcaacaaactgcaggaggaggtgatttgcccaatctgtttagatattctgcagaagccagtgaccatcgactgcggccataacttctgtctcaagtgtataactcaaatcggggaaactagctgcgggttttttaaatgtcccctgtgtaagacaagtgtacgaaaaaatgccatccgatttaattctttgctgcgcaacttagtagaaaaaatccaagcgctccaagcaagtgaggtccagtccaaaagaaaggaggcaacctgcccacgccaccaagaaatgttccactatttttgcgaggatgatggaaagttcctgtgtttcgtttgttgcgagagtaaagaccacaaaagccacaatgtaagcctcattgaggaggcagctcagaattatcaaggccagattcaagagcagatacaggtcctgcaacagaaagagaaggaaacagtgcaggtgaaggcccagggagttcatcgggttgacgtgtttacagaccaggtagaacacgagaaacagcggatactcacagaatttgagctcctgcatcaggtgcttgaggaggagaaaaacttcctcctcagtcggatttactggttaggccacgagggaaccgaggctggaaaacattatgtggccagtaccgaacctcagctcaatgatctcaaaaagttagttgactccttgaagaccaagcagaatatgccccctaggcagttgcttgagcctgcacagccacatctcccacgcagtgaggagttccaatttctaaaccctactccagtaccccttgagctggaaaagaagctttccgaagcaaagtcacggcacgattcaatcactggtagtttgaagaagtttaaggatcagctccaggcggacagaaagaaggatgagaatcgctttttcaaatccatgaacaaaaacgacatgaagtcttggggtttgctccagaagaacaaccacaagatgaataagacatctgaacctggctcttcctccgctggcggaagaaccacatctgggcctcccaatcatcacagctccgctcctagccactctctctttagagctagttctgctggcaaagtgacattcccagtatgtttgctggcatcatatgatgaaatctcaggccagggtgcttcctcccaggatactaagacattcgatgtggctctttcagaggagcttcatgccgctctgtcagaatggctgacggctatccgggcttggttttgtgaagtgcccagcagttag

SEQ ID NO: 245037 - DNA, 1278 bp, Artificial Sequence
  Description of Artificial Sequence: Synthetic coding sequence
atggcctcggggcagtttgtcaataagctgcaggaagaggtcatctgccccatatgcctggacatactccagaagccagtcacgattgactgcgggcataacttttgtctcaaatgcataacccaaatcggggagacgtcctgcggattttttaagtgtcctctgtgcaagaccagtgtccgtaagaacgctatccggtttaacagcttgctaagaaacctggtggagaagattcaggctctgcaagccagcgaggtccagtctaagaggaaagaagccacatgcccaagacatcaggagatgttccattatttctgtgaagatgacggtaagtttctctgtttcgtgtgccgagagagcaaagatcacaaatcccacaacgtctccttgatcgaagaggctgcccagaactatcagggtcagattcaggaacagattcaggtgttacagcagaaggaaaaggaaacagtccaggtaaaggcgcagggggttcacagagttgacgtgttcacagaccaggttgagcatgagaagcagcggatactcaccgagttcgagttactccaccaggtgctagaagaggagaaaaactttctactatccaggatctactggctcggacatgaggggactgaggccggaaaacattacgtggcaagcacggaaccacagctgaacgacctcaagaagctcgtggattccctcaaaaccaaacagaacatgcccccaaggcaacttctcgaggacatcaaagttgttctctgccgttccgaagaattccagtttctcaatcctacaccagtccctctcgagcttgagaaaaagctgtccgaagccaaaagccgacacgattcaatcaccggatccctgaagaagttcaaggatcagctgcaggccgaccggaaaaaagacgaaaaccggttcttcaagagtatgaacaaaaacgatatgaaatcgtggggcctgttgcagaaaaataaccataaaatgaataaaaccagtgaacctggatcgtctagtgctgggggaaggaccacatccggtccgcctaatcaccactcttccgcccctagccatagcctgttcagggcttcttcagccggtaaggtgaccttccccgtgtgcctcctggcatcctacgacgaaatctccggacagggagcaagctcccaggacacaaagacgtttgacgtggccctgtcagaagagctgcatgctgcgctcagcgagtggctgactgcgatccgggcatggttctgtgaggtgccatcatcatag

SEQ ID NO: 245038 - DNA, 1278 bp, Artificial Sequence
  Description of Artificial Sequence: Synthetic coding sequence
atggcaagtggccagttcgttaacaagctccaggaggaggtgatctgcccaatttgcctagatattttacaaaagccagtcactatcgattgcggacataacttttgtctcaagtgtattactcaaatcggggagacatcttgtggatttttcaagtgccccttgtgcaagacttctgtaagaaaaaatgccatcaggttcaacagcttactccgtaatctcgtggagaagattcaggcgctgcaagcctcggaggtgcagtcaaaacgcaaggaagccacttgtcctaggcaccaagagatgtttcattacttctgcgaagatgatgggaaatttctgtgcttcgtctgtcgagaatctaaggaccacaagagccataatgtgtctcttatcgaagaggcagcacagaactaccagggccagatccaggagcagattcaggttttgcagcagaaggaaaaagagaccgtccaggtgaaggcacagggcgtccaccgcgtggacgtgtttacggaccaggttgagcatgagaaacaaagaattcttaccgagttcgaactactgcaccaagtcctggaagaggaaaagaacttcttacttagtcgtatatactggctaggtcatgaaggaaccgaggcgggtaagcactacgtggcctcaacggagcctcagctgaatgatctcaagaagcttgtggatagcctgaaaacaaagcagaacatgccgcctaggcagctgttggagccagcacagccacacctcccacggtcagaagagttccagttcctgaaccctacaccggtgcccctcgagttagaaaaaaagctgtcagaagccaaaagcagacatgacagcatcactggttctctgaagaaattcaaggaccagcttcaggctgaccgtaaaaaagatgagaataggttttttaagtcgatgaacaaaaatgacatgaagtcttggggattgctgcaaaagaataatcataaaatgaacaagaccagtgaacctggcagttcctctgccggtggacggacgacctctggacctcctaaccaccactcttctgccccttcacacagcctgttccgggcaagttccgctggcaaggtaacatttcctgtctgtctcctcgcttcttacgatgagatcagtggacagggggcatctagtcaagatacaaaaaccttcgacgttgctttatcagaggaactgcacgctgccttgagcgaatggctgacagcaattcgagcttggttctgcgaagtgcctagctcgtag

SEQ ID NO: 245039 - DNA, 1278 bp, Artificial Sequence
  Description of Artificial Sequence: Synthetic coding sequence
atggcctctggccaattcgttaataaactgcaggaggaagtcatctgtccgatttgtctggatatccttcagaaaccagtgacgatcgattgcgggcacaacttctgtctgaagtgcatcacccaaatcggtgaaactagttgcggcttcttcaaatgtcctctttgcaagacatcagtaagaaagaacgctattcgattcaactcgttgctgcgtaacctagtcgagaagattcaggccctacaggcgagcgaggtccagtcaaagagaaaggaggctacgtgtcctcgccaccaagagatgtttcactacttttgtgaggatgatggcaaattcttgtgctttgtgtgctgcgagagcaaagaccataagagccataacgtgtccctcatagaagaggctgcccagaactaccagggacagatccaggagcagatccaggtgcttcagcagaaagaaaaggagaccgttcaagtgaaggcgcaaggtgtgcatcgcgtagacgtctttactgaccaggtagagcatgaaaagcagaggatcttaacagaatttgaactcctgcaccaggtgctggaagaggagaaaaactttctgctgtcacgaatctattggctggggcacgaaggtactgaagctgggaagcactacgtggcgagtacggagcctcagttaaatgacctaaaaaagctcgtcgattctctcaaaaccaagcagaatatgccacccagacagctactcgaagacatcaaagttgtgttgtgcaggtctgaggaattccaattcttaaaccccacacccgtaccattggagctcgagaagaagctgtcggaggcaaaatctcgacatgactcaatcaccggcagcttgaaaaagtttaaagatcagctccaagccgatcgcaagaaagatgagaacagatttttcaaatccatgaataaaaatgacatgaaatcttgggggctcttacagaagaataatcacaagatgaacaaaacatctgagcccggaagttcctcagctggagggaggacaacctctgggcctcctaaccatcactcaagcgcaccttcccactctctattccgagcgtcatccgccggtaaagtgactttcccggtgtgcctgctggcatcctacgatgagatttccggtcagggcgctagttctcaggacacaaagactttcgatgtggccctatctgaggagcttcatgcggcactgagtgagtggttgactgccatacgggcatggttctgcgaggtgccatccagctag

SEQ ID NO: 245040 - DNA, 1278 bp, Artificial Sequence
  Description of Artificial Sequence: Synthetic coding sequence
atggcatctggtcaatttgtcaataagctccaggaagaggtgatttgccccatttgcctggatatcttgcagaaaccggtgactatagactgtgggcataacttctgtttgaaatgtattactcagattggcgagacgagctgtggcttcttcaagtgtccactgtgcaagacctctgttcggaagaacgctattaggttcaactccctattgcgcaatttggtggagaaaatacaagctctccaggctagcgaggtgcaatcaaagcgaaaagaagccacctgcccacgtcaccaggagatgttccactacttttgtgaagatgatggtaagttcctgtgtttcgtctgccgagaaagcaaagaccacaagtcccataatgtttctcttatcgaggaggctgctcagaactatcagggccaaatccaggaacagatccaagtcctgcagcagaaagagaaggaaactgtgcaggtcaaggctcaaggagtgcaccgcgtcgatgtgtttacagaccaggttgagcacgagaagcagagaattctcactgagtttgagctcctacaccaggtgctggaggaagagaagaactttctcctgtccaggatatactggctcgggcacgagggcaccgaagcagggaagcattatgttgcttctaccgagccacagcttaacgatttgaagaagcttatcgattcgcttaagactaagcagaacatgccccctcgccagctgttggaagatattaaggtggtgctttgcagaagcgaggagtttcagttcctcaatcccactcctgtgcctttggagttggaaaagaagctttccgaagcaaagtctcggcacgactctattaccggttcattaaagaagtttaaagatcaattgcaggctgacaggaagaaggatgagaaccggttctttaaatcgatgaacaagaatgacatgaagagctggggcttgctgcagaaaaataaccataaaatgaacaagacttccgagcctggcagctccagcgccggagggagaacaacaagcgggcctcccaaccaccacagttcagctccctcgcattctttgttccgcgcatcctcggcaggaaaggtgacatttccggtctgcctgctggcttcctatgacgagataagcggccaaggagctagctctcaggatacaaaaacattcgatgtggccctaagtgaggagttacacgctgctctttctgaatggttaacagccatacgtgcctggttctgtaaggtaccgtcatcttag

SEQ ID NO: 245041 - DNA, 1278 bp, Artificial Sequence
  Description of Artificial Sequence: Synthetic coding sequence
atggccagcggacagttcgtgaacaagctacaggaagaagtgatttgtccaatatgtttagacattttacagaagcccgtaaccattgactgtggtcataacttctgcctgaaatgcatcacccagatcggtgagacctcatgcggcttttttaaatgcccactgtgcaaaacgtcagtgcgcaaaaatgctatccggtttaactctctgctacgcaacttggtcgaaaagattcaagcccttcaggcaagtgaggtccagtctaaaaggaaagaagcaacttgtccaaggcaccaggaaatgttccactacttctgcgaagacgacgggaagttcctgtgtttcgtgtgcagagagagcaaggatcacaagagccataacgtgtccttaatcgaggaggcagcacagaattaccagggccaaatccaagaacagattcaggtgttacagcagaaggagaaagaaacggtgcaggtcaaggctcagggcgtccaccgcgtggacgtgtttaccgaccaagttgagcatgaaaagcagaggatcctgaccgagtttgagctactgcaccaagttctcgaagaggaaaaaaacttcctcttgtccaggatctattggctgggtcatgaaggcacagaggccggaaagcattacgtggcctctacagagcctcagttgaatgacttgaagaaactcgtcgacagcttaaagactaagcagaacatgccccctaggcagcttctggagcctgcccaacctcacctgccccgaagcgaggagttccagtttctcaatcctacaccagttccgctcgagctcgagaaaaaactcagcgaggctaagagcaggcacgatagtatcactgggagcctcaagaaattcaaagaccagctgcaagccgacaggaagaaggatgaaaatcgtttcttcaagtccatgaacaagaatgatatgaagagctggggcctgcttcagaaaaataaccacaaaatgaacaaaacctcagagccaggctcctcgagcgctggtgggaggactacatcgggaccacccaaccaccactcctctgccccaagtcattccctgttccgagcctcttctgccggaaaggtcactttcccggtatgtttactggcttcctacgacgagatcagtggtcaaggggcttcctcgcaggacactaagacgtttgatgtcgctttatcagaagaactccacgccgcactgtcggagtggctgacggctattagagcgtggttctgcaaggtgccaagtagttag

SEQ ID NO: 245042 - DNA, 1278 bp, Artificial Sequence
  Description of Artificial Sequence: Synthetic coding sequence
atggcctctggccagttcgtaaacaaattgcaggaggaggtcatctgccccatctgtctggacatcttacaaaagcccgttactattgactgcgggcacaacttttgcctcaagtgtatcacgcaaatcggcgaaaccagctgcggattctttaaatgtcctctgtgtaagaccagtgtccggaagaacgcaattcggtttaatagcttactgagaaacctggtggaaaaaatacaggctttgcaagcctcagaggtgcagtccaagcgaaaggaggctacatgcccaaggcaccaggaaatgttccactatttttgtgaagacgacggtaaattcttgtgtttcgtctgccgggagagtaaggaccacaagagtcataatgttagtctgatcgaggaagcagcgcagaactaccagggacagatccaagaacagattcaagtacttcagcagaaggaaaaggagaccgtgcaggtaaaggcacagggcgtacatagagtggacgtgtttactgaccaggttgaacatgagaaacagcgcatattgactgagtttgaactgctgcatcaggttctggaagaagagaaaaacttcctgctttcgcgcatctattggctaggacatgaaggaaccgaagcaggtaagcactatgtggcatctaccgaaccccagctgaatgacctaaaaaagctcgtagattcccttaaaactaaacaaaacatgccacccagacagctcttggaagacattaaagtcgtgctgtgtcgctcagaagagttccaatttctgaatcctaccccagttcctctggagctggaaaaaaagttaagcgaggccaagagcaggcacgacagtattacaggttccctaaagaaattcaaggaccagctgcaggctgatagaaaaaaggatgagaatcggttctttaagagcatgaacaaaaatgatatgaagtcctggggcctgttacaaaaaaataatcacaagatgaataagacatcagagccaggctcatcttcagcaggcggaaggactacaagcggacctccaaatcatcactcaagtgcacccagtcactctcttttccgcgcttcctccgcgggtaaagtgaccttcccagtttgcttgcttgcgagctatgatgaaatcagcggtcagggggcttcgagtcaggacaccaagacctttgatgtggccctcagtgaagagctgcatgctgccttgtcggagtggttaactgccatcagggcttggttctgcgaggtgccttcatcttag

SEQ ID NO: 245043 - DNA, 1278 bp, Artificial Sequence
  Description of Artificial Sequence: Synthetic coding sequence
atggcatccggccagtttgtgaacaaactacaggaggaagtgatctgccccatctgtctggatatactgcaaaaaccagtcacgatcgattgcggacacaacttttgtctgaaatgcatcacgcagataggcgaaacctcctgcgggtttttcaaatgccccctttgtaaaacctccgtgcggaagaatgctattcgcttcaactctcttctgcggaacctggtggaaaaaatccaggccctgcaggcttctgaagtgcagagcaaacgtaaggaagccacatgcccgcgacaccaggaaatgttccactacttctgtgaggatgatggtaaattcctgtgcttcgtatgcagggagtccaaggatcacaaaagtcacaatgtcagcctgattgaagaggcagctcagaactaccaagggcagatacaggaacaaatccaagttcttcaacaaaaagagaaggagactgtgcaagtgaaagctcagggggtgcatcgcgttgatgtgttcacagaccaagtggaacatgagaaacagagaattcttacagagtttgagctgcttcaccaagtgttggaggaagagaagaatttcctgctctccagaatatactggctgggtcatgagggtaccgaagccggtaagcactacgtagccagcacagaaccacagctgaacgacctgaaaaaacttgtcgactctttgaaaacaaaacaaaatatgcctccccgtcagttattggaggacattaaggttgtgctgtgccggtcagaagaatttcagtttctcaacccgacacccgtcccactggagcttgagaaaaagctttctgaagctaaatcacggcacgacagtataaccggctccctgaagaaatttaaggaccagctccaagccgatcgcaagaaggacgaaaaccgattctttaagtccatgaataaaaacgatatgaagtcctggggtctgttgcagaaaaataaccacaaaatgaataagacgtcagagccgggatcttctagcgccggaggcagaaccactagcggtccacctaaccatcactccagtgcgcctagccatagtctgtttcgggcttcatctgccggtaaggtgacattcccagtctgcttgcttgcttcttatgacgaaatttctgggcagggcgcttcttcccaggatactaaaacattcgatgtagcactatccgaggaattacacgccgctctgtccgagtggctaacggctatccgggcatggttctgcgaagttccatccagctag

SEQ ID NO: 245044 - DNA, 1962 bp, Artificial Sequence
  Description of Artificial Sequence: Synthetic coding sequence
atggcagccgcagctgcttcacacctgaatctagacgccctccgtgaggttctcgaatgcccaatttgtatggaatcatttactgaagaacagctccgccctaagctcttgcattgtgggcacaccatctgtcggcagtgcctggaaaaactgctcgctagttcaataaacggggtcaggtgtccgttttgctcgaagattacgaggataacatctctgacccagctaaccgataatctgactgtactgaagattattgatacagcagggctgtctgaggcggtgggtctgctcatgtgcaggtcttgcggccgacgcctgcctcggcagttttgtcggagttgtggccttgtgttgtgtgagccatgcagagaggcagatcatcagccaccaggccattgcactttacccgtcaaagaagcagctgaggagagaaggcgggatttcggggaaaagttgactaggcttcgggaactgatgggcgaactccagcgccgaaaggctgctcttgaaggagtgtcgaaagacctgcaggctcgttacaaagcagtattgcaggagtatgggcatgaggagcgccgagttcaggatgaactggctaggtcccgcaaattctttaccgggtcccttgccgaggtcgagaaatctaacagccaggtggtggaagagcaatcttacctgctcaacatcgctgaggtccaagcggtttctcgatgtgactattttcttgccaagattaaacaggcagacgtggccctcctggaagaaacggccgatgaagaagaaccagaacttaccgcctcactaccgagagagctcactctccaggatgttgaactactgaaggtgggccatgtcgggcctcttcagatcggtcaagcagtcaagaagccaaggaccgttaacgtcgaggactcctgggctatggaggccaccgcaagtgccgcttccacctcagtcacattccgcgagatggatatgtcacctgaagaagtggtggctagtccaagggctagcccagccaagcagagaggccctgaagccgcttcaaacattcagcaatgtctcttcctgaagaaaatgggggcaaaaggctcaacccccggaatgtttaatttgccagtcagtctatacgtcactagccagggcgaggtgctggtcgcagaccgcggaaactacagaatccaagtgtttacaagaaaggggttcctcaaagagattcgaaggagcccgagcggcattgactcgttcgttctttccttcttgggcgctgatctcccaaatctgacccccctgagtgttgctatgaattgccagggtctgattggcgtgactgactcatacgataattctcttaaggtttatacactggacggtcactgtgtggcttgccacagatcacaactgtcgaaaccctggggaataaccgcactgccttctggacagttcgtggtgacagatgtagagggcggaaaattgtggtgcttcacagtcgaccggggttccggcgtggttaaatactcatgcctctgtagcgccgtccggccaaaatttgtaacctgcgacgctgaaggtaccgtctattttactcagggactgggtctcaaccttgagaatcggcagaatgagcaccacctcgaggggggattctctatcggctcagtgggccctgatggccaactggggaggcagatttcacatttcttctcagagaacgaagattttcgatgcatagctggcatgtgcgtggacgcccgtggagatctgatagttgcggatagttcgcgtaaggaaatcctgcactttccaaagggcggaggctattcagtgctcatcagagaaggtctcacatgtcctgtaggaatcgcgctcactcccaagggtcagctgctggtgcttgattgctgggaccactgtattaagatctactcataccacctgaggcgctactccaccccttag

SEQ ID NO: 245045 - DNA, 522 bp, Artificial Sequence
  Description of Artificial Sequence: Synthetic coding sequence
atggctgccgctgccgctagccacttgaacctggacgcgctaagagaagttcttgaatgccctatttgcatggaatcatttacagaggagcaactgcggcctaagctgttgcattgcggccataccatttgccgtcagtgtttggaaaagctcctcgcaagtagcatcaatggggtccgatgtccattctgttctaagattactcggattacgtcactgactcagcttacagacaacctgaccgttctgaaaataatcgacaccgctggattatccgaagctgtgggcctgctcatgtgtcggtcctgcggacgaaggttgccacgccaattttgcaggtcgtgtgggctcgtcctctgcgaaccttgtcgagaggcagaccatcagcctccaggacattgcaccctgccagttaaggaagcggctgaggagaggagaagagacttcggagagaagctcactcggctgcgagagctgatgggcgagctgcaaaggagaaaggccgctctggagggggtctag

SEQ ID NO: 245046 - DNA, 1962 bp, Artificial Sequence
  Description of Artificial Sequence: Synthetic coding sequence
atggctgcagccgcagcatctcatctcaacctcgatgccctgcgcgaggtcctggagtgtccgatctgtatggagtcctttactgaggagcaactcaggcctaagcttttgcactgcgggcacactatctgtaggcagtgcctcgaaaagcttcttgccagttctatcaatggagtaaggtgtcccttctgttccaaaattacgaggattacctctttgacccaactcaccgataatctgactgtgttgaagatcatcgatacggccggactgtcggaagccgtgggcctgctgatgtgtaggtcctgtggaagaaggctaccacgacagttctgtcgttcatgcggattagtcctctgcgaaccatgccgggaggccgatcatcagccaccaggccattgtacgctcccggtaaaggaggcagctgaggagcggaggcgcgacttcggcgagaaattgacgaggttgcgtgagctcatgggcgaactgcagcgccgtaaggcagccctggagggagtgagcaaggatctgcaggctaggtataaggctgttcttcaggaatatggccacgaagagaggcgtgtacaggatgagctagctagaagccgcaagttctttaccgggtcgctcgctgaggttgagaagtcgaattcccaagtagtggaggaacagtcctacctgctgaacatcgccgaagtccaagccgtatctcgttgtgattattttctcgccaagatcaaacaggcggacgtggccctgctcgaggagacggctgatgaagaagaaccggagctcaccgctagtctgcccagggaactgaccctgcaggacgttgagctgctgaaggttggacacgtagggccactccagatcggacaggcagtgaagaaaccccgtaccgttaatgttgaagacagctgggccatggaagcaaccgcttctgcagcaagcacctcagtgacctttcgagagatggatatgagcccagaagaagtcgtcgccagtccacgggcatcacctgccaagcagcgcggaccagaggctgctagcaatatacaacaatgccttttcctgaaaaagatgggggcaaaaggatccacacctggtatgtttaacctaccagtgagtctgtacgtgacctcacaaggtgaagtactggttgccgaccggggaaattacagaatccaggtgtttacaagaaaaggcttcttaaaggagataaggagatcgccaagtggtatcgattcttttgtgctcagcttcctcggggctgatctccctaacctgacaccgctgtccgtcgccatgaattgtcagggactgattggcgtgactgactcttacgacaactcgttaaaagtttacacactcgatggccactgtgttgcatgtcaccgaagtcagctgtctaaaccctggggtattacagccttgccctccggacagttcgtagtcacagatgtagagggagggaaactgtggtgctttaccgtggatcggggttctggcgtggtgaagtactcatgtctgtgctccgcggtgcggccaaaattcgtgacttgtgatgcagagggtacagtctactttacgcaggggctgggtttgaatctggagaacaggcagaatgaacaccacttagaggggggattctccattgggtcggtgggtccagatggccagctgggtcgccagatcagccatttcttttctgaaaacgaggactttcgttgcattgcgggaatgtgcgtggacgctaggggtgacctcatcgtcgccgattccagcaggaaggagatcctgcacttcccgaagggtggcggatactccgtgctgatccgagagggtttaacttgcccggttggcatcgcccttacccccaagggccagcttctggttcttgactgctgggaccactgcatcaagatctactcttatcacctgaggagatacagcacaccttag

SEQ ID NO: 245047 - DNA, 3384 bp, Artificial Sequence
  Description of Artificial Sequence: Synthetic coding sequence
atggcagaaaacaagggcggtggcgaagcagaatctggcggtggcggttctgggtctgccccagtgacagccggtgccgctggacctgccgcacaagaggctgagcctcccctaactgcagttctggtggaagaggaggaggaggaagggggtagagcgggtgctgagggtggcgctgccggaccagacgatggcggagtggctgcagcctcgtccggcagcgctcaggccgcttctagccctgcagcgagtgtcggcacgggggtggctggcggagcagtgagtacacctgccccagccccagccagtgcgccagcaccgggacccagtgcaggcccaccacctggaccccctgcaagtctgctggacacatgcgctgtgtgtcagcagtccctacaaagcaggcgcgaggctgagcccaaactgctaccgtgtctgcatagcttttgtctgaggtgtctgccagagccagagagacagctaagcgtgcccattcctggaggatcaaacggtgatatacagcaggtcggggtcatccggtgtccggtgtgtcggcaggagtgcagacagattgacctggtggacaactacttcgtgaaggatacgagcgaggcacccagttcctcagacgaaaaatcagaacaagtttgtacatcttgtgaagacaatgccagtgccgtaggcttttgcgtcgaatgcggggagtggttgtgtaagacttgcatcgaagcccatcaaagagtgaagtttacgaaggatcatctcatcagaaaaaaggaagacgtttctgaatccgtcggagcatcagggcagcgtccggttttctgtccggttcataaacaggaacaactcaagctgttttgtgaaacatgtgacagactgacatgtagggactgtcaactgttagaacacaaggaacaccggtaccagttccttgaggaagcatttcagaaccagaaaggtgcaatcgaaaacttgctggcaaaattgctggagaagaaaaactacgtccactttgcggctacacaggtgcaaaacagaattaaagaggtgaacgagaccaataagagggtggaacaagaaattaaggtcgcgatctttactttaataaatgagatcaacaaaaaaggaaagtccttgctacagcagctcgagaacgtaaccaaggaacgccagatgaagctgctgcagcagcaaaatgatataaccggcttaagccgccaggttaagcatgtaatgaattttacaaactgggcaattgcaagcggctcatccaccgctttgttatactccaaacggctaattacctttcaacttcgacacatcttaaaggctcgttgcgatcccgtgcccgcagctaatggtgctatcaggtttcactgcgaccctacattctgggctaagaatgtggtgaacctcggcaatctggttattgagtctaagccagcacccggatacactccaaatgtcgtggtaggccaagttcctcccggaactaatcatatatcaaagaccccaggccagatcaacctcgctcagctgcggctgcagcatatgcagcagcaagtttacgcccagaaacatcagcagttgcagcagatgcggatgcagcagccccctgcacctgtgccaaccacaaccacgaccactcagcagcatccgagacaggccgcacctcagatgctgcaacagcagccgccacgcctcatctccgtgcagaccatgcagcgcggtaatatgaattgtggtgcattccaggcccaccagatgaggcttgcccagaatgctgcacgtatcccaggcatccccagacattctgggccacagtacagtatgatgcagcctcaccttcagagacagcactctaacccaggccatgcagggccattccccgtcgtgagtgtgcacaacaccacgattaatccaacctctcctaccacggccactatggccaatgccaacagaggccctacttccccctccgtgacagccattgagttgatacctagtgtgactaaccctgaaaacctgccgtctctgcctgatattccacccatccagctggaagacgcaggtagctcctccctcgacaatcttctgagccgatatatcagtggatcccatctgcccccacagcctacctcaactatgaacccatcacccggaccctccgccctgagtcctggatctagcggcctctcaaatagccatacaccagtgcggcctccttctaccagctccaccggatcaaggggtagctgtggatccagcgggaggactgcagaaaaaacatccttgtcttttaaaagtgaccaagtcaaggttaagcaagagcccggaacggaggatgaaatctgcagcttttctggcggagtgaaacaggaaaaaacggaagatggtaggagatctgcctgtatgctttcttcacccgagtcaagtctcacccctccactgtctacaaacctgcatttggagagcgaactggacgcactcgcctctttagaaaatcacgtgaagattgagccggcagacatgaacgagtcttgcaagcagtcaggactcagctcattagtcaacggaaagtcacctatccgaagcttaatgcataggagcgctaggataggcggtgatgggaataataaggatgatgacccgaacgaagactggtgtgcagtttgccaaaacgggggtgatctgctttgctgtgaaaagtgccccaaggtgtttcacctgacatgtcacgttcctacgttgctgtcttttccatccggggactggatatgtaccttctgcagagacataggcaagccagaggttgaatatgactgtgataatctacagcacagcaaaaagggcaaaaccgcccagggtctcagtccagtggaccaacgcaagtgtgaaaggttactgctgtatctgtattgccacgagctatctatcgagtttcaagaaccggtgcccgctagcattcctaattactacaagattattaaaaagcctatggatttgagtaccgttaaaaagaaactgcagaagaagcactctcagcactaccagataccagatgacttcgtcgccgatgtgaggctcattttcaaaaactgcgaacgttttaacgagatgatgaaagtggtgcaggtctacgccgatacccaagagattaatcttaaagctgacagtgaagttgctcaagccggtaaggccgtagcactatacttcgaagacaagctgactgagatttacagtgataggacctttgcacctctgccggagttcgagcaggaggaggacgatggagaggtgaccgaggactcagacgaagattttatccaaccccgtcgaaaacgtctaaaaagcgacgagcgtcccgtgcacattaagtag

SEQ ID NO: 245048 - DNA, 3333 bp, Artificial Sequence
  Description of Artificial Sequence: Synthetic coding sequence
atggccgaaaacaaggggggaggggaggcggagtccggcggagggggtagtggaagcgccccagtaaccgctggcgcagccggaccggcagcccaagaagcagaaccgccactgacagctgtcttggtcgaagaggaggaagaagagggcggtagggccggagcagaaggcggtgctgccggtcccgacgacggaggcgtcgcggctgcctcaagtggctcagctcaggccgcttcctcacctgctgccagtgtaggaactggggtggcaggtggcgctgtatctacacctgcccctgctcccgcttctgcccctgcacccggaccctccgcaggtccccctccagggcctccagcctcactcttagacacttgcgccgtttgccagcagtccttgcaatcacgcagggaagcagaacctaagctgctgccatgtttgcattccttctgcctgcgttgtctgccagagcctgaaagacagttaagtgtcccgattcccggaggatccaacggcgatattcagcaggtaggggttataagatgccccgtgtgccgccaggagtgcagacagattgacctcgtggacaattatttcgtgaaagacacgtccgaggccccatccagctctgacgaaaaaagtgagcaggtgtgcacttcatgcgaggacaacgcatccgctgtcggattctgtgttgagtgcggagaatggctgtgtaaaacttgcatagaagcccatcaaagggtaaagtttacaaaagaccacctaatccggaagaaagaggatgtcagtgagtctgtgggggcatcggggcaaagacctgtcttctgccccgttcacaaacaggagcagctgaaattattctgcgaaacatgcgatcgactaacctgccgtgattgccagcttctggagcacaaggagcatcggtaccagtttctggaagaggccttccagaatcagaaaggcgcaattgaaaacttactcgccaagcttcttgagaaaaagaactatgtgcattttgccgcaacccaggtgcagaatcggattaaagaggtaaatgaaaccaacaagagggtcgagcaagagatcaaggtcgccatattcacgttgattaatgaaatcaataaaaaggggaagtcccttcttcagcaattggagaacgtgaccaaggagcgccagatgaaattgctgcagcagcagaacgatattactggtctctcgcgtcaagtcaaacacgttatgaactttactaattgggcaattgcatcaggtagttcaaccgcgctgctgtacagcaaacgtctgattaccttccaactgaggcacattctcaaagctaggtgtgaccccgtgccagccgctaatggcgcaatcaggtttcattgtgatcctactttctgggcaaagaacgtggtgaacctgggtaatctggtgatcgagtcaaaacctgccccaggctacactcctaacgtggtcgtaggacaggtaccacccggaaccaaccatatctcaaaaaccccgggtcagatcaaccttgcacagctgcggcttcagcacatgcagcaacaggtgtacgcccaaaaacaccagcagctacaacagatgaggatgcagcagcccccagctcccgtacccacaaccaccaccactacgcagcagcaccctcgtcaagccgcaccccagatgctccagcaacagccccctagactgatctcagtccagacgatgcagcgaggaaatatgaattgtggtgcttttcaagctcaccagatgcggctggcccagaacgctgcacgcatccccggaattccccgtcacagtgggcctcaatacagtatgatgcagccccacctgcagcgccagcacagtaacccgggacacgctggaccttttcccgtagtcagcgtgcacaataccactattaatccaacctctccaactaccgcaaccatggccaatgctaatcgcggtcctactagcccttcagtaacagccatagagctcataccaagtgttaccaaccctgagaacttgcctagtctgcccgacatcccccctatccagcttgaggatgcaggcagttcttcattggataacctcttatccaggtatatctcaggatcccacctccctccacagccaacgagcactatgaacccctctcccggacccagcgccctgtccccaggtagctcaggtctgtctaattcccacacccctgtgcgcccaccgtccactagctcaaccggctccagaggtagctgtggctcatcaggcaggaccgcggagaagacgtccctgtcctttaaatctgaccaagtcaaggtcaagcaagaacctggcaccgaggacgagatctgctcattttctggtggagttaagcaagagaagactgaagatgggcgacgctccgcctgcatgttgagttcaccagagtctagccttacacctccactgagcaccaatcttcatctggaaagcgaacttgacgcgcttgcgtccctcgaaaaccacgtgaagatcgagcctgctgacatgaatgaatcatgtaaacagtccgggctgtcctccctcgtcaatggcaagtcacccatccgtagcttgatgcatcgcagcgccaggatcggcggtgacggaaacaacaaagacgacgatccaaacgaagactggtgtgcagtttgtcaaaacggcggagatctgctttgttgtgagaagtgtccaaaagtcttccatctgacatgccatgtccccacacttttaagtttccccagtggcgattggatatgtacattctgccgggatataggcaaacccgaagtggagtacgactgtgacaacttgcaacatagcaaaaagggtaagaccgcgcaaggcctgtctcctgtggaccagagaaaatgcgaacgcctgctcctgtatctctattgtcatgagctgagcatcgagttccaagagcccgtgcccgcttcgattcccaactattacaagatcataaagaagccaatggatctgtctacggtgaaaaagaagctccaaaagaagcactcacagcactatcagatcccagacgattttgtcgccgatgtcaggcttatcttcaaaaactgtgaaaggtttaatgaggctgactcggaggtggcccaagccggaaaagcagtggctttgtatttcgaggacaagttgacagagatctactcagataggacctttgcccctctacctgagttcgagcaagaggaggatgacggtgaagtcactgaagactcggacgaggactttatccagcctcgccgtaagcggctgaagtccgacgaaaggcccgttcatattaaatag

SEQ ID NO: 245049 - DNA, 2667 bp, Artificial Sequence
  Description of Artificial Sequence: Synthetic coding sequence
tgatccgtcggcgcatctgggcagaggccagtcttttgccccgtccacaaacaggaacaattgaagttattttgcgaaacttgcgacagactcacatgcagagactgtcaactgctagaacacaaggagcatagataccaattcctggaggaggcattccagaaccagaaaggggctatagagaaccttctggctaaactcctcgagaagaagaattatgtgcacttcgcggctacccaggtgcaaaaccgcataaaggaggtgaatgaaaccaacaaacgtgtggaacaggaaatcaaagttgccatatttacgctgatcaacgaaatcaataaaaaaggtaagtcccttttgcaacagctggagaatgttaccaaggaaagacagatgaaactccttcagcagcagaacgatatcacaggcctgtccagacaggtcaaacacgtgatgaattttaccaactgggctatcgcgtctggctcctccaccgctctgttatattcaaagagactcatcaccttccagctcaggcacatcttgaaagctcggtgcgaccccgtcccagctgctaacggcgctattcggtttcattgcgacccaacattttgggccaagaacgtcgtcaacttggggaacctggtcattgaaagtaagccagcgccagggtacacccctaatgttgtcgtaggacaggtcccccctggcacaaaccacattagcaagactcccggtcagatcaacctcgcccagctcaggttgcagcatatgcaacagcaggtttacgcacaaaagcatcaacagctccagcaaatgcggatgcagcagccgcctgcccctgtacctacaacaaccactaccacacagcaacatccacggcaggctgctcctcagatgctccagcagcagccccctcgcctaattagtgtgcaaacaatgcagaggggcaacatgaactgtggcgcattccaggcacaccagatgcggctggctcagaatgccgctaggatcccgggaatcccgagacacagcgggccacagtattccatgatgcaaccccatctgcaaagacaacactctaatccaggccatgccggaccattccctgtggtgtctgtgcacaacacaaccatcaacccgacatcccccactacagctaccatggcgaatgctaaccgcggacccacaagtcctagtgttaccgctattgagctcattccatctgtgactaatccagagaacctgccatcgctgcccgatattccaccaattcaggctaatgtcgtgccaatgatgcactcttggtacgagttcggagctcgggaaaaaacccaggaccagaacgtgctggaagacgccggaagtagtagcctggacaatttgctgtccagatacataagcggcagtcacctgccgccacaacccacttccacaatgaatccttccccagggccttccgcgcttagccctggctcctcaggtctttctaattcccacacccccgtgagaccaccctcaacttcctcaacaggatcccgaggctcatgtggttcgtctggcagaaccgccgaaaagacgtccctgtctttcaagtctgaccaggtaaaagtcaaacaagaacctggaaccgaggatgaaatctgctcattctcaggcggagtgaaacaagaaaaaactgaggatggtcgccgttccgcttgtatgctgagtagtcccgaaagtagccttacccccccactgagcaccaacctgcatctcgaatcagagcttgatgctctcgcgtcactggaaaatcacgttaagatcgagcccgctgacatgaacgagagctgtaagcagtccgggttgagctccttggtcaatgggaagtctcctattagatctctgatgcataggtctgcacgcattggtggtgacgggaacaataaggatgatgaccctaacgaggactggtgcgccgtttgccagaatggtggcgacctactctgctgcgaaaagtgtcccaaagtgttccatctcacgtgccatgtccctacactgctgagttttccttccggcgactggatctgcaccttctgcagggatattgggaaacccgaagttgagtacgactgcgataacctgcaacacagcaaaaaagggaagacagctcaggggctgagcccagtcgatcagcggaagtgcgaaaggctcctactgtatctgtactgtcacgaactgagcatcgagtttcaagagcctgttcctgcctccatccctaactactataagatcattaagaagccaatggatttgtctaccgtcaagaagaagttacagaaaaaacactcccagcactatcagatcccagacgactttgtggccgacgttcgattgattttcaagaattgcgagcggtttaacgagatgatgaaagtagtccaagtgtacgcagatacccaggaaattaatctgaaagccgattcagaggtagcccaggccggaaaggcagtggctctctatttcgaagacaaactgaccgaaatctacagtgacaggacatttgcacccctgcctgagttcgaacaggaggaggatgacggagaggttaccgaagactcagatgaagacttcatccagcctagacggaaacggcttaagtctgatgaaagacccgtccacataaagtag

SEQ ID NO: 245050 - DNA, 2280 bp, Artificial Sequence
  Description of Artificial Sequence: Synthetic coding sequence
atgaagctgttgcagcagcagaacgacattactggtctgtcgagacaggtgaagcacgtgatgaattttacaaactgggccatcgctagcgggtcttccacagccctgttgtactctaaacggctaatcacattccaactcagacacatactgaaagccaggtgcgatcccgttcctgctgctaatggagcgataaggttccactgcgaccccactttctgggctaaaaatgttgtgaacctaggcaatttggtgatagagagcaagcctgcgcctgggtacaccccaaatgtggttgttggtcaggtgccaccagggacgaaccacatcagcaaaaccccaggccagattaatctggctcagttgagactgcagcacatgcagcagcaggtgtatgcccagaagcaccaacagctgcagcagatgaggatgcagcagcccccagcccctgttcctaccacaactacaacaactcagcagcacccaagacaggccgctccccaaatgttacagcaacagcccccaagattaatatccgtgcagaccatgcaacgtggtaacatgaactgcggagcattccaggcgcatcagatgcggctggcccaaaatgcggctaggattcccggtatccctcgacactccgggcctcagtacagcatgatgcagccccacctgcagcgtcagcactctaaccccggtcatgccggacctttccctgtcgtgtccgtgcacaacaccaccataaacccaactagccctactactgcgacaatggccaacgccaacagaggccctacatccccatccgtgactgcaatcgaacttattccctccgtgaccaaccccgagaatcttccctccctacccgacatccccccaattcaggcgaatgttgtgccaatgatgcactcctggtatgaatttggtgccagggaaaagactcaggatcaaaacgtgttagaggacgctggctcatcctctctggataatctcctcagtagatacatctcaggttcacaccttccccctcaacccactagcaccatgaatccgtctcctggaccatcagcactttccccgggatctagcggtctgtctaacagccacacacccgtccgccctccttccacttcttccacagggagccggggaagttgtggctccagcgggagaactgctgaaaaaacctccttaagtttcaagtccgatcaggttaaggtcaagcaagagcctggcaccgaagacgagatctgctccttctctggaggggtaaagcaagaaaaaacggaagacggtcgcaggtccgcatgtatgctaagttcccccgaatcatcactcacacccccattgtccactaacctgcacctggaaagtgaacttgacgccctagcaagcctcgaaaatcatgtgaagatcgagcccgctgacatgaacgaatcttgtaagcaatccggtctgtcatcattggttaatggtaagtctcctattcggagtctgatgcatagaagcgctcgaatcggcggtgatggtaacaacaaagacgatgacccaaatgaggattggtgtgctgtgtgtcagaatggaggagatttgctgtgttgtgaaaaatgccccaaagtcttccatctcacctgtcacgtgccaactcttctctcatttccctcaggggactggatctgtacattctgtcgcgacattgggaagccagaggtcgagtatgattgtgacaacctgcagcactctaagaaaggcaagacagcccagggattaagtcctgttgaccagcgaaagtgtgagcggctgttgctctacctgtattgccatgagctgtcaatagagttccaggagcctgttccagcttcaattcctaactactataagattattaagaagcccatggatttaagcactgtcaagaagaagctgcaaaaaaagcattcacagcactaccaaataccggacgacttcgtcgccgacgtgaggttgatattcaaaaattgcgagcgttttaatgagatgatgaaagtggtgcaggtgtacgcagacacacaggaaatcaatctgaaagcggacagtgaagtcgcacaggcgggaaaggctgttgctttgtacttcgaagacaagttaaccgaaatttatagcgaccgtacttttgctcccctgccagaattcgaacaggaagaagacgatggggaggttaccgaggactctgatgaggacttcattcagccacgccgaaaaagactcaagagcgacgagcgtccagtacatattaagtag

SEQ ID NO: 245051 - DNA, 2529 bp, Artificial Sequence
  Description of Artificial Sequence: Synthetic coding sequence
atgtgtggaagtgaacgtatattgcaagccggtaatattttggaaatcagagttgggcaggccggagccaggcgagttgcgactatgacaagcccagtcttggtcgatattcgcgaagaagtgacatgtcctatttgcctggaactcctaacagagcccctgtctattgactgcggacactccttctgccaggcgtgcatcaccccgaatggtcgcgaaagcgtgataggacaggagggagaaaggtcttgtccagtgtgtcagacctcttaccagccagggaatctcaggccaaacaggcacctggctaatatcgtcaggcgcctgcgggaggtggtcctggggccaggaaaacaattgaaggcagtcctatgtgccgaccacggggaaaagttgcagcttttctgtcaggaggacgggaaagtgatctgctggctatgcgagaggagtcaggagcacaggggacaccacaccttcctggttgaggaagtggcccaagaatatcaggaaaagttccaggagagtctgaagaagctgaagaacgaggaacaagaggccgaaaagctgacagcattcatccgagagaaaaaaacctcatggaaaaatcagatggaaccagaaagatgtcgcatccagacagaattcaaccagctgcggaatatacttgatcgggtggaacagcgtgagctgaagaagcttgaacaggaggaaaaaaaggggctgcggataattgaggaggctgagaatgacctggtgcaccagacccagtctctgcgggaattgatctcagacctggagcggaggtgccaaggcagcaccatggagctgctgcaggacgtctccgacgtgactgaaagaagtgagttttggactttgagaaagcccgaagccctgccgactaagctgcgctcaatgttcagggcaccagacctgaagaggatgttgcgggtgtgtcgagaactgactgacgtgcagagctactgggcgattcaaggctctttgacacgccgtgagaggcgcgcttctggcgtgcgcactcggcgttcccagggatctagcgccatggccagcaagatcctcctcaacgtgcaggaggaggtgacgtgcccaatctgcctggaattgttgactgaaccattgtctctcgattgtggacactcgctatgcagagcttgtataacagtgagcaataaggaagcagtgacttccatgggtgggaaaagcagctgtccagtctgcgggatctcatattcctttgaacacctacaggcgaatcagcatctcgcaaatattgtggaacggttgaaagaagtgaagttaagtcccgacaatggcaaaaagagggacctttgtgatcaccacggcgaaaaactgcttttattttgtaaagaggatcggaaagttatctgttggctctgcgaacggtcccaagagcatcggggacatcacaccgtgcttaccgaggaagtgttcaaagagtgtcaggagaaacttcaagctgtactgaaaaggctaaagaaagaggaagaagaggccgagaagcttgaagccgacattagagaagaaaaaacttcatggaaataccaggtgcagactgagaggcagagaattcagacagagttcgatcaactgagaagcatccttaataacgaagaacagcgggaattgcagcgccttgaagaagaggaaaagaaaactcttgacaaatttgccgaggcagaggatgaattggttcagcagaagcagcttgtcagagaacttattagtgacgtcgagtgtagaagccagtggagcaccatggagctgttgcaagacatgtctggcatcatgaaatggtcggaaatttggcgccttaaaaagcccaagatggtgtcaaagaaattaaaaacagttttccatgcaccagatctttcccgaatgctgcagatgtttcgcgaattgacggccgtgaggtgttattgggttgatgtgactctcaactcggtgaacctgaacttaaatctcgtgctgagcgaagatcagaggcaggtgattagtgtgcctatttggccttttcagtgttacaactacggcgtcctcggcagccaatatttttcgtctggcaaacattattgggaagtggatgtctcaaaaaagactgcctggattctgggtgtatactgccgaacctattcacgccacatgaagtacgtggtacgccgttgtgccaatagacagaatctttacacaaagtataggcctctatttgggtattgggtcatcgggcttcagaacaaatgtaaatacggtgtgtttgaagagtctttaagctcagatcctgaagtcctgacattgtctatggccgtacctccgtgtcgcgttggagtcttcctagactatgaggctgggattgtgtcgtttttcaatgtgacctcacatgggtcactgatctataagttcagcaaatgctgcttcagccagcccgtttatccatacttcaatccttggaattgtccagccccaatgaccctgtgtcccccatcgtcatag

SEQ ID NO: 245052 - DNA, 1467 bp, Artificial Sequence
  Description of Artificial Sequence: Synthetic coding sequence
atggcgtccaagatcctcctaaatgtgcaggaagaggtaacctgccctatatgcctcgaattgctcacagaacctctcagcttagactgcggccactctctgtgccgggcttgcattacagtgtccaataaagaagccgtcacgagcatgggtgggaaatccagctgccccgtttgtggtataagctattcctttgagcatttgcaggccaaccagcatcttgcgaatattgtggagcggctgaaggaggtcaagctaagtccggacaatggaaaaaagagggacctgtgcgatcaccatggcgagaaactgcttctgttctgcaaggaggaccgcaaggttatttgctggctgtgcgagcggagccaagagcacagagggcaccatactgtcctcactgaggaggtgttcaaagaatgtcaggaaaagctgcaggccgtgctgaaacggcttaagaaggaagaggaagaggccgagaaactagaggccgatatccgcgaagagaagacttcctggaagtatcaggtccagactgagcggcaaaggatacaaaccgaattcgatcaacttaggtccatccttaataatgaagagcagagagaactgcagcgtctggaagaggaagagaagaagaccctggataagttcgctgaagccgaggatgaactggtccagcagaaacagctggtgcgcgagcttatctcagatgtggaatgtcgttctcagtggtccacgatggaactgcttcaggatatgagcggaatcatgaaatggagtgagatttggcggctgaagaagcccaagatggtgtcaaagaagttgaaaacagtgtttcacgctccagatctcagtaggatgctgcagatgttccgggaactgaccgctgtgagatgctattgggtggatgtgaccctcaattcagtgaatctgaatctgaatcttgttctgtcagaggaccaacgacaagtcatatcagtgcccatctggccctttcagtgctataactacggagttctcgggagccagtacttcagttcaggaaagcattattgggaagttgacgtgtccaaaaagactgcctggatcctgggagtgtactgtagaacttactcaaggcatatgaagtatgtcgtaagaagatgcgccaaccggcaaaatttgtataccaagtaccggccactttttggatactgggttatcggtctgcagaataaatgcaaatacggagtgtttgaggagtctctctcgtcagacccggaggtacttactctgtcaatggctgtccccccatgtagagtcggtgtcttcctcgattatgaagctggtatcgtgtcattttttaacgtaacaagccacggatccctcatatacaagttcagcaaatgctgctttagccagccagtgtacccctactttaatccttggaactgcccagcaccaatgacattgtgtcctccgtctagctag

SEQ ID NO: 245053 - DNA, 1467 bp, Artificial Sequence
  Description of Artificial Sequence: Synthetic coding sequence
atggcgtccaagatcttgctcaatgtacaggaagaggtgacctgtcccatatgcctggaactcctgacggagccactgagcttggactgcggccacagcttgtgcagggcttgtattacagtgtcaaataaggaggccgttacgtctatgggtgggaaatcttcctgccctgtgtgtggcatctcttattcatttgagcacctgcaggccaatcaacacttggccaatatcgtagaacggctgaaggaagtcaagctatccccagacaatggcaagaaacgggacctctgtgatcatcatggcgagaagctgctgctcttttgcaaagaggacagaaaagttatctgctggctgtgtgagcggagccaggagcacagaggccaccacaccgtgctgacggaggaagtttttaaagagtgccaggaaaaactgcaggccgtcctaaagagacttaagaaggaggaggaggaagccgaaaaactggaagccgatattagggaggaaaaaacaagctggaagtatcaggtccagacagagcggcaaaggatccagacggagtttgaccaactgagatccatattgaataacgaggagcagcgggaactgcagcgcctcgaagaagaagagaagaagacgctagacaagttcgccgaggccgaggatgaactggtgcagcagaagcaactggttagagagctgattagcgacgtggagtgtcgatcccaatggagtactatggagcttcttcaggatatgagcggcataatgaagtggagcgaaatctggcgcctgaagaaacctaaaatggtgagtaaaaagctcaaaacagtgttccacgccccagacctgagcagaatgctccaaatgttcagagagttgaccgcggtgcggtgttactgggtggacgtgacactcaactccgttaacctgaatctcaacctggtgctttccgaggatcaacgacaggttatctccgtgcccatctggcccttccaatgttataactacggggttttaggtagtcagtatttctcttcgggcaaacactattgggaagttgacgtgagcaaaaaaactgcttggatccttggtgtgtactgcaggacctatagtagacacatgaaatatgttgtacgcaggtgtgcaaaccgccaaaatctgtacacaaagtacagaccgctgtttggatattgggtcatagggctgcagaacaagtgtaaatacggcgtttttgaggaatcactgagttcagatccagaagtgctcaccttatccatggcagtgccaccctgcagggtgggcgttttcctcgattacgaggccggaattgtgtccttctttaacgtgacttcacacggtagtctcatatacaaattctccaaatgttgcttctcacaacctgtatacccctattttaatccttggaactgtccagccccaatgaccctctgccctccgtccagctag

SEQ ID NO: 245054 - DNA, 1467 bp, Artificial Sequence
  Description of Artificial Sequence: Synthetic coding sequence
atggcaagtaagattttgctcaatgttcaggaggaagttacatgccctatttgtctggagcttctgactgaacctctgagcctagattgcggacacagcctttgccgtgcctgtattactgtaagtaataaagaagctgtcaccagcatgggcggaaagagttcctgtccggtttgcggaatatcttactctttcgaacatctgcaagccaatcagcacctcgccaacatcgttgagcgtttgaaagaggtgaaactcagcccagacaatggcaagaagcgagatctgtgtgaccaccatggggagaaactgctgctgttctgcaaggaggatagaaaggtgatttgctggctgtgcgagagatctcaggagcaccggggacaccacaccgtgctaactgaggaagtatttaaagagtgtcaagaaaaacttcaggccgtactgaagaggctgaaaaaggaggaggaggaggcagagaaactcgaggctgacattcgcgaagagaagacaagctggaaataccaggtgcagacagaacgacagcgcattcagactgaatttgaccagttgcgttccatactaaataacgaagagcaaagagaactgcagcggttggaggaagaagagaaaaaaactctggacaagttcgcagaggctgaagatgagcttgtgcaacagaagcagctggtgagggaacttatcagcgatgtggagtgtcgcagccagtggagcacgatggagctgctccaagacatgtctgggatcatgaaatggtccgaaatttggagattgaagaagcctaagatggtctccaagaagctgaagactgttttccacgctcctgacttgtctcggatgctgcagatgttcagagaactgaccgccgtcagatgttattgggttgacgtgactttgaactctgtgaacctgaacctgaatcttgtcctttctgaagaccagaggcaggtgatctccgtgccaatttggccctttcaatgttataactatggagtgctgggctctcaatacttctccagcgggaaacactactgggaggtggacgtatccaagaagaccgcctggattttgggcgtgtactgccggacctactcacgacacatgaagtatgtggtacgccgatgcgctaatcgtcagaacctttacaccaagtaccggccactgttcgggtactgggtcattggccttcagaacaaatgcaagtacggggtgtttgaagagagtctttcaagcgatcctgaggtcctcaccttgtctatggccgtgcctccatgcagggtgggagtgtttctggactatgaggccggaattgtgtcattctttaacgtgaccagtcatggttctctaatctacaaattctcaaagtgttgcttctcacagcctgtctacccgtatttcaacccctggaattgtcccgcacccatgacactgtgccccccatcctcttag

SEQ ID NO: 245055 - DNA, 2187 bp, Artificial Sequence
  Description of Artificial Sequence: Synthetic coding sequence
atgtcggagagcggcgaaatgagcgagtttggttacatcatggaattgattgccaaaggtaaagttactatcaagaatatcgagcgcgaattaatctgtcccgcatgtaaagaactgttcacacacccgctgatcttaccatgtcagcattcaatatgccacaaatgcgttaaggagcttctgttgaccctggatgactcttttaatgacgtcgggagcgacaacagtaaccaatcatcacctcgcctacgattaccgagtccatctatggacaagattgataggattaaccggccaggttggaaaaggaacagcctcacccctcggacgactgtgtttccgtgccccggatgcgaacatgacgttgatttgggggaacggggaatcaatggcctgttcaggaacttcaccctggaaacgattgtagaaagataccggcaggctgccagagccgcaacagccatcatgtgtgacctgtgtaaaccaccccctcaggagtccaccaagtcgtgcatggattgtagcgccagctattgcaatgagtgtttcaagatccaccacccgtgggggacaattaaagcacagcacgaatacgttggcccaaccacgaatttccggccaaagattcttatgtgtcctgaacacgaaaccgagcggatcaacatgtactgtgaactgtgccgccgtcctgtctgccatttgtgtaaattgggcggtaaccatgccaaccatagagtgacaacaatgtcctccgcatacaagacactgaaggagaagttgtcaaaggatatagattatctcatcggtaaggagtcgcaggtgaagagccaaatctctgaactgaacttgctgatgaaggaaaccgagtgcaatggtgagagagctaaggaagaggccataacccattttgaaaaactctttgaagtcctagaagagcggaaaagttcagtgttgaaagcaattgactcttctaaaaaacttaggttagataagttccagacccagatggaggaatatcaaggattactggagaataatgggttggtgggttatgctcaggaggtgcttaaggaaaccgatcaaagttgtttcgtgcagacagccaaacaactgcatcttagaatccaaaaagcaactgaaagtctgaaatcctttaggcctgcggcacagacctctttcgaagattacgtggtgaatacatcaaagcagacggaactgctcggagaactatcttttttctccagcggcatagacgttcccgagattaatgaggagcagtcaaaggtctacaacaatgcgctgatcaattggcatcatcccgagaaagataaagctgattcgtacgtacttgagtacaggaagattaatagagatgacgaaatgagctggaacgaaattgaagtgtgtggcacttctaagatcatccaggacctggaaaacagtagtacctatgcattccgggtgagagcctacaagggctctatctgttctccctgtagcagagagctcattctgcacacccctccggcaccagtcttttctttcctcttcgacgagaagtgtggatataacaacgaacacctgttactcaatctgaaacgggatcgcgtggagagtagggctggatttaatctcctgttggcggctgagcgcattcaggtggggtactacaccagccttgactatatcattggcgacacaggaataactaagggtaaacacttctgggccttccgggtggagccatattcctatctagtaaaagtgggggtagcgtccagtgacaagctccaggagtggctacgaagtccacgcgacgccgtgtcaccacgatacgagcaggactctggacatgactcgggcagtgaagatgcctgtttcgattcctcacagcccttcaccttggtcactatcggtatgcagaagtttttcatccctaagtctcctacctccagtaatgagcctgagaaccgcgttctacccatgcccacatcgattggaatctttttggattgtgataaggggaaagtcgacttttacgatatggaccaaatgaaatgcctttacgagagacaggtggactgcagccacacgctgtacccagcgtttgccctcatgggcagtggcggaatccaactagaagaacccataaccgcgaagtacctggagtaccaggaggatatgtag

SEQ ID NO: 245056 - DNA, 186 bp, Artificial Sequence
  Description of Artificial Sequence: Synthetic coding sequence
atgagtgagagcggagagatgtccgaatttggctatatcatggagcttattgccaaagggaaagcctccgctatgggcttgcagcagacccacgagcattctcggctgacctccaagggcggtgaagccagatgcccctttgagatatcggaggtgggaaagcagagcctcccgagacgaacctag

SEQ ID NO: 245057 - DNA, 183 bp, Artificial Sequence
  Description of Artificial Sequence: Synthetic coding sequence
atgtccgagtccggagagatgtccgagttcggatatatcatggagcttatcgccaagggcaaaatgcccgattggaggaggggatatcggtgtcgacagggatgtggtaagactaccgaactcgctaccgcaacagacttttcccagaccggaaacaagtctggtaaacattttaagacatag

SEQ ID NO: 245058 - DNA, 2895 bp, Artificial Sequence
  Description of Artificial Sequence: Synthetic coding sequence
atggacgagcagtccgtcgagagtattgccgaggtgttccgctgcttcatctgcatggagaaactacgtgatgctaggctgtgtccacactgctctaaactctgttgctttagctgtatacgcaggtggctaacagaacagagagcacagtgcccccactgccgggctcccctacaactgagggaactagtgaactgcaggtgggctgaggaggtgacccaacagctagatacgctgcagctttgttccctgaccaaacacgaggaaaatgaaaaggacaaatgcgagaatcatcacgaaaaactttccgtattttgctggacttgcaaaaagtgcatatgtcaccaatgtgccctctggggtggcatgcatggtggtcacactttcaaacctctggctgagatttacgaacaacatgtgactaaggtgaacgaagaagttgccaaactcaggcggcgactgatggaattgatcagccttgtacaggaagtcgaacgcaacgtggaggcagtaagaaacgccaaagacgagcgagtgcgggaaattagaaatgccgttgagatgatgatcgccaggctggatacccaactgaagaacaaattaataaccctcatggggcagaagacttccctcacgcaagagacagagctgctcgagtccctcctccaagaagtggagcaccagctccgatcttgctcaaagagcgaactgatctcaaaaagcagtgaaatcttaatgatgtttcagcaagttcataggaagcccatggccagcttcgtcacaactccagtcccacccgattttacaagcgaactcgtgccatcatacgattcggcaacttttgtgctcgagaatttctccactctccgtcagcgggcagacccagtgtatagcccgccactccaggtgtctgggctgtgctggcggctgaaagtctatcccgatgggaatggtgtggtgcgcggatactacctctcggtcttcctggagttgtctgccggactacctgaaacctccaagtacgagtaccgggtggagatggtccatcagtcatgcaacgatccgactaagaacattattcgcgagttcgcgtcagactttgaagtcggagagtgttggggatataatcgattcttcagactcgatcttctggctaatgagggatacctgaatccccagaacgacacggtgatactccgcttccaggtcaggtctccaacattctttcagaagtctcgggatcaacactggtacatcacacaactagaggcggcacagaccagttacatacagcagattaacaacctgaaggagcggttgacaatcgaactcagcagaacgcagaagtctcgagatctatcaccaccagacaatcacttgtccccgcaaaatgatgatgccctcgagacaagagccaaaaagagcgcctgcagtgacatgctcctcgaaggcggacccaccacagctagtgttagggaggcaaaggaagacgaagaagatgaggaaaaaatccagaatgaggactaccatcacgaactatctgacggggacttagaccttgacctggtgtacgaagacgaagtgaaccaactggatggcagtagcagcagcgcctcaagtacagccacctccaacactgaggagaacgacattgatgaggagacaatgagcggagaaaacgacgtggaatataacaatatggaactggaggagggcgagttgatggaagatgctgctgcagctggtccggcaggttcatctcacggttacgtgggcagcagttctcgcatttcgcggcgtacccacctgtgttcagcagcaacgagcagcttactggacattgacccgctgatcctgatacatctactagacctcaaagatagatctagtatagaaaacttgtggggactccagccaagaccacctgcctccctgcttcagccaacggctagttatagccggaaggataaggatcagagaaagcagcaagccatgtggcgggtgccgtccgatctcaagatgctgaagcggcttaaaacacagatggcggaagttcggtgtatgaaaaccgacgtgaaaaatacgctctccgaaatcaaaagcagcagtgcagcatccggtgacatgcaaactagtctctttagcgcagatcaggctgcactggccgcttgcgggaccgaaaacagcggtaggctccaggatctgggaatggagctgttggctaagtcttctgtggcaaactgttatatccgtaactccacgaataaaaagagtaatagccccaagcccgctcgctcgtccgtcgccggaagtctgtcattgagacgtgcagtcgaccccggtgagaatagcaggtcaaagggcgattgtcagacattgagcgaagggagcccagggtcaagccagagtgggtccaggcattcaagcccaagagccctgatacatggaagcatcggcgatatactgcccaagaccgaggaccggcaatgtaaagctctcgatagcgacgctgttgtggtggccgtgttttccggactgcccgcagtcgaaaagagaaggaaaatggtgacactgggggctaatgccaagggcggacacctggaaggcctccagatgactgacctggagaacaacagcgagaccggcgagctgcagcccgttctgccagagggcgcatccgcggctcccgaagaagggatgtccagcgattcagacattgaatgcgatacggagaatgaggagcaggaagagcacactagtgtggggggattccatgatagtttcatggtcatgacacagcccccagacgaggacactcatagctcatttcccgatggggagcagattggaccagaagacctgagttttaacacagacgagaattccggacgatag

SEQ ID NO: 245059 - DNA, 2412 bp, Artificial Sequence
  Description of Artificial Sequence: Synthetic coding sequence
atgcacggaggccacacttttaagccattggccgagatctacgagcagcatgtcaccaaagtcaacgaagaagttgctaaattaagaaggcgcctcatggaactgatatcccttgtccaagaggtggagcggaatgtcgaagccgtcagaaatgccaaagatgagcgagtgcgtgaaatcagaaacgccgtggagatgatgatcgctagactagacactcagttgaaaaacaagctgatcaccttaatggggcagaaaaccagcttgacacaggagacagagcttctggagtccttattacaagaggtcgagcatcagctcaggagctgttcgaaatccgagctgatctctaagtcctcggagattctgatgatgtttcagcaggtgcacaggaagcccatggcgagcttcgtaaccacccctgtccctcccgatttcacttcagagctcgtccctagctatgactcggctacatttgtgcttgagaatttctctaccttgagacagcgcgcagacccagtatattctcctcccctccaggtgtctggtctctgctggcgcttgaaggtttatccggacggcaatggcgtcgttcgtggttattacctaagcgtgtttcttgagctgagtgcaggactgccagaaacgagcaagtatgaatatcgagtcgaaatggtgcatcaatcttgtaacgatccgaccaaaaatattatccgggagtttgcaagcgatttcgaggtgggggagtgctggggctacaataggtttttccgactagatctcctggccaacgaggggtatctgaatccccagaacgacaccgtgatactacgattccaggtaaggtctcctaccttcttccagaaatctagggaccagcactggtatatcacacagctggaggccgcacagacatcttacatccagcagataaataatcttaaggaacggctgacgatcgagctcagccgcacccagaagtcccgggatttgtctccgcctgataaccacttgtccccacagaacgatgacgcactggagactcgcgcaaaaaaaagcgcttgcagtgacatgttgctggaaggcggacccacaaccgcctcggtcagggaagctaaggaagatgaggaggacgaagaaaaaatccaaaatgaagactatcatcacgagctgtcagatggtgacctcgatctggatttggtgtacgaggacgaggtgaaccagctagacgggagctcctcctcagcttccagtaccgcaacatccaacactgaggagaatgatattgatgaggagaccatgtcaggagaaaacgacgtcgagtataataacatggagctggaagagggcgagctcatggaagacgccgctgcagctggccctgcaggctcgagtcacggatatgtcggatcaagcagtcggattagcaggcggacccacctctgttcagccgctactagtagccttctggatattgaccccctaattttgatccatctactcgatctgaaggaccgctccagtatagagaatctctggggtctccagcctagaccccctgcctcactccttcagccaaccgcttcctatagcaggaaagataaggatcaacgcaagcagcaggcaatgtggagagtgccctctgatctgaagatgctcaagagactgaagacacaaatggctgaggtgcggtgtatgaagaccgacgtcaagaacactttaagcgaaataaaatctagttctgctgcatccggtgatatgcaaactagtttgttcagcgctgaccaagctgcccttgcagcctgcggtacggagaactcgggacgtttgcaggacctgggcatggaactgctggcaaaatcttccgtcgctaattgttacatcaggaattctaccaacaaaaaatctaatagtcctaagccggctagaagttctgtagcgggaagccttagcctccgacgtgccgtagatcccggagaaaacagtcggtctaaaggagactgccagaccctgagtgaaggcagcccgggttcctctcaaagcgggagtcgacactcctccccaagggccctgatccatggttccatcggtgacatcttacccaagacagaagaccggcagtgtaaggcattggacagcgatgccgtggttgtggccgttttctcaggcctgcctgcagtggagaaacggcgtaagatggtgactctgggggcaaatgccaaggggggtcaccttgaaggcctgcaaatgaccgacctagagaacaacagcgagacgggtgaactgcagcctgtgctcccagagggcgctagcgcagcaccggaagaagacacacacagttcctttccggacggcgagcagattggaccggaagacctgagcttcaatactgacgagaattctggtagatag

SEQ ID NO: 245060 - DNA, 2793 bp, Artificial Sequence
  Description of Artificial Sequence: Synthetic coding sequence
atggatgaacagtcagtggagcggtggctaaccgagcagagggctcagtgtccacattgtcgagctcccctgcagctgagagagctggtgaactgtcgttgggccgaagaggtgactcaacagctggacaccttgcagttgtgcagcctgactaagcatgaagagaacgaaaaggacaaatgtgaaaaccatcatgaaaaactctctgtgttctgttggacatgcaaaaagtgtatatgccaccagtgcgctttatggggcggaatgcacgggggtcacacctttaagcccctagccgaaatctatgaacagcacgtgactaaagttaacgaggaagttgctaagctacgtcgtaggctcatggaactgatctctctagttcaagaggtagagaggaatgtcgaggctgtccggaacgccaaagacgagcgggtgagggaaatacggaacgcagtagagatgatgatagcacggttagacactcagctgaagaacaaattaattacattgatggggcagaagacttccctgacacaggagaccgagctgcttgagtccctgctacaggaggttgagcatcagctgagaagttgcagtaagtcggagctcatctctaagagctctgagattctcatgatgttccaacaggtgcatcgaaagcctatggccagtttcgtgacaacgcctgtccctccggactttacgagtgaactggtgccttcatacgattccgccacatttgtgcttgagaattttagtactctgaggcagcgggcagacccagtatattcacctcctctccaggtgtccggcctttgctggcgactgaaagtgtatcccgacggcaacggagtcgtacgaggctattacctgtccgtttttctcgagctatcagcaggcctgccagagacctccaaatacgagtatagggtggaaatggtgcaccaatcctgcaacgaccctacgaaaaatatcatacgggaatttgcaagcgattttgaggttggagagtgctggggatataatagattttttcgcctggaccttctggctaacgaaggatatctgaacccccagaacgatacagttatcctgcgatttcaggtgagatcacccaccttcttccaaaagagtagagaccagcactggtacatcacacagctcgaggccgcacagacctcatacattcaacagattaataatctcaaagagcggttaacgattgaactgtcacgaactcagaagtcccgagatctgagccccccagacaatcacctttctcctcagaatgatgacgccctggagactcgcgcaaaaaagtccgcatgttccgacatgttgctggagggcggtccgacgacggctagcgtgagagaagcgaaggaggatgaagaagacgaagagaagatccagaatgaagattatcaccatgaactgagcgacggtgacctggacctcgaccttgtctacgaggacgaagtgaatcagctggatggttcgtcctctagcgcttcgagcaccgctacaagcaacactgaggagaacgatatcgatgaggagacgatgtcgggcgagaacgacgtagagtataacaatatggaactcgaagagggagaactgatggaggatgccgcagctgcgggaccagctgggagtagtcatgggtatgttggttcctcaagcagaatttcccggaggacacacctctgctctgccgctacgtccagcctcctcgatattgatcccctcatcctaattcatctactggatctcaaggacagatcctcaattgaaaacttgtggggcctccagccgagaccccctgcttccctgctccaaccaactgcttcttacagtcgaaaagataaagaccaaaggaaacagcaagcaatgtggagggtgccgtcagatctgaagatgctcaagcgcctgaagactcagatggcagaggtccgctgtatgaagaccgatgtcaaaaacacactctccgagatcaaatcaagttccgcagccagtggagacatgcagacctccctgttttccgctgatcaagctgccctggccgcttgcgggaccgagaattctggtcgattacaagatctcggcatggagctgttggctaaaagctccgtggcaaactgctacattcgtaactccactaacaaaaagtctaactccccaaagccagccaggagtagtgtggccggttccctgtccttgcgacgcgctgtggatcccggtgagaacagtagatcaaagggcgactgtcagacactctcagaaggctctcccggaagctcccagtccgggtcccgccattcctcaccaagagccttgatccacgggtctattggcgatattcttcctaaaaccgaggatcggcagtgtaaagcacttgatagcgacgctgtggtggtcgctgtctttagtggattgcctgccgtggagaaacgacggaaaatggtgactttgggagctaatgcaaaggggggacatctagaagggctgcagatgactgatctggaaaataactccgaaactggggagcttcagcccgtgcttccagagggcgctagtgcggctcccgaggaaggaatgtcctcagacagcgacattgagtgcgatacagaaaatgaagaacaggaggaacatacatcagttgggggatttcatgactcctttatggtaatgacacagccgccagatgaagacacacactcttcctttcctgatggggaacagatcggacctgaggatctttccttcaacacagacgagaattccgggcgatag

SEQ ID NO: 245061 - DNA, 2895 bp, Artificial Sequence
  Description of Artificial Sequence: Synthetic coding sequence
atggacgaacagtctgtggagtccatagcggaggtctttagatgttttatttgtatggagaagttaagggatgcacggctctgcccccactgttctaagctgtgctgtttcagctgtatacgacgctggctgacagagcagcgtgcccaatgtccacactgccgcgctcccttacaactgcgcgaactcgtgaattgtcgctgggcagaagaagtgacacaacagctcgatacattacagctctgcagcctgacaaaacacgaagagaacgaaaaagataagtgcgaaaatcaccacgaaaagctgagtgtcttctgctggacatgcaagaaatgtatttgtcaccagtgcgccctgtggggcggaatgcatgggggtcataccttcaagcccctggcagaaatctacgagcagcatgtgaccaaggtgaatgaggaagtggctaagctgcggaggcgcctgatggagttgatctctctagtccaagaagtggagcgaaatgtggaggctgtaaggaatgctaaggatgaacgagtgcgcgagattagaaacgcagtcgagatgatgatcgcacgtttggatacccagctgaaaaataaactcatcaccttgatgggccagaagacgagcttgacccaggaaactgagctgctggaaagtttactgcaggaggtggagcatcagctcaggagttgcagtaagtctgaactgatctctaaatcctctgagattttgatgatgttccaacaggtgcatcggaagcctatggctagcttcgtgacaacccctgtcccccctgatttcacatcggaattggtgccttcttacgactctgcaactttcgttctcgaaaatttctcgaccttgagacagcgtgctgatccagtctattctccccctctgcaggtcagtggactatgttggagactcaaggtttacccagacggcaatggagtcgtccgcggatactacttaagcgtgtttttggaactgagcgcagggctccctgagactagtaaatacgagtatcgcgtggagatggttcaccaatcatgcaatgacccgactaagaatatcattagggaatttgcctcagacttcgaagttggcgaatgctggggttacaatagattctttagactcgatcttcttgccaatgaagggtacctgaacccacagaacgatacagtgatcctgcgcttccaggtgcggtcccctaccttcttccagaagtcaagggaccaacactggtacatcacccagctcgaggccgctcagacaagctatatccagcagatcaataatctcaaagagcgtttgacaatcgagctctcccgcacacagaaatcacgcgacctatcaccacccgacaatcatttgagcccccagaacgatgacgccctcgaaactcgtgcgaaaaagtctgcatgctcggacatgctgcttgagggcggacctactacagcgtcggttcgcgaggccaaagaagacgaagaggatgaggagaagattcaaaacgaggattaccaccatgagctgtcagacggggacctggacctggatttggtgtacgaagacgaagtgaatcagctggacggatcatccagcagtgcctcttcaacagccacgagtaacacggaagaaaacgatatcgacgaggagacaatgtccggcgagaacgacgtggagtacaataatatggaattggaggagggtgagctgatggaagatgcagctgcagctgggccagctggttcttctcacggctacgtgggttcaagtagcaggatttcgaggagaacacacttgtgctcagccgcaacctcctctctgttagacattgacccattgatccttatccatttattggacctcaaggacaggtcatcaattgaaaatctgtgggggctccaaccaagaccacccgcttctctccttcagcccaccgcatcctattcacgcaaggacaaggatcagagaaaacagcaagcgatgtggcgggtaccctccgatctgaagatgctaaaacggctgaagacgcaaatggccgaggttcggtgtatgaaaacagacgtgaagaatacgctgtcagagattaaaagcagctccgccgcttccggggacatgcagacctcactcttttcagccgaccaggccgcactggcagcgtgcggaaccgagaatagtggacgccttcaggacctcgggatggagctcctggccaaatcgtcggtcgcaaactgctacatacgcaatagtacaaataagaagtccaattcacccaaaccagcccgttcaagcgttgctggttccctatccctcagaagagcagtagatcctggagaaaattctagaagcaagggggattgccagaccctgtcggaaggctcacccggatcttcccagtccgggtcacggcactcttcaccacgtgcattaattcacggttccataggcgatattctcccaaagactgaagatcggcaatgcaaagccctggatagcgatgcagtcgtcgttgctgttttctcaggactgcctgccgttgagaagcgccgaaagatggtaaccctaggcgcaaacgcgaaaggaggtcacctggaaggtctccagatgacggatctggagaataattccgaaaccggggagcttcagcctgtattaccagaaggggcttctgccgctcccgaagagggcatgagttccgatagcgatatcgagtgtgatacagagaacgaagaacaggaagagcacaccagcgttgggggtttccacgattcattcatggtcatgacccagccacccgatgaagacacacatagctcttttccagacggagagcagatcggacccgaggacctttctttcaacacagacgaaaactcgggcaggtag

SEQ ID NO: 245062 - DNA, 1557 bp, Artificial Sequence
  Description of Artificial Sequence: Synthetic coding sequence
atggctgaaacctccctgttagaggctggcgctagcgctgcttctacagcggctgcactggaaaacctacaggtggaggcctcctgcagtgtttgtttggagtaccttaaggagcctgtgattatcgaatgtgggcacaacttctgcaaggcctgtattacccggtggtgggaggacctcgagagagactttccttgtcctgtctgtagaaaaacctccaggtatagaagccttcgtcctaaccgccaattggggtctatggtcgagatcgctaagcagctacaggcggttaaacggaagattcgtgacgagagtctttgcccacagcatcacgaggccctctcactgttctgttatgaagatcaggaggccgtttgcctcatctgcgccatttcccatacacaccgggcacacacagtagtgccgctagacgatgccacgcaggaatataaagaaaaattgcagaagtgcttggaaccactagaacagaaactgcaggaaatcacgagatgcaagagtagcgaagagaaaaaacctggcgagttgaagcgcctggtcgagtcccgtcgccagcaaatcctccgtgaattcgaggagctccatagaaggttagatgaggagcagcaggtacttcttagtcggctcgaagaggaggagcaagatatactgcagcgcctgcgcgagaacgcagcacacctgggagacaagcggagagacctggcccacctggccgcagaggtagaaggaaaatgcttgcagagcggatttgagatgctaaaagatgtaaagagtaccttggaaaagaatattcccagaaaattcggagggtcgctgtcaacaatctgcccacgggaccataaggccctgctaggactggtgaaggagattaatagatgtgaaaaagtcaaaacaatggaggtcacaagtgtgtccatagaactggagaagaatttcagtaattttcctcgccagtacttcgcgttgagaaagatcttgaaacagttaatagccgatgtcacgctcgaccccgagactgctcatcccaatttggttttaagtgaggatcggaaatccgtgaagttcgtggaaacaagactgcgggatctccccgacactccaagacgtttcacattttatccttgcgtgttggccactgaggggttcacttccggaaggcattactgggaggtggaagttggtgataagacccactgggcagtgggagtgtgtagagattcagtttcacggaagggagagcttacgcccctgccagaaactggctactggcgtgtcaggctctggaacggtgataagtacgcggctacaaccactccatttacacccttgcacatcaaggttaagcccaaaagggtggggatctttctcgactacgaagccggtaccttaagcttctacaacgtaacggatcgttcacacatttacacatttacagatacattcacagaaaaactgtggcctctgttttaccccggaatccgggcaggaaggaaaaacgctgcaccactaaccatcagacccccaacggactgggagtag

SEQ ID NO: 245063 - DNA, 1467 bp, Artificial Sequence
  Description of Artificial Sequence: Synthetic coding sequence
atggccgaaacgagtttgctcgaggcgggagcctcagccgcaagcacagccgcagcccttgagaaccttcaggttgaagcatcctgttctgtctgtcttgaatacctcaaagaacccgtgattatagagtgtggccacaacttttgtaaagcatgtatcacaaggtggtgggaagacctcgaaagggatttcccctgtcccgtgtgccgtaagacaagtaggtaccggtctttgcgccctaataggcaactgggctcaatggtcgagatagccaaacagcttcaggccgtcaagcgaaaaattcgggatgaatctctgtgccctcagcaccacgaggctttaagcttattttgctatgaggatcaggaggccgtttgtctcatctgtgccatttctcacacacatcgcgcacatacggtggtaccgttagacgacgcaacacaggaatacaaggaaaagcttcagaaatgtttggaacccctggaacagaaactgcaggaaatcacacgctgcaaaagtagtgaagaaaaaaagcctggcgagcttaagcggctggttgagtcacggagacaacagattctccgagaatttgaggagctgcaccgtcgactggacgaagaacaacaggttttgctttctcgactggaagaggaagagcaggatatcctacagaggctgagggagaatgccgcacatcttggcgacaagcggcgagatcttgcccacctcgctgccgaggtggaggggaaatgcctgcagagcggatttgaaatgctgaaagacgtgaaatcaaccctggaaaagtgcgaaaaagtgaagacaatggaggtgacatcagtgtccattgagcttgaaaagaactttagtaatttcccaaggcagtacttcgcattaaggaaaattctgaagcaactcatagctgacgtcacattagatcccgaaacggcacacccgaacctggttctaagcgaggacaggaagagtgttaaattcgtggagacacgcctcagagatctgccggataccccgaggcggttcacattttacccatgtgtgctggccacggaaggcttcactagcggtcgccattattgggaggtcgaggttggggacaaaacacactgggctgtaggcgtctgtagagattccgtgtctagaaaaggcgagctgacaccactccctgaaaccggctattggagggtccggctgtggaacggggataaatatgcagcgaccacaaccccattcacaccactacacatcaaagtaaagccaaaacgcgtgggtatttttctggactatgaggccggtaccttaagtttctataatgtgacagatcgatcccacatctatacttttactgatacctttactgaaaaactctggccactcttttaccctggtatcagggcaggcagaaaaaatgccgcacctctgaccatacggcctcctaccgattgggaatag

SEQ ID NO: 245064 - DNA, 1467 bp, Artificial Sequence
  Description of Artificial Sequence: Synthetic coding sequence
atggctgaaacctctttactcgaggcaggagcctccgctgcctcaactgcagctgcactggagaacctccaggtggaggcctcgtgttccgtgtgccttgagtacctgaaagaacccgtgatcatcgaatgtgggcacaacttctgcaaggcttgtatcactagatggtgggaggacctggaacgtgacttcccctgcccagtctgtaggaaaacttccagatatagatcactgcgaccaaaccgacagctgggatcaatggttgagatcgcaaaacagctccaggccgtgaagcgcaaaatccgggacgagagtttatgtccacagcaccatgaagctttatctctgttttgctatgaggatcaggaggcagtttgcttaatttgcgcaatcagccatacacacagggcccacactgttgtacccctggacgatgccactcaggagtataaagaaaaactgcaaaaatgtttggagcccctggaacaaaagttgcaggagataacccggtgtaagtcaagtgaggagaagaagccgggagaactcaagcgattagtggagagcagaaggcagcagattcttagggagttcgaagagctgcatagaaggctggatgaagaacagcaggtcctcttatcccgactagaagaagaggagcaagacatcctccagcgtctacgggagaacgctgcacacctgggggacaagcgccgtgacctggcacatctggcagcggaggtggagggcaagtgtttgcaaagcggattcgagatgctgaaggacgtaaagtcaactctcgaaaagtgtgagaaagtaaagacaatggaggtcacctcagtatccatagagctggagaagaacttctcgaacttccccagacagtattttgcactccgcaagattcttaagcagctgatcgcagatgtgaccctcgaccctgaaaccgcccatccgaatctcgttctgtctgaggaccgaaaatctgtcaagtttgtcgaaacgcgtctgcgcgacctgcccgacaccccaaggcgattcactttctacccatgcgtgttagccacagaggggttcacgtctgggcgacactattgggaagttgaggtgggcgacaaaacccactgggctgtgggtgtgtgccgcgattccgtgagcaggaaaggcgaactgacacccctcccagagaccggctactggcgagtgagattgtggaacggcgataaatatgccgcaactactacgccatttacacccctgcatattaaagtgaaaccaaagagggtgggaatttttctggattatgaagctggtacactctcattttacaatgtcacggatagaagccatatttacacctttactgacacttttaccgagaagctctggccacttttctatcccggaatcagggccggaaggaaaaacgcagcaccactaaccatcaggcctcctacggattgggagtag

SEQ ID NO: 245065 - DNA, 1557 bp, Artificial Sequence
  Description of Artificial Sequence: Synthetic coding sequence
atggctgaaaccagcctattagaggctggggcatccgcagccagcactgcggctgctcttgaaaacctgcaggttgaggctagttgtagcgtgtgcctagaatacctgaaagaacccgtgataatcgagtgtggtcataacttctgtaaagcctgcattacaaggtggtgggaggacctcgaaagagactttccctgtcctgtgtgtagaaaaacatctcggtacaggagtttgcgccctaataggcagttaggaagcatggttgaaattgctaaacagttgcaggcagtgaagcgcaaaatccgggacgagtcactgtgcccacaacaccatgaagccctctctctgttctgttacgaggatcaagaggcggtctgtctaatatgtgccatcagccatacccatcgcgctcatactgtcgtcccccttgatgatgcaacacaggagtacaaagaaaagctccagaagtgtttggaaccgctggagcagaagcttcaggaaataacaaggtgcaaatctagtgaagagaaaaaaccgggtgaactcaagagactagtcgaaagcaggcggcaacagatcttaagggaatttgaggaattacacagacgtctggatgaagaacagcaggtgctgctctctaggctggaggaagaggaacaggacattcttcagaggctgcgcgagaacgctgcacatcttggggacaaaagacgcgatctagcccatctcgctgcagaggtggaagggaaatgcctgcaatctggcttcgagatgttgaaggacgtgaagtcaaccttggagaaaaacatccccaggaaatttggtggttcactctcaaccatctgccccagggaccacaaggccctgctgggcctggtgaaggagataaaccgttgcgaaaaggtgaaaacaatggaagtgacgtccgtgtctattgagctggagaagaatttctctaactttcctcgccaatatttcgctctgcggaaaattctcaagcagttaatcgctgacgtgacccttgacccagaaacagcccaccctaacctcgttctgtctgaggaccggaaatccgtgaagttcgtggaaaccagactcagggatttacccgacaccccccgacgatttactttctatccctgtgtgctcgccaccgagggatttacgtccggacggcattattgggaagttgaggtgggggataagacacattgggcggtgggggtttgtcgggactctgtgtcccggaagggagagcttactccactgcccgagactggatactggcgagtacgcctttggaacggggacaagtacgcagcaaccactactccgtttacccccctgcacataaaggtgaaacctaaacgggtggggatcttcctggattacgaggcagggaccctgagtttttacaatgtgactgataggtcacatatctacacgtttacggacacattcaccgaaaagctatggcctctcttctacccagggatccgcgcagggcgtaaaaatgcagcccctctgacgatccggcctccaactgactgggagtag

SEQ ID NO: 245066 - DNA, 1467 bp, Artificial Sequence
  Description of Artificial Sequence: Synthetic coding sequence
atggcagaaacatcactcctggaagctggggcatccgcagcctccaccgctgctgctctcgaaaatctgcaagtcgaagctagttgctccgtttgtttagaatacctgaaggaaccggttataatcgagtgtgggcataatttttgtaaagcctgcatcactcgttggtgggaggacctcgagagggatttcccttgtcctgtgtgtcgcaagaccagccggtatagatccctgcggccaaacaggcaactggggagtatggtcgagatcgcaaagcagctccaggccgttaaacggaagataagagatgagtctctttgtccacagcaccacgaggccctttccttgttctgttatgaggaccaggaggcagtatgcttgatctgtgcaatctcacacactcacagggcccacacggtcgtccccctcgacgacgccacccaggaatacaaggaaaagctgcagaaatgtctggagccactggagcagaagttgcaggagattacccggtgtaagtcatctgaggaaaaaaagccaggtgaactgaagagactggtggagtctcggcgtcagcagatcctgcgagagtttgaggaactgcaccggcgactggatgaggagcaacaggtcctgttatctaggctggaggaggaagaacaagacatcctgcagaggctgcgcgagaacgccgcacacctgggggacaaacgcagggatttagcccacttggccgcagaggttgaaggcaaatgtttacagtccggttttgaaatgctgaaagatgtcaaaagcacactcgagaaatgtgagaaggtgaaaaccatggaagtaacatccgtatctatcgagctggaaaagaacttcagcaattttcctaggcagtattttgcactgcgcaagattcttaagcaactcatcgccgatgtgacgctggatcccgagacagcacatccaaatttggtgctgagcgaagacagaaagtccgtgaagttcgtagaaaccaggctgagagacctgccagacaccccaaggaggtttaccttctatccctgcgtgcttgcgaccgagggattcacaagtggacggcattattgggaggtcgaggtgggtgacaaaacacattgggcagtgggagtgtgtcgagatagcgtctccaggaaaggggagctgaccccgcttcctgagactggctactggcgtgttaggctgtggaatggcgataagtatgccgctacaactaccccttttactcctctccacataaaggttaagccaaagagggtggggattttcctcgactacgaagccggtaccttgagcttttacaacgttaccgatcgatctcatatttacacattcaccgacacattcacagaaaaactgtggcctttattctatccagggatccgggcaggtaggaagaacgccgctcccttgactattcggcctcccacagactgggagtag

SEQ ID NO: 245067 - DNA, 1557 bp, Artificial Sequence
  Description of Artificial Sequence: Synthetic coding sequence
atggccgaaacatctctcctggaagcaggagccagcgcagccagtactgctgctgccctcgagaatctgcaggtcgaagcctcttgtagcgtttgtctggaatacttaaaggaacctgtgattatcgagtgcggtcacaacttttgtaaagcctgtataacccgatggtgggaggacctggagagggacttcccatgcccagtgtgcagaaagacatccaggtataggtctctgagacctaataggcaattgggaagtatggtagagatagccaagcagttgcaggctgtcaagagaaagattcgggatgagtccctatgccctcaacatcacgaggctctgtccctgttctgctatgaagatcaggaggccgtctgtctgatctgtgccatctcacacacacaccgggctcatactgttgttcccttagacgatgccacacaggaatacaaagaaaagctacagaagtgtcttgagcctctggagcaaaagctccaggaaattactaggtgcaagtcctctgaggagaaaaagcccggtgagttaaaaagactggtggaaagcaggcggcaacagatactcagggagttcgaagaactccacaggagactagacgaggaacagcaggtcttgctttcgaggctggaggaggaagagcaggacatactgcagcggctgagagagaacgcagcacacctgggagataaacgcagagatctcgcccatctagctgccgaggtggaaggcaaatgtctgcagtcagggttcgagatgttgaaagatgtaaagtcaactctcgaaaaaaacatacccagaaagtttggcggttccttgagtacgatctgtcccagagaccacaaagctctgctgggacttgtgaaagaaattaaccgatgtgagaaggtgaagacaatggaagtgacttccgtcagcatcgaactcgaaaaaaacttctccaacttccctcggcagtacttcgcactccgcaagattctcaaacaactgattgccgatgtgacactggacccagagaccgctcatcccaacctcgtgctctccgaggaccgcaaatctgtgaagtttgtcgaaaccagacttagagatttacccgatactcctcgtagatttaccttttacccctgcgtcttggctactgagggattcacatcagggcgacactattgggaggtcgaggtgggagacaagacgcactgggcagtgggagtatgcagagatagcgtgagccgtaaaggcgagctaacccctctgcccgagacaggttactggagggtgaggctctggaacggcgataagtacgccgctaccacgacgcccttcacccccctgcatattaaggtgaaaccaaagcgggtcggaatattcttggattatgaggctggtacgctcagtttctacaatgtcaccgatcgctcccatatttacacatttacggacacattcacagaaaaactgtggcctctattttatccagggattcgagccggacgaaagaacgctgcccctctaactatcagaccccctaccgattgggaatag

SEQ ID NO: 245068 - DNA, 1467 bp, Artificial Sequence
  Description of Artificial Sequence: Synthetic coding sequence
atggcagagacatcactcctggaagctggcgctagcgccgctagtacagcagccgctctggagaacctgcaggtggaagcctcttgcagcgtgtgtcttgagtatttgaaagagccggtgatcattgagtgcgggcacaacttttgtaaggcttgtatcactcggtggtgggaagatcttgaaagagactttccatgccccgtgtgtaggaaaacaagccgttaccgctcattacgtccgaacagacaattgggatcaatggtcgagattgcaaaacagctgcaagccgtcaagaggaaaattcgcgacgaaagtttgtgcccacagcatcacgaggcgctttccttattctgttacgaagaccaggaggccgtgtgtctcatttgcgccatatctcatacacaccgggcacacactgtggtgccactggatgatgccactcaggaatacaaggaaaagctgcagaagtgcctcgagcccctagaacaaaagctgcaggaaatcacaagatgcaaatcttccgaggagaaaaagccaggcgaactgaaacgactggttgaaagccggaggcagcagatcttaagggaattcgaggagctgcaccggaggctggacgaagagcagcaggttctattgtctcgacttgaagaggaagaacaggacatactccagaggctaagagagaatgcagcccacctgggggataagcggcgagatttagcacacttggctgcagaggtagaggggaagtgcctgcagtccggcttcgagatgctgaaggatgtgaaaagcaccctggagaagtgtgagaaagttaagactatggaggttactagcgtgagcatcgaactggaaaaaaatttctcaaacttcccaagacagtactttgctctgaggaagatcttaaagcagctgatcgcggacgtgacactcgatccagagaccgcccacccaaatctggttctgtcagaagatcgaaaatctgttaagttcgttgaaactcgcctgcgcgatttgccagacacccccaggcggttcaccttctacccatgcgtgctcgcaacagagggtttcacatcaggtaggcactactgggaagtggaggtaggggacaagacacactgggcagttggtgtgtgtagagattcagtcagtcgaaagggagaattgactccactgcctgaaaccggctattggcgcgtgcggctctggaatggagataagtacgcagctacaactactccgtttacaccactgcatatcaaggtgaagcccaagagggtaggcatctttctggactacgaggctggtactctgtctttctataatgtcaccgatagatcacatatctataccttcaccgatacctttacagaaaagctgtggccacttttctatccgggaatccgcgctggacgaaagaacgccgctccactaactatccgccctccaaccgattgggaatag

SEQ ID NO: 245069 - DNA, 1467 bp, Artificial Sequence
  Description of Artificial Sequence: Synthetic coding sequence
atggcagaaacctctcttttagaggccggtgcctccgcagccagcactgctgcagcccttgaaaacctccaggtggaggcttcttgctcagtctgcttggagtaccttaaagagccggtaatcattgaatgcggtcataatttctgcaaggcctgtattacccgttggtgggaagatttggagagggatttcccgtgccctgtgtgcagaaaaacatcacgatatcggagcctgcgcccaaaccggcagttaggatcgatggtggagatcgctaaacagctacaggctgtgaagagaaagattcgagatgagtctctgtgtccgcagcatcatgaggccctcagtcttttctgctacgaggaccaggaggccgtgtgtctgatctgcgctattagccatacccaccgcgctcacactgtggtacccctggacgatgctacccaggaatacaaggaaaagttgcagaagtgcctcgagccactcgagcagaaactgcaagagatcacccgctgcaaaagctctgaggagaagaaaccaggtgagcttaagagactcgtcgaatctagaagacagcagatccttcgcgaatttgaagagctgcacaggaggctcgatgaggagcaacaggtgttactgtctcgccttgaggaagaggaacaggatattttgcagcgcctgagggagaacgccgcacatctaggcgataaacgcagagacttggctcatttggctgcagaggtcgaaggcaagtgtctgcagtccggattcgagatgctgaaggatgtaaaatcaacacttgaaaagtgtgagaaggtgaagactatggaagtgacatccgtcagcatagagctcgagaagaacttctcaaattttccaaggcagtattttgcactgaggaagatcctcaagcagcttattgccgacgtgaccctagatccagaaaccgctcatcctaatctggtgctctccgaagacagaaaatcagtaaaattcgtagaaacaagactccgggatttgcctgacaccccccgaagattcacattctatccctgcgtgctggcaacagaagggtttacatcagggcgacattattgggaagtagaggtgggcgacaagacgcattgggccgtcggggtgtgtcgtgactctgttagtcgcaagggagagctgacgcctctccctgaaaccggctactggagagtaagactctggaatggcgacaagtatgccgctactacaactccctttactcctctgcatatcaaggtcaagcctaagcgagtaggtatctttcttgactatgaagcagggaccctgtctttttataacgtcactgaccgcagtcatatttacacgtttacagatactttcacagagaaactctggccgctgttttatccaggcattagagcgggacggaaaaacgccgcacccctgacaattcggcctcctactgattgggaatag

SEQ ID NO: 245070 - DNA, 1467 bp, Artificial Sequence
  Description of Artificial Sequence: Synthetic coding sequence
atggcagagacttcccttctggaggctggagcatctgcagccagtacagccgcagccctggagaacctgcaggtcgaggcatcctgttccgtgtgtctggagtacctgaaggagcccgtcatcatcgaatgcgggcataacttctgcaaggcatgcatcactcggtggtgggaggacctagagcgggactttccgtgccctgtgtgcagaaaaacttcccgttatcgcagtttgcggccaaaccgtcagctcggttcaatggtagaaatagccaagcaattgcaggccgtcaaaaggaaaataagggacgagtcactgtgcccacagcaccatgaggccctgagcctgttttgctatgaagatcaggaggccgtgtgtctcatatgcgccatttctcacactcaccgagcccacacagttgtccctttagacgacgccacacaggagtataaggagaaactgcagaagtgtctcgaaccccttgagcagaaacttcaggagatcaccaggtgtaagtccagcgaggagaagaagccgggtgagcttaaacgcctggtggagagccggagacagcagattttaagagagttcgaggagttgcaccggaggctggatgaggaacagcaagtgctgctttctcggttagaggaagaagaacaggatatcttacagcgactgcgcgaaaacgccgctcaccttggtgacaagagacgagatctggcccacctcgctgctgaggtggaaggtaagtgtcttcagtctggctttgagatgcttaaagacgtgaaaagcactctggagaagtgtgagaaagtcaagacaatggaagtgactagcgtgtccattgaactagaaaaaaacttcagtaattttcccagacagtactttgcattgaggaagattttgaaacagcttatcgccgatgtcaccctagatccagaaaccgcgcatccgaacctggtcctgtcagaagatcggaagtcagtgaaattcgtggagactagactcagagatctgcccgacacgccacgtagattcaccttttacccatgtgtgcttgcaaccgagggtttcacgtctggtcgccactattgggaggtggaagtgggagacaagacccactgggccgtgggagtctgcagagacagcgtgtccagaaaaggggaactgactcctctgccagagacagggtactggcgcgtgcgactgtggaacggggacaagtacgccgcaactacaacacccttcacacccctgcacatcaaggtgaaaccgaagcgcgttggtatcttcctcgattatgaagccggaacgctgtctttctacaatgtgacagataggagtcatatatatacttttaccgataccttcaccgaaaaactatggcctcttttttaccctggcattcgtgccggacgaaagaacgcagcacccctgacaattaggcctccaactgactgggaatag

SEQ ID NO: 245071 - DNA, 435 bp, Artificial Sequence
  Description of Artificial Sequence: Synthetic coding sequence
atggccgaaacatcactgctcgaggcaggtgcctccgcagcttccaccgcagctgctttagaaaacttgcaagtggaggcgtcatgttccgtgtgtttggaatatctgaaggagcccgtgataattgagtgcggccataatttctgcaaagcgtgtataaccagatggtgggaagacctggagcgcgattttccatgtcccgtctgcaggaaaacatcgcggtatcggtcacttcgaccaaatcggcagctcggaagtatggtcgaaattgccaagcagctccaggctgtgaagaggaagatccgcgatgagtctctgtgcccgcagcatcatgaggcactcagcctcttctgctatgaggaccaagaagccgtttgtcttatctgcgccattagccacacccacagggctcacactgtggttcctttagactag

SEQ ID NO: 245072 - DNA, 684 bp, Artificial Sequence
  Description of Artificial Sequence: Synthetic coding sequence
taaacgtctcgttatagatctctaaggcctaaccgccagttgggtagcatggtagagatcgcaaaacaactacaggccgtcaaaaggaaaatccgggatgaatctctttgtccccaacatcatgaagctctttcactgttttgctacgaggaccaggaggccgtgtgcctgatctgtgcaatatcccacactcacagggcacatactgtcgtgccgctcgacgacgccacacaggaatataaggaaaaactccagaaatgtctcgagcctctcgaacagaaacttcaggagataacacgctgtaaaagctcagaggaaaagaagcctggggaactaaagcgtctggtggagtcccgtcgccaacagattctcagggaatttgaggagctgcataggcgcttagatgaagagcagcaggtgctgctgtctcggctggaggaagaagagcaggacatcttgcagaggctaagggaaaacgcagcacacctgggcgacaaaagaagggatctcgcacatttagcagctgaggttgaaggtaagtgcttgcagagtggcttcgagatgctgaaggatgttaagagcacactcgaaaaatgtgagaaggtgaaaaccatggaggtcacatctacaaccccctgtactagtcttcactccgagattaatgacaacgtgcggggtcgctag

SEQ ID NO: 245073 - DNA, 225 bp, Artificial Sequence
  Description of Artificial Sequence: Synthetic coding sequence
atggctgaaacctcactgctggaggctggagcatccgcagccagtaccgcggctgccctcgaaaatctgcaggttgaagcctcatgcagtgtatgcctggagtacctgaaggaacctgtgatcattgagtgcggccacaacttctgcaaagcatgtataactcggtggtgggaagatctggagagggacttcccctgtccagtgtgcagaaaaacttctcgatag

SEQ ID NO: 245074 - DNA, 1254 bp, Artificial Sequence
  Description of Artificial Sequence: Synthetic coding sequence
atggtcgaaattgcaaaacagctgcaagccgtgaagcggaaaatcagggatgaatctctatgcccacagcatcacgaagctctgagcctgttctgttatgaagaccaggaggccgtgtgcctgatttgtgccatcagccacacccaccgcgcacataccgtggtgcctttggatgacgccacacaggagtataaagaaaagctgcaaaaatgcctcgagcccctcgagcagaaattgcaggagatcacccggtgcaaatccagtgaggagaagaagcctggtgagcttaagaggttggtggaaagccgccgtcaacagatattacgagagttcgaagagctccaccggagactggacgaagaacaacaggtcctgctcagccgacttgaagaggaggaacaggatattctgcaaagactgagggagaatgccgcacacctgggggacaagcggagggacttagcacacctggccgctgaggtggagggtaagtgtctccagtcaggttttgagatgctcaaaccagtgttgtctgctcgcgaggagtgcgagaaggtgaagacaatggaggtgacgtcggtgtccatagagcttgaaaagaacttctcaaatttccctagacagtactttgctttgcggaaaatcctcaagcagttgattgccgacgttaccctcgaccctgagaccgcccatcccaatctagtgctcagtgaagaccggaaaagcgttaaattcgtggagaccagactgcgggacctccctgatacgccaagacggtttaccttctatccatgcgttctggctacagaggggtttacaagtggtcgtcactattgggaagtggaggcggcacactgcgtactggcccaagaccctgaaaaccaagctctcgctagattctactgttatacggagcgaaccattgccaaacgcctcgtgctgcgcagagacccctctgtcaaacggaccctttgtcgcggttgttccagccttttggtgcccggactgacttgtactcaacggcaaaggcgctgtcgcggacaaagatggactgtccaaacgtgtctaacctgtcaacgtagtcagaggtttttaaacgatcctgggcacctgctgtggggagaccgacccgaagcacagctcgggagccaggccgacagcaaacctttacagcccctgcctaatacagcgcactctatttccgatcggcttcccgaggagaaaatgcaaacacagggttcaagtaaccaatag

SEQ ID NO: 245075 - DNA, 1557 bp, Artificial Sequence
  Description of Artificial Sequence: Synthetic coding sequence
atggcagaaacatccctgttggaggccggtgcctccgctgctagtacagcggcagccctggaaaatctgcaagtggaagcatcctgcagtgtctgtctagagtatctcaaggagcccgtaatcatcgagtgtggacacaacttctgcaaggcatgtatcacaagatggtgggaagatctagagcgcgactttccctgtccagtgtgccgcaagaccagtcggtaccgtagccttcgtcccaatcggcagctggggtctatggtcgagatcgccaagcagctccaggctgttaagaggaagattagagatgaaagcctgtgccctcagcatcacgaagccttaagtcttttctgttacgaagaccaggaggctgtttgcttgatttgtgccatctcccacactcaccgcgctcataccgtagtgccactggacgacgccacgcaggaatacaaggagaaattacagaagtgtttggaaccactcgaacagaagttgcaagaaattacccgttgcaagagctccgaagagaagaaacccggagagcttaaacgtctcgtggagagcaggcgccaacagattcttcgggaattcgaggaactccaccgccgtctcgacgaagagcagcaggtgcttttgtcgagactggaagaggaggaacaggacattctccagcgactgagagagaatgcagctcacctgggagacaaaaggagagatctagctcatttggcagccgaagtcgagggcaaatgcctgcaatcaggttttgaaatgctcaaagacgtaaagagtaccctcgaaaaaaatataccaaggaagttcggaggctccctaagcaccatctgcccacgtgaccataaagccctgctcggccttgtgaaagaaatcaacaggtgcgagaaagtcaagaccatggaggttacgagtgttagtatagagctcgagaagaatttctccaatttcccacgccagtacttcgctttgcgcaagattctcaagcaacttatcgctgatgttacgctcgaccccgagaccgcgcaccccaatttggttctgtccgaggacaggaagagcgtgaagttcgtggaaactcgcctacgggatctgcctgacacacctcggaggtttactttttacccatgtgtcttggcaacagagggatttacatccggacggcattattgggaagtggaggtaggggataagacacactgggccgttggtgtgtgtagagacagcgtatctcgcaagggcgaacttacccctttgcctgagacaggatactggagggtgcgcctttggaacggagacaaatacgcagccacaaccacacccttcacaccactgcacatcaaggtaaaacctaagcgggtggggattttcctggactacgaagcgggtaccctgtctttctacaacgtgaccgatagatcccatatttataccttcacagacaccttcactgagaaactatggcccctcttctatcccggaatcagggcgggaagaaagaacgccgcacccctaaccatacgaccacccactgactgggaatag

SEQ ID NO: 245076 - DNA, 1467 bp, Artificial Sequence
  Description of Artificial Sequence: Synthetic coding sequence
atggcagagacctctctgttagaggcaggggctagcgccgcaagcacagccgctgccctggaaaacctgcaagtcgaggctagttgcagcgtgtgcttagaatatttgaaggagcccgtgatcatcgaatgtggtcacaatttctgcaaggcctgtataacacgttggtgggaggatcttgagagagatttcccatgtcccgtctgccgtaagacctccagatacagaagtttaaggcccaatagacagctggggagcatggtggagatagcaaaacagctgcaggcagttaagaggaagatccgggatgaaagcttgtgtccgcagcaccacgaggctctgtcactgttttgttacgaggaccaggaggcagtatgcctcatatgcgccatttcccatacccatagagctcatacagtggtcccactggacgatgccacccaggaatataaagagaagcttcagaagtgtctggaacccctggaacagaagttgcaggaaattactagatgcaagtccagcgaggaaaaaaaaccaggagagcttaagagactggtggagagccggagacagcagatcctacgggaatttgaagaactccatcgcagactagatgaggaacagcaggtgctcctcagccggttggaagaggaagaacaggacatcttacaaagactccgggagaacgccgctcacctgggggataagagacgagatctcgctcacttggccgctgaggttgaaggaaagtgtttgcagtccgggttcgaaatgctcaaagatgtgaagtccactctggaaaaatgcgaaaaggttaaaactatggaggtgacctctgtgagcatcgaattggaaaaaaatttcagcaacttccctaggcagtacttcgccctgcgcaaaatcctgaagcagctcattgctgacgttactttagatcccgagaccgcacatccaaacctcgtgttgtcggaagacaggaaaagcgtgaagtttgttgagactagactaagggatctgcccgacacacctcgtcgtttcacgttttatccttgtgttttggcgacggaaggcttcacaagtggaaggcactactgggaagttgaagttggggacaagacgcactgggccgtcggcgtctgccgggacagcgtctccaggaagggcgagttgacccctctgcccgagaccgggtattggcgcgtacgcctgtggaacggagataaatacgctgccaccacaaccccattcacaccactgcacataaaggtgaagccaaagcgagtgggtatatttttagattatgaggccggaaccttgtctttctataacgtgaccgacagatcccacatttataccttcactgatacgtttaccgagaaactgtggccgctgttttaccccggaatacgtgctggacggaaaaacgcggctccgttgacaataagacctccgaccgattgggagtag

SEQ ID NO: 245077 - DNA, 435 bp, Artificial Sequence
  Description of Artificial Sequence: Synthetic coding sequence
atggctgagacctccttgttggaagcgggagctagtgctgcctctaccgctgctgccctcgaaaacctgcaggtcgaggcatcatgtagtgtctgcttggaatacttaaaagaacctgtcatcattgaatgtggacacaatttctgtaaggcttgtattactcggtggtgggaagatctggagagagatttcccatgccccgtttgtcggaaaacaagtaggtaccgcagtctcagaccaaaccgtcaattgggctcaatggtggaaatagctaaacagctgcaggctgttaagcgcaagatacgagatgagtccttatgcccacaacatcatgaagccttatccctgttttgctacgaagaccaggaagctgtctgtctgatctgcgccatcagccacacccatagagcacacaccgtggttccgcttgactag

SEQ ID NO: 245078 - DNA, 225 bp, Artificial Sequence
  Description of Artificial Sequence: Synthetic coding sequence
atggcggaaacctctctgcttgaagcaggagctagcgccgcttctacggcagctgcactcgaaaatttgcaagtagaagcaagttgcagcgtgtgtctggaatatttgaaggagcctgtgatcattgagtgtggtcataatttttgcaaagcatgcatcactagatggtgggaggatctggagcgggatttcccttgtcctgtttgccgcaagacgtcacggtag

SEQ ID NO: 245079 - DNA, 147 bp, Artificial Sequence
  Description of Artificial Sequence: Synthetic coding sequence
atggccgaaacttcactgttagaggccggtgcttctgcggcttccaccgccgcagcactggaaaatctgcaggtggaggcatcttgtagcgtttgcctagaatacctgaaagagccagtgatcatcgagtgtggccacaatttttag

SEQ ID NO: 245080 - DNA, 1467 bp, Artificial Sequence
  Description of Artificial Sequence: Synthetic coding sequence
atggctgagaccagcttacttgaggcaggggctagcgcagcttccaccgcagccgctctggagaatctgcaagttgaggcttcctgctccgtgtgccttgagtacttaaaggaacccgtgattattgaatgtggccacaatttctgcaaagcctgtattacccggtggtgggaggacttagagcgcgacttcccttgtcctgtctgccgaaagacgtcccgctaccgaagcctcaggcctaatcggcagctgggctccatggtggagatcgccaagcagctgcaggccgtgaagcgcaaaatccgagacgaatccctttgtccacagcatcacgaagccctgagtcttttctgctatgaggaccaggaggccgtgtgcctgatctgcgccatatcgcacacacaccgcgcacataccgtggtgcccctggacgatgcaacccaggagtataaagaaaagctacagaaatgcctcgaacctttagaacagaagctccaggaaatcaccagatgcaagtccagcgaggaaaagaagccaggagagctgaaaagactggtggagtcccgcagacagcaaatcctccgggaattcgaggaattgcatagacggcttgatgaggaacagcaggtgctcttatccaggttggaggaggaagaacaggacattttacagcggctgcgtgagaacgctgcccatctgggcgacaaacggagggacctggctcacctggcagcagaggtggaaggcaaatgcctccaaagtggattcgagatgttgaaagatgtgaaatccactctggagaagtgcgagaaagtgaagactatggaggtaacatccgtctcaattgagcttgaaaagaacttctctaattttccgagacaatactttgctcttcgcaagattttgaaacaactaatcgctgatgtgacgctcgatcctgaaacagcacatcccaacctcgttctaagcgaggatcgcaagtcggtgaagttcgttgagactcgtctaagagacctacccgatacaccccgtagatttaccttttatccatgtgtgctggccaccgaagggttcacatccggaagacactattgggaagttgaggtaggcgataaaacacactgggccgtgggggtgtgtcgtgattccgtttccagaaaaggcgagctgactccacttccagaaactgggtattggcgggttcgcctgtggaacggagacaaatatgccgcaactactactccattcacccctctgcatatcaaagtgaagcctaaaagagtcgggatcttcctggactatgaggccggtaccctcagcttctacaacgtgacagacaggtcacatatttataccttcacggatactttcacggagaagctgtggcccttgttctacccaggaataagggcaggtagaaagaacgctgcaccattgaccatcaggcccccaaccgattgggagtag

SEQ ID NO: 245081 - DNA, 684 bp, Artificial Sequence
  Description of Artificial Sequence: Synthetic coding sequence
taaactagccgttacagatccttaaggcccaaccgacagctgggcagcatggttgaaattgcgaagcagttgcaggcagtcaagagaaagataagggatgagtcattgtgcccacagcaccatgaggcgttatcacttttctgctacgaggatcaagaggccgtgtgcctgatttgcgccatctcacacacacacagggcacatacggtcgtcccactggacgacgccactcaggagtataaggaaaaattgcagaagtgcctggagcccctcgagcagaagctccaggaaatcacccgctgcaagagcagcgaggaaaagaagcctggagagttaaagcgcttggtggagagccggaggcaacagatcctcagggagttcgaagagctccacagacggcttgacgaggagcagcaagtcctgctcagtcggttagaggaggaagagcaggacattctgcaacgcctgcgggagaacgccgcacatctcggggacaagcgtcgagacttggcacatctcgccgctgaggtggaaggcaaatgcctgcaatctgggttcgagatgttaaaagacgtgaaatccaccttggagaagtgtgagaaggtgaagactatggaggtgacttcgaccacgccttgcacatctcttcattcagagattaacgataacgttcgcggaagatag

SEQ ID NO: 245082 - DNA, 147 bp, Artificial Sequence
  Description of Artificial Sequence: Synthetic coding sequence
atggccgagacatcactgctggaagccggtgcatctgccgctagcaccgcggctgctctggagaatttgcaggtggaggccagctgcagcgtgtgcctggagtacctaaaggagcctgtaatcattgagtgcggccacaatttttag

SEQ ID NO: 245083 - DNA, 147 bp, Artificial Sequence
  Description of Artificial Sequence: Synthetic coding sequence
atggccgagacgagcctcctggaagctggcgcatctgctgcaagtacggccgctgcgcttgagaacctccaggtggaggcctcatgctctgtgtgcttggaatatctgaaagaaccggtcataatcgaatgcgggcataatttttag

SEQ ID NO: 245084 - DNA, 180 bp, Artificial Sequence
  Description of Artificial Sequence: Synthetic coding sequence
atggccgaaacttcgctacttgaagctggcgcaagcgccgcatctacagccgctgctctggagaacctgcaggtggaggctagctgtagcgtatgtctggagtacctgaaggaacccgttatcatcgaatgtgggcacaatttttgcaaagcatgcattaccagatggtgggaagattag

SEQ ID NO: 245085 - DNA, 180 bp, Artificial Sequence
  Description of Artificial Sequence: Synthetic coding sequence
atggccgaaacctctcttctagaggcgggagcctcagctgcctccactgctgcagccctggagaacctgcaggtggaagcaagctgctctgtgtgcctagagtacctcaaggagccagtgattatcgaatgtggtcacaacttctgcaaggcatgtatcacgaggtggtgggaagattag

SEQ ID NO: 245086 - DNA, 435 bp, Artificial Sequence
  Description of Artificial Sequence: Synthetic coding sequence
atggctgaaacctcccttctcgaggccggagcatcggcagcctcaactgctgccgctctggaaaatttgcaagtggaagcgtcctgtagtgtgtgcctggaatatctgaaagaaccagtgatcatcgagtgcggccataacttctgtaaagcttgtattaccaggtggtgggaggacctggaaagggacttcccctgccctgtgtgccggaaaacatcaaggtaccgctctctccgtccaaataggcaactaggctccatggtagagatcgcaaagcaattgcaagctgttaagcgtaagattagagacgaatcgttgtgtccccaacatcacgaggccctctcgttgttctgctacgaagaccaggaagccgtgtgcctgatatgcgcgatctcacacacgcacagggctcacacagtggtaccgctggactag

SEQ ID NO: 245087 - DNA, 1557 bp, Artificial Sequence
  Description of Artificial Sequence: Synthetic coding sequence
atggccgaaacatccctgttggaagcaggggctagcgctgcctccacggccgctgcactggaaaaccttcaagtggaagcaagttgctctgtgtgcttggagtacctgaaggagcctgttattatcgagtgtggccacaatttctgcaaggcctgcatcactcggtggtgggaggacttggagagagactttccgtgtccagtgtgcaggaagaccagtcgttaccgctcactgaggccaaatcgtcagctcggctcgatggtggagatcgctaagcaactgcaagccgttaagagaaaaattagagacgagagcctgtgccctcagcatcacgaagccttgtcactgttctgctacgaggaccaggaggccgtctgcctgatttgcgctatcagccatactcatcgcgcacacaccgtggtccctctggatgatgccactcaggagtacaaagaaaagttacagaagtgcttagagcctcttgagcagaagctgcaagagatcacaagatgtaagagcagcgaggagaagaagccaggcgagttaaagagactggtggagtcaaggcgccagcagatactccgggagttcgaagagcttcaccggagactggatgaggagcaacaggtgctattgagccggctggaagaagaggaacaggacatcctgcagcgtttgcgcgaaaatgccgctcacctgggtgacaagagacgggaccttgcccacctcgctgcggaggtggaagggaagtgcctgcagagtggcttcgaaatgctcaaagatgtcaagagcacattggagaagaatatccccagaaagttcggaggatcactgtctacaatttgccccagagaccacaaagctctgctaggtctggtgaaagaaattaaccggtgtgagaaggttaagactatggaggtgacatccgtttctatcgagctggagaagaacttcagcaattttccaaggcagtactttgcattgcggaaaattcttaaacaactcatcgcggacgttaccctcgaccccgaaacggctcatcccaaccttgtgcttagtgaggatcgaaagtccgtgaagttcgtggaaaccagattgagggacctgccagatacgccgaggagattcactttttacccttgtgttctggcaaccgaaggtttcacatccggaaggcattattgggaggtagaggtgggagataaaacacactgggccgtcggggtgtgccgggatagtgtgagtcggaaaggcgagctgacccccctccctgagacgggctattggcgcgtgcgattatggaatggagacaagtatgcagctaccacaacaccattcacgcccctccacattaaagtgaagccaaaaagggtcgggatctttctggactacgaagctgggaccctgtctttctacaacgttaccgatcgaagccatatatatacctttaccgatacatttactgaaaagttatggccactcttttatccaggaatccgcgcaggacgcaaaaacgccgctccgcttaccattcggcctcctaccgattgggaatag

SEQ ID NO: 245088 - DNA, 684 bp, Artificial Sequence
  Description of Artificial Sequence: Synthetic coding sequence
tgaaccagcaggtataggtcgctgaggcccaacagacagctcggaagcatggtggagatcgcaaagcagctacaggccgtcaagcggaaaattcgcgacgagtccctctgcccccagcaccacgaagctctgagccttttctgttacgaggatcaagaagccgtttgcttgatttgcgctataagccacacccatagagcccacactgtggtcccactggacgatgctacccaagagtacaaagagaagctgcagaaatgcctcgagcctctcgaacagaagctgcaggagatcaccagatgtaagagctcagaggagaaaaagcctggcgagttgaagcgcctggtggaatcacgtcggcaacagattctccgcgaattcgaagagctccacagaagactggacgaggagcaacaagttctcttgagccgccttgaggaggaagagcaggacatactgcaaagacttagagagaacgcagcacacttaggcgacaaaaggcgggatctggctcatctagctgcagaggtcgaggggaagtgcctgcagtccggatttgagatgcttaaggacgtgaaatctaccctcgagaaatgcgaaaaggtgaagacaatggaagtgacctcaaccactccctgtacaagcctccactctgagattaacgataacgtgcgtggacgctag

SEQ ID NO: 245089 - DNA, 684 bp, Artificial Sequence
  Description of Artificial Sequence: Synthetic coding sequence
tgaacatcacgctacaggtccctgagaccaaaccgacagctgggatctatggtagaaatagccaagcagctgcaggctgtgaaaagaaagattagggacgaatcgctgtgcccacagcaccacgaggccctgagcctgttctgttacgaggaccaggaggcagtgtgtcttatctgtgcaatctcacatacccacagagcgcatacagttgttccattagacgacgccacgcaggagtacaaagaaaagctgcagaagtgcctcgagcccttggaacaaaagctgcaggaaatcacgcggtgtaaatcctctgaagaaaaaaagcctggcgaactgaagagattagtggagagtcgtaggcagcagatcctgagagagtttgaggagttgcacaggagacttgacgaggaacagcaagtactgctcagcagactggaggaagaggaacaggacattctccagcggttgcgcgaaaacgccgcacatttaggcgataaacggagagatctggctcacttggctgccgaggttgagggtaaatgccttcagtctggcttcgaaatgcttaaggacgtgaagtctacacttgagaaatgtgagaaggtcaagactatggaggtgaccagcaccaccccatgtacatcgctgcattcagaaataaatgacaatgtgcgcggtcgatag

SEQ ID NO: 245090 - DNA, 147 bp, Artificial Sequence
  Description of Artificial Sequence: Synthetic coding sequence
atggctgagacctctttgttggaggcaggcgcaagtgctgcctcaacagccgctgccctcgaaaatcttcaggttgaggctagttgtagcgtgtgtctggagtatctgaaagaaccagtaatcatcgaatgtggccacaacttctag

SEQ ID NO: 245091 - DNA, 1557 bp, Artificial Sequence
  Description of Artificial Sequence: Synthetic coding sequence
atggctgagacatccctgttggaagctggcgcttccgcggcatcgactgccgcagctctcgaaaatctgcaggtagaagcaagttgttctgtctgtttagagtatctaaaggaacctgtcattatcgagtgtgggcataatttttgcaaggcttgtatcacccgctggtgggaggatctagagcgagatttcccttgtcctgtgtgcagaaaaacttctcgctaccgctccctacggcctaatcgtcagttagggtccatggtggaaatcgccaaacagctccaggcagtgaagagaaaaatccgggacgaaagtctttgtccacagcaccatgaggccttgtctctgttctgctacgaggaccaagaagccgtctgcctgatttgcgctataagccacacccacagggctcatacagtggtgccactcgatgacgccacccaggagtacaaggagaaacttcagaagtgcctggaacctctcgaacaaaagctccaggagattacaaggtgtaaatccagtgaagagaagaagcccggtgaacttaagcgactggtggagtcacggaggcaacagatactccgcgagttcgaggaactgcaccgcaggctggatgaggaacagcaagtccttttatcaagacttgaggaggaggagcaggacattttgcagcgccttagagaaaacgccgcacatctcggagacaagcggcgagatctcgcccacctggcggctgaggtggaaggaaagtgtttgcagagcggttttgagatgcttaaggatgtgaaaagtacccttgagaaaaatatcccgagaaaattcggcggaagcctgagcacaatctgccctcgcgaccataaagcattgctgggactggttaaagagattaacagatgcgagaaggttaaaacgatggaggtgacttctgttagtattgaactagagaagaatttctccaactttcctcgccagtactttgctttgaggaagattctcaagcagttgatcgccgacgtgaccctggaccctgagaccgcccaccctaacttagtgcttagcgaagatagaaagtccgttaagttcgtggaaactaggctgcgggatctccccgatacaccaaggcggttcaccttttacccttgcgtgctggcaacagaaggatttacaagcggcaggcactattgggaggtggaagtgggagacaagactcattgggctgttggagtttgcagagattccgtgtcaagaaaaggcgagctcaccccactgcccgaaacaggttactggcgtgtaagactctggaatggtgacaagtacgcagccactactacacctttcacaccattgcacatcaaagtcaaacccaagcgggtgggaattttcttagactatgaagctgggactctctccttctacaatgtaacagataggtcacacatctatacattcacagacaccttcacagagaaactgtggcctctgttttacccaggcatccgcgctggaagaaaaaacgctgcgccactcacaattcggcctcctacggattgggaatag

SEQ ID NO: 245092 - DNA, 225 bp, Artificial Sequence
  Description of Artificial Sequence: Synthetic coding sequence
atggcagaaacctctctcctcgaggcaggcgcaagcgccgctagcaccgctgcagcgctggaaaacctgcaagtcgaggcctcttgcagcgtgtgcctcgaatacctaaaagagcccgtgataatcgaatgtggtcacaacttctgcaaagcttgcattaccaggtggtgggaagacctggagcgagactttccttgtcccgtctgcaggaaaacgagccgctag

SEQ ID NO: 245093 - DNA, 180 bp, Artificial Sequence
  Description of Artificial Sequence: Synthetic coding sequence
atggcagagacaagcctgttagaggctggagcctccgccgcatcgacagcagcggctttagaaaacttgcaggtggaggccagctgttcagtctgtcttgaatatctgaaggaacccgtgatcatagagtgcgggcataacttttgcaaagcatgtatcactcgatggtgggaagactag

SEQ ID NO: 245094 - DNA, 147 bp, Artificial Sequence
  Description of Artificial Sequence: Synthetic coding sequence
atggccgaaacttctctgctcgaggccggagcctcggctgctagcaccgcagccgctctggagaacctacaggtggaagcatcttgcagcgtttgcttagagtacctgaaagaacctgtgattattgagtgcggccacaacttctag

SEQ ID NO: 245095 - DNA, 786 bp, Artificial Sequence
  Description of Artificial Sequence: Synthetic coding sequence
atggccgagacatcacttttggaagctggcgcatctgcagcctcaactgcagctgcactcgagaatctgcaggtggaagccagctgtagtgtttgcctggaatatctgaaagagccggttatcatcgagtgtggacacaatttctgcaaggcctgcataactcgctggtgggaagacctggagcgggacttcccttgtcctgtgtgccggaagacatcaaggtataggtctctgcgccctaatcgccagttaggatccatggtggaaattgccaagcagctccaggccgtgaagcgaaagatcagggacgagtctctgtgtccccagcatcacgaagcgctgagtctgttctgctacgaggaccaggaggctgtctgtctgatttgcgcgatctcccatacacacagggcccatactgtcgtccccctcgatgacgccacccaggagtacaaggaaaaactgcaaaagtgtctggaaccactggagcaaaaactccaagaaatcacaaggtgtaaatcctcagaggaaaagaaaccgggagagttgaagcgtttggtggagtccaggcgacagcagattcttcgcgaatttgaggagctccacaggcggctggacgaagaacagcaagtgctcctttcgagactggaggaagaggagcaggatattctgcagaggcttagagagaatgcagcgcacttgggagacaagagaagggacctggcacacctcgctgcagaagtcgagggaaagtgtcttcagagcggctttgagatgttgaaggtatag

SEQ ID NO: 245096 - DNA, 180 bp, Artificial Sequence
  Description of Artificial Sequence: Synthetic coding sequence
atggctgagacttccctgttagaggctggcgcatctgccgcaagcactgccgctgcactcgaaaacctgcaggttgaggcgagctgctctgtgtgccttgaatatctaaaggaacctgtgattatagagtgtggtcacaacttctgcaaggcatgtattacgagatggtgggaagactag

SEQ ID NO: 245097 - DNA, 435 bp, Artificial Sequence
  Description of Artificial Sequence: Synthetic coding sequence
atggctgagactagcctgctggaggcgggagcatcggctgctagcactgccgcagcattagaaaacctacaagttgaggcatcctgctcggtgtgtcttgaatatctcaaagagccggtcataatcgaatgtggccacaacttctgtaaagcatgtatcacgcgttggtgggaagatctggagcgcgactttccatgccccgtttgtcggaagacaagccgctatcgaagtctcagacctaatcgacagttaggatctatggtggagattgccaagcaactgcaagcagtgaaaaggaaaatcagagacgagtcactgtgcccacaacaccacgaagcgctgagcttattttgttacgaggatcaggaagcggtatgtcttatttgtgccatttcacacacgcatagagcccacacagtggtgcccctcgattag

SEQ ID NO: 245098 - DNA, 1467 bp, Artificial Sequence
  Description of Artificial Sequence: Synthetic coding sequence
atggctgagacttcactactggaagctggagcctcagccgcttctacagctgccgctttagaaaatttgcaggttgaagcgtcctgtagtgtttgtctagagtatttaaaggagcccgtcatcatagagtgtggtcataatttttgtaaggcctgcattacccggtggtgggaggatctggaacgggactttccatgtccagtgtgcaggaaaacaagtcggtaccgttccctcaggcccaatagacagctgggaagtatggtagagatcgcgaaacaacttcaggcggtgaagcgcaaaatcagggacgaatccctctgcccccagcatcatgaggctctcagtcttttttgttatgaagaccaggaagctgtctgtcttatctgcgcaatttctcacactcatagggctcataccgtggtcccattagatgatgctacacaggagtataaagaaaagctgcagaagtgccttgaacccctcgagcagaaactgcaggaaataaccagatgtaaaagcagcgaggagaagaagccaggtgagttgaagcgcctggtagaatcaagacgacaacaaattctcagagagtttgaagagctgcacagacgtttggatgaggaacaacaggtgttgcttagcaggttagaggaggaggagcaggacatactgcaacgtcttagggagaatgccgctcatttgggcgataagcggcgtgatctggcccacctcgctgctgaagttgaaggaaagtgtctgcagtccggcttcgagatgttaaaagatgtcaagagtactctcgaaaagtgtgaaaaagtcaagactatggaagtgacatctgtttcaatcgagcttgagaagaacttctctaactttcctcgccagtatttcgcactccggaagatcttgaagcagctaattgccgacgtgacactggatcccgagactgcacaccctaacttggtactcagtgaagacagaaaaagtgtgaaattcgttgagacacggctcagagatctgccggacactccaaggagattcaccttttatccttgcgtcctggctactgagggctttaccagtggtcgccactactgggaggtcgaagtcggagataaaacccactgggcggttggagtttgtagggactccgttagtcgcaaaggtgaactcactcctctgccagaaactggctattggagggtcaggttgtggaatggggataagtacgcagctactaccacccccttcacgcctctccacatcaaggttaaacccaaaagagtgggaatttttctggattatgaggccggtactctgtcgttttacaacgtgactgataggtcccacatatatacctttacagatacattcacggaaaaactgtggccactgttttaccctggcatccgcgctggccgtaagaatgcggcacctctgacaatccggccacctacggattgggagtag

SEQ ID NO: 245099 - DNA, 1467 bp, Artificial Sequence
  Description of Artificial Sequence: Synthetic coding sequence
atggcggaaaccagtctgctggaggccggagcctcagctgcttccaccgccgctgctcttgagaatctgcaggtcgaggcatcatgctccgtttgtctggaatatctcaaagagcctgtcataattgagtgtggccacaacttctgcaaagcatgcatcacacgatggtgggaagacctagagcgtgatttcccttgccccgtgtgtcggaaaaccagccggtatcgctctctgcgaccgaatagacaactcggctcgatggtagagatcgccaagcagctgcaggccgtgaagagaaaaatccgcgatgagtctctgtgcccccagcatcatgaggccctgagtttattctgttacgaagatcaggaggcggtgtgcctgatttgcgcaatctcccatacccaccgcgcacatacagtggtgcccctggatgacgccacccaagagtataaggagaagctccagaagtgtctggagccgctcgaacagaagctgcaggagataaccaggtgtaagtcttctgaggaaaaaaagcctggcgaactgaagaggcttgtagaaagtcgcaggcaacaaatcctacgggagttcgaagaattgcatcggagactggatgaggaacaacaggtgctgctctcccggttggaagaggaggaacaggacatactgcagcgcttgcgagaaaatgctgcccacctgggtgataagaggagagacttagcccatctggctgcagaagttgaaggaaagtgcctccaaagtggctttgagatgctgaaagacgtgaaatctaccctggaaaaatgtgagaaagtgaagaccatggaagtgacctcagtttctattgagctcgagaaaaatttttccaatttccccaggcagtatttcgcactacgaaaaatcctgaaacagttaattgctgacgtcactctggacccggagaccgctcaccctaatctagtattgagtgaggatagaaaatccgtgaaatttgtagaaacccgcctgcgtgacctgcctgatacgcccaggcgctttaccttctatccatgtgttcttgcgaccgaggggttcaccagcgggagacactactgggaggtggaggtgggagataagacccactgggctgtcggcgtgtgtcgcgattctgtaagccgcaagggagaacttaccccactcccagagactggctattggcgcgtgcggttatggaacggagataagtatgccgcaacaacaacacctttcacgccgttgcacataaaagtaaagccgaagcgcgtgggcatctttctggactacgaggctggcaccctatccttctataatgttactgatcgctcccacatctatacattcacagataccttcacagaaaagctgtggcccctattttatcctggcattcgcgcaggacgcaagaatgctgcccctctcactatcagacctccaaccgattgggagtag

SEQ ID NO: 245100 - DNA, 786 bp, Artificial Sequence
  Description of Artificial Sequence: Synthetic coding sequence
atggccgagaccagtctcctggaggcaggtgctagtgccgcaagcactgctgctgccctggaaaacctgcaggtcgaagcctcatgcagcgtctgcctggagtaccttaaggagcctgtcatcatcgaatgtggccataacttttgcaaagcatgcattacaagatggtgggaggaccttgaacgggactttccttgcccagtctgcagaaaaacctccaggtatcgctctctgaggcccaatcgacagctaggcagcatggtggaaatagcaaaacaacttcaggccgtgaagagaaagataagggacgagagcctatgcccccaacaccatgaggccttaagtttgttttgctacgaggaccaggaggcagtgtgtttgatctgcgcaatcagtcacacccatcgcgcacatacggtcgtgcccctggatgacgcgactcaggagtacaaggagaagttacaaaaatgcctcgagcctttggaacaaaaattgcaggaaataacccggtgcaagtcgagtgaagagaagaagccaggtgagctgaagcgcttagttgagagtcggcgtcagcagatcttaagagagttcgaagaactgcaccgcaggctggatgaagaacaacaggtactcctgtcccgactggaagaagaagagcaggatatcttgcagagacttcgagaaaatgctgcacatcttggagacaagcgcagggatctggcccatctggccgcagaggtggaaggcaagtgccttcagtcgggctttgagatgctcaaagtatag

SEQ ID NO: 245101 - DNA, 1467 bp, Artificial Sequence
  Description of Artificial Sequence: Synthetic coding sequence
atggccgaaaccagcctgctcgaagcaggtgccagcgccgcttccacagctgcagccctggagaatttacaggtggaggcctcctgtagtgtatgcctcgaatatctcaaagagccagtcataattgagtgcggccacaacttctgcaaagcttgcataaccagatggtgggaggaccttgaaagagattttccatgcccggtttgtcgcaaaacctccaggtataggtctctgcgccctaaccggcagcttggtagcatggtggagattgcgaagcagttacaggctgttaagcgtaaaatccgcgacgagagcctgtgtccgcagcaccatgaagccctttcactgttctgctacgaggaccaggaggctgtttgtctgatctgcgctatttcacacactcatagggctcatacagtggtcccactcgacgacgccacacaagagtataaagagaaattacagaagtgcctcgagcccctggagcagaaactgcaagagataaccagatgcaagtcatccgaagaaaagaagccgggtgagttaaaacggctggtggagtctagacgccagcagatcttgagggagttcgaggaacttcatagaaggctggatgaggagcagcaggtgctgctgagtcggctggaggaagaagagcaggacattctccagcgactgcgggaaaatgccgctcatctgggtgataagcggagggacttagcccacttagccgcagaggtagaaggcaaatgcttacagtcaggttttgagatgttaaaagacgtcaaatcaacgttagagaaatgtgagaaagtaaagacaatggaggttacgagtgtgagcattgagttggaaaagaatttttctaattttccacggcagtactttgctctgcgaaagatcctcaagcagctcatcgcggatgtaactctggatccagagacagctcatccaaacctcgtactgtcggaggatcgaaagagcgtaaagtttgttgagacccggttaagggacctgcccgacacccccaggcgcttcaccttctacccctgtgttcttgccacagaggggtttaccagcgggaggcactattgggaggtcgaagtgggtgataaaacccattgggctgtgggtgtttgtcgcgattcggtatcacgaaaaggagagctaacacctctgccagagacagggtactggcgcgttcggctctggaatggcgacaagtatgctgccaccactaccccatttactccgctgcatatcaaggtcaagccaaagcgcgtgggaatcttccttgattatgaagccggtaccttaagcttctacaatgtgaccgacagatcccatatctacacttttacagacacatttactgagaaactgtggcctcttttttacccagggatacgggctggtcgtaagaacgccgctcctctgacaattagaccccctaccgactgggagtag

SEQ ID NO: 245102 - DNA, 180 bp, Artificial Sequence
  Description of Artificial Sequence: Synthetic coding sequence
atggccgagaccagtttgctagaggccggtgcttctgccgctagcaccgccgcagccttggagaacttgcaagtcgaggcaagttgttcagtgtgccttgagtacctgaaagaacccgtaatcattgaatgtggtcataacttctgcaaagcttgtattacccgatggtgggaagattag

SEQ ID NO: 245103 - DNA, 180 bp, Artificial Sequence
  Description of Artificial Sequence: Synthetic coding sequence
atggccgagactagtctcctggaagctggtgcttcagcggcatccaccgccgctgctctggaaaatctgcaggtggaggcctcttgtagcgtgtgcctggaatatctcaaggagcccgttattatcgagtgcggccataatttctgcaaggcctgtataaccaggtggtgggaggactag

SEQ ID NO: 245104 - DNA, 684 bp, Artificial Sequence
  Description of Artificial Sequence: Synthetic coding sequence
tgaacctcacgataccgaagcctacgtccaaatagacagcttggcagcatggtggagatagccaagcagctgcaagctgtaaagcgcaaaatccgggacgaatccttgtgcccccaacatcacgaagcactgagtttgttttgttacgaagaccaggaagccgtgtgcctgatttgtgccatctcccacacgcaccgtgcgcacaccgtcgttccactggacgacgccacccaggaatacaaggaaaaactccagaaatgcctggagcctctagagcagaagctgcaagaaatcacaagatgcaaatcctccgaggagaagaagcctggggagttgaaacgcctagtagagtcccggagacagcagatccttcgagagtttgaggagctgcataggcgattggatgaggagcaacaggtgttgctaagcagactggaagaggaagaacaggacattctccagaggctccgggagaatgccgctcatctcggggacaagagacgcgacctggcacatcttgccgcagaggttgaaggtaagtgcctgcagtctgggttcgaaatgcttaaggacgtgaaatccacgttagaaaagtgtgagaaggtgaagaccatggaagttactagcacaactccctgtacatctctgcactccgaaatcaatgataatgtccgcggaagatag

SEQ ID NO: 245105 - DNA, 1467 bp, Artificial Sequence
  Description of Artificial Sequence: Synthetic coding sequence
atggcagagacgagcctgttggaggccggagcttcagcagcatctacggccgctgcccttgagaacttgcaggttgaggcttcatgcagcgtctgtctggagtacttgaaagaacctgtaattattgagtgcggccataatttctgtaaagcttgcatcacccgctggtgggaggacctggagcgagatttcccctgcccagtgtgtcggaagacctctcgataccgctcgctccgacctaaccggcagcttgggtctatggtcgagatagctaagcagctccaggcagtgaagcggaaaatacgagatgaatctctatgcccacaacaccatgaggcgctctctctgttttgttatgaggatcaagaagcggtctgtttaatatgcgccatttctcacacccatagggcccatacagttgtgcctcttgacgatgccacgcaggagtacaaggaaaagctccagaagtgtctagagcccttagagcagaagttgcaagagatcaccagatgtaagagtagcgaggaaaaaaagcccggagaactgaagcggcttgtggagtccagacgccagcagatcctgcgggaattcgaagaactgcataggcgcctggacgaggaacaacaggttctattatctcgactggaggaagaagaacaggatatactccaaagattgcgcgagaatgcagcccacctcggcgataaacgcagagacctggcccacctcgccgctgaggttgagggaaagtgtttgcagtccggcttcgagatgcttaaagacgtgaaaagtaccctggaaaagtgcgaaaaagtgaagaccatggaggtgacctcggtcagcattgaacttgaaaagaatttttccaacttccctagacagtacttcgcccttcgcaagatcttaaaacagctgatcgccgacgtcactctggatccggagactgctcatcccaacctcgttctttccgaagatagaaagagcgtgaaatttgttgaaacccggctgcgagacctgcctgatacaccacgtcgctttaccttctatccttgcgtgctggctaccgaaggcttcacctccgggagacactattgggaggtcgaggtgggggataaaacccactgggcggtgggtgtgtgtagagattccgtctcaaggaagggggaactcacacctctgcccgaaacggggtattggcgagtgagactgtggaacggggataaatatgctgctactaccacgccgtttacaccactccacatcaaggtgaagcccaagcgcgtggggatatttctggattatgaagctggcacgctgtccttctacaacgtgactgatcgcagccacatatacacattcacagatacatttactgagaagctgtggccactgttctacccaggtatccgcgcaggaagaaaaaacgcagcccctttgacaatccgtcctcctactgactgggagtag

SEQ ID NO: 245106 - DNA, 225 bp, Artificial Sequence
  Description of Artificial Sequence: Synthetic coding sequence
atggctgagacgtcgttactggaggccggagccagtgccgcatctactgccgcagcccttgaaaacctgcaagttgaggctagctgctctgtttgtttggagtacctcaaggagccagttatcattgagtgcggccataatttttgtaaagcctgcattactcgatggtgggaggatctcgagcgagacttcccatgcccggtttgcaggaagacttctcggtag

SEQ ID NO: 245107 - DNA, 684 bp, Artificial Sequence
  Description of Artificial Sequence: Synthetic coding sequence
tgaacctcgcgctaccgatctctgcgtccaaatcgtcagctcggctctatggtcgagattgcaaagcaactgcaggcagtgaagcgtaaaataagagacgaaagtctttgtccacaacaccatgaggccctgtcactcttctgctatgaggatcaggaggcagtgtgtctaatttgtgcaatatcccacacacacagggcccatactgttgttccactggatgacgccactcaagagtataaggagaaactacagaaatgtttggagccgctggaacagaagttacaggagatcactcggtgcaaatcaagcgaagagaagaaacccggagaacttaaaaggctggtggaatcgcgccgacagcaaatattgagagagttcgaggagctccaccggagattggacgaggaacagcaggtgctactgagcaggctggaagaggaggagcaggatatacttcaacggctccgagaaaacgcagcccatcttggagacaagaggagagacctcgcgcacctggcagccgaggtagagggtaaatgtctgcagtctggtttcgaaatgctaaaggatgtcaaatcaacattggagaagtgtgagaaagtgaaaacaatggaggtcacctccacaactccctgcacatccttgcatagcgagattaatgataatgtgcgtggtagatag

SEQ ID NO: 245108 - DNA, 1467 bp, Artificial Sequence
  Description of Artificial Sequence: Synthetic coding sequence
atggcagaaacctcacttttggaagcaggcgctagcgctgcttccacggcagccgcactcgaaaacctccaggtggaagccagctgttccgtttgcctggagtacctcaaggagcccgttatcatcgagtgcggacacaatttttgcaaggcttgcattacaagatggtgggaggaccttgagcgcgacttcccatgtcctgtatgtcgcaaaacttctcgatatcgttcgctaagaccgaacagacagttaggaagcatggtcgaaattgccaagcagctgcaggctgtgaaacgcaagatcagggatgagagcttgtgtcctcaacaccatgaagcactgtccctgttctgttatgaggaccaagaagccgtctgcctgatctgcgcaatcagtcacacccatagagcgcatacagtggtgcctcttgacgatgctactcaggagtataaggaaaaattgcagaagtgcctcgaaccccttgaacagaaactccaggaaattacacggtgtaagagctccgaggagaaaaagcccggagagctgaagagactcgttgagtcaaggagacaacagattcttagagaatttgaagaattgcacagaagactcgacgaggagcagcaggtgctcctgtcccggttagaagaggaggagcaagatattttgcagaggctacgcgagaatgcagcccatctgggtgacaagagacgcgatttggcccacctagccgcagaagtggaggggaaatgcttacagagcggattcgagatgctgaaggacgtaaagtcaaccctggagaaatgtgaaaaagtgaaaactatggaggtgacttctgtcagcatcgagctggaaaaaaacttctcaaactttcctcgacagtatttcgccctgcggaaaatattaaaacaactcatcgcagacgtgaccttggatcctgagacagcccacccaaacctggtcctaagcgaggatcggaaatccgtgaagtttgtggaaacaagacttagagacctgcccgataccccacggagattcaccttctacccgtgcgttctggctactgagggctttacctctggaagacactattgggaggttgaggtaggcgataagactcactgggctgtgggcgtgtgcagagatagtgtgtcccgtaaaggagaactgacaccccttccagaaacagggtattggcgggtacgcttgtggaatggtgacaagtacgcagctaccactaccccattcactcccctccatattaaggttaagccgaaacgcgttggtatcttccttgattatgaggccggtactctctcattctacaatgtgaccgaccggagccacatctacacattcaccgacactttcaccgagaaactttggcccctgttctaccccggaatcagagccggtcggaaaaatgccgctcccttgaccattagaccgcctacagattgggagtag

SEQ ID NO: 245109 - DNA, 1467 bp, Artificial Sequence
  Description of Artificial Sequence: Synthetic coding sequence
atggccgagacctcccttctggaggcaggcgcatccgccgcaagtaccgcggctgccctggaaaacctccaggtagaagctagctgcagcgtatgcctggagtaccttaaggaaccagtgattatcgaatgcggtcacaacttctgtaaggcatgcattacacgatggtgggaggatctcgagcgagacttcccctgtcccgtctgccgaaaaacttctcgttacagatctctcaggccaaatcggcaactgggctctatggtggaaatcgcaaagcaactgcaggccgttaagcgcaagatccgtgacgagagtctgtgtccccagcaccacgaggctctctctctgttttgctatgaagaccaggaagccgtctgtctaatctgcgccatttcccatacccacagggctcatacggtagtcccccttgatgacgccacccaggaatataaggagaagttgcagaaatgcctggaacctctcgaacagaaattgcaggaaatcaccagatgcaaatcctcggaagaaaagaaacctggggagctaaagcggctggtcgaatctaggcgccagcaaattcttcgggagttcgaagaactccaccgcagattggatgaggagcagcaggtgctgctcagccgcctggaagaagaagagcaggatattcttcagaggttaagagagaatgcagcccatttgggggacaagagacgggacctggcgcatctagctgccgaggtcgaagggaaatgtttacagagcggattcgaaatgttaaaggatgtcaagtctacattagaaaaatgcgaaaaagtcaaaacaatggaagtgaccagcgtgtcgattgagctggagaaaaatttctcaaatttcccgaggcagtactttgccctgcgcaaaattctgaaacaattaatcgccgatgtcaccctcgatccggaaacagctcatcccaatctggtgttgagcgaggaccgcaagtccgttaaatttgtggagacccggttgagagacctgcctgacacacccaggaggtttaccttttatccatgcgtgttggcgacggagggttttacatctggcagacattattgggaggtggaggtgggagacaagactcactgggcggtcggcgtttgcagagattccgtgtcacggaagggggagctaacgccattgccggaaacgggctattggagggtgcggctgtggaatggggacaaatacgcagctaccactacgccctttactcccctgcatattaaagtgaagcccaagcgcgtgggaattttcctggattatgaggctggcaccttatccttctacaatgtcaccgatcgcagccacatatacacgtttaccgacacatttaccgagaagttatggcccctcttctatccagggataagggcgggacgcaaaaacgccgcacctttaacgatcaggccgcctactgactgggaatag

SEQ ID NO: 245110 - DNA, 786 bp, Artificial Sequence
  Description of Artificial Sequence: Synthetic coding sequence
atggccgaaacctcccttctcgaagccggagcctctgccgcatcaaccgccgcagcactagagaatctgcaggtggaagcctcctgttccgtgtgtctggaataccttaaggagcccgtgatcattgagtgtgggcacaatttctgtaaagcctgtatcacccgttggtgggaggatttagagagggattttccatgcccagtgtgtaggaaaacctcacgttatcgttcccttagacccaacagacagctcggatcaatggtggaaatcgccaaacaactccaggctgtgaaaaggaagattagggatgaaagtctctgccctcaacaccatgaagctctgagtctcttctgctacgaggaccaggaagctgtgtgtctgatctgcgccatctcccacacacaccgagctcacacagtagtgcctctggatgatgcaacccaggagtataaagagaagctgcagaagtgcctggagccactggagcagaagctgcaagaaatcacgagatgcaaatcatcagaggaaaaaaaacctggcgagctgaaacgcctcgttgagtcaagacgccagcagatcctcagagaattcgaagagcttcacagaagactggatgaggagcaacaagtgctactatcccggctcgaagaagaggagcaggatatcctgcaacgtctgcgggaaaatgctgctcatctgggggacaagagacgcgaccttgctcacttagcagccgaggtggaaggaaaatgcctgcaatcaggatttgagatgctgaaggtgtag

SEQ ID NO: 245111 - DNA, 225 bp, Artificial Sequence
  Description of Artificial Sequence: Synthetic coding sequence
atggccgaaacaagcctgctcgaagccggtgccagcgcggcttcaacggccgcagccctggagaacttgcaggtggaagcctcctgtagcgtctgtctcgaatacctcaaggagccagtgataatagagtgtggccataatttttgcaaagcctgtatcacccgatggtgggaggacctggaaagagatttcccctgcccagtgtgtagaaaaacttctagatag

SEQ ID NO: 245112 - DNA, 180 bp, Artificial Sequence
  Description of Artificial Sequence: Synthetic coding sequence
atggctgagacctcacttcttgaggccggagcatccgccgctagcacagccgctgccctcgagaacctccaggtcgaggcctcttgcagcgtttgccttgagtacctgaaggaaccagtcattatcgaatgtggacacaacttttgtaaggcatgcattacgagatggtgggaagactag

SEQ ID NO: 245113 - DNA, 786 bp, Artificial Sequence
  Description of Artificial Sequence: Synthetic coding sequence
atggctgagaccagcttactggaagccggtgccagcgctgcgagtactgctgctgcccttgagaaccttcaagttgaagccagctgctctgtctgccttgaatacctaaaggagccagtgattatcgaatgcggacacaatttctgcaaggcctgtataacaaggtggtgggaggatctggagcgtgatttcccttgtcccgtgtgtcggaaaacttcccgctatcgttcactgcgacccaatcggcagctggggtctatggttgaaattgccaaacagctccaggcggttaaacgaaagatccgagacgaaagcttgtgcccacagcaccacgaggcacttagtctgttctgttacgaggaccaggaggctgtgtgtctgatctgcgccatcagccacacccaccgggctcatacagtggtgccattggacgatgctacccaggagtataaggaaaaattacaaaagtgtctcgagccactggaacagaagctgcaggagatcacgaggtgcaagtcgtctgaggagaagaagccaggtgaactcaagagacttgtggagtctcgtcgacaacagattctgagagagttcgaagaactgcatcgaaggctcgatgaagaacagcaagtactcctcagccggctagaggaggaagaacaggacatccttcaaagactgagggagaacgccgcacacctcggtgataagaggcgcgacctggcacacctcgccgcagaagtcgagggtaaatgccttcagagcgggttcgagatgcttaaggtgtag

SEQ ID NO: 245114 - DNA, 1467 bp, Artificial Sequence
  Description of Artificial Sequence: Synthetic coding sequence
atggcagagactagcctgctcgaggctggagcctcagctgcatctacggcagcagcactagaaaaccttcaggtagaagccagttgttctgtgtgcctggagtatctcaaagagccagtgattatcgagtgcggacacaatttctgcaaagcctgcataacgcgctggtgggaagatcttgagcgcgatttcccgtgtccagtatgcaggaagaccagtagataccggtctctcagaccaaataggcagctggggtcaatggttgaaattgccaagcagctgcaagctgtgaagcgtaaaatcagagacgaatctctgtgccctcagcatcatgaggctctcagcctcttttgttacgaggaccaagaggctgtctgtttgatttgtgcaatttcccacacccaccgggcacatacagttgtacctctcgatgatgcaacacaggaatataaggagaagctgcagaaatgtctcgagccgttggaacaaaaactccaggaaatcacccggtgcaagtcaagcgaagaaaagaagcctggagagctaaagcgattggtggagtccagaagacagcagattctcagggagtttgaggagttgcacaggcgcctggatgaggagcaacaagttctcctttctcggctggaggaagaagagcaagacatacttcagcgcctgcgagagaacgctgcacacctgggcgacaagaggcgcgatttggcccacctcgcagctgaagtagagggaaagtgtttgcagagcgggtttgagatgctcaaagacgtgaaaagcacattggaaaaatgtgaaaaggtgaagacaatggaggtgaccagtgtgagcatcgaactggaaaagaactttagcaactttcccagacaatacttcgcattaagaaaaattcttaagcagctgattgccgacgtgacattagatccagagactgctcatcccaacctagtgttgtccgaggaccggaagagcgtgaaatttgttgagacaaggctcagggacctgccagacactcccaggagattcaccttttatccatgcgtgctggctaccgaaggcttcacttctggaaggcattactgggaggtggaggtgggtgacaagacccattgggcagtgggcgtctgtcgggactctgtctcaaggaagggcgagctcacaccccttcctgagaccggatactggagggtgcggctgtggaacggcgacaaatatgccgcaaccaccacacctttcaccccgcttcacatcaaagtcaagcctaaaagagtgggtatctttttggattatgaagctggaaccctttcattttacaatgttacggacagatcccacatttataccttcaccgacacgtttaccgagaaactctggcccctcttttaccccggaatccgagcaggcaggaagaatgcagctcctctgacaattagacctcccacagactgggaatag

SEQ ID NO: 245115 - DNA, 1557 bp, Artificial Sequence
  Description of Artificial Sequence: Synthetic coding sequence
atggccgaaacttctctgctggaagctggagcatctgccgcatcaacagcagcggctcttgaaaacctgcaggtcgaagccagctgctccgtctgcctggagtatttgaaagagcctgtgataatcgagtgcgggcacaacttctgtaaagcctgtattacacgatggtgggaggatttggaaagagattttccctgtcctgtctgcaggaagactagcagataccgttccctgcgccctaacaggcagctgggaagtatggtcgagattgcaaaacagttacaagccgtgaagcgaaaaattagggacgagagcttgtgtccccagcaccatgaggctctcagcctgttttgttatgaagatcaggaagccgtgtgtctgatctgtgccatctctcacacccatagggcgcacacagtggtcccattggacgacgccacccaggagtataaggagaaacttcagaagtgcctggagcctctggagcagaagctgcaggagattaccaggtgcaaaagcagcgaggaaaaaaaacccggtgagctcaaacgattggtggagtcgagaaggcagcaaattctgagagaatttgaggaacttcacagacgtctagacgaggaacagcaggtgttgttgtcacgactggaggaggaagagcaggacatacttcagcgtctccgggaaaatgctgcccatttgggggataagcggagggacctggcccacttagcggctgaggtggaggggaagtgtctgcaatccgggttcgaaatgctaaaggacgtcaaatctaccttagagaaaaacattcctcggaagttcgggggaagcctgtcgaccatctgtccccgtgaccacaaggccttgctggggctggttaaggagatcaatagatgtgagaaggtcaaaacgatggaggtgaccagtgtatcaatcgagttagagaaaaatttttccaactttccccgtcagtactttgcccttagaaaaattctcaagcagcttatcgctgatgtgacactagatccagagacggcacaccctaacctggtgctgtcagaggaccggaaatccgttaaattcgtggagacccggctgagagatttacctgacactcccaggaggttcactttttacccatgcgtgctggccaccgagggctttactagtggacgccattactgggaggtcgaagtgggggacaaaactcattgggccgtgggggtgtgccgggattccgtttctcgtaaaggagagctgactccactgccggaaacgggatattggagagtccgattgtggaacggcgataagtacgccgctacaacaactcctttcacaccactgcatataaaagtgaagcccaagcgggttggaatttttctcgattatgaagccggaacgcttagtttttataacgtcacggacaggagtcacatatataccttcacagatacattcacagaaaagctctggcccttgttctaccccggtattcgcgcaggcagaaaaaacgcagcccctctgactatcaggccgccaactgactgggagtag

SEQ ID NO: 245116 - DNA, 1467 bp, Artificial Sequence
  Description of Artificial Sequence: Synthetic coding sequence
atggccgagacaagcttactggaggccggagcatccgccgcttcaacagccgcagccctggagaatctccaagtggaggcaagttgctcagtgtgtctagaatatctgaaggaacccgtgatcatcgaatgtggccataacttctgtaaggcgtgcatcacaagatggtgggaggatctcgagagagattttccctgtcccgtctgccgcaagactagtcgctacaggagtctgaggcccaaccgccagttgggaagtatggtggagatcgcaaagcagttacaagcggtcaagcgaaaaatcagagatgaatctttatgtccacaacaccatgaagccctttcactcttttgctacgaggatcaggaggccgtctgtctgatctgcgccatttcccacacccacagagctcatactgtcgtgcccctcgacgatgccacacaggaatataaggagaagttgcagaaatgcctcgaaccactggagcaaaaactgcaggaaattaccaggtgcaagtcatccgaagagaagaagccaggtgaattaaaaagacttgtagagagtcggaggcagcagattcttcgagagtttgaggagctccaccgaagattggacgaggagcaacaggtgctgctctctcgactggaggaggaagaacaggatatactccagcggctgcgcgaaaacgctgcccacctcggggacaagcgcagggaccttgcccatcttgcagcagaagtggaagggaagtgcctgcagtccgggttcgagatgttaaaggatgtgaaatctacattggagaaatgcgagaaggtgaaaactatggaggtcaccagcgtttctattgaactcgaaaagaatttcagtaatttcccaagacagtactttgcgttgcgaaagatcttaaaacaacttatcgcagatgtcaccctcgaccccgagacagctcacccaaatctggtcctgtctgaagaccgtaagtctgttaaattcgtggagactcgcctgcgggaccttcctgatactcctcgtagattcacattctacccctgcgtgttggccacagagggtttcaccagcggtcggcattactgggaggtcgaggtcggcgacaaaacacactgggcagttggagtgtgccgtgattccgtttcgagaaagggtgagctcacaccactgccagaaaccgggtattggcgcgtgcgcttgtggaatggtgataaatacgcggcaacgacgaccccatttaccccgctacacatcaaggtgaagccaaagcgagtcggaatatttctggattacgaggccggaactctcagcttttacaacgtgactgatcgctcccatatttataccttcaccgacactttcacagagaaactgtggcccctcttttatcccggaatccgtgcaggccgaaagaacgccgctcccctgaccatccgccctcctactgattgggaatag

SEQ ID NO: 245117 - DNA, 786 bp, Artificial Sequence
  Description of Artificial Sequence: Synthetic coding sequence
atggcagaaactagtctcctggaggccggtgccagtgcagcctcgacagctgccgcactggaaaaccttcaggtggaggccagttgtagcgtctgtctggaatacctgaaggagcccgtgattatcgagtgcgggcacaacttttgcaaagcttgcattaccaggtggtgggaggacctggagcgagactttccatgtcctgtgtgccggaaaactagtcgctaccgctccctgcgccctaatcgacagctgggcagcatggtggaaatcgctaagcagctccaggccgttaagaggaagatccgtgacgagtcactgtgtcctcagcaccatgaggcacttagtctgttctgctacgaagaccaggaagccgtgtgcctgatatgcgccatttcccacactcacagagcacacaccgtagtccccctagacgatgccacacaggaatacaaagaaaaactccagaagtgtcttgagcctctggaacagaaactgcaggaaatcacacggtgtaagtcttctgaggagaagaaaccaggggagctgaaacgtctggtggagtccaggcgtcagcagatcttgagagagtttgaggagcttcaccggaggctggacgaggagcaacaggtgttacttagtcgcctcgaggaggaggaacaggatattctacagagactgagagaaaacgcggctcacttgggggataagagaagggatctagctcatttggctgccgaggttgagggcaaatgtctgcaatcgggtttcgagatgcttaaagtctag

SEQ ID NO: 245118 - DNA, 225 bp, Artificial Sequence
  Description of Artificial Sequence: Synthetic coding sequence
atggccgagacgtcactgctcgaggcaggcgctagtgcagcaagtactgcggcagcactcgaaaacctgcaggtggaagccagctgctctgtgtgtctggagtacctaaaagaaccagtgattattgaatgcggacataacttctgtaaggcttgtatcactcgttggtgggaggatctggagagggacttcccttgtccggtctgtagaaaaacaagccggtag

SEQ ID NO: 245119 - DNA, 1236 bp, Artificial Sequence
  Description of Artificial Sequence: Synthetic coding sequence
atggccgagacctcactgctggaagcaggagctagtgccgcttcaacggctgctgctttagagaaccttcaggtggaggcaagctgctctgtctgcctcgaatatctaaaagaacctgtgattatcgagtgtggacacaatttctgcaaagcatgtattacgcggtggtgggaagacttagagcgtgatttcccatgtccagtgtgcagaaaaactagccggtatcgaagtctgcggcctaataggcagctgggatcaatggtggagatcgccaaacaactccaggccgtgaaacgcaagatcagagacgaatctctctgccctcagcatcatgaggccctaagtctgttttgttacgaagatcaagaggctgtctgcctcatttgtgctatttctcatacacatagagcccacaccgttgtgccactggacgacgctacgcaggaatacaaggagaagcttcaaaaatgtcttgagcccctcgaacagaagctccaagaaattacccgttgcaaaagcagtgaagagaagaaaccaggcgagttgaaacgcttagtagaaagcagaagacagcaaattctgagggagttcgaggagctgcatcggaggctggatgaagaacagcaagtccttctgtcccgcctggaagaagaggagcaggatatccttcagaggttgcgggaaaacgcggcacatctaggagacaaaaggagagatcttgcgcaccttgctgccgaggtggagggcaaatgcctgcagagcggcttcgagatgctgaaacccgtgttgtcagcaagggaggagtgcgagaaagtgaagacaatggaagtgacaagcgtgtcaatcgagctggagaaaaatttttcgaacttccccagacagtactttgcgcttcgaaagatcctaaagcagttgattgcagacgtgactctggatccagaaacagcacaccccaacttagtgctgagtgaagatcgcaaatcagtcaagttcgtcgaaacccgcctgcgtgacctccccgatactcctcggaggtttacattttacccttgtgtcctcgctacggaggggtttacaagtggaaggcactactgggaggtggaggtcggcgataagacccattgggccgttggcgtgtgtcgggattcggtttctaggaagggagggtgtgggtacggcatgggtacaaacatgcaacctcctccccatctcttaccactatgcacaagtcggtag

SEQ ID NO: 245120 - DNA, 1467 bp, Artificial Sequence
  Description of Artificial Sequence: Synthetic coding sequence
atggctgaaacttcccttctggaagctggtgcttcagcggcttctaccgccgctgctctggaaaacctccaagtggaagcgtcatgttcagtgtgcctggagtatttgaaagagcccgtcataatcgagtgtggacataatttctgtaaggcctgcatcacccgttggtgggaagaccttgagagagacttcccatgccctgtctgtcggaaaaccagtaggtacagatccttgaggccaaatagacagctgggaagtatggtggagatcgccaagcagctccaggctgtgaaacgaaagataagggatgaaagtctgtgcccgcagcaccacgaggccctctcgcttttttgctacgaagaccaggaagcagtgtgcctgatctgcgcaatttcacacacccacagagctcacaccgtggtgcctctggatgatgccactcaggaatataaggaaaaactacagaagtgtttggagcctctcgaacaaaagttgcaggagatcactcggtgcaagagtagcgaagagaagaaacctggggagctgaaaaggctggtggagtccaggcgacagcaaatactgagggagttcgaggagctccatcgccgtctcgacgaggaacagcaggtcctgttatccaggctagaagaagaggagcaggatatcttgcagcgcctgagggagaacgctgcccacctgggtgataagagaagggaccttgcccacctcgctgcggaggtggaaggcaagtgcctgcagagtggctttgaaatgctgaaggacgtgaaatctaccctggagaagtgcgagaaggtcaaaaccatggaagtgacctccgtgagcatcgaactcgagaagaacttcagtaatttcccacggcagtattttgctctccgtaaaatcctgaagcagctgatcgccgatgtgacactggatccggagacagctcatcctaacctagtcctgtccgaggatagaaagagcgttaagttcgttgagacccggctgcgagacttacccgatactcctcgcagattcaccttctacccatgcgtgttagccactgagggattcactagtggcaggcattattgggaggtagaggtcggcgataaaacccattgggctgtgggcgtctgcagagacagcgtctcccgaaagggtgaactcaccccacttccagagaccggatactggcgggtgaggctgtggaacggcgataaatacgccgcaactaccactccttttacacctctccatattaaagtcaagcccaaaagggtaggcattttcttagattatgaggcaggcacactctcattttataacgtgaccgatagaagccacatatatacattcaccgacacattcacagagaagctctggcccctgttctaccccggaattagggccggacgcaaaaatgcagcccctttgacaattcgcccacccaccgattgggagtag

SEQ ID NO: 245121 - DNA, 786 bp, Artificial Sequence
  Description of Artificial Sequence: Synthetic coding sequence
atggccgagacttccctgctggaagcgggagcttcagccgcatctacagccgctgccctcgagaatctgcaggtggaggccagttgctccgtttgcctggaatacctgaaagagccagtgatcatagagtgcggccacaatttttgtaaggcatgcataactagatggtgggaggatctggagcgcgacttcccctgccctgtttgccgaaagacatcaaggtaccggagccttcggccaaacaggcaattgggttcaatggtggagattgcaaaacagctgcaggccgtgaaaagaaaaatacgggatgaatctttatgcccgcagcaccatgaggccctgagtctgttctgttacgaagaccaggaggcggtgtgtctcatttgcgctatatctcatactcatagggcccacactgtggtaccactcgacgatgcgacccaggaatataaggagaagcttcagaagtgcctagagcccctggagcaaaagttacaagaaatcaccagatgcaagagtagtgaggaaaagaaacccggagagctaaaacggcttgtggaaagtcggaggcaacagattttgcgcgaatttgaggagcttcatcgacggctcgacgaggagcaacaagtgctgctgtctaggctggaggaggaggagcaggatatcctgcagaggcttcgggagaatgccgctcatcttggggataaacggagagatctcgcgcacctcgcggctgaagtggagggcaagtgtctccagtctggcttcgagatgttgaaagtgtag

SEQ ID NO: 245122 - DNA, 147 bp, Artificial Sequence
  Description of Artificial Sequence: Synthetic coding sequence
atggctgaaacaagccttctggaggcaggcgcaagcgcagcctctactgccgcagccttagaaaatctccaagtggaggcctcctgttccgtgtgcttagaatacttgaaggagccagtgatcatagaatgcggtcataatttttag

SEQ ID NO: 245123 - DNA, 786 bp, Artificial Sequence
  Description of Artificial Sequence: Synthetic coding sequence
atggccgagacttcactgctggaagccggagcaagcgctgcctcaaccgctgcagccctcgagaatttacaggttgaagcttcttgcagcgtgtgtctggaatatctgaaggagcccgtgataattgaatgcggccacaatttttgtaaggcttgcatcacccggtggtgggaggatctagagcgcgactttccctgtccggtttgccgtaaaacctccaggtaccgctcacttaggcccaaccggcagctcggcagcatggtggagatcgccaaacagctgcaggccgtgaaacgcaagattagggacgagtcactgtgtccccagcatcacgaagccctgtctttgttctgctacgaggaccaggaggcagtttgtttgatatgtgcaattagtcacacccatagagcccacaccgtcgtgcccttggatgatgcgactcaagagtataaggagaagctgcagaagtgtctcgagcctctcgagcaaaagctgcaggagataacccgctgcaagtcaagcgaggaaaagaagccaggagagctcaaaagactggtcgaaagtagacggcagcaaatcctgcgcgagtttgaagagctgcataggcggcttgacgaggagcaacaagtcttgctaagtcgcctggaggaggaggaacaggatatcctgcaaagacttcgtgaaaatgctgcccatctcggcgacaaacgcagagacctcgcccacctggctgcagaagtggagggcaagtgccttcaatccggtttcgagatgctgaaagtctag

SEQ ID NO: 245124 - DNA, 1467 bp, Artificial Sequence
  Description of Artificial Sequence: Synthetic coding sequence
atggcggagaccagcctgttggaggccggagcgtccgccgcttcaacagccgctgcccttgaaaatctgcaggtggaggctagctgtagtgtttgcttagagtatctcaaagaacctgtgattatcgaatgtggtcataatttttgcaaggcttgcattacacgctggtgggaagatctggagcgtgactttccatgccccgtgtgtaggaaaacttcgcgttatcggagtctgaggcccaatcggcagctgggcagtatggtggaaattgcaaaacagctgcaggctgttaagcgaaaaatccgagacgagtccctctgcccccaacatcatgaagccctcagcctcttttgttatgaagaccaggaagcagtctgtttaatttgcgctatttctcacactcatcgtgctcacaccgtggtgcccctagatgacgccacgcaggaatacaaagaaaaacttcagaaatgcctcgaaccactggagcagaaactccaggaaattacccggtgcaaatccagtgaggagaaaaaacctggcgaactgaaaagactggtcgaaagcaggcgccagcagattctgcgtgaatttgaagaactgcacaggcgattagacgaggagcagcaagttctgctgagccgcctggaggaggaggaacaggacatactgcagagactgcgtgaaaacgccgcacatttaggagataagaggcgagaccttgctcacctagccgctgaggtcgaggggaaatgcctgcagtccggttttgaaatgctgaaggacgtcaagagtaccttggaaaaatgcgagaaagtgaagactatggaggtaacatccgtcagcattgagttggagaagaatttttccaatttccccaggcaatatttcgcccttcgtaaaattcttaagcaacttattgcagacgtcacactggatcccgagacggcccatcccaatctggtgctgagcgaagaccggaagtccgtgaagttcgtggagacacgtctccgcgatctgcccgataccccccgacgcttcaccttttacccctgtgtcctagcgaccgaaggctttacaagcggcagacactattgggaggtggaggtgggagataagacccattgggccgtcggggtttgtcgagattctgtcagccgcaagggagagctcactcccctgcccgagaccggttattggagagtacgcctgtggaatggcgacaaatatgccgcaacaactaccccttttacacctctgcatataaaagtaaagcccaagcgcgtaggcatatttctggactacgaagctggcacactctcattctacaatgtgacggaccggagccacatctacaccttcacggacacttttacggaaaagttgtggcccctcttctaccccggtatccgagctggtcgaaagaatgccgcacccctcacaatcaggccaccaacagactgggagtag

SEQ ID NO: 245125 - DNA, 225 bp, Artificial Sequence
  Description of Artificial Sequence: Synthetic coding sequence
atggccgaaacttcactcctcgaggccggtgccagtgccgcaagcactgccgctgccctcgaaaacctgcaagtggaagcctcttgttctgtctgtctcgagtatctcaaagaacccgtgatcattgaatgtggccataacttctgcaaggcctgtatcacgcgctggtgggaggacctcgaacgggactttccctgcccagtttgccggaagacctcccgatag

SEQ ID NO: 245126 - DNA, 1467 bp, Artificial Sequence
  Description of Artificial Sequence: Synthetic coding sequence
atggcagaaaccagccttctagaggcaggcgcttccgccgcttctactgcggcagctctcgaaaacctgcaagtcgaagcatcttgctccgtctgtctcgagtatctaaaggagccggtgattattgagtgcggtcacaacttctgcaaagcctgtatcactcgctggtgggaagacctcgagcgggattttccctgtccagtttgccgcaagacgtcccgctatagatctctgcgtcccaatcgtcagcttgggagtatggttgaaatcgcgaagcaacttcaggccgtgaagagaaagattagagacgagtctctttgcccacaacaccacgaggccctgtctctgttttgctatgaagatcaggaagctgtctgtctgatctgtgcgatttcacacacccacagggcccatacggtggtgccacttgacgacgcgacacaggaatataaagaaaagctgcagaaatgtctggaaccactggaacagaagctgcaagaaatcacccgctgcaaatctagcgaagagaagaaaccgggtgagttgaaacggctcgtggagtccaggagacaacagatcctgcgggaattcgaagaactgcaccgcaggctggacgaagagcagcaagtgttgctgtcaagactggaggaggaggaacaagacattttgcagcggcttagagagaatgctgcccacctgggggacaaacgccgagacctcgcacaccttgctgccgaggtcgaggggaagtgtctgcagagtggttttgagatgttgaaagacgtaaaaagcactcttgagaagtgcgaaaaagtgaagaccatggaggtgaccagtgtgtctattgagctagagaaaaacttttccaatttccctcggcagtacttcgctttgaggaagattctgaagcagctgatcgcagacgtgaccttagatcccgaaacggcccacccaaatctcgttctaagcgaagatcgcaaatcagtgaaatttgtcgagaccaggctacgggatctgcctgacacgcctcggagattcactttctatccttgcgtgttggccaccgagggattcacctccgggcgacactattgggaagttgaagtcggtgataaaacccattgggcagtaggggtgtgcagagactccgtgtcccgtaaaggggaactcacgcccctacctgaaactggctattggcgagtgaggctttggaacggcgataagtatgccgcaacgaccactcccttcacgccccttcatatcaaggtaaagcctaagagagtcggaattttcctggattatgaggctggcacactgtctttctataatgtcaccgacaggagccacatttatactttcaccgacacattcacagaaaaactgtggccgctcttttatccaggaataagggccggtaggaagaacgcggcacccctcaccatcaggccaccaaccgattgggaatag

SEQ ID NO: 245127 - DNA, 1557 bp, Artificial Sequence
  Description of Artificial Sequence: Synthetic coding sequence
atggctgagactagcctgcttgaggctggggcatccgccgctagcaccgccgctgctctggaaaatctacaggtggaagcgagctgttctgtctgtcttgaatacctgaaagagcccgtcataatagagtgcggtcacaatttttgtaaggcatgcattacacggtggtgggaggatctggaacgcgactttccgtgcccagtatgccggaaaacctctagatatcggagtctccggccaaaccgccagttaggaagcatggtggagatcgccaagcagctacaggccgtaaaacgtaaaattcgagacgaaagcctgtgcccccaacaccatgaggcactctctctgttctgttatgaggaccaggaggccgtttgcttaatctgtgctatttcccacactcaccgcgcacacaccgttgtgccactggacgatgctacccaggagtataaggaaaagctccagaaatgcctcgagcccctagaacagaagctacaagagattacccgttgtaaatcttctgaggaaaaaaagcctggcgagttgaaacggcttgtggagtcacggcgtcaacaaatcttacgggaattcgaagaactacaccggaggctagatgaggaacagcaggtactgcttagccgcctggaggaagaggaacaggacatcctgcaacggctcagagaaaacgcagctcatctgggtgacaaacgaagagatttggcccatctggcagcagaagtcgagggaaagtgcctccagtctgggttcgaaatgctgaaagacgtcaaaagcacactggagaagaatatcccgcgaaagttcgggggtagcctctcaacaatctgccccagggaccataaggcccttctggggttagtgaaggagattaataggtgcgaaaaggtcaagaccatggaagtaacaagtgtgtccatcgagctggagaaaaacttttcaaactttccaagacagtatttcgctcttaggaaaatactgaagcaattgatcgcggacgtgaccttggaccctgagacggcccaccccaatctggtgttgtcagaagacagaaaaagcgttaaattcgtagagactcgccttagagacctgcctgatacacctagacggttcaccttctacccatgcgttctcgctactgaaggtttcactagtggacgacattactgggaagtggaagtcggcgacaaaacccactgggcagtcggagtatgcagggactccgtgtcccgcaagggtgaactcactccccttcctgagaccggatactggcgtgtgaggctttggaatggcgataagtacgccgcaactaccacgccctttacccccctccacattaaggttaaacccaaacgggtggggatctttctggattacgaagctggcaccttgtccttctataacgtcaccgaccgatcccacatctacacattcaccgacactttcaccgagaagctgtggccattgttttatccgggaattcgcgctggtagaaaaaacgctgctccactgacgatacggcctcccaccgactgggagtag

SEQ ID NO: 245128 - DNA, 1467 bp, Artificial Sequence
  Description of Artificial Sequence: Synthetic coding sequence
atggccgaaacatcactactggaggcaggtgccagcgccgcatctaccgcagccgctttagagaacctgcaggttgaagcttcttgttcagtgtgcctggagtacctcaaggagccagtcattatcgagtgcggacacaatttttgcaaagcgtgtatcactcgctggtgggaagacctggaacgggatttcccctgcccagtgtgccggaaaactagccggtaccgttccctgcggccaaaccggcaattgggatcgatggtggagattgccaagcagctacaggctgtaaagcgcaagatccgagatgagtccctgtgccctcaacatcatgaagcattatccctattctgctacgaagaccaggaagctgtgtgtctgatctgtgccatatctcacacccacagagctcacaccgtcgtgccattagacgatgcaacccaagagtacaaagaaaagctccagaagtgccttgagcctctggagcaaaagctgcaagaaataacaaggtgtaagtcctccgaggaaaagaagcccggtgagctgaagcgcttggtcgagtcccgcagacagcaaattttgagggagttcgaggagctgcaccgacgcctcgacgaagaacagcaggtattgcttagtaggctggaagaggaagagcaggacattttgcaaaggcttagagaaaacgccgcacacctgggcgataagaggagggatcttgcccatctggctgccgaggtcgagggtaaatgcctgcagagtggcttcgagatgctcaaggacgtaaaatctactcttgaaaaatgcgagaaggtgaagacaatggaggtgacttcagtgtctattgaactcgagaagaatttctctaatttcccgagacagtattttgccttgaggaagattctgaaacagctgatagccgacgtgactctggacccagaaactgcccatcctaatctagtgctatcagaggacagaaaaagcgtgaaatttgtggaaacgaggttaagggacctcccagacacacctcgtcggttcaccttttatccctgtgtactggccacagaggggtttacaagtggcagacattactgggaggttgaggtcggcgacaagacccattgggccgttggagtctgccgtgattcagtctcccgcaaaggggagctcacaccattaccagagaccgggtactggcgggttcgcctgtggaatggagacaagtacgccgcaactacgactcccttcacaccattacacatcaaggtaaagcccaagcgggtcggcatattcctggactacgaggccggaacactgtctttttataacgtcaccgatcggtcccatatctatacattcactgatactttcacagagaaattatggccactcttttatcccggaattcgagccggaaggaagaacgcagcccctcttactatccggcctcccacggactgggagtag

SEQ ID NO: 245129 - DNA, 435 bp, Artificial Sequence
  Description of Artificial Sequence: Synthetic coding sequence
atggcagagacaagtctcctcgaggccggagcaagtgctgcatctacagcagctgccctggagaatttgcaggtcgaggcatcttgttctgtatgtcttgaatacctgaaggagcctgtcattatagaatgcggccacaatttttgcaaggcctgcattactcggtggtgggaagatcttgaaagagacttcccttgccccgtatgccgcaagacctcgcggtaccggtccttaaggcctaatagacagctggggtccatggtagagatcgctaaacagctacaagcagtgaagcggaagattcgggacgagtccctgtgcccacaacaccatgaagcccttagtcttttctgctacgaagatcaggaggctgtatgcctgatctgtgccataagtcatactcatcgcgctcataccgtggtgccactggattag

SEQ ID NO: 245130 - DNA, 435 bp, Artificial Sequence
  Description of Artificial Sequence: Synthetic coding sequence
atggccgaaacatccctgcttgaagccggtgcttccgccgctagtactgctgccgctctggaaaatctgcaggtagaggcaagctgcagcgtttgtcttgagtatctcaaagaaccagtgattattgagtgcggacacaatttctgcaaggcgtgtattactaggtggtgggaagacctggagcgggatttcccatgccctgtgtgccgaaagacttcaagatatcggtctctcagacctaaccgccaactggggtctatggtggagatcgctaaacagctacaggccgtgaaaagaaaaatccgcgacgagtccttgtgccctcaacatcacgaagccctttccctgttctgctacgaagaccaggaggctgtctgcctgatttgtgctatctctcatacgcatcgagcacacactgtggtgccgcttgattag

SEQ ID NO: 245131 - DNA, 684 bp, Artificial Sequence
  Description of Artificial Sequence: Synthetic coding sequence
tgaacctccaggtatcggagtctcagacctaaccggcaactgggaagcatggtggagattgcaaaacagttgcaggcagtcaaacggaagatccgggacgagagcctgtgcccccaacatcacgaggcattaagtctcttctgctacgaggaccaggaggctgtttgcctaatctgcgcaatctctcacacacaccgtgcccacaccgttgttccacttgatgacgccactcaggaatataaagaaaaactgcagaagtgcctggagccactggagcagaagctgcaggaaataacccgatgcaagtcgtccgaggagaagaaacccggtgaactgaaacgtttggtggaaagtcgcaggcaacaaatactgagggagtttgaggaactgcaccggcgactggatgaagagcagcaggtgcttctctccaggctggaggaagaagagcaggacatccttcagcgattgcgagaaaacgctgcccacctgggagataagcgtagagacctcgctcatctggccgcagaagttgagggcaagtgcctgcagagcggcttcgaaatgctgaaggacgtgaagtccaccctggagaagtgtgagaaggtgaaaaccatggaggttactagcacaaccccatgcacctctctgcactctgaaattaatgataatgtgcgagggagatag

SEQ ID NO: 245132 - DNA, 147 bp, Artificial Sequence
  Description of Artificial Sequence: Synthetic coding sequence
atggccgagactagcttgttggaagccggagcctcagccgcttctactgcggctgcgttggaaaacctccaggttgaggcctcgtgctcagtgtgtctggaatatctcaaagaacccgtgataatcgagtgcggtcataatttttag

SEQ ID NO: 245133 - DNA, 435 bp, Artificial Sequence
  Description of Artificial Sequence: Synthetic coding sequence
atggcagaaactagcctgctggaggccggagcatctgccgcttctactgctgcagctctggaaaacctgcaggttgaggccagctgctccgtatgtcttgaatatttaaaagagccagtgattatcgagtgcggccataatttttgtaaagcctgcattaccaggtggtgggaggatcttgagcgcgattttccctgccctgtctgtcggaaaacctcaagatatcggtctttgcggcctaataggcagctcggctccatggtggaaatagctaagcagctgcaagccgtaaagcggaagattagagatgaaagcctgtgtccccagcatcatgaggctctcagcctcttctgttatgaagatcaggaggccgtgtgtctcatctgtgccattagccatacccaccgggctcataccgtagttcctctagattag

SEQ ID NO: 245134 - DNA, 1467 bp, Artificial Sequence
  Description of Artificial Sequence: Synthetic coding sequence
atggccgagacgtccctgctagaagccggagctagtgcagctagtaccgcagctgccctggaaaatctccaggttgaagcctcttgctctgtgtgcctcgagtacctgaaagagcccgttataattgagtgtggtcataatttctgtaaggcgtgtatcaccaggtggtgggaagacctagaaagggacttcccctgtcctgtgtgcagaaagacaagtcggtatcggagcctgcgcccaaaccggcagctgggttcaatggtagaaatagcgaaacagctacaggcagtaaagcgcaagatacgagacgagtccctgtgtcctcaacatcacgaggctcttagcctgttttgttacgaggaccaggaggccgtgtgcctgatctgtgctatctcccacactcatcgggcacatacagtggtcccactggatgacgctacacaagagtacaaggagaaactccaaaagtgcctggagcctttggagcagaaactccaggagattacacggtgcaaatcttcggaggaaaaaaagccgggagagctgaagcgtcttgtcgagagtaggcggcaacagatcctcagggagttcgaggagctgcatcggagactggatgaggaacagcaagtgttactttctaggctggaggaggaagagcaggacatcttgcaaaggttaagagagaacgccgctcacctgggcgataagcgaagggatctagcccatcttgctgctgaagttgaaggaaagtgcctccaaagtggattcgaaatgctaaaagatgtgaaatccaccctggagaaatgcgaaaaagtaaaaacgatggaggtgacatcagtgtcgatcgagttggagaagaatttttccaacttcccaagacagtattttgccctgcgtaaaatcttaaaacagttgatcgcagatgtgaccctggatcccgaaacagcccatcctaacctggtcctgtccgaagaccggaagagcgtgaaattcgtggagacaagacttcgcgacttgccagacacccccaggcgtttcactttttatccttgtgttttggccacagaggggtttacatctggccgtcactattgggaagtggaggttggcgataaaacacactgggccgtaggcgtctgccgcgactccgtcagcaggaagggagaactgactcccctgccagaaactggctattggagagtgagactatggaacggcgacaagtatgctgccacgaccacaccctttactcctctgcatatcaaagttaagcccaagcgcgtcggaatctttctcgattacgaggcaggcactctctcattttacaatgtcactgaccggtcccacatatataccttcaccgatactttcactgaaaagctgtggccacttttttatccagggattagggctgggagaaagaacgctgccccattaactatcagacccccaactgattgggaatag

SEQ ID NO: 245135 - DNA, 1467 bp, Artificial Sequence
  Description of Artificial Sequence: Synthetic coding sequence
atggctgagacctcactcctggaagcaggcgcaagcgccgctagcactgccgcagctctggaaaacctccaggtggaggccagctgttccgtgtgtctggagtacttgaaagaacccgttataatagagtgtggtcataacttttgcaaggcgtgcataacgcgctggtgggaagaccttgagagagattttccatgtcctgtctgccggaagacttctcggtaccgcagtctgcgtccgaacagacaactaggatccatggtcgagatcgccaagcagctacaggctgtcaaacggaagatccgcgacgaatccctgtgtcctcagcaccatgaagccttatcacttttctgctacgaagaccaggaagctgtgtgtttgatctgcgcaatatcgcacactcatagggcacacaccgttgtgccacttgatgacgctacccaggaatacaaggagaaattgcagaagtgtctggagcccctggagcagaaactacaggaaataaccaggtgcaaaagttccgaggaaaagaagccaggggaattgaagcgattggttgaaagcagacgccagcagatacttagagagttcgaggagttgcaccgaagacttgatgaagagcagcaggtcctgcttagccgactggaagaggaagagcaggatattttgcaaagactgagagagaacgcagcacacctgggcgataagcgtagagatctggcacacctggcagctgaagtcgaggggaaatgtttacagtcggggttcgagatgctcaagccggtgctgtctgccagagaggaatgcgaaaaagtgaagacaatggaggtcacatccgtgtcaatcgagcttgagaaaaacttttctaattttccacggcaatattttgcactgaggaagatcctgaaacagctcatcgccgacgtcactctggatcctgagactgcccacccaaacttggtgctgagcgaagaccgtaaatccgtaaaatttgtagaaacacgacttagagacttgcctgacacgccccgtaggttcaccttctacccctgcgtcctagccaccgagggtttcacatctggacgtcactactgggaggtcgaagtgggcgacaagacacactgggcagtgggagtgtgtagagactccgtgtcccggaagggcgaactcacacctctgccagagaccggatattggcgggtcaggctgtggaatggggacaaatatgcagccacaacaactccatttaccccactacatattaaggtgaagccaaagcgagtgggcattttcctggactatgaagcaggaaccctttcattttataacgtgaccgacagaagtcacatttacacatttacagacactttcactgagaagttatggccacttttttaccccggtataagggcaggtaggaagaacgcagccccattaactatcaggcccccaactgattgggagtag

SEQ ID NO: 245136 - DNA, 1557 bp, Artificial Sequence
  Description of Artificial Sequence: Synthetic coding sequence
atggcagagacatctctgctagaggccggagctagcgccgcttcgactgcagcagcactcgagaaccttcaggtcgaagcctcctgttctgtgtgtttggaatatctgaaggagccggtgatcatagaatgtggccataacttctgcaaagcgtgtattacccggtggtgggaagacctcgagagagactttccttgtcctgtttgcaggaaaacctctaggtacagaagtctgcggcctaaccgtcaacttggctcaatggttgagatcgcaaaacaactccaagccgtgaaaaggaaaattagggacgaaagtctgtgtcctcagcatcacgaggcactttctctgttctgttatgaagaccaggaggccgtgtgtttgatttgcgcgatctctcacacccatagggctcacaccgtcgtgccactggatgatgccacacaagaatacaaggagaagttacagaagtgtctggaaccactcgagcagaaacttcaggagatcaccaggtgtaagtcttccgaagagaagaagccaggagagctgaagcgtctagtcgaaagccggagacagcaaatcctccgagaattcgaggaactgcatcggaggcttgacgaagagcagcaggtgctgctaagtaggcttgaagaggaggagcaggacattctccagaggctgcgcgaaaatgctgcacacctgggcgacaaaagaagagatcttgcccacttggccgcagaagtcgagggcaagtgccttcagagcggctttgaaatgttaaagccggtgctttcagcgagggagaagaatataccacggaagttcggtggctctttgtcgacaatctgccctcgtgaccataaggctttgcttggactggtgaaggaaatcaacagatgtgaaaaagtaaagacgatggaggttaccagcgtttcaatagagctggagaaaaatttcagcaactttcctcggcagtacttcgcactgagaaaaattctcaagcagctgattgccgatgttaccctcgatccagagaccgctcacccaaatctggtactaagcgaagacagaaaatcagtgaagtttgtggaaactcgcctgcgagacctccctgacactccacgacggttcaccttttacccatgcgtcctggcaaccgagggatttaccagcggccgtcattattgggaggtagaagttggcgataagactcactgggccgtcggcgtttgcagagatagcgtatcgcgcaagggggagcttacccccctgcctgaaactggatattggcgcgtcagactgtggaatggagataagtacgccgcaacaactactccttttacacccctgcacatcaaagtgaaacctaagcgggtgggcatcttcctggactatgaagcaggcactttatcattttacaatgttaccgataggagtcacatttacaccttcacagacacgtttacggagaagctgtggcccctgttttatccaggcatcagggcaggacggaaaaacgcagctccactaacgattcgcccacccacagattgggagtag

SEQ ID NO: 245137 - DNA, 1236 bp, Artificial Sequence
  Description of Artificial Sequence: Synthetic coding sequence
atggcagagacgagcttgttggaagctggggcatctgccgctagtaccgctgctgcccttgagaatctgcaagtggaggctagctgtagtgtgtgtctggagtatctgaaagagccagttatcatcgaatgcggacacaatttctgcaaggcctgcattactagatggtgggaggacttagagagggactttccatgccccgtctgcaggaagacctctcgctaccgatcactgagaccgaatagacagcttggaagcatggtggagattgcgaagcaactgcaggccgtgaagagaaaaataagagacgaatctttgtgccctcaacaccacgaagcactttccctgttttgctacgaggaccaggaagccgtgtgtttgatttgcgccatctcccatacacaccgagcccataccgtagtgcccctagatgacgctacacaggagtacaaagaaaagttgcaaaagtgcctggaaccactcgaacagaagttacaagagattactcgttgcaagagctccgaagaaaaaaaacccggtgagctgaaacggctcgtggaatccaggcggcaacagatcctccgggaattcgaggagctccatcggagacttgacgaggagcagcaggtcctcctcagtcggctagaggaggaagagcaggacatcctgcagcgattgcgagagaatgccgctcatctcggggacaaacgaagggatctggctcacttagcggctgaggtcgaaggtaagtgcttgcaatcgggatttgaaatgctgaagccagtcctatctgcaagggaggagtgtgaaaaagtcaagacaatggaggtgacaagcgtttcaatcgagctcgaaaaaaactttagcaatttccctcgccagtatttcgcactgcgtaaaatactgaaacaactgatcgcagatgttaccctcgacccagagacggcccaccctaatctcgtgctgtccgaggacaggaagagcgtcaagttcgtcgaaactcgtttgcgggacctccctgatacacctcggaggtttaccttttacccctgtgtccttgccactgagggctttaccagcggccgtcattactgggaagtagaggtgggggacaagactcactgggctgtgggtgtctgcagagattccgtgagccgcaaagggggatgtggatacgggatgggcactaatatgcagcctccaccccacctgcttcctctctgcacttcccgatag

SEQ ID NO: 245138 - DNA, 1557 bp, Artificial Sequence
  Description of Artificial Sequence: Synthetic coding sequence
atggccgagacctcactgttggaggctggtgcctcggcggctagcacagctgcagccttggaaaacctgcaggtggaggcttcatgttcagtgtgccttgaatacctcaaggaacctgtaatcatcgagtgcgggcataatttctgcaaagcttgcattactaggtggtgggaggaccttgaacgagattttccctgccccgtgtgccggaaaactagtcgctaccgcagtcttaggcctaaccgccagttggggtctatggtggagattgccaagcagctccaggctgttaagcgaaagattcgggacgaatccctgtgcccacagcatcatgaggcactgtctttgttctgttacgaggaccaagaagccgtgtgcttaatttgcgctatctcgcacacacaccgagcccacacagtggtgccgctggacgacgctacccaggaatataaagaaaagctgcagaaatgccttgagcccttggagcagaaactccaagagatcacgaggtgtaagtcaagcgaggaaaaaaagcccggagaactcaaaaggctcgtcgaatctcgacggcaacagatcctaagagaatttgaagagctccaccgtcgcctggacgaagaacaacaagtgctgctctcccgtctcgaagaggaggagcaggacatcctgcagcggctcagagaaaacgccgcacacctgggcgataagagacgagacctggcacacctggccgctgaggtggaagggaagtgccttcaaagtggattcgaaatgctcaagcctgtcctgagtgctcgggaaaagaacattcccagaaaatttggaggcagcctatctacaatctgccccagggaccataaagccctgttaggacttgttaaagagattaatcgatgcgagaaagttaagaccatggaggtgacgtccgtgtctattgagctcgaaaaaaacttcagtaatttccccaggcaatattttgctctcagaaaaattctgaagcagctgatcgccgacgtgactctcgaccccgaaaccgcccaccctaacctggttctgagcgaggatcgaaaaagtgtgaagtttgttgagacaaggcttagagacctgcctgatactccccgaaggtttacgttctacccctgcgttctcgctaccgaaggatttacaagcggtagacattattgggaggtggaagtgggtgacaagacacactgggctgtgggggtatgcagagactcggtgtcaaggaagggcgaattaactcctttgccagaaacagggtactggcgcgttcgactgtggaatggggacaagtacgcggctactactacaccctttaccccgttacatatcaaagttaagcccaaaagggtgggcatcttcctggactacgaagctgggacactttccttttacaatgtgacagaccgctctcacatttacaccttcacagacacgttcactgaaaaactttggcctcttttttatcctggcattagagcaggacgaaagaacgctgctccactcacaatcagacctcctaccgactgggagtag

SEQ ID NO: 245139 - DNA, 1467 bp, Artificial Sequence
  Description of Artificial Sequence: Synthetic coding sequence
atggcagagacttcactcctggaggctggggcatccgcggcatctacggcagccgcactcgaaaatctccaggtggaggctagctgctcagtctgcctggaatatctcaaggagccagtgattatcgagtgcggccataatttctgtaaagcatgcataacacgctggtgggaagaccttgaacgcgattttccctgtccggtctgcaggaagaccagccgttaccggtcacttagacccaatcgacaactggggagcatggtcgaaatagccaaacagttacaagcagtgaaacgcaaaattagggacgagtccctgtgtccccaacaccacgaagccctgtccctgttctgctacgaagaccaggaagcagtgtgtcttatctgtgcaattagccacacccatcgggctcacactgtggtgccacttgatgatgccacccaggaatacaaagagaagctgcagaagtgcttggaaccattagaacaaaaactgcaagagattacccggtgtaagagtagcgaggagaaaaaaccaggggagctgaagaggcttgtggaatctagaaggcagcagattttgcgggagtttgaggaacttcatcgcaggctggacgaggagcagcaagttctgctgtccaggctcgaagaagaggaacaggacatccttcagagacttcgagagaacgcggcacatctgggtgataaacggcgtgacctcgcacatcttgctgccgaagtggagggaaagtgtttgcagtcagggttcgagatgctgaagcccgttctcagcgctagagaggagtgtgagaaggtcaaaaccatggaggtgactagtgtatccatagagttggagaaaaatttttcaaatttcccaagacaatatttcgccctacgcaaaattttgaagcaactgatcgccgatgtaacattggaccctgaaactgcacatcccaacctagtactctctgaagaccgtaaaagtgtgaaattcgtggagacacgactgagggacttgccagacactccaagacgattcactttctacccttgtgtgctcgctaccgaagggttcacctccgggagacactactgggaggtggaggttggtgacaaaactcattgggcagttggggtgtgtagggatagtgtctcccgcaagggcgagttgactccactgcccgagactggctactggagggtgaggctgtggaatggcgacaaatacgctgccacaacaacccctttcaccccactccacattaaggtgaaacccaagcgcgttggcatcttcctcgactacgaagctggtaccctgagtttctacaacgtgaccgatagaagtcatatctacacctttaccgatacatttacagagaagttatggcctctgttttacccaggtattagggcagggaggaagaatgccgctccactcactatccgccctcccacagattgggagtag

SEQ ID NO: 245140 - DNA, 1557 bp, Artificial Sequence
  Description of Artificial Sequence: Synthetic coding sequence
atggcagaaacaagcctactggaagccggtgcatcggctgcaagcactgctgccgcactagaaaaccttcaagtggaggccagttgcagcgtgtgtctggagtacctaaaagaacctgttattatcgagtgcgggcataatttttgcaaagcctgtattacacgctggtgggaagatctggaacgagacttcccatgccctgtgtgcagaaagacctctagatatagatctctccgccctaaccgacagctcgggagcatggtagaaatcgctaagcaactccaagcggtgaaaagaaagatccgcgacgaaagcctatgtcctcagcatcacgaggcattaagcctgttctgttacgaggatcaggaggcagtttgcctgatttgcgccattagccacactcatcgggctcacaccgtcgtgcccctcgacgacgccacccaggagtacaaagagaagcttcagaagtgcctggagcctttagaacagaaactgcaggagatcacacgctgtaagtccagtgaggagaaaaaacctggggagctgaagcgcctggtggaaagccgaaggcagcagatcctgagagagttcgaagagttacatagacggcttgatgaagagcaacaggtgctgttatccagattagaggaggaagaacaggatattttacagcgactcagggaaaacgctgctcatctgggagacaaacggcgagaccttgcgcacctggctgctgaagtggaggggaaatgcctccagtctggctttgaaatgctgaaagacgttaagagtacactggaaaagaatattcccagaaaattcggcggtagccttagtaccatctgccccagagaccacaaagccctgttaggcctcgtgaaagagatcaaccgttgcgagaaggttaagaccatggaagtgacttcggtgtccatcgaactagagaagaatttttctaattttccccgacagtacttcgccttgagaaaaattttgaagcagctgatcgcggatgttacgctggaccccgagacggcccacccaaatttagtgctttctgaagatagaaagagcgtaaagtttgtggagaccagactaagggacttgcccgacactccaaggcgattcacattctatccctgcgtccttgctacggaaggctttacgtctggtaggcactactgggaagtagaggtgggggacaagacccactgggcggtgggcgtttgtagagactcggtaagcaggaagggagaacttacccccctgccggaaacaggatactggcgggtgaggctctggaacggagataaatatgcagccacaaccacaccttttactcccttgcatatcaaggttaaacccaagcgcgtcgggatatttttggactatgaggccggtactctctcattttacaatgtaaccgatagatctcatatctacacttttacggacaccttcacagagaagctctggcccctattctatccaggaattcgtgccggtcgaaagaacgccgctcccctaacaatccggccacctacagactgggagtag

SEQ ID NO: 245141 - DNA, 1467 bp, Artificial Sequence
  Description of Artificial Sequence: Synthetic coding sequence
atggctgagacgagcttgctggaagccggagcatctgctgccagtactgcagctgctctggagaacctgcaggtggaggctagctgtagcgtgtgtctggagtacttaaaggaaccggtgattattgaatgtggccacaacttctgtaaggcatgcatcacccggtggtgggaggatttagagcgcgactttccttgtccagtgtgcagaaaaacctctaggtaccggtctctccgcccaaatagacaactgggatctatggttgagatcgcaaaacagctccaggccgtgaagaggaagataagggacgagagtctgtgcccccaacaccatgaggccctcagtctgttttgttatgaggaccaggaagcagtttgcctgatttgtgccatctcccacactcaccgagcccacactgtggtacctctcgatgatgccactcaggaatataaggaaaagctgcaaaagtgtctcgagcccctcgagcaaaaattacaggagatcacacggtgtaaatccagcgaggagaaaaagcctggagagctgaaacgccttgttgagtcacgacggcagcaaatactgagagagttcgaggaactgcatcgcagactagacgaggagcagcaagtcttactatcaaggctggaggaagaggagcaggatatcctgcaacggctccgcgagaacgctgcgcacttgggggataagagaagagatctcgcccatttggcggctgaagtcgaaggcaagtgtctccagtcagggttcgaaatgcttaagcctgtccttagcgcccgagaagaatgcgaaaaggttaagacgatggaggtcaccagcgtttctatcgagctggagaagaatttcagtaattttccaagacagtatttcgccttgagaaaaattctcaagcagctgatcgccgatgtgacgcttgatccagaaactgcccaccctaatctggtgctcagcgaggatagaaagtcagtcaaattcgtggagacacggctgcgcgatctgcccgacaccccacggcgttttacattctacccttgcgtcctggccacggaaggtttcacgagcggacgccactactgggaggtcgaggtcggcgacaagacccattgggccgtcggggtgtgcagagactcagtgtcacgtaaaggggaattaacccccctccccgaaactggttattggcgggttcgactttggaatggtgacaaatacgctgcaacgaccaccccttttacccccctccatatcaaggtgaaacccaaacgtgtgggaatttttctagactacgaagccggaacattgtcattctataatgtcaccgaccgcagccacatttatacctttacagataccttcacggaaaagctgtggcctctcttctatccgggaattagagctgggcgtaagaatgctgcaccgctcacaattcggccacctacagactgggagtag

SEQ ID NO: 245142 - DNA, 1467 bp, Artificial Sequence
  Description of Artificial Sequence: Synthetic coding sequence
atggcagaaacaagcctgcttgaggccggagcatcggccgcttccacggccgcagcactcgagaatcttcaggtggaggcgtcctgtagtgtgtgtctggaatacctgaaggaaccagtaattatagagtgtggacacaacttctgtaaggcctgcatcactagatggtgggaggacctggagcgcgacttcccttgtcctgtgtgccggaaaaccagcaggtatcgaagtctgcgacccaatcgtcagctagggtccatggttgaaatagccaagcagctacaggcagtgaaacgtaaaatccgtgacgaatcgttgtgccctcagcaccatgaggcactctctctgttctgttatgaggatcaggaagctgtctgtctcatttgtgccatttctcacacccatcgggcacataccgtcgttcccctcgatgatgctacccaggaatacaaagaaaaattgcagaagtgtctggagcccctggaacagaaactgcaggaaatcacgcggtgtaaatcttcagaggagaaaaaaccgggagagcttaaaaggctggtcgaaagtagaaggcagcagatcctgagagagttcgaggagctgcaccggagactggatgaggagcagcaggtgctcttgtcgaggctggaggaagaggaacaggacatcctgcagcgcctgagagagaacgccgcacatttgggcgataagagaagagacttggctcacctggcagccgaagtggaaggaaagtgtctccaaagcggttttgaaatgctgaaaccagtcctgtcagccagagaagagtgtgaaaaagtgaagaccatggaggtgacatcggtctctatcgaactggaaaagaacttctctaacttcccccgacagtatttcgccctccgcaaaattctcaagcagctcattgccgatgtgacactggaccccgaaacagcgcaccccaatcttgtgcttagcgaggacagaaaatctgttaagtttgtggagacgcggctcagggacctccctgatacccccagaaggtttaccttctacccttgtgtcctagccaccgagggctttacatcaggacggcattattgggaagttgaagtcggtgacaagacacattgggccgtcggagtttgcagggattccgtgagcagaaagggggagttgacccctctccccgaaaccgggtactggagagtgagactgtggaatggagacaagtatgcggctaccaccaccccttttacacctctgcatatcaaggtaaagccaaagagggtgggcatatttctcgactacgaagcaggaaccctgagcttttacaatgttacggaccgctcccatatatatacgtttacagacacctttaccgagaagctgtggcctctgttctaccctggtatacgtgccggaagaaaaaacgccgctccactcaccattagacctccaaccgactgggagtag

SEQ ID NO: 245143 - DNA, 1467 bp, Artificial Sequence
  Description of Artificial Sequence: Synthetic coding sequence
atggctgagaccagtctacttgaagcaggtgcctctgcagcctcaactgccgcagcactggaaaacctgcaggtggaggcctcttgctccgtgtgcctagaatacctgaaagaacccgtgattatcgagtgcggacataatttctgtaaagcctgcattacacgctggtgggaggatctggagagggatttcccttgccctgtgtgtagaaagacttcccgatatcggtctcttagaccaaaccggcagctaggctccatggtcgagatcgctaaacagctgcaggcagttaagaggaaaattagggatgagtctttgtgcccgcaacaccacgaggctttgagcctgttctgctatgaggatcaagaggctgtctgcctgatatgtgccattagccatacccaccgagcccacactgtcgtgcccctagacgacgctacccaggagtacaaggagaaactgcagaaatgtctcgaaccattggaacaaaagttacaggaaatcaccaggtgcaaatcatcggaagagaaaaagccaggcgagctcaagcggcttgtggagagcaggaggcaacagatcctccgagaattcgaagagttgcatagacgtcttgatgaggagcagcaagtcctcttgagtcgacttgaagaagaggagcaagatatcttgcagcggctaagagaaaatgccgcacatttgggggataagagacgcgaccttgcccacctcgccgctgaagttgagggaaagtgtctgcagtccggcttcgagatgctgaagccagtgttatctgcacgcgaggaatgtgagaaggtgaaaacaatggaggtcacttcggtcagcatcgagctggagaagaatttttcaaactttcccagacagtacttcgcactgaggaagattctgaagcagctcattgcagatgttaccttggaccccgagactgcacatcccaaccttgtgttaagcgaggaccgaaaatccgtgaagtttgtagaaacccggcttcgggatctgcctgatacccctaggcgattcacattctacccttgcgttcttgctacagagggatttactagtggtcgtcactactgggaggttgaggtgggtgacaagacccattgggctgttggggtgtgccgggattcagtgtctagaaaaggagagcttacacctctgcccgagacaggatattggcgtgttcgattgtggaatggggacaagtatgccgctacaacaacaccctttacgcctttacacatcaaggttaaacctaagcgcgttggcatattccttgactatgaggcaggaacgctgtctttttataatgtaaccgaccggagtcatatctacacgtttaccgacacctttactgaaaagctttggccgttgttctacccaggcatcagagccggaaggaagaatgccgctcctctgaccattcgcccaccgactgactgggaatag

SEQ ID NO: 245144 - DNA, 1557 bp, Artificial Sequence
  Description of Artificial Sequence: Synthetic coding sequence
atggccgaaactagcctcctggaggctggagcatccgcagcctcaacagcagcggcactggagaaccttcaggtagaagctagctgctcagtgtgcctcgaatacttgaaggaacctgttattattgagtgcggccacaacttttgcaaggcatgcattacaagatggtgggaagacctggagagggattttccatgtcctgtttgtcgtaaaacttcacgctaccgtagcctcagacctaataggcagttgggtagcatggtcgaaatagccaagcagctgcaggccgtgaaaagaaaaattcgtgacgagtcactgtgtccacaacaccacgaggctttatcgctgttttgctacgaagaccaggaagccgtctgcctgatctgcgcgatttctcacacgcacagagcccacactgtcgttccactagatgacgcgacgcaggaatataaggaaaagctccagaagtgtctggagccactcgaacagaaactacaggagataactcgctgtaagtcatccgaagaaaaaaaacctggcgagctgaagcggctggtggagagtcgtcgtcagcagatcttacgggaattcgaggagctccatcgacggcttgacgaggagcagcaggttctgctgtcacggttggaggaggaggagcaggacatcctgcagcgcttgcgcgagaacgcagcccatttaggagataaacgaagggatctggcgcacctggcagcagaagtcgaagggaagtgtctccagtctggatttgagatgcttaaagacgtaaagtcaactttagagaaaaacatacctagaaagttcggcggatcactctcaactatttgtccaagagatcacaaggctctgctgggactggtcaaggaaatcaaccgttgcgaaaaggtgaagacaatggaggttactagcgtgtcaatcgaactggaaaagaatttttcgaacttcccaaggcagtacttcgcattacggaagatattgaagcagctgatcgcggacgtgaccttggatcccgagaccgcccaccccaacctggtgctgtccgaggacagaaagtctgtaaaattcgtggaaaccagactaagggacctaccagacacacccagaaggtttaccttttatccctgcgttctggctactgaaggcttcacaagtggacggcactattgggaggtggaggtcggtgacaagacacattgggccgtgggcgtctgccgcgactctgtgtcaaggaagggcgaactcaccccattgcccgagactggttattggagggttagactgtggaatggggacaagtacgctgccactacgacccctttcacccccttgcatatcaaggtgaagcccaagcgagtgggtatttttctcgactacgaggccggtactttgtcattttacaatgttacagaccgcagccacatttacacatttactgacacattcacagagaaactgtggcctctgttctaccccggaatccgggctggcagaaaaaatgccgctccactcacaattcgacctcccaccgattgggagtag

SEQ ID NO: 245145 - DNA, 1236 bp, Artificial Sequence
  Description of Artificial Sequence: Synthetic coding sequence
atggccgaaacaagcctactggaggccggagcgtcggcagcttcaactgctgctgccctggaaaatctgcaggtggaggcaagttgcagtgtatgcctggagtacctaaaggagccagtaatcattgagtgcggacataatttctgtaaggcctgcattacacggtggtgggaagacctcgagcgcgactttccatgccctgtatgccggaaaacttcgcgctacagaagcctaaggcccaataggcagctggggtctatggttgaaattgcgaagcagcttcaggcagtgaagcgaaagattcgtgacgagtccttgtgtccacagcaccatgaagctctgtcactgttctgctacgaggaccaggaggcagtttgcttgatttgtgctatttcccatactcaccgcgcacacaccgttgtgcccctcgacgacgccactcaggagtataaggagaaactgcagaagtgcctcgagcccctggagcagaaactccaggagattacgagatgcaaatcttcagaagaaaagaaacccggtgaactcaaacggctagtggagtcacggagacaacagatactgcgagaattcgaagaattacaccggagactggacgaggagcagcaggtattactgtcacgactagaggaggaagaacaggacatcctgcaacggttgcgcgagaatgcagcccacttgggcgataagcggagagacctggctcacctggccgctgaggttgagggcaagtgtcttcaaagtggcttcgagatgctgaagccagtgctgagcgctagggaggagtgcgagaaggtgaaaacaatggaagtcacaagcgtgagtatcgaattggaaaagaatttttcaaacttcccaaggcagtacttcgcactgagaaagatcttgaaacagctcatcgccgacgtcacccttgatccggagacagcacatcccaacttggtgttgtccgaagaccgcaagtccgtgaaattcgtcgagacacgtctgcgagatcttccggacacgcctcgacggttcacattttatccctgcgtcctggctacagagggctttacttctgggcgacactactgggaggtggaggtaggcgataaaacccattgggctgtgggagtgtgccgggattctgtgtcccgcaaaggtggatgcggctatggcatgggcacaaatatgcaacctcccccacatcttctccccctttgcacaagtagatag

SEQ ID NO: 245146 - DNA, 1557 bp, Artificial Sequence
  Description of Artificial Sequence: Synthetic coding sequence
atggctgaaacctctctgctggaggctggggcaagcgccgcaagtactgccgcagccctggagaatctgcaggtcgaggcgagctgcagcgtgtgtttagaatacctgaaagagcccgtgatcattgagtgcggtcacaacttctgcaaggcttgcattactaggtggtgggaggacctggagcgggatttcccctgcccagtctgcagaaaaacttctagatatcggagcctaagacctaatcgacagcttggcagtatggtggaaatcgctaagcaactgcaggccgtgaaacggaaaataagggatgaaagcttatgcccgcaacaccacgaagcgctgtccttgttttgttatgaggaccaggaagccgtgtgtctgatttgcgctattagccacacccacagagcgcacactgtggtgcctctggacgatgctacccaggagtataaggagaagttgcagaaatgcttggagccgttagagcagaaattacaagagatcacacggtgtaaatcatccgaggagaagaaacctggtgaactgaagcgcctcgtggaaagccgacggcagcagatcctgcgcgagttcgaagaacttcaccgccgattggatgaggagcagcaggtcctgttatcacggttagaagaagaggagcaagacattctccagcggttgcgcgagaacgccgctcacctcggcgataaaagaagggacctggctcacctggcagccgaggtcgagggcaagtgtctgcagagcggcttcgaaatgttgaaaccggtcctctccgccagggagaaaaacatccctagaaaatttggcggtagcctaagcaccatctgtcctagagaccataaagccctgcttgggctggttaaggaaataaatcggtgtgagaaggtcaagacaatggaagtgacctctgtatccatcgagctggagaagaattttagtaacttccccagacagtacttcgcactccgcaaaatcttaaaacagctcattgccgacgtgaccctcgaccctgagacagcccatccgaacctggtgctgtccgaagaccggaaatctgtgaaattcgtggagacacgcttgcgagacctccctgacacacctcggaggttcactttttatccttgcgtgcttgcaacagagggttttacatctggtagacactactgggaagtggaagtcggggacaagacacattgggccgttggcgtgtgcagggacagcgtcagcaggaagggagaactaacacctttgcctgaaaccggatattggagagttaggctgtggaacggcgacaaatatgcggcaacgactacaccttttactcccctgcacatcaaagttaaaccaaagcgggttggcattttccttgattatgaagctggcacgctgtcattctataacgtgacagatcgctctcacatttacacctttactgacacattcaccgagaagctctggcctcttttctatcctggaatcagagcaggcaggaaaaacgcagcccctttgacaattagacctccaactgactgggagtag

SEQ ID NO: 245147 - DNA, 1236 bp, Artificial Sequence
  Description of Artificial Sequence: Synthetic coding sequence
atggccgagaccagtctgcttgaagcaggcgcaagcgccgcatctacagctgcagccctagaaaatttacaggttgaggccagctgctccgtgtgtctcgaatatctcaaggagccagtaataatcgagtgcgggcacaatttctgtaaggcctgtataaccagatggtgggaagatttagagagggacttcccatgtcccgtgtgccggaagacctcccggtatcgttcacttaggcctaaccggcagctcggcagcatggtcgagatcgctaaacagttacaggccgtgaagcggaagatcagggacgaatctttatgcccacagcaccatgaagctttaagcctcttttgttatgaggatcaagaggctgtctgtctcatctgcgccatctctcatacacacagagcacatacggtcgtgcctcttgacgatgcgacacaagagtacaaagagaaattgcaaaaatgcttagaaccccttgagcagaagctgcaggagattactcgttgcaagagttccgaggaaaagaagccaggtgagcttaagcggctagtcgaatctcggagacaacagatcctacgggaattcgaagaacttcacagaagactggacgaagagcagcaagtcctgctctccaggttggaggaggaggagcaggacatattgcagaggctcagagaaaacgcagcccatctgggcgacaagaggagggaccttgcccaccttgccgctgaggtcgagggcaaatgtctccaatcaggctttgagatgctgaaacccgtgctgagtgccagggaagagtgtgagaaggtcaagacaatggaagttacgtctgtaagtatcgagctcgagaagaatttctccaatttcccgagacaatactttgctctccgtaagattctgaaacagctgattgcggatgtgactctggatcctgaaacggcccacccaaacctggtgctatcggaagataggaagagcgtcaaattcgtggaaacgagacttcgggatctcccagacactcctcggcgatttactttctacccttgtgtgttggccaccgaaggattcacgtccggacgacactattgggaggtggaggtgggcgataaaacccactgggcggttggagtctgcagagattccgtgtcacgcaagggaggatgtggctatggtatggggacaaacatgcagcccccaccccatctactgcccctgtgtacttccagatag

SEQ ID NO: 245148 - DNA, 1236 bp, Artificial Sequence
  Description of Artificial Sequence: Synthetic coding sequence
atggccgagacctcactgctcgaggctggggcatcggcagctagtaccgccgctgccctagaaaatctccaggtggaagcctcgtgttccgtgtgtttggagtatctcaaggagcctgtgattatcgaatgtggtcacaatttctgtaaggcctgtatcacccgctggtgggaggacctcgagagagattttccctgtcctgtctgtcggaaaacatccagatataggtctttgcgcccaaatcgtcagcttggctcaatggtggaaattgcaaagcagctgcaggcggtaaagcgcaaaattagggacgagtctttgtgccctcagcaccatgaagccttgtcccttttctgctatgaagatcaggaagccgtctgtctgatctgtgcaattagccacacacatcgggctcataccgtggtccctctagatgatgcgacacaagaatacaaagagaaactgcagaaatgcctggaacctctggaacagaaactgcaggagattacaagatgtaagagtagtgaagaaaagaagcccggagaactaaaacggttggtcgagagcagacggcagcagatcctacgagagtttgaggagctccacagacgactcgacgaggagcagcaggtgcttctgtcccggctggaagaggaagagcaggacatcctccagaggctgagagagaatgccgctcatttgggagacaaacgccgagatttggcccacctggcggcagaagttgaagggaagtgtctgcagagcggcttcgagatgttgaaaccagtgttatctgcacgggaggaatgcgaaaaggtcaaaaccatggaagtgacatccgtatcaattgaattagagaagaattttagcaattttccaagacagtacttcgcgctccgtaagattctcaaacagttgatcgcggacgtgactctagatcccgaaaccgcccaccccaatctggtcctctccgaggacaggaagtctgtcaagtttgtcgagacccggctgagggacctgcccgacaccccaaggagatttactttctacccgtgtgttctcgccactgaagggtttacctcagggaggcattactgggaagtcgaagtgggcgacaagacgcattgggcagtcggcgtgtgtcgggattccgtatccaggaagggcggatgtggctacgggatgggaactaatatgcagcctccgcctcacctgttgcctctctgcacctcacgctag

SEQ ID NO: 245149 - DNA, 1557 bp, Artificial Sequence
  Description of Artificial Sequence: Synthetic coding sequence
atggcagagactagcctactcgaagctggggcttcggctgccagtacggccgcagctctggagaatctccaggtggaggccagttgttctgtgtgtttagagtacctaaaggaacccgtaatcattgagtgcggccataacttttgcaaggcctgcatcaccaggtggtgggaggacttggaacgcgactttccttgtcctgtgtgccgtaaaacctccagatatcgtagccttcgcccaaaccgtcaactgggatccatggtggaaattgccaagcagctgcaggccgtgaagcgaaagattcgggatgagagtctctgtccacaacaccacgaggccttgagcttgttctgctatgaggaccaggaagccgtgtgtctgatatgcgctatctctcacactcaccgagctcacactgttgtgcctttagatgacgcaactcaggagtataaagagaagttgcagaaatgcctggaacccctagagcagaagctgcaagaaataactaggtgcaagtcaagcgaggaaaagaagcctggcgagttgaaacggctggttgagtcccgaagacagcagattctcagagaattcgaggaactgcataggaggctggacgaggaacagcaggtgctcctgtcccgccttgaagaagaagagcaggacattctgcagcgattgcgcgagaatgctgcccaccttggcgacaaaagaagggatttggcccacctggcagctgaggttgaggggaagtgcctgcagtcaggcttcgaaatgttgaaggatgtgaagtcgaccctggaaaaaaatatcccaagaaaatttgggggatctcttagcactatttgcccaagggaccataaagccctcttgggtctggtaaaagagattaacagatgtgagaaggtgaagacaatggaagtcacttccgtttccatagagctggagaagaatttcagtaacttcccccgacagtactttgccctccgcaagatccttaagcagcttattgctgacgtgaccctggatcctgaaaccgctcatcctaacttagtgctgtcagaggaccggaagtccgtgaaattcgtggagacacgacttcgcgatctccccgataccccgagaagattcactttctatccctgtgtcctagccacagagggctttaccagcggcagacattactgggaggtagaggtcggcgataagacgcattgggcagttggcgtgtgccgagactcagtgtcccgcaaaggcgaattaacccccctgcccgaaacgggctactggagagtgcggctttggaacggcgacaaatacgccgcaaccactacaccattcacccccctgcatatcaaggtcaagccaaagagggtggggattttcttggactacgaggctggtactttatccttttataatgtgactgataggagtcacatttatacgttcaccgacacttttacggagaagctatggcctctcttttacccaggcatcagagctggacgaaaaaatgccgcacccctaaccatcaggccccctacagactgggagtag

SEQ ID NO: 245150 - DNA, 1557 bp, Artificial Sequence
  Description of Artificial Sequence: Synthetic coding sequence
atggcagaaacttcattgctggaggctggcgcttcggccgcttcgaccgccgctgctctcgagaacctccaagtggaggcctcctgttcagtctgcctggaatatcttaaggaaccagtcattatcgagtgtggacataatttttgtaaggcctgtattacgagatggtgggaagatctggaacgagattttccttgcccagtatgccggaagacctcacgctaccgctctctaagacccaatcgccagctggggagtatggtggagatcgcaaagcaactgcaggcagttaagcgcaaaatcagggacgaaagcctctgtcctcaacatcacgaggcattatcattgttctgttatgaggatcaggaggctgtgtgtctgatctgtgctattagccatacccatcgagcccataccgtagtacctttggacgatgctactcaggagtacaaggagaagctccagaagtgtctagagccattagaacagaaactgcaggagattacacggtgcaaaagctctgaagaaaaaaaacctggggaactgaaaaggctggttgagagccggagacagcagatcctccgagaatttgaagaactgcacaggagattggacgaagaacagcaggttctgctgtcccggctcgaagaggaggagcaggacattctgcagaggctgagagagaacgcagctcaccttggtgataaacgacgagatctggctcacttggccgctgaggtggagggcaaatgtctgcagtcaggatttgaaatgctgaagcctgttctatccgctcgcgagaagaatataccgaggaaattcggaggttctctgtctaccatctgtccaagggaccataaagcactcctggggctggtaaaggagataaaccgttgcgaaaaggtgaagactatggaggtgacttctgtcagcattgaactggagaagaacttttccaattttcccaggcaatacttcgcccttcgtaagatcttgaagcagttgatcgcagacgttaccctggaccctgaaactgcacacccaaacctcgtgttgagtgaagatagaaaaagcgtcaaatttgtggaaactcgattgcgggacctccctgatacacccaggagatttaccttctatccttgtgtgctggcaaccgagggttttacctccgggagacactactgggaggtggaggttggtgacaagacacactgggccgttggagtttgccgcgacagcgttagcaggaagggggagcttacgcctttacctgagacaggttactggcgggtgcggttgtggaacggagataagtatgctgccactactacaccattcaccccactccacattaaagttaaacccaaaagggtggggatttttctcgattacgaagctggtacactgtccttctacaacgtcaccgacagatcccatatatatacttttaccgacacctttactgagaagctctggccactgttctatccgggaatcagggccggaaggaaaaatgcggctcctttgactattagacctcctacagattgggagtag

SEQ ID NO: 245151 - DNA, 1557 bp, Artificial Sequence
  Description of Artificial Sequence: Synthetic coding sequence
atggccgaaaccagtctcctggaagccggagcttccgctgcctctactgccgctgctctggagaacttacaggtggaggccagttgcagcgtgtgtctggaatatctgaaagagccagtcataattgaatgcggacataacttttgtaaggcttgcattactagatggtgggaggatctggagagggactttccctgcccggtgtgcaggaaaacctcacggtaccggagtctccgcccaaatcgccagctgggttccatggtagaaatcgcaaaacaattgcaagccgtgaaacgcaagattcgcgacgaatccctgtgtccacagcaccacgaagccctgagcctgttttgttacgaggaccaggaggcagtgtgcctgatctgtgcaatatcccacacccacagagctcataccgtagtgcccctagacgacgccactcaggagtataaagagaaactgcagaagtgcctcgagccccttgagcaaaagcttcaggagattacccgctgcaagtcgtccgaggagaagaaacccggtgagctgaaaaggctcgtggagtcgcggcgacaacaaattttgagagagtttgaggagcttcatcgcagactggacgaagaacagcaggttttactgagcaggctagaggaggaggagcaagatatcctgcaaaggctccgcgagaatgccgcacatttaggagacaagcgacgggatctggcacacctggccgcagaggtcgagggaaagtgtctgcagtctggatttgagatgttgaagccggttctgtccgcacgagagaagaacatacccaggaagttcggcggaagcctaagcaccatttgtccaagagatcacaaggccttgctcgggcttgtgaaggaaatcaaccgttgcgaaaaggtgaagacgatggaagttaccagcgtatccatcgaactcgaaaaaaatttttctaactttccgagacagtatttcgccttgcgcaaaatccttaagcagctgattgccgatgtgacactcgaccctgaaaccgcccacccaaatctggttctgtctgaagataggaaatccgtcaagttcgtcgagacacgcctgagagacctgcctgacactcccaggaggttcaccttttacccctgcgtgctggccaccgaaggttttacttccggccgacattactgggaggtggaggtgggtgataaaacccattgggctgttggggtttgcagagactcagtgagccgtaagggtgagctgacgcccctgccagaaacaggttactggcgggttagattgtggaacggcgataaatacgccgctactacgacaccctttacgcccctgcatatcaaggtcaagcccaaaagggtcggcatcttcctggactacgaagcaggcactctcagtttttacaatgtcaccgatagatctcatatctacaccttcactgatactttcaccgaaaagctctggccactattctatcctgggattcgcgctggcaggaagaacgcagcccctcttactatacgcccacccacagactgggagtag

SEQ ID NO: 245152 - DNA, 1557 bp, Artificial Sequence
  Description of Artificial Sequence: Synthetic coding sequence
atggctgagacctctctgttagaagctggcgcaagtgcagcatccaccgccgctgcgttagagaacctgcaggtggaggcttcttgttccgtgtgtcttgagtacttgaaggagccagtgattatcgaatgtggacacaatttttgcaaggcctgtatcactaggtggtgggaagacctggagagggattttccttgccctgtttgccgaaaaaccagccggtatagaagcttgcgtccaaaccggcagttgggaagtatggtggaaatcgctaaacagctgcaagccgttaagcggaagattcgggacgaatccctgtgccctcaacaccacgaagccctttccttattctgttatgaggatcaggaggccgtctgtttgatatgtgcaatatcacacacacacagagctcacactgttgtgcccttggacgacgccacacaggaatacaaggaaaagctgcagaaatgtctcgagcccttggagcagaaactccaggagatcacaagatgtaagtcttctgaagagaagaaacccggagagcttaaaagactggttgaaagcaggcgccagcagattctcagggaattcgaagagctgcatcgcaggctggacgaggaacagcaggtgttgctttcacgattagaggaggaggaacaggatatactgcaaaggctacgcgagaatgctgctcatctgggcgacaagagacgggatctggcccacctagctgcggaagtggagggcaagtgccttcagtcaggctttgaaatgctgaaagacgtgaagagtacccttgaaaagaacatcccacggaagtttgggggatccctgtcgactatctgcccgagggaccataaagccctgcttggcctggttaaggagattaatagatgcgagaaggtgaagacaatggaggtaacgtccgtgagtattgagctcgagaagaacttctccaactttccacggcaatactttgcacttcgcaagatcttaaagcagctgattgccgacgtcacacttgatcctgaaactgcacaccccaacctagtgctctccgaggataggaaatctgtgaagttcgtggagactcggttgcgcgacctgccagatacaccaaggaggttcacgttctacccatgcgtgctcgccaccgaggggttcacgtccggcaggcactactgggaggtcgaggtgggcgacaagactcactgggccgtgggggtgtgccgtgacagcgtaagcagaaaaggcgaactcacaccacttcccgaaactgggtactggcgcgttcgcttgtggaacggtgacaagtatgccgcaaccacaactccattcacacctctgcacataaaggtgaaacctaaacgtgtgggcatctttctcgattacgaggcaggcacattaagcttctacaatgtgactgacagaagtcacatctacaccttcacagataccttcaccgaaaagttatggccactgttttaccctgggatccgcgctggaagaaagaacgccgctcccctgacgattagaccccctactgattgggagtag

SEQ ID NO: 245153 - DNA, 1557 bp, Artificial Sequence
  Description of Artificial Sequence: Synthetic coding sequence
atggccgaaacatcactcttggaagctggtgccagcgccgcatccaccgccgcagccctcgagaaccttcaagtggaggcctcctgctctgtatgcttagagtatctaaaggaaccagtgataattgagtgtggacataatttttgcaaggcttgcatcacgaggtggtgggaagatctagaaagggattttccctgccccgtgtgccgcaagacctccaggtatcgcagcttacgccctaaccgacagctgggatctatggtggaaatagcaaagcagctacaggctgttaaacgcaagattagggacgaaagtctgtgtcctcagcatcacgaagcgctgtctctcttttgttacgaagaccaagaggcggtctgcttgatctgtgccatatctcacacccatcgagcccacactgtggtgcccctggacgacgcgacgcaagaatataaggaaaaactgcaaaagtgtctggagccccttgaacaaaaacttcaggaaatcaccaggtgcaaatcttccgaagaaaagaagccaggggaactcaagcggttagtggaaagtcgtagacaacagatcctgcgcgaatttgaagaattacaccggagactcgacgaagaacagcaagtcctcctgagcaggttggaggaagaggaacaagacatcctccaaagactccgagagaatgccgcacatttaggagacaagaggagagaccttgctcacctcgcggcagaggtcgagggaaagtgtttgcagtccggatttgagatgctgaaacctgtgctatcagcgagggagaaaaatatcccaagaaagttcggcggttcgttgtctactatttgtccccgagatcataaagcgctcctcggtctcgtcaaggagatcaatagatgcgagaaggtgaaaaccatggaggtgacatctgtatctatcgagctcgagaagaatttcagtaatttccccagacagtattttgctttgagaaagatccttaaacagctgatcgccgatgtcaccttagacccggagacggcccacccgaatctcgtcctcagcgaagatcggaagtctgtgaaattcgtcgaaacccggctcagagatctgccggacacccccaggaggttcaccttttacccatgtgtactcgccaccgagggctttacatctgggagacactattgggaggtggaagtgggagataagacacattgggcagttggcgtttgtcgggatagcgtatcgcgcaagggcgagctaacaccgctgcccgaaactggatactggcgggtccgactatggaacggggataaatatgcagctacaaccactccgttcacccctttgcacatcaaggtcaagcctaagcgggtggggattttcctggattacgaagcaggaacgttgagtttttacaatgtgacagaccggtcgcacatctataccttcacagatacctttaccgagaagttgtggcctctcttttaccctgggataagggcgggtcgcaagaatgcagcaccgctgacaattagaccccctactgactgggaatag

SEQ ID NO: 245154 - DNA, 1254 bp, Artificial Sequence
  Description of Artificial Sequence: Synthetic coding sequence
atggtcgagattgctaagcagctccaagccgttaaaagaaagatccgggatgagtccctctgtccacaacatcatgaggccctgtctctcttctgttacgaagatcaggaggccgtctgtctgatctgcgccatttcacacacacatcgagcccacactgtagtgcctctggatgacgccacacaggaatacaaggagaaactgcagaaatgccttgagcccctggaacagaagcttcaggagattacaagatgcaagtcttctgaggagaaaaaaccaggagagttgaaacgccttgttgagtctcgcaggcagcagattctccgcgagttcgaagaactgcatcggagattagatgaggagcaacaggtgctgctttcccgccttgaagaagaagaacaagacattctgcagcgactgcgggagaacgcggctcatctaggcgacaaacgtcgagaccttgctcatctagccgcagaggtggaaggcaagtgtcttcagtcaggtttcgagatgctcaagcctgtgttgagcgctcgcgaagaatgcgagaaggttaagaccatggaagtgacatccgtatcaatcgaactggaaaagaatttctccaatttccccaggcagtattttgcccttcggaaaatcttaaagcaactgatcgcagatgtgacactggaccctgagacggcccaccccaacctcgtgttgagcgaggatagaaaatcagtgaaattcgtggagaccagattgcgagatttgcccgacacccctcggagatttacattctacccttgtgtgctagccaccgagggctttacctccgggagacactactgggaagtggaagctgcccattgtgtcctggcacaagatcctgaaaaccaagctctggcgcgattttactgctataccgagagaaccatcgcaaagcgtctggtcctccgcagagatccatctgtcaagaggacgctctgtaggggctgttcgtccctgcttgtgcctgggctgacttgcacacacagacagcgaagatgccgcggacagcgatggactgtgcaaacctgtctgacatgccagaggtctcaacgtttcttaaatgaccctggtcacctgctctggggggaccggcctgaggcacagctgggttcccaggccgacagcaagccactgcaaccattaccaaacaccgcccactctatcagcgaccggctacctgaagaaaagatgcagacccaaggcagtagtaaccaatag

SEQ ID NO: 245155 - DNA, 1254 bp, Artificial Sequence
  Description of Artificial Sequence: Synthetic coding sequence
atggtggaaatcgccaagcaactccaagctgttaaaagaaaaataagggacgaaagcctttgcccccagcaccatgaagcgctgtctttgttttgttatgaggatcaggaagctgtgtgcctgatttgtgctattagccatacacaccgggctcatactgtagtgccgctggacgacgctacccaggagtataaggaaaagctgcagaagtgcctggagcctctggagcagaagctccaggaaataacacggtgtaagagtagtgaagagaagaaacctggggaactaaaacgcctggtggaatcaaggcgtcagcagattcttcgggagtttgaggaactgcacaggcgattggatgaggaacaacaggtgcttctcagccggttagaggaggaagagcaggacattcttcaaagattgcgtgagaatgcggctcacttaggcgacaagcggagggacctggcccacctggccgcagaggtggagggcaaatgcttacagagcggctttgagatgctgaagcctgtactgtctgcaagagaagaatgcgaaaaggtgaagaccatggaagtgacaagcgtgtccatcgaactcgagaagaatttttccaatttcccgcgacaatactttgctctgagaaaaatccttaaacaactgattgccgacgtcactctcgatcctgagacagctcacccaaatcttgtgttgtctgaagacaggaaatctgtgaagtttgtagaaactcggctgagagacctccctgacacaccgaggcgtttcaccttttacccgtgcgttctcgccacagaaggcttcactagtggacggcactactgggaagtggaagccgctcactgtgtactggctcaagacccagagaatcaggccctcgctcggttttattgctataccgagcgaactattgcgaaaagacttgtcctcagacgggatcccagtgttaaaaggaccttatgccgaggctgtagttccctattggttcctggacttacgtgcactcacagacagcgtcgttgtaggggtcagaggtggacggtccaaacttgcctcacttgtcagaggagccaacggttcttgaacgatcctgggcacttactctggggcgaccgcccagaagcccagctcggaagtcaggcggacagtaagcctttgcaacctttgcccaacacagcccactctattagtgaccgcttgcccgaggagaaaatgcagacccaggggtcaagcaatcagtag

SEQ ID NO: 245156 - DNA, 1236 bp, Artificial Sequence
  Description of Artificial Sequence: Synthetic coding sequence
atggccgagacatcactgctcgaagccggtgcctccgccgctagcacagccgcagcgctcgaaaatctgcaagtggaggccagttgttcagtctgcctggaatacttgaaggaacccgtgatcatcgagtgtgggcataatttctgtaaggcttgtatcactcgatggtgggaggacctcgagcgagattttccatgtccggtgtgtaggaagacaagcaggtaccgaagcctgagacccaaccgccagcttggctctatggtggaaattgcaaagcagctacaggctgtgaaacggaaaattagagacgaatctctatgccctcaacaccatgaggcactgagcctgttctgttatgaggaccaggaagctgtgtgtcttatctgcgctatctcgcatacccaccgggctcatactgtggtccccctggatgatgcgacacaggagtacaaggaaaaactgcaaaagtgtctggagccacttgaacagaaactgcaggaaattaccaggtgtaaaagctctgaggagaaaaagcctggggaactaaaaaggttagtggaatcccggagacaacaaatccttagggaattcgaggagctgcatcgcaggctcgacgaagagcagcaagtgctgctgtcaagactcgaggaagaggaacaggatattcttcaacgcctccgcgagaatgctgcacatcttggggacaaaagaagagatttagcccaccttgctgccgaagttgaggggaaatgtctgcagtctggctttgaaatgctcaaaccggtgctcagcgccagagaagagtgcgaaaaagttaagaccatggaagtaacctctgtctccatagagctggagaaaaacttcagtaattttccacggcagtactttgctctgaggaagatcttaaaacagctcatcgctgatgtcactctggacccagagactgctcacccgaatttagttctctccgaggaccgtaaaagcgtgaagttcgtggagactagactcagggatctgcctgacaccccaagacgatttaccttttatccgtgtgtcttggctacagaagggttcacttccgggaggcattactgggaggttgaagtgggtgacaagacacattgggctgtgggcgtttgccgggattccgtctctaggaagggaggctgcggctacgggatgggtacaaatatgcagccaccaccacacctattgcccctctgtacatcacggtag

SEQ ID NO: 245157 - DNA, 1254 bp, Artificial Sequence
  Description of Artificial Sequence: Synthetic coding sequence
atggtggaaatcgccaagcaattgcaggcagtgaaacggaagattcgggacgagagcctgtgtccgcagcaccatgaggccctgtctctgttttgctacgaggaccaggaggcagtgtgtttgatttgcgctatctctcacacacatcgtgcccacacagttgttcccctcgacgatgccacccaggagtataaagagaagctgcagaaatgcttagagcctctggaacagaagttgcaagagattaccaggtgcaaatcatcagaagaaaagaaaccaggagagctgaagcgactcgtggaatcacggaggcaacagattttgcgggagtttgaagagctccaccggagactggacgaggaacagcaagtgcttctcagccggctggaagaggaggagcaagatatactgcagaggctgcgtgaaaatgccgctcacctaggagataagagacgagacctggcgcacctggccgcagaggtcgagggcaagtgcctacagagcgggttcgaaatgctcaagcccgtcctctcagccagggaagagtgcgagaaagtcaaaacaatggaggtgacttctgtaagcatagagttggagaagaacttctcaaacttccctcgccagtatttcgctctgaggaagattcttaagcaactgatcgcagacgtaaccctggaccccgaaacagcacaccccaacctcgtgctctctgaagatcgcaagagcgttaagtttgtggagaccagactccgcgacctccctgatacaccacgcagatttaccttttatccttgcgtcctcgcaaccgaagggtttacatccggtcgccattattgggaagtggaagctgctcactgcgttttagctcaagaccctgagaaccaggccttagccaggttttactgttacacagaaagaactatcgcaaagcgcttagtgttgaggcgagatccatccgtgaaacgtactctctgccgagggtgtagctcactccttgtgcccggactgacttgcactcacaggcagaggcgatgccgtgggcagcggtggactgtgcagacgtgtttgacttgtcagaggagccaaaggtttttgaatgatccaggacacttgctgtggggggacaggccggaggctcaattgggaagtcaagcagacagtaagccattgcagccactgcccaatacagcccactcaatttcggacagactccccgaggagaagatgcagacacaaggctctagcaatcaatag

SEQ ID NO: 245158 - DNA, 1557 bp, Artificial Sequence
  Description of Artificial Sequence: Synthetic coding sequence
atggctgagacaagtctattggaggccggagccagtgcagcatccaccgccgcagcactggagaatcttcaggtcgaggctagctgcagcgtgtgcttagagtatctgaaagaacctgttatcatcgagtgtggccataatttttgcaaggcatgcatcactagatggtgggaggatctggaacgcgatttcccttgtcccgtgtgcaggaagacctcaagatatagatctctccgtcccaatcgccaacttggcagtatggtcgagatcgctaagcagctccaggccgtgaaaagaaagatccgcgacgagtcactttgcccacagcaccatgaggctttaagcttgttttgctacgaagatcaggaggccgtgtgcctcatctgcgcaatctcacacacacacagggcacacaccgtcgttccgctggacgatgccacccaggaatataaggaaaaactgcaaaagtgtctggaaccactggagcagaagttacaggagattacccgctgtaagtcctccgaggagaagaaacctggcgagctgaaacgtctggtggagagcagacgtcagcaaattttaagggagtttgaggagctacaccgtcgcctggatgaggagcagcaggtcttgttgtcccgcctcgaagaagaagaacaggacatcctccaaagactgagagagaatgcggcacatctaggcgacaagcggcgtgacctggcgcatctggcagccgaggtagagggtaaatgccttcagagcggttttgagatgttaaaacccgtcctgagtgccagggagaagaacatacccaggaagttcgggggttccctgagcacaatctgccccagagatcacaaggcgctccttgggctggtgaaggagattaacagatgcgagaaggtcaaaaccatggaagttacttccgtgagtatagagctcgagaaaaacttttctaattttccaagacagtattttgccctgcgaaagatcctgaagcagctgatagccgacgtgaccctggaccctgaaaccgctcacccgaatctcgtgttgagcgaggacaggaaatctgtgaagtttgtggagactcgtctcagagacctgcccgacacccctcgtcgcttcactttttatccctgcgtcctcgccactgaaggatttacctccggaagacattattgggaggtggaggtcggagacaagactcactgggccgtgggtgtttgccgagactcagtttcacgcaaaggggagctgacgcctctccccgaaacaggatattggcgggtgcggctgtggaatggtgacaagtacgccgctactacaacgccattcacacctctgcacatcaaggtaaaacccaagcgcgttgggatattccttgattacgaggcagggaccctgagcttctataatgtgacggatcgtagtcacatatacacatttaccgacaccttcaccgagaagctgtggccactcttttatccaggcatcagagcgggacgcaaaaatgctgcccctctgactatccggccaccgacagattgggagtag

SEQ ID NO: 245159 - DNA, 1254 bp, Artificial Sequence
  Description of Artificial Sequence: Synthetic coding sequence
atggtggagatcgccaagcaacttcaagcggttaagcggaaaatcagagacgagagtctgtgtccgcaacaccacgaagcgctgtcactcttctgctatgaagaccaagaagccgtgtgtctaatttgtgctataagtcacacccatcgcgctcatacggtagtacccctggatgacgccacccaggaatataaggagaagctacagaagtgtcttgagcctcttgagcagaagctgcaagaaattactaggtgtaagagctccgaagagaaaaaaccaggcgagctgaagaggctggtggagtcccgtcgtcagcagatcctccgggagttcgaggagctgcaccggaggctcgatgaagaacagcaggtgctgctgagccgcctggaggaggaggagcaggacatcctccaaaggctgagggagaatgctgctcacctgggtgacaaacggcgtgatctggctcatctcgccgctgaggtggaaggcaaatgcttgcagagcggatttgagatgttaaagccggtgctgagcgccagggaggagtgcgaaaaggtcaaaaccatggaggtgactagcgtgtccatcgaacttgagaagaacttttctaattttcccagacagtacttcgccctgcgtaagatcctgaagcagctcattgcagatgtaaccctggatccggagaccgcccaccccaatctggtgctaagcgaagatcgaaagtccgtcaagtttgtcgagacgaggctgagggatctgcccgatacaccacggagatttaccttctacccttgcgttttagccactgaagggttcacctccggcaggcattattgggaggtcgaagccgcacactgcgtgttggcgcaggatcccgaaaatcaggctctggcacgtttctattgttacacggagcgcaccattgccaaaaggctggtcctgcgaagggatccatccgtgaagaggactctgtgtagaggctgctcttccctgttagtgccgggtcttacgtgcacgcagagacagcgaaggtgtcgcggacaacggtggaccgtccagacatgtttaacctgtcaaagaagccagcgctttctgaatgaccctggacacctgttgtggggagatcggccagaagcccagctaggttcacaggccgatagcaaaccactgcagccgttaccaaatactgcccacagcatttctgaccgtttgccggaggagaagatgcagactaagggaagtagcaaccaatag

SEQ ID NO: 245160 - DNA, 1236 bp, Artificial Sequence
  Description of Artificial Sequence: Synthetic coding sequence
atggctgaaacatctctgttagaggctggtgctagcgctgcgagtacagccgcagctctggaaaacctgcaagtggaagcatcatgtagcgtgtgccttgagtacctgaaggagcctgtgattattgagtgcggacataatttctgcaaggcttgcatcactcggtggtgggaggacctggaacgcgacttcccctgccccgtttgtagaaagacaagtcggtatcggtcactgcgaccaaaccgacagctgggcagcatggtcgagatcgcaaaacagctgcaggcagtgaagcggaagatccgcgacgagtccttatgtccccaacatcatgaggccctgagcttgttctgttacgaggatcaagaagcagtgtgcttaatctgcgccatttctcatacccaccgcgcacatacagtggtcccactcgacgatgcaacccaggagtataaagagaagctgcagaagtgtctcgagccattagagcaaaagttgcaggaaatcacaagatgcaagagcagtgaagagaagaagcccggagagctcaagaggctggtagaaagtcggagacaacagatcctgcgcgagttcgaggaattacaccgcaggttggatgaggagcaacaggtacttctaagcaggcttgaggaagaggaacaggatatactgcaaagactgcgggaaaacgcggctcatctgggggacaagcgcagagatcttgcacatttggccgctgaggtggagggaaagtgtctccagtcagggttcgagatgttgaaacccgtgttgagcgcgagggaagagtgtgagaaagttaaaaccatggaagtgacatctgtgtcaattgaattggaaaaaaacttctctaacttccctcgtcagtactttgccttacgcaagattctgaagcaactgatcgcagacgtgacgctggaccccgaaactgctcacccgaacctagtcctgtccgaggataggaaatccgtaaaattcgtggagacgcggttgagagacctgccagacaccccacgaagattcaccttctacccttgcgtactggcgacagaaggctttacttcagggcgacactactgggaggtggaggtaggagataaaacacattgggcagtgggagtgtgcagagactcagtgagcaggaaggggggatgtggctatgggatgggaactaacatgcagccccctccccatctcctgccactgtgtacttcgaggtag

SEQ ID NO: 245161 - DNA, 1254 bp, Artificial Sequence
  Description of Artificial Sequence: Synthetic coding sequence
atggttgagattgctaagcagctccaggcagtcaagcggaaaataagggatgagagtttatgtccgcagcaccatgaggccctgagtttgttttgttacgaggatcaagaagcagtgtgtctgatttgcgctatatcgcacacccaccgagctcacacggtggtcccactggacgatgccacccaggaatataaggaaaagctccagaagtgcttagagcctctggagcagaagctgcaggagatcacaagatgcaagagttcagaggagaaaaagcccggagagttaaagcgactggtggagtccagaagacagcagatccttcgcgaattcgaggaactgcaccgtcggctcgacgaggagcaacaggtgctactctcaaggctagaagaggaggaacaagacattctgcagcgcctacgcgagaacgctgctcatctgggggacaaacgtagagatcttgcccaccttgccgctgaagtagaaggaaaatgtctgcaatctggtttcgaaatgctgaagccggtactgagtgccagagaggagtgcgagaaggtgaagactatggaggtgacctccgtgagtatcgagctggaaaaaaatttttctaattttccacgtcagtactttgctctgcggaaaatcttaaaacagctgattgccgatgtgaccctggaccccgagacagcccatcctaacctggtgttgtcagaggatagaaagagtgtcaaatttgtcgagacaaggctgagggacctgccggacacgcctcggcgtttcaccttttacccatgcgtgctggccacagaaggatttacgagcgggcgtcactactgggaggtcgaggccgctcactgtgtcctagcccaggaccccgagaatcaagcacttgctaggttttactgttacacagagcggacgatagcaaagaggttagtactgaggagagacccatcagtgaaacgtactctatgccgcggttgtagtagcctgctggtccctggactcacctgtacacagcgccaaaggcggtgtaggggccagaggtggactgttcaaacctgcctcacctgccagagatctcagcgctttctgaacgatccgggtcacctgttgtggggggaccggccagaggcccagttaggctctcaggccgacagtaaacccctccagcctctgcctaacaccgcccattcaatatcagataggcttcccgaggagaagatgcagactcagggcagttcaaaccagtag

SEQ ID NO: 245162 - DNA, 1557 bp, Artificial Sequence
  Description of Artificial Sequence: Synthetic coding sequence
atggctgaaacctccttattggaagccggtgcttctgctgcctccacagccgctgcactcgagaacctgcaggtcgaagccagttgttcagtatgcctggagtatcttaaggaacctgtgatcattgaatgcggccacaacttctgcaaagcatgcattaccagatggtgggaggacctggagcgggatttcccatgccccgtgtgccggaaaaccagccgctaccggagtcttagacctaaccgccagctcgggagcatggtggagatagccaaacagctgcaggcagtgaagcgcaaaattcgagatgagagcctgtgcccccagcatcacgaagcgctcagtcttttctgttacgaagaccaagaagccgtgtgcctgatctgtgcaatttctcacactcaccgggctcacaccgtagtgcccctcgatgacgccacacaggagtacaaggagaaacttcagaagtgccttgaacccctggagcagaagctacaggaaatcactaggtgcaaatccagcgaggagaagaagcctggggagttaaaaagattagtggagagcagaaggcagcagatcctcagggaatttgaggagctgcataggcggcttgacgaagagcagcaggtgctgctgtctcgcctcgaagaagaggagcaggacatactgcagagactcagggaaaacgctgctcaccttggcgacaagcgcagggatctggctcacctagccgctgaggtggagggaaagtgcctgcaatcaggctttgagatgctcaaagacgtcaaatcaacactagagaagaatatccctcgaaagttcggtggatctctgtccacgatatgccctagagaccacaaggcccttttgggtttagttaaggaaatcaataggtgcgaaaaggtgaaaacgatggaggtcacatccgtgtctattgaactggagaagaacttcagcaattttcctcgtcagtactttgccctgaggaaaattctgaagcaactgatagcggacgtcactctggaccctgaaaccgcgcaccccaacctcgtcctcagcgaagatagaaagagcgtgaagtttgtggagacgaggttaagagaccttcctgacacccctagaagattcacgttttatccctgtgtcctcgccacagagggtttcacttctgggagacactattgggaagtcgaggtgggggacaagacccactgggctgtcggggtgtgtagagattctgtgtctagaaagggggagctcacccccttacccgagactggttactggcgggtgcgactgtggaacggggacaagtatgctgcaaccactaccccttttacacccctgcacatcaaagttaagccaaagcgggtgggcattttcttggactacgaggccggaactctttctttctacaatgtgacagaccgcagccacatttacaccttcacggatacgttcacagagaagttgtggccgcttttctatcctgggattcgggcagggagaaaaaacgctgcacccctgacaatccgtccacccaccgactgggagtag

SEQ ID NO: 245163 - DNA, 1557 bp, Artificial Sequence
  Description of Artificial Sequence: Synthetic coding sequence
atggcagaaacaagtcttctcgaggccggagcctccgcagccagcaccgccgcagccctcgaaaacttgcaagtcgaggcatcctgcagcgtatgtctcgagtacctcaaggagcctgtcatcatcgagtgtggccacaacttctgtaaagcatgcatcacgaggtggtgggaggacctcgagcgtgactttccttgccccgtgtgcaggaagacgtcccgctataggagcctgaggccaaatagacagctgggcagtatggtagaaattgcaaaacaactgcaagctgtgaagagaaagattcgggacgagagtttgtgcccacagcatcatgaagctctatcattgttttgctacgaggatcaggaggccgtatgcctcatctgcgcaatcagccatacgcacagagcccacactgtcgtgcccctggacgacgccacacaagagtacaaggagaagcttcagaagtgtctcgagcccctggaacagaagctgcaagaaattacaaggtgtaaaagcagtgaggaaaaaaaaccaggggagctgaaacgactggtagagtcaagacggcaacagatcctccgcgagttcgaggaactgcaccgcagactggatgaggagcagcaggttttgctgtctagacttgaggaagaagaacaggacattctgcaaaggctgagagaaaatgcagcccatctgggcgataaacgcagggatcttgcccatctcgccgctgaagtggagggaaaatgcttacagtcaggcttcgagatgctgaaggacgtcaagtctaccctcgagaaaaatattcccaggaagttcgggggtagcttgtctacaatttgcccacgggaccacaaagctctgctgggcctagtgaaggaaataaatcggtgcgagaaagtgaaaacaatggaggtgacgagcgtatcaatcgagttagagaagaattttagtaacttcccccgacagtattttgctctgaggaagatactgaagcagctgatcgcagacgtgacattagatccagaaacagctcaccccaacctagtgttatccgaggacagaaaaagcgttaagttcgttgaaacccgcctgagagacctgccagatacccccagaaggttcaccttttacccctgtgtgctggcaacagagggatttacttctggaaggcattattgggaggttgaggtgggagacaagacacactgggccgttggagtatgccgagattctgttagcaggaagggcgaactgacacccttaccggagacgggatactggcgggtcagactgtggaacggagacaaatatgctgcaactaccaccccgttcactccattgcatatcaaagtcaagcccaagcgcgtggggattttcctcgactacgaggctgggacacttagcttctacaatgtcacagatcggagtcacatctacaccttcaccgacaccttcacagaaaaactctggccactgttctacccaggaatcagggctggcaggaagaatgccgctcctctaactataaggccgcctaccgattgggagtag

SEQ ID NO: 245164 - DNA, 1467 bp, Artificial Sequence
  Description of Artificial Sequence: Synthetic coding sequence
atggccgaaacatcactccttgaagcaggggctagtgcagcaagcaccgctgcggctttggaaaacttgcaagtggaggcaagttgcagtgtgtgcttagaatacctgaaggaacctgtgatcatcgaatgtggtcataacttttgcaaggcctgcatcacacggtggtgggaagatctggagagagatttcccttgccctgtctgccgaaagacttctcggtaccggtctctgagacctaatcgtcagctgggctccatggtggagatcgctaaacagctgcaggcggttaagcgaaagatccgagatgagtcactgtgcccacagcaccacgaagccttatcgctcttttgctatgaggatcaagaggcagtttgcctcatctgcgccatatctcatacccatcgggctcacaccgtggtgcccctggatgatgccacacaggagtacaaggagaaactgcagaagtgtctggagcccctggaacagaaactccaggagatcactcggtgcaagagtagtgaggagaagaaacccggagaattaaagcgcttagtcgaatcccggaggcaacagatcctccgagaattcgaagagctgcatcggcgactggatgaagaacagcaggtgcttctcagtcgtcttgaagaggaggaacaagacatcctgcagcgactgcgagagaatgcagcacatctgggcgataagagacgggacctggcacatttggccgctgaggtcgagggcaagtgtttacagtcaggcttcgagatgctgaagccggtgttatcagcacgcgaagaatgcgagaaggtcaagactatggaggtaacttcggtgagtatagagctggagaagaacttttcgaacttcccccgtcagtattttgctttgagaaagatcttgaaacaattgatcgccgacgtaaccctggaccccgagacagcccaccctaatctcgttctaagtgaggaccggaagagcgtcaaattcgtggaaaccagattgcgtgacctccccgacacccccagacggttcactttttacccatgcgtgctggccacagaaggttttacttccggccgtcactactgggaagtggaggtcggcgataaaactcattgggctgtgggagtttgcagggactctgtgtccagaaagggcgagctcacaccgttgccagagacagggtactggcgggtcaggctctggaatggcgataaatatgccgctacaaccaccccattcacccctctgcacatcaaagtgaagcctaagagagtcggcatttttttagattatgaggctggcaccctaagtttttataacgtgactgatcggtcacatatctacaccttcactgacacatttactgaaaagttgtggcctctcttctacccagggattagggccggaaggaaaaatgccgcaccactgacaattcgacccccaactgattgggagtag

SEQ ID NO: 245165 - DNA, 1467 bp, Artificial Sequence
  Description of Artificial Sequence: Synthetic coding sequence
atggccgaaacgagtctgctagaggccggtgccagcgccgcttcaacagccgctgcgctcgagaatctgcaggtcgaggcctcatgcagcgtgtgtctcgaatacttaaaggaaccggtcatcatcgagtgcggacacaatttttgcaaggcttgcattactagatggtgggaggacctcgaacgagactttccatgcccagtctgtcgaaagacaagtcggtatagatccctccggcctaatcgacagttgggaagcatggtggagattgcgaaacagctgcaggccgtgaagagaaaaattagggacgagagcctgtgcccccagcaccatgaggccctctcactcttctgttacgaggaccaagaagccgtgtgtctcatttgtgcgattagccatacacatcgagctcacacggtggtgcccctggacgacgcaactcaagaatacaaggaaaaactgcaaaagtgtcttgagcccctggagcagaagctccaggagatcactcggtgcaagtcttccgaggagaagaagcccggagagctcaagagactggtggagtcaaggaggcagcagattctgagagagttcgaagaactgcatcggagactagacgaagagcagcaggttctgctctctcggctggaagaagaggagcaggacattctccagcgcttaagggagaatgctgctcacctgggcgataaacgcagggatctggcccatttggcagccgaagttgaaggaaaatgtctccaaagtggattcgagatgcttaagcccgtgttaagcgccagagaggaatgtgagaaagtcaagactatggaggtgacaagtgtctcaatcgaactggagaagaacttttccaatttccctaggcagtatttcgcattgagaaagatcctgaagcagctgatcgctgacgtgacactggatccagagacagcacatcccaatctcgtgttgtcagaggatagaaagagcgtgaaattcgttgagaccagactgcgggacctgcccgataccccgcgacgctttaccttctacccctgtgtgctggctacagagggattcaccagcggtcgacattactgggaggtggaagtcggggataaaacacactgggccgttggtgtttgtcgggatagtgtcagtaggaagggagagctgacacccttacccgaaacaggctattggcgggttcggctatggaatggcgacaaatatgctgccacgacaaccccatttacacctctccatatcaaagtcaagcccaaaagggtgggaattttcctggattacgaggccggaacactctccttttataacgttaccgacaggtcacatatctacaccttcacagacacctttacggaaaagctgtggcccctcttctaccccggtatccgggcaggacggaagaatgccgcaccgctgacgatacgcccacctactgattgggaatag

SEQ ID NO: 245166 - DNA, 1254 bp, Artificial Sequence
  Description of Artificial Sequence: Synthetic coding sequence
atggtggagatcgccaaacagctgcaagctgtgaaacgcaaaatccgggacgaatcactgtgtccccaacaccacgaggcactatcgctcttttgctacgaggatcaagaagccgtgtgtctgatctgcgctatctcccacacccacagggcccataccgtggtgcctctcgacgatgccacccaggaatataaggaaaaactgcagaaatgtctggaaccactggagcagaagctacaggagatcactcgatgcaaatcaagcgaagagaagaaacccggagaattgaaacgcttagtggaatcacggaggcaacagattctccgggaatttgaagagctacaccggagactggatgaggagcaacaggtgcttctgtctcgcctcgaggaagaggagcaggacatactgcagcgcctacgggaaaacgcagcacatctcggcgataagcgaagagatctcgcccacttggctgcagaggttgagggcaaatgcctccagtcggggttcgagatgctcaagcctgttctgagcgccagagaggagtgtgagaaggtgaagactatggaggtgacctccgtctctatagaattagaaaaaaatttcagtaattttccaaggcaatacttcgctctccgcaaaattcttaagcaattgatagcggacgtgaccctggaccccgaaactgctcatcctaacctggtgctgagcgaagacaggaagagcgtgaaatttgtggaaacacggcttagagacctacccgatacgccaagaaggtttaccttctacccttgcgttctagctacagagggctttacgagtggcaggcattactgggaggtcgaagcagctcattgtgtgctcgcccaagacccggaaaaccaggccctggcaagattttactgttataccgaacgcaccatagctaaaaggttagtgctccgtcgcgacccgtccgtcaaaaggaccctctgtagaggctgctcctccctgctagtccccggattgacttgcactcagcggcaacgcagatgccgaggtcagcggtggactgtacaaacatgcctgacttgtcagcgcagtcagaggtttttgaacgacccaggacaccttctttggggagatcggcctgaagctcagctcgggtctcaggccgattcaaagcccctgcagcctcttccgaataccgcccatagcatatctgaccgactgccagaagagaaaatgcagacacagggctcttcaaatcagtag

SEQ ID NO: 245167 - DNA, 1893 bp, Artificial Sequence
  Description of Artificial Sequence: Synthetic coding sequence
atggccgcagtggctatgacccccaacccagtccagacactgcaggaagaggccgtttgtgctatttgcctggactatttcaccgatcctgtgtctatcgggtgcggacacaatttctgccgcgtctgcgtaactcagctgtgggggggtgaagacgaagaggatcgagacgagcttgaccgcgaagaagaggaggaagacggcgaagaggaggaggtggaagccgtgggggcaggcgcaggctgggacactccgatgagagacgaagactatgaaggcgacatggaggaagaggtggaggaggaagaggagggcgttttctggactagcggtatgagccgaagcagctgggataatatggactacgtttgggaggaggaggacgaagaggaagatctggattactacctgggtgacatggaagaggaagatctgcgcggagaggatgaggaagatgaggaggaggtgctcgaggaggtggaggaggaagatttggatccggtgacaccattgccacctccaccagctcctcgcaggtgttttacttgtcctcagtgccggaaaagcttcccaaggcggtcgttcagacctaacctccagcttgccaacatggtccaagttattcgccaaatgcaccccactccaggtcggggttctagagtaaccgatcagggcatttgtccaaagcaccaagaggcattaaagctcttttgcgaggtcgacgaggaggctatatgcgtcgtgtgtagggagtcaaggagtcacaagcagcattccgttgttccccttgaagaagtggtccaggaatacaaagcaaaacttcaaggccacgtagagcccctgcggaaacatctcgaggcagtacagaagatgaaggccaaggaggaacgaagggtcaccgaactgaaatcgcagatgaagtcggaattagcagccgtggcaagcgagttcggacgcctgacacgcttcctcgcggaggaacaggctggcttggaacgacgcctgagggaaatgcacgaagcccagcttggtagggccggtgcagcagcttccaggttggcagaacaggccgcacagctgtccagactcttagccgaggcgcaggagcggtcccaacaaggagggctgaggctcctccaggatattaaggagacattcaaccgatgcgaggaggtgcaactccagcccccagaggtttggtccccagacccatgtcaaccccatagtcatgacttcctcactgacgcgattgtgcgaaagatgtctcgtatgttctgccaggcggcacgtgtggacctgaccctggatccagacacagcccatccagcgcttatgctctctcccgaccgacggggtgtgaggctagccgaacgcagacaagaggtcgcagaccaccccaagaggttcagcgctgattgctgcgtcctaggggctcagggtttcagaagcggtcggcattattgggaggtggaggttggcggtaggaggggctgggccgtgggtgcagccagagaaagtacacatcacaaggagaaggtgggcccaggtggcagctctgttggatctggggacgcctcgtcgagtcggcaccaccaccgaaggaggcggctgcacttgccacaacagcccttgctgcagagagaagtatggtgtgtcggaaccaatggaaagagataccaggcacagtcctccactgaacagaccttgctgtcgccttctgagaaacctaggagatttggcgtgtatcttgattatgaagcaggtaggctcggattttataatgcagagacactggcccatgtccatacattcagcgccgcattcctcggcgagagagtgtttcctttcttccgagtgttatctaagggaactcgaattaaactctgcccctag

SEQ ID NO: 245168 - DNA, 1557 bp, Artificial Sequence
  Description of Artificial Sequence: Synthetic coding sequence
atggctgcagttgctatgaccccaaaccctgtccagacgctgcaagaagaagccgtatgtgcaatctgtcttgactattttaccgaccctgtgtcaattggttgcggccataacttttgtagagtttgcgttacacagctgtggggcggagaggatgaggaggacagagatgagctagaccgggaggaggaggaggaggatggcgaggaggaggaagtggaggcagttggtgcaggtgccggatgggacactcctatgcgggatgaggactatgagggtgatatggaggaagaagtggaggaggaggaagagggtgtcttttggacaagtggcatgtctagatctagttgggacaatatggattatgtttgggaagaagaggatgaggaagaggatctggactactacttgggagacatggaggaagaagacttacggggagaggatgaagaggacgaggaagaagtcttggaggaagtagaagaggaggacctggaccctgtcacgccgctgcctccccctcccgctccccgtcgatgttttacttgcccacagtgtcgaaagtctttcccacgcaggtcattccggcctaacttgcagctggccaacatggtacaagttatcaggcagatgcatcccacgcctggtaggggttcgcgcgttacagatcagggaatttgtcccaaacaccaggaggctctgaagttattttgcgaagttgacgaggaggctatttgcgtcgtgtgtcgcgagagtcggagccataaacagcattctgtggttcctcttgaggaggtggtacaagagtacaaggccaagcttcagggacacgtggaacccctccgcaagcatctcgaggccgtccagaaaatgaaggctaaggaggaacgacgtgtcaccgagttgaaaagccagatgaagtctgagcttgctgcagtggcttccgaatttggtcggctgacacgcttcttggccgaggagcaggccggactggagcgaaggctgagggagatgcatgaagcacagcttggaagggcaggcgcagccgcttcccggctggcggagcaagcagctcaattgagtcggctcctcgctgaggcgcaggagagatcccagcagggtggtctcaggctgttgcaagacattaaagagacattcaacaggtgcgaagaagtccagctccagcccccagaagtctggtctcccgacccgtgccagcctcactcgcacgacttcctgaccgacgctatcgtgagaaagatgtcccgcatgttttgccaagcagccagagtagatcttacgctggatccagacactgcacacccagctctgatgctaagcccagatagacgtggcgtgcggttggcagaacggaggcaagaggttgccgatcaccccaaaagattctctgccgactgctgtgtcctgggcgcacagggattcaggtcaggcaggcattattgggaagaaccaaaagagccttcttggccccctgcacagcccagcttgacctattacgtttgcccaactgaccgtcccgagtttagctttacatag

SEQ ID NO: 245169 - DNA, 453 bp, Artificial Sequence
  Description of Artificial Sequence: Synthetic coding sequence
ctgcaggaagaggcagtttgcgccatatgcttagattattttacagaccccgtgtctatcggctgtggccacaatttttgccgtgtctgcgtaacccagctctgggggagacgcggtggagggagcggaggataccccgtgactccacttccaccacccccagctccccgacgttgcttcacttgtcctcagtgcagaaaatcattcccacgcaggtcatttaggcctaatctccagctggctaacatggtccaagttattaggcaaatgcatcctacccctgggcgtggtagcagagttactgatcagggaatctgccctaaacaccaggaggcccttaagttgttttgtgaggtagacgaagaggccatctgcgtggtgtgccgggagtcccggagccataaacagcacagcgtggtgcccttagaagaggttgtgcaagaatataaatag

SEQ ID NO: 245170 - DNA, 948 bp, Artificial Sequence
  Description of Artificial Sequence: Synthetic coding sequence
atgaaggccaaggaggaaagacgggttaccgaactgaagagccagatgaagagcgagctggctgctgttgcatccgagtttggcagactgacacgtttcctagccgaggagcaagccggactcgagcgcagactacgagagatgcatgaggcccaactggggcgtgccggagccgcagcttcacgactggccgagcaagctgcccagctcagcaggctcctggccgaggcgcaggaaagatcacagcaagggggacttcgccttctgcaacaggatattaaagagacgtttaatcgctacgccatcgtgcgaaagatgtcccgaatgttttgccaggccgctagggtcgatttaactctcgaccctgacaccgctcaccctgctctgatgctgtctccagatcggaggggagtgagactggccgagcggaggcaggaggtcgcggaccaccctaaacggttctccgcagattgctgtgttctcggcgctcagggtttcaggtctggaagacattattgggaggtggaggtcggaggacgcagagggtgggcagtgggagccgctagagagtcaacacaccataaggagaaagtgggacccggaggatccagtgtaggatcaggagatgctagttcatctaggcatcatcataggcgccgacggttgcacttaccacagcaacctttattgcagcgggaggtgtggtgcgtaggaaccaatggcaaacggtatcaagcgcagagctccacagaacagacactgctgagccccagcgaaaaaccacgcaggttcggcgtatacctcgattatgaggccggtaggcttgggttctacaatgcagaaaccctggcacacgttcacaccttcagtgctgcatttttgggtgagcgtgtctttcctttctttcgtgtgctgtcaaagggtacccggattaagctgtgcccctag

SEQ ID NO: 245171 - DNA, 1035 bp, Artificial Sequence
  Description of Artificial Sequence: Synthetic coding sequence
atggcctcaggggtgggagcagccttcgaagagttacctcacgacggtacgtgtgacgaatgcgagcctgacgaggccccaggcgctgaggaggtgtgcagagaatgtgggttctgctattgcaggcgacacgccgaggcccatcggcaaaagttcctttctcaccacttggccgagtacgtgcacggctcgcaagcctggaccccacctgccgatggtgagggtgctggcaaagaggaggcggaggtaaaagtggagcaggagcgggagattgagtccgaagcaggagaggaatcggagtccgaagaggagagcgagtctgaggaggagtcagagacagaagaggagtcagaagacgagagtgatgaggaatcagaagaggattccgaagaggagatggaggatgaacaggaaagtgaggcagaagaggacaaccaggaggaaggagaatctgaagccgagggtgaaacagaagccgagagtgaatttgacccagagattgagatggaggcggaacgggtcgccaagcggaagtgccctgaccacggacttgatttatcgacttattgccaagaggatcgacaactaatttgtgttctgtgcccggtgatcggcgcacatcagggacatcagctgtcgacactcgatgaagcattcgaagagctccgcagcaaggattcgggcggactgaaggccgctatgatagaactcgtggagagactcaaattcaagagctccgacccaaaagtgacaagagatcagatgaaaatgtttatccagcaggaatttaaaaaggtccaaaaggttatcgcggacgaggagcagaaagcccttcatctcgtggacatccaggaggcaatggccactgcgcatgttaccgaaatcttggctgatattcagtcgcacatggacagactgatgactcaaatggcccaggccaaggagcagttagacacgagtaacgaatcagcagaacccaaggctgagggagatgaggaggggcctagtggcgcatccgaggaggaagacacatag

SEQ ID NO: 245172 - DNA, 1743 bp, Artificial Sequence
  Description of Artificial Sequence: Synthetic coding sequence
atgtccgagaatagaaaacccctgctgggattcgtttcaaagcttacctccggcaccgccctcggtaactccggcaagacacattgtccactttgtctcgggctttttaaagcacccaggctgctcccgtgtttacatacagtgtgtacaacgtgcctcgaacagttagaaccatttagcgtggtggatattagggggggtgactcagatacctctagcgagggttccatattccaagaattgaagccaaggtcactgcagtcccagatcggtattctgtgccccgtttgcgatgctcaggtggatctgccaatggggggagtcaaggctctgaccatagaccacctcgctgtgaacgatgtgatgcttgaaagcctgcgcggagaaggccaaggtctcgtatgtgacctatgcaatgaccgcgaggtggaaaagcgctgtcaaacttgtaaggccaacctctgccatttttgttgccaggcccaccggaggcaaaaaaaaaccacttaccacactatggtggaccttaaagacctcaagggttattcccggattggcaagcccatcctctgccctgtccaccccgcagaagagctgcggttgttttgcgaattctgtgacaggcccgtgtgccaggactgtgttgtcggagaacaccgcgagcacccttgcgacttcactagtaacgtgatccacaagcacggagatagtgtttgggagctgctaaaaggaacacaaccacatgtcgaagccttagaagaggccctagcacagatccacatcattaatagcgctctgcagaaaagagtagaggcagtggccgctgatgtgcgcaccttttctgaggggtacattaaggcaatcgaggagcaccgggataaactactgaagcagcttgaggatatcagagcccagaaggaaaactccctccagctgcagaaagcacagctagagcagctgttggccgacatgcgcacaggcgtggagtttacagagcaccttctgactagcggttcggaccttgaaattctgataacaaagcgggttgtggtagagcgactgcgcaagcttaataaggtgcagtacagcacacgaccaggggtgaacgacaagatccgcttctgtccgcaagagaaagccggacaatgcaggggttacgaaatctatggcaccataaatactaaagaagtggatcccgcaaagtgtgtcctccaaggggaggacctacacagagccagagagaagcaaactgctagttttacacttctatgtaaggacgctgctggtgagataatgggacgaggaggggacaatgttcaggtagccgttgtgcctaaagacaagaaggactcacctgtaaggaccatggtccaagacaacaaggatggcacctattacattagctatacaccaaaggagccaggcgtttacactgtgtgggtttgtatcaaggagcagcacgttcaaggcagcccgttcacagtgatggtgagacggaaacatcgacctcattcaggcgtttttcattgctgcaccttctgctcctcaggcggacagaaaactgcaagatgcgcctgcggcggaacaatgcctgggggttaccttggctgcggccacgggcacaagggccatcctgggcatccccattggtcttgttgtggaaaatttaacgaaaagtccgaatgcacctggacaggaggacagtctgctcctagatcgttgctccgaactgtcgctttgtag

SEQ ID NO: 245173 - DNA, 1572 bp, Artificial Sequence
  Description of Artificial Sequence: Synthetic coding sequence
atgctctctggcgtcacactggagggaggaggagccagaagcggtgagggtcggagatcccgcaccgagctcaagcctcgcagcctccagagtcagattggaattttatgccccgtgtgtgacgctcaggtcgatcttccaatgggcggagtgaaggccctgaccatcgatcacctcgccgttaatgacgtcatgctggaatcactgcgaggtgaggggcagggactggtctgtgatctgtgtaatgaccgcgaagtcgagaagcgttgccagacttgcaaggccaacctgtgtcacttttgttgccaggcccacaggaggcagaagaaaactacatatcacaccatggtggaccttaaggacttgaaaggatactccagaataggtaaacccatcctctgtccggtgcatcccgcagaagagctccggctattctgtgagttctgtgatcgcccagtgtgccaggactgcgtggtaggggagcatcgagagcatccttgcgacttcacttcaaacgtgattcataagcacggggatagcgtgtgggaattgctcaaagggactcagcctcacgttgaagctttggaagaggcgcttgctcagatacacattatcaacagcgctctacaaaagagggtagaggctgttgccgctgatgtgcgaaccttctctgagggttatataaaagcgatcgaggagcacagggataagctgctcaagcagctggaggacatcagggcccaaaaggaaaactcacttcagctgcagaaagcccaactggaacagttgctggccgatatgagaacaggtgtagagtttaccgagcacctccttacttcgggctccgacctcgaaatcctcattactaaacgcgtggtcgttgagaggctccgcaaattgaataaggttcaatactccactcgccctggagtgaatgacaagattcgattctgtcctcaggagaaagcaggtcagtgccgcggatatgagatttatggcaccatcaacaccaaggaagtagaccccgctaagtgcgtgcttcagggtgaagacttacatagagccagggagaaacaaacagcaagcttcaccttattatgtaaggacgcggcaggagagatcatgggccgagggggagataacgttcaggtggccgtggtgcccaaagacaaaaaggattcaccggtgcgcacaatggttcaagataacaaggatgggacttattacatctcatacacaccgaaagagccaggggtgtacaccgtttgggtctgcattaaagagcaacatgtgcaggggtcgccctttaccgtgatggtccggagaaagcacaggccacacagcggagtcttccactgctgcaccttctgttcctccggcggacaaaagaccgcgagatgcgcttgcggtggtacaatgcctggaggctacctgggctgcggtcacgggcataaaggccaccctggccatccacattggtcatgctgcggaaagttcaatgaaaaatccgaatgtacatggactgggggacagagcgcacccagatcgctgcttagaactgtggccctctag

SEQ ID NO: 245174 - DNA, 1689 bp, Artificial Sequence
  Description of Artificial Sequence: Synthetic coding sequence
atgtcagaaaaccgaaagcctctcctcggattcgtttcaaagctgaccagcggaacagcactgggcaatagtggcaagacacactgtcctttgtgtctgggcctttttaaggctccaagactcctgccttgcttacataccgtttgcaccacttgcctggagcagctggaaccattcagcgtggtggacatccgcggaggagatagtgatactagcagcgagggctcaatcttccaggaactgaaacccaggtcacttcaatcccagattggcatcctgtgccccgtgtgtgatgcacaagtggatctgccaatgggtggggtgaaggcattaacgatcgatcatctggcggtcaacgacgtgatgctggagtcactccggggtgagggccaggggctggtgtgcgacttatgcaatgacagggaagtggaaaaacgctgccagacatgtaaggctaacttgtgccacttttgttgtcaggcccaccgaagacagaagaagacgacctatcacactatggttgacctgaaggatctgaagggttactccaggatcggcaaacccattctgtgtcccgtgcacccagccgaggagctccgcttgttttgcgagttctgtgatcggccagtctgccaagactgcgttgttggcgaacacagagagcatccgtgcgacttcacatcgaatgtgatacacaaacatggcgacagcgtgtgggagcttttgaagggaacgcagccacacgtggaggctttggaggaagctctggcccaaattcacatcatcaacagcgctctgcagaaaagagtcgaggcagttgcagcagacgtccgtaccttcagcgaaggctacatcaaagctattgaggaacaccgtgacaaactcctcaagcagctggaggacatccgcgctcaaaaggagaattccttacagcttcagaaggcccagctggaacaattattggccgacatgcggacaggcgttgagtttaccgaacacctgctgaccagtggttctgatctggagatattaattaccaaacgcgtggttgtagagcggctcagaaaactgaataaagtccagtatagcactcgcccaggggtgaacgacaaaattcggttctgccctcaggagaaagctggacagtgccggggttacgagatttatgatcttcatagagcacgcgaaaaacagaccgctagtttcacgttgctgtgtaaagatgcagcaggggaaatcatgggtcggggtggtgacaatgtgcaagttgccgtggtccccaaagataagaaagactcccctgttcggactatggtccaagacaataaagacggcacctactacatctcatataccccaaaggagcccggagtgtacacagtttgggtgtgtattaaagaacagcatgtgcaggggagccccttcactgttatggtcagaaggaagcaccggcctcatagcggcgtcttccactgctgtaccttctgcagttccggaggccagaagaccgcgcgatgcgcatgtggcggtacgatgcccggagggtatcttggctgcggccacggccataaaggtcatcctggacacccacactggtcctgctgcggaaagttcaatgagaaatccgagtgtacttggactggtggtcagtccgctccccgttcactgctcaggactgtagccctctag

SEQ ID NO: 245175 - DNA, 1917 bp, Artificial Sequence
  Description of Artificial Sequence: Synthetic coding sequence
atggacggcagcggtccttttagttgccccatctgtctcgagccacttcgagagcctgtgactctcccatgcggccataacttttgtctcgcctgcctgggcgcactgtggccccataggggggcttctggtgccggagggcctgggggtgcagcccgttgtccgctttgtcaggaacctttccctgatggcttgcagctgaggaaaaatcacacattgtccgaactcctgcaacttcggcaggggtcgggccctgggtctggtcccggtcccgcaccagccctcgcgcctgagccctccgcaccaagcgctctaccaagcgtgcccgagccttcagctccctgcgctcccgagccatggcccgctggagaagaacccgtgcgctgtgatgcctgccctgagggcgcagccctcccagctgccctgtcttgtctgtcctgtctggcctccttctgcccagctcatctgggccctcacgaacgaagtcctgctctccgcggacaccggttggtgccgcctttgcgccgactggaggaaagtctgtgtcccaggcacctgcgtcctttggaacggtattgcagagcagagcgagtctgtctgtgtgaggcatgcgccgctcaagagcatagaggtcacgaacttgtcccactagagcaggagagggctttgcaggaagccgagcagtcgaaggtgttgtccgccgttgaagatcgaatggatgagttgggagctgggatagcacagtcacggagaaccgtagccttgataaagtcagctgccgttgcggagcgagagcgtgttagtcgcctattcgcagatgccgctgcggcattgcagggcttccaaacgcaggtccttggttttattgaggagggagaggctgcgatgcttgggagatctcagggtgacttgaggaggcaggaagaacagaggtctagactgtcgagagccaggcagaacttgtcccaagtgccagaggccgactctgtgtcatttctccaggagctccttgctttgcgactagcccttgaggacggctgcggcccagggcctgggcctcccagggaactgtcctttacaaagtcctcccaggctgtgagggccgtgagagacatgttggccgtcgcctgtgtgaaccagtgggagcagctgcgtggtccgggaggtaacgaagatggcccacagaagctcgactcggaggccgacgctgaacctcaggacctggagtctaccaacctcctggagtcagaagcccctcgagattactttctgaagttcgcttatatcgttgacctcgacagcgataccgctgacaagttcctgcaattgttcggaactaaaggcgtgaagagggtcctttgccccatcaattacccactttcgccaacccgttttactcactgcgagcaggtgttgggggagggcgcacttgaccgtggtacctactactgggaggttgagattatcgaaggctgggtctccatgggcgtaatggcagaggatttttcccctcaagaaccatatgacagaggacgtctggggaggaatgcgcactcatgttgtctgcaatggaacggtagaagtttttcggtgtggttccacgggctcgaggctcctcttccccaccctttttctccaactgtcggagtctgcctggagtatgcggatcgtgccctggccttttacgccgtgcgggacggaaagatgtcactgctgcggagactgaaggcttctagaccgaggcgcggagggattccagcttctccaatagacccttttcagagcagactggattcacacttcgccggactgtttacacacaggctgaagccagctttctttcttgagtctgtagatgcccatttgcagatagggcctctgaaaaaaagctgtatttcagtccttaagagacgctag

SEQ ID NO: 245176 - DNA, 1482 bp, Artificial Sequence
  Description of Artificial Sequence: Synthetic coding sequence
atggcctctggcatcctggttaatgtaaaagaagaggtgacctgcccaatttgcctggagctcctgacacagccactatccctggattgtggacatagtttctgccaggcttgcttaaccgccaatcataagaaatcaatgctggacaaaggcgaaagttcctgccctgtgtgccgcatcagctatcagcctgagaatataaggcccaaccggcatgtcgccaacatcgtggaaaagctgagggaagtgaagcttagtcctgagggacaaaaggtggatcactgtgcaaggcacggcgaaaaattgctgctgttctgccaagaagatggcaaggtgatctgttggctatgcgagcgaagtcaagagcaccgcggacaccacaccttcctgactgaggaagtcgcacgagaataccaagtcaagttgcaggcagccctcgaaatgctacggcaaaaacagcaggaggcggaagagctagaggctgacatccgcgaggagaaagcttcgtggaagacccaaattcagtatgataaaactaatgtactggccgatttcgaacagctgagggatattctcgactgggaagagtctaatgagctgcagaaccttgaaaaggaggaagaggatatactgaaatcgctgacaaattccgaaaccgagatggtgcagcagacacagtccctgagggagcttattagcgacttggaacaccgtctgcaaggcagcgtcatggagttgctacagaaagtgtcaggaaagatacttaggactgaaaacgtgacactcaaaaaacctgaaacgtttcccaaaaaccagcgcagggtgtttcgagcacccgacttaaaagggatgctggaagttttccgggaacttacggacgtcagaaggtattgggtagacgtgactgtcgcacccaataacatctcgtgtgcagtaatttcagaagacaagcggcaagtcagttctcccaaaccacagatcatctatggtgccagaggtactcggtaccagacatttgttaatttcaactactgcaccggaatcctcggatctcaatccatcacgagcggtaaacactattgggaggttgatgtttctaaaaagacagcatggattctcggtgtgtgcgcgggtttccagccggatgccatgtgcaacatcgaaaaaaatgaaaactaccagcctaaatatggctactgggtgattggccttgaggagggcgtaaagtgctctgccttccaggatagttccttccacacccccagcgttccgtttatcgttcctctctccgtgatcatatgtcccgaccgcgtgggggttttcctggattatgaggcatgtaccgtgtccttctttaacatcaccaatcacgggtttttgatatacaagttcagtcactgctccttctcccagcccgtgttcccatacctgaaccccaggaaatgcggagtgccaatgaccttatgctctcccagttcgtag

SEQ ID NO: 245177 - DNA, 981 bp, Artificial Sequence
  Description of Artificial Sequence: Synthetic coding sequence
atggcatcaggcatactggtgaacgtcaaggaggaagtgacatgccccatctgcctggaactgctcacccaaccattatctctcgattgcggtcactctttttgtcaagcctgtttgaccgcaaatcacaaaaaatccatgctggacaagggggagagctcatgtcccgtgtgtcggatatcctatcagcccgagaacatcagacctaaccgccatgtagccaatattgtcgaaaagctgcgggaggtgaagttgtctccagaagggcaaaaggtggatcactgcgcaagacacggtgaaaagctcctgcttttctgccaggaagatggcaaggtgatttgctggctgtgtgaaaggtctcaggaacacaggggacatcacacattcctgactgaggaggtggcacgcgaataccaagtgaaactccaggccgctctggagatgcttaggcagaaacaacaggaggccgaggaactcgaggcagacattagagaagagaaagcctcttggaagactcagatccaatacgataaaaccaacgtccttgccgatttcgagcagctgagggacatcctggactgggaagaaagtaacgagctccagaacctcgagaaggaggaggaggatatcttgaagtctctaaccaacagcgagaccgagatggtgcagcagactcagagcctgcgggagctgatatcagatctggagcaccgtctgcaagggagtgtgatggagctgttgcaaggggtggatggagtcattaagcgaaccgagaacgttactttaaagaaaccagagacattcccgaaaaatcagagacgcgtgttccgggctccagatcttaaaggcatgctggaagtgttccgagaattgactgacgtgcggagatattggggctggtccgctatggctagaagcaggtttacggccacctccacttcacaaatccaggctatcctgctgccccagccacccaaatag

SEQ ID NO: 245178 - DNA, 1482 bp, Artificial Sequence
  Description of Artificial Sequence: Synthetic coding sequence
atggccagcggcattttggtcaacgtgaaggaggaggtgacctgcccaatctgcctggagttgttaacgcagcccctgagccttgactgcggccacagtttttgtcaggcttgcctgactgccaatcataaaaaatccatgctggacaaaggcgaatcgtcctgtccagtgtgcagaattagttaccagccagagaatatccgtcctaacagacacgttgcaaacatcgtggagaaactgcgggaagtgaaactgtcccccgaaggacagaaggtcgatcactgtgcaagacacggcgagaagctgctcctgttctgccaagaggatgggaaagtgatctgttggctgtgcgagcggtcccaggaacaccgcggtcaccacacattcttgaccgaggaggtcgcacgggaatatcaggtaaagttacaggctgcccttgaaatgctcagacagaaacaacaagaggcagaggaacttgaggccgatatccgcgaggaaaaggccagttggaaaactcagattcagtatgacaagactaacgtcctggccgatttcgaacagttgcgggatattttagattgggaggagtctaatgaacttcaaaatttagagaaggaggaggaggatatcctaaaaagcctgaccaactctgagaccgagatggtacagcaaacacagagcctgcgcgaactaattagtgacctcgaacatagactccaagggagtgtgatggagctgctgcagggcgtcgatggcgtgattaaacgcacggagaacgtcaccctaaagaaacccgagactttcccaaagaatcagaggagagtcttcagagctcctgaccttaaaggaatgctggaggtgttccgcgaattgacagatgtcaggaggtactgggtggatgtcacagtggcccctaataacattagttgtgcagtcatttccgaagataagagacaggtttcaagcccaaagcctcagatcatatacggtgcgagggggacgcggtaccaaactttcgttaactttaattattgcacaggcatcctggggtcacagtccataacctctgggaagcattactgggaagttgacgtttctaaaaaaacagcgtggatactgggcgtatgcgcgggattccagcctgacgccatgtgtaatatagaaaagaacgagaactaccagccgaaatacggctactgggtaattggcctggaggaaggcgtgaaatgtagcgccttccaggatagtagcttccacactcctagcgtgccattcatcgtcccattgtctgtaattatctgcccggaccgcgtgggtgtcttcctcgattatgaggcatgcacagtgtcattttttaacatcactaatcatggatttctgatttacaaattcagccattgtagcttcagccagccagtgttcccttacctgaatcctcggaaatgtggagtccccatgaccctgtgttccccatcatcatag

SEQ ID NO: 245179 - DNA, 1044 bp, Artificial Sequence
  Description of Artificial Sequence: Synthetic coding sequence
atggcaagcggtattcttgtcaacgttaaagaagaagtcacttgccctatctgcctggaactactgacacagccactgtctctggactgcggccactccttctgtcaggcatgtcttacagccaaccacaaaaagagcatgctcgacaaaggcgagtcctcctgtcctgtgtgtcgcataagttaccagccagagaacatcaggcctaatcggcacgttgccaatattgtggagaaactgagggaagtcaaactgagccctgaagggcaaaaagtggaccactgcgcgagacacggcgagaaactgttgttgttctgccaagaggatggcaaggtcatttgctggttatgcgagaggagccaggagcacagaggtcatcacacgtttctcactgaggaggtggctagggaatatcaggtcaagctgcaagcagcattggagatgctgcggcagaagcaacaggaagccgaagagctcgaggctgacatccgggaggaaaaggcaagttggaaaacccaaatccagtatgacaaaacaaatgtcttagccgactttgagcagctgcgtgacattctggactgggaagagtcaaatgaactgcagaacttggagaaagaagaagaggatattctaaagagcttaaccaacagcgagaccgaaatggtgcagcagactcaaagtctgagagaactgatcagtgatctcgagcacaggctgcaaggctctgtcatggagcttctccagggtgtggacggggtaattaagagaactgaaaacgtgacattgaagaaaccagagaccttccccaaaaaccaacgaagagtgttccgggcaccagatctgaagggtatgctcgaagttttcagggaacttacagacgtgagaagatattgggggaaggaaaagtcccactaccacaaacctccatgcggcttaagcctcctgctgtccctctcatttcgcattttatgttctctcttagggtcatgttttaaaatctatgatagtccgagcaaaacacacattacttacccgtctctctag

SEQ ID NO: 245180 - DNA, 984 bp, Artificial Sequence
  Description of Artificial Sequence: Synthetic coding sequence
atggccagtggtatccttgtcaacgtcaaagaggaagtgacttgccccatatgcttggaactgctgacgcagcccttgtctctggattgcgggcatagtttctgccaggcatgtctgaccgccaaccacaagaagagtatgctggacaagggtgagagtagctgcccagtgtgtaggatcagctaccagcctgagaacatcaggcccaacaggcatgtggcaaatatagtggagaagcttcgtgaggtgaaacttagtcccgaagggcagaaagtggatcattgtgctcgtcatggggaaaaactccttttattctgtcaggaagatgggaaagtgatttgctggctgtgcgaaaggtctcaggagcatcgcggtcaccatacgttccttacagaggaagtggccagagagtatcaggtaaaacttcaggccgcactggaaatgttgcgccagaaacagcaagaggctgaagaactggaggcagacattagggaagagaaggcctcttggaaaactcagatccagtatgataaaaccaacgtcctggcggattttgagcagctccgtgatatcctggattgggaagagagcaacgagctgcagaacctcgagaaggaggaagaggatatacttaagtcccttactaattcagaaacagaaatggtgcagcaaactcagagcctgcgagagttgatcagtgacttagaacaccgccttcagggatctgtcatggaactgctccaagccggtgtgcagtgtctgatcctgcgcactgaaaacgttacactgaaaaagcctgaaactttccccaagaaccagcgcagggtcttccgggcaccagatctaaagggaatgctggaggtgttccgggaactcactgatgtgaggagatattggggctggagcgccatggcaaggagtaggttcaccgctacctcaacaagtcagatccaggccatcctgcttccacagccgcctaagtag

SEQ ID NO: 245181 - DNA, 981 bp, Artificial Sequence
  Description of Artificial Sequence: Synthetic coding sequence
atggcttcagggatcctggtgaatgtgaaagaggaggtgacgtgccctatttgccttgagttgctcacacaaccactgagtctggattgcgggcactccttctgtcaggcctgtttgaccgcaaaccacaaaaaatcaatgctggataaaggtgagagcagctgccccgtatgccggattagctatcagcccgaaaacataaggccgaacaggcatgtggctaatatcgttgagaagctccgtgaggtgaaactgtctccagagggacaaaaagtggaccattgtgccaggcacggcgagaagcttttgctgttctgtcaagaggatggcaaagtcatttgttggctgtgtgaaaggtcccaggagcataggggccaccacacgtttcttacggaagaagtggcaagagagtaccaggtgaagctccaggccgctcttgagatgttaaggcaaaagcagcaggaagctgaagagctggaggctgacatccgcgaggaaaaagctagttggaaaactcagatccagtacgacaaaaccaacgtgctggctgatttcgaacagttgagggacattcttgattgggaagagtcgaatgaacttcagaatttagaaaaagaagaagaggatatcctgaagtctctcacaaatagcgagacagaaatggtccagcagacacaatctctcagggagttgatttctgacctggagcataggctgcagggttcggtaatggagcttcttcagggcgtggatggagtaatcaaaaggaccgaaaacgtgacccttaagaagcctgaaaccttcccaaagaatcagcgccgagtcttcagagctccggacctcaagggaatgctggaggtgttccgagagctgaccgacgtgcgtaggtattggggctggtctgccatggctcgctcacgtttcacagcgacaagtactagccagatccaggctattctattgccccagcctccaaaatag

SEQ ID NO: 245182 - DNA, 630 bp, Artificial Sequence
  Description of Artificial Sequence: Synthetic coding sequence
atggccagtggaattcttgtgaatgtcaaagaggaagttacctgtccaatttgtctcgagctgctaacccagccgctgtcccttgactgtggacattccttctgccaggcatgccttactgcaaatcacaagaagtctatgctggacaagggagaaagctcctgcccagtatgcaggatttcctaccaacccgagaatataaggcccaatcggcatgtggccaacatcgtggagaagctgagagaagtaaagctgagcccggagggccaaaaggtcgatcattgcgccagacacggggagaagctcctgctgttttgccaggaagatggcaaggtaatctgttggctgtgtgagagatcacaggagcatcggggtcaccatacctttttgactgaggaggttgccagggaataccaagtgaagctgcaggcagcgctcgagatgctgcggcagaagcagcaggaggctgaggaacttgaagcagacattcgggaagaaaaggccagttggaaaacacagatccaatacgacaaaactaatgttttagccgactttgagcagttgcgcgacatcttggactgggaagagtctaatgaattgcagaacttggagaaagaggaggaagactag

SEQ ID NO: 245183 - DNA, 219 bp, Artificial Sequence
  Description of Artificial Sequence: Synthetic coding sequence
atggctagcggaatactcgtgaacgtaaaggaggaggttacctgtcctatctgtttggagctattgacccagcccctgtctctcgattgcggacattccttctgtcaagcatgcctgacagcgaaccacaaaaagtcgatgctcgataaaggggagagctcatgtcccgtctgtcgcatctcctatcaacccgagaacatcaggcccaaccgtcactag

SEQ ID NO: 245184 - DNA, 816 bp, Artificial Sequence
  Description of Artificial Sequence: Synthetic coding sequence
atggcttcaggcattcttgtgaatgtgaaagaagaggtgacttgccccatatgcttagaactcctaacacagcctctgtcgttggattgtggacactcattctgccaggcatgcctgacggccaatcacaaaaagtccatgctggataaaggagaatcatcatgcccagtgtgcagaatcagttatcaaccagaaaacattcgccctaaccggcacgttgctaatatcgttgaaaaactgagggaagtcaagctgtcaccagagggtcagaaagtagaccactgcgcaagacacggtgagaagctgctgctcttttgccaggaggatggcaaagttatttgctggttgtgtgagcgatctcaggagcacagaggacaccatacgtttttgactgaagaagttgcaagggagtaccaggtcaagctacaggctgcgctagagatgctcagacagaaacagcaggaggccgaagaacttgaggccgatattcgcgaagaaaaagcctcatggaagacacagatccagtatgataaaactaatgtgctggcggactttgagcagctacgggacatcctcgattgggaggaatctaacgaactgcagaacctggaaaaggaggaggaggatatcctcaagagtctaactaacagcgaaacagaaatggtccagcagactcagtcattaagggaactgatctcggacctggagcatagactccagggatccgtcatggaactactgcaggatggggagagagacctggaggaggccagaaattttagcaaaaagtcgaaggagtctgtctcttctagttag

SEQ ID NO: 245185 - DNA, 1464 bp, Artificial Sequence
  Description of Artificial Sequence: Synthetic coding sequence
atggcatggcaagtatctctcctggagttggaggactggctgcaatgccctatttgcctcgaagtctttaaagagcccctgatgctgcaatgtggccacagctactgcaagggttgtctagtgtcgctgagttgccacttggacgccgagctacggtgcccagtctgtaggcaggcggtggacggatcatcatctctgccaaacgtgtcactggctagggttatcgaagcgctacgactcccaggggatcctgaacctaaggtatgcgttcatcatcgaaatccccttagcctgttctgtgagaaggatcaggaactgatttgcggcctgtgcgggctgctggggtcccatcagcatcacccagtgacacctgtaagtaccgtttattctagaatgaaggaggaactggcggcactcatcagtgagttaaagcaggaacaaaagaaggtggatgaattgatcgcgaagctggttaacaatcggaccagaatagtcaatgaatccgatgtgttcagctgggtgatccggagagaatttcaggaactgcatcatctggtcgatgaggagaaagctaggtgcctggagggtattggcggtcacacacggggactcgtggccagtctggacatgcagctggaacaggcccaaggtacccgggaacgcctcgcccaagccgagtgcgtattggagcagtttggcaatgaggaccatcacaagttcatcagaaagttccactctatggcctcccgggcagagatgccccaggcgagacctctggagggagcattttctccaattagcttcaagcccggtctgcaccaagccgacattaaactgacagtgtggaaacggctttttagaaaggtactaccggctcccgaaccactgaaactcgacccagctaccgcccaccctctcctcgagctctccaagggtaacacagtggttcagtgcggacttttggcacagcggagggcctcccaacctgaacgctttgattacagcacctgtgtgttggcttcaaggggctttagctgcgggcgacattactgggaagtggtggttggaagtaaaagcgattggcgactgggtgtgattaaaggtaccgctagtcgtaagggaaaactaaaccgctctcctgagcacggtgtctggttgatcggtctgaaagaaggcagagtgtatgaagcctttgcttgtcctagagtccccctaccagtcgctggtcaccctcatcgaatcggattatatctacactacgagcaaggagaactgacctttttcgatgctgacaggccggacgatttaaggcctctttatacctttcaagcggatttccagggtaaactctacccaattttggatacttgttggcacgaacgaggatctaactccctacccatggtgctaccgcctccgtcggggcctggaccattatcaccagagcagccgactaaactgtag

SEQ ID NO: 245186 - DNA, 1464 bp, Artificial Sequence
  Description of Artificial Sequence: Synthetic coding sequence
atggcatggcaggtgagcctgctcgagctggaagattggcttcagtgtcccatatgtctcgaggtgttcaaagagcctctgatgttgcagtgtggccatagctattgcaagggctgtcttgtgtctctcagctgccacctcgacgccgagctgagatgtccagtgtgtaggcaggccgtggacggtagtagctccctgccaaacgtttcccttgcccgtgtcatagaagccctacgcctacccggagacccggagcctaaggtgtgcgtccaccacagaaacccgctgtccttattttgtgagaaggaccaggaactaatctgcggactttgtggcttgctcggttcacaccagcaccaccctgtgacccctgtaagcacagtttactccaggatgaaggaggaattggccgcactcattagcgagctgaaacaggagcaaaagaaggtggacgagctcatcgcgaaactggtgaacaacaggacacgcattgttaatgagtccgatgttttttcctgggtcatccgtagggaatttcaggagctgcatcacttggtggatgaagaaaaggcacgctgcctcgaaggtatcggcggacacacccgtggtctggttgcttcgctcgatatgcagctagagcaggcacaaggcacgcgagagcgtctggcgcaggctgaatgcgttctggagcaattcggaaatgaggatcaccacaagttcatccgaaaatttcactcaatggccagccgtgccgagatgccccaggctcgacccctggaaggcgcattctcacccatttcatttaagccgggtcttcatcaagccgatatcaaactgactgtgtggaagaggctgttcagaaaggtgttgcccgctcccgagcctctcaagttggaccctgccacggcgcatcccctgctcgaattatccaaagggaacacggtggtgcagtgtggcctactcgcacagaggcgcgcttcccaacccgaacgctttgattatagcacttgtgtactggcctccagagggttttcttgcggccgacactattgggaagtcgtcgttggttcaaaatccgactggcgcctcggagtgattaaggggaccgctagccggaagggcaagctgaatcgtagtcccgagcacggcgtgtggctcattgggctgaaggaagggagggtgtatgaagcatttgcttgccccagagtccccctcccggtggcgggacaccctcataggataggtctctatctccattacgagcagggtgaattgaccttctttgacgccgatcggcctgacgatctgagacctttgtacacattccaagctgacttccagggaaaactctacccaatcctagacacatgttggcacgaacgcggtagcaacagtctccccatggtgcttcccccaccatccggaccaggaccgcttagcccagaacagccgacaaagctgtag

SEQ ID NO: 245187 - DNA, 1467 bp, Artificial Sequence
  Description of Artificial Sequence: Synthetic coding sequence
atgacatctcccgtgctcgtagacattagagaggaagtcacttgtcccatctgtctcgaactcctaaccgagcccctaagtattgactgcggtcactcgttttgccaagcctgtatcaccccaaacgggcgtgagtcagtcatcggccaggagggcgaacgcagctgcccagtctgccagacgagttatcagccgggaaacttacgccctaataggcatctcgctaacatcgtgcgcaggctcagggaggtggtgctggggcctggcaagcagcttaaggccgtactttgtgctgatcatggggaaaagctccagctgttctgccaggaggacgggaaggtgatatgttggctgtgtgagaggtctcaggaacacaggggtcaccatactttcctggttgaggaggtggctcaagagtaccaagagaagtttcaggagagtcttaaaaagctcaaaaatgaggaacaggaagcggaaaagttgaccgcttttattagggaaaagaaaaccagttggaagaaccaaatggagccagagagatgcaggatccagaccgagttcaatcagctgcgaaatatcctggacagagtggagcagcgggagctcaagaaacttgagcaggaggaaaagaaggggttgaggatcatcgaggaggcagaaaatgatttggtgcaccagacacagagtctgcgggagctcatttctgatctcgagcggagatgccaggggagcacgatggagctgttgcaggacgtgtcagacgtgactgagcgctccgagttttggaccctgagaaaaccagaagctttacctacaaagctgcgtagcatgtttagagctccagaccttaagaggatgttgcgagtctgcagagagctcacagatgtccaatcttattgggtcgacgtgacgttgaatccccacaccgctaatcttaacttggtactggcaaagaatcggcgtcaggtccgctttgtgggcgctaaggtatctggaccaagctgtctcgaaaaacactacgattgctccgtgctaggaagccaacatttttcctcaggcaaacattattgggaggtggatgtagccaaaaagacggcatggatcctcggggtttgcagcaacagtctggggccaaccttttctttcaaccactttgcccaaaatcattctgcttactcgaggtaccaacctcagtcaggctactgggtgatcggcctccagcataatcatgaatatagagcctatgaagatagcagccccagcttattactgagcatgaccgttccaccaaggcgggtgggggtgtttctggactatgaagccggaacagtttctttttataacgtgacgaaccacggatttcctatatacacattttccaaatattactttcccactactttgtgcccctacttcaacccatgtaactgtgttatccccatgactctgcggcgaccttcaagttag

SEQ ID NO: 245188 - DNA, 1551 bp, Artificial Sequence
  Description of Artificial Sequence: Synthetic coding sequence
atgtgtgggtcggaaaggatcctgcaagccggaaatatactggagattcgcgtcggacaggcaggcgctcgcagggtcgcaaccatgacgtcaccagtcttggtggatattagagaagaagtgacctgtcctatatgcctcgaattgctgacagagcccctgagcattgactgcggccattctttttgtcaggcatgtatcactcccaacgggagggagagtgtgataggtcaggagggtgagaggtcatgccccgtgtgtcaaacctcataccagcccggaaacctgagacctaaccgacacctcgccaacatcgtgcgcagactaagagaagttgtgctgggacccggtaagcagctgaaggccgttctctgtgcagaccacggagagaaactccagctgttctgtcaagaggatgggaaggttatatgctggctctgtgaaaggtcacaggaacaccggggacaccacacattcctcgttgaagaagtggcacaggaatatcaggagaagtttcaggagtccctgaagaagctgaaaaatgaggagcaggaggccgaaaagctgactgcctttataagggaaaaaaaaaccagttggaaaaaccaaatggaacccgagcgctgtcgcattcagacagagttcaaccaactccggaatattctggatcgggtcgagcaacgggaacttaagaagctcgaacaggaggaaaaaaaggggctccggatcattgaagaagcagaaaatgatcttgtgcaccagacacagtccctgagggaactaatatccgacctggaaaggcgctgccagggctctactatggaacttctacaggatgtgtccgatgttaccgagaggagcgagttctggacactgcgtaaaccagaggcacttcctacaaaactgcggagtatgtttagggccccagacctcaagcggatgctacgggtgtgcagggaacttaccgacgtgcagagttattgggttgacgtaacgctgaatccacacactgcgaatctgaacttggttttggctaagaacaggagacaggttagattcgtgggcgcaaaagtgagcgggccatcctgcctggagaagcattatgactgctcggtgctcggaagccagcacttctcaagtgggaagcattactgggaggtggatgttgcaaaaaaaacagcttggatcttgggcgtatgcagtaacagcttgggccctaccttctctttcaatcacttcgcccaaaatcatagtgcctacagccgctaccaacctcagtcaggctactgggtgattgggctgcagcataaccatgagtaccgggcatatgaggactctagcccttccctcctgttgagtatgacggtaccaccgagacgggtcggcgtgttcttagactatgaggcaggcacggtatctttttacaatgtcaccaaccatggctttcccatctacacgttttccaaatattattttccaacgaccctttgcccttacttcaacccctgtaactgcgttatccccatgacgctgcgccgtccttccagctag

SEQ ID NO: 245189 - DNA, 1389 bp, Artificial Sequence
  Description of Artificial Sequence: Synthetic coding sequence
atgacctccccggtactggtggacataagagaagaggtgacgtgtccaatttgccttgagctactcaccgaaccactgtccatcgactgcggtcattctttctgtcaagcgtgtattacacccaatggccgtgagtcggttattggtcaggaaggagagcggagttgtccagtgtgccagacctcgtaccagccaggaaatctgagacccaaccggcacctggccaacatcgtacgcagactgcgcgaagaggatggtaaagtaatctgttggttatgtgaacgatcccaggagcatcggggacatcacacttttctggttgaggaggtggcccaagaataccaagaaaaatttcaagagagcctcaagaaactgaaaaacgaggagcaggaggccgagaagctgaccgccttcattagagaaaagaagacgtcctggaagaatcagatggaacctgaaagatgcaggatacagacagaatttaatcaactacgcaatatattagacagagtcgagcaacgtgagctcaagaaacttgagcaggaagaaaagaaagggctaagaatcatcgaagaagccgagaatgatcttgtgcatcagacacagtctctccgggagctaatctcagatttggaaaggaggtgccaggggtcaaccatggagctattgcaggacgtgagcgacgttacggaaaggagcgagttctggaccttgcggaagccagaggccctaccaaccaaactgcgttctatgtttcgggcaccagacctaaagagaatgttacgcgtttgtagagaattgacagacgtgcagagctattgggtggatgtgacactcaacccacataccgcgaacttgaacctcgtacttgccaagaataggagacaggtccggttcgtcggcgcaaaagtttcaggtcctagctgccttgaaaaacactacgactgctccgtgctggggagtcagcacttctcaagtggcaaacactattgggaggtagatgttgcaaagaaaacggcttggattctcggcgtatgctccaattcactggggcctaccttttccttcaatcattttgcccagaaccattctgcatacagcagatatcagccacagtctggctattgggtaattgggcttcaacacaaccacgaatacagggcttatgaggattcaagtccatctctgctcctctctatgaccgtgcctcccaggagagttggagtcttcctggattatgaggcgggaacagtgagtttctacaatgtgacaaaccatggattcccaatctacacttttagcaagtattatttccccactaccttgtgtccttatttcaacccttgtaactgtgtaattcccatgacccttcggcgaccctcctcgtag

SEQ ID NO: 245190 - DNA, 1188 bp, Artificial Sequence
  Description of Artificial Sequence: Synthetic coding sequence
atgtgtggcagcgaacgaccatggagaaaaacagctgcactgttgtcaggcggttgggaggggcacctgctcgcctgcgagaggagccaggaacaccgcggacaccatacctttcttgtggaggaggttgcacaagagtatcaagagaaatttcaggaaagcttgaaaaaacttaaaaacgaggaacaagaggcagaaaaactgaccgcatttattcgcgagaagaaaacctcgtggaagaaccagatggagcccgaacgttgtcgtatccagactgagtttaatcagttgcgaaatattttggatcgggttgagcagcgagagctcaagaaacttgaacaggaagagaaaaaggggctgcgaattattgaagaggctgagaatgacttggtccaccagacccagtccttacgggagctcataagcgacctggagaggagatgccagggatcaaccatggagctgctacaagacgtgtcagatgtgaccgagaggtctgagttttggactttacggaagcctgaggcactgcctacaaagctgagaagcatgttccgggcaccagacttgaaacggatgctgagagtatgtagagagctgactgacgtgcagtcttactgggttgatgtcacccttaacccccatactgcaaatctgaatctggtactggccaaaaatcggcgtcaagtgcgcttcgtcggcgcaaaggtttcggggcctagctgcctggagaaacactacgattgttctgtgttaggctctcagcacttctcctccggaaagcactattgggaggtcgacgtggctaaaaaaaccgcatggattcttggtgtgtgctccaattcactgggtccaactttttcctttaaccatttcgcccagaatcatagtgcatattccaggtatcaacctcagtcaggttactgggtcatagggctgcagcacaaccacgagtatagagcatacgaggactctagcccgtccctcctgctgtctatgaccgtcccaccgcgacgcgtcggtgttttccttgattatgaagccggaacagtcagtttctataacgtgacaaaccatggttttcctatatatacattttcgaagtattatttccctacgactctctgcccttactttaatccttgtaactgcgtgattcccatgacgttgaggcgacccagtagttag

SEQ ID NO: 245191 - DNA, 942 bp, Artificial Sequence
  Description of Artificial Sequence: Synthetic coding sequence
atggagccggagaggtgccgtatccaaactgaatttaaccagctgagaaatattttggacagggtggaacagcgggaattaaaaaagttggaacaggaggagaagaagggtcttcgcattatcgaggaggccgagaatgaccttgtgcaccagacccagtctttgagagagctgatttctgacttggagaggaggtgccaggggtccacgatggagttgcttcaggacgtgagcgacgtcactgagcgtagtgagttctggactctacgcaaaccagaggctttgccaaccaagttgcgcagtatgttccgggcaccggacctgaaaagaatgctcagagtgtgccgggaactgaccgacgttcaatcctactgggttgacgtgaccctcaatcctcacaccgcaaatctgaacctggtccttgccaagaacagaaggcaggtgcgtttcgtaggagccaaagtttctggcccaagctgtctggagaagcactacgactgtagtgtgcttggcagccagcatttcagctccgggaaacactattgggaagttgacgtggcgaagaaaaccgcttggatccttggagtttgttccaattctctaggaccaaccttcagcttcaaccatttcgcccagaaccactctgcgtatagtagataccagccccagtcaggatattgggtgatcggcctgcagcacaatcacgagtaccgggcatacgaggactcctctccatccctgctcttatccatgacggtacctccaaggagagtcggggtttttttagactatgaagccggaaccgtcagcttttacaatgttacaaaccatggctttcctatttacacttttagtaagtattacttcccgactacattatgtccttattttaacccctgcaactgcgtcatccccatgactttacgcagacccagtagctag

SEQ ID NO: 245192 - DNA, 942 bp, Artificial Sequence
  Description of Artificial Sequence: Synthetic coding sequence
atggagccagagcggtgcaggattcaaacagaatttaaccagctgcgtaatattttggacagagtggagcagagggaactgaagaagctcgagcaagaggagaagaaggggctccgcattattgaagaggctgagaatgacctggtgcatcagacccagagtctgcgagagctgatttctgaccttgagcggcgttgccagggctcgaccatggagctcctgcaggatgtgtctgacgtgaccgaaagaagtgagttctggacgctgcgcaaacctgaggctctccccaccaaacttagatcaatgtttagggctcctgacctcaagcggatgctgcgtgtgtgccgggaattgacagatgtgcagtcctactgggtggacgtgacactgaacccacatacggccaacctgaatctggttctcgcaaagaaccgacgacaggttcgttttgtcggagctaaggtttctggacctagttgtctcgaaaagcactacgattgctctgtgttagggtcacagcacttttcttcgggtaaacactactgggaagtcgatgtggccaagaaaaccgcatggatactgggtgtgtgttccaactctttgggtcccacatttagcttcaatcactttgcgcaaaatcactccgcctattcaagataccagccacagagtgggtactgggtaattggtctgcaacacaaccacgaatatcgcgcatacgaggattcatcgccctcactcctactgagtatgaccgtgccgccaagacgcgtgggggtttttttagattatgaggccggaaccgtttccttctataacgttacgaatcacggtttccccatttataccttttctaaatactacttccctacaactctgtgcccctattttaacccatgtaattgcgtcataccgatgaccctccggagaccgtccagctag

SEQ ID NO: 245193 - DNA, 942 bp, Artificial Sequence
  Description of Artificial Sequence: Synthetic coding sequence
atggagccggagagatgccgcattcagacagagttcaaccagcttaggaacatactggacagggtcgaacagagggaattgaagaagctagagcaggaggagaaaaaggggctgagaatcattgaagaagcggagaacgacttggtccaccagactcaatccttgcgagaacttatctccgacctcgagcgaagatgccaggggtctaccatggagttgctgcaggatgtgtcagacgtgacagagaggagtgaattttggaccttgaggaagccggaagccctgcctaccaagctgcgaagcatgttccgcgctccggacctgaagcgaatgcttagggtatgccgggaactgactgacgtgcaatcttactgggtggatgtcacacttaatccacacacagccaatctaaatctagtactggccaagaaccggagacaggttagattcgttggcgctaaggtatccggtcctagctgtttagaaaagcactacgactgctcagtattgggcagccagcactttagcagcggcaaacattattgggaagtagatgtggcaaagaagactgcttggattctgggagtctgctctaactccttaggccctaccttcagtttcaatcactttgcccagaaccatagcgcctactcccggtatcagccgcagtcaggttattgggtgatcggcctgcagcacaaccatgagtaccgcgcatacgaggattcgtcgccttcactgctgttaagtatgaccgtccctccacggagagtcggcgtgtttctggactacgaggcgggtaccgtttccttctacaatgtgactaatcacgggtttcccatttacaccttcagtaagtactactttccaacaacattgtgcccttatttcaatccatgcaattgcgtcatccctatgaccctccgtagaccttcctcttag

SEQ ID NO: 245194 - DNA, 942 bp, Artificial Sequence
  Description of Artificial Sequence: Synthetic coding sequence
atggagcctgagcgatgtcgtatccagactgagttcaaccagctcagaaatattctggatagagtggagcagcgggagctaaaaaagctggagcaggaagagaaaaaaggcctgaggatcatagaggaagcagagaatgatctggtgcaccagacacagtctctccgcgagctgatctccgacctcgagcgcaggtgccaaggaagtactatggagctgctccaggacgtaagtgacgtaacggagagaagcgagttctggactctgcgtaaaccagaggccttgccgactaagctgcgctcgatgtttcgggctcccgatctgaagagaatgctgcgcgtttgtagggagctcactgatgtgcagagctactgggtagacgtgaccctgaatcctcacactgccaacctgaacctggtattggccaagaatcgtcgtcaagtgcggttcgtgggcgcaaaggtcagcggacctagctgtttggagaagcactacgactgctcggtcctgggctcacagcactttagcagcgggaagcattactgggaagtcgatgtggccaagaagacagcctggatcctgggcgtttgctctaactccctgggcccaaccttcagttttaatcactttgctcagaaccactcggcttacagcaggtaccagccccagagtggatattgggttattggtctccagcataaccacgaatatagagcttacgaagattcgagtcctagcctcctgctgtcaatgaccgttcccccaagaagagtcggggtttttctagattacgaagccggtaccgtctctttctacaacgtcactaaccatggttttcctatttacactttttccaaatactatttccccaccacgctgtgtccgtatttcaatccttgcaactgtgttattccaatgaccttaaggcggccaagctcatag

SEQ ID NO: 245195 - DNA, 3651 bp, Artificial Sequence
  Description of Artificial Sequence: Synthetic coding sequence
atggccagaaattgttccgagtgtaaagagaaacgggcagcccatatcctttgcacatattgtaatcgctggctttgctcttcttgtaccgaggagcatagacattcgccggtccctggcggacccttttttcctagagctcagaaagggagtcctggcgtgaatgggggtcccggagatttcacactgtattgcccgttacatacacaggaggtgctgaaattattctgtgaaacatgcgacatgctgacatgccactcctgtttggttgttgagcataaagagcaccggtgtaggcacgtggaagaggtgctgcagaatcagcgcatgcttctggagggtgtcactacacaggtcgcccataaaaaatcgtccctccagacttccgccaaacagatagaagaccgtatattcgaagtgaagcaccagcataggaaggtggagaaccaaataaaaatggctaagatggtgctgatgaatgaactcaacaaacaagctaacggactcatcgaggagctggagggcattactaatgagcgcaaacgcaaattggaacagcagttacagagcataatggtgctgaatagacaattcgagcatgttcagaacttcataaactgggcagtttgttcaaagaccagtgtaccattcctattttctaaagaactgatcgtgttccagatgcagcggcttcttgaaacatcctgtaacacagatcccggaagcccttggtccatacgcttcacttgggagcccaacttctggactaagcaactggcttccttaggatgcatcacaaccgagggcggtcagatgagtagggcagatgcgccagcatatggaggcctccaaggcagttcaccattttaccaaagccaccaatctcccgtggcccaacaggaagcgttgagtcacccgtcccacaagtttcaatcccccgctgtgtgctccagctctgtctgttgctcccactgcagcccagtgtcaccaagccttaaaggccaggtaccacctccctctattcaccctgcgcactccttcaggcagccacctgagatggtgccccagcagctaggtagcttacagtgctcagcccttctccctagggagaaggagctggcttgctccccacacccaccaaaactgctgcagccgtggttggagacccagccccctgtggaacaggaaagtacctcacagcgtctcggacagcagctcactagtcagcccgtctgtatagttccaccccaggatgtgcagcaaggggcacacgctcaacctaccctgcaaaccccttccatccaggtgcagtttggacaccaccagaagctcaagttgtcccacttccagcagcagccacagcaacaacttccgccaccgcctccacctttgccgcacccccctcctccactgccaccaccaccacagcagccgcacccaccgctgcctccttcgcaacatctggcctcctcccagcatgaatcgccaccaggccctgcctgttctcagaacatggatatcatgcatcacaaattcgagctagaggaaatgcaaaaagatctggaattgcttctacaggcccagcagccatccctgcagcttagtcagacaaagtctcctcagcacctgcagcagaccatcgtgggacagatcaattacattgtccgtcagcccgcacccgtgcagtcacagtcccaggaggagactctgcaggccaccgatgagcctcccgcttcacaaggaagcaaacctgccctgcccctcgataaaaataccgctgcagctctgcctcaagcctctggagaggaaacacctctttccgtgcctccagtcgacagcaccatccaacatagcagtccaaacgttgtccggaaacactcaaccagtctgtctattatggggttctccaacacacttgaaatggaactctcgtccacccggctcgagaggccactggagccccagatacagtccgtctcaaatcttactgcaggcgcacctcaagccgtgccatccctactgtctgctcctcccaaaatggtgagcagcctaacaagcgtccaaaaccaagctatgcctagtttgacaactagtcacctgcagactgttccttccctggttcattcaacatttcagtcaatgccgaacctcatttctgattcacctcaggcaatggcttccctcgccagtgatcatcctcaggccggaccttccctgatgtctggacacacgcaggccgtcccctcattagcgacttgccctctgcagtcaatccctccagtgtctgacatgcagcccgaaaccggatcttcatcatcttctgggaggacaagtgggagcctgtgtccccgagatggggctgatccatctctggaaaacgccctgtgtaaagtgaagttagaagaacctatcaatctgtctgtaaaaaagccgcctcttgcgccagtcgtgtcaacaagtaccgcgctacagcagtaccaaaaccctaaggaatgcgaaaacttcgagcagggggctctggaacttgatgccaaggaaaaccaatccatccgggcttttaactctgaacataagattccgtatgtgagattggaaaggctcaagatctgtgccgctagcagcggcgaaatgccagtcttcaaactgaaacctcagaagaatgatcaggacgggagcttcttactcataattgagtgcggaactgagtcctcctctatgtcgatcaaagttagtcaggataggctgtcggaggccacacaagctcccggactggaaggcagaaaagtaacggtcacatcactggccggacaacggcctcccgaagtggaaggcactagcccggaggaacacaggttgatcccacgcacccctggggctaagaagggaccgcctgcccctattgaaaacgaggacttctgcgccgtctgccttaacggcggagagttactgtgttgcgatcgttgccccaaggtattccacctgtcctgccacgtgcccgcactcctgtcctttccgggaggcgagtgggtctgtacactgtgccggagcctgacgcaacccgagatggaatacgactgtgagaacgcatgttacaatcaacctgggatgagagccagtcccggactgtctatgtatgatcagaagaaatgtgaaaagctggtcttgagtttgtgttgcaataatctgtccctgcctttccacgaacccgtatctccgctggcacggcactattatcagatcataaaacgcccaatggacttgagtattatcaggcggaagttgcagaagaaggatccagctcactataccacccctgaagaagtcgtcagtgacgtgagactgatgttctggaattgcgccaaatttaattacccagactctgaggtagcagaagctggtcgttgtctagaagtcttctttgaaggatggctcaaagaaatctatcctgaaaagcggtttgcccagccccgacaagaggactctgactccgaggaggtcagttctgagtcagggtgctcaacaccgcagggcttcccatggcccccttacatgcaagaagggattcagcccaagagacgcagaaggcacatggaaaatgagcgtgccaaaagaatgagcttccgactggccaactctatttcacaggtctag

SEQ ID NO: 245196 - DNA, 1458 bp, Artificial Sequence
  Description of Artificial Sequence: Synthetic coding sequence
atggacccaaccgcactggtcgaagccattgtggaagaggttgcctgtccaatctgcatgacatttctgagagaacctatgtccattgattgtgggcatagtttttgtcacagctgtcttagcggactgtgggagataccgggtgagagtcagaactgggggtatacctgtccactgtgcagagctcctgtacagccaagaaacctgcgacctaactggcagctggccaacgtcgtggagaaagtgcgcttactcaggctgcacccaggtatggggctgaagggtgatctctgtgagcgccacggagaaaaactgaaaatgttttgtaaggaggatgttctgattatgtgcgaagcatgctcacagtcacccgagcacgaagcacactccgtggtccccatggaagacgtagcatgggagtacaaatgggaactgcacgaggccctggagcacctgaaaaaagaacaggaggaagcctggaagctggaggtgggtgaacggaagcgtaccgccacatggaagatccaagtcgaaaccagaaagcagagtattgtctgggaattcgagaaatatcagcgcttactggagaagaagcagccacctcatcgccagctgggcgctgaagtcgcggctgcgctcgccagtctccagagagaagctgccgagacaatgcaaaaactagagctgaaccactctgaactcattcagcagtctcaggtgttatggaggatgatcgccgagctgaaggaaaggagtcagcgccctgtacggtggatgctgcaagatatccaggaagtgctcaacaggtccaaatcatggtcgttgcagcaaccagagcccatttctctggagcttaagacagactgcagggtgctcggcctgagggaaattctcaagacctacgccgcagatgtgaggctcgacccagataccgcttactccaggctgatcgtctcagaggaccgcaaacgcgttcattatggggatactaaccagaaactccccgacaaccctgagcggttctatagatacaacatcgttctcgggtcacagtgtataagcagtggtcggcattattgggaggtcgaggtcggagataggagcgagtggggcctcggggtgtgcaagcagaatgtggatcggaaggaagtagtctacctgagtccccactacggcttctgggtgattagactgagaaaaggcaatgagtaccgcgcaggtacagacgagtaccctattttaagccttcccgtgcctccgcgacgcgtgggcatctttgtagattatgaagcacatgacattagcttttacaacgtgaccgactgtggttcccatatttttacttttcctagatatccatttccgggacgcctgctgccctatttttctccctgttacagcatcggaacaaataatacagcacctctagcgatttgtagcctggacggcgaagactag

SEQ ID NO: 245197 - DNA, 621 bp, Artificial Sequence
  Description of Artificial Sequence: Synthetic coding sequence
atgcagaagctggagttaaaaaccgattgtagagtcctggggttaagagaaatcctgaagacctatgcagctgacgtgcgccttgatcccgacaccgcgtatagcaggcttatagtttcagaggaccgtaaacgcgtacactatggagataccaaccaaaagctgccggacaaccccgaacgtttctataggtacaacatcgtgctgggaagtcagtgcatttcttctggtaggcactattgggaggtcgaggtgggggatcggtcggaatggggcttgggagtgtgcaaacaaaatgtcgataggaaggaggtggtgtatttgtccccacactatggtttttgggtgatacgactgcgaaagggcaatgagtacagagccggtacagatgaatatcctatcctttcactgccggttcctcctcgtcgtgtagggatcttcgttgattatgaggcacatgacatttccttttacaatgttacagactgcggctcccatatattcacctttccgagataccctttccccggtagattactgccatatttcagcccatgctatagcattggcacgaacaatacggcgccactggcaatatgttctctggacggcgaagactag

SEQ ID NO: 245198 - DNA, 1536 bp, Artificial Sequence
  Description of Artificial Sequence: Synthetic coding sequence
atggccgcagtcggacccaggactggccctggtaccggggctgaggctttggcactcgccgctgagctccaaggcgaggccacctgttccatctgcttggaattattccgcgagcctgtaagcgtggaatgtggccactccttctgccgggcatgtattggcagatgctgggaacgaccaggagccggtagcgtgggggcagccacgagggctccccctttcccactcccttgcccccagtgcagagagccagctagaccctcacagctccggcctaacaggcagctcgctgccgttgctacactactgcgcagattttcccttccagccgctgcccctggagaacatggctctcaggctgccgctgcgcgagctgctgcggcaagatgtggccagcacggcgagccatttaagctttactgccaggacgacggcagggctatatgcgtagtctgcgacagagcccgtgagcaccgagagcatgccgtgctgccgttggacgaggccgtgcaggaggctaaagagcttttagagagccggttgagggttcttaaaaaagagcttgaagattgcgaagttttcaggagcaccgagaaaaaggagtccaaggaactgctcaagcaaatggcggcagagcaggaaaaagtgggcgcagagtttcaagcactgcgcgcttttctggtggaacaggaaggcagactactgggacgcctggaggaactctcgcgggaggtggcacagaaacagaacgagaacctcgcccaattaggtgtcgagatcactcagctgagtaagctttcctcccagattcaggagacagctcaaaagcctgacttagactttttacaggagtttaaatccaccctgtcacggtgtagtaacgtgccaggcccaaaacccacaaccgtcagctccgaaatgaaaaataaggtgtggaacgtgtcactcaaaacattcgtgctcaaggggatgctcaagaagtttaaggaagatctccgtggggaattggagaaggaagagaaagtggagctcacattggaccctgacacagcgaatcccagactgatactttcacttgacctaaaaggggttcgccttggcgagcgggcacaggatctgcctaaccatccctgccgttttgataccaacacaagggttttggcctcctgtggtttttcctccggacggcaccactgggaggtagaggttggcagcaaagatggatgggccttcggagttgcacgagaatctgttaggcgaaagggcctcaccccattcacccctgaggagggggtctgggcactgcaactcaatggcggtcaatactgggctgttaccagccctgaaaggagcccgctctcttgtggccatcttagcagggtaagggtggccctggacctggaggtgggagcagtcagcttctacgccgtggaagatatgagacacctttacacctttcgagttaactttcaggaaagagtttttcccctgttttctgtctgcagtactggaacataccttaggatctggccgtag

SEQ ID NO: 245199 - DNA, 666 bp, Artificial Sequence
  Description of Artificial Sequence: Synthetic coding sequence
atggccgctgttggccctcgaaccggaccaggaacgggagccgaggcactggcactggctgccgaactccagggcgaggcgacctgctccatctgtcttgaactctttcgcgagcccgtatcagtcgagtgcggccattccttttgccgggcttgcatcggcagatgttgggagaggcccggtgctggatcggtcggggctgctacccgcgctcctccattccccctcccgtgcccacagtgccgggagcccgctcgtccatcccagctccgccctaataggcaacttgcagctgtagccacactgctcaggaggttttcccttcctgccgcagccccaggagaacatgggtcacaagccgctgccgctagagctgctgctgccaggtgtggccaacatggggagccgtttaaattatattgtcaagacgatggtagggccatttgtgtcgtgtgcgatcgcgctcgagagcatagagagcacgctgtactgccgttggatgaggcggttcaagaggctaaagaactattagagtctcgcctccgagtacttaaaaaggaactggaggattgtgaggtgtttagatcgacagagaaaaaggagtccaaggaactgcttgtgtctcaggcgcctgccggaccaccctgggacattacagaggcctag

SEQ ID NO: 245200 - DNA, 912 bp, Artificial Sequence
  Description of Artificial Sequence: Synthetic coding sequence
atggctgccgagcaggagaaagtgggagctgagtttcaggctctgagggcattcctcgtggagcaagagggacggctcctgggacggctggaagagctttcccgcgaagtggctcagaagcagaacgagaacctcgcacagcttggagtcgaaataacgcagctctctaagctgtcaagccagatccaagagacagctcagaagcctgatctggacttcctccaggaattcaagagcaccttgtcccgatgcagtaatgtccctggaccaaagccaacaacagtgtcctcggagatgaaaaacaaagtgtggaacgtatctctcaagacattcgtgctgaaggggatgctgaaaaaattcaaggaagatctccgtggggagctggaaaaggaggaaaaagtggagctgacgctggatcccgacacagccaaccctaggctcatccttagcctggatctaaagggtgtccggctgggggagagagcccaagatctgcctaaccacccctgcagattcgatacaaacactagggttctggcaagttgtggcttctccagcggcagacaccactgggaagtcgaggtcgggtctaaggatggctgggcctttggagtcgcccgagagagtgtcagaaggaaggggcttactcccttcacacccgaggagggcgtgtgggccctgcagctgaatggaggacagtactgggccgttacatcccccgaacggagtcccttgtcttgcgggcacctgtctagggtgagggtggccctggaccttgaggtaggcgcagttagcttctatgctgtcgaagacatgaggcacttgtacaccttcagggtcaatttccaggagagggttttccccctgttttctgtctgcagcacaggcacctacctcaggatctggccttag

SEQ ID NO: 245201 - DNA, 912 bp, Artificial Sequence
  Description of Artificial Sequence: Synthetic coding sequence
atggcagctgagcaggaaaaggtgggggctgaattccaggcactcagagcttttctggtggagcaggagggcagactgcttggccgactggaagagctttcacgagaggtggcccagaaacagaatgaaaacctggcccagctgggcgttgagataactcaactgagcaaactgagttcacagatacaggaaaccgctcagaagcccgatctggactttctgcaggaattcaagtccacactgtctaggtgcagcaatgtcccgggaccaaagcctaccacagtttcctctgaaatgaagaacaaggtctggaatgtgagcttaaaaacattcgttctgaaaggtatgctgaagaagtttaaggaggaccttagaggcgaactcgaaaaggaagaaaaagtggaactgaccctcgacccggatacagccaatcctcgcctcatccttagccttgaccttaaaggagtccgcctcggtgagcgcgctcaggatctccccaaccacccctgccgcttcgatacaaacacccgggtactggctagttgcgggttctcttctgggcgtcaccattgggaggttgaagtcggcagcaaggacggatgggcctttggcgtcgcaagggagtcagtccggcgtaagggcttgacccctttcacaccggaagagggcgtgtgggcactgcagcttaacggcggacagtactgggctgtcacatctcctgagaggtcccctctgagttgcggtcatctgagtcgggtgcgcgtggcattagatttagaagtcggggctgtgagcttttacgccgtggaagatatgcggcatctgtataccttcagagtgaatttccaagagagggtattccctctgttcagcgtgtgttctacaggcacctatctccgcatctggccatag

SEQ ID NO: 245202 - DNA, 990 bp, Artificial Sequence
  Description of Artificial Sequence: Synthetic coding sequence
atgactcaagccaccggccagatgctgtgcctccatgtccaggtgcccctacagctcttgctgttaggtcaaaaacagatggccgctgaacaggagaaggtgggcgctgagtttcaggctctgcgggcttttctggttgaacaggagggcaggctcctgggtcgcttggaggaactttcaagggaagtggctcagaagcagaacgaaaacttagcacagctgggagttgagatcactcagctctccaagctatcaagccagatacaagagacagctcagaaacctgatctcgatttcctccaggagtttaaaagtactctgtctcggtgcagtaacgtgcctgggcctaagcctacaacagtcagctctgagatgaagaataaggtgtggaacgtgtcactgaaaactttcgtcctgaaggggatgttgaagaagttcaaagaggacttacggggtgagctagaaaaagaggagaaggtagaattaacactggatcccgacactgccaatccacggctgatactttccctcgatttaaagggcgtgagacttggggagcgggctcaggatctgccaaaccacccttgccgcttcgataccaatactagggtgctggcctcctgcgggttttcctcaggccgacaccactgggaggtggaagtaggttcaaaggacggctgggcctttggagtcgcacgcgagagcgtgagacgcaagggcttaacacctttcaccccagaggaaggagtgtgggctctgcaactcaatggcggacagtactgggctgtcacctcgcccgagcgctcacccctttcgtgtggccatctgtccagagtgagagtagccctggatctggaggtgggggctgtgtcattctacgccgtcgaagatatgcggcacttgtacacgttccgcgtgaattttcaagaaagggtctttccactgttcagtgtttgctctaccggaacatatctgcgcatctggccctag

SEQ ID NO: 245203 - DNA, 912 bp, Artificial Sequence
  Description of Artificial Sequence: Synthetic coding sequence
atggcagccgagcaagagaaggtgggcgctgagttccaagccttgcgcgcttttctggtggagcaagaaggtaggctgctgggcagactggaggagctcagtcgagaagttgctcagaagcaaaatgaaaacctagctcagctgggagtggaaatcacacaactatctaaactttcatcacagattcaggaaacagcccagaaacctgatttagacttcctgcaggagtttaaatctacacttagcagatgctccaatgttccaggcccaaagcctaccaccgtgtcctcggagatgaaaaataaggtctggaacgtctctttgaagacttttgttctgaaggggatgctgaagaaatttaaggaagatttaaggggcgagcttgaaaaagaggaaaaggtagagctaacacttgatcccgatacagcgaatccaaggctcatcctgagcctggatctcaagggagttcggctaggagagcgagctcaagatctgcccaatcacccctgcaggttcgacaccaacacccgcgtgctcgcctcatgtggattcagctccggccgacatcactgggaggttgaggtggggtcaaaggacggatgggcctttggcgttgcccgtgagtccgtgcgtagaaaaggtcttacccctttcacacctgaggagggagtgtgggcactccagttaaacgggggtcagtattgggccgttacaagtcctgaaaggtcccctctctcttgtggccatctgtcgcgcgtccgcgttgctctggatctcgaggtcggagccgtcagcttttacgcagtggaggatatgcggcacttgtacacttttcgcgtcaatttccaggaaagagtctttcccctatttagcgtttgcagcacaggcacatacctgagaatctggccatag

SEQ ID NO: 245204 - DNA, 1434 bp, Artificial Sequence
  Description of Artificial Sequence: Synthetic coding sequence
atgagcgccgcacccggacttttgcaccaggaactttcgtgccccctctgtttacaactgtttgatgctcctgtgaccgcagaatgtgggcactccttttgtcgggcatgcctgggtcgtgtagccggagagcccgctgctgatggcactgtgctttgtccatgctgccaggccccaacaaggccacaggccctgagcaccaatctccagctggctagattagtggagggacttgcccaggtcccacagggtcattgtgaagagcatctcgacccactgtccatttactgcgagcaggaccgcgcactcgtgtgtggcgtctgcgcatccctaggcagccatcgtggccacaggctgttgccggctgccgaagctcatgcacggctcaaaactcagctgccccagcaaaagctgcagttgcaggaggcatgcatgcgcaaagagaaaagtgtggccgtactggagcaccagctggttgaggtagaagagaccgtccgtcagttcagaggagcagtgggcgagcaattaggcaaaatgagggtgtttctcgctgccttagaaggttctctcgatcgcgaggcggaacgtgtgagaggtgaggccggagtagccctccggagagagctggggagtttgaactcatatctcgagcagctgcgtcagatggagaaggtgctggaggaggtggccgataagcctcaaaccgaatttctcatgaaatactgtcttgtaacttctcggttacaaaagatcttggcagaaagcccccctcctgcccgactggatattcagctgccaatcatatcagacgactttaagtttcaggtatggcgcaagatgttcagagcgctgatgcccgctctggaggagctgaccttcgaccctagttcagcccacccatcactcgtggtgagttcaagcgggagacgggtcgaatgctccgagcagaaggcgccaccagccggtgaggatcctagacaatttgataaagccgttgctgtcgttgcacaccagcagctctccgagggcgagcattactgggaggtcgatgtgggtgacaaacccagatgggcacttggcgtcatagccgcagaggcgccaagacggggtcggttacatgcagtaccctcacagggtctgtggttgctgggcctcagggaaggcaagattctggaggctcacgtcgaggccaaagagccaagggccctgcgtagcccagagagacggccaacgcgcatcggactttatctgagcttcggggacggcgtcctatccttctacgacgctagcgatgccgatgccctggtgccactttttgcatttcatgaacgcctccccagacccgtgtacccgtttttcgacgtgtgctggcacgataaaggcaagaacgcacaacccctgctgcttgtggggccagagggagcagaagcttag

SEQ ID NO: 245205 - DNA, 753 bp, Artificial Sequence
  Description of Artificial Sequence: Synthetic coding sequence
atggcatggcaggtgagcctgcttgaactcgaagatagactccaatgccccatatgtctggaagtcttcaaggaatctttgatgctgcagtgcggacacagttactgtaaagggtgcctggtatcactatcctaccatcttgacacgaaggtccgctgcccaatgtgttggcaggttgttgatgggagttcgtctctgccgaatgtcagtctagcttgggttattgaggcacttcggctccctggagaccctgagcccaaagtgtgcgtgcaccacagaaatccactgagtctgttctgtgaaaaggatcaggaactcatttgcgggctgtgtgggctgctagggtctcatcagcatcaccctgttacacccgtaagcactgtttgtagtcgcatgaaggaggagctagcagcgctgttttctgagttaaaacaagagcagaagaaggtcgacgagctaatcgcaaaactagtcaaaaatagaacacgaattgttaacgagtcagacgtgttttcttgggttatccggagggaatttcaagagctgcgtcaccctgtggacgaagagaaggcacgatgtctggaaggtatcggaggtcacactagggggctggtggccagcttagatatgcagctagagcaggctcaaggaacacgggagcgtttggctcaagcagagtgtgtgcttgagcagttcgggaatgaggatcaccacgagttcatttggaagtttcacagtatggctagccgctag

SEQ ID NO: 245206 - DNA, 849 bp, Artificial Sequence
  Description of Artificial Sequence: Synthetic coding sequence
atggcatggcaggtaagtctcctggaacttgaagatcggctgcaatgccccatctgcctggaggtcttcaaggaatcgttgatgctgcaatgtggccactcttattgtaaaggatgcctggtcagcttatcctatcacctcgacactaaggttcgttgcccgatgtgctggcaggtagtggatgggtcctcatccctccccaacgtgtcccttgcttgggttatcgaggccctgcgcctgcccggagatcctgaaccaaaagtctgcgtccatcacagaaatcccctatcactgttttgcgagaaggaccaggagctgatttgcgggctgtgtgggctgctgggctctcatcaacaccatccagtgacacccgtaagcaccgtttgttccaggatgaaggaggaactggcagcgttgtttagcgagttaaagcaggagcagaagaaggtcgatgaactgatcgcgaaacttgtgaaaaaccgcactcggattgttaacgagtccgatgtcttcagctgggtgattagacgagagtttcaggagctgagacaccccgttgacgaagaaaaggctaggtgtttagagggtattggaggccatacgagaggtctggtggccagtcttgatatgcagcttgaacaggctcaaggaactcgagagcgcctggcccaggctgagtgcgtgctggaacaattcggaaatgaagaccaccatgagtttatctggaaatttcattcaatggcctcccgtctgactaagacggaagaacttgagaaaaagtggcggaatggactagcagcaagtcactccttgccacagcaggttagaccgcagaggcgcaccccttag

SEQ ID NO: 245207 - DNA, 753 bp, Artificial Sequence
  Description of Artificial Sequence: Synthetic coding sequence
atggcttggcaggtatctctcctcgaacttgaggaccgactgcagtgtcctatctgtcttgaggtatttaaggaatccttaatgctacaatgcggtcactcttactgtaaaggttgtctggtgtcgctgtcttaccacctggacacgaaggtccggtgccctatgtgttggcaggtagtcgacggatcatcgagccttcctaatgttagcctagcttgggtgattgaggcgttgaggctgccaggggatccagaaccgaaggtctgtgtgcaccatagaaatcccttgagcttattctgcgagaaggatcaggagttaatctgcggcctgtgtgggctcttaggctctcaccagcatcaccctgtaacccccgtgagcacagtgtgttcaagaatgaaggaggaactcgctgccctgtttagcgagctgaaacaagaacaaaaaaaggtggatgagctcatcgccaaactcgtgaagaatcgcacacggattgtcaacgaatctgatgttttctcgtgggtaatccggagggaattccaggaactgcgccacccagttgacgaggagaaggccagatgccttgagggcatcggcggacatacaagagggctggtggcctcactggacatgcaactggagcaggcacaagggactcgagaacggctagcccaagcagagtgtgtcttagagcaatttggaaatgaggaccatcacgagtttatttggaaattccactcaatggcttcccggtag

SEQ ID NO: 245208 - DNA, 750 bp, Artificial Sequence
  Description of Artificial Sequence: Synthetic coding sequence
atggcctggcaggtcagcctgctggaactggaagaccgcctgcagtgccccatctgcctcgaggtgttcaaagagagtttgatgctgcagtgcggacattcctactgtaagggctgtctggtttctctttcgtatcatctggacacgaaggtaaggtgccccatgtgttggcaggtggtcgatggatctagctctctccctaacgtgagccttgcatgggtcatagaggcattacggttacccggtgatcccgaacctaaggtttgcgtccaccatcgaaatccgctgagtttattttgcgagaaagatcaagagctaatatgcggcctctgtggtctgcttggctcgcaccagcaccatcctgtgacccccgtgtccacagtttgcagtaggatgaaggaagagcttgcggcactattttcagagctgaaacaggagcagaagaaagtcgatgagctgattgccaaattggtaaagaaccgcaccaggatcgtaaacgaaagtgatgtgttctcctgggtaatccgccgagagttccaagagctgcgacatcccgtggatgaggagaaggcgagatgcctggaaggtataggcggacatactcgcggactcgtggcatctctggatatgcagcttgagcaggctcagggcacaagggagcgacttgcacaagcagagtgtgtcctggaacagttcgggaacgaggaccatcacgaatttatctggtttcactcaatggcctcccggtag

SEQ ID NO: 245209 - DNA, 753 bp, Artificial Sequence
  Description of Artificial Sequence: Synthetic coding sequence
atggcctggcaggtcagcctgctggagcttgaagactggttacagtgcccaatttgtttggaggtcttcaaagaaagtctcatgctgcaatgcgggcacagctattgcaagggctgcctcgtgtccttgtcctatcatctcgacacaaaggtgaggtgtccaatgtgctggcaagtggtggatggatccagtagcctgcccaatgtgagtctggcgtgggtgattgaggcccttcgcctgcctggagacccagaaccaaaagtgtgtgtccaccacagaaaccccctgtctcttttctgtgaaaaggatcaagagctgatctgcggtctctgcgggttgttgggatcccatcagcatcacccggtgacgccggtttccacggtgtgttcccggatgaaagaagaacttgcagccctatttagtgagcttaagcaggaacaaaagaaggtagatgagttaatcgcaaagctggtgaagaaccgtacccggatcgtgaacgaatccgacgttttttcctgggtgatacgtcgtgaattccaggagcttcggcacccagtggacgaggagaaggcccgttgcttagagggcattggaggccacaccagagggctcgtcgcttctctggacatgcagcttgaacaagcccagggcaccagagagcgccttgcccaagccgagtgcgtattggagcaatttggaaacgaggaccaccatgagttcatttggaagttccattctatggcgtccaggtag

SEQ ID NO: 245210 - DNA, 750 bp, Artificial Sequence
  Description of Artificial Sequence: Synthetic coding sequence
atggcctggcaggtatccctgcttgagttggaagactggttacagtgtccgatttgtttagaggtcttcaaagaatcattaatgcttcaatgtggacattcctactgcaaagggtgccttgtcagtttgtcctaccacctggatacaaaagtcaggtgtccaatgtgttggcaagtggtcgatggctctagctcgctaccaaatgtgtcattggcctgggtgatagaagcattgcgattacccggagaccccgagcctaaagtgtgcgtccaccatcgaaatcccttatccctgttttgcgaaaaggatcaggagctgatatgtgggctttgtggcctcctggggtctcatcagcaccacccagtcacaccggtttccactgtgtgcagcaggatgaaggaggaattagcggcactattcagcgaactgaaacaggaacagaagaaagttgatgaacttattgcaaagctggtaaagaataggactcgcattgtgaatgagtcagatgtcttcagttgggtcattagacgggagtttcaggagctccgccatcctgtcgacgaagaaaaagccaggtgcctggagggaattggcggacataccagaggactggtagcctctcttgacatgcagctggaacaggctcaggggaccagagaaaggctagcacaggctgaatgcgtactcgagcaattcggcaatgaggatcaccacgagtttatctggttccatagcatggccagcagatag

SEQ ID NO: 245211 - DNA, 1656 bp, Artificial Sequence
  Description of Artificial Sequence: Synthetic coding sequence
atggccgagaactggaagaactgcttcgaggaagagctgatctgtcccatctgtctacatgtctttgtggagcctgttcagcttccgtgtaaacacaatttctgcagagggtgtatcggggaggcgtgggccaaagactctggtctggtcaggtgccccgagtgcaaccaagcatacaatcagaagcctggactggagaaaaatctgaaattaactaatatcgttgagaaattcaatgctttgcacgtggagaaaccacccgctgcacttcactgtgtattctgtcgacggggaccgccactccctgcgcagaaagtgtgtctgcggtgcgaggccccttgttgccagtcccacgttcagacccaccttcaacagccttccaccgccaggggtcatctactggtggaggccgatgatgtccgagcctggtcatgtcctcaacacaacgcttatagattataccattgtgaggcggaacaggtggctgtgtgtcaatattgttgttattattctggagcacaccagggacattcggtgtgtgatgtcgaaatacgtcgaaatgaaatacggaaaatgctgatgaaacagcaagatcgcctggaggaaagagagcaggacatcgaggaccagctctacaagttagagtccgacaagcgcctggttgaggagaaagtgaatcagttgaaggaggaggtgcgccttcagtacgaaaaactccaccagctgttagatgaagaccttagacaaacggtcgaggtcctggataaggcccaggcgaagttttgctccgagaacgctgcccaagcactgcatctgggcgagagaatgcaagaggctaaaaagttactggggtctctgcagctgttgttcgacaaaaccgaagatgtgtccttcatgaaaaatacaaagagcgttaaaatcctcatggataggacacaaacatgcacatcatcctcactctcgcctacaaaaataggccacttgaacagcaaactctttctgaacgaggtggcgaaaaaagagaaacagctccggaagatgcttgaagggccattctctacgcccgtgcccttcctccagtcagtccccctgtacccctgcggggtgtcctcatccggtgcggaaaagagaaagcactctaccgcattccccgaggctagttttctggagacttcgagcggccctgtaggtggccaatatggtgctgcaggtacagcctcaggcgaaggccagtccggacagcctctgggcccttgttcttccactcagcatctggtggcccttcctggcggagctcagccagtgcacagctccccggtgtttcccccatcccagtatccaaatggctcagccgctcagcagccaatgctgcctcagtacgggggacgtaagatcctagtgtgctcagttgacaattgttattgttcttccgtcgctaaccatggcggtcaccagccctaccccagatccgggcatttcccctggacagtaccaagtcaggaatacagccaccccctcccgcctaccccctctgtccctcaaagcttgccctctctggccgtgcgggactggctcgatgcgtcccagcagccaggccatcaggatttctatcgcgtgtacggccagccgtcaaccaagcactatgtcacttcctag

SEQ ID NO: 245212 - DNA, 1653 bp, Artificial Sequence
  Description of Artificial Sequence: Synthetic coding sequence
atggcagaaaactggaagaactgctttgaagaggaacttatttgccccatttgtcttcacgtgtttgtggagcccgtacagctgccttgcaagcacaacttttgtcgcggatgcatcggcgaggcctgggctaaagacagcggcctggtacggtgtcccgaatgtaatcaggcatacaaccagaaaccgggattggagaagaatctaaagttaacaaatattgtggaaaaattcaacgccctgcacgtggagaaaccaccagccgcactccactgcgtgttttgtcgcaggggcccaccgctgcccgcacagaaggtgtgtcttagatgcgaggccccttgttgtcagtcccatgtacagactcacctgcagcagccctcaacagcaagggggcacttgcttgtggaggcagacgatgttcgtgcatggagttgccctcagcataacgcctatagactgtatcactgcgaggctgagcaggtcgccgtgtgccagtattgttgttactacagcggagcccaccaaggtcacagtgtgtgtgacgtggaaatcagaaggaatgagatacgtatgctgatgaagcagcaggaccgtttggaggagcgcgagcaagacatagaggaccagctgtataagctggagtcggataaaagactggtagaggaaaaagtcaatcaactcaaggaagaagttaggctccagtacgagaagctgcaccagctgctcgacgaggacctgagacaaaccgtcgaagttctcgataaggcgcaggccaagttttgttccgagaatgccgcacaggcacttcacctcggcgagcggatgcaggaagcgaagaaactcctggggtctctgcagctgctgtttgataagactgaggatgtgtcattcatgaagaatactaagagcgttaagatcctaatggatcgtacccagacatgtacaagctcttccctctccccgaccaagatcggccatctaaatagtaaactcttcctcaatgaagtggccaaaaaggaaaaacagctccgcaaaatgctcgagggaccatttagcaccccggttcccttcctccagtcagttccactgtacccgtgcggcgtgagtagctcgggcgctgaaaagcgaaaacatagtactgccttcccagaggcctcttttctcgagacctcttccggccctgtcggtgggcagtatggagccgcaggcactgcgtcaggagaagggcagagtggacagccactgggaccgtgctccagtacccaacatctcgtggccctccccggtggcgcacaacccgtgcatagttcacccgtgtttccaccctcacagtaccccaacggtagcgccgcacaacaaccgatgcttccgcaatatgggggtcggaaaatcctggtctgtagcgtcgacaactgctactgttctagcgtggctaaccacgggggacatcagccctacccgcgttctggccattttccatggacagtgccgtcccaggagtactctcatccactcccccctaccccaagtgtgccccagtcattgccatcactggcggtcagggattggctcgacgcgtctcagcagccaggccaccaggatttctaccgggtgtacggacaaccatcgactaaacattacgtcacatcatag

SEQ ID NO: 245213 - DNA, 2133 bp, Artificial Sequence
  Description of Artificial Sequence: Synthetic coding sequence
atggaagagatggaagaggagttgaagtgtcccgtctgcgggtccttctacagagagccaatcatcttgccatgctcccacaatctgtgccaggcctgcgcaaggaatattctggttcagacaccagaatcagaatccccccagtctcatagagcagcaggttctggagtgtctgactatgattatctggatttggacaagatgtccttatattccgaggccgattctggctatggttcttacggcggatttgcctcagcacccaccacaccgtgccagaaatcacctaatggcgttcgggtgttcccccctgccatgcccccacccgctacccacctgtcacctgcgctggcccctgtacctaggaacagctgcatcacttgtccgcagtgtcaccgaagtttaatcttggatgataggggtttgcggggattcccgaaaaatagggttctcgagggcgtgattgaccgctatcagcagagcaaagccgctgccctgaagtgccaactttgcgagaaggcccctaaagaggcaactgttatgtgtgaacagtgcgatgtcttctactgtgatccgtgtagactgcgctgccacccccctcggggacctctcgcaaaacatcggttggtacctccagctcagggtagggtttctcgacgcctttcaccacgcaaagtgtcaacctgtactgatcacgagctggagaaccactccatgtactgtgtccagtgtaagatgcccgtttgctaccaatgcctcgaggaaggcaagcacagtagtcatgaggttaaagcgctcggcgctatgtggaagctccataaaagccagctgtcacaggctctcaatgggctgtcagacagagcaaaggaggcgaaagagtttctggtgcagctgcggaacatggtacagcaaatccaggagaactctgttgaatttgaagcatgtttagtggcccagtgcgacgccctgatcgatgccctgaatagacgtaaggcccagttgcttgctagggtgaataaagagcatgaacacaaacttaaagttgtgagggaccagatatctcattgcacagtgaaattgaggcaaactacgggacttatggagtattgtttggaggtgattaaggaaaacgaccccagtggctttttgcagatttccgatgctctgatcagacgtgtgcacctgactgaggatcagtggggcaaaggcaccctgactccccgaatgacaaccgatttcgacttgtcccttgataactctcctctgctgcaaagcatccatcaactggactttgtgcaggtgaaggcatcaagcccggtgcccgcaacaccaatcctgcagcttgaagagtgctgcacacacaacaactctgcgacgctctcttggaagcagccgcctctgtccacggttcctgcagatgggtacatcttggaactcgacgatgggaatgggggacaatttcgggaagtttatgtgggaaaagagaccatgtgtacagttgacggattgcactttaacagcacttataacgcaagagtcaaagcattcaataagactggggtgagtccatactccaagacactcgtcctgcaaacatcagaagtcgcatggttcgcatttgacccaggaagcgctcactctgacatcattctcagcaacgataatcttaccgtgacttgttcttcttatgatgaccgggttgttctcggtaaaactggattttcaaaaggtatccactactgggagttaacagtcgacagatacgacaaccatccggaccccgcattcggagtcgctaggatggatgtcatgaaagacgttatgttagggaaggacgataaggcctgggccatgtacgtggacaacaatcgaagctggttcatgcacaacaattctcacacgaatcgaacagaaggcggaattaccaagggggctaccataggtgtgctcctcgacctaaatcgcaagaatctgactttcttcatcaatgatgagcagcagggtcctatcgccttcgataatgttgagggactgttcttccctgcagtgagcctgaatcgaaatgtgcaggttaccttacatactgggcttcctgttcccgacttttatagctctcgggctagcattgcctag

SEQ ID NO: 245214 - DNA, 2409 bp, Artificial Sequence
  Description of Artificial Sequence: Synthetic coding sequence
atggaagagatggaggaagaattaaagtgccccgtgtgtggaagtttttaccgtgaacctataatcctgccctgctcgcacaatctttgtcaggcctgtgcgaggaacatcctcgtgcagaccccggagagtgagagtccacaatctcacagggccgctggaagcggtgtgagtgattacgactacctggatcttgataagatgtccttatattccgaagccgattccggctacggctcctatgggggttttgcctctgctcctacgacaccatgtcagaagtcaccaaacggcgtgcgtgtgttccccccagcaatgccaccaccagctactcacctcagccctgccctggccccagtgcccaggaactcctgtataacttgtccccagtgtcaccggtctctgatcctggatgacaggggcctaagaggctttccgaaaaaccgggtgttagagggagtgatcgaccggtaccagcagagtaaggctgctgccctcaagtgccagttatgtgaaaaggctcccaaggaagcaactgtaatgtgtgagcaatgcgacgtgttctactgtgatccatgtcgcttgcggtgtcatccgccaaggggacccctggcgaaacataggcttgttccgcctgcccagggtcgcgtttcacgaagactctctcccagaaaggtctcaacctgcacggatcatgagttagagaaccatagcatgtactgcgtccagtgtaagatgccggtgtgttaccagtgcctggaggaaggtaagcacagctcccacgaggtcaaggcactgggggcaatgtggaaactccacaagtctcaactctctcaggccctaaatggtctttccgatagggccaaagaagccaaggagttcttagtgcagcttagaaacatggtgcaacagatccaagaaaacagtgtcgaattcgaggcctgcttggtggcccagtgtgacgctttaattgatgcccttaatcgccgaaaggcacagttacttgccagggtgaataaggagcacgaacacaagctcaaggtagtgagggatcagatcagccactgcaccgtgaagttacgtcaaactaccgggctaatggagtactgtctggaggtgataaaagagaatgacccttccggctttctgcagatctcagatgccctcattaggcgggtccatctgaccgaggatcaatggggtaagggtaccctgactccgagaatgacgaccgactttgatctctctttggataactctcctcttctccagagtatccatcaacttgactttgtccaggtgaaagtgcctgccaccccaattctgcagctggaggagtgttgtacccataacaacagtgccacgcttagctggaaacaacccccactgtccaccgtgcccgctgatggttatatccttgaattggatgacgggaacggtggtcaatttagagaagtttacgtcgggaaggaaacaatgtgtaccgttgacgggctacactttaactccacatacaacgctcgggtgaaggccttcaacaagacaggcgtatccccctactccaaaactttggtgctgcagactagcgaggacacggatagcgaagagcagactttaccctttcctgtcccgagtgaacgattacccctgcgacgcatgtctcctttctcatccactttgaacttacagccgtcattcccgggaaggtcctacttcgacttccgatcgtccccgcaccagctcagcttgcacagctccctccagtccctcaacgccccaggctgtaatttcgagactcaatcagcgccttactctcagcttgtggacatcaaaaaattactggctgtggcctggtttgcgtttgatccaggcagtgctcacagcgatattatcctgagcaacgataacttgaccgtgacctgcagctcgtacgatgatcgtgtcgtgctgggcaagacagggttctccaagggaatccactattgggagcttaccgttgaccggtacgacaaccatcctgaccccgcattcggagtggccagaatggatgttatgaaggacgttatgctaggtaaagatgacaaggcctgggcaatgtacgtggacaacaaccgatcctggttcatgcacaataatagccacaccaatagaacggaaggagggatcactaaaggggctaccataggcgtgctcctcgatcttaatcggaagaacttgacctttttcattaacgatgagcagcagggacctatagcttttgacaacgtggaggggctctttttcccagcagtatccctaaaccgcaacgttcaggtgtcgacactgcctctccgattaaacagctgttgctggcttcctgtccagcggttgccacgggctgtccaatcaaacagacgagagggcagttag

SEQ ID NO: 245215 - DNA, 1653 bp, Artificial Sequence
  Description of Artificial Sequence: Synthetic coding sequence
atggaggaaatggaagaggaacttaagtgtccggtatgcggttctttttacagggaaccaatcattctgccctgttctcataatttgtgtcaggcttgcgcccgaaacatccttgtgcagacccctgaatcggagtctccacagtctcaccgcgcagcaggctccggcgtgtcagattacgactacttagatctcgataagatgtccttgtacagcgaagcagattcgggatacggaagctatggagggtttgcctctgcccctaccacgccttgccagaagtcacctaatggcgtacgtgtgtttccccctgctatgcctcctcctgcaacccatctgtcccccgcactggccccagtcccaagaaactcatgtattacttgcccacagtgccacaggtcactgatcctcgacgatcgcggattacggggtttccctaagaatcgggttcttgaaggggttatagaccgttatcagcagtcaaaagcagccgctcttaaatgccagctgtgtgagaaggcccctaaagaagcgactgtgatgtgcgagcagtgcgacgtcttctactgtgacccgtgtagactgcggtgtcacccacctcgtggacctctggccaaacaccgcctggtcccacccgcacagggccgagtctccaggcggttgagccctcgaaaggtctctacatgcactgatcacgaactagagaatcatagtatgtactgtgtacagtgcaagatgccagtgtgctaccagtgccttgaggagggcaagcactcatcccacgaagtaaaagcgctaggagctatgtggaagcttcataaatctcagctctcacaggcactcaatggactcagcgacagagctaaggaggctaaagagttccttgtccaactgcgtaacatggtccagcagatccaggaaaattctgtggaatttgaagcgtgtttggtcgcccagtgtgacgcgctcattgatgctctcaatcgcaggaaagcacagttactggctcgggtgaataaggaacatgagcacaaactgaaagttgtccgcgatcagataagccactgtaccgttaagctccgccaaactactggtctcatggagtattgcctggaagttataaaggagaatgacccctcagggtttttgcagatcagcgacgctctgattagaagggtgcacctaaccgaagatcaatggggaaagggaaccctcactccaagaatgactaccgacttcgatctgtcactggacaattcacccctgcttcaatccattcaccagctggactttgtccaggtgaaagcatccagtccggttccggcaacccccatcctgcaactggaagagtgctgtactcacaataattccgcaacactgtcatggaagcagccccctttaagcaccgtgccggcagatggatatatcctcgagttagacgatggcaatggcggacagtttcgagaggtgtacgtcggtaaggagacaatgtgtaccgtggacgggctgcatttcaactccacctataatgccagggtgaaagcattcaacaagaccggggtgtccccatactccaaaaccttggtgttacaaacaagcgagggtaaagcactccagcagtatccctctgaacgggagctgagaggaatttag

SEQ ID NO: 245216 - DNA, 3750 bp, Artificial Sequence
  Description of Artificial Sequence: Synthetic coding sequence
atggctaccgctgcaacagaagaaccgttcccctttcacgggctgttgcccaagaaggagacgggcgctgccagttttttgtgcagatacccggaatacgatggacggggagtccttattgcggtgctggatacgggggtggaccccggagcccctgggatgcaggtcacgacagacggtaagccaaagattgttgatatcattgataccactggatccggagacgtcaatacagcaaccgaggtggagcctaaggacggagagatcgtcgggctctctggtcgcgtcctaaaaatcccagccagctggaccaacccctccggcaagtaccatatcgggattaaaaacggctacgacttctacccaaaggcgctcaaggaacgtatacagaaggagcgcaaggagaagatctgggacccggtgcacagagtggccctggccgaggcttgccgtaagcaagaggagttcgacgttgctaataatggttcttcacaggctaataaactcattaaggaagaactgcaatctcaggtggagctgctcaatagttttgagaagaagtactccgaccccggacctgtgtatgactgcctcgtgtggcatgatggggaagtgtggagggcttgcattgactcaaatgaggatggagatctgagtaagagcaccgtgctgcgcaactacaaggaggctcaagaatacgggtctttcgggactgctgagatgctcaactactcggtgaatatctatgacgacggaaacctgttgtcgatcgtaacttcaggaggcgctcatggtacgcatgtagcttcaattgcagcgggacacttccccgaggagccagagcgcaacggtgtggcaccgggagcacagattctgtcaatcaaaattggcgatactagattatcaactatggaaaccggtaccgggcttatccgcgcaatgatcgaggtgattaaccacaagtgcgaccttgtgaactacagctatggagaagccacccactggcccaattcagggagaatctgcgaagtcatcaacgaagcagtgtggaagcacaacatcatttatgtgagctctgcagggaataatggtccctgcctctcgactgttgggtgccccggaggaaccacctcctcggtgataggcgttggagcttatgtttcaccggacatgatggtagctgaatatagtctgcgcgaaaagcttccagcaaatcagtatacctggagctcacgcggacctagcgccgatggcgctctcggtgtgtcaatatcagcacctggcggagctattgccagtgtgcccaactggaccctacgtggcacgcagctcatgaatggaaccagcatgtccagccccaatgcatgcggagggatcgccctgattctgtccggcctgaaagccaacaatatagattacactgtccactccgtacggcgagccttggagaataccgcggtaaaggccgacaacatcgaggtatttgcccagggccacggtataatccaggtggataaagcctacgattatctggtgcaaaataccagcttcgctaacaaattggggttcaccgtaacagtggggaataatcgtggcatttatctacgggaccccgttcaggtggctgctcccagcgatcatggtgtgggcatcgagcccgtatttcccgaaaacaccgaaaacagtgaaaaaatatccctgcagctgcacttggcattaaccagcaactcctcctgggtgcaatgcccgtcacacttagaactcatgaatcagtgcaggcacatcaatatccgagtcgatccccgaggcctgagggagggactgcattacaccgaagtgtgtggttacgatattgcctctcctaacgccggtccactgttccgcgtgccaattacagctgtgattgctgcaaaggttaacgaaagcagccactacgatctcgcattcaccgacgtccacttcaagcctggccagattaggaggcatttcatcgaagttccggagggcgctacctgggccgaggtcactgtatgctcttgctcttccgaagtatctgctaaatttgtactccacgccgtacaactggttaagcagcgggcttaccggtcccatgaattctacaaattttgcagcctccccgagaagggcactctgactgaggccttcccagtgctcgggggaaaggccatcgagttttgcatagctcggtggtgggcctctctgtcggacgttaatatagactacaccatctcatttcatgggattgtctgtacagcaccccagctgaacatccacgcaagcgagggcatcaaccgtttcgacgtccagtcgtccctaaaatacgaggatctggccccttgtattacactgaaaaactgggtgcagacactgcgacccgtctccgcgaagactaaacctctcggctctagggatgttctaccaaacaaccgacagttgtatgagatggtccttacatataacttccaccagcctaaaagtggagaagttacaccatcatgcccgttgctttgcgaactgctttacgagtccgagttcgactcgcagctctggatcatttttgaccagaataaacgtcaaatggggagtggtgacgcttacccacaccagtacagcctgaaactggaaaagggcgattataccatcagattgcagatccgtcacgagcagatatcagacctagagagactgaaggatctgccgtttattgtctctcacagactgtccaacaccttgagcctggacatacatgagaatcattcattcgcactcctaggcaaaaagaagtccagtaacctcacccttccgcctaaatacaatcagccgttcttcgttacaagtcttcctgatgataaaattcccaaaggggctggtcccggttgctacctggcaggaagcctcacactcagcaaaacagagctgggaaagaaggctgatgtcatccctgtgcactactatctgattcccccaccaaccaaaaccaaaaacgggagcaaagataaggaaaaagacagcgagaaagagaaggatcttaaagaggaatttacggaggcgctgagggatttaaaaatccagtggatgacgaagctggattcatcagatatctataacgaacttaaggagacatatccgaactatctccccttatatgtggctcgactccatcagttggatgcggagaaggaaaggatgaaacgcctcaatgaaatcgtggatgccgctaatgcagtgatttcccacatcgaccagacagctctggccgtgtatatagcaatgaaaacagatcctcgcccagacgcagctacgatcaaaaatgacatggacaagcaaaagtctaccttagtagatgctctctgcaggaagggttgcgcgttggctgaccatcttctccatacacaggcccaggacggcgcaatttcaactgacgcggagggcaaggaggaggagggcgagtcgcctttggacagtctagctgagacgttttgggagacaactaagtggaccgacctcttcgataacaaggtcttgacattcgcatacaagcatgccctggtgaataaaatgtatggtagaggattgaagtttgctacaaaactagtagaggagaagcctacaaaagagaactggaagaattgcattcaattgatgaagctccttggatggacgcactgcgcatcattcactgagaattggctaccgattatgtatccaccggattattgtgtgttttag

SEQ ID NO: 245217 - DNA, 1791 bp, Artificial Sequence
  Description of Artificial Sequence: Synthetic coding sequence
atgctacccagccaagcacagggcctgctctggtgggtttttcccctctttcctgcctcgtctttatcatatccccctgtgtcgtatcgagcggacgggttagccaggaacacatttcttaaagcttgcagtgagtccagcagctcaagtaacatctctacaatgctggtgacccatgactacaccgctgtgaaagaggacgagatcaacgtttaccaaggagaggtggtgcagatcctcgcatccaaccaacagaacatgttcctcgtcttcagagccgcaacagatcagtgccccgctgcagagggttggatcccgggatttgtgctcggccacaccagtgcagtgattgttgaaaacccagatggtactctgaagaagagcacaagttggcacacagccctgcgccttcgaaaaaagagcgaaaaaaaggacaaagatggtaagagggagggcaaactggagaacggctaccgcaagtcacgtgagggtctctcaaacaaggtatccgtgaagctgctcaatccaaactacatctacgacgtgccacctgagttcgtcatcccgctttccgaggtgacatgtgagaccggagagaccgttgtgctgcgatgcagagtgtgcggaagacccaaggctagcataacctggaagggccctgaacacaacactctgaacaatgacgggcactacagcatctcctacagcgatcttggagaggccactctgaagatcgtgggcgtaaccactgaagacgacggaatctacacctgcatagctgttaacgacatgggtagtgctagctcatctgctagtctgcgggtactgggacctggaatggatggtataatggtgacttggaaggataacttcgattccttctattccgaggtggcagaactggggcgtggaaggtttagtgtggtgaaaaaatgtgatcagaagggcactaagagggcagtggccaccaaatttgttaacaaaaaactcatgaaacgagatcaggtgacccacgaactgggaatcctgcagtctctgcagcatcccttactggtcggccttctggacacctttgagacgcccacctcctacattcttgtgcttgagatggccgatcagggcagactgttggattgtgtagtgagatgggggagtttaaccgagggaaagattagggcgcacctgggtgaggtcttagaggcagtgcgctacctgcacaactgcagaatcgctcacctggacctgaaacctgagaacatcttggtggacgaatcactggccaagcctacgatcaaacttgctgatttcggcgacgccgttcaactgaacaccacctactatatccaccagctgctgggcaaccctgagtttgctgccccagagattatcttggggaacccagtgtctctcacatcagacacctggagtgtcggtgtgctaacttacgttctgctgagtggcgtatccccttttcttgacgatagcgtggaggagacctgtctcaacatctgtcgcctcgactttagctttccagacgactacttcaaaggagtgagtcaaaaggctaaagagtttgtatgtttcctccttcaggaggacccagccaagcgtccttctgcagcactcgccttacaggaacagtggctccaggctggcaatggcaggtccacaggcgtgctggacacttcccgccttacttctttcattgagagacggaagcaccagaacgatgttagacctatcaggagtattaagaatttcctccagtctcgcctactacctcgggtctag

SEQ ID NO: 245218 - DNA, 9293 bp, Artificial Sequence
  Description of Artificial Sequence: Synthetic coding sequence
atgagcggctcctctggcggtgcagctgccccagccgcatcgagcggaccggcagccgctgcaagcgcagctgggagtgggtgtggtggcggtgctggggagggtgcagaggaggctgctaaggacctcgcggatattgctgctttctttcgctcaggtttccggaaaaatgacgagatgaaggccatggatgtgctgccgattttgaaggaaaaagtggcctatctgtcaggaggcagggacaaaagggggggtcccattcttacgtttccagccaggtcaaaccacgataggatccgacaagaagacctgaggaggttgatctcctatcttgcctgtataccctcggaggaagtgtgcaagagggggttcacagttattgtggacatgcggggaagcaaatgggatagcattaagccccttctcaaaattctgcaggaaagtttcccgtgttgtatccatgtggctctgataataaagccagataacttttggcaaaaacagcgaaccaattttgggagtagtaagttcgaatttgagacaaatatggtgtcgctcgaggggctgacaaaggtagtcgatccttcccagttgacgcctgagttcgatgggtgtctggagtacaatcacgaagaatggatcgagattagggtggcgtttgaggattatatttccaacgcaacccacatgctgtctcggcttgaggaactgcaggacatccttgctaaaaaggaactgccgcaggacctggaaggggctagaaacatgatcgaagagcactcccagttaaaaaagaaagtgattaaagccccaatcgaggacctagacctcgaaggtcaaaagctcctgcagagaattcagagctccgaatcatttccgaagaagaattccggtagcggcaacgcagatctgcagaatttgctgcctaaggtcagcaccatgctggacagacttcatagtacacggcagcatcttcaccagatgtggcatgttcggaaattgaaacttgatcagtgttttcagttaagacttttcgaacaagatgccgagaagatgttcgactggatcacacataataaagggctgtttctcaatagctacacggagattgggacctcccatccacacgcaatggagctgcaaactcagcacaaccattttgctatgaattgtatgaacgtctatgtgaatatcaaccgcatcatgtctgtcgccaaccggctggtcgaaagtggacattacgcctcccaacagattcgccaaatcgccagtcagctcgagcaagaatggaaggcctttgcagctgcccttgacgagcgctccaccctgctggacatgtcctctatattccatcagaaagctgagaaatatatgagcaatgtcgacagttggtgtaaagcctgtggagaggtcgacttgccatccgagctgcaagaccttgaggatgccatacaccatcaccaaggaatttacgagcacattaccttggcctatagtgaagtgtctcaggacgggaagagcctgctcgacaaactgcagaggcctctcaccccagggtcttccgactccctgacggcctctgcaaattactccaaggccgttcatcatgttcttgacgtgattcacgaggtcttacatcaccaacggcagttagagaacatatggcagcacagaaaggtccgcctgcatcaacgcctgcaactgtgtgtgttccagcaggatgtgcaacaagtgctggattggattgagaaccacggggaggcctttctcagtaagcacacaggcgtcggtaagtcactccaccgggcacgtgccctacagaagcgccacgaggacttcgaggaggtcgctcagaatacgtacactaacgctgacaagctgctcgaggcagccgaacagctggcccaaaccggcgaatgtgatcccgaggagatctatcaagccgcacaccagctggaagaccgcatccaggacttcgtacgacgcgtcgagcaacggaagatccttctcgatatgagcgtttccttccatacacacgtgaaggaactgtggacgtggctggaagagctgcagaaagaactcctcgacgacgtatatgcagaaagtgtcgaggctgtacaggatctaattaagcgcttcggtcaacagcagcagactacactccaggtgaccgtgaatgtgatcaaagaaggggaggatctgattcagcagctgcgcgactccgccatttcatccaataagacaccacacaacagctcaattaaccatatagagacagtgctgcagcaacttgacgaagcccagagccagatggaagagctgtttcaagaaagaaagatcaagctggaactgtttctgcagctcagaattttcgagagagacgccattgacattatctctgatctcgagtcgtggaacgatgaactgtcgcaacaaatgaatgactttgacaccgaggatcttacgatcgcagaacagcggctgcagcatcacgcagacaaggccctgactatgaataacctaaccttcgatgtgatacaccagggccaagaccttctccagtacgtaaatgaagttcaggcatccggggttgaactgctttgcgacagggacgtcgatatggcaacgcgcgttcaggatcttctcgagtttctacacgagaaacaacaggagctggacctggccgctgagcagcatagaaagcacctggaacagtgtgtgcagcttcgtcacttgcaagccgaagtgaagcaggtcctgggatggatccgcaacggagagagcatgttgaatgccggactgattacagcaagctcccttcaagaggctgaacagctccagagagaacatgagcagttccagcatgcaatcgaaaagacccatcagagcgccttacaagttcagcagaaagctgaggctatgttacaggcaaatcattacgacatggacatgattagggactgtgcagagaaagtggcctcgcactggcagcagttaatgctgaaaatggaggacaggctgaagttggtgaatgcctctgtcgctttctacaagacgagcgagcaggtttgttccgtgctggagagtctcgagcaggaatacaagcgcgaggaggattggtgtggtggagccgataagctgggaccaaactctgagaccgaccatgtaacccccatgatttcgaaacacctggagcagaaagaagcattcctcaaggcctgtacactcgctagacggaacgctgacgtgtttcttaaatatttacacaggaatagcgtgaacatgcccggaatggtgacgcatataaaggcccctgaacagcaagtgaagaacattctaaacgaactatttcaacgggaaaaccgggtcctgcattattggaccatgcgcaagagacggcttgatcaatgtcaacagtacgttgtcttcgaacgttctgcgaagcaggcactggaatggattcatgataatggagagttttatctgagcactcacacgagcacagggtccagtattcaacacactcaggaactcttgaaagaacacgaggagttccagattactgcaaagcagacgaaggagcgcgtgaagttactcatccagctggctgacggattctgtgaaaaaggccatgcccatgcagcggaaattaaaaaatgcgtgactgccgtcgataagagataccgcgacttcagtcttaggatggaaaaatatcggacctccctcgaaaaggccctcggaatatcatcagattccaacaaatccagtaagagcctgcagctcgatattatcccagccagcatccctggtagcgaggtgaaattaagagacgccgctcatgagctgaacgaagagaaaagaaagagtgccaggagaaaggagtttattatggcagagctcattcaaacagagaaggcatacgtccgggacctgcgggagtgtatggacacttacctgtgggagatgacgtccggtgtggaagaaatcccgccaggaattgtcaacaaggagctgatcatcttcggcaatatgcaggaaatctatgagttccataacaatatattcttaaaggagctcgaaaaatacgagcaattgcctgaagatgtcggtcactgcttcgtcacatgggccgataagttccagatgtatgtgacatattgcaaaaataagcctgatagtactcaactaatcctcgaacacgctggctcctatttcgacgaaatccagcagagacatggattagctaactccatttcaagctacttaattaagccggtgcaaagaattaccaagtaccagctgctactgaaggaactgctgacctgctgtgaggagggtaaaggagaaatcaaagacgggctggaggtgatgctatcagtgccgaagagagctaatgatgctatgcacctctctatgctggagggattcgatgagaatattgagagccaaggcgaacttatccttcaagagagctttcaggtttgggatcctaagactctgattaggaaggggagagaacgccacctgttcttgtttgagatgagtcttgtttttagcaaggaagtgaaagattcctcagggagatcgaaatacctttataaatctaagctgttcacttccgaactgggagttaccgagcacgtggaaggcgacccatgtaagtttgccctctgggtcggacgcacacccacctcagataacaagatcgttctaaaagcaagcagcatcgagaataagcaggactggatcaagcacattcgggaggtgatccaagaaagaaccattcatctgaagggagcgctaaaagagccgatccacatccctaaaaccgccccagctacaaggcagaagggcaggcgcgatggcgaggatctggacagccaaggcgatgggagcagccagcccgacacgatttctatagcgagtagaaccagccagaataccctcgattcagataaactttccggtggctgtgagctgaccgtcgttattcatgatttcactgcctgcaactccaatgaacttactattcgaaggggccagactgttgaagttctggagagacctcatgacaaacccgattggtgcctcgtgcgcacaactgacagaagtcctgcggctgaaggccttgtcccatgcggcagcttatgcatcgcacactcccggagctccatggaaatggagggaatattcaaccataaagattctctcagtgtgagtagtaacgatgctagcccacctgctagcgttgcgtccttgcaaccccacatgattggtgcccagagttcaccaggtcctaagagacccggaaacacgcttagaaagtggctgacctcacctgtccgcagactgtcttccgggaaagcagatggacacgtgaaaaagttagcccacaagcataagaaatctagggaggtgagaaaaagtgccgacgccggatcacagaaagatagcgatgacagcgccgctacaccacaggatgagactgtggaggaacgaggaagaaatgagggcctgtccagtgggacactgagcaagagcagcagctccgggatgcaatcttgcggcgaggaggaaggggaggaaggagctgacgcagtgccgctgcctcctccaatggctattcagcagcatagcctccttcagcccgatagccaggatgataaagcttcatctcgcctgctggttagacccacatctagcgagaccccgagcgctgcagaactagtctcagccattgaggagcttgttaaatccaaaatggccctggaagacagaccttcttcactattggtagaccagggtgattcctcctctccttcgtttaatccatcagataattctctgctgtcttctagttccccaattgacgagatggaggagagaaaaagttcttctttaaagaggcggcattacgtcctacaggaactggtagagactgaaagagattatgtgcgagacctgggctacgtggtagaaggatatatggctctgatgaaggaggatggagtccctgacgatatgaagggtaaggacaaaattgtatttgggaatattcaccaaatctacgattggcacagagatttttttttgggagaattagagaagtgtctagaggacccagagaagttgggttctctgtttgttaaacatgagagaagactgcatatgtatattgcctactgtcagaacaagcctaaatccgagcacattgtgtccgagtacatcgacacattctttgaggacctaaagcagaggttagggcaccgactgcagctcaccgacttgttaattaagcctgtgcaaagaatcatgaaatatcagttactcttgaaggacttcctcaaatactctaaaaaagcttcgctcgatacttccgagctcgagagagccgtcgaggtgatgtgcatcgtgcccaggaggtgcaatgacatgatgaatgtcggtagacttcagggatttgatggtaagattgtagcacaaggtaagctcctgctgcaagacaccttcctcgtgactgaccaggatgcgggattgctgcctcgttgcagggaaagacgaatcttcctgttcgaacagatcgtgatcttttctgagcccctagacaagaaaaaagggtttagcatgccaggtttcctattcaagaattccattaaagtgagttgtctgtgcctcgaggagaatgtggaaaatgatccatgtaagttcgctcttacgtccaggaccggcgatgttgttgagacgtttatcttgcattcaagctctccgagtgttcgacaaacttggattcacgagattaaccaaatcttggaaaaccagaggaatttcctgaatgcgctgacctctccgattgaataccagcgtaatcattcaggcggaggcggtgggggtggatcaggtggcagcggtggaggtggcggatcaggcggtggaggagcccctagcggtggatcaggacacagcggaggtccgtcgtcttgcggaggcgctcccagtacctcaaggagtaggccttcccgcatcccacagccggtccgccatcaccccccagttctcgtgtcgtctgccgcaagctcgcaggcagaagccgataagatgtccggtacgagtaccccgggaccctctctgcccccacctggagccgctccggaagccggaccttccgccccttccagacgaccacccggagccgatgcagagggtagcgagcgagaggcggagcctattcccaagatgaaagttctggaatccccccgaaaaggggctgccaacgctagtggctcttcaccagacgcccctgcaaaagatgctcgtgcctcactcggtaccttgcctctggggaagcctcgtgcgggtgccgcatctccattgaactcgcctctgtctagtgccgttccttccttgggcaaggagccctttccaccttccagccccttgcagaagggcggatccttctggtctagcattcctgcctccccagccagccggcctggcagcttcacgtttccaggagattccgattccctgcagcggcagacccctaggcacgcggctcctggaaaagataccgataggatgtcaacgtgttcctccgccagtgaacagagtgtacagtccacgcagtctaatggttccgaaagtagttccagctctaacattagtaccatgttggtaacacacgactacacagccgttaaagaggacgagattaatgtgtatcagggagaggtcgtgcaaattttggcctccaaccagcagaacatgtttctggtcttccgcgctgcaactgaccagtgccctgccgctgaaggttggatccccggtttcgtgttaggccataccagtgccgttatcgttgaaaatcccgacgggactcttaagaagtcgaccagctggcataccgctctgaggttgagaaaaaaaagcgagaagaaggataaagacggcaaaagagaaggtaagcttgagaatggctatcgaaaaagtcgtgaaggacttagtaacaaggtgtcggttaagctgcttaacccgaattatatttacgatgttcccccagaattcgttatccctttatctgaggtgacgtgcgaaaccggggagactgtggtgcttaggtgtagagtgtgcggaaggccgaaagcctcgatcacctggaaagggccagaacacaacacattaaacaatgacggtcactattcgatttcctatagtgatcttggtgaggccactcttaagattgtgggcgtgactaccgaagatgacggtatctatacttgcatcgcagtgaacgatatgggcagtgcaagctcctccgcgagtctgcgggttctgggacccggaatggatggcataatggttacgtggaaggacaacttcgactccttctattctgaagtggctgaattgggcaggggtaggttctctgttgtcaagaagtgcgaccagaaagggacaaagagagccgtggcgactaagtttgttaacaagaaacttatgaaacgggaccaagtgactcacgagctgggcatcctccagagcctgcaacatcctctgctggtcgggctgctggacaccttcgagacccccactagttatatcttagtgctcgagatggctgatcagggaaggctattagactgcgtcgtgcggtggggatctcttacagaggggaaaattcgggctcacctgggtgaggtcttagaagcagtgcgctatttgcataactgccgcattgcacacctcgaccttaaacctgaaaacattctcgtcgacgagtccctggccaagcccacaatcaaactcgccgattttggtgatgctgtacagctaaacacgacgtattatatacatcagctgctggggaatccagagttcgctgcccctgaaattatcttggggaacccggtaagtctgacctccgatacctggagcgtgggcgtccttacatacgtgttactcagtggcgtgagcccatttctagacgactctgtggaggagacatgcctcaacatttgccgcctggatttctcattccccgacgactactttaaaggtgtgagccagaaggctaaggagtttgtgtgctttctgctccaggaggatccagccaagagaccgtctgcggcactggccctccaggagcagtggttgcaggcaggcaacggaagatctacaggtgtgctggacacgagcagactgacttctttcattgagagacggaaacatcagaacgatgttaggccaattcgcagtatcaaaaactttctgcagagcaggctactgcctagggtata

SEQ ID NO: 245219 - DNA, 7502 bp, Artificial Sequence
  Description of Artificial Sequence: Synthetic coding sequence
atgctggacaggctgcactcaactcgacaacatctgcaccagatgtggcatgtgagaaaactaaagttggatcagtgtttccaacttaggctcttcgagcaagacgccgagaaaatgttcgactggatcactcacaacaaggggttattcctgaactcatatacagagattggcacttctcatcctcatgctatggagctgcagacacagcacaatcatttcgcaatgaactgcatgaacgtgtatgtgaacattaacagaattatgagcgtagctaataggcttgtggagtccgggcactatgcctctcagcagatcagacagatagcaagtcaactggaacaggaatggaaagcttttgccgctgcactggatgagagatctaccctgctggatatgagtagtatctttcaccaaaaggccgagaagtatatgagcaacgtggattcatggtgcaaagcttgtggggaagtagatctgcccagtgagctgcaagacctggaggacgccatccatcaccatcaggggatatacgagcatattacgctggcatacagcgaggtgtcgcaggatggtaagagcctcctcgataagctgcagagaccgctcacacctggatccagtgattctctgaccgcaagcgcaaactacagtaaggccgtgcatcacgttctggacgtgatccatgaagtgctgcatcaccagaggcagctggagaacatttggcagcaccgaaaggtgcgcctacaccagagactgcagctctgtgtgttccagcaggacgtgcagcaggttctcgattggatcgaaaaccatggagaggcgttcctcagcaagcacaccggagtaggcaaatccctccatcgggcacgcgctctgcaaaagcgtcacgaagatttcgaagaggttgctcaaaacacatacaccaacgcagataagttgctggaagccgctgagcaattagctcagaccggcgaatgtgatcctgaggaaatttaccaggcggctcaccagctggaggataggattcaagacttcgtcagaagggtcgaacagcgaaaaatcttgttggacatgagcgtgagcttccatacccacgttaaggaattgtggacttggctcgaggaacttcagaaagaactgctcgatgacgtgtacgccgaatccgttgaagccgtgcaagatctgataaagcgatttggccaacagcagcagacaaccctacaggtaaccgtgaacgtgatcaaggagggtgaagatctcatccagcagctccgcgatagtgctatcagctcaaacaagacccctcataatagttctattaaccacatcgaaactgtgcttcagcagttagatgaggctcagtcgcagatggaagagctgtttcaggagcgaaagatcaagctggaattgtttctccaactacggatattcgaaagggatgccattgatatcatttcagacctcgaatcttggaatgatgagctctcacagcagatgaatgacttcgacacagaggacctgaccatagccgaacaacgacttcaacaccacgccgataaagccctgactatgaacaatctgaccttcgacgtgatccatcagggccaggacctcctacagtacgtgaatgaagtgcaggcctctggcgtggagctgctgtgtgaccgcgacgtggatatggccacaagagtccaggaccttctcgaatttctgcatgagaaacaacaggagttggatctggctgctgaacagcatcggaagcacctggaacagtgcgtccagctaagacacctccaggccgaagtgaaacaggttcttggatggattcgaaacggagagtccatgcttaatgcagggctgatcactgcaagctcgttacaggaagccgaacaactgcagagagagcatgagcagtttcaacacgccattgaaaagacacaccagagcgccctgcaggttcagcagaaagccgaggccatgctccaggcaaaccattatgatatggacatgattcgagactgcgccgaaaaagtggctagccactggcagcagctcatgctgaaaatggaggaccggttaaaactggtgaatgccagcgttgccttttacaaaactagcgagcaggtttgctctgtcctcgaaagcctggaacaggaatataaacgcgaggaagactggtgcgggggagcggacaagctaggtcctaattctgagactgaccacgttacccccatgatcagcaaacatctggagcaaaaggaggccttcttgaaagcctgtactctggcaaggagaaacgcagacgtgtttctgaaatatttgcaccggaattctgtgaatatgccgggtatggtaactcatattaaagcccctgaacagcaagtcaagaacatcttgaacgagctgtttcagcgagaaaacagagtgctacattattggaccatgaggaagcggagactggaccaatgtcagcagtatgttgtctttgagaggtccgccaagcaagcacttgagtggatccacgataatggcgagttttacctttccacacacaccagtaccggcagctctatccagcacacacaggaactcctaaaagaacacgaggagtttcagatcacagcaaagcagaccaaagagcgcgtcaagcttctgatccaactagccgatgggttttgcgaaaaaggtcatgcacacgctgcagagatcaaaaaatgtgtgacagccgtggacaagaggtatcgtgatttctcgctgcggatggagaagtaccggacttccctcgagaaagcgctggggatatcgagcgattccaataagtcgtccaagagccttcagctggacattatccctgcatctatcccaggctcggaagtaaagctcagggacgccgctcatgagctaaatgaagagaagcgcaaatcagctagaagaaaagaatttatcatggccgagttgatccaaacagagaaggcctacgttcgggatttacgggagtgcatggacacttatctttgggaaatgacatcaggcgtcgaagaaattccccctgggatcgttaacaaggaactaattatctttgggaatatgcaggaaatttatgagttccataacaacatcttcttgaaggagctcgaaaagtatgagcagcttcctgaggatgttgggcattgcttcgtcacatgggccgataaatttcagatgtacgtgacttattgtaaaaacaagccggattcaacccagcttatattagaacacgcaggttcgtatttcgatgaaatccagcaaagacatggcctcgctaacagcattagtagctatttgatcaaacccgtgcagcgtattacaaagtatcaattgctccttaaagagctgctgacctgttgtgaggagggaaagggtgagataaaagacggcctcgaagttatgctgtctgtgcctaaacgcgctaatgacgctatgcacctgtcgatgctcgaggggttcgacgagaacatagagtcccagggcgaactgatactgcaggagagttttcaggtgtgggatccgaaaaccctcatcagaaaggggagagagcggcacctgttcctgttcgagatgtcattagtcttctctaaggaagtcaaggacagtagcggcagatctaaatatctatacaagagcaaactgttcacatccgagctgggggtgaccgagcatgtggagggggatccttgtaaatttgccttgtgggtgggaagaacacctacatcagataacaaaatagtgctgaaggcctcttctatcgagaacaaacaggactggatcaagcatatccgagaggtcattcaggaacgcaccatccacctgaagggcgctctcaaggagccaattcatatccctaaaactgcccctgcaacacgccagaaagggaggagggatggagaagatctggacagtcaaggagacggcagttctcagcccgacacgatatcgatcgcctcacgtacttcccaaaacaccctggacagcgacaaattgtcaggcggatgcgagctgacagtagtgatccatgacttcacagcatgcaactccaatgaactgactatacgacgaggccaaacagtagaagtgctcgagaggccccacgacaaaccagattggtgccttgtccgcaccacggatcggagccctgccgctgagggcctggttccttgcgggtccctctgtattgcccattcccgctcatcgatggagatggaaggaatcttcaaccacaaggacagcctctcagtttcaagtaacgatgccagcccaccagccagcgtggccagtctccagcctcacatgattggagcccagtccagtccaggtcccaaacggccagggaacacacttagaaagtggctgactagccctgtccgtcgtttgagctcgggtaaggcagatggtcacgtaaagaaactcgcccataaacacaaaaagagtagagaggttaggaagtcagctgatgccggatcgcaaaaggatagcgacgactctgctgcaacccctcaggacgaaactgtcgaggagcggggacgaaacgaaggtctgagctctgggaccctgagtaagagttccagttcagggatgcagagttgcggagaagaggaaggcgaggaaggcgcagacgccgttccactgcctccaccaatggccatacagcagcacagtctcctgcagcctgattcccaggacgacaaggcaagttctcggttacttgtcagaccaacaagtagcgaaactccttccgctgcagaattggtgtctgcaatcgaggagctggtgaagagtaaaatggccttagaggacaggcctagtagcctgttggttgaccaaggcgactcttccagtccatctttcaacccttctgacaattccttactatccagttcttcccccatagatgagatggaagagcgcaagagcagctccttaaagcgcaggcactatgtattacaggaattagtggaaactgaacgcgactacgtcagggacctcggttacgtcgtcgagggctatatggcgctaatgaaggaagatggagttcctgacgatatgaaggggaaggacaagattgtatttggcaacatacatcaaatctatgactggcatagagacttcttcctgggggagcttgagaaatgccttgaggaccccgaaaaattaggtagcttgtttgtcaaacacgagaggaggctccatatgtacattgcctactgccagaataagcctaagtctgagcacatcgtgagtgagtacattgatactttcttcgaagatctgaaacaacggctgggacaccggttgcaactgacagatctgctaataaaaccggtccaacggattatgaagtaccagctcctgctcaaagattttcttaagtattccaaaaaggcctccctggacacgagtgagctggagcgtgccgtagaggtgatgtgcattgtccctcgccgttgcaacgacatgatgaatgtgggccgtctgcagggttttgacgggaagattgtggcacaggggaagctgctgctccaggacacttttctagtcactgatcaggatgcgggactgctccccagatgccgcgaacgtaggatatttctttttgaacagattgtgatcttttcagaaccactcgacaagaagaaaggcttctcgatgcccggtttcttgttcaaaaacagcatcaaagtgtcttgtttgtgtctggaggaaaatgtggagaacgacccctgcaagttcgcgctgacttctaggacaggcgatgtggtggaaacatttatattgcacagttcaagtcccagtgtcagacagacctggatccatgaaataaatcagatcttggagaatcagagaaactttctaaacgccttaacctcccccatcgagtatcagagaaatcactccggcggtggaggcggtgggggaagcggcggatcagggggagggggtgggtccgggggaggaggagccccatctggtggcagcgggcattccgggggtccatcgagctgcggtggcgcaccctccaccagtcgatcgcggccatcgagaattccacaacccgtccgccaccacccaccagtgcttgtttcgtcagccgcttcttctcaagccgaggcggataaaatgtctggaacttctacccccggaccaagtttacccccacctggcgcagcgcctgaggctgggccttcagcacctagccgcagacccccaggagctgacgccgagggctctgaaagagaggcggagcccattcccaaaatgaaggtgctcgagagtcccagaaagggagccgctaacgctagtggctcatcacctgatgcacccgcaaaagatgccagggccagtctcggcacactacccctggggaaacctcgggctggcgctgcctcccctctgaactccccactttcatcagccgttccatccttaggaaaggagccctttcccccttctagccccctacagaaaggcggttccttctggagttccatccctgcgtcaccagcctcccgtcctggctctttcacatttccgggtgactcggactccctccaaagacagactcctaggcacgctgccccaggtaaggataccgatagaatgtctacatgctcgtctgcttccgagcagtcagtacaaagcactcagtcaaatgggtccgaaagtagctcaagcagcaatatcagtactatgctggtgacccatgattataccgcagttaaggaagacgagattaatgtttaccagggtgaagtggttcagatcctggcctctaatcagcagaacatgttcctagtcttcagagcagccactgatcagtgcccagccgcagagggatggatcccaggatttgttctcggacacacctcggccgtgatagtcgaaaatcccgacggaacactgaaaaaatcgacaagttggcacaccgccttgaggttgagaaaaaaatcagagaaaaaggacaaagatggaaagagagagggaaaattagagaacggatatagaaagtctagggaaggtctgtcgaacaaggtgtctgtgaagctgcttaatccaaattatatctacgacgtcccccctgagttcgtcatacctctgagcgaagtgacttgcgaaacaggggagaccgttgtcctgcgctgccgagtgtgcggtaggccgaaagccagcattacatggaagggcccagagcataacacattaaataacgacggtcactactccatcagctacagcgacctgggcgaagctacactgaagattgtcggagtcaccacggaagatgacgggatttacacatgtatagccgtcaacgacatggggtcagctagtagctcagcgagcctcagagttctcggcccaggcatggacggaattatggtgacttggaaggacaatttcgatagtttttatagtgaggtggccgagctcggcagagctaattggaacaactggtccccatatta

SEQ ID NO: 245220 - DNA, 8765 bp, Artificial Sequence
  Description of Artificial Sequence: Synthetic coding sequence
atgtcgggctctagcgggggtgcggctgcccctgccgctagttcaggtcctgccgcagccgctagcgcagctgggtctggctgcggtggtggggcaggcgaaggcgctgaggaggctgctaaagatctggcagatatagccgctttctttcggagcggctttagaaaaaatgatgagatgaaagctatggacgtgcttccgattctcaaagaaaaggtggcttacctgtccgggggtcgagacaagagagggggacccatactcaccttccccgctaggtctaatcacgacaggatccgccaggaggacctgcggagacttataagctatctggcatgcatccctagtgaggaggtgtgtaaaaggggcttcacggttatcgtggacatgaggggttctaaatgggacagcattaagcctcttctcaagatcctgcaggagtcattcccctgttgcattcatgttgccttaatcattaagcctgataatttctggcagaaacagcggaccaactttgggagcagtaagttcgagttcgaaacaaacatggtgtctctggaaggcctgaccaaagtagtggacccatctcagctgacacccgagttcgatgggtgtctcgaatataaccacgaggaatggatagagattagggttgccttcgaggattacatctcaaatgcaacacatatgctcagtcggctggaggaactgcaagacatcttagctaaaaaggagctcccacaggacctggagggtgcacggaatatgatcgaggagcatagccagttgaaaaaaaaggtcatcaaagccccaattgaggacctggacttggagggtcagaagctccttcagcggatccagtcctctgagtctttccccaaaaagaacagtggaagtggcaatgctgacctgcagaatctgctccctaaagtttccacaatgttggacagactgcattctactagacagcacctgcaccagatgtggcacgtgcgaaagctgaagctggaccaatgttttcagcttcgcctgttcgaacaggatgccgaaaagatgtttgattggattacccacaacaaaggcctgtttctgaattcttacaccgaaattgggactagtcatcctcacgcgatggaactccagacacagcataatcacttcgccatgaattgtatgaatgtgtatgtgaacatcaacagaattatgagcgttgcaaatagactggtagagtccgggcattacgcctcccagcaaatccgccagattgcctcccagttagaacaggagtggaaagctttcgctgccgctttggatgagaggagcaccctactagacatgagctcgatatttcatcagaaggctgaaaaatatatgtccaatgtcgactcatggtgtaaagcctgtggcgaggtggacctgccgtctgaactgcaagacctggaggacgccatccaccaccaccagggcatctacgaacacattaccttggcgtattccgaggtttcccaagacgggaagtctctgttagacaagctgcagcgaccactgacaccgggttcttcggacagcctgactgcatctgccaactactccaaagccgtgcatcatgttctggatgttatccatgaagttttgcatcaccagcggcaactggaaaatatttggcagcatcgcaaggtccgcctacaccagcgcctccagctgtgcgtctttcaacaggatgtccagcaggttctcgattggatcgagaatcatggggaggcatttctgtccaagcatactggggtgggaaagtccttacacagagcccgagccctgcagaaaaggcacgaagacttcgaagaagttgctcaaaacacatacaccaacgcggacaagctccttgaagccgcagaacagcttgcccaaactggggagtgtgacccagaggaaatttaccaggcagctcatcagctcgaggacagaatccaagattttgtcaggagggttgaacagcgcaaaatccttctggacatgagcgtgtcttttcacacccacgttaaggaactgtggacttggctagaggagctccaaaaagagcttctggacgatgtgtatgcagagtctgtagaagccgtgcaggatttgattaagcggtttggacagcaacagcagacaacgctccaggtgaccgtgaatgtcatcaaggagggagaagatctgatccagcagttgcgcgacagcgctattagttcaaataaaacccctcacaattctagcattaaccacatagagactgttcttcagcagctcgacgaagcccagtctcagatggaggagctgtttcaggagcgcaagataaagctcgaactcttcctgcaactgaggatctttgagcgggatgctatcgacattatttctgacttagagagctggaatgacgaattgtctcagcagatgaacgatttcgacacagaagatctgaccatcgcagagcagcgactgcagcaccacgcagataaagcccttaccatgaacaatcttacctttgacgtgatccaccagggtcaggacctgctacagtacgtgaacgaggttcaggccagcggagtggagcttctgtgtgaccgcgatgttgatatggccacccgagtgcaggacctgttagagttcctgcatgaaaagcagcaggagttggatttggcggcagaacaacaccggaagcatctcgagcagtgcgtccagttgcgtcacctgcaggcggaggtgaaacaggtactgggctggattcgtaacggggagtcaatgctgaacgcaggacttataaccgcctcaagtcttcaggaggctgagcagttgcagcgagagcacgagcagttccaacatgcgatcgaaaagactcaccagagcgcgcttcaggttcagcagaaagctgaggcaatgctgcaggccaaccattatgatatggatatgatccgagattgtgctgagaaggtagcttcccactggcaacagctcatgctgaagatggaagatcgactcaagttagtcaacgccagcgtggccttttacaagacttccgagcaggtctgtagtgtcttggaaagtcttgaacaggagtacaagcgtgaggaagattggtgcggcggtgccgataagctgggtcctaactctgaaaccgatcatgtgacgcccatgatcagtaaacatctcgagcagaaagaggccttcttaaaagcctgcaccctagctcgacgcaacgccgatgtttttctcaaatacctccaccgtaatagtgttaacatgccagggatggtgacccacatcaaagcacctgaacagcaggtgaaaaacatcctcaatgagctgttccagcgtgagaaccgcgtcctgcattattggaccatgcggaaaaggcggctggatcagtgtcagcagtacgtggtgttcgaacgaagtgctaaacaggctctcgaatggatccatgataacggcgagttttacctttctacacacaccagcaccggcagcagcatccagcacactcaggagttgttaaaggaacatgaagaattccagatcaccgcgaaacaaactaaggagcgtgtgaaacttctgatacagctcgctgatgggttttgcgaaaagggccatgcccatgccgctgagattaaaaagtgtgttactgccgtggataagagatatagggacttctcattacggatggagaaataccgaacatcacttgagaaggcccttggcattagctcagattctaataagtcatctaaatcactgcagcttgatatcattccagcttctatcccaggctctgaggtaaaactgagggatgccgcacatgaactcaacgaagagaaacgaaagtctgccaggcgtaaagagttcattatggccgagcttatccaaaccgagaaggcctacgtaagggatctgcgcgagtgtatggacacctatttgtgggaaatgacgagcggcgtcgaggagatccccccagggatagtgaacaaggaattgatcatctttggaaatatgcaagagatctacgaatttcacaacaacatcttcctgaaggaattagaaaagtatgaacaattgcccgaagatgtaggacactgcttcgtgacatgggccgacaagttccagatgtacgtcacttactgtaaaaataagcccgatagtacccagcttattctagagcacgccggttcctacttcgacgagattcagcagaggcatggactggccaattcaatttcgtcttacttaattaaacccgtacagaggatcacaaagtaccagcttctgctcaaggaacttctgacctgctgcgaggagggaaagggcgagatcaaagatggacttgaggtaatgttgtccgtacctaagcgtgccaacgatgctatgcatctcagcatgctggaggggttcgacgagaatatagagagtcaaggcgaactcatcctgcaggagtcgttccaggtctgggaccctaaaacactgatccgtaaagggagggagagacacctcttcctgtttgaaatgtcccttgttttcagcaaagaggtcaaagattcatcaggacgtagcaaatacctttataagagcaagctcttcactagtgaactgggagtgaccgaacacgtcgagggggacccatgcaaatttgccctgtgggtgggtagaactcctactagcgataacaaaatcgttctaaaggcttcttcaatagagaacaagcaggattggattaaacacatccgggaagttatccaagaaaggaccatccatttgaagggagctttgaaagagcccattcacatacccaagacagccccagcaacccgccaaaaaggcagacgtgatggcgaggatctggattcccaaggcgacggaagctctcagcccgataccatttcaattgcaagtcgcacatcacaaaatacgctggactcagataaactgtcaggagggtgcgaattgacagtggtaatccacgactttacggcatgcaactcaaacgaactgaccatacgtcggggacaaaccgttgaagtgctagaacggccacatgataaacctgactggtgtctggtgcgcaccaccgataggtcaccagctgcagagggcctggtgccctgcggttcattgtgcatcgcccattcccgctcaagtatggagatggaaggcatattcaaccacaaggattctctgagcgtgtcctccaacgatgcaagtccgccagctagcgtcgcctccctccagccgcatatgatcggagcacagtccagcccgggacctaaaagaccaggaaatacacttcgcaagtggttgaccagccctgttcgtcgcctctcaagcggaaaggctgatggtcatgtcaagaagttagcacacaaacacaagaaatcacgggaggtcagaaagtccgcagatgccggatcccagaaagactctgatgattcagcagccaccccacaggatgagactgtcgaggagcgtggcagaaatgaagggttgtcatccggcacactatcaaagagctcctcttccggaatgcagtcatgcggggaagaggagggtgaagagggcgcagacgctgtgcctctgcctccacctatggctatccagcaacacagcctgcttcagccagatagccaggatgataaggcgagctctagactgctcgtcaggcctacttcatcagaaacgcctagcgctgctgaattggtgtcggccattgaagaattggtcaagtctaaaatggctttggaagaccgcccatcgtctctccttgtggaccaaggggacagttctagccctagtttcaatccttccgacaacagcttattatcctccagttcaccgattgacgagatggaggagcgaaaatcctcctcactcaagcgacggcactacgtgttgcaagagcttgttgagacagagagagactatgtgcgcgatttgggatatgtggtggaaggatatatggccctgatgaaggaggatggagttcccgatgatatgaagggaaaagataaaatagtgtttggcaatattcatcagatctatgattggcaccgtgacttcttcctcggcgagctggagaagtgtctggaggaccccgaaaaacttggatcattatttgtgaagcatgaaagaaggcttcacatgtacatagcctactgccagaacaaaccaaagagcgaacacattgtgagtgaatatatcgatacctttttcgaagacctgaaacagaggcttggccatagactacagctcaccgacctccttattaaaccagtgcagcggatcatgaaataccagctcctgctgaaagatttcttgaagtatagcaagaaagcttcactggatacttccgagcttgagagggcagtagaggtgatgtgtatcgtgcccaggaggtgtaatgatatgatgaacgtgggcaggttgcagggctttgacggcaagatcgtggcgcagggaaaacttctcctccaggacacatttctcgtaaccgaccaggatgccggactattacctagatgccgggaaagaagaatcttcctgttcgagcagatcgtcattttctccgagcctctggataaaaagaaggggttcagtatgcccggatttctgttcaagaattcaatcaaggtgtcgtgcctgtgtctggaagagaacgtggaaaacgatccttgtaaattcgcactgacctcccggactggtgacgtggtcgagacattcattcttcacagtagctctccttcagttcgccagacatggattcacgagatcaaccagattctagaaaaccaacggaactttctgaacgccctgacatctcctatcgagtaccagcggaatcacagtggagggggtggtggaggcggtagtgggggttccggcggagggggtgggtccgggggaggaggtgctccctcggggggatccggtcattcagggggtcctagtagttgcggcggagcaccatccacctcgaggtccagaccttcaaggattcctcaacctgtgcgccaccatccaccagtcttggtgtccagcgcggctagctcccaggctgaagctgacaagatgtccgagtccgagtcctccagcagttctaacatatcgaccatgctggtcacacacgattacactgctgtgaaggaggatgaaatcaatgtctatcagggcgaagtagttcagatactagccagtaaccagcagaatatgtttctggtctttcgcgctgccactgatcagtgtcccgcagccgaagggtggatcccgggtttcgtactaggccatacatctgccgtgattgtggagaatcccgatgggaccctgaagaaatccactagctggcacacagccctccgcctaaggaaaaagagtgagaaaaaggacaaggacggcaagagagaaggcaaactggagaacggctataggaagtcccgcgaaggtttgtcaaacaaggtgtcagtgaagcttctgaaccctaattatatctacgatgttccaccggagtttgtaatccccctcagcgaagtgacctgcgagaccggtgaaacagtcgtcctgagatgccgggtttgcggtcgcccaaaagcaagcattacttggaaagggccagaacataacacactgaacaacgatgggcactacagtatctcatacagcgacttgggcgaggcaacgctgaagatcgtgggcgtaaccacggaggacgatggaatctatacctgtatcgccgtgaatgacatgggtagcgcatctagttctgcaagcttaagggttctgggaccagggatggatggtattatggttacctggaaagacaacttcgacagtttctattcggaagtggccgaattgggtcgtgggagattcagcgtggtgaaaaaatgtgaccagaaaggcactaagcgtgctgtagccactaagtttgtcaacaaaaaacttatgaagcgggatcaggtgacacacgagctgggaatcttacagtctctgcaacatccactactggtgggactgctcgacaccttcgaaacaccgaccagttacatcttggtcctggaaatggccgatcagggaagattgctcgactgtgtggtgcgctggggatcactcacagaggggaaaattcgtgctcatttaggagaagtcctcgaggcagtaaggtacctccacaactgccgaattgcacacctggacctcaaacctgaaaacatactggtggatgagtctctggccaagccgaccataaagcttgctgacttcggggacgccgtgcaactgaacaccacctactatatacatcagctgctcgggaaccccgagttcgctgccccagaaatcatccttggtaatccagtctctcttacttctgatacctggagcgtgggcgtcctcacttacgttctactttctggggtttctccttttttagacgactcagttgaagagacctgccttaatatctgtcgcctagacttcagctttcctgatgactactttaaaggcgtgagtcagaaggcaaaggagtttgtctgttttctacttcaagaggaccctgctaagaggcctagcgctgccctcgctttgcaggagcagtggttacaagccggtaacggtaggtcaacaggcgtcttagacacaagtagactgacgagctttatcgagaggagaaagcaccagaacgatgtacgacccattcgctctatcaagaatttcttacagagccgcctgctgccgagagtata

SEQ ID NO: 245221 - DNA, 768 bp, Artificial Sequence
  Description of Artificial Sequence: Synthetic coding sequence
atggccttggaagatcgtccttcctcactcctggtcgaccagggggattcatcatccccgagctttaatccttctgacaattcactcctctcttcatcttcaccgattgatgagatggaggagcggaaaagttcctccctgaaacggaggcactatgtcttacaggaactagttgagacagagcgcgactatgtcagggatctgggatacgtcgtggagggatatatggccctcatgaaggaggacggagtgccggatgatatgaaaggaaaagacaagatagttttcgggaacatccaccagatctatgactggcaccgagacttcttcctgggtgagctggaaaaatgccttgaagacccggaaaagctcggctccctcttcgtgaaacacgaacgcagattgcacatgtatatcgcttactgccagaataaaccgaagtctgaacatattgtgtctgaatacatcgacacatttttcgaagacctgaaacagaggctgggccaccgccttcagctgaccgacttacttatcaaaccagttcaaagaatcatgaagtatcagttgctgcttaaggactttctgaaatactctaagaaagcttccctggatacctcagaactggaaagggccgtcgaggtcatgtgtattgtgcccagacggtgcaacgatatgatgaatgtgggcagactgcagggcttcgatgggagagtggtcgcactatgtcataggttcaaggaaactttcagagagatctgttggttctag

SEQ ID NO: 245222 - DNA, 1203 bp, Artificial Sequence
  Description of Artificial Sequence: Synthetic coding sequence
atgaacggacagctagatctgagcggcaagctgatcatcaaagcccagttgggggaggatattcggagaataccaattcataacgaagatatcacctatgacgaacttgtgttgatgatgcagcgggtcttcagaggaaagcttctctccaacgatgaggtgactatcaagtataaggacgaagacggggatctgattacgatctttgacagctctgacctgtctttcgccattcaatgtagccggatactaaagcttaccctgttcgttaacggccagccacgtcccctggaatcatctcaggtgaaatatttgcgccgtgaactaatcgagctgcggaacaaggtcaatcgactgctcgactcccttgagccgcctggcgaacctggtcccagcaccaacatccctgagaacgatacggtggatggcagggaggagaagagtgccagcgactcttccggtaaacagagcacccaggtcatggctgcctctatgtcagctttcgatcccttaaagaaccaagatgaaatcaacaagaatgtgatgagtgccttcggcctgaccgacgaccaggtgagtgggcctccctctgcgcctgccgaggacaggtcaggtacccctgactcgatcgcttcttcatcatccgctgcccacccgccaggcgtccagccgcagcagcctccctatacaggggctcagactcaagccggtcagattgagggccaaatgtatcagcagtaccagcagcaggcaggctacggagcacagcagccccaagccccaccccagcagccacagcagtacgggattcagtactccgcttcatactctcagcagaccggcccacagcagccgcagcagttccaggggtatgggcaacagcccacctcccaggcacctgccccagcctttagcggacagccccaacagctgcctgcacaacccccacagcaataccaggcgagcaactacccggctcaaacatataccgctcagacgtcacagcctactaactacacggtggcacccgcatcccaaccaggaatggcaccctcccaaccaggcgcttatcaacccaggccgggatttaccagtttgcctggatcaacaatgactccccctccctccggcccaaacccatatgctaggaacaggccaccgttcggacagggctatacacagcccggacctgggtaccgatag

SEQ ID NO: 245223 - DNA, 1101 bp, Artificial Sequence
  Description of Artificial Sequence: Synthetic coding sequence
atgaatggacagcttgatctgtctggcaaactgataattaaggcccagctcggggaagatattcgaaggattcctattcataacgaagatattacctacgatgaactggtgctgatgatgcaacgggtgtttcggggaaaactgctaagcaatgacgaagttacaatcaaatacaaagatgaggacggtgacctgattacaatctttgactcaagcgacctctcctttgccatccagtgctcccgcatccttaaattgacactcttcgtgaacgggcagcctcgtcctctcgaaagcagtcaggttaagtacttacgcagagaactgatcgaactacggaataaggtaaaccgccttctggactcccttgaacctcctggggaacccggaccaagtaccaatatcccagagaatgataccgttgacggacgggaggaaaagtccgcgtctgactcttctggcaagcagtcgacccaagtgatggccgcaagtatgagcgcattcgaccctctcaaaaatcaggatgagatcaacaaaaacgtgatgagcgctttcggactaactgacgatcaggtctctggccctccttccgccccagccgaggaccgtagcgggacccccgattctattgcgtccagctcctccgccgcacaccctcctggggtgcagccccagcagcctccctacaccggcgctcagacccaggctggccaaatgtaccaacagtacagcaatcgcccagcaatggttcatagttcccgacggctgcatctcagttcgttaaactctatggtgtttagcatccagcaggccattgtaagcagactggacctcaataatctgagctcttctcgggacatggcctctaaccaattaccacggcatcaactgcttcctttcctggtgtcactgaacaattgcctgttgtccaggcacagtagcacgcggagagcaattatcctacataaactcaccctccctaaactcctctcgctcctcattatcctgtggctcctaccactcaacttggaatggctgcaggcgaacctaggccctattaatcaagaccaagtcctgctgcactttctggaagtcccctag

SEQ ID NO: 245224 - DNA, 474 bp, Artificial Sequence
  Description of Artificial Sequence: Synthetic coding sequence
atgaacggtcagctagacctctctgggaagttgatcatcaaggctcaacttggagaggacattcggcgaatccccatccacaatgaagacatcacctacgatgagcttgtgctgatgatgcagcgtgtttttcggggaaagctcctgtctaacgacgaagtgaccattaaatacaaagacgaagacggagatctcatcacaatcttcgactccagcgatctgtcattcgccattcagtgctcgagaatactgaagctcaccctattcgtgaacggacagccccgacccttggagtcatctcaggtgaagtacctcagaagggaactgattgagctgaggaacaaagttaacaggctgctggactccctcgaacctccaggagagcctggcccaagcactaatattcctgaaaacgacaccgtggatggccgtgaggagaagtcagccagtgactccagcgggaagcagtcctag

SEQ ID NO: 245225 - DNA, 387 bp, Artificial Sequence
  Description of Artificial Sequence: Synthetic coding sequence
atgaatgggcaactggatttgagcggaaagctcatcatcaaagctcagttgggagaggatattaggcgcatacctatccataacgaggatattacctacgacgagctcgtgctgatgatgcagcgtgtgttcaggggcaaattactgtccaacgatgaggtcacaatcaaatacaaggatgaagacggagatctgataaccatattcgacagtagtgatctgtctttcgctattcaatgcagtcgaatcctcaaattgacactcttcgtcaatgggcagcctaggcccctggaaagtagccaagtgaagtacttacgccgtgaactgatcgaactacgcaacaaggtcaaccgactgctggactctcttgaaccccctggagagtag

SEQ ID NO: 245226 - DNA, 546 bp, Artificial Sequence
  Description of Artificial Sequence: Synthetic coding sequence
atgaatggtcagcttgatctttcgggcaaactgatcattaaggcacagctgggtgaggacatccggagaattcccatacacaatgaagacatcacctatgacgaactcgtgctgatgatgcagcgtgtatttaggggaaaacttctgagcaatgacgaggtaaccatcaaatacaaagatgaagacggggacttgattaccatttttgacagctctgacctatcattcgctattcagtgttcacgtattcttaaactcactctcttcgtcaacggccagcctcggccactagaatcctcccaagttaagtacctgcgtcgagaactgattgagctgagaaataaggttaaccgattattagattctctcgagccacctggggaacccggtccctctaccaacatccccgaaaacgatactgtagatggccgagaagagaaaagcgcgtctgactcctccggaaaacaatcaacacaggtcatggccgcaagtatgtctgccttcgacccgctcaaaaatcaggacgaaattaacaaaaacgtgtag

SEQ ID NO: 245227 - DNA, 1203 bp, Artificial Sequence
  Description of Artificial Sequence: Synthetic coding sequence
atgaatggccagctcgatctgtcaggcaaattgatcatcaaggcacagctgggagaagacatccggagaatcccaatacacaatgaggatataacgtatgatgagctagtacttatgatgcagcgtgtctttcggggtaagctgttaagcaatgacgaggtcactatcaagtacaaagacgaggatggagacctgatcaccatattcgactcctccgacctgagctttgccattcagtgtagccgcattctaaaactcacgctgttcgtaaacggacagccccgtccactcgagtcctctcaagttaagtacctcagaagagaactgatcgagctgcggaataaggtcaatcggctcctcgactcactcgagcctcctggagagcctggaccctccacgaatataccagagaatgataccgttgacgggagagaggaaaaatccgctagcgatagttccggcaaacagtccacacaggtcatggccgctagcatgtctgcattcgaccccttgaaaaatcaggatgagattaacaagaacgtgatgtcggcctttggattgacagatgatcaagtgtccgggccaccctccgcgccagcagaagatcggtccgggacaccagactccatcgcgtcatcctcatcagcggctcatccccctggcgtgcagccccagcagccgccttatacaggcgcacaaacgcaggccggacagatagaggggcagatgtaccagcagtatcagcagcaagcgggatatggggctcagcagcctcaagcacctccacaacaacctcagcagtatgggatccagtactctgcttcatactcacagcaaacgggacctcaacagccacagcaatttcagggttacgggcagcagcctacgagccaggccccagcccctgctttttccggccagccgcaacagttgccagctcagccaccccagcagtatcaggcatcaaactacccagcacagacctacactgcacagacttctcagcctaccaactataccgtcgcccctgcctcccagccaggcatggccccatcgcagcccggagcgtatcagcctaggccaggctttactagtttgcccggatccactatgaccccacctcctagtggtcccaatccctacgcccgaaatcggcctcctttcggccaggggtacacgcagccaggtccaggatacagatag

SEQ ID NO: 245228 - DNA, 1191 bp, Artificial Sequence
  Description of Artificial Sequence: Synthetic coding sequence
atgaatgggcagctggatctcagcggaaaattaatcattaaagcgcagttgggcgaggacataaggaggatacccatacataatgaggatatcacctatgatgagcttgtcctgatgatgcaaagagtatttcggggtaaactcctgtccaacgacgaggtcaccattaagtataaagacgaagacggcgacctgattaccatcttcgattctagcgacctgagttttgccattcagtgcagcaggattctgaagttaacattattcgtgaatggccagccgagacccctcgagtcgtcacaggtgaaatacctaaggagagaattgatcgagctgcgcaataaggttaatcgtttgctggactcattggagccaccgggagagcctggtcctagtacaaatattccagagaatgatacagtggatggtcgagaagaaaaatctgcctctgacagctccggcaagcaatccactcaggtgatggcagcatccatgtctgctttcgacccgttaaaaaatcaagatgagatcaataagaatgttatgtcggcattcggcctgaccgatgatcaggtgtctggacccccaagcgcgccagcggaggaccgatcagggacacctgatagcatcgcgtcctcgagcagcgccgctcatcctcccggagttcaaccccagcagccaccgtacacaggtgcccaaacacaggcaggtcagatgtaccagcagtatcaacagcaggcgggttatggcgctcagcagccacaggccccacctcagcagccacagcagtacgggatacagtattccgcctcctactcacagcagaccggaccccagcagcctcagcagtttcaggggtacggccagcagcccaccagccaggcccctgccccagctttttccgggcaacctcagcaacttccagcgcagccgcctcaacaatatcaggcttccaattaccccgcacagacttacaccgcccaaacatctcagcccactaattacacagtggccccagctagccagccagggatggcccctagtcagccaggcgcttatcagcccagacccggatttacctcccttcccggatctaccatgaccccgcctccctcggggcctaatccctacgcaagaaaccgtcctccattcgggcagggatacacccaacccggacccggttataggtag

SEQ ID NO: 245229 - DNA, 729 bp, Artificial Sequence
  Description of Artificial Sequence: Synthetic coding sequence
atgggggaagcctcgcctcccgcacccgctagaaggcacctcctggtcctcttgttgctgctttcgacactggtgattccctctgcagcagcgcctatccacgacgccgacgcgcaggagtcttctctgggcctcaccggactacaaagcttgcttcaaggcttcagtagattattcctgaaggggaatctgttgcgaggaattgattcactcttctccgcaccaatggacttccggggactgcccggaaactaccacaaagaggaaaaccaggagcaccagctgggcaacaataccctatcatcgcatctccagattgataaaatgacagataataaaactggggaggtgctgatttcggagaacgtcgtagcttcaatccagcccgctgaagggagtttcgagggcgacctcaaagtgcccaggatggaggaaaaggaggctctcgtgcccatccaaaaagcaacagatagctttcatactgagctccatcccagagtggctttttggatcattaagctgccgcgacgcaggtctcatcaagacgctctagagggtggtcactggctgtccgaaaagcgacatcggctgcaagctatcagagacgggctccgaaaaggaacacataaagatgtgctggaggagggaaccgagtcgtctagtcattctaggctatcaccgagaaagactcatctgctttatattctcagaccctcacgacaactctag

SEQ ID NO: 245230 - DNA, 1980 bp, Artificial Sequence
  Description of Artificial Sequence: Synthetic coding sequence
atgcaaggaagctccctgtggctgagcctaacattccggtctgctcgggtcttgtcacgtgccaggttctttgaatggcagagccccggtctacccaatactgctgctatggagaatgggactgggccttatggcgaggaaaggcctcgtgaggtgcaggaaacgaccgtaaccgagggggctgccaagatagcctttcctagcgccaacgaggtgttctataacccagtacaagagttcaaccgtgaccttacatgtgccgtgattacagagttcgcgagaattcagctgggcgctaagggcattcagatcaaggtccccggagaaaaggatacgcagaaagtggtggtggacctgtccgaacaggaggaagagaaagtggagttaaaggagtcggaaaacctggcatctggggaccaaccccgaacggctgctgtgggtgaaatttgcgaggaaggcctccacgtgctggagggcctcgctgcatctggcctgcgctccatcagatttgcactagaggtgcccggattaaggagcgtcgtggccaatgatgcatctaccagagcagtggacttgatcaggcgcaatgtgcaattaaacgatgtggctcacctggtgcagccaagtcaggctgacgctcggatgttgatgtaccagcatcaacgggtgtctgagaggttcgatgttatcgaccttgatccctacggatcgccagcaacattcctcgatgcagctgtgcaagccgttagtgaggggggtctcctttgcgtgacatgtaccgatatggcagttctggccggtaattccggagagacttgctattcaaaatacggcgctatggctctgaaatctcgtgcgtgccacgagatggccttacgtatcgtattgcatagccttgaccttcgggctaattgctatcagaggttcgtggttcctctgctgtcaataagtgccgatttctatgtacgtgtgtttgtgagagtgtttacaggacaggccaaggtgaaagcctcagcctccaagcaggcgctggtctttcagtgcgtgggctgcggcgcatttcacctgcaacgcctgggaaaggcttccggagtcccatcagggagagccaaattcagcgcagcttgtggaccccctgttacacccgaatgcgagcactgtggccagcggcaccagctggggggtccaatgtgggccgagccgatccatgaccttgattttgtgggaagggtgcttgaggccgtgtctgccaatcccggtagattccacacctctgaaagaatcaggggggtcctgtctgtgattactgaagagctgcctgatgtccctctctactacaccctggaccagctgagcagcacaatccactgtaacacgcctagtctgctgcaattgaggagcgccctgctgcacgctgatttccgggtatctctcagccatgcatgtaagaacgcagtgaagactgatgcacccgcatccgcactatgggatatcatgcgctgctgggagaaggaatgccccgtcaagagggagcgcttaagtgaaacatcacctgcattccggattctgtcggtagaacctcgattgcaagccaactttaccattcgagaagatgccaaccctagttcgcgccagcggggacttaagagatttcaggcaaacccagaggctaattggggccctaggcctcgcgctaggcccggaggtaaggcagcagacgaagctatggaggaaagaaggagacttctgcaaaacaagaggaaggagccaccagaggatgttgcacaacgggctgcgcgtttgaagacattcccatgtaaaaggttcaaggaaggcacatgtcagcgcggagaccagtgctgctattcacactcaccccctactcccagggtttcagctgatgccgcacctgactgtcctgagacttctaatcagacgccacccggtcccggtgctgcagctggtcctgggatcgattag

SEQ ID NO: 245231 - DNA, 1980 bp, Artificial Sequence
  Description of Artificial Sequence: Synthetic coding sequence
atgcagggatcaagcttatggttaagcctgacgtttcggtccgctcgagtgctctcaagggctcgcttctttgagtggcagtctcctggactgccaaatactgccgctatggaaaatggtacaggaccttatggggaagagagacccagggaggtgcaggagacaactgttacagaaggggcagccaagatcgctttcccctcggccaatgaggtcttctataatccagttcaggagtttaatagagatctgacatgcgcggtgatcaccgagtttgcacggatacagttgggcgcaaaggggatacagatcaaggtcccaggcgagaaagatacgcagaaagtagtggtcgacttgtctgagcaggaagaggagaaggttgaactcaaggagtcggagaatctggcctcaggtgaccaacccaggaccgctgctgtgggggaaatttgcgaggaaggtttacacgtgctggaggggcttgcagcaagtggactgagaagcatacgttttgctctcgaggtgccaggcctgagatctgttgtggcaaacgatgcaagcacccgcgctgtggacctaattcgccgaaacgtccaactaaatgacgtagcacacctcgtgcagccttctcaggccgacgctcggatgctcatgtatcagcaccaacgggtgagtgagaggtttgacgtgattgacttggatccatatggttcacccgcaacatttctcgacgccgctgtgcaagccgtgtctgaggggggtttgctgtgtgtgacttgtaccgacatggcagtgttggccggaaactcaggggagacatgttacagcaagtatggcgctatggcactaaagtcacgggcttgtcacgagatggcactgagaatagtattgcattcgcttgatctgcgggctaattgttatcaaagattcgtggtaccgttactgtccatctcagccgacttctacgtgcgggtgtttgtgcgagtctttaccgggcaggccaaggtgaaagcatcagcgtcaaaacaagcactggtgttccagtgcgtgggatgtggcgctttccacttgcaacggctgggcaaagcgtcaggggtcccctcaggcagagcaaaattttcagctgcctgcggacctcccgtcacccctgagtgtgaacactgtggacagcgacaccagctagggggacctatgtgggcagaaccgattcatgacctggacttcgttggccgagttctggaggccgtcagcgctaatcccggtagattccacacgtctgagcggatccgcggtgtgctgtctgtaataactgaggagttgcctgatgtcccactttactatacattggaccagctctcaagtaccatccattgtaatacacctagcttgcttcaactccgcagtgctctgctccatgccgattttagagtgtccctaagtcatgcatgtaagaacgcagtcaagactgatgcgcctgcaagtgctctctgggacattatgaggtgttgggaaaaggagtgcccagtgaagcgcgaacgcttatccgaaacgagtccagcattcagaatactctcggttgagcccagactccaggcaaacttcaccatccgggaggatgctaacccctcttcaaggcaacgcggacttaagcggtttcaggcaaacccagaagctaactgggggccaaggcccagagccaggcccggaggtaaggccgctgacgaagcaatggaagagagacgtagactgctccaaaacaaaagaaaggaaccaccagaggatgtggctcagcgcgctgcccgactgaagactttcccctgcaagagatttaaagagggcacctgccagaggggcgatcagtgttgctacagccatagtccgccaaccccaagagtatctgcagacgccgcacctgattgtcccgagacttctaatcaaacgccacctggcccaggagccgcagccggacctggcatcgattag

SEQ ID NO: 245232 - DNA, 1878 bp, Artificial Sequence
  Description of Artificial Sequence: Synthetic coding sequence
atgagtgaaaacttggacaacgaggggcctaagcccatggagagctgtggccaggagtcctcttccgccctctcctgtcctacagtctccgtgcctcctgcagcccctgcggcactggaagaagtcgagaaagaaggggcaggcgcagctacaggacccggtccccaacctgggctttactcttatattagagatgatctgttcacctccgagatctttaaattggagctgcaaaacgttcccaggcacgctagcttctctgacgtgagaaggtttctgggccgttttgggctgcagccccataagaccaagttgtttggccagccaccgtgtgcattcgtcaccttccgcagtgccgcagagagggacaaagcacttcgggtgttacatggagcgctgtggaaaggacgcccactgagcgtcaggttggctagaccaaaggcagaccccatggctcggaggcgcaggcaggaaggtgagtcagagccccctgtaacccgtgtggcagatgtagtgacgccactgtggaccgtaccatacgcggagcagctcgagcggaagcagctcgagtgtgaacaggtgttacaaaaactcgctaaggagatcggctccactaacagggccctgctgccctggctgctggagcagcggcacaagcataataaagcgtgttgccctttggagggcgtacgacctagcccacagcagactgaatatcggaacaaatgcgaattcctggtgggcgtgggcgtcgatggagaagacaataccgtgggctgccgcctggggaaatataaaggcggaacctgtgccgtcgccgctccctttgataccgtgcacatcccggaggcgactaaacaggtcgtgaaagcctttcaagaatttatacggtctaccccctactcagcatacgatcccgagacctacaccggtcactggaagcagctaacagtcagaacttctcggagacaccaggctatggcaattgcatatttccatccacagaaactgtcacccgaagagcttgccgagctcaagacttccctagcccagcatttcactgccggtccaggccgagcatctggcgttacttgcttatatttcgtggaagaaggccaaaggaagactccgtcgcaggagggattaccccttgagcacgtggccggtgacagatgcatccatgaggatctcctgggccttactttccgcattagcccacatgccttcttccaagtcaatacacccgctgccgaagtcctctatacagtcatccaggactgggcgcagctagacgctggctccatggtactggacgtatgctgtggaacaggaactattggactcgctctcgcaaggaaggtaaagagagtcattggcgttgaattgtgccctgaggctgtagaggacgcccgagttaacgctcaggacaatgaactgtcaaatgttgagttccactgtggaagagctgaagacctggtcccaacgctggtgagccgcctggcctctcagcatcttgtggctattttggacccacctcgggcaggacttcatagtaaagtaatcctggctattaggcgagcaaaaaacctgcggagactcctctatgttagttgcaatccccgtgcggctatgggaaatttcgtggacctctgtcgggcacctagcaacagagttaagggtatccctttccgacccgttaaggcggtggctgtggaccttttcccccagacccctcactgtgagatgttgattctttttgaaagggtggagcacccgaacggaacaggcgtgctagggcctcactcaccgccagctcagcctaccccgggacctcctgacaatactctccaggaaaccgggacctttccatcatcatag

SEQ ID NO: 245233 - DNA, 1878 bp, Artificial Sequence
  Description of Artificial Sequence: Synthetic coding sequence
atgtccgagaacttagataacgaaggacctaagccgatggaatcctgcgggcaggagtccagctcagctctcagctgtcctaccgtgagtgtcccaccggctgcgcctgccgcactggaggaggtggaaaaagagggggctggggctgccaccggacccggaccgcagccagggctgtacagctacattcgtgacgatctgttcacaagtgagattttcaagttagaactccaaaacgtgcctaggcatgcttctttcagcgatgtacgcagattcctcggcagattcggtctccaacctcacaagacaaagctattcggccaacctccctgtgctttcgtcacatttagatcagccgctgaacgagacaaggcactccgtgtcttacatggggcactctggaaagggcgacccttgagtgtgcggcttgcacgtcccaaagccgaccccatggcacgtcgaagacggcaggaaggagagtcagagcccccagtgacgagagtggcggatgtggtcacacccctgtggacagtgccttacgccgagcagcttgagaggaaacagttggagtgcgaacaggtgctacagaaactggccaaggaaatcggctctactaatagagccctcctgccctggttactggagcagcgccataaacataacaaagcttgttgccctcttgagggagttaggccctccccccagcaaactgagtaccgcaataagtgcgaattcctggtgggggttggcgtggacggagaagacaacactgtgggttgcaggctgggtaagtataaggggggaacatgcgctgtagctgcaccattcgatacagtccacattccggaagctacaaaacaagtggttaaggcttttcaggaatttattcggtctactccatacagcgcctacgaccccgagacatatactggccattggaagcagctgactgttcggacaagcagacggcatcaggccatggctatagcctattttcacccccagaagctgtctccagaggaactagcagagctcaaaacctccctggcgcagcattttactgcgggtcccggtcgagctagcggtgtaacctgcttgtactttgtggaagagggccagcgtaaaactccatctcaagaaggtctgcctcttgaacacgtggccggagatagatgcatccatgaagacttgctggggctgacatttcggatttccccccatgcatttttccaggtgaatacccccgcagctgaagttctgtacaccgttatacaagattgggctcaattagacgcgggttccatggtgcttgatgtctgttgcgggacaggcacaattggcctcgcactggcaagaaaggtgaaacgcgtcataggggttgagttgtgccctgaggctgtcgaagacgccagggtaaacgcccaagacaacgagctgtctaatgtcgagtttcactgcgggagggctgaagacctggtgcccacgctggtgtcccggctcgcctcgcagcacctggtggccatcctggacccaccccgtgccggtttacactcaaaagtgatcctggccatccgcagggcaaagaatctgaggcgcctgctttacgtttcctgtaacccacgggctgcaatggggaattttgtcgatttgtgtcgcgctccttctaaccgagttaaaggtatcccgttcagaccagttaaggccgttgctgtggaccttttccctcagactccacactgtgagatgttaattctttttgaacgcgtggagcatccgaacggcacgggtgttctagggccacactccccccctgctcagccgactcccggaccccctgacaatacattgcaagagaccggcaccttccccagctcttag

SEQ ID NO: 245234 - DNA, 1689 bp, Artificial Sequence
  Description of Artificial Sequence: Synthetic coding sequence
atgtcagagaacttggataatgaggggcctaagccgatggagagctgcggtcaggaatcgtcaagtgccctatcgtgccctactgtaagtgtgccacccgcagccccagcggctctggaagaggtggaaaaggaaggggcaggagccgcaactggcccaggcccacaacctggtttatactcatacatacgcgacgaccttttcacttctgagattttcaaattggagttacagaatgtgccacgacacgcttcattcagcgacgtgcgacggttcctgggcaggtttgggttgcaaccacacaaaactaaactgttcggtcagcctccgtgtgcattcgtgactttccgctctgccgcagaacgggacaaggcactgcgagttttgcatggcgctttgtggaagggaagacccctgtcagtgaggttggctagacctaaggcggaccctatggcaaggcgtcggagacaggaaggtgagtctgaaccccctgttacaagagtggcagacgtggttacaccgctgtggacagtcccgtatgccgaacaactcgagagaaaacagcttgagtgtgagcaagtgttacagaaacttgccaaggaaatcggctccaccaatcgggctctgctgccgtggctcctggagcagcgacacaaacataacaaggcatgttgtccacttgagggcgtccggccttctcctcagcaaactgagtatcgcaataagtgtgaatttctagtgggcgtcggggttgacggcgaagacaacactgttggctgtagactcggcaagtataagggcggtacttgcgctgtcgctgcaccttttgatactgttcatatcccagaagctacaaaacaagtcgttaaggccttccaggaattcatccgcagtaccccttactccgcttatgaccctgaaacatacaccgggcattggaagcagctgacagttcgcacatcacgacgccaccaggcaatggctatcgcatactttcaccctcagaagctttcccccgaggagcttgctgaactgaagacttcccttgcccagcactttaccgcaggaccaggcagagcgagtggcgtgacctgcctgtatttcgtggaagagggtcagaggaagaccccctctcaggaggggctgcctctggaacatgtagcaggggacaggtgtattcacgaagatctactcggcctgaccttccgcatctcaccacatgccttcttccaggttaacactccagcggcagaggtactgtacactgtgatccaggactgggctcagcttgatgcaggttctatggtactcgacgtgtgctgcggcacgggaaccatcgggctggcgctagctaggaaggttaaacgcgtcatcggtgtggaactttgccccgaggcagtggaagatgcaagggttaacgcccaggataacgagctgtctaatgttgaattccactgcgggagggccgaagacctcgtcccaacactggtgtctcgattagcatcccaacacctggtggcaatcctagaccccccaagagccggtttgcactcaaaggtcattctggccatccgcagagccaaaaacctgcgcagacttctgtacgtcagctgcaatccacgcgctgcaatggggaactttgtcgacgccccactgttccctccacagcctttgcagtcccccatctag

SEQ ID NO: 245235 - DNA, 1530 bp, Artificial Sequence
  Description of Artificial Sequence: Synthetic coding sequence
atggtgttgtggatattatggcgccctttcggcttctctggtcgattcctgaaactagagagccactccataacagagtccaagagcctgattccggttgcctggaccagcctcacacagatgttgttggaggcgccaggcatatttctcttgggccagcgaaagcgcttttccaccatgcctgaaaccgaaactcacgaacgcgagaccgaactgttcagccccccaagcgatgtccgcggaatgaccaaactggaccgtaccgcatttaaaaaaaccgtgaacatcccggtgctgaaagtgcggaaagaaatagtcagcaaactgatgagaagcctcaagcgggctgccctacagcgcccagggattcgacgagtcatagaggatcccgaggacaaggagagcagactgatcatgcttgatccgtacaaaatcttcacccacgattcattcgagaaggcagaacttagtgtgctcgagcagcttaacgtcagtcctcagataagcaaatataacctggagcttacatacgaacacttcaagtcagaagaaatcttgcgggcagtgcttccagaggggcaggatgtgactagcggcttctcacggatcgggcacatcgcccacctcaacctgcgcgaccaccagctttctttcaaacatctgattggccaggtgatgatagacaaaaacccaggaattacgtcagccgttaacaaaatcaacaacatcgacaatatgtacaggaacttccagatggaggttctttcgggtgaacagaacatgatgacaaaagtacgcgaaaacaattatacttatgaattcgacttcagcaaggtctactggaatccacgcctgagcaccgagcattccaggattactgaactactgaaaccgggtgatgtcctgttcgacgtatttgcaggcgttggacccttcgcaatccccgtggcgaaaaagaactgtacagtcttcgccaatgatctgaaccccgaatctcacaaatggctcctttacaactgcaagctgaacaaggtcgaccagaaggtcaaagtgttcaatctggatgggaaggacttcctgcagggcccagtcaaggaggaactgatgcagctgttgggcctgtctaaagagaggaagccctctgtacacgtggtgatgaatctgcccgcaaaagccattgaatttttgagtgcctttaaatggctactcgatgggcaaccctgcagcagcgagttcctgcctatcgtgcactgctactcattctccaaagacgccaatcctgctgaggatgtgagacagcgagcgggagccgtgctcggcatctcactggaggcctgcagtagcgttcacttggtcagaaatgtggctcccaacaaggagatgttatgcatcacttttcagataccagcctcagtgttgtacaagaaccagactcggaatccagagaatcatgaagatccaccgctgaagcgacagaggacagcggaggcgttttcagatgagaagacccagatcgtttctaacacttag

SEQ ID NO: 245236 - DNA, 1266 bp, Artificial Sequence
  Description of Artificial Sequence: Synthetic coding sequence
atgcaagccctgcgccatgtggtctgtgctttaagcggtggagtcgatagcgcagttgccgcactgctgttacggaggagggggtatcaggtcactggcgtgttcatgaaaaattgggactcactagacgagcacggtgtgtgtaccgcagacaaggattgtgaagacgcctatcgcgtctgccagatactggacattccctttcaccaagtctcatatgtgaaggaatattggaacgacgtgttcagtgatttcctgaacgaatacgaaaagggaagaactccgaaccctgacatcgtgtgtaataagcacattaagttttcttgttttttccattatgccgtggataacttgggcgctgacgcaattgccactggacactatgccaggactagtctggaggatgaggaagtatttgagcagaaacacgttaagaagcccgagggcctatttagaaatcgcttcgaagtgcgaaacgctgttaaactattgcaagccgctgactcttttaaagaccagaccttttttctgtcacaggtcagccaggatgccctgaggagaacaatcttcccgctcgggggactgacaaaggagtttgtcaagaaaatagcagcagagaaccgccttcaccatgtgctccagaaaaaagaaagtatgggcatgtgcttcataggaaagcggaatttcgagcattttctcttacaatacctgcagcccagacctgggcattttatcagtatagaggacaacaaggttttgggaacccacaagggctggtttctttatactctcgggcaacgagcaaatattgggggattgagggagccctggtatgttgtagaaaaagattccgtcaaaggtgatgtctttgttgcgcctcgtactgatcatccagccttgtatcgcgatctgctgaggacaagtcgggtgcactggatagccgaggagccaccagccgctctggtccgagataaaatgatggagtgtcacttccggtttcggcatcaaatggctctggtgccatgtgtgctgaccctaaatcaggatgggaccgtgtgggtgacggccgtgcaagcagtgcgggctctggcaaccggccagttcgcggtgttctataaaggggacgagtgtctgggtagcggaaagatcttgcgattgggcccttctgcatacacactgcagaagggccagcggagagcaggcatggcaacagaaagtcccagcgatagtcccgaggacggtcctggcctgagtccacttctgtag

SEQ ID NO: 245237 - DNA, 300 bp, Artificial Sequence
  Description of Artificial Sequence: Synthetic coding sequence
atgcaggccctccgccacgtggtttgtgcactgtccgggggagtagactctgccgttgccgctcttcttctgcggaggcggggataccaggtgactggtgtatttatgaagaactgggactcactcgatgagcacggcgtatgcaccgcggataaagattgtgaggacgcttaccgggtttgtcagatcttggacattccctttcaccaggtgtcttacgtgaaggagtactggaacgatgtatttaggggccgttgccattgccaccgaagcctctgtaaaaatttcccgggtcgctag

SEQ ID NO: 245238 - DNA, 396 bp, Artificial Sequence
  Description of Artificial Sequence: Synthetic coding sequence
atgaagaattgggattccctggacgagcacggcgtctgcacagcagacaaggactgcgaggacgcctaccgcgtctgtcagattttggacatcccattccatcaagtgtcatacgtaaaagaatattggaatgatgtgttctccgactttttaaatgaatatgaaaaaggtagaacccccaatcctgacattgtatgtaacaaacatataaagttcagctgctttttccattacgctgtagacaatctgggcgctgacgctatcgctactggtcattatgctcggacatcactggaagacgaggaagtctttgagcaaaagcatgtaaaaaagcctgagggcctattcagaaatcgcttcgaagtccgcaatgcacggttccctagaatgccttag

SEQ ID NO: 245239 - DNA, 300 bp, Artificial Sequence
  Description of Artificial Sequence: Synthetic coding sequence
atgcaggccctgaggcacgtagtctgcgccctaagtggcggagtggattctgctgtagcagcattactgctcaggcggcgtggatatcaggtgactggagtgtttatgaaaaactgggattcgctggacgagcatggagtgtgcacagccgacaaagactgtgaagacgcttaccgcgtttgccagatattggacatcccattccaccaagtaagttacgttaaggagtattggaatgatgttttcagaggaaggtgtcattgtcacaggagcctctgcaaaaactttccaggacgctag

SEQ ID NO: 245240 - DNA, 300 bp, Artificial Sequence
  Description of Artificial Sequence: Synthetic coding sequence
atgcaggccctcagacacgtcgtctgtgctctgagcggcggtgttgactctgccgttgctgccctcctgttgcggcgtcggggatatcaggtaacgggagtcttcatgaagaactgggactcactggatgagcacggggtttgcacggctgacaaagattgcgaagatgcttatcgcgtgtgtcagatcttggacattcctttccatcaggtctcatatgtgaaggagtactggaatgacgtcttcagaggcaggtgccactgccatcggagcttatgcaaaaacttccctgggaggtag

SEQ ID NO: 245241 - DNA, 300 bp, Artificial Sequence
  Description of Artificial Sequence: Synthetic coding sequence
atgcaggctctaagacacgttgtctgtgcgttatctgggggtgtagactctgctgtcgccgcactgctgttgagaaggagggggtaccaggtgaccggcgtgtttatgaaaaactgggacagcctggatgaacacggggtgtgcaccgctgataaggactgcgaggacgcctatcgggtgtgccaaattctcgatatccctttccatcaagtcagttatgtgaaagagtattggaacgacgtgttcaggggccgatgtcactgccacaggtcactgtgtaagaactttcctggccgttag

SEQ ID NO: 245242 - DNA, 501 bp, Artificial Sequence
  Description of Artificial Sequence: Synthetic coding sequence
atgcaagcattgaggcatgtggtatgtgctctttctgggggagtagatagtgctgtagccgctttgctgttgcggagacgcggataccaggttacaggcgtgttcatgaagaattgggatagtttggatgaacacggagtttgtaccgccgataaggattgcgaagatgcgtacagggtgtgccagattctggacattccattccatcaggtgagttacgtgaaggaatactggaatgatgttttctccgactttttgaacgagtatgaaaaagggagaaccccaaaccctgatatcgtttgcaacaagcacattaagttcagttgtttcttccattacgccgttgacaatctaggagctgacgcaatcgccaccgggcattatgctaggaccagcctcgaagacgaggaggtcttcgagcagaaacacgtgaaaaaacccgagggactgttccgcaatcgctttgaggttcgtaatgcccgattccccaggatgccttag

SEQ ID NO: 245243 - DNA, 1038 bp, Artificial Sequence
  Description of Artificial Sequence: Synthetic coding sequence
atggagcccctgcgtgtgctggagttgtactcgggagtcggcggaatgcaccacgctttgcgagagtcttgcatcccggctcaagttgtagctgcgatagatgttaacaccgtcgctaacgaggtctataagtacaacttccctcatacccagctgctggcaaaaactatcgaggggatcaccttggaagagtttgaccgattgtcctttgacatgattctaatgagtccaccttgtcagccgtttacaagggacttgctgatacagaccatcgagaattgtggattccagtaccaggagttcctcctgagccccacctcccttggcatcccgaattcgcggttgaggtacttccttattgcgaagctccaatctgagccactgcccttccaagctcccggacaggtgttgatggagtttcctaaaatcgaaagcgttcaccctcaaaagtatgctatggatgttgagaataagatacaggaaaaaaatgttgaacctaacatcagctttgacggtagcattcagtgctccgggaaggatgctattttgttcaagttggagacggccgaggagatacaccgcaaaaaccagcaagattcagacctttcggtgaagatgttgaaagattttctcgaagatgacaccgatgtgaatcagtatctactgccccctaagagcctgcttagatatgcccttttgttggatattgtgcagccaacatgccgcagaagcgtttgcttcacgaagggctatgggagctatattgagggaacaggtagtgtactccagactgcagaggatgtacaggtcgagaacatttacaagtccctgaccaatctgagtcaggaggaacagattacgaaactgctaatcctcaaactccggtattttaccccaaaggagatcgccaacttactgggctttccacccgagtttggtttccccgagaagattactgtgaaacagaggtaccggctcctggggaatagtttaaatgtgcacgtggtagccaagctcataaagattttgtacgagtag

SEQ ID NO: 245244 - DNA, 216 bp, Artificial Sequence
  Description of Artificial Sequence: Synthetic coding sequence
atggagccactcagagtgctggagctgtatagcggggttggagggatgcaccatgccctgagggaatcttgtatcccggcacaagttgtagccgcaatagacgtcaacacagttgctaatgaggtgtataagtataattttccacatacccagctcctggctaaaaccatagaaattacgaaaatcaccaaggtatattcttttggaaagtgctag

SEQ ID NO: 245245 - DNA, 354 bp, Artificial Sequence
  Description of Artificial Sequence: Synthetic coding sequence
atggagccgttgagagttcttgaactgtactccggggtggggggaatgcaccacgccctgcgagagagttgtatacctgcccaggtggtggcggctatcgacgtcaataccgtggcaaatgaagtctataaatacaatttcccccatacccagttgcttgccaagaccattgaaaggcccctcgataccaataacagaaaactatggctcagcgtgccaagggtcagcatcatatctaatctctcttggcattccaagttcaaagcaaccattttttcttattgtaaggcctccgtcagggccattactctctcctcaccctggtccggcactgatggggtaccccagaactag

SEQ ID NO: 245246 - DNA, 1176 bp, Artificial Sequence
  Description of Artificial Sequence: Synthetic coding sequence
atggagccgcttagggttctggaattatattcgggtgtgggcggaatgcatcacgccctccgggagtcctgtatcccagcgcaagtcgttgccgcaattgatgtaaacacagtagcaaacgaagtatataaatacaacttcccccacactcagttactcgcgaaaactatcgagggcattacattagaggagttcgaccgtcttagcttcgacatgattctgatgtcacctccgtgtcagccttttacccgcataggtagacagggagatatgaccgacagccgaaccaatagttttctgcatattctggacatcctgcctagactgcaaaagttgcccaaatatatccttctcgagaacgtgaagggatttgaggtatcaagtacgcgtgatctgcttatacagaccatagagaactgcggattccaatatcaagagtttcttctatcacctactagtctgggcatcccaaactccagattgcgctacttcctaattgcaaaactccaatctgagcccctgcccttccaggccccagggcaggtgctcatggagtttcccaagatcgagtctgtccaccctcagaagtacgccatggacgtagagaacaagattcaggaaaaaaatgtggaacctaatatcagcttcgatgggagcattcagtgctcagggaaggacgcgatcctgttcaagcttgagacagccgaggaaattcatcgcaaaaatcagcaagactctgatctcagcgtgaaaatgttgaaggactttttagaggacgacacagatgtaaaccagtatctgctgcctcccaaatctttgctgagatacgccctcctgctggatattgttcagcccacttgccgaagatcggtctgttttactaagggatacggcagttacatagaggggacagggagcgtgctgcaaaccgccgaagatgttcaggttgagaacatctataagtcactgacaaacttgtcgcaggaagaacagattactaagctgctgattctgaaactacggtactttactcccaaggaaatcgccaatctgctgggttttcctccagagttcggatttcctgagaaaatcactgttaagcaacgataccgtctacttggtaactccttgaatgtgcacgtggtcgccaaattgatcaaaatcctgtacgaatag

SEQ ID NO: 245247 - DNA, 1104 bp, Artificial Sequence
  Description of Artificial Sequence: Synthetic coding sequence
atggagccgctgagggttctggaactgtatagtggcgtcggtggcatgcatcatgctttgagagaatcttgtatcccggctcaggttgtggccgcaatcgacgtcaacactgtcgcaaacgaggtgtacaagtataacttcccacatacgcagttgcttgccaagacaattgagggaattacattggaggaattcgaccggcttagcttcgacatgatattaatgagccccccatgtcagccattcacgcggttgcaaaaattgcccaaatacatactactggaaaatgtgaagggattcgaggtgagcagtacgcgggacttacttatccagactatcgagaactgcggttttcagtaccaagaatttctgctctcccctacctcactcgggatcccaaactctcgcctgcgctatttccttattgcaaaattgcagtccgagcccctcccattccaggcccctggacaggtgttaatggagtttcccaaaattgaatctgttcacccccagaaatatgctatggatgtggagaacaagatccaggagaagaacgtcgagccaaatatcagttttgacggctcaattcaatgcagtggaaaagacgcaattttgttcaaactggaaacagcagaagagatccaccgtaaaaaccagcaggatagcgatctgtcagttaagatgttaaaggacttcctggaggatgataccgatgttaaccagtacttattgccacccaagtccctcctcagatatgctttgctattggatatagtccagcccacctgccgacgaagcgtctgcttcacaaaggggtatggtagttacatcgaaggcaccggatcagtattacagactgcagaagacgttcaggtcgaaaatatatataaatcacttacaaacttgtcccaagaggagcagattacaaagcttttaatccttaaactgcgctacttcacgcccaaagaaatagctaacctgctggggtttcctcctgaatttggtttcccagaaaaaatcacagttaagcagcgttaccgtctcctgggcaatagcctgaatgtgcacgttgttgcaaaattaatcaaaatcctgtatgaatag

SEQ ID NO: 245248 - DNA, 933 bp, Artificial Sequence
  Description of Artificial Sequence: Synthetic coding sequence
atgtctactttgtccctcatgaaatacactagtatcatattcctcacccacagttacctccctagacgattgaagattggtcgtcagggtgatatgaccgacagccgaacgaacagttttctgcatatacttgacattctccccagggatctgctcatccagaccatcgaaaactgtgggtttcagtaccaagagttcctactaagccctacttctctggggattcctaactctagacttcgatacttcctcattgcaaaactgcaatccgaacccttgccttttcaagcaccagggcaagtactcatggagttccctaagatagagagtgtccatccccagaaatacgccatggacgtggaaaataaaatccaagagaagaatgtggaaccaaacatttcattcgacgggagtatccagtgtagcggaaaggacgctatccttttcaagcttgagaccgcagaagagatccatcgcaagaatcagcaagacagtgatctctccgtgaagatgcttaaggattttctcgaagacgataccgatgtgaaccagtatttgctgcccccaaagtcactgctgaggtatgcactgcttttagatattgtgcagccgacttgccggaggtcagtttgttttactaaaggatatggaagctacatagagggcaccggaagcgtgctgcaaactgcagaggacgtgcaggtggagaatatatacaaatctctcacgaatttgtcccaggaggaacagattactaaattgttaatcctgaagttgaggtatttcacaccaaaagagattgctaatcttctgggattcccacctgagtttggtttcccagaaaaaatcaccgtcaagcaacgatacagactgcttgggaacagtctgaatgtgcatgtcgtggcaaaactgatcaaaattctatatgaatag

SEQ ID NO: 245249 - DNA, 1305 bp, Artificial Sequence
  Description of Artificial Sequence: Synthetic coding sequence
atgctgagatgcctttatcactggcaccgccctgtcttaaatcggagatggagccgtttatgtcttccaaagcagtatttattcacaatgaaattacaatctcccgaattccagtccctgttcactgaggggttgaagagtctcaccgaattgtttgtgaaggaaaaccatgaactgcgcatagcagggggtgctgtccgggatctgcttaatggggtgaagccacaggatatcgactttgctaccactgcaacccctacccagatgaaggaaatgttccagagcgctggcatacgcatgatcaacaaccgcggtgaaaagcatggcacaatcacggctcgccttcacgaggaaaattttgaaattactacactgagaatcgatgtgacaactgacgggaggcacgcggaagtggagtttactacagattggcaaaaagacgctgagagacgggacttaacaatcaacagcatgtttttgggctttgatggcacgctctttgactattttaacggatatgaggatctgaaaaataaaaaagttagattcgttggtcacgcaaagcagagaatccaagaagattacctgcgcatcctgcggtacttccggttttacggaagaattgttgataaacccggagaccacgacccagagacactggaggcaatcgccgaaaatgccaaaggtctggccggtatatcgggcgaaaggatctgggtggaacttaaaaaaattcttgtgggcaatcacgttaatcacctgattcacctgatttatgatctcgacgtggccccatacattggcctgcctgccaacgccagtcttgaggagtttgacaaagtttccaagaatgtggacggtttctctcctaagcctgttacccttctcgcttcactctttaaagtccaggacgacgttaccaaactcgatctgcggctcaagatagctaaagaagaaaaaaacctgggcttgttcatcgttaagaatcgcaaggacctgatcaaagcaactgacagcagcgacccactgaaaccgtaccaggactttatcatcgactctcgggagcccgacgcgaccacccgcgtatgcgagctactgaagtaccagggcgagcattgcctgctaaaggagatgcagcagtggtccattccaccttttccagtgagcggccacgacattcggaaggttggcatctccagcgggaaagagatcggagccctattgcagcaattacgggaacagtggaaaaaatcgggatatcaaatggagaaagacgagctgttgtcttatatcaagaaaacctag

SEQ ID NO: 245250 - DNA, 1245 bp, Artificial Sequence
  Description of Artificial Sequence: Synthetic coding sequence
atgctcaggtgtctttatcactggcacagaccggtgcttaatcgcagatggtcaaggctgtgcctaccaaaacagtacctgtttactatgaagttgcagtctcctgagtttcaatcacttttcaccgaaggactgaaaagtctgaccgaactattcgtaaaggaaaatcatgagctgagaattgcaggcggagccgtgcgagatttgctgaacggtgtcaaaccgcaggacattgacttcgcaacaacagccacccccacccaaatgaaagagatgtttcagtctgctggcatacggatgattaataatcgcggagagaagcatgggacaatcacagcccgtctccatgaggaaaacttcgagattactacactcaggatagatgtcactactgacggcagacatgctgaggtggaatttactaccgattggcaaaaggatgccgagcgacgagatctcacaattaactcaatgttcctgggatttgacgggaccctgttcgattatttcaatgggtacgaagacctcaaaaacaagaaggtgaggtttgtgggccacgctaaacagcgcatccaagaggattacctgcgcattctgcgatacttcaggttctacggccgaatcgtcgacaaaccaggagatcacgatcctgaaacacttgaagctatagccgagaacgctaaaggtttggctggcataagcggtgagcgtatttgggtggaacttaagaaaattctggtgggtcttccagcaaacgcatccttggaagaatttgacaaagtttcaaagaatgtcgatggattcagcccaaagcccgtcactctgttggccagtctgttcaaggtacaggacgatgttactaagcttgacttgcgacttaagattgcgaaagaggaaaaaaatctggggcttttcatcgtgaaaaaccggaaggatttaattaaagccaccgattcctccgaccctttaaagccctaccaagatttcatcatcgatagccgggagcccgacgctacgacccgagtgtgtgaactgctcaaatatcaaggggagcactgcctcctgaaggagatgcagcaatggtccataccccctttccctgtgagcggacacgacatacgtaaggtgggcatttccagcggtaaggagatcggcgcactgttacagcaactgagagagcagtggaaaaagagcggatatcagatggagaaggacgagctattgtcatatatcaagaaaacatag

SEQ ID NO: 245251 - DNA, 174 bp, Artificial Sequence
  Description of Artificial Sequence: Synthetic coding sequence
atgctgcggtgtctttaccactggcaccgtcccgtgctgaacaggaggtggtcgcggctgtgcctgcctaagcagtatctatttaccatgaaactgcaatctcccgagtttcagagcctttttacagagggactgaagagtctgactggcataaatgcatttcatgagaactag

SEQ ID NO: 245252 - DNA, 174 bp, Artificial Sequence
  Description of Artificial Sequence: Synthetic coding sequence
atgctgaggtgtctgtaccattggcatcgcccagtattaaatcgcagatggtcccgtctttgtttgcctaaacagtacctgtttactatgaagctgcagtcccctgagttccagtcactttttacagaaggactgaaatctctcactggaatcaacgctttccatgagaattag

SEQ ID NO: 245253 - DNA, 189 bp, Artificial Sequence
  Description of Artificial Sequence: Synthetic coding sequence
atgctgcgttgcctgtaccattggcaccggcctgtcctgaacagacgttggtctcgtctgtgcctgcccaagcagtacctgttcaccatgaaactgcagagtcctgaattccagagcctgttcacagaaggcctgaagtcacttacggagctgttcgtgaaagagaatcacgaacttcgcattgcctag

SEQ ID NO: 245254 - DNA, 174 bp, Artificial Sequence
  Description of Artificial Sequence: Synthetic coding sequence
atgctcagatgcctgtatcattggcaccgtccggtgcttaatagacggtggtcccgcctgtgtttaccaaagcaatacctgttcaccatgaagctccaatcccccgagttccagagcctctttaccgagggcctcaagagtttgacaggcatcaacgcctttcacgagaactag

SEQ ID NO: 245255 - DNA, 1305 bp, Artificial Sequence
  Description of Artificial Sequence: Synthetic coding sequence
atgctccgctgcctctatcattggcatcgacctgtattaaataggagatggagcaggttgtgcctgcccaagcaatacctctttaccatgaaactgcagagccccgaatttcagagtctgttcacagaggggctgaaatctcttacagagttgtttgtgaaagagaatcacgagctgcgtatagcgggaggtgcagtccgagacttgttaaatggagtgaagcctcaagatatcgacttcgccacaacggccacccctacccagatgaaagaaatgttccaatctgccggaataaggatgataaataatagaggtgagaagcatggcactattactgcacggctgcatgaggagaatttcgagatcactaccctcaggattgacgtgaccaccgacggtcgtcacgcagaagttgagttcacgacagattggcagaaggacgctgagaggcgagatttaaccattaattccatgttccttggcttcgatggaaccttgtttgactatttcaatggatacgaggacctgaagaacaaaaaggtacgattcgtgggccacgccaaacagcggatccaggaagactaccttagaatacttcgatacttccgcttctacggcagaattgtggataagccaggggatcatgatcccgagaccctggaagcaatagccgagaacgctaaagggctcgccggaatcagtggggaacggatttgggtagagctcaaaaaaatccttgtgggcaaccacgtgaaccacctgatccatctgatctatgaccttgacgtggcaccatacatcgggctgccagctaacgcaagccttgaggagtttgacaaagtctctaagaacgtggacgggttttcgccaaagcctgtgacgctcctcgcttcactctttaaggtgcaagacgacgtgaccaagctggacctccggctaaagatcgccaaagaggagaaaaacctaggactgtttatcgtgaagaacaggaaggacctcatcaaggccacagactcgtcagaccccctaaaaccttaccaggattttattatcgatagtcgagagcctgatgctacaacccgggtttgtgaactcctgaagtaccaaggggagcactgtctactcaaggagatgcaacagtggagtatccctccgtttcctgtgtccggacatgatatccggaaggttggtattagtagcggtaaggaaattggggctctgctgcagcagctgcgcgaacagtggaaaaaatcaggttaccagatggaaaaggatgagcttctatcctatattaaaaagacgtag

SEQ ID NO: 245256 - DNA, 762 bp, Artificial Sequence
  Description of Artificial Sequence: Synthetic coding sequence
atgaatttctcaggcggaggtcgccaggaagccgcaggtagccggggacgtagggctccccgacctagggagcaggaccgcgacgtgcagttaagtaaggcactgagttatgctctgcggcacggtgccctgaagctcggcttacccatgggcgcagatgggttcgtgccgctggggaccttgctgcaattgccccaattccgcggatttagcgctgaggacgtgcagagggttgtggatacaaaccggaagcagcggtttgctctccagctgggagatcctagcaccggactgctcatccgcgctaaccagggtcacagtctgcaggtgccaaaactcgagctcatgcccctcgagacaccgcaggccttgccaccaatgctggtccacggtactttctggaagcactggccttccatcctgctgaaaggcctgtcttgtcaggggaggacccatatacatctagcaccgggactgcccggtgatcctggcattatctccggcatgcgatcccattgtgagattgctgtgttcatcgacggccctctggccctggccgatggcatcccatttttcagatctgctaatggagtgatcctcactcctggcaatacagatgggttcctgctgccaaagtattttaaggaggctttacagctgcgaccaacccggaaacccctttctttagccggtgatgaggagaccgaatgccaatccagcccaaaacactccagccgggaacgaagacgtatccaacagtag

SEQ ID NO: 245257 - DNA, 768 bp, Artificial Sequence
  Description of Artificial Sequence: Synthetic coding sequence
atgaacttcagtggcggtgggagacaggaggcagctggaagccggggaagacgggctcccaggcccagggagcaagatagagatgtgcagctgtccaaggcactgtcatacgcgctacggcatggagcattaaagttagggctccccatgggcgcagatgggtttgtgccccttgggaccctattacagctgccccagtttcggggttttagtgcggaggacgttcagagggtcgttgataccaaccgtaagcaacgcttcgccctgcagctgggcgacccaagtacaggactgctcattcgcgcaaaccagggacactcactgcaggtcggggtgcccaagctggagttgatgcctctggagacaccccaagccttgccccctatgctggtacatggtacattctggaagcactggccaagcatcttgttgaaggggttgtcctgtcagggacgcacccatatccaccttgcccctggacttccgggagatcctgggattatttccggcatgagaagccactgcgagattgccgtcttcatcgacggtccactcgcactggctgatgggattccattcttcagaagtgcaaatggtgtgatcctcacccctggcaacaccgatggattcctgctccctaagtacttcaaggaggcactgcagctgagacctactcgtaagcctctgagtttggctggtgacgaggagacagagtgccaatcatccccaaagcactcctcacgggaacgccgtcggatccaacagtag

SEQ ID NO: 245258 - DNA, 615 bp, Artificial Sequence
  Description of Artificial Sequence: Synthetic coding sequence
atgggagcagatggttttgtgccactggggactctgctgcaactgccccagttcaggggattcagcgcggaagatgtgcaacgcgtagtggataccaatcgaaagcagcgattcgcacttcaactgggggaccccagtacgggcctcctcatcagggcaaaccagggtcattccctgcaggttcccaagctagagctaatgccactggagacgccacaggccctgcctcccatgttggttcacggtacattctggaagcattggcccagtattctgctgaaagggctgtcctgtcagggtcggactcatatccatctggcacccggactgcccggagacccagggatcatcagcggtatgcgctctcactgtgaaatcgcagtatttattgacggaccactggcacttgctgacgggatccctttctttcgctccgccaacggggtgatcctgacccccggtaatacagacggtttcttgctgcccaagtacttcaaagaggcattgcagctgcggcctactagaaagccattaagcttagccggagatgaggagaccgaatgtcaaagttcccccaagcattcatccagggagcgacgtaggatccagcaatag

SEQ ID NO: 245259 - DNA, 651 bp, Artificial Sequence
  Description of Artificial Sequence: Synthetic coding sequence
atgaacttctctggagggggacgccaagaggcggcaggaagcaggggacgccgagctccacgccctagagagcaggaccgtgacgtgcagctgagcaaggccctgagttatgcccttcgccacggcgcattaaaacttggccttccgatgggggcagatggattcgtgccactgggcaccctgctccagctgcctcagtttagggggttttctgcagaagacgtgcagcgcgttgtcgacacaaatcggaagcagagattcgcactccagcttggtgatccatctaccggtctgcttatcagggccaaccagggccatagtctgcaagtgcccaaactcgaactgatgccccttgagacccctcaggccctgccaccaatgcttgtacacggcacgttctggaaacattggccaagcatcttattaaaaggtctctcttgtcaggggagaacacatatccacttagctcctgggctcccaggggaccctggaattatttccgggatgaggtctcattgtgagattgctgtgttcatcgacggaccactagccctggctggcaaaccactgagcctagccggtgatgaggaaactgaatgtcagtctagtcccaagcactcgtccagagagcgacgacgcatacagcagtag

SEQ ID NO: 245260 - DNA, 504 bp, Artificial Sequence
  Description of Artificial Sequence: Synthetic coding sequence
atgggcgcagacgggttcgtgccactggggacactgctgcagctgcctcagtttcgtgggttttcagccgaggatgtacagagggttgtcgatactaacagaaagcagaggttcgccttgcaacttggcgacccctccactggactcctaattcgagctaaccagggacactccctccaagttccaaagctagaactaatgcccctggaaaccccacaagcacttccaccaatgttagtacacgggacattctggaagcattggccttctattttactcaaaggtctgtcatgccagggacgcacccacatccatctagcgcctggcctgccaggagaccctggaattatctctggcatgagatcccattgcgagatagcagtgtttatagacggcccactggccctggcagggaagcctctttctctggccggagacgaggagaccgagtgccagagttcccccaaacattccagtcgggaacgcaggagaatccagcagtag

SEQ ID NO: 245261 - DNA, 516 bp, Artificial Sequence
  Description of Artificial Sequence: Synthetic coding sequence
atggaagagcgcggagactccgaacctacacccggttgttctgggctgggcccaggaggggtgagagggttcggggacggaggaggcgcaccatcctgggctcccgaagatgcatggatggggacacacccaaaatatttggaaatgatggagctagacattggggatgctactcaggtgtatgtggcatttttagtctacctggacttgatggagtccaaatcctggcatgaagttaactgtgtgggtcttccagaactccagctgatctgcctagttggcactgagatcgaaggagaagggctccagacagtcgtgccgacgcccatcacagcatccctttcacataatagaattcgcgagattctgaaggcttcccggaaactgcagggggatcccgacttgcctatgagtttcacccttgccatcgtggagagtgactccacaatagtgtactacaagctcactgatgggtttatgctacctgatccccagaacatctcactccgcagatag

SEQ ID NO: 245262 - DNA, 390 bp, Artificial Sequence
  Description of Artificial Sequence: Synthetic coding sequence
atggaggagagaggagattcagagccaacacctggctgctcaggtctgggtcccggaggggtccgaggcttcggcgacggaggcggtgcacccagttgggcccctgaggacgcctggatgggtactcatccgaagtatcttgaaatgatggagctcgacataggcgacgctacgcaagtttacgtcgccttcctggtgtacctagatctcatggaaagcaagagctggcacgaggtcaactgcgtggggctgcctgaactgcagctcatttgtctggtcggcaccgaaatcgagggcgagggcctgcagacagtagtcccaactccgattacggctagtttgagccacaacaggatcttcctgctcgaagatgacatacatgtctcttag

SEQ ID NO: 245263 - DNA, 1398 bp, Artificial Sequence
  Description of Artificial Sequence: Synthetic coding sequence
atggctgaagccgtgttccatgcgccaaaacgtaaaagaagagtgtacgagacgtatgaatcccccctccctatcccatttggtcaggatcacggacccttgaaggaattcaagatctttagggcagagatgatcaacaataatgtcattgtgcggaatgcagaggacatcgaacagctgtatggcaaaggatacttcggaaaaggaattttgagcagaagccgcccatcatttacaatcagtgatcccaagttggtggccaaatggaaagacatgaaaacaaatatgccgattatcactagtaagcgataccaacacagtgtggaatgggcagctgaactcatgcgcaggcaaggccaggacgagtcaacggtccgacggattctaaaagattatactaagccattagaacatcctccggtgaagcgcaatgaggaagctcaggttcacgataaacttaatagcggtatggtgagtaatatggagggcacagctggtggggaacgtccttcggtagtgaacggtgatagtggaaagagtggtggtgttggcgaccctagagaacctttgggctgccttcaggagggctctggctgccaccccactacggaaagttttgaaaagtcagtcagggaagatgcgtcacctttaccacatgtatgttgttgtaaacaggatgctttgatcctgcaacggggattgcaccatgaggacgggtctcaacatattgggctcctccaccccggagatcggggtccagatcacgagtatgtgctcgtcgaggaagccgagtgtgctatgagtgagagggaagcagcaccaaatgaagagctggtacagagaaatcggttgatctgtcgtaggaacccatatcgcatttttgagtatctccaactgtcactggaagaggccttctttctggtatacgctttaggctgcctctctatatactatgagaaagagcccctgaccattgtgaagttgtggaaagcctttacggtggtccagcctacattccgaacaacctatatggcatatcattattttagatcaaaaggatgggtccccaaggtagggctcaagtacggtaccgaccttctgctgtaccggaaaggtccacccttctaccacgcgagctacagcgttatcatagagcttgtagatgatcacttcgagggttcccttaggcgtcccctcagctggaagtcactcgccgcactgtcccgtgtgtcagttaatgtaagtaaggaacttatgctgtgctatttaatcaaaccctccacaatgacagataaggaaatggagagccccgaatgtatgaaaagaatcaaggttcaggaggttattctctcccgctgggtgtcttcccgggaaaggtccgaccaggatgacctgtag

SEQ ID NO: 245264 - DNA, 1320 bp, Artificial Sequence
  Description of Artificial Sequence: Synthetic coding sequence
atggctgaagcggttttccacgcccctaaacgaaaacgcagggtgtacgagacatatgagtctcctctcccaattcctttcggtcaagaccacggcccacttaaagagtttaagatctttagagctgagatgattaataataatgttattgtcagaaacgccgaagacattgagcaattatatggcaaaggatactttggaaaaggcattctatcacgcagccgaccttctttcaccatctccgatcctaagctggttgcaaagtggaaggacatgaagactaacatgccaataattaccagcaagcggtaccagcatagcgtggaatgggccgctgaactgatgcggcgacaagggcaggacgaaagcacggttcggcgaatcctgaaagattataccaaaccactcgagcacccgccagtgaaacgaaacgaggaagcacaggtgcatgacaaattaaactcaggcatggtgtcaaatatggagggaaccgctggcggagaacgtccatctgtcgtgaacggtgactcaggcaaaagcggcggagtaggggaccccagggagcccttaggctgtttgcaagaaggctcgggatgtcaccctacgaccgagtctttcgaaaaatctgtgagggaagatgccagccctctaccccacgtttgttgctgcaagcaggacgccctcattctccagcgagggctccaccacgaagacggctcccagcacatcgggctcctgcacccaggagatcgtggccctgatcacgagtatgtattggtggaggaagctgaatgcgccatgtcggagagagaggctgcacctaatgaggaggcattttttctagtctatgccctggggtgcctgtccatctactacgaaaaagagcccctaactattgttaaactgtggaaagcttttaccgtcgtccagcctactttccgcacaacctatatggcgtatcactactttagatctaagggttgggtcccaaaggtgggtctcaaatacggcaccgatctattgttgtatcggaagggtccaccattctatcacgccagctacagtgttattatcgagctggtggacgaccattttgagggctccctccgcagacccctgagttggaagtccttagccgctctgtctcgcgtgtcagtgaatgtctctaaggagctcatgctctgctatttaatcaagcctagcactatgactgacaaagaaatggaatctccagagtgtatgaaaaggatcaaggtccaggaggtaatactaagtcggtgggtaagctccagggagcggtccgatcaggatgacctgtag

SEQ ID NO: 245265 - DNA, 1347 bp, Artificial Sequence
  Description of Artificial Sequence: Synthetic coding sequence
atggcagaggcagtatttcatgcacccaagcgcaagaggcgcgtttatgagacatacgagagtcctttaccgattccctttggccaggaccacggccctcttaaggaattcaaaatcttcagggctgagatgataaacaataatgtgatagtgcgaaatgccgaagatattgagcagctgtatggcaagggttatttcgggaagggaattttgtcacgcagtagacccagttttactattagcgatccaaaactcgtagccaaatggaaagacatgaaaaccaatatgcctatcattacatctaagaggtatcagcattctgtggaatgggcggctgaactgatgcgtcggcagggccaggacgaatccacagtgcggaggattctgaaagactatactaaacctctcgagcatccgcctgtgaaacgtaatgaagaagcccaggtacacgacaaactgaattcggggatggtgagcaacatggagggcaccgcaggcggagaaaggcccagtgtggtgaacggtgatagtggaaagtcaggtggcgtcggtgatcctagagaacctctcggctgtctgcaggagggatccggctgtcatcccacaaccgaaagttttgaaaagtctgtgcgcgaagatgcgagtccactgccgcatgtgtgttgctgtaagcaagacgctctgatcctgcaaagaggactgcaccatgaagacggcagccagcatatcggattattacaccctggcgacaggggcccagatcatgaatatgtcctggtggaagaagctgagtgcgctatgtcagagagagaagctgcccctaacgaggaactagtgcagcgcaatcgcctcatttgtcgacgcaatccttataggatttttgaataccttcagctttccttggaggaggagcccctgactatagtgaaattatggaaagctttcactgttgtacagccaaccttccggacaacgtacatggcatatcactactttcgcagcaagggatgggttcccaaagtgggacttaagtatggtactgacttgttgctttacagaaaagggcctccattctatcacgcaagttacagcgtgatcatagaattagtggatgatcatttcgaaggatcgctgaggcgacccctgtcttggaagtctctcgctgcgctgtcacgggtatccgttaatgtcagtaaggaactgatgctgtgttacttaatcaagccctccacaatgaccgacaaagaaatggaaagccctgagtgtatgaagagaatcaaagtccaagaggtaatactttccaggtgggtgtcctctcgggagcggagtgatcaagacgacctctag

SEQ ID NO: 245266 - DNA, 1398 bp, Artificial Sequence
  Description of Artificial Sequence: Synthetic coding sequence
atggccgaagccgttttccatgcgccaaagcggaagcgacgcgtttatgagacatacgagtccccccttccaataccgtttgggcaggaccatgggccactcaaagagtttaaaatcttccgagcagagatgattaataacaatgtcattgtccgtaatgcagaggatattgagcaattatatggaaaaggctacttcggtaagggaatcctatccaggtcccgcccaagttttaccatcagcgaccctaaacttgttgccaaatggaaggatatgaaaaccaacatgccaattattacctccaagcggtatcagcactcagtggaatgggctgccgagctcatgcggagacagggacaggatgagtcaacagtccggaggatactgaaagactataccaaaccactcgaacatccacctgtcaaacggaatgaggaggctcaggtgcacgacaaattgaactctgggatggtttccaatatggagggtactgctggaggggaaagaccctcagttgtgaatggtgacagcggcaaatcaggtggggtgggagaccccagggagccactaggatgcctgcaggaaggcagcggctgtcaccctaccacagagtcctttgagaagagtgtgcgcgaggatgccagccccttgccccacgtgtgttgctgcaaacaggacgccctcattctccaacggggactgcaccacgaggacgggagccagcatattgggcttctgcaccccggtgatagaggacctgaccacgaatacgtgttggtggaagaagccgagtgtgcgatgagcgaacgagaggcagcccctaacgaggaacttgtccagagaaatcggctcatatgccggaggaacccttaccggatcttcgagtatctccagctgagcttagaagaggcgtttttcctggtttacgccctgggttgcctatcaatttactacgaaaaggaaccgctgacaatcgtgaaactctggaaggcatttaccgtggtccagccaacattcagaacgacttatatggcctatcattatttccgcagcaagggttgggtgcctaaagtgggccttaagtatggcacagacctgctgttatatcgaaaaggccctcctttctatcacgcgagttacagtgtgattatcgagctggtggacgaccacttcgagggctcccttcgacgccctttgagttggaagtccctggccgctttgtcgcgcgttagcgtgaacgtgagcaaagagctgatgctgtgttatctgataaagcccagtacaatgaccgataaggagatggagtccccagagtgcatgaagcgaataaaggtccaggaggtgatcctgtccagatgggtcagctcaagagagcggtcagaccaggacgatttatag

SEQ ID NO: 245267 - DNA, 1320 bp, Artificial Sequence
  Description of Artificial Sequence: Synthetic coding sequence
atggcagaagccgtgtttcacgctcctaaacggaaaaggagagtgtacgaaacctacgaatcacccctgcccatcccttttggccaggaccacgggcctctcaaggaattcaagatattcagagccgaaatgattaacaataatgttatagttagaaacgccgaagatatcgagcagctgtacggtaaagggtacttcggaaagggaatcctttcgaggtctagaccctccttcaccataagtgacccaaagctcgtggcaaaatggaaagacatgaaaacaaatatgccaataattacttcaaagagataccaacattccgtggagtgggcggcagagctgatgagacgccagggccaagacgagagtacagtcaggcgcatcctgaaagactatacaaagcctctggaacaccctcctgtgaagcgaaatgaggaggcgcaagttcatgacaagctcaattcaggcatggtctctaatatggagggcacagcagggggagaaaggccgtcagtggttaacggggatagcggaaagagcggcggagtgggagatccacgcgagccgctcgggtgccttcaggaaggaagcgggtgtcatcccaccaccgaatcatttgaaaaaagcgtgcgtgaagatgcatcccccctgcctcacgtctgctgctgcaagcaggatgctctgatcctgcagagagggcttcatcacgaggatggatctcaacatatcggactgttacatccgggagaccggggtccggatcatgaatatgtgttggtcgaagaggcggagtgcgccatgagcgagagagaggcagcccctaacgaagaagccttcttcctggtgtatgccctagggtgtttgagcatctactacgagaaagagccactcaccattgtcaagctctggaaggccttcactgtcgtgcagcctacgttcaggacaacttacatggcttatcactacttccgtagcaaaggatgggtgcccaaagtcggactgaaatatgggacagacctgctgctctatagaaagggacccccattttatcacgctagctattctgttatcatagagcttgttgatgaccacttcgaaggctctttacgccgtcccctgagctggaagagcctggctgctctgtctcgtgtctctgtgaatgtaagcaaggagctgatgttgtgttatctgataaagcccagcaccatgaccgacaaggaaatggaaagccctgaatgcatgaagcgtatcaaggtgcaagaggtaattctctccagatgggtgagctctagagagcggtcagatcaagatgatctctag

SEQ ID NO: 245268 - DNA, 1209 bp, Artificial Sequence
  Description of Artificial Sequence: Synthetic coding sequence
atggccgaggcggtctttcacgctcccaagcgaaagcgccgagtgtacgaaacgtacgagtcacccctccccattcccttcggccaggaccacgggccactcaaagagttcaaaattttccgcgcagagatgatcaacaacaacgtcatagttagaaacgcggaggacatcgagcagttgtacgggaaaggctatttcggcaaagggatcctgtcccgttcacgcccttccttcactatttctgacccaaagctggtcgcaaaatggaaagacatgaagactaacatgcctattatcacatccaagcggtaccagcatagcgtcgaatgggccgctgaactaatgaggagacagggacaggacgaatccaccgtgcggagaatcctgaaagattacacgaagccactcgagcacccaccggtgaagcgaaacgaggaggcccaggtgcacgacaagctcaattcaggtatggtctcaaatatggaagggacggccggtggtgaaaggccctccgttgtaaatggcgattccggaaagtccggaggcgtgggcgacccaagagagcctctgggttgcttgcaagaagggtcaggctgccacccaactaccgaatccttcgagaagtccgtcagagaagatgcttcacccctgcctcacgtttgttgttgcaaacaggatgccctgatccttcagagggggctgcaccatgaggatggatcgcagcacattggcctgctccatccaggcgaccggggacccgaccacgaatatgtcttggtggaagaggcagagtgcgctatgtccgagcgagaggctgcacctaatgaggaagctttcttcctggtgtacgcacttgggtgtttgagtatctactacgagaaggaaccactgaccatcgtgaagttatggaaggcctttacagttgtacaacctaccttcagaaccacatatatggcttaccattacttccggtccaaaggctgggtcccaaaggtcggcctcaaatatggtacagatctgctcctgtacagaaaaggtccccctttctaccacgcgagttacagcgtgattatcgagctagtggatgatcacttcgagggatccctccggaggccactctcgtggaagtcactcgcagccctctctcgcgtttctgtgaatgtgtctaaagttacccaacatcagctctgccactggtcagtcacctag

SEQ ID NO: 245269 - DNA, 1137 bp, Artificial Sequence
  Description of Artificial Sequence: Synthetic coding sequence
atggccgaggctgttttccacgcccctaagagaaagcgcagagtgtacgagacctatgaaagccccctgccaatcccattcgggcaagatcatgggcctctgaaggaattcaagattttccgcgcagagatgatcaacaataacgtaattgtcagaaacgcagaggatattgagcagctgtatggcaagggatacttcggaaaggggatcctcagtcgctccagaccaagtttcacaatctccgatccaaagttggtggcaaaatggaaggacatgaagacgaacatgcccatcattacatcgaaaaggtaccagcactcagtggagtgggccgcagagttgatgaggcggcagggccaggacgaaagtacggttcgacggattttaaaggattacacaaagcccctcgagcaccccccagtaaagcgaaacgaagaagctcaggtgcacgataagctcaactctggaatggtctccaatatggagggaacagctggtggcgaacggccttccgtggtgaacggagacagcggcaagtcaggaggtgttggagatccgagggaacctctggggtgccttcaggagggtagcggctgtcaccccaccaccgagtccttcgaaaagtccgtgcgcgaggacgcctcacctctcccccatgtgtgttgttgcaagcaggacgcgctcatacttcagcgaggtcttcatcatgaagacgggagccaacatattggcctactgcaccctggggatcgcggaccagaccacgaatatgtgctcgtggaagaggccgagtgtgctatgtccgagcgagaggccgctccgaacgaggagctggttcagagaaatcgacttatttgtcggaggaatccttaccgaatcttcgagtacttacaacttagcctggaggaggcgttcttcctcgtatacgctctaggttgtctgtcgatttattatgagaaggagcccctgacaattgtaaagctgtggaaagccttcacggtcgtgcagcctacgtttaggaccacatacatggcctaccactactttcgaagtaagggctgggttcccaaagtgggccttaagtatggcacggatctgctgctgtatagaaagggacctcccttctatcacgcgtag

SEQ ID NO: 245270 - DNA, 1317 bp, Artificial Sequence
  Description of Artificial Sequence: Synthetic coding sequence
atggccgaggcagtgttccatgctcccaaacggaagcgccgagtttatgagacctacgagtcccctcttccgatccccttcggccaggatcatggccctctgaaggagttcaagatattccgggctgagatgatcaacaacaacgttattgtccgcaacgctgaggatattgaacaactttacgggaaagacatgaagacaaatatgcctattattacctcgaagcgctaccagcattccgttgagtgggccgcagagctcatgaggcgtcaaggtcaggacgaatcaaccgtgagacgaatactcaaggattatacaaagccactagaacaccctcctgtaaagaggaatgaagaggcccaagtgcacgacaagctcaatagtggaatggtgagcaatatggaaggcaccgctggcggtgaacggcctagtgttgttaacggagactctggcaagtctggtggtgtaggagacccaagggagcctctcggctgcctccaggaaggatctggatgtcacccaactactgagagcttcgagaaatcggtacgagaagacgcttctcctcttccgcacgtatgctgttgtaaacaggatgctctgatcctgcagcgcggtcttcaccacgaagatggaagtcagcatatcgggctgttacaccctggcgatagagggcctgaccacgaatacgtcctcgtcgaggaggccgagtgtgcaatgtcagagagagaagccgctccaaatgaagaacttgtgcagcgaaaccggttgatatgccggcgaaatccttatcggattttcgagtacctgcagctatcgctcgaggaagcctttttcctcgtttacgcattgggctgtttaagcatttattatgaaaaagagccactcaccatagttaagctgtggaaggcttttactgtagttcagccaacatttcgaactacgtacatggcataccattacttccggagcaagggctgggttcctaaagtgggcctgaaatacggcaccgatctgctgctctataggaagggccctccgttctaccacgccagctactctgtaataatcgaactggtcgacgatcatttcgagggctcgcttagacgtcccctgagctggaagtcactcgcagcattaagccgcgtgtcagttaacgtctccaaagaactcatgctttgctacttgattaagcccagtacaatgacggataaggagatggagtcccctgaatgcatgaaacggattaaagtccaagaggtgattctctcccgctgggtttcatcaagggagcgatcggaccaggacgatttgtag

SEQ ID NO: 245271 - DNA, 1221 bp, Artificial Sequence
  Description of Artificial Sequence: Synthetic coding sequence
atggcagaggcggtgttccacgcacccaagagaaagcgacgggtttacgaaacgtacgagtcccccttacctataccttttggacaggaccatggccctttgaaagagttcaagatcttccgggcagaaatgatcaataacaacgtaatagttaggaacgctgaggatatcgagcagctttatgggaaaggctacttcgggaaagggattttgtcacggtctcgcccaagttttacgatctctgacccaaagctggtcgccaaatggaaggacatgaagacgaatatgccaattataacaagcaagagataccagcatagtgtcgaatgggctgctgagcttatgagaaggcagggacaggatgaaagtacagtgcgccgtattctgaaggactacactaagccactggagcatcctcccgtcaagcggaacgaggaagctcaggtgcatgacaagctgaattccggaatggtaagtaacatggaaggaaccgccggaggagagaggccaagcgtgcgaggtctgcatcacgaggacgggagccagcacattggtttactgcaccctggagaccgagggccagaccatgaatacgtgctggtggaggaggccgagtgcgcgatgagcgaacgtgaggctgcgcctaacgaggaacttgtgcagcggaatcggctaatatgccgcaggaatccttaccgaatctttgaatacctgcaactgtcactggaagaggccttctttctggtgtacgcccttggttgtcttagcatatattacgagaaagagccccttactatcgttaaactttggaaggcctttactgtcgtccagcccactttcagaacaacttatatggcataccactactttcggagcaagggatgggttcccaaggtgggtctgaagtatgggactgatctcctgttgtataggaaaggccctccattctatcacgccagctattccgtcattattgagctggtggatgaccatttcgaggggtcgctacgccgtccactgtcctggaagagcctagcagcactgtccagggtgtcagtgaatgtgtccaaggagctaatgctatgttatttgatcaagccttctactatgacagacaaggaaatggagtcacctgaatgcatgaaacgaatcaaggtacaagaggtcatcttatctaggtgggtgtcttctagagaacgttctgatcaagacgatctttag

SEQ ID NO: 245272 - DNA, 933 bp, Artificial Sequence
  Description of Artificial Sequence: Synthetic coding sequence
atgctcgtcgttgaagttgctaatgggcgttccctggtgtggggggctgaggccgtgcaagccctgagagaacgcctgggggtgggcggtcgcacagtcggtgcattaccacgcggacctagacagaatagcagactgggattgccactgttacttatgccagaggaggctcgcctattggcggagataggcgctgtcaccttagtgtcagcccctcgccctgattccaggcatcactcattggcgctgacctctttcaagcgccagcaagaagagtcgttccaggaacagagtgcacttgctgcggaggcacgggagaccagaaggcaagagctgttggaaaagattactgagggccaagccgctaaaaaacagaagctagaacaggcctcaggtgccagctcctcgcaagaggccggttcttcacaagcagcgaaagaggacgagacctcagacggacaggcttctggggaacaggaggaggccggaccatcctcttcacaggcagggcctagcaatggtgtggccccactccccagatctgcactgctcgtccagctggcaacggcgaggccacggcctgtcaaagcaaggcccctggactggagagtccaaagcaaagattggccccacgctggaagaccagcgcacgagcttaggtacagcatctatcgcgacctgtgggagcgcggattttttctgtctgcagcaggaaaatttggcggagacttcctcgtgtaccctggagaccccctcagattccacgctcactatatcgcccagtgctgggcacccgaggataccatccctcttcaggacctcgtggccgctgggcgactcgggaccagcgttcggaaaaccttgctgctgtgttccccccaacccgacggaaaggttgtgtatacatcgctgcagtgggctagtttgcagtag

SEQ ID NO: 245273 - DNA, 933 bp, Artificial Sequence
  Description of Artificial Sequence: Synthetic coding sequence
atgctcgtcgttgaggtcgccaacggcaggtccttggtttggggcgcagaagcagtccaagcacttcgtgaacggctgggcgtgggcggtcgcacagtcggcgctcttccccgaggaccaagacagaactcccgcctcgggctcccactgctcctcatgcctgaggaggctcggcttcttgccgaaattggagcagttacacttgtttccgcaccaagacctgattcccgccaccactccctggccctgacctcgtttaaaagacagcaagaggagagtttccaagagcagtccgccctggctgccgaagcacgggaaacccggcgtcaagagctactggagaaaattactgagggacaagcagcgaaaaagcagaagttagagcaggcctcaggcgcatcgagctcccaagaagcaggttctagccaggccgcaaaggaagacgaaacctctgatggccaggccagcggggagcaggaagaggctggccctagcagctcacaggcagggccttctaacggagtcgcccctttgcctcggtctgccttgctggtccagctcgctacggccaggcctcgccctgtcaaggcacgtccactggactggagagttcagtccaaggattggccacacgctggccgtccagcacacgagcttcggtacagcatctaccgagatttgtgggaacgcggattctttctctctgctgcaggtaagttcggaggtgattttctcgtttaccccggagatcctctgaggttccacgcacattacattgcacagtgctgggctcctgaggacacaatacctctccaggatctggtggcagccggacggctgggaaccagtgtcaggaagaccctgctactttgctctccccagcccgatggtaaggtagtgtatacgtccctgcaatgggcctctcttcagtag

SEQ ID NO: 245274 - DNA, 933 bp, Artificial Sequence
  Description of Artificial Sequence: Synthetic coding sequence
atgttggttgttgaggtggccaatgggagaagccttgtctggggggctgaggcggtgcaagcactaagggaacgcttgggcgtggggggacgaacagtcggggctctcccacgtggcccacggcagaattccagattaggactgccattgttgctgatgccggaagaggcccgactgctggctgagatcggcgctgtcacgctggtctcagcccctcgtccggattcaaggcatcactcactcgcactaacctcgtttaaacgtcaacaggaggagtcttttcaggagcagagtgccctggcagcagaagccagggagacgagacgacaagaattactagagaagatcacagaagggcaggctgccaagaagcaaaaactcgagcaggccagcggtgcctcttcaagccaggaagctggatcgtctcaagccgcaaaagaggatgagacgagtgatggacaagccagcggcgagcaggaagaggctgggccaagtagctcccaggctggacccagtaatggtgtagcacctcttccgcgttccgctctgttggttcaactcgccacagctaggcccaggcccgtgaaggctagaccccttgactggcgggtgcagagtaaggattggccgcacgcgggaagacccgctcatgaattacgatatagtatttatcgcgacctttgggagagaggattctttctgagcgctgcaggcaaatttggcggtgatttcctggtctatcctggcgaccctttacgcttccacgcccattacatagcacaatgttgggctcccgaggacacaatcccactccaagacttggtcgccgctgggagactgggcacatcagtgcgaaagacgctactactgtgctcgcctcagccagacggcaaggttgtctatacaagtctacaatgggcctctctccaatag

SEQ ID NO: 245275 - DNA, 939 bp, Artificial Sequence
  Description of Artificial Sequence: Synthetic coding sequence
atgctcgtggtggaggtcgccaatgggcgttccctggtgtggggggctgaggccgtccaagccctgagagagcggctgggcgtcggaggcaggactgttggagcactgcctcggggtccccgtcagaatagccgactgggcctgcctctgttgttgatgcctgaagaggcaagactacttgctgaaattggcgcagttactctagtgtccgctccgaggcctgactctcggcaccatagtctcgcactgaccagcttcaagaggcagcaggaagaaagctttcaggaacagtccgctctggcagcagaggccagagagacgagacggcaggaactcttggaaaagatcacagagggccaggccgctaaaaaacagaaactcgagcaggcgagtggagccagctctagccaggaggcaggaagttctcaggcggctaaagaagacgaaacctccgacggacaggcatcaggcgaacaagaggaggctggacccagtagctcccaggcaggtccatctaatggcgtcgctcctttgccgcgatccgcccttctggtacaactggccaccgcaagacctagacctgtaaaagcgcgacccctggactggagggtgcagagcaaggactggccccacgccggtagaccagcccacgaactgagatactctatttatcgagacctatgggaacgagggttttttctgagcgccgcaggtaaatttggcggtgacttcctcgtgtacccgggagatccgctgagattccatgcacactacatcgcccagtgctgggcaccagaggatactatccctcttcaggatctggtggccgcaggacgtctgggtacctctgtgagaaagacattgctgctatgttctccacaaccagatggatttaagagtcaggaagtgtccataaatctagtgtacaagtgtagttag

SEQ ID NO: 245276 - DNA, 729 bp, Artificial Sequence
  Description of Artificial Sequence: Synthetic coding sequence
atgcttgtggtggaagtggcgaacggaagatcgcttgtatggggtgccgaagcagttcaggctctaagggagcgactcggcgtgggcggtcgcaccgtaggggcactcccaaggggcccaagacaaaattctcggctcggcctcccactgctgctgatgcctgaagaggccagattgctggctgagatcggagctgttacgctggtcagtgcacctcgaccagattcaaggcatcactccttagcactaactagctttaagaggcaacaagaggaatctttccaggaacaatctgctcttgcagccgaggctagggagacacgccgtcaggaactcctggagaagatcacagaaggccaggctgccaagaagcagaaactggagcaggcatccggcgcaagctcgagccaggaagccggtagttcacaggcagccaaagaggatgagactagtgacggacaggccagcggagaacaggaagaggccggaccctcgtcctcccaggccggaccctccaacggcgtcgctccactgcccaggtcagccttgctcgtacaactcgcaaccgctaggcccaggcctgtaaaagccaggcctctggattggcgcgtccaaagtaaagattggcctcacgccggaaggcctgcacatgagctgagatattcaatatatcgggatctctgggagcgagggttctttctttcggccgcaggaaaatttggcggatag

SEQ ID NO: 245277 - DNA, 1581 bp, Artificial Sequence
  Description of Artificial Sequence: Synthetic coding sequence
atggaaccggaaccagagcctgcagccgtggaagtgccagccggtagggtcctatcagccagggaactgttcgccgctcgctctaggtcccagaagctgcctcaacgaagccacggtcctaaggacttcttgccagatggctcagccgctcaggccgagaggctgcgacgctgccgagaagagctgtggcagcttttagccgaacaaagagtggagcgcctgggctccctggtcgccgctgagtggcgccctgaggaagggttcgtagaactgaagagcccagccggaaaattttggcagacgatgggtttctctgagcaaggcaggcaacgcctccatcctgaggaggcgttatacttgcttgaatgtggtagcatacacctctttcaccaggacctgcccctatcaatccaggaggcctaccagcttctgttaactgaccataccgtaactttcctgcaataccaagtcttttcacacttgaagaggctgggttatgtagtccggcgttttcagccttccagcgtcctctcaccttatgagagacagctaaacctggacgcgtcagtgcaacacctcgaagacggcgacgggaagaggaaaaggtctagctcctctccgaggtcgattaataagaaagccaaggcgctggataacagtctgcagccaaaatccctggcagctagctcccctcccccatgctcacagccttcacagtgtcccgaggagaagccacaggaaagcagccctatgaagggtccagggggtccctttcagctgctcgggtccctgggtccaagccctggccctgctagggaaggtgtgggatgctcctgggaaagcggtagggcagagaacggagtgactggtgccggaaagcggaggtggaatttcgaacagatatcttttcccaacatggcctctgactcccggcatacccttctcagggcacccgcacccgagctacttccagccaatgtggcaggtcgagagactgacgccgaaagttggtgtcagaagcttaaccagaggaaagagaaacttagccggagggaacgtgaacatcacgctgaagctgctcagtttcaagaggatgtaaatgcggacccagaagtccagagatgttccagctggcgggaatacaaggagctgctacagagaaggcaggtccaacgtagtcagcgccgtgcccctcacctatggggacagcctgttacgcctctcctttctccagggcaggcttccagtcctgcagttgtcctgcagcatatctccgtactgcagaccactcacctccccgatggaggtgccagactgctagagaagtccggtggcctggaaatcatttttgatgtttatcaggcagacgctgtggcaactttcaggaaaaacaacccgggtaagccctacgcaagaatgtgcataagcggttttgacgagcccgttcccgacttgtgcagcctaaagaggctatcttatcaatctggcgacgtacccctgatctttgcactcgtcgaccatggtgatatctccttttatagtttccgggattttactttgccccaggacgtgggccactag

SEQ ID NO: 245278 - DNA, 594 bp, Artificial Sequence
  Description of Artificial Sequence: Synthetic coding sequence
atgggattcagcgaacaaggcaggcagcggctccatcctgaggaggccttgtatcttctggagtgtggaagcatccacctgtttcaccaagacctgcccttgagtattcaggaggcctatcagttactacttaccgatcataccgttacattcctgcaataccaagtgttctcccacttgaagcgactcgggtatgtggttcgccgtttccagcccagctccgtgttgagcccttacgagaggcagcttaacctggatgcctcagtccagcacctggaggatggtgatggcaagagaaagcggagttcatcttccccaagatcaatcaacaagaaagctaaggccttagataacagcctccaacccaaatctctggccgctagctcaccaccctccggaacctcccgctgtcctagaatgtggggcactgatctaactgccttgcagagaatggaactggctcccggtgatagagattgcctcttctctggcactattagcgcagcctcgtgtactcagacactgacttgttcattccgcggacaatctggtccgtggccttgggtgagcgatactcaccgtgtgaagctgtag

SEQ ID NO: 245279 - DNA, 534 bp, Artificial Sequence
  Description of Artificial Sequence: Synthetic coding sequence
atggaacctgaacctgagccggcagctgtggaggtgccagccggtagggtgctgtctgcccgagaactctttgccgcacgaagccggtcccaaaagctgccgcagcgctcccatggacctaaggactttctcccagatggaagcgcggcacaagcagagaggctgcgaaggtgcagagaggagctctggcaactgttggccgagcagagagtcgagaggttgggttctttggtcgccgctgagtggcggccagaggaagggtttgtggagctgaaaagtccagcagggaaattttggcagaccatggggtttagcgaacaggggaggcaaagactgcacccagaggaggccttgtatctcctggagtgcgggagcatccatctctttcaccaagatctgcccctttcaatccaagaggcctatcagctgctgcttaccgaccataccgtcacttttctgcagtaccaaccgccagaggaggtgggcttgtgtggctccactatacccactaagctgtgcccagtaccagtgtag

SEQ ID NO: 245280 - DNA, 4296 bp, Artificial Sequence
  Description of Artificial Sequence: Synthetic coding sequence
atggatcgcaggaacgactacggttatagagtgcccctgttccagggtccgctccctcctccgggttccctgggtctcccgtttcctcccgacatccaaacagagaccactgaagaggacagcgtgttgctgatgcacacgttgcttgccgctacaaaggatagcctcgccatggacccccctgtcgtgaaccggcctaaaaagtctaaaacaaagaaagcaccaatcaagaccatcacaaaggctgcccctgccgcacctcccgtacccgctgccaacgagattgccactaataagcctaaaatcacctggcaggccctcaatttacccgtgattacgcagatatctcaagcgctgcccaccaccgaagttacaaatacccaggcatctagcgtgaccgctcaacccaagaaagccaacaaaatgaagcgtgtgactgccaaagccgctcagggtagccagtccccaactgggcacgagggcggaaccattcagctaaaatccccactccaagtactgaagctgcccgtgatttctcagaatattcacgcgccaattgccaacgagagcgcttcctcccaggctctgattacgagtatcaaacccaaaaaggcaagcaaggctaaaaaagctgccaataaagccatcgcctccgcaaccgaggtgagcctcgctgcgactgctacccatacagccacgacccaaggtcagatcaccaacgagactgcctcaattcacaccacggctgcctctattcgtaccaagaaggcttctaaggcacggaagactatcgccaaagtgataaatacagatactgagcacattgaagcactgaatgtaactgacgctgcaacccggcagatcgaagcctccgtagtcgcaatcaggcctaaaaaaagtaaagggaagaaagcagcctcccggggacctaattcggtttctgagatttccgaggctcctttagcgacgcaaattgtcacaaaccaggcgcttgcagctacattaagagtgaagaggggatctagagcgagaaaggccgcaacaaaggcccgtgctactgaaagtcagactcccaacgcggatcagggggctcaggctaagattgccagcgcccaaacgaatgtatccgcccttgagactcaggtcgcggctgcggtgcaagctttggctgatgactatttagcgcagctgagcttggagccaaccacgcggactcgtggtaaaaggaacagaaagtccaaacacctaaatggagatgaacggtcaggcagcaattaccgaagaatcccgtggggaagacgtcccgcacctccacgggatgtggccatccttcaggagagagccaataagctagtgaagtatctactcgtgaaagaccagactaagatacccattaaaagatcagacatgttgagggacgtgattcaagagtatgatgagtacttccccgagatcatcgagagggcgtcttacactctggagaaaatgttcagagtcaacttaaaggaaattgacaaacaatcgtccctgtacatattgatcagcacacaggaatccagtgctggcatattgggaacaactaaggataccccgaaacttgggttactgatggtgatcctgagtgtcatttttatgaacggcaataaggcctccgaggcggtgatttgggaagttctgcggaagctcgggctcagacctggagtgcgtcacagcttgtttggcgaggtccgaaagctgattacggacgaattcgtgaaacaaaagtatttagaatacaaaagagtgcctaacagcagacctcccgaatacgaattcttctggggcctacgtagttatcacgaaaccagcaagatgaaggtgcttaagttcgcctgccgagtgcagaagaaggatcccaaagattgggccgtacaatacagggaagccgtagaaatggaagtgcaagctgcggcagtggccgtggctgaggctgaggcgagggccgaagcgagagcgcagatgggcatcggtgaagaagcggtagctgggccatggaattgggacgacatggacatcgactgtcttacacgagaagagctgggggacgacgcccaggcttggtctcgcttctcatttgaaatcgaggctcgcgcacaggagaatgctgacgcaagcacaaacgtgaatttttctagaggcgctagcacacgcgcaggtttttctgacggtgcaagcatttctttcaacggtgccccttcctccagcggaggtttctccggcggacctggcataaccttcggggttgccccttcaacctctgcctcattcagtaatacagcctctatcagcttcggaggcacgctgtccacctcatcatcgtttagttcagccgcttctatctcatttggttgtgcacattcgacgagcacctccttttcctccgaggcgtcgatttccttcggaggaatgccatgtaccagcgccagtttctctgggggtgtgagtagttccttttccggaccactgagcacttcagctacgttttctggaggtgcatcctccgggtttgggggaacgttgtccaccaccgccggtttctcaggagtgctgagcacatcaacatccttcggttcggcccctaccacaagcacagtgttcagttcggctctgtctacctctaccggattcggaggtatcctgtcaacatctgtgtgtttcgggggtagtccctcttcatccggttccttcgggggaaccctgtccacatcaatctgcttcggagggtcgccttgcacatcaactggcttcggtggaacgctgtccaccagcgtctcattcggtggctcctcgagcacttcagcgaactttggaggaacgctgagtacttctatctgttttgacggaagtcctagtacaggggctgggtttggtggcgctctgaatacaagtgcatcattcggatcagtgttaaacacctccactggatttggaggtgctatgagtactagcgcagatttcggcggtaccctgagcacctctgtctgtttcggaggaagcccaggaacttccgtcagtttcggctccgccctcaatactaatgccggatatgggggtgcagtttccacgaacaccgatttcggcggtaccctgtccaccagcgtatgcttcggtggatctcctagtaccagtgccggttttggaggagcactcaacactaacgcaagctttgggtgcgcagtctccacgagtgcaagcttctccggcgctgtctcaacatccgcgtgtttttccggggcaccaatcacaaatcccggatttgggggtgctttctccacatctgccggattcggaggcgctctctcaacagctgcggattttggcggaaccccttctaatagtataggattcggggcagctccctctacatccgtgtcattcggaggggcacatgggacctcactgtgcttcgggggagctcccagcacatcactttgctttggaagcgccagcaatacgaatctctgctttggcggacccccatctacttccgcatgtttctccggggcaacatcccccagcttctgcgacgggccaagcacctctaccgggttcagctttggtaatggcctgtccaccaacgcaggtttcggaggaggtttgaacacttctgctggattcggaggtggcctcggcacgtcggctggtttctcaggtgggttatccaccagcagcggcttcgatggcggacttggcaccagcgctggctttggtggaggacccggaaccagcacgggcttcggcggaggcctgggcacaagtgctggtttctccggcggtctcgggactagcgcagggttcgggggaggtttagttactagcgacggtttcggcggtggcctgggcactaacgccagtttcggcagcaccttgggaacctccgcgggtttcagcggagggctcagtactagtgatggattcgggtctagacccaacgcctctttcgaccggggactcagtaccatcatcggatttggaagcggttctaacacctccaccgggttcacaggagaaccaagcactagtaccggcttcagctccggaccttcatctattgtaggtttctctggcggacctagcactggtgtcggtttctgttccgggccaagcactagcggttttagtgggggacctagcactggggctggctttgggggaggcccaaatacaggcgcaggatttgggggaggaccatccacaagcgccggtttcggaagcggcgctgcgtcacttggagcgtgtggattctcatacgggtag

SEQ ID NO: 245281 - DNA, 2121 bp, Artificial Sequence
  Description of Artificial Sequence: Synthetic coding sequence
atggacagacggaacgattatggctatcgcgtgcccctgttccaagggcctctcccacctccaggcagcctggggctgcccttcccccctgacatccagactgagactaccgaggaagatagcgtgttactgatgcacacgttactagctgctaccaaggacagtctggctatggatcctccggtggtgaataggcccaagaagagcaagacaaagaaggcaccaatcaagacaattactaaagctgcaccagctgcaccgccagtccccgcagcaaatgaaatcgccacgaataagccgaaaattacctggcaagcactgaacctcccagtgatcacccagatctcccaggctctcccaacgacggaagtgactaatacacaggcatcttctgttactgcacagccaaagaaagcaaataaaatgaagagggtgaccgcgaaagctgcgcaaggctcacagtcccccaccgggcatgaaggtggcaccatccagttaaaatccccactccaggtcctgaaactgcccgtaatcagccaaaacatacacgccccaatcgccaacgagtccgctagttcacaggctttgatcacatcaatcaaacccaagaaggcctccaaggccaaaaaggccgctaataaagctatagccagtgccaccgaggtaagcctagctgccacggcaacccatacggcgacaactcagggccagatcaccaacgaaactgcaagcattcataccacagctgctagcattcgcaccaaaaaggcctctaaggccaggaaaactatcgctaaggtcatcaacactgacacagaacatatagaggcacttaacgtgaccgatgctgccacccgccagattgaagcctcggtggtcgctataagaccaaagaagtctaagggtaagaaggcggcatctcggggtcccaatagtgtgtcagaaatcagcgaggccccattagctacacaaattgtcaccaatcaggccctggcggctacactgcgagtgaagcgaggtagtagagcccgtaaggccgcaaccaaggccagagctactgagtcccagactccaaacgcagatcagggcgctcaggccaagatcgcttccgcacagactaatgtaagtgcccttgaaacccaagtcgctgctgccgtgcaggccctagctgatgattatctagctcagctgtcccttgagcctactacacgcacccgcggtaagagaaaccgcaaaagtaaacacttgaatggggatgaaaggtccgggtccaactatcgtcgaatcccatggggaaggcgtccggcacctccgagggatgtggccatcctgcaagaacgagccaacaaactggtgaaatatctactcgtcaaagatcagaccaagatcccaattaaaagaagtgatatgctgagggacgtgattcaggaatatgacgaatattttcctgagattatcgaaagagcatcatatactctcgaaaagatgttccgcgtaaacctgaaggaaatagacaaacagagttcgctttacattctaatctcgacccaggaatcttcagcgggaatcctaggaacaaccaaggacacaccaaaactaggtctgttgatggtgattctatccgtcatcttcatgaatgggaataaggcaagtgaagccgtgatatgggaggttctgcgtaaactgggattaaggcccggagttaggcattccctcttcggcgaagtgaggaagctgattaccgacgagttcgtgaaacagaagtacctggagtataaacgcgtaccaaactccagaccacccgagtatgagtttttttggggcctcagaagttaccatgaaacaagcaagatgaaagtgctgaagtttgcgtgccgagtgcagaagaaggatccgaaggactgggcagtccagtatcgtgaggctgtcgagatggaggtgcaggcagcagcggttgcggtcgccgaagccgaagccagagccgaaatatattcaccttgtctgcaaattccactcattaactgtagttcccccagccacggagcaaaggtccatccttggaacctttgccctcacagtagccaggggagttacggacagtcagccgagggagtcatgtag

SEQ ID NO: 245282 - DNA, 1074 bp, Artificial Sequence
  Description of Artificial Sequence: Synthetic coding sequence
atggacaggagaaacgactatggctatagagtccctctcttccagagcaaacacctgaatggcgacgagaggtccgggagtaattatcgacgaatcccatggggaaggcggcctgcccctccgagggacgttgcaatcctgcaagagagggccaacaagctcgtcaagtacctgctggtcaaggaccaaaccaagatacccatcaaaagatccgatatgctgagagatgtgatccaggaatatgacgagtatttccctgaaatcatcgagcgcgcttcgtacacattggagaaaatgttccgcgtcaatctgaaggagatcgacaagcagtcatcactctacattctcatctccacgcaagagagtagtgccggaatcctgggcacaacaaaggacacccccaagctaggcctcctaatggtgattttaagcgtgatcttcatgaatggtaataaagcctctgaagcagtgatctgggaggtcttgagaaagctgggcttgaggcctggagtgaggcactcgctgttcggcgaggttagaaaactcataacggacgagtttgtgaagcagaaatatctcgagtacaaaagggtaccaaacagcaggcctcccgaatacgaattcttttggggcctgcggagttaccatgagacctctaagatgaaggtgcttaaatttgcctgtagggttcaaaaaaaggatcctaaagactgggccgtccagtatagggaagctgtagagatggaggtccagttgcagctgtggctatggcttcggctcaagcccggattatccggctcaaatacctccactgggtttacaggggagccttcaacctcaactggcttcagttctggcccatcatccatcgtggggttttcaggtggcccaagtacaggcgtcgggttctgttccggtccgtccacgtcgggattttctggtggcccatcaacaggcgcagggtttggaggcggacccaataccggtgctggttttggcggtgggccttcaacatccgctgggtttggctcaggtgctgcatctcttggagcttgcggattttcttacggctag

SEQ ID NO: 245283 - DNA, 2121 bp, Artificial Sequence
  Description of Artificial Sequence: Synthetic coding sequence
atggacagacggaatgactatggctatcgcgtccctctgttccagggcccattaccgcctcccggttccctcggcctgccctttcctcctgatattcaaacagagactaccgaggaggactccgttctgctgatgcacacactcctggctgcaaccaaagactctctcgccatggatcctcccgtggtcaaccggccaaaaaaatcgaagacgaagaaagctcccataaagactattaccaaggccgcaccagcagctccccctgtgcctgcggctaacgaaattgctactaataagcccaaaatcacctggcaggccttaaatttaccagtcattactcaaatctcccaggcgctgccgaccacagaggttacgaacactcaggcctcatctgtgacagcccagccgaagaaagcaaataagatgaaacgagtcactgccaaggctgcacaggggtcacaatcccctacaggtcacgaaggaggcactatccagctcaagagccccctccaggtcctgaagctgccagtgattagccagaatattcacgcacccatcgcaaacgaatctgctagcagccaggcactcataaccagcatcaaacctaagaaggcttcaaaggccaagaaggccgcaaacaaggccattgcctctgccactgaagtctcattggccgcaacagcaacacacaccgcgaccacacagggtcagataaccaacgagacagcctccattcacactacagcagctagtatccggacaaagaaggccagcaaagcacggaagactattgccaaggtgattaataccgatactgagcacatcgaggccctgaatgtgacggatgccgcaacaaggcaaatagaggcctccgtagtcgccatccgcccaaaaaaatctaagggaaagaaagccgcttcaagggggccaaactcagtgtcagaaatttccgaggcacccctggccacccagattgtcaccaatcaagcactagccgctactttacgagtgaagcgcggtagccgggctcgaaaagcggcaactaaggccagagcaaccgaaagccagactccaaatgccgatcagggggcacaagccaaaattgcctccgcacagactaatgtctccgcactggagacccaagtggcagctgccgtgcaggccctggccgacgattacctggctcagctgtctttggaacctaccacacgcacccggggaaaacgcaacaggaagtctaaacacctgaacggagatgagcgcagcggctctaactacaggcgcattccctgggggaggcggcctgctcccccacgcgacgtggcaatactacaggagagggccaacaagctcgtaaagtacctcctggtgaaggatcaaaccaagatccctattaaacggagcgatatgctccgcgatgtcatacaggaatatgatgaatatttccccgagatcattgagcgagctagttacactttggagaagatgttccgggtcaatctaaaagagattgacaagcagagttctctttacattttgatatccacgcaagagtcatcagccggtattctggggaccaccaaagatacgcccaagctgggcctactgatggttattttatcggtgatctttatgaacggcaacaaggcaagcgaagcagttatttgggaagtgctgcggaagctggggttgcgaccgggagtaaggcactcactctttggggaagtgaggaaattgattaccgacgagttcgtgaaacagaaatacctcgaatataaacgggtgcccaacagccgcccacctgaatatgagttcttttggggattacggtcataccacgagacttcaaaaatgaaggttttgaagttcgcctgcagagtccagaagaaagatcccaaagattgggccgtccagtacagagaagccgtcgaaatggaggtgcaagcagcagccgtcgccgtggctgaagccgaggccagggccgagatatacagcccctgcctccagatacctctcataaactgttctagtccgtcccacggagccaaggtacacccttggaatctgtgtccccacagttcccagggctcgtacggccaatctgccgagggtgtaatgtag

SEQ ID NO: 245284 - DNA, 3105 bp, Artificial Sequence
  Description of Artificial Sequence: Synthetic coding sequence
atggaccgtcgtaatgattacggttatcgcgtgccgctgttccaaagcaaacatcttaatggggacgaaaggtctgggtcaaattacagacgaatcccctggggcagacggccagcgcctccacgcgatgtcgcgattctccaggagcgagctaataagctggtcaagtatctgctagtcaaagaccagaccaagatcccaatcaaacgttcggatatgctgagggacgtgattcaagaatatgacgagtactttcccgaaatcattgagagagcctcatatactcttgagaaaatgtttcgagttaatctcaaggaaatagacaagcagagcagtctgtacatactgattagcactcaggaatcatcagcaggcattctggggacaacaaaggatactcccaagctcggtctgttaatggtgattctttctgttatctttatgaacggcaacaaggcctctgaggccgtgatatgggaggttcttcgcaaactgggactcagacccggtgtgagacactcattgttcggcgaggtgcgtaagctaattaccgacgagttcgtcaaacagaagtacctggagtacaagcgagtacctaactcgcgtccgccagaatacgagttcttctggggacttagaagctaccacgaaactagcaagatgaaggtcctgaaattcgcttgtcgagtgcagaagaaagaccccaaagactgggccgtacagtacagagaagccgtggagatggaggttcaggctgccgctgtggcagtggccgaggcagaggccagagccgaggcaagggcccagatgggcataggcgaggaagcagtggccggtccttggaactgggacgacatggacatcgattgcctaactagagaggagctaggtgatgacgctcaggcgtggtcaaggttcagctttgagatcgaggccagagcacaagagaacgcagacgcatctactaacgtcaatttctctcgcggtgcctctacacgggcaggcttctccgacggcgctagtattagcttcaacggcgcaccctcctcttcaggcggattctctggcggacccggtatcacatttggggtagctccttccacatcagcttccttctccaatactgcatcaataagctttggaggtaccctgtcaactagcagttcattctccagcgctgcctctatctcctttgggtgcgcgcacagtacatcaacctccttttcctcagaagccagcatcagcttcgggggtatgccctgcacaagcgcgtcgtttagtggcggtgtatccagttccttcagtggaccattatccaccagtgctacattcagcggcggtgcttccagcggattcggaggtacattgtcaactactgcaggcttcagcggagtgctctcaacatccacttcctttgggtctgcccctaccacttccaccgtatttagttcagccctgagcacatccactggcttcggtggaatcctgagtacatccgtgtgttttggaggctctccttcttccagcggctcatttggagggacactgtccacttctatctgcttcggaggcagcccctgtacatctaccggctttggtgggactctgtctacctccgtgagctttggcggaagcagctcgacatccgcgaattttgggggaaccctcagcacgagtatttgcttcgatggatccccatcaaccggagccggattcggtggcgctctcaacacttcagcctctttcggtagcgtgctgaatacgagcactggtttcggcggagctatgagcaccagtgcagattttggaggcacgctctcaacctccgtgtgctttggcggttctcctggcacttctgttagtttcggcagtgccctgaatacaaatgcagggtacggtggtgcggtcagtactaatactgacttcggcggaacactctccacaagtgtttgctttggtggctcaccatccacaagcgctggattcggcggagcacttaataccaacgcaagttttggatgcgccgtatccacatccgcaagctttagtggggctgtctcaacaagtgcctgttttagcggcgctcccatcaccaatcccggtttcggaggagctttcagtacttcagcgggatttgggggtgcactcagtaccgcagcagattttggcggtaccccgtctaactcaatcgggttcggggcagccccttcaacgagtgtgagtttcggaggcgctcatggcactagcctctgcttcgggggagccccatcaacatcgctctgtttcgggagtgccagcaataccaacttatgtttcgggggtccgccatctacaagtgcctgtttctcgggggctacgtcacctagcttttgtgatggtccatctaccagtactggttttagcttcggcaatggactgagcaccaacgctggcttcggtggtggcttaaacacatcggctggcttcggcggtggtctgggtacaagcgctggttttagcgggggactttcaacctcatcaggattcgatggcggattaggtacttcagcgggtttcggcggaggtcctgggactagcacaggattcggtggtggcctgggcacatcagctgggttctctggaggactcggtaccagtgccggatttgggggaggcttggttacgtcggacggattcggcggtggtctggggaccaatgcctcatttggctccactcttgggactagtgcgggtttctctggtggcctatccacctctgatgggtttgggagtagacccaatgccagcttcgaccgtggactcagcactatcataggatttggctcaggatcaaacacttctaccggattcactggcgagcccagcacttccaccgggttcagcagcggacctagtagcatcgtcggcttctcaggcggacccagcaccggcgttggtttttgcagtgggccatctacgtcagggttctcaggtggaccaagtactggcgctggcttcggcggtgggccaaacacaggagccggttttggcggagggccaagcactagcgcaggctttggtagtggcgcagcgtccctcggtgcctgcgggttttcctacgggtag

SEQ ID NO: 245285 - DNA, 693 bp, Artificial Sequence
  Description of Artificial Sequence: Synthetic coding sequence
atgcacaccctcttagctgcaacaaaggacagcctggctatggatcccccagtggtcaataggcccaagaagtccaagacaaagaaagctccaataaagacaattaccaaggcggctcctgccgctcctcctgtccctgcagccaatgagatcgctactaacaaaccaaaaatcacctggcaggcgctcaacctgcccgttatcactcagatttctcaagccttgccgaccacagaagttacgaacacacaggcgtctagcgtcaccgctcaacccaagaaggccaacaagatgaagcgagtgaccgctaaagccgcacagggatcgcagagcccaactgggcacgaaggaggtaccattcagctcaagtcacctttgcaggtactcaagcttcctgtcatctcccaaaatatacatgctcctatcgccaacgaatcagcatccagccaggctctcatcactagcatcaaacctaagaaagcatctaaggccaaaaaagccgctaataaggccatcgcctccgctaccgaggtgtctctcgccgcaactgcaacccacacggcaacaacgcagggccaaataaccaacgagaccgcaagcattcacaccacggctgccagtatccgcaccaagaaggcttctaaggcaaggaagaccatcgcaaaggtgattaataccgacaccgaacactag

SEQ ID NO: 245286 - DNA, 510 bp, Artificial Sequence
  Description of Artificial Sequence: Synthetic coding sequence
atggaccgcaggaatgattacggatatagggttcctcttttccaaggacctctccccccacccggtagccttggtttaccgttccctccggacatacagactgaaaccaccgaagaggactctgttcttttgatgcacaccctgctggctgccactaaggactctttggccatggaccccccagtcgttaacaggccaaagaagtcaaagaccaagaaagcaccaattaaaaccatcactaaagcggcacctgcagcccctcccgttcctgcagccaatgaaattgccacaaataaaccaaaaattacttggcaggctttgaacctgcctgttattactcagatttcgcaggcattacccacaaccgaggtcacgaatacccaggcctcgagcgtcaccgcccagccaaagaaggcaaacaaaatgaagagggtgaccgccaaagccgcacaagggtctcagtcaccgaccggtcatgaagggggtactatccagctcaaaagtccttag

SEQ ID NO: 245287 - DNA, 2889 bp, Artificial Sequence
  Description of Artificial Sequence: Synthetic coding sequence
atgttacgcgatgtcatccaggaatacgacgagtacttcccagagatcattgagcgtgccagttacaccctggagaaaatgttcagagtcaatctgaaagagatcgacaaacaatcttccctatatatactcatttccacccaggaaagcagcgccggaattctcggaacaacgaaggatactcccaaactaggactgttgatggtgatactctccgtgatttttatgaacggcaacaaggcatccgaagcagtgatctgggaagtgctgaggaagcttggcttgcgcccaggagtgaggcacagcttgtttggcgaagtgcgcaaactgatcactgatgaattcgtcaagcaaaagtatctcgaatacaagagagtgccaaactcacgccctccagagtatgagtttttctggggtctccgttcttatcacgagacttccaagatgaaggttctgaaatttgcttgccgggtccaaaagaaagatccaaaggactgggcagtgcaataccgcgaggccgtcgagatggaggtgcaagcagcagctgtggcagtggcggaggcagaggcacgagcagaggctcgtgcccagatgggaatcggggaagaagcggtggcaggcccttggaattgggacgacatggatattgattgtctcactcgcgaagagttaggtgacgacgcacaagcttggtctaggttctcttttgagatcgaggccagagcacaggagaatgccgatgcaagtacaaacgtcaacttctcaaggggcgcatccactcgcgctggattcagcgatggagcctccatttcattcaacggcgctcctagctcatctggaggttttagtggaggacccggtataacatttggggtggccccaagcacttccgcttccttctcaaacacagcgagtatcagttttggcggaaccctgtccacctctagctcattctcatcggctgcaagcatttccttcggctgtgcgcatagcacatcaacttctttctcatccgaggcctctataagcttcggaggcatgccttgcacctctgcctcgttttcaggcggagtgagcagcagcttctctggacccctcagcacctccgcgacgttcagcgggggagcatccagcggattcggtggaaccctgagcacaaccgcagggttctcaggagttctctccacttcgaccagctttgggagtgcacctacaactagtacagtgtttagtagcgctctttccaccagcactgggtttggtggcatcctctctacatctgtttgttttgggggatctccctccagcagcggttcttttggcggtaccctttccacctctatttgtttcgggggatccccgtgtaccagcactgggttcggcggaacactttctacctcagtcagttttggcggtagcagttctactagcgctaattttgggggtaccttgtcaactagcatttgtttcgacgggtctccttctaccggcgcaggcttcggtggtgctcttaacacctccgcctcgttcggctcggtattaaatacgagtaccgggttcggcggagccatgtccacatccgcagatttcgggggtacccttagtacaagcgtctgtttcggaggctctcccggtacttctgtgtcattcggctccgctctcaacaccaatgccggatacggcggtgccgtctcaactaacaccgatttcggcggtaccctgagtacctccgtgtgctttggaggtagcccttcgacttcagcgggattcggcggagcactgaatacaaatgcctcattcggttgcgctgtatccactagcgcgtcattcagtggcgctgtgtccacaagcgcctgtttttccggtgcaccaattacaaaccctgggtttggtggggcattcagcacttctgccggttttggaggagcgctcagcaccgctgcggacttcggcggaacgccatctaatagcattggtttcggggcagcgcctagcacctcagtttcctttgggggtgcacatggtacctccctgtgctttggcggagcccctagtacctccctgtgcttcgggtcagcatcgaacaccaacttgtgttttgggggtccgccatcaacatccgcatgttttagtggcgctacgagcccctccttttgtgacggaccttctaccagcacgggcttctcgttcggtaacgggctgtcgactaacgcaggctttggaggcggtctcaacacctcagcaggatttggcggtggtctggggacgagcgctgggttttctgggggactgagcacttctagcgggtttgatgggggactgggtaccagtgctgggtttgggggtggcccaggcacaagtacaggtttcggcggaggtctcgggacatccgcaggcttcagcgggggtcttggaacatctgcgggattcggcggaggcttggtgacctcagacggctttgggggaggcctcggaaccaacgcctccttcggctccactctggggaccagcgcgggattttcgggtggcctgtccaccagtgacggatttggatccaggccgaacgcatcttttgatcgcggtctgagcacaattatcgggtttggcagcggatcaaacacttccactggcttcactggcgagccgtcaaccagtaccggattttctagcggaccgagttctatcgtgggtttctctggtgggccaagtacaggcgtggggttctgctcaggtcccagtacgtccggattctcaggaggccctagcactggggcaggctttggagggggacccaacactggcgctgggttcggtgggggtcccagcacatcagctggatttgggtctggagccgcatcccttggggcttgcggcttttcatacggctag

SEQ ID NO: 245288 - DNA, 366 bp, Artificial Sequence
  Description of Artificial Sequence: Synthetic coding sequence
atgcacacccttctggcagccaccaaggattcactcgctatggacccacccgtggtgaaccgacctaaaaagagcaagactaagaaagcacccatcaagactattacgaaagcggcacccgctgcccctcctgttccagctgctaacgagattgcgactaacaagcccaagatcacatggcaggccttaaaccttcccgtaattacccagatctcccaagcattgccgacaactgaggttacgaatacgcaagcatcctctgtcaccgcccagcccaagaaggccaataaaatgaaaagggtgacagcaaaggccgcacagggctcacagtcccccaccggccacgagggcggtaccatccagtag

SEQ ID NO: 245289 - DNA, 579 bp, Artificial Sequence
  Description of Artificial Sequence: Synthetic coding sequence
atgcacacactactggctgcaaccaaagactcactcgccatggatccccctgtggtgaataggcccaagaaaagcaaaaccaagaaagcacctatcaagaccatcacaaaagcagccccagccgcaccacccgtgccggctgccaacgagatagcgacaaataaacccaagatcacctggcaggccctgaatctccctgttattacacaaatctcccaggccctccccaccacggaggtcaccaacacgcaggcctcatcagtaacagcccagcccaagaaagccaataaaatgaaaagagtgacggctaaggcagcgcagggaagccagagtcctaccggtcatgagggaggcacaatccagttaaaaagccccctgcaggtgctaaagctgcctgttatctctcaaaacattcacgccccaatcgcaaacgaatctgctagctctcaggccctgatcacatcaattaaacccaagaaggcaagcaaagcaaaaaaagctgccaataaagcaatcgcatccgctacagaggtgagtctggctgctactgctacacataccgccaccacgcagggctag

SEQ ID NO: 245290 - DNA, 531 bp, Artificial Sequence
  Description of Artificial Sequence: Synthetic coding sequence
atggaccgtagaaacgactacggctatagggtgcctctgttccagggaccactacccccacctggttccctcggtctccctttcccgcctgatattcagactgagaccaccgaggaggattccgtcctgctgatgcatacccttctggctgcgacaaaggactctctggcgatggatccgcctgtggtaaatcggcctaaaaagtccaagaccaagaaagcaccaataaagaccataacaaaggccgcacccgctgcccctcctgtgcccgcagccaatgaaattgccacaaataagccaaaaatcacctggcaggcactcaacctgcctgtgattactcagatcagtcaggccctccccaccacggaagtaactaatacacaagcctcttctgtcactgctcagcctaaaaaagccaacaaaatgaagagggtgacagccaaggccgctcagggttctcagtcaccaaccggccatgaaggagggaccattcagctgaaatcccctttacaagtgctgaaacttccttag

SEQ ID NO: 245291 - DNA, 507 bp, Artificial Sequence
  Description of Artificial Sequence: Synthetic coding sequence
atggatagacgcaatgattacggttaccgagtgccactatttcagggcccattgccgcctcccggttctttggggctcccctttcccccagatatacaaacagaaacaacagaagaggactctgtcctgctcatgcacactctcttggccgctaccaaggatagtttagctatggaccctccagttgtaaacagacctaaaaaatcaaaaactaaaaaagctcctattaaaaccataacaaaggccgctcccgctgcccctcctgttcctgctgccaacgaaattgcaactaacaaacctaaaatcacttggcaggcccttaacctccctgtgatcacacaaatctcacaagcactgcctactacagaggtgacgaacacacaggcaagctccgtgaccgctcagcccaaaaaagctaacaaaatgaagagagttacagccaaagctgcacaaggaagccagtcgccaacaggccacgaagggggtacaatccaattgaaatcatag

SEQ ID NO: 245292 - DNA, 2046 bp, Artificial Sequence
  Description of Artificial Sequence: Synthetic coding sequence
atggacaggcgcaatgactatgggtatagagttcctctgtttcaaggcccactgcctccccctggttcactcggcttgccatttcctccagatattcagacagagactacagaggaagattccgtgctcctgatgcatacgctgctcgccgcaaccaaggactcccttgctatggatcctcctgtggtgaacagaccaaaaaaaagcaagaccaaaaaggccccaattaagaccataacgaaggcagccccagcagctcccccagtgccagctgccaacgaaattgccaccaacaagcccaaaatcacatggcaggccttgaatcttcccgtcatcacacaaatctcccaggcactccccactacagaagtgaccaacactcaggccagtagcgtcaccgctcaacccaaaaaagccaataaaatgaagagagtgactgcaaaggctgcacaagggtctcagagccccacagggcatgagggaggtacaatccagttgaagtcaccactccaggtgctgaagctcccagtcatatcccaaaatatacatgctccaatcgcaaacgaatctgccagctcacaggctctgattaccagtattaagccaaagaaagcctctaaggcaaagaaggcagctaacaaggcgatcgccagtgctaccgaggtgagcctggccgcaacagcgacacacacagccacgactcagggtcagatcactaatgaaacagcctcaattcatacaacggcagcgagcatcaggacaaaaaaggcatccaaagcgaggaagacgattgctaaggtgattaacacggacacggagcatatcgaggcgctcaacgtgacggacgccgctaccaggcagatcgaggcctctgtggttgccataagacccaaaaagtcaaagggaaaaaaggcagctagcagaggtccgaactctgtgagtgagatttctgaggctcctctggcaacgcagatcgttacaaatcaggctctggcagccactttacgagtcaaaagaggcagcagggctaggaaggccgctacaaaagcacgcgcaactgagagtcagactccaaatgcggaccagggggctcaggctaagatcgcctctgcacagactaacgtgagcgccctggaaactcaggtggcagctgccgtgcaggcgttggccgatgactatcttgcacagctgagccttgaaccaactacacggactaggggaaagaggaatcggaaaagcaagcatctcaatggtgacgaacgaagcggctccaactacagacgtatcccatggggcaggaggcccgcaccgccacgagacgtggccatcctccaggagcgcgcaaacaagttggtgaagtatctgctggtgaaagatcagacaaaaattccgattaaacggtccgatatgctcagggatgtgattcaagagtatgacgaatacttcccagagatcattgagcgcgctagctacacactggaaaagatgtttcgcgtaaaccttaaggaaattgacaagcagagctccttgtatatcctcatatccacacaggagtccagtgcgggaatcctgggcacaactaaagatactccaaagctgggtctgctgatggtgattctgagtgtcatattcatgaatggtaataaagcttccgaggcggttatctgggaagtattaaggaagctcggattgcgccctggagttagacacagcctgtttggcgaggtccgaaagcttatcaccgacgagtttgtgaagcagaagtacttggagtacaagcgcgtgcccaattcaaggcctcccgaatacgagttcttctgggggctgcggagttatcacgagacttcaaagatgaaagtgcttaagtttgcctgcagggtccagaagaaagaccctaaggattgggctgtgcagtaccgggaagcggttgagatggaggtacaggcagcggcagtcgctgtggcagaagcagaagctcgcgcagaatggttccaacaccaacattggctctactggcggacgcagcatcagcacggtttacagtag

SEQ ID NO: 245293 - DNA, 372 bp, Artificial Sequence
  Description of Artificial Sequence: Synthetic coding sequence
atgcacaccttgctggctgctactaaggacagcctggctatggatcccccagtggtcaacagaccaaagaaatcaaaaactaagaaagccccaatcaagactatcactaaggcagcacccgcagcgcctcccgtgccagcagctaatgagatagcaacaaataagccaaaaatcacgtggcaagccctaaacctgcctgttattactcagatatctcaggctctgcctacaacagaggtgactaacacacaagcttctagtgttacagcacagcctaagaaagctaacaagatgaagcgcgtgacggctaaggccgctcagggaagccagtcccccaccggccacgagggcggtactattcagctgaagtag

SEQ ID NO: 245294 - DNA, 216 bp, Artificial Sequence
  Description of Artificial Sequence: Synthetic coding sequence
atgcacaccctgttggctgctaccaaagacagcctggctatggacccccctgttgtgaaccgacctaagaagagtaagacaaaaaaggcacccattaaaacaatcacgaaggccgctcccgctgccccaccagtccccgctgcaaacgaaatcgctacaaataagccaaagatcacttggcaggcccttaatctgcctgtgatcactcaaatttag

SEQ ID NO: 245295 - DNA, 195 bp, Artificial Sequence
  Description of Artificial Sequence: Synthetic coding sequence
atgcatacacttcttgctgccactaaagactctctggcaatggatcctccagtggtcaatcgccctaagaagagcaaaacaaaaaaggcccctatcaaaactatcactaaagcagcccctgcagcccctcccgtgccggcagctaatgaaatcgcaaccaacaagcccaagattacctggcaggcactgaattag

SEQ ID NO: 245296 - DNA, 930 bp, Artificial Sequence
  Description of Artificial Sequence: Synthetic coding sequence
atggaccgtaggaatgactatggataccgcgtacctttgttccaaagcaaacaccttaacggagacgagaggagcggatcaaactatcggcgaattccttggggtagaaggcctgctcccccacgagatgtcgctatcctgcaggaaagggctaataaattggtgaagtacctactggtcaaagatcaaaccaaaatcccgataaagagatcggatatgttaagggacgtcatacaggaatacgatgagtattttcccgagataatcgagagagcaagttacaccctggaaaagatgtttagagtgaatttgaaggagatagacaagcaatcctcactgtacatcttgatatccacacaagagtccagtgccggaatcctggggacgactaaggacacacccaagttggggctgttgatggtaattctcagcgtcatttttatgaacggcaataaggcatcagaggctgtgatttgggaggtgttacgaaagttaggcctgagacctggagttagacattcactgttcggggaggtgaggaagctgatcactgatgaatttgttaagcagaaatatctggaatataagcgcgtgcctaattctagacctccagagtatgaattcttctggggtttgaggtcttatcacgaaacatcaaaaatgaaggtgctgaaattcgcctgccgcgtgcagaagaaggaccccaaggattgggctgttcagtaccgcgaagccgtggagatggaggtccaggcggcagccgttgctgtggcagaagcggaagctcgggcagaaatttacagcccttgcttgcagatccctcttatcaattgcagtagcccttcccatggggctaaggtacacccctggaatttgtgccctcactcatcacaaggatcatatggacagtccgccgagggtgtgatgtag

SEQ ID NO: 245297 - DNA, 1263 bp, Artificial Sequence
  Description of Artificial Sequence: Synthetic coding sequence
atgccgggtggctgttctcgaggtcccgctgcaggcgacggaagattacggctggcccgtcttgctctggttctcctggggtgggtctcttcgagctcccccaccagcagcgcgagttcctttagttccagcgctccctttctcgcctctgccgtctctgcccagccacctctgcccgatcagtgccccgcactgtgcgagtgcagtgaggcagctcgcacggttaagtgcgtcaaccgcaacctgacagaagtgcccaccgatctgcccgcttatgtccgcaacctcttcctgaccggcaaccagttggcagtgcttcctgcaggagcttttgctaggcgaccccctcttgcggagctcgccgctttgaacctctccggatccagactggacgaagtccgcgcaggcgctttcgagcatcttccatcgctgagacagctggatttgtctcataacccgctagccgacctgtcgccttttgcgttttccggcagtaacgcctctgtgagtgctcccagcccactagtggaactaatccttaaccacatcgtaccccctgaagatgagcgtcagaacaggtccttcgagggtatggtggtggcggctttgctggcagggagagctttgcagggattgcgtcgcttagagcttgcgtccaaccattttctttatctgccacgggatgttcttgcccaactcccaagtttgagacatttagatctatctaacaacagtcttgtttcccttacttacgttagcttcaggaacctcacccatctagaatccctacacctcgaagataacgctctgaaggtgctccataatggaacactggcagagttacagggactccctcatattagggtctttctagacaataacccatgggtttgtgattgccacatggcagacatggtcacgtggctgaaggaaacagaggtggttcagggcaaagatcggctaacctgcgcatatccggaaaagatgcggaatcgagtcctgctagagttgaacagcgccgatctggactgcgaccctatactgccaccctctctccagacatcttacgtgttcctcggcatcgtactggcactgataggcgcaattttcctcctggttctctatttaaacaggaaagggatcaagaaatggatgcacaatatccgggatgcctgtcgggaccatatggaaggctatcactaccgatacgagattaacgctgatcctcggttgacaaacttgagtagtaattccgacgtgtag

SEQ ID NO: 245298 - DNA, 1263 bp, Artificial Sequence
  Description of Artificial Sequence: Synthetic coding sequence
atgcctggtgggtgtagcaggggtccggctgctggcgatgggcgtcttcggctggccaggcttgctctggtcttactcgggtgggtgagctcttcatcacctacaagcagcgccagcagcttttctagcagcgcgccattcttagcgtctgccgtgtctgcccagccccctctgcccgatcagtgtcctgccctctgcgaatgttccgaggctgcgaggacagtaaagtgcgtcaaccgtaatctgacagaagtgcctacagacctgcccgcttatgtgaggaacctcttcctgacaggaaatcagctcgcagtcctacctgcaggcgcattcgccaggcggcctcctctcgcagaactcgccgctcttaacctttctggttcgaggttggatgaggtgcgagccggtgccttcgaacatctcccgagtctccgccagctggacctttctcacaaccccctagcggatctaagtccattcgcgttttccggatctaatgcatcagtctccgctccttctcctctcgtggaactcattctgaatcatatcgtgcccccagaagacgagcgccagaataggagcttcgagggtatggttgtcgcggcacttctcgccggacgcgcactccagggactacggagactcgagctagcttctaaccactttctctatctgccaagggatgtactggcgcaactgcctagccttcgtcatttggacttgtccaacaacagtctggtcagtctgacatatgtgtcattcagaaacctgacccatctagaatctctacacctcgaggataatgctctgaaggtactccacaatgggacccttgcagagttgcagggcctcccccatatccgtgtcttcctggacaataatccatgggtgtgtgactgccacatggctgacatggtcacatggctgaaagagaccgaggtggttcagggaaaagaccggctaacatgcgcttaccccgagaagatgcgaaaccgggtgctgctggaactgaattccgctgacctggactgtgatcctattttaccaccttccctgcagacgagctacgtattcctaggtatcgtactcgcactaatcggtgccatctttctgctggtgttatacttgaacagaaaaggtattaaaaagtggatgcacaacattagggatgcctgccgtgaccacatggagggctaccactacaggtacgagatcaacgcagatcccaggctaacaaacctcagttccaacagtgacgtgtag

SEQ ID NO: 245299 - DNA, 1263 bp, Artificial Sequence
  Description of Artificial Sequence: Synthetic coding sequence
atgcctggaggttgctcacgcggtcccgcagccggtgatggcagactccgcttggctcggctggccctggtgctgctaggttgggtgtcctccagttccccaacctcgagtgctagttctttttctagcagcgcacccttcctggcctccgctgtgagtgcacaaccaccactgcccgaccagtgtcctgccctctgtgagtgctcagaggcagctcgtacagtaaaatgcgtaaatcggaatctcactgaggtccctacggacctgcccgcttatgtgcggaatcttttcctgaccggcaaccagctcgcagtgctgccagcgggagccttcgcccgacgcccaccactagccgagttggccgcacttaatctgtccggaagtcgactcgatgaggtccgagccggtgcgttcgagcaccttcctagcttgcgccagctcgacttgtctcacaatcctttagcagatctttcaccctttgcttttagcgggagcaacgcctcagtttccgcgccatccccattggtggagttgattcttaaccatatagtaccgcctgaagacgaacgccagaacaggagcttcgaggggatggtagtcgccgcactcctcgctggaagggccttgcaggggctccgaaggctcgagttggcttcaaaccactttctttacttgcccagggatgtactggctcagcttccttcgctgaggcacctggacctctctaataatagcttagttagccttacgtacgttagctttcggaatttgacccatttggaatcccttcacttggaggataatgctctgaaggtcctgcataacggaactctagctgaactacagggattaccccacatccgcgtgtttctcgataacaacccatgggtgtgcgattgtcatatggcagacatggtaacttggctgaaggaaactgaagtcgtgcagggaaaagaccgactgacatgcgcatatccagagaagatgcgcaacagggtccttttggagcttaacagcgccgatcttgattgtgacccaatacttccaccttccttgcagaccagctacgtgttcctgggaatagtgcttgctctcataggcgctatttttctcctggtgctctacctgaacagaaagggcataaagaagtggatgcacaacatcagagatgcgtgtcgggatcatatggagggatatcactatagatatgaaatcaacgcggacccacgccttacgaacctgtcaagcaacagtgatgtctag

SEQ ID NO: 245300 - DNA, 1056 bp, Artificial Sequence
  Description of Artificial Sequence: Synthetic coding sequence
atggctctgcctttccaaaaggaacttgagaaatataagaatattgacgaagatgaattactaggaaagctgagcgaggaagagcttaagcagctcgagaacgtcctggatgacctcgaccctgagagcgccatgttgcctgctggctttcgacagaaagaccagactcagaaggccgctaccggacccttcgaccgcgaacaccttttgatgtacctggagaaagaggccctcgagcagaaggacagagaggattttgttcctttcaccggagagaagaagggaagggtgtttattcccaaagagaagcctattgagacaaggaaggaggaaaaagtgacactcgaccccgaactagaagaagcacttgcttcagcctctgatacagaactctacgaccttgccgcagtcttgggggttcacaacctactgaacaaccctaaattcgacgaggagaccgctaacaataagggaggtaagggtcctgtgaggaacgtagtgaaaggggaaaaggtgaagccagtatttgaggagcccccaaatcccaccaatgtggagatctcattgcagcaaatgaaggctaatgatccatcactccaagaagtgaacctgaataatatcaaaaacatccctatccctactctccgcgagtttgccaaagcattggagacaaatacccacgtgaaaaaattcagtctcgcagccacgagaagcaatgatccagtggcaatcgcattcgcggatatgttgaaggttaacaaaaccctcacgtccttgaacattgaatccaacttcatcacagggaccggtatacttgccctcgttgaggctctgaaagagaacgatactctgacagagatcaagatcgacaatcagcgacagcagctgggcactgcagtcgagatggaaattgcccagatgcttgaagagaactctcgcattctgaaattcggttaccagtttactaaacagggaccccgtacacgggttgctgctgccattaccaagaataacgacctggttagaaaaaagagggtcgaggctgaccgacgttag

SEQ ID NO: 245301 - DNA, 948 bp, Artificial Sequence
  Description of Artificial Sequence: Synthetic coding sequence
atggccctgccctttcagaaggaactggagaagtacaagaacatcgatgaagacgagttgctgggcaaactctccgaagaggaacttaaacagctcgaaaacgtcctagatgacctggatcccgaaagcgccatgctccccgcaggttttagacaaaaggatcagacacaaaaagcggcaacaggacctttcgacagagagcatctgttgatgtatctggaaaaggaggcactcgagcagaaggaccgcgaagacttcgtccctttcacgggtgaaaaaaaagggcgagtctttatccctaaagagaagccaattgaaacccgcaaggaagagaaagttaccctggatccagagctagaggaagccctggcctctgcctcggatactgagctatacgacctggcagccgtgctgggagttcataatttgctcaataatcccaagttcgacgaggaaacagccaataataagggcggaaagggacctgttcggaacgtggtgaagggggaaaaagtcaagcccgtgttcgaagagccaccaaaccccaccaatgtggagatcagcttgcagcagatgaaagctaatgatccctctttgcaagaggtaaatctgaataatatcaaggccttcgcagatatgctgaaggtgaataagaccttaactagcttgaacattgagtctaatttcataacagggaccgggattctcgctttagttgaggccctaaaggagaacgataccttgaccgagataaagattgataaccagcggcagcaacttgggacagcagtggagatggagattgcccagatgttagaagagaattctcgaattctgaaattcggttatcagtttacgaaacaggggcctagaactcgggtcgcggctgccattaccaaaaataatgacctcgtacgcaagaaaagagttgaggctgacaggagatag

SEQ ID NO: 245302 - DNA, 1059 bp, Artificial Sequence
  Description of Artificial Sequence: Synthetic coding sequence
atggcgctaccatttcgtaaagatcttgaaaaatataaggatctggatgaggatgaacttctcgggaacctgtcagaaacagagctaaagcaacttgaaacggtccttgacgacctggaccccgaaaacgccttactacctgcaggctttcggcaaaagaatcaaacgtctaagagcacaactgggccattcgaccgagaacatctgcttagctatctcgagaaggaagcactcgaacacaaggacagggaagattacgtcccgtacactggtgaaaaaaagggaaagatatttatccctaaacagaagccagtgcaaacattcacagaggagaaagtatctctggaccccgagctggaggaagcattgaccagcgcctctgacacagagctatgcgacctcgctgccatcctgggcatgcacaatctgataactaacactaaattttgtaatattatgggaagtagcaatggagtcgaccaggaacacttttctaacgtggtgaagggagagaaaattctcccggtgttcgacgagcccccaaaccctacaaacgttgaggagtctctcaagagaacgaaagaaaacgatgcccacttagtcgaagtgaaccttaacaatattaaaaatatccctatccccacgctgaaagatttcgccaaggcactcgagaccaatacacatgtaaagtgcttctccctggccgcaacccgatctaacgaccctgtcgcgactgcattcgctgaaatgctcaaggtgaacaagacgctgaagagtctcaacgtggaaagcaatttcatcacaggcgttggcatcctggccctgatcgatgcacttcgcgacaacgaaacccttgctgaactcaagattgataaccagcgccaacaacttggtactgcggtggagctggaaatggcaaagatgctggaagagaacaccaacattctgaagtttggataccagttcacccagcaggggcctagaacgcgtgctgccaacgcaataactaagaacaatgacctggtgcgcaagcgccgagtagagggggatcaccagtag

SEQ ID NO: 245303 - DNA, 1059 bp, Artificial Sequence
  Description of Artificial Sequence: Synthetic coding sequence
atggcattgccatttcggaaagatctcgaaaagtataaagacctagacgaagatgaactgctcgggaacctgtctgagacagaactgaagcagctggagacggttctagacgatttagatccagaaaacgctcttctgccagcaggcttccgccagaagaatcaaacatcaaagtcaacaacaggcccttttgaccgggagcacttgctgtcttacctggagaaggaggcgctggagcacaaggaccgagaagattatgtgccatacaccggggagaagaaaggaaagattttcatccccaaacaaaaaccggtgcagacatttacggaggagaaagtttccctggaccctgagctggaggaagctctaaccagcgcgtctgataccgaactgtgtgacctggccgcaatcctgggaatgcacaacttaataactaataccaagttctgtaatataatggggagtagtaacggagtagaccaggagcatttctccaacgtagtcaaaggcgagaaaattctgcctgtgttcgatgaacccccaaaccccacaaacgtggaggagtccctaaagcgaacaaaggaaaatgatgctcaccttgtggaagtgaatcttaacaacatcaagaatatccccatccccacccttaaggatttcgcgaaagcacttgagaccaatacccacgtgaagtgttttagtctggcagctactcgctcaaatgacccagtagcaacagcttttgcggagatgctcaaagtgaataagacgctaaagtctctgaacgtggaatctaacttcattacgggcgtcggcatcctggcactcatcgatgcactgcgggacaatgaaactctggcagagctcaagatcgacaatcagcggcagcaattggggaccgccgtagaactggagatggctaagatgctcgaggagaacaccaacatcctgaaattcggatatcagttcactcaacagggacccagaacccgcgcagccaatgctataacaaaaaataacgacctggttcgtaaacgtcgcgtcgaaggcgatcaccagtag

SEQ ID NO: 245304 - DNA, 102 bp, Artificial Sequence
  Description of Artificial Sequence: Synthetic coding sequence
atggcgctgccattccggaaagatttggagaaatataaagatttggacgaggatgaactcctagggaatctctcagaaacggagcttaagcagcttgaatag

SEQ ID NO: 245305 - DNA, 1038 bp, Artificial Sequence
  Description of Artificial Sequence: Synthetic coding sequence
atgagctcatatcagaaggagctagagaagtatagagacatcgacgaggacgagattcttcgaaccctaagcccggaggaactcgagcaactcgactgtgagttacaggagatggatcccgagaacatgttgttgccagctggtctcagacagagggatcagacgaagaagtcccccacgggccctttggatcgggaggctttgcttcaatacttggaacagcaggcccttgaagttaaggaaagagacgacctggtgccatttacaggcgaaaaaaagggaaaaccctacattcaaccaaagcgggaaatcccagccgaagagcagattaccctcgaaccggagctggaggaagcgctcgcccacgcaaccgacgccgaaatgtgcgatatcgcggctattttggatatgtacacactcatgtccaacaagcagtactacgatgccttgtgttcgggcgaaatttgcaatacggagggcattagcagcgtggtgcagcctgataaatacaaacccgtaccggatgaacctccaaaccctaccaacattgaggaaatattgaagagagtgagatccaatgataaggagctcgaggaagtcaatttgaataacatccaagatattcctatccctatgttaagtgagttgtgtgaggcaatgaaggcaaacacctacgtacgcagcttcagtcttgttgccactagaagcggtgacccaatcgctaatgccgtcgctgacatgctcagagagaaccggtccttacagtccctgaacatcgaaagcaacttcatcagttccacaggactgatggccgtgttaaaggccgtaagagaaaatgcaactctcacagagttgagggtcgataatcagcgacagtggcctggcgacgctgtcgagatggagatggctacggtgctggagcagtgcccgtctatagtgagatttggatatcattttacacagcaaggacccagagcccgagcggcacaggctatgacgcgcaataacgagctgcggagacagcagaagaagcggtag

SEQ ID NO: 245306 - DNA, 831 bp, Artificial Sequence
  Description of Artificial Sequence: Synthetic coding sequence
atgtcttcctatcagaaggaattagagaaatatagggatatcgatgaagacgaaatccttcgcacgctgagtcctgaggaactcgaacagctggattgcgagttgcaagaaatggacccagaaaatatgctgctgccagcaggcctccgacagagggatcagacaaagaagagtcccacgggccctttggaccgggaggcacttcttcaatatctggagcagcaggcacttgaagtaaaagagagggatgatctggtaccctttaccggggaaaagaagggcgtagtccaaccagataaatataaaccggtcccggatgaaccacctaaccccaccaacatcgaagagatacttaaacgagtgcgcagcaacgacaaggagttagaggaagtgaatttgaacaacattcaagacattcctatacccatgctgtcagagctctgtgaagccatgaaagcaaacacgtatgtccgcagcttttcactggttgctactcgctccggcgatccgattgcgaacgctgttgccgacatgcttcgcgaaaatcggtcactgcagtcactgaacatcgagagcaattttatcagctcaaccggtctgatggccgttctgaaggcagttcgtgaaaatgccacccttaccgaattgcgcgtcgataatcagcgacagtggcccggagatgccgtagagatggagatggctaccgtgcttgaacagtgcccatcaatagttagattcggatatcatttcacacagcagggtccaagagccagagcagcccaggccatgactcgcaacaacgaactccgccgtcaacaaaagaaacgttag

SEQ ID NO: 245307 - DNA, 429 bp, Artificial Sequence
  Description of Artificial Sequence: Synthetic coding sequence
atgagctcataccagaaggaattggagaagtaccgggatattgacgaagacgaaattctccggactctgtctcccgaggaattggaacagctcgactgtgagctccaggaaatggaccccgagaacatgctgctgcccgcaggtcttcgccagcgagaccagactaaaaagtcacccaccggacccctcgaccgggaggcattgctacagtatcttgagcaacaggcgctggaggtgaaggagcgggacgacctggtacccttcaccggcgaaaaaaaaggcaaaccctacatccaaccaaaaagggaaattccagccgaagagcagataacactggaacctgagctcgaggaagcacttgcacatgccactgacgcagagatgtgcgatatagccgcaatcctggacatgtatacactgatgtcatag

SEQ ID NO: 245308 - DNA, 855 bp, Artificial Sequence
  Description of Artificial Sequence: Synthetic coding sequence
atggacgctattaagaaaaagatgcaaatgctcaaattagataaggagaacgcactggatagagctgaacaagctgaggctgacaagaaggccgctgaggatcggagtaaacagctggaggaggacatcgccgctaaggagaaactgctgagggtgagcgaagatgaacgagaccgagtcttggaggagctccataaggctgaggactctctcctcgcagctgaggaggccgctgccaaggccgaggctgacgtcgcttctttaaatcgtcggatccagttggtcgaagaggagcttgacagagcgcaggagcgcttagcgacagcactccagaagttagaggaagccgagaaggcagctgacgagagtgaacgcggtatgaaagtgatcgagtcacgggctcaaaaggacgaagaaaaaatggagatacaggaaatccagttgaaggaagcaaagcatattgccgaggatgccgatcgtaaatacgaggaagtggcaaggaagctagtgattatagagtcagaccttgagcgggctgaagagagagcagaattatcagaggggaaatgtgctgaactcgaggaggagcttaagaccgtgaccaataatttgaagtccctcgaggctcaggctgaaaagtactctcagaaagaggacaggtatgaggaagagatcaaggtactgtccgacaagttgaaggaagctgaaactcgagccgaattcgctgagcggtcagtgacgaagctcgaaaagagtatagatgacctggaagagaaagtcgcgcacgctaaagaggagaatctgtcaatgcaccagatgctagatcagaccctcttagaactgaataacatgtag

SEQ ID NO: 245309 - DNA, 855 bp, Artificial Sequence
  Description of Artificial Sequence: Synthetic coding sequence
atggatgccatcaagaagaaaatgcagatgctcaaactggataaggagaacgcccttgatcgagcagagcaagcagaagccgacaaaaaggcagccgaggaccgctcaaagcaattagaggacgaactggtttccttgcagaagaaactgaaggggaccgaagacgaactcgacaagtacagcgaagccctaaaggatgcgcaagagaagctggagcttgcggagaagaaggctactgacgcagaagctgacgtcgcctcacttaacaggcggattcagctggtggaggaggagctggatcgagcccaggagcgcttggcaaccgccttacagaaactagaagaggcagaaaaggctgcagatgaatcagagcggggtatgaaggtgatcgagtcccgggcacagaaagacgaggagaagatggaaatccaggagattcagctgaaagaagcaaagcacatcgcggaagatgcggaccgtaagtacgaggaagtcgcccgtaagcttgtgatcatcgagtcagatctggagcgtgccgaggagagggcagaactttcagaaggccaggttagacaattagaagagcagctgcggattatggaccagactttgaaagccctgatggccgcagaagacaagtattctcagaaagaggaccgctatgaggaagaaattaaagtcttatccgataagctgaaagaggctgagactcgggcagaattcgccgagcgaagtgtaaccaaactggagaaatcgattgatgacctcgaggatgagctctacgcccagaagcttaagtacaaagcaatctcagaagaactggatcacgctctgaatgacatgaccagtatgtag

SEQ ID NO: 245310 - DNA, 738 bp, Artificial Sequence
  Description of Artificial Sequence: Synthetic coding sequence
atggctgggtcttcaagcctcgaagccgtcagacgcaaaatcaggtccctgcaggagcaggccgatgcagctgaggaacgggctggcacacttcagagggagttggatcacgagcggaagctccgtgagactgccgaggccgacgtagcgagcctgaaccggagaatccagcttgtcgaggaagagctcgacagggcgcaagaacgcctggccacggcattgcaaaaactcgaggaggcggaaaaagccgctgatgaatctgagcgaggtatgaaagtaatcgagagtcgggctcaaaaagatgaagaaaaaatggagatccaggagattcaattgaaggaggccaagcacatagcagaagacgccgatcgaaagtatgaggaagttgcacgcaagctggtgatcatagagtctgacttggagcgcgctgaagagcgagccgaactgagcgaagggaaatgcgccgaacttgaggaagagctaaagaccgtcacaaacaaccttaaatctctggaagcccaagcagagaagtattctcagaaggaggacaggtacgaagaggagatcaaagtgctgagcgacaaacttaaagaagctgagactcgggctgaatttgcggaacggtctgtgaccaagcttgaaaagtcgatcgacgatcttgaagatcagctgtaccagcagctggagcagaacaggaggcttacaaacgaactaaaacttgccctcaatgaggactag

SEQ ID NO: 245311 - DNA, 981 bp, Artificial Sequence
  Description of Artificial Sequence: Synthetic coding sequence
atggacgccattaaaaaaaaaatgcagatgctcaaactggacaaagagaacgccctggacagagctgagcaggctgaagctgacaagaaggcagcggaggaccgaagcaagcagctcgaagaggacattgctgctaaggaaaaacttctgcgtgtaagtgaagacgaaagggaccgggtcttggaggagcttcataaagcagaagacagtctgctggccgcagaggaagcggctgcgaaattggaagatgagttggtgtcccttcagaagaagctgaagggaaccgaagatgagctggataagtacagcgaggccctcaaggacgcccaggagaagcttgaactggcggaaaagaaagccaccgacgcagaggccgatgttgcaagcttgaacaggagaatccagctagtagaggaggagctcgatcgggcacaggagcggttggctacggccctgcaaaagttggaagaagccgagaaggcagcggatgaatccgaacgtggtatgaaagtgatagagtctagggcacagaaggacgaggaaaagatggaaattcaagagatccagctcaaggaggctaagcatattgctgaagacgccgacagaaagtacgaagaagtggcaagaaaattagtaatcattgaatccgacctagagcgcgcagaagagagagccgaactctcagaaggcaagtgcgcagagttagaagaagaactgaagaccgtcactaataatctcaagtccctggaagcccaggcagaaaagtacagccagaaggaggaccgttacgaggaagagattaaggttctgagtgataaactcaaggaagctgaaaccagggcggagtttgcagagcggtctgtgacaaaattggaaaagtcaattgacgacctggaggagaaagtcgcccatgccaaggaagaaaatctttctatgcatcagatgctggaccagaccctcttggaactgaacaatatgtag

SEQ ID NO: 245312 - DNA, 855 bp, Artificial Sequence
  Description of Artificial Sequence: Synthetic coding sequence
atggatgccattaaaaagaagatgcagatgctgaagctcgacaaggaaaacgccctggacagggcagaacaggctgaagcagacaaaaaggccgcagaagataggtccaagcagctcgaggatgaactcgtgagtctacagaagaagttgaagggtaccgaagacgaactcgacaaatattccgaggccttgaaagacgctcaggaaaagctggagcttgcagagaagaaggcgacagacgcggaggctgacgtggcatctcttaacagacgaattcagctagttgaggaggagcttgaccgggcacaggagcgactggccaccgccctgcagaagctggaggaggctgaaaaggccgctgacgagtcagaaagggggatgaaagtgattgaaagtcgggctcagaaggacgaggaaaaaatggaaatacaggagatccagctcaaggaagcaaaacatattgccgaggacgctgaccgcaaatacgaggaagttgcccgaaaacttgttatcattgagtctgacttagaaagagcagaggaaagggcagagctttctgaaggccaggtgagacagctggaagagcagctgcgtataatggaccagaccctgaaagcactgatggccgcagaagacaaatacagccaaaaagaggaccgatacgaggaggaaatcaaggtactctccgacaagctgaaagaggcggagactagggcggaattcgccgagagaagtgtgaccaaactagagaagtccatagatgatctggaagagaaagtggctcatgccaaagaagaaaatttatctatgcaccagatgcttgaccagacactgcttgaactcaacaatatgtag

SEQ ID NO: 245313 - DNA, 855 bp, Artificial Sequence
  Description of Artificial Sequence: Synthetic coding sequence
atggacgccataaaaaaaaaaatgcagatgcttaagttggataaggaaaacgcactggatagagctgaacaagccgaggccgacaaaaaagcggctgaagatagaagcaaacagctggaggacgaactggtctccctgcagaagaaactcaagggaacggaagacgagctggacaaatattcagaggctctgaaggatgcccaggaaaagctggaattggccgagaagaaagccacggatgcagaggccgacgtggcatcactgaaccggcgtattcagctagtggaagaagaactggacagggcccaagaacgactagccaccgccttgcagaaattggaggaggctgaaaaggccgcagacgagtccgagagaggaatgaaggtgattgaatctcgggctcagaaggatgaagaaaagatggagatacaggaaatccagctcaaggaggccaagcatatcgcagaagacgctgaccggaagtacgaagaggtggcgcgaaagctagttataatagagtctgacctggagcgggctgaggagcgcgctgagttatccgagggaaagtgcgccgagttggaggaagaactaaagacagtaacaaataaccttaagtcactggaggcccaggccgaaaaatacagccagaaagaggatcgatacgaagaagagataaaggtgctgtccgataaactcaaagaggcggagacacgtgcagaatttgcagaaaggagcgttacgaagttagaaaaatctatagacgaccttgaagatgaactctatgcgcagaaactcaaatataaagctatttcagaagaactcgatcacgccctaaacgatatgacatccatttag

SEQ ID NO: 245314 - DNA, 855 bp, Artificial Sequence
  Description of Artificial Sequence: Synthetic coding sequence
atggacgcaataaagaagaaaatgcaaatgctgaagctggacaaggaaaacgctttggatcgggctgaacaagcagaggcagacaaaaaggccgctgaagaccggtcaaaacagctcgaagaggatatcgccgctaaggagaagctcctacgagtgagtgaagatgagagagacagggtcctcgaagagttacacaaagcagaggactctctgctggccgcagaggaagccgctgccaaggccgaggctgacgtggcctcgcttaatcgaaggatccaattggtggaagaagagctggatcgcgcacaggagcgcttggcaaccgctctgcaaaagttggaagaagcggagaaagccgcagacgaatcagagcgagggatgaaggtcatcgagagtcgcgctcagaaagacgaggaaaagatggagattcaggaaattcagctgaaggaagctaagcatatcgccgaggatgctgacaggaagtacgaggaggtcgcgagaaaactagtcatcatcgaatctgatctggagagagccgaggagagggcggaactgagcgaggggcaggttaggcagttggaggaacagctacgcatcatggatcagacactgaaggctctcatggctgccgaagataaatactcccagaaagaagacaggtatgaggaggaaataaaggtactaagcgataaactaaaggaagcagagacgagggcggagttcgcagagaggagcgttactaagctcgaaaaatccattgacgatctggaagagaaggtggctcacgcaaaggaggaaaatttgtcgatgcatcagatgctggaccagacgctgttggagctgaataatatgtag

SEQ ID NO: 245315 - DNA, 855 bp, Artificial Sequence
  Description of Artificial Sequence: Synthetic coding sequence
atggacgcaatcaaaaagaaaatgcagatgttaaagttggacaaggagaacgctttagacagggccgaacaagccgaggccgacaaaaaggccgcagaggataggagcaaacagctggaagatgaactcgtgtctctgcagaagaagctcaaaggcacagaagacgagctagataagtatagtgaagcactgaaggacgcccaggagaagcttgagctggccgaaaaaaaagccaccgacgccgaagcagacgtagcatcacttaatcggagaatccagctggttgaagaggagttggacagggcacaggagagattggcaactgccttgcaaaaacttgaggaggccgagaaggccgctgatgagagcgagcgcggaatgaaggtgatagagtccagagcccaaaaggatgaggaaaaaatggaaattcaagagattcagctgaaggaggctaagcatattgcggaggatgctgacaggaaatatgaggaggtggccagaaagctggtcatcatcgaatctgatctggagcgcgctgaggagcgcgcagaactgagcgaggggaaatgcgcggagctcgaggaagagttgaaaaccgtgacaaataacctgaaatctctagaagctcaggctgagaaatactcccagaaggaagacagatatgaggaagagatcaaggtgttgagcgacaagctgaaagaggcagagactagggcagaattcgcagaaaggagtgttacaaaactcgaaaagtcaattgacgaccttgaggaaaaggtggcccacgcaaaggaagagaacctgtctatgcaccaaatgctcgatcagaccctcttagagctgaacaacatgtag

SEQ ID NO: 245316 - DNA, 798 bp, Artificial Sequence
  Description of Artificial Sequence: Synthetic coding sequence
tgacgtgcagagcaagctgaggccgataagaaggcagctgaggacaggagcaagcagctagaggacgagcttgtctcacttcagaagaaactgaagggcaccgaagacgaattggacaaatacagtgaggcactcaaggacgctcaggagaagctcgagttggccgaaaaaaaggcaaccgatgccgaggcagatgtcgccagcctgaatagacgtatccagctggtggaggaagaactcgaccgggcacaggaacggttggcaactgcccttcagaagctggaagaagccgaaaaagccgctgacgaaagcgaacgaggaatgaaggtaatcgaatccagagcccagaaagacgaagagaagatggaaattcaagaaattcagttaaaggaagccaagcatatcgcagaggatgccgaccggaaatatgaggaagtggcacgcaaactggtgatcatagaatctgacctggaaagggctgaagagcgcgctgagctgtccgaaggcaagtgcgctgaactggaagaagagctcaaaactgtgaccaacaatttgaagagtctggaggcgcaggctgaaaaatacagtcagaaagaggaccggtacgaagaggaaatcaaagtactcagcgataagttgaaggaggctgaaacgcgtgcagagttcgctgaacgcagcgtgactaagctggaaaagagtatcgacgatttggaggacgagctgtatgctcagaaactcaaatacaaggccatctctgaagagctggatcacgccctgaatgacatgaccagcatgtag

SEQ ID NO: 245317 - DNA, 855 bp, Artificial Sequence
  Description of Artificial Sequence: Synthetic coding sequence
atggatgccattaaaaaaaagatgcaaatgctgaaactggataaagaaaacgcaatcgatcgggctgagcaagccgaagcggataagaaacaggctgaagacagatgcaaacagctggaggaggagcaacaagccctgcagaagaagctgaagggtaccgaggatgaagtggaaaagtactctgaatctgttaaagaggcgcaggagaagctggagcaggccgagaagaaggcaaccgatgccgaagcggatgtggccagtctaaacagaagaatccaacttgtcgaagaagagcttgacagagcacaggaaaggctcgccactgctcttcaaaaactggaggaggcagagaaagctgcggacgagagtgagaggggtatgaaagttatcgaaaatcgtgcgatgaaggatgaagagaagatggaactccaagaaatgcagctcaaggaagctaagcatatcgctgaggatagcgaccggaagtacgaggaggtcgcgaggaagctggtcatccttgagggcgaattggaacgatctgaggaacgggctgaagtcgctgagtcaaagtgcggtgatcttgaggaggaattaaagatcgtcaccaataatttaaagagtcttgaagcccaggccgacaaatattcaacaaaagaagacaagtacgaggaagagattaagcttctggaggagaagctcaaagaggccgagacccgagccgagtttgcagaacggagcgtcgcgaagctcgagaagacaatagacgacctggaggaaacgctggcttctgctaaggaggagaatgtggaaattcatcagacgctggaccagactctcctagagctgaacaacctgtag

SEQ ID NO: 245318 - DNA, 855 bp, Artificial Sequence
  Description of Artificial Sequence: Synthetic coding sequence
atggatgctattaaaaaaaaaatgcaaatgcttaaactggataaggaaaatgctatcgatcgggctgagcaagccgaagcagacaaaaaacaggctgaggatcgctgtaaacagcttgaagaagaacagcaggcccttcagaaaaagcttaaggggaccgaggacgaggtagaaaagtacagtgaaagtgtgaaggaagcacaggaaaaactcgagcaagctgaaaagaaggccaccgacgcagaggccgacgtcgcctccctcaaccgccgaatccagctggtggaggaggagctcgacagggcacaggagagacttgctactgccctacaaaagttagaagaagccgagaaggccgcagacgaaagcgaacgcggaatgaaggtcatcgagaatagggccatgaaggacgaggagaaaatggagctgcaggaaatgcaacttaaggaggccaagcacatcgccgaggatagtgaccgtaagtacgaagaagtggcaagaaagctagtgatactcgagggagagttggaacggtccgaggagcgcgctgaagtggccgaatctaagtgcggcgatctggaggaggagctgaagatcgtgacaaataatttgaagtctttggaggcgcaggctgataaatactctacaaaggaggataaatacgaggaggagatcaagcttcttgaggagaagctgaaggaggcagaaaccagagcagaattcgccgagaggtctgtggccaagctggagaaaaccattgatgatctggaggacgaggtttatgctcagaaaatgaaatacaaggcaatcagcgaagagctcgacaacgcgctgaatgacatcacatctttgtag

SEQ ID NO: 245319 - DNA, 855 bp, Artificial Sequence
  Description of Artificial Sequence: Synthetic coding sequence
atggacgcaatcaaaaagaagatgcagatgctgaagcttgataaggagaacgccattgatagggcagaacaggcggaggcagataaaaagcaggctgaagaccgctgtaaacagcttgaagaagaacagcaggctctgcagaaaaaactgaagggaacggaggacgaagttgaaaagtactccgagagcgtaaaagaggcacaggagaagctagagcaagctgagaagaaagccaccgacgccgaggcagacgtagcatccttgaatcgcaggatccagctggtggaggaagaactcgatcgcgctcaggaacgtctggctaccgcacttcaaaaactggaggaagctgagaaggccgctgatgaaagcgagcggggaatgaaagtcattgagaacagggccatgaaagatgaagagaagatggagctgcaggagatgcagctgaaggaggcgaaacacattgctgaggactcggatcggaaatacgaggaggttgcacgcaagctggttatcctcgagggtgagctcgagaggagcgaggagcgcgctgaagtggccgagtccagggccaggcagctggaggaggagctgcggaccatggatcaggcactcaagagtcttatggcctctgaggaggagtatagtacaaaggaggacaagtatgaagaggaaatcaaacttttggaagagaagctcaaggaggccgaaaccagagcagaatttgcggaacgatcagtggctaagttggagaaaactattgacgatctggaagaaacactagcctccgctaaggaagaaaacgtggagatccaccagacactggaccagacactgctagaactgaacaacctgtag

SEQ ID NO: 245320 - DNA, 969 bp, Artificial Sequence
  Description of Artificial Sequence: Synthetic coding sequence
atggacgctatcaaaaagaaaatgcaaatgctcaagctggacaaggagaatgctatagaccgcgctgaacaggccgaggctgataagaaacaggccgaggacagatgtaagcagctcgaagaagaacaacaagctctgcagaagaagctcaaagggactgaggacgaggtcgaaaagtacagtgagtccgtgaaagaggcccaggagaaactggaacaggctgagaaaaaagcaacggacgccgaggctgacgtcgcctcactcaatcggcgaatccagctggtagaagaggaactggatcgggcacaggaacgcctggccactgcactccagaagctagaagaggcggagaaagctgcagatgagagcgagcgcggaatgaaagtcattgagaaccgggctatgaaggacgaggagaaaatggagctccaagaaatgcagttgaaggaggctaagcacatcgccgaggattccgatagaaaatacgaggaagtcgcgagaaagctagtaattcttgagggagaactggagagatccgaggagcgagccgaagtggcggagagtaagtgcggggatctcgaggaggaactgaaaatagtgactaataacctgaagtccctggaggcccaggctgacaagtactcaaccaaggaagataagtatgaagaggaaataaaactattagaagagaaactgaaagaggcagagacccgggctgagtttgcggaaaggagcgtcgcaaaactcgaaaaaaccatagacgatttggaggaatccacttcaattgcaactactgaacattggtttacccctgatacgcttgcacttacagataccccttctccttgtactgaaccaacccacaaaaccccctggccaaccttaaaacctctgtgcacagggactccttggctcagtctctccgatagccccttgcacgtgggtacgtgtggcccaattaagccatag

SEQ ID NO: 245321 - DNA, 858 bp, Artificial Sequence
  Description of Artificial Sequence: Synthetic coding sequence
atgatggaagctataaagaaaaaaatgcagatgctaaaactggataaggagaatgctctcgatagggccgagcaagcagaggcagagcagaagcaggcggaagagcgttctaagcagctcgaagacgagctggcggcaatgcagaagaagctcaagggcactgaagacgagttggataagtacagtgaggccctgaaagatgcccaggaaaagcttgagctggccgaaaaaaaggcggcagatgccgaggctgaggtggcctcactgaatcgcagaatccaacttgtggaagaggagctggacagggcccaggaacggctcgccactgcgcttcagaagctagaagaagctgaaaaggcggctgacgaaagcgagcgcggtatgaaagtcattgagaaccgggctcttaaggacgaggaaaaaatggagttgcaggaaattcagctaaaggaggcaaagcacatcgcggaagaggcagaccgcaagtatgaggaggtggcgcgaaagctggttattattgaaggggatctggaaagaaccgaggaacgggcagagctagcagagtcgcgatgtcgcgaaatggacgagcagatcaggctcatggatcagaacctaaagtgtctctcagctgccgaagagaaatatagtcaaaaggaggataagtacgaggaagagatcaagatcctgaccgataaattaaaggaggccgagacacgcgctgaattcgcagaacgatctgtcgctaagttagagaaaacgattgatgacctagaggacaagctgaaatgcactaaggaggagcatctgtgtacgcagcggatgctcgaccaaacattgttggacttgaatgaaatgtag

SEQ ID NO: 245322 - DNA, 744 bp, Artificial Sequence
  Description of Artificial Sequence: Synthetic coding sequence
atggccggaattacaactattgaggctgtgaagaggaaaatccaggtgctccagcagcaagccgacgacgcggaggaacgcgcagaacgcctgcagagagaggtggagggcgaacgcagagctagagagcaggctgaagcagaggtggcatccctgaatagacgcatccagctggtagaagaagagcttgatcgcgctcaggagcggctcgccacggccctccagaagctggaagaggcagaaaaagccgctgatgaatccgaaagggggatgaaagtgattgagaatcgcgctctcaaggacgaggaaaaaatggaactgcaagagatacagctgaaagaggctaagcatatcgccgaagaggccgatcggaagtatgaagaggttgccaggaagctggtcatcatcgagggagacctggagcgcaccgaggaacgagctgaacttgccgagagtaaatgttctgagctggaggaagaacttaagaatgtaaccaacaatttgaagtccctagaggcccaggccgagaagtacagccaaaaagaggacaagtacgaagaagaaattaaaatcttgaccgacaagttgaaagaagctgaaacaagagctgaatttgctgagcgatcggttgccaaactcgagaaaacgattgatgatctagaagagcgattatactcccagctggagaggaatcggttactgtccaacgaactgaaactgactttgcacgatctctgtgattag

SEQ ID NO: 245323 - DNA, 747 bp, Artificial Sequence
  Description of Artificial Sequence: Synthetic coding sequence
atggcaggcatcactaccatagaggccgtaaaacgcaagatacaagtcttgcagcagcaggccgacgacgccgaagaacgggctgaaagattgcagagagaagtggagggagaaagaagggcaagggaacaggctgaggcagaagtagcttccctgaaccgcagaattcaattagtggaagaagaactggaccgtgcccaggaacggttagctacagctctgcagaagctagaggaagctgaaaaggctgccgatgagtcagagagagggatgaaggtcatcgagaatcgggctctcaaggatgaagaaaagatggaactccaggaaattcagcttaaggaggcaaagcacattgcagaggaagccgacagaaaatacgaggaagtggcacgcaagctggtgattattgagggggacctggagcggactgaggagagagctgaactggcagaaagtcggtgtagagagatggacgaacaaattcgtctcatggaccaaaacttaaaatgcctgagcgcggctgaagaaaaatacagtcagaaagaggacaagtacgaggaggagatcaagatcttgacagacaaacttaaagaagctgaaaccagagccgaatttgctgagcgctcagtggctaagctcgagaagactattgacgaccttgaggacgaactgtacgcacagaagctgaagtataaagcaatttctgaagaactggatcacgccctgaatgatatgaccagcatctag

SEQ ID NO: 245324 - DNA, 747 bp, Artificial Sequence
  Description of Artificial Sequence: Synthetic coding sequence
atggcgggtatcaccacaattgaggcggttaagcgaaagattcaggtcctgcagcagcaagcagacgacgctgaagaaagagccgaaaggcttcagagagaggtggaaggtgaacgtagggctagagaacaggccgaggccgaggtagcttccctcaaccggcgtattcagttggtcgaggaagagttagatagagctcaagagcgcctggctacagcactccagaaactggaagaggccgagaaggccgctgatgagtcagaaaggggtatgaaggtgattgagaaccgggcactcaaggatgaggagaagatggagctgcaggaaatccagttgaaggaagccaagcacattgctgaggaggcagatcgcaagtatgaagaagttgccagaaaattggtcatcattgagggtgacttagaaaggaccgaagagagagccgaacttgctgagtctaaatgcagcgagctggaggaagagcttaaaaatgttactaacaacctgaaatccttagaagcccaagcggaaaaatatagccagaaggaggataagtacgaggaagaaattaagattctgactgacaagctgaaggaagccgaaacacgagctgaatttgccgaacggtcggtcgcaaagttagagaaaaccatagatgatcttgaagataaactgaagtgtacaaaggaggagcacctgtgtacacaacgcatgctagatcaaactctactggatttgaatgagatgtag

SEQ ID NO: 245325 - DNA, 675 bp, Artificial Sequence
  Description of Artificial Sequence: Synthetic coding sequence
atggccggaattacaacaatcgaggccgtcaagagaaaaatacaggtccttcagcagcaggccgacgatgccgaggagcgcgctgaaaggttgcaaagggaggtcgagggcgaacgcagggctcgagagcaacgattagctactgcgctgcaaaaactggaagaggccgagaaagcggcagacgagagcgaacgcggaatgaaggtgattgagaatagagctctgaaagatgaggagaagatggagcttcaagaaatacaactcaaggaagctaagcatattgccgaagaggccgatagaaaatacgaggaggttgctaggaaactcgtcattatcgagggcgacctagagcgtacagaagagcgcgcagagttggccgaatcccgatgtagagaaatggacgagcagattagactgatggatcagaacttgaagtgcctcagtgctgctgaggagaagtatagccaaaaagaagacaagtacgaggaggagatcaaaatcctgactgacaaactgaaagaagcagagacaagagccgagtttgccgaaagaagcgtagccaaactcgagaaaacaattgacgacctggaggacaaactcaaatgtacaaaggaggagcatctgtgcacccagagaatgctggaccagactctcctggatctgaacgagatgtag

SEQ ID NO: 245326 - DNA, 858 bp, Artificial Sequence
  Description of Artificial Sequence: Synthetic coding sequence
atgatggaggccatcaagaagaaaatgcagatgctgaaattagacaaggaaaacgccctggatcgagccgagcaggccgaagccgagcagaagcaagcagaggagcggagtaaacaacttgaggatgagcttgcggcaatgcagaaaaaactgaagggtacagaggacgagctagataaatattctgaagcactgaaagacgctcaggaaaaactggaactggccgagaagaaggctgcagacgcggaagccgaggtcgccagcctgaaccgcagaatccaattagtggaggaagagctggaccgggcacaggagaggctcgctacggccctgcaaaagttggaggaggccgaaaaggccgcagatgagagcgaacggggaatgaaagtcattgagaatagggcgctcaaagatgaagagaagatggagctgcaggaaattcagttaaaagaagccaaacacatcgcagaggaagcagacagaaagtacgaagaggtagccaggaagctcgtaatcattgagggcgatctggagcggaccgaggagcgcgctgaactggctgaatctaaatgtagcgagcttgaggaagaattgaaaaatgtgaccaacaacctcaaatctctggaggcacaagccgaaaaatatagtcagaaggaagacaagtatgaggaagaaatcaaaatactgacagataaactgaaggaggccgagacccgagccgagtttgctgagcgtagtgtcgcgaagctggagaagactatcgacgacctggaagacgaattatatgcccagaaactgaagtacaaggccataagtgaagagctagaccacgctcttaacgacatgacgtctatttag

SEQ ID NO: 245327 - DNA, 744 bp, Artificial Sequence
  Description of Artificial Sequence: Synthetic coding sequence
atggccggaataacaacaatcgaggccgtcaagcgcaagatccaggttcttcaacagcaggcagatgacgctgaagagagggcggagcgcttgcagcgtgaggtcgaaggggagcggagagcccgtgagcaagctgaggcagaagtggcatctcttaaccgtagaatccagctggtggaagaagaactcgacagggcccaggagcggcttgcaaccgccctccagaaactggaagaagctgaaaaagcggctgatgaatccgaacgtgggatgaaggtgatagagaatcgtgctctgaaagacgaagaaaagatggaactgcaagagatccaactgaaagaggcaaagcacattgccgaggaggccgaccggaagtacgaagaggtagccaggaagttagtaataatagagggcgacctagagcggactgaggagcgcgctgagcttgccgagagcagatgcagagagatggacgagcagatcaggctgatggaccagaatctgaagtgtttgagcgctgcggaagagaagtatagccagaaggaagataagtacgaagaggaaatcaagatccttaccgacaaattaaaggaggcagagactagggccgaattcgcagagaggtctgttgccaaacttgaaaaaacgatcgacgatctcgaagagcgtttgtattctcagttagaacgcaatcgtttgttatcaaacgaactgaaactcacactgcacgacctttgcgattag

SEQ ID NO: 245328 - DNA, 747 bp, Artificial Sequence
  Description of Artificial Sequence: Synthetic coding sequence
atggctggaattactactattgaggccgtgaagcgtaaaattcaggtgttgcaacagcaggccgatgatgccgaggaacgcgctgagcggctccagagggaagtagagggggaacgcagagctagggagcaagcagaggccgaggtagctagcttgaaccgacggattcagctcgtggaggaagagctggaccgggcacaagaacggctagcaaccgcactacagaaactggaagaagcagagaaagccgctgatgagtcagagcgcggaatgaaggtcattgaaaacagggcacttaaagacgaggaaaaaatggagctgcaggagatccaactgaaagaggcgaagcacatcgccgaagaggccgatagaaagtatgaggaagtggccaggaagcttgtaattatagaaggcgatctcgagagaaccgaggaacgcgctgagctggccgaatcacgctgcagggagatggacgaacagattcggctgatggaccagaacctgaagtgcctatccgctgctgaagagaaatacagccaaaaagaagacaaatacgaagaggagatcaagatcctcacagataagctgaaagaagccgagacacgggcagagttcgccgaacggagcgtggcaaagctggagaagacaattgacgatctggaagataaactgaagtgtaccaaagaggagcatctctgcacccagcgaatgttagaccaaacactgctggatctcaacgagatgtag

SEQ ID NO: 245329 - DNA, 228 bp, Artificial Sequence
  Description of Artificial Sequence: Synthetic coding sequence
atgatggaggccatcaagaagaagatgcagatgctaaaactcgacaaggagaacgcactggacagggctgagcaggccgaagccgaacagaagcaagccgaggaacgctcaaaacaactggaagacgaactggccgcaatgcagaagaaactcaaaggaacggaggatgagctggacaagtatagcgaggctctaaaggatgcccaggaaaaactggagcttgcctag

SEQ ID NO: 245330 - DNA, 747 bp, Artificial Sequence
  Description of Artificial Sequence: Synthetic coding sequence
atggctggtcttaactccctggaggccgtgaagaggaagatccaggctctccagcagcaagccgacgaagccgaggaccgcgctcagggcctccagcgcgagctcgacggcgagcgcgagcggagggagaaggcagagggcgatgtagccgctctaaaccgaaggatccagctcgtcgaagaggagctcgacagggcccaggaaaggctcgccaccgctttacaaaaattggaggaagcagaaaaagccgctgacgagagcgaaagggggatgaaggtaatcgaaaatagagcgatgaaagatgaggaaaagatggagattcaggaaatgcagctcaaagaggccaaacacattgccgaagaagcagaccgtaagtacgaggaggtcgccaggaagctggtcatcctagagggagagctggaaagggctgaggaaagagctgaggtgtcggaacttaagtgtggcgacctggaggaggaactgaagaatgtgaccaacaatctgaagagcctggaggcagccagcgagaagtactccgaaaaggaggacaagtacgaggaagaaatcaagctgctctcagacaaactaaaagaggcagagactcgcgctgagttcgccgagcggactgttgccaagctcgagaagactatcgacgatctggaagagaagctcgcacaggcgaaggaggagaatgtgggcttgcaccagacattggaccagactctgaatgaacttaactgtatctag

SEQ ID NO: 245331 - DNA, 855 bp, Artificial Sequence
  Description of Artificial Sequence: Synthetic coding sequence
atggaggccattaagaagaaaatgcagatgttaaagctagacaaagagaatgccatcgaccgggctgagcaggccgaagcagacaaaaaagccgctgaggacaagtgcaagcaggtggaagaggagctgacacatctgcagaagaagctcaaagggacagaagatgagctggataagtattctgaggatctcaaggacgcccaggaaaagctagagctgacggaaaagaaggccagcgatgccgagggtgacgttgccgctctgaatcgccgaattcagctggtggaagaggagctggaccgcgctcaggagagactggcaactgctctgcaaaagctggaggaggccgaaaaagcagctgacgagtcggagagaggaatgaaagtaattgaaaaccgagccatgaaggacgaggagaagatggaaatccaggaaatgcagttgaaagaggccaagcatatcgcggaagaagccgatcggaaatatgaagaggtggcccgaaagcttgtgatactcgagggggaactggaacgcgctgaagagagagccgaggtgtccgaacttaagtgcggcgatctggaggaagagctcaaaaatgttacaaacaaccttaagagcttggaggctgcaagcgagaaatatagtgagaaggaggacaagtacgaggaagaaattaaactgctaagcgacaaactgaaggaagctgagacacgagccgaatttgccgagcgtactgtcgctaagctggagaaaactatcgacgacttggaggagaaactggctcaggctaaggaggagaatgtggggctgcaccagaccctggatcagacactaaacgagttaaactgtatctag

SEQ ID NO: 245332 - DNA, 855 bp, Artificial Sequence
  Description of Artificial Sequence: Synthetic coding sequence
atggaggctatcaagaaaaagatgcagatgttaaagctggataaagaaaatgcaatcgatagggccgagcaggccgaggcggacaagaaggcagctgaggataagtgcaaacaagtggaggaggaactgacccatctgcagaagaagttgaaaggcactgaggacgaactggataaatattcagaggaccttaaggatgcccaggagaagctagaattaacagagaagaaagcttcagacgccgaaggggacgttgcagccctcaaccgcagaatacagctggtggaggaggagctggacagggcacaggaacgcctggcaacagcgttgcagaagttggaggaggccgagaaagccgcagacgaaagtgagagggggatgaaagtgattgagaatcgcgcaatgaaagacgaggagaagatggagatacaggaaatgcagcttaaggaggcgaagcacatagccgaagaggccgacagaaagtacgaagaggttgccaggaagctcgtcatcctcgagggggaactcgaacgagctgaggagagggccgaggtctctgagctgaagtgcggggatctagaggaggaactgaagaacgtcaccaacaacctgaaaagcctcgaggctgcgtccgaaaaatactcggaaaaggaagataaatatgaagaagaaattaagctgctgtcagacaagcttaaggaagctgagaccagagccgagtttgccgagagaaccgtggccaagctggaaaaaacgattgatgatctggaagaaaaactagcacaagctaaggaggagaatgtgggcctgcatcagacgcttgatcaaacgctgaacgaactcaattgcatttag

SEQ ID NO: 245333 - DNA, 2244 bp, Artificial Sequence
  Description of Artificial Sequence: Synthetic coding sequence
atgggtcgcttaaatgagcagcgactattccaacctgatctctgcgacgtcgacttggtgctcgtgcctcaacggagcgtcttcccagctcataagggggtgctggctgcatactcacagttttttcattcgctgtttacacagaataaacagctgcagcgtgtggaacttagtctcgaggccctggccccaggaggcctgcagcagatcttgaactttatatacacaagcaagctgctggtcaacgcggctaacgtccacgaagtgttatcagctgcttccctgctccagatggccgatatcgcagccagctgccaagaactgttggatgccagaagccttggaccccctggaccgggaacagtcgcactcgcccagcctgctgccagctgcactcctgctgcaccaccatattactgtgatatcaagcaagaagccgatacccctggcctccctaaaatttatgccagggagggtcccgacccctattcagtcagggttgaagacggcgcaggaaccgctggaggcacagtgcctgctacgatcgggcctgctcagcccttcttcaaggaggagaaggaggggggagtcgaggaggcgggaggaccacccgcttcactctgtaaacttgaagggggtgaagaattggaggaggaactgggcggtagcgggacctacagcaggcgagaacaatctcagatcatcgttgaggtcaatctcaacaatcaaacactccacgtgtccacaggacccgaaggcaaacccggtgccggaccgtcacccgctaccgtcgtgctcggccgagaagacggacttcagcgccactccgacgaggaagaggaagacgatgaagaggaggaagaagaagaagaagaagaggagggtggcggttccggcagggaagaggaggaagaggaggagggaggaagccaaggtgaagaggaagaggaggaagaggacgggcacagtgagcaagaggaggaagaggaggaggaagaggaagaggggccatctgaacaggatcaagaaagctccgaagaagaggagggcgaggagggcgaggccggaggtaagcaggggccacgcggttcccggagctcccgagctgaccctcccccacacagccatatggccacacgcagcagagagaatgccagacgacgcggtacgcccgagcccgaggaggctgggaggcgtggaggaaagcggccaaagccaccacccggtgtagcttccgccagtgctagaggccctccagctacagatggactgggtgccaaggtaaagctggaggaaaaacagcatcacccatgccaaaaatgtccacgcgtctttaacaatcggtggtatctggaaaaacatatgaatgtgacgcattccagaatgcagatctgcgaccagtgtgggaagcgattcctgctggagagcgagttgctcctgcaccgccagacagactgtgagagaaatattcagtgtgtgacatgtggcaaagccttcaagaagctgtggtctctgcacgagcacaataagattgtgcatggatacgcagaaaagaagtttagctgcgaaatctgcgaaaaaaaattctacaccatggctcacgttcgtaaacatatggtggcccacacaaaagacatgccctttacctgcgagacctgcggaaaatccttcaaaaggtctatgagtctcaaggtccactcccttcaacactccggcgaaaaacctttcaggtgcgaaaactgcaacgagagatttcagtataaatatcagctcagatctcacatgagtatccacattggacataaacaattcatgtgtcagtggtgcggaaaagactttaacatgaaacagtacttcgatgaacacatgaagacccacacgggggagaaaccttacatctgcgaaatctgcggaaaatcgttcacaagccgtcctaatatgaagcgccatcgccgaactcatacgggagagaaaccctatccctgcgacgtttgtgggcaaaggttccgtttctcgaatatgctcaaggcgcacaaggagaagtgctttagggtctcccacacattggccggagatggggttcccgcagcacctggactgcccccaactcagcctcaggcgcatgcactgcctttgttaccagggctgcctcaaactctgcccccacccccacatctccctccgccaccccctctgttcccaactacagcctcccctggtggacgaatgaatgccaacaactag

SEQ ID NO: 245334 - DNA, 483 bp, Artificial Sequence
  Description of Artificial Sequence: Synthetic coding sequence
atgaccgatcagcaagctgaggccagatcctacctctcagaggaaatgatagcggagtttaaagctgcgtttgacatgttcgacgccgacggaggcggagacatttcagttaaggaactgggaaccgtgatgcggatgctcggccagacacctactaaggaagagcttgacgcaattatcgaggaagtcgacgaagatggaagcggtaccatcgactttgaagaattccttgttatgatggtcaggcagatgaaagaagacgcaaaaggcaagagcgaggaggaattggcagagtgctttcgaatattcgatcgcaatgcggatgggtacattgatcctgaggagctcgctgaaatcttcagagccagcggagagcacgtcacggatgaggagattgaatccctcatgaaggatggagacaaaaacaacgacggtcgaatcgattttgacgaattcctgaaaatgatggaaggtgtccagtag

SEQ ID NO: 245335 - DNA, 438 bp, Artificial Sequence
  Description of Artificial Sequence: Synthetic coding sequence
atgattgctgaatttaaagccgcttttgatatgtttgacgcagatggcggaggagacatatctgtcaaggaactgggaaccgtgatgcggatgctcggacagacccccaccaaggaggagctcgatgcaatcatcgaggaagttgacgaagatggcagcggaacaatcgattttgaggaattccttgttatgatggtgagacagatgaaggaggatgccaagggcaaatcagaggaagaactagccgagtgcttcagaatctttgaccggaacgcagatggctacattgaccccgaggaattggccgagatattcagggcttccggagaacacgtgacggatgaggaaatagaatccttgatgaaagatggcgataagaacaacgacggccgaattgattttgacgagttccttaaaatgatggagggggtgcagtag

SEQ ID NO: 245336 - DNA, 564 bp, Artificial Sequence
  Description of Artificial Sequence: Synthetic coding sequence
atgcctgaggtagaaagaaagccaaagattacagcatctcgaaaactgctactgaagtctcttatgcttgcaaaggctaaagaatgttgggaacaggagcatgaggaaagagaggccgagaaggtaaggtatctcgcggaacggatccctaccctgcagacccggggtctgagcctcagcgcactgcaagacctgtgccgggagctccatgccaaggtggaggtcgtcgatgaagaacgatatgacatagaagccaaatgcctgcataacaccagagagatcaaggatcttaaactgaaggttatggacttaaggggcaaatttaaacggcctccactgcgcagagtccgcgtaagcgcggatgccatgctaagagctctgcttgggtccaaacataaggtgtctatggaccttagagcaaacttgaaatccgtaaaaaaagaggacaccgagaaagagagacccgtggaggtgggcgactggcgcaagaacgttgaagctatgagcggcatggagggtcggaaaaagatgttcgatgcagcaaaatcacccacctcccagtag

SEQ ID NO: 245337 - DNA, 564 bp, Artificial Sequence
  Description of Artificial Sequence: Synthetic coding sequence
atgcctgaggtacagcgcaagcccaaaatcactgcctcccggaagttactgctgaaatctctgatgctggccaaggcgaaagagtgttgggagcaggagcatgaggaaagagaagctgagaaggtgagatatctggccgagaggatcccaactctgcagactcgaggcctaagtctgtccgccctacaagatctgtgtcgcgaacttcacgccaaggtcgaagtcgtggatgaagagaggtatgatatcgaagctaaatgtcttcataatacccgcgagatcaaggaccttaagttaaaggtgatggatctaagaggcaagttcaagcgtccaccgttgcggagggttagagtttcagccgacgccatgctgagagcacttctggggtctaagcacaaagtcagtatggacctgcgagccaatcttaaaagtgtcaagaaagaggatacagagaaagagcgccctgtggaggttggcgattggagaaaaaatgtggaggctatgtccggtatggagggccgtaaaaagatgttcgacgccgctaaaagtcctacctctcagtag

SEQ ID NO: 245338 - DNA, 564 bp, Artificial Sequence
  Description of Artificial Sequence: Synthetic coding sequence
atgccggaggtagaacggaaacctaaaattactgccagccggaagctcctcctgaagtccctgatgctggcgaaggcgaaggagtgttgggagcaggagcatgaggaaagggaagccgagaaagttcgctatctggctgagagaatacctaccctccagaccagagggctgtctctatccgccctgcaggacctttgcagagaactgcacgctaaggtcgaagtagtggacgaagagcggtacgacatcgaggctaaatgcttgcacaatactcgcgagatcaaggatctgaaactgaaagtcatggatcttcgcggaaagttcaaacgccctcccttaaggagagtacgggtgtccgccgatgctatgctgcgcgcactgctgggatcaaagcataaagtatccatggacctgagagccaacctgaagtctgttaagaaggaagacacggagaaggagcgacctgttgaagtgggtgattggagaaagaatgtggaggccatgagcggtatggagggacggaagaagatgtttgacgccgcaaagagcccgactagtcagtag

SEQ ID NO: 245339 - DNA, 564 bp, Artificial Sequence
  Description of Artificial Sequence: Synthetic coding sequence
atgccagaagtcgagagaaagcccaaaatcactgcatcacggaaactgttgttaaaaagcctgatgctggccaaagcgaaggaatgttgggagcaggaacacgaagagcgcgaggccgaaaaggtcagatatctggcggagcgcattccaacacttcaaaccagagggttgtcgctgagtgccttgcaggatctatgtagagagcttcatgccaaggtcgaggttgtcgacgaggagcgttatgacatcgaggctaagtgcctacacaatacccgcgagatcaaagacctgaagcttaaagtgatggacctaaggggcaagttcaagcggcctcccttacgcagggtcagagtctcggcggatgccatgcttagagccctcctgggatcaaagcacaaggtgtcaatggatctgcgcgcaaatctgaagtctgtcaagaaggaagacacagaaaaggagagacctgtggaagtgggggattggaggaagaatgtcgaggcaatgtccgggatggaaggcaggaagaaaatgttcgacgcggctaaaagccctacaagtcagtag

SEQ ID NO: 245340 - DNA, 564 bp, Artificial Sequence
  Description of Artificial Sequence: Synthetic coding sequence
atgccagaagtgcaacgaaaaccaaaaatcaccgcatcacgcaagctgctcctcaaatcactcatgctcgccaaagccaaggagtgttgggaacaggagcacgaggagcgagaggcagagaaggtgcggtatctggccgagagaattcccactttacaaaccagggggctgtcactgagtgccttgcaggacttgtgcagggaattgcacgcgaaagttgaggtggtggatgaagagagatacgacatcgaagctaagtgcttacataatactcgtgaaatcaaggatctgaaactcaaggtaatggacctacgcggtaagtttaagagaccacccctccggagggttcgcgttagcgccgacgctatgctccgcgcattgttaggatcgaaacacaaggtcagtatggatttgagagccaacctaaaaagtgtgaagaaagaggacaccgagaaggaaagacccgttgaggtcggcgactggcggaagaacgtggaggctatgagcgggatggagggacgtaagaagatgtttgatgccgctaagagtcctacatcccagtag

SEQ ID NO: 245341 - DNA, 414 bp, Artificial Sequence
  Description of Artificial Sequence: Synthetic coding sequence
atgccagaggttgagcggaagccaaaaataactgcgtctcgtaaattgcttctgaaatctctgatgcttgctaaagccaaagagtgctgggaacaagaacatgaagagcgcgaggctgagaaagtccggtaccttgccgaacgcatcccaactctacaaacgagggggctgtccctgagcgcccttcaggacctgtgtagagagcttcacgctaaggtcgaagtggtggatgaggagcgttacgatatcgaggccaagtgcctccataacacacgagagatcaaggatctaaaactgaaggtgatggacctgagaggcaagttcaagcggccacccttgcggagggtgagggtgtctgcggatgctatgctgagggctctgctgggttctaagcacaaggttagtatggactag

SEQ ID NO: 245342 - DNA, 549 bp, Artificial Sequence
  Description of Artificial Sequence: Synthetic coding sequence
atgtcacagtgcaagaaacggaatagagctatcactgcgagaagacagcatcttaaaagcgtgatgctgcaaattgccgctacagagctagaaaaggaggaatcccgtcgggaggctgaaaagcagaattatcttgccgaacattgccctcctcttcatatccctggctccatgtccgaggtgcaggaactctgcaaacagctgcatgcgaagatagacgccgcagaagaggagaaatacgatatggaggtaagagtacagaagacctcaaaggaactggaagacatgaatcaaaaactcttcgatttgcgcggtaaatttaagaggcctccccttcgccgtgtgcgcatgagtgcggacgcaatgcttaaagccctactaggaagcaagcataaggtgtgcatggacctccgggctaatctgaagcaggtgaagaaagaggatacagaaaaggagcgggacctgcgcgacgtgggggactggaggaagaacatcgaggagaaaagcggaatggaagggaggaagaaaatgtttgagagcgaatcatag

SEQ ID NO: 245343 - DNA, 549 bp, Artificial Sequence
  Description of Artificial Sequence: Synthetic coding sequence
atgggggacgaagagaagcggaaccgggcaattaccgccaggagacagcacctaaaaagtgttatgctccaaattgcagccaccgagctggaaaaggaggaatcaaggagggaagctgagaaacaaaattacctagccgagcattgccctcccttgcatataccaggctctatgagcgaggtccaggaactgtgcaaacagctccatgcgaaaatagatgccgcagaagaagagaagtacgatatggaagtgagggtacaaaagacatcgaaagagctagaagatatgaaccagaagctgtttgacttgaggggcaagtttaaacgcccacccctgcgcagggttcgaatgagcgccgatgcaatgctgaaggccttactgggttccaaacacaaggtgtgtatggatctgagggctaacctaaagcaagttaaaaaggaagacactgaaaaggagcgcgatctccgcgatgtgggagattggcgcaaaaacattgaggaaaaatctggaatggaaggccgtaagaaaatgttcgagtcagagtcttag

SEQ ID NO: 245344 - DNA, 549 bp, Artificial Sequence
  Description of Artificial Sequence: Synthetic coding sequence
atgggtgatgaggagaaacggaatagagccattacagccagaaggcaacatctgaaaagcgtgatgcttcagatcgcggctaccgaactcgagaaggaagagagcagacgcgaagccgagaagcagaactacttggctgagcactgcccacctctgcatattccagggagtatgagcgaagttcaggagctttgcaagcagttgcacgcaaagatagacgcagcggaggaagaaaagtatgatatggaggtgcgtgtacaaaagacaagtaaggaactggaggacatgaaccagaagctgttcgatctgcgcggaaagttcaagaggccacctctgcgtagggtacgcatgagcgccgatgcgatgctaaaagccctgctgggcagtaagcacaaggtctgcatggacttgagagctaatctgaaacaggttaagaaggaagacaccgaaaaggagcgagatttacgggacgtgggagattggcggaagaacattgaagaaaaatccggtatggaaggcaggaagaaaatgttcgagagtgagagttag

SEQ ID NO: 245345 - DNA, 549 bp, Artificial Sequence
  Description of Artificial Sequence: Synthetic coding sequence
atgggggatgaggaaaagcgcaaccgggcaatcacggctaggagacaacacctcaaatccgttatgctccagatagccgcaacggagcttgagaaggaggaatcgagaagagaagccgagaagcagaattatctagcggagcattgtccacccctccacatcccagggtcgatgtctgaggttcaggagctgtgtaagcagctacacgccaagatcgatgcggcagaggaagagaaatacgatatggaagtgagagtacagaagacttctaaggaactggaagacatgaaccagaagctgtttgatctccgcggtaaatttaaacggcctccacttcgccgagtgcggatgtctgccgacgcaatgctgaaggctcttttgggaagtaagcataaggtgtgtatggatctcagagccaatcttaagcaggtgaaaaaggaagacacagagaaagagcgagacctgcgcgacgttggggactggcggaagaacattgaggagaagtctgggatggagggtcgaaagaagatgttcgagtcagagagttag

SEQ ID NO: 245346 - DNA, 633 bp, Artificial Sequence
  Description of Artificial Sequence: Synthetic coding sequence
atggctgacggatctagcgatgcggcaagggagcccagaccggcacccgcacccatacgaaggcgaagtagcaactatcgcgcatacgccactgaaccacacgccaaaaaaaagagtaaaatatctgcaagcaggaaacttcagctgaagaccctccttctgcagatagccaagcaggaattagaacgggaggctgaggagcgccgtggcgagaagggtcgggctttgtctaccagatgtcagccgctggagttagccggactcggattcgcagagctacaagatctttgccggcaattgcatgcgcgagtcgacaaagtggacgaggagcggtacgatattgaggctaaagtcacgaaaaacattactgaaatcgcggacctcacccagaaaatctttgaccttagaggtaaatttaagaggcctacgctgcgtcgcgttcgaatttccgctgacgctatgatgcaagcattgctcggcgcacgcgcaaaagagagcttggacttgagggcccatctgaagcaagtgaagaaagaggacacagagaaggaaaacagagaagtgggagactggcggaagaacatcgacgctctttctggaatggaagggcgtaagaagaagttcgagagttag

SEQ ID NO: 245347 - DNA, 837 bp, Artificial Sequence
  Description of Artificial Sequence: Synthetic coding sequence
atgtctgacacagaggaacaggagtatgaagaggaacaaccggaggaagaggctgccgaagaagaagaagaggctccggaggagcctgagcccgtcgctgaacctgaagaggagaggccaaaaccaagtagacccgtcgtccccccactaatccctccaaagattccggaaggggaaagggtcgactttgacgacattcatcggaagaggatggaaaaagacctgcttgagcttcaaacactgatagacgtccacttcgagcagcgcaagaaggaagaagaggaactcgtagcattaaaagagaggattgaacggagaaggagcgagagagccgagcagcagagattccggacagagaaggaacgcgaacgtcaggcgaaactcgcagaggagaagatgagaaaagaggaagaagaggcaaagaagagagccgaggatgacgccaaaaagaaaaaggtcttatccaatatgggcgcacatttcggaggttatctcgtcaaggccgaacaaaaacgaggcaaaagacagaccggacgcgagatgaaggttaggattctgtctgaaagaaaaaagcctctggatatcgattacatgggggaggaacagctgcgcgctcgtagtgcctggctaccaccaagccaaccctcatgtcctgcgagagagaaggcacaggagctgtctgactggatacaccagctggaaagcgagaagtttgatctgatggccaaactgaaacaacaaaagtatgaaatcaatgtactgtacaatagaatctctcacgcgcagaaattccgaaagggagccggtaaagggagggtagggggtcggtggaaatag

SEQ ID NO: 245348 - DNA, 837 bp, Artificial Sequence
  Description of Artificial Sequence: Synthetic coding sequence
atgagcgatactgaagagcaggagtacgaggaggaacagcccgaggaagaggccgctgaggaggaagaagaggcaccggaggagcccgaacccgtggcggagcccgaagaagagcggccaaagcctagtagacccgtggtccctcctctgataccacccaaaatccccgagggcgagcgcgtggactttgacgacattcacagaaaacgcatggaaaaggacctgcttgagctacagactttgattgacgtacacttcgagcagagaaagaaagaagaggaggagctcgtggctctaaaggagcgcattgagaggcgaagaagcgaaagggccgagcaacaacgctttaggacagagaaggagagagaacgccaggccaaactcgccgaagagaagatgagaaaggaagaggaggaagcaaagaagagggccgaagacgacgctaagaagaaaaaggtgctttctaatatgggcgctcactttgggggataccttgtgaaggccgaacagaagcggggaaaaagacagaccggcagggaaatgaaagtgaggatcctctccgaaagaaagaaacctctagatattgattacatgggggaggaacagctccgcgctcggagtgcctggctgccacctagtcagcccagttgcccagcgcgtgaaaaggcccaggagttgagtgactggattcatcagttagaaagtgagaagttcgatctcatggctaagctgaaacagcagaagtacgaaattaatgttctctacaatagaatatctcacgcgcaaaagttcaggaaaggcgcaggcaaaggacgagttggcggacggtggaagtag

SEQ ID NO: 245349 - DNA, 756 bp, Artificial Sequence
  Description of Artificial Sequence: Synthetic coding sequence
atgagtgacaccgaagagcaggagtatgaggaggaacagcctgaagaagaggcggctgaagaggaagaagaagaggaagagcggcctaagcccagcaggccagtggttccccctttgatcccccctaaaattcctgaaggagagagggtcgacttcgacgacattcaccggaagcgcatggaaaaggacttgctggagttgcagacactgattgacgtgcacttcgaacaacggaaaaaggaagaagaagagctggtggcactgaaggaaagaatcgaacgtcgccgaagcgaacgcgcagaacagcagcggtttcgcacagaaaaggagcgcgagcgacaggccaagctggctgaagagaaaatgcgcaaggaagaggaggaggccaagaagagggcggaggatgacgctaagaaaaagaaggtcctgtctaatatgggagcgcatttcgggggttacttagttaaggcagaacagaaacgcggaaagaggcaaacaggtcgggagatgaaggtgcggatcttgtctgaacgaaaaaaacccctggacattgattatatgggggaggaacagctccgagaaaaggcacaggaacttagtgactggatacatcagcttgagtccgaaaaatttgatcttatggccaaacttaagcagcagaaatacgagatcaatgtgttgtacaatagaatcagccacgcccaaaaattccggaaaggtgcagggaagggtagagtcggcggtaggtggaaatag

SEQ ID NO: 245350 - DNA, 522 bp, Artificial Sequence
  Description of Artificial Sequence: Synthetic coding sequence
tctaaagcgcagccgcaggactcacaacatctgcggcattcactcgggcgtacccgcatgtcagacacggaagaacaagaatacgaagaagagcagcccgaagaggaagcagcagaggaggaagaggaaggcgaggtccctgattcggcagaagaagagagacctaaaccgagcaggcctgtggttccccctctcattcccccaaaaattcccgagggcgaacgggtggattttgatgacattcacaggaagagaatggagaaggatctactggagctgcagactcttatcgatgtgcatttcgagcagcggaagaaggaggaggaggaacttgtcgcgcttaaggaaagaatcgagaggaggcgcagcgaacgggctgagcaacagaggtttcggactgagaaggaacgggaaaggcaggctaagctggcggaagaaaagatgcgcaaagaagaagaggaagctaaaaagcgtgccgaggacgacgctaaaaagaaaaaaaaaaaaaaaaagaaaaaatag

SEQ ID NO: 245351 - DNA, 756 bp, Artificial Sequence
  Description of Artificial Sequence: Synthetic coding sequence
atgagcgacactgaagaacaggaatatgaggaggagcagcccgaggaagaagcagctgaggaggaggaagaagctcctgaagagcctgagccagttcgccctgtagtgcctcctctcatccccccaaaaatccccgaaggcgaacgcgtggattttgacgacattcaccgcaagcgcatggagaaggacttgcttgagctgcaaactttaatcgacgtccatttcgagcagcgcaagaaagaagaagaggagctcgttgcgctgaaagaacgcatcgagagacgcagaagcgagcgtgctgaacagcagagatttcggactgaaaaggaacgggaacggcaggctaaactcgccgaggagaaaatgcggaaggaggaggaagaggcgaaaaagcgcgctgaagacgatgccaaaaaaaaaaaggtgctttccaacatgggggcacattttggcggatatctagtgaaggcagaacaaaagcggggtaaaagacaaactgggagagaaatgaaagtaagaatattaagtgagcggaaaaagccactagacatagattacatgggagaagagcagctgagagaaaaagcccaggagctgtctgactggatacaccagcttgagagcgaaaaattcgacctaatggccaagctgaaacaacagaagtacgagattaatgtgctgtacaatcgcatctcacatgcacagaagttccggaaaggagctggtaaggggagggtgggcggacgatggaaatag

SEQ ID NO: 245352 - DNA, 579 bp, Artificial Sequence
  Description of Artificial Sequence: Synthetic coding sequence
atggagaaggacttgttggagctccagaccctgattgatgtacactttgaacaacggaagaaggaagaagaggagctcgtcgctcttaaggaacgaatcgagcgcagacggagtgagagagccgagcaacaacgtttcaggacagagaaagagcgcgaacggcaggccaagctcgccgaagagaaaatgcgtaaggaggaagaagaggcaaaaaaacgggctgaggatgacgctaagaagaaaaaggtgctgagcaatatgggtgctcactttgggggttatctggttaaggccgaacagaaacggggaaagcgccaaacagggcgagagatgaaagtgaggattctgagtgagcgcaagaagcccctggacatcgattacatgggcgaagagcagctacgggaaaaggcccaggaattatcagattggatccaccaactcgaatctgagaagttcgacttgatggcgaagttgaagcagcagaaatatgagataaatgtgctgtataaccggattagccatgctcaaaaattccggaaaggtgcaggcaagggacgcgtgggcggtcggtggaagtag

SEQ ID NO: 245353 - DNA, 882 bp, Artificial Sequence
  Description of Artificial Sequence: Synthetic coding sequence
atgtctgatatcgaggaggtggtcgaagagtacgaagaggagcacccagaggaagaggaggattggagggaggatgaggacgagcaggaagaggccgctgaagaggacgccgaggcagaggccgagaccgaggagacccgcgctgaagaagacgaggaagaggaagaagccaaagaggcggaggatggacccatggaggagagcaaaccaaaacccagaagctttatgcccaacctggttccaccgaaaatcccggacggagagcgagttgatttcgacgacattcaccgcaaacgcatggaaaaggatcttaatgaactgcaggccctgatagaggcccattttgagaacagaaaaaaagaggaggaagagctcgtgtctctcaaagatcgcatagagcgcaggagagctgaaagggccgaacagcagagaatacggaatgagagggaaaaggaacggcaaaataggttagcagaagagagggcccgtcgagaggaagaggaaaaccgcagaaaggctgaggatgaggctcggaaaaagaaagcattatctaatatgatgcattttggcggatacatccaaaaacaggcgcaaacggagagaaaaagcggaaagcggcagaccgagagagaaaaaaagaaaaagatcctggcggagcgcaggaaggtcctcgcaatagatcacctgaacgaggatcagttgcgggagaaggcgaaggaattgtggcagagtatttataatctggaggccgagaaatttgatctccaggagaagttcaaacagcagaaatatgaaattaatgtgctccgtaacaggataaacgataaccaaaaggtctcaaaaacaagagggaaagcaaaggttacgggaaggtggaagtag

SEQ ID NO: 245354 - DNA, 600 bp, Artificial Sequence
  Description of Artificial Sequence: Synthetic coding sequence
atgtcagatattgaggaggtggtggaagagtatgaagaagaaatggcggctccccaacatcaggaagaagccgctgaagaagatgccgaagctgaagccgagacagaagagacccgggctgaagacgaagaagaagaggaagccaaggaagcggaagacggaccaatggaagagagcaagcctaagccaaggtcctttatgcctaatctggtgcctccaaaaattcctgacggcgaacgtgttgatttcgatgacatacaccggaagaggatggagaaagacctgaatgaactccaggcactgatagaggcccatttcgagaacagaaagaaggaggaggaggagctcgtctctctgaaagataggatcgaacgtagaagagccgagagagcagaacagcaaagaatcaggaacgaaagggaaaaggagcggcagaataggctggcagaggaaagagcaagaagggaagaagaagagaatcgcaggaaagcagaggacgaggcgcgaaaaaagaaggcactgagcaatatgatgcactttggtggctatatccaaaagcatccacccgaccgagctgagaaatgggaggaggctgactag

SEQ ID NO: 245355 - DNA, 852 bp, Artificial Sequence
  Description of Artificial Sequence: Synthetic coding sequence
atgagtgacatcgaggaagtggtggaggaatacgaggaagaggcgaagctcgaacaggaagaggccgctgaagaggatgccgaggcggaggctgagactgaggaaacccgagccgaagaggatgaggaggaagaggaggcgaaggaggctgaggacggcccaatggaggagtccaaaccaaagccaagatcctttatgcctaatcttgtacctcccaaaatccctgacggcgagcgagtggactttgacgacatacacaggaaacggatggagaaagatcttaacgaactgcaggcactaattgaagctcacttcgagaaccgcaagaaggaagaagaagaacttgtctccctgaaggatagaatcgaaaggaggagggccgagcgcgctgagcagcagcggatacgcaacgagagggagaaggagcggcaaaatagattagccgaggaacgcgctcggagggaagaagaggagaacagacgtaaggcagaggacgaggcgcgaaagaagaaggccctgtccaacatgatgcatttcggcggttatatccaaaaacaagcccaaaccgaacggaaatctggtaagagacaaactgaaagagaaaaaaaaaaaaaaattctagcggaaaggagaaaggtactcgcgatcgatcacttaaatgaggatcaactgcgggagaaagctaaagagctgtggcagagtatttacaatctggaggcagagaagtttgacctgcaggaaaaatttaagcagcaaaagtacgaaattaatgtactgcgcaatcgaattaatgacaaccagaaagtttccaagacacgcggaaaggcaaaggtcaccggtcggtggaaatag

SEQ ID NO: 245356 - DNA, 858 bp, Artificial Sequence
  Description of Artificial Sequence: Synthetic coding sequence
atgagcgacatcgaagaagtcgtggaggagtatgaagaggaggagcaagaggaagccgctgttgaggagcaggaggaagccgcagaagaggacgcagaggcagaggccgaaactgaagaaacccgggcagaggaggacgaagaggaggaggaagctaaagaagcggaggacggacctatggaggaatcaaagccaaagccaaggtccttcatgccaaacctcgtgccccctaagattcccgacggggaacgggtcgactttgacgatattcaccgcaaaaggatggagaaggacctgaatgaactacaggctctcatcgaggcccacttcgaaaatcgcaagaaagaggaggaagagctggtgtcactaaaagatcgcattgaacgcaggcgggcagaaagggccgagcagcagagaatacgtaacgagcgcgaaaaggaaaggcagaaccggctggccgaagagcgagcaagaagggaagaagaagagaacagaagaaaagccgaagatgaggccaggaaaaagaaagctctgtctaacatgatgcacttcgggggttatattcagaagactgagagaaagtcaggtaagagacaaaccgagcgagaaaagaagaaaaagatactggctgaaagaaggaaggtactagcgatcgatcatcttaacgaagaccaattaagggagaaggcaaaggaactgtggcagtccatatacaacctagaggccgaaaagttcgacctgcaggaaaagtttaagcagcagaagtacgagatcaatgtgctgagaaatagaattaatgacaatcaaaaggtgtctaagaccaggggaaaggcaaaagtgacaggacgctggaagtag

SEQ ID NO: 245357 - DNA, 867 bp, Artificial Sequence
  Description of Artificial Sequence: Synthetic coding sequence
atgagcgatatcgaggaagtggttgaagagtacgaagaagaagagcaagaggaggcggcagtcgaagagcaggaagaagccgcagaagaggacgcagaggccgaggctgagaccgaggaaacaagggccgaagaggacgaagaagaggaggaggctaaggaagctgaggatggtcccatggaggagtctaaacctaagccacggagttttatgcctaacttggttcccccaaagatcccggacggggagagggtggacttcgatgatatccacagaaaaagaatggagaaggacctgaatgagcttcaggcgctgatagaggcccactttgagaaccggaaaaaggaggaggaggaactggtctcacttaaggatcgcattgagaggagaagggcagaaagagccgagcagcagcggataaggaacgaacgagagaaagaacgccagaataggttggcggaagagcgggctcggagggaggaggaggagaaccgtcgaaaagccgaggacgaagctcggaagaaaaaggctttaagcaacatgatgcatttcgggggatacatacaaaaacaagcccaaacagaaaggaagagcgggaaacggcagaccgagagggagaagaaaaaaaagatacttgctgagagaaggaaggttctggccatcgaccacctaaatgaggatcagttgcgcgaaaaagccaaggagctttggcagagtatctacaatctcgaggctgagaaatttgacctacaggagaagttcaaacagcagaagtatgagattaacgtgttgaggaacaggatcaacgacaaccaaaaggttagcaagaccagggggaaggctaaggtgaccgggaggtggaaatag

SEQ ID NO: 245358 - DNA, 867 bp, Artificial Sequence
  Description of Artificial Sequence: Synthetic coding sequence
atgtccgacatcgaggaagtagttgaggagtatgaggaagaggagcaggaggaagccgcagtagaggagcaggaagaggcagctgaagaggatgctgaagctgaagccgagaccgaggagactagagccgaggaggacgaagaagaagaggaagcaaaggaggccgaagatggtcctatggaagagtcaaagcccaagccacgctcattcatgcctaacctggtgccaccaaagatccctgacggcgagcgggttgatttcgacgacatacatagaaaacggatggaaaaagacttgaatgagttgcaggcactgatcgaagcgcatttcgaaaataggaagaaagaagaggaagaactagtgtctctgaaggatagaattgagaggaggcgagcggaaagggccgagcagcagcggatccgaaatgaaagggagaaggaacgccagaatcgtcttgctgaagaaagagcacgaagggaggaggaagaaaatcgcagaaaggcagaagatgaggcccgtaagaagaaagctctgtccaatatgatgcactttggaggctacattcaaaagcaggctcagacggaaagaaaatcagggaaaagacagacggagcgggaaaaaaagaaaaagattctggctgaaagaaggaaagtcctggccatcgaccacctgaatgaagaccagctgcgggagaaagccaaggagctctggcaaagcatatacaatctagaggcagaaaagttcgacctgcaggaaaagtttaagcagcaaaagtatgagatcaacgtgctccggaaccgcattaacgacaaccagaaagtttcaaagacccgaggaaaggctaaggttactggaaggtggaaatag

SEQ ID NO: 245359 - DNA, 681 bp, Artificial Sequence
  Description of Artificial Sequence: Synthetic coding sequence
atggaagaatccaagccgaaacctcgcagcttcatgccaaacctggtgccacctaaaatacccgatggtgaacgcgtcgacttcgacgacatacatcgtaaaagaatggaaaaggatctgaatgagcttcaagccctgatcgaagcccacttcgagaacagaaaaaaagaagaggaggagctcgtgtcacttaaggataggatcgaacgccgtcgcgctgaaagagcagagcagcagcgtattagaaacgagcgtgaaaaagagaggcagaacaggctggccgaggaaagggcacgaagggaggaagaagaaaatagacggaaagccgaggatgaagctaggaagaaaaaggccctctccaatatgatgcacttcggaggatatatccagaagacagaacggaagtcaggtaaaaggcagactgaaagggagaagaaaaagaagattctggccgaaaggagaaaagtgctggccattgatcacttgaatgaggaccagttaagggagaaagctaaggagctgtggcagagcatctacaacctggaagccgagaagttcgatctgcaggagaagttcaagcagcagaagtacgaaattaacgtgttgaggaaccggattaacgacaatcagaaagtctccaagacaagggggaaggctaaagtcaccggcagatggaaatag

SEQ ID NO: 245360 - DNA, 858 bp, Artificial Sequence
  Description of Artificial Sequence: Synthetic coding sequence
atgtctgacattgaggaggtggtggaagagtatgaagaggaggaacaggaagaagcagccgtcgaagagcaagaagaagccgcagaggaggacgccgaagcagaagccgaaaccgaggaaactcgcgctgaagaagacgaggaggaagaagaagcaaaagaagcagaagacggtcctatggaagagagtaagccaaagcctcgctcctttatgcccaatttggtacccccaaaaattccagacggcgaaagagtggacttcgacgatatccacagaaagcggatggagaaagacttaaatgagctccaggccctgatagaagctcactttgagaaccgtaagaaggaggaagaagaactggttagcttgaaagaccggattgagcgtcgacgcgctgagcgtgcggagcagcagcgtatccgtaacgagcgggagaaagaaagacagaatcgcctggccgaggagagagcacggagagaggaggaagaaaatcggcgaaaagctgaagatgaggcccgaaagaaaaaggcacttagtaatatgatgcatttcggtggctacatccagaagacagagcggaaaagcggcaaaagacagaccgagcgcgaaaaaaaaaagaaaatccttgcagagcgcaggaaggtgctggcaattgaccatctaaatgaagatcagctacgcgaaaaggcaaaggagctatggcaaagcatttacaatcttgaggccgaaaagtttgatctgcaggaaaaatttaaacagcagaagtacgagatcaacgtcctgcgcaatcgtatcaatgacaatcagaaagtctctaaaacaagaggaaaggccaaggtgactggtaggtggaaatag

SEQ ID NO: 245361 - DNA, 876 bp, Artificial Sequence
  Description of Artificial Sequence: Synthetic coding sequence
atgtccgacattgaggaggttgtggaagagtatgaggaggaatatctggagcacgccgaagcagcagtcgaggagcaggaagaggccgctgaggaagatgcagaggccgaggctgagaccgaggagactcgggctgaagaagacgaggaagaggaggaagctaaggaagctgaggacggacctatggaggaaagcaagcccaaacccaggtcattcatgcccaacctggtgcccccaaaaatcccagatggcgagagggtcgactttgatgatattcaccgcaagcgcatggaaaaagatttaaacgagctgcaggccctgatcgaggcccacttcgagaatcgcaagaaggaagaggaggaactggtcagcctgaaggaccgtattgagaggcggagagcagagagagcggaacagcagcgcatcaggaacgaacgggagaaggagcgccagaaccgcctggctgaggagagggcccgtagggaggaagaggagaaccggcgaaaagcggaagatgaagctcggaaaaaaaaggccttaagcaacatgatgcactttgggggttatattcagaaacataccctgcagacagagaggaaatcaggcaaaagacagaccgaaagggagaagaaaaagaagatcctggccgaacgcaggaaggtcctggccatcgaccatctcaatgaggaccagctaagagagaaggccaaagagctctggcagtccatctataacctggaggcggagaagttcgatttgcaagagaaatttaaacaacagaaatacgagattaacgtgctacgtaatcgaataaatgacaaccagaaggtgagcaagacaaggggtaaagccaaggttacagggcgatggaagtag

SEQ ID NO: 245362 - DNA, 894 bp, Artificial Sequence
  Description of Artificial Sequence: Synthetic coding sequence
atgtccgatatcgaagaagtggtggaggagtatgaggaggaatatctggagcatgctgaggccgctgtggaagaggaagaggattggcgcgaagacgaagacgagcaagaggaagctgccgaggaggacgctgaggccgaagctgaaactgaagaaactcgcgctgaagaggacgaggaagaagaggaggctaaggaggcagaggacggtcccatggaagagtcaaagccaaaacctcggtcattcatgccgaatctagttccgccaaagattccagacggggaaagagtggacttcgatgatatccacagaaaaaggatggaaaaagacctaaatgaactccaggccctcattgaagcacacttcgagaataggaaaaaggaggaggaggagttggtctctctcaaggacagaatagagcggagacgggctgaacgcgcagaacaacagcgtattagaaacgagcgcgagaaggagcggcagaaccggttagcagaggaaagggcccgtcgggaagaggaggaaaataggagaaaagcagaggatgaggctagaaagaagaaagccctgagcaacatgatgcacttcggaggatacattcaaaaaactgagcgcaaaagcggcaagcgacagaccgaacgagagaaaaaaaagaaaatactcgctgagcggagaaaggtgttagctatcgatcacttaaatgaggaccagttaagagaaaaagcaaaggagctgtggcagtccatctacaacctggaagcagaaaaattcgatctacaggagaagttcaagcaacaaaagtacgagatcaacgtgcttagaaataggatcaatgacaaccagaaggtgagcaaaacgagaggcaaagcaaaggttaccggtcggtggaaatag

SEQ ID NO: 245363 - DNA, 867 bp, Artificial Sequence
  Description of Artificial Sequence: Synthetic coding sequence
atgtcggatatcgaagaggtcgtcgaagaatatgaggaggaggagcaggaggaagcagctgtggaggagcaggaggaggccgcagaagaggatgccgaggccgaggcagagacagaagaaacccgcgctgaggaggatgaagaggaggaggaagcaaaagaggccgaagacgggcctatggaggaatccaaacccaaaccacggagctttatgcccaacttagttcctcccaaaatacccgatggcgagcgcgtggattttgacgacatccatcgcaaaaggatggagaaagacctgaatgagctgcaggccttgatcgaggcacacttcgagaacaggaagaaggaggaggaagagctcgtgagtcttaaggacaggatcgagcgacgacgcgctgagcgggctgaacagcaaaggatccggaacgagagagaaaaggaaagacagaacagattagcagaggagagagccagacgagaagaggaagagaacaggagaaaagccgaagatgaggccaggaagaaaaaagcattgtccaacatgatgcatttcggcggttacatacagaaacaggctcaaactgagcgcaagtcagggaagcggcagacagaacgtgagaaaaagaagaaaatcctcgccgagcgacgaaaagtcctcgccatagaccacctgaacgaagatcagctcagggaaaaagctaaagagctttggcagtccatatataacttagaggctgagaaatttgatttgcaggagaagttcaagcaacagaagtacgagatcaacgtcctgaggaataggataaatgacaaccagaaagtgtctaaaactcgaggcaaagccaaggtgacggggcgatggaagtag

SEQ ID NO: 245364 - DNA, 771 bp, Artificial Sequence
  Description of Artificial Sequence: Synthetic coding sequence
atgagcgatgaggaagtggaacaggtggaggagcagtatgaagaggaggaggaagcacaggaggaagctgccgaagtgcacgaggaagtccacgagcccgaagagaagccccgacccaagctgaccgcacccaaaataccagagggagagaaagtcgatttcgatgacatacagaagaaaaggcagaataaggacttaatggagctacaggccctgatagactcacacttcgaagctagaaagaaggaagaggaagagttggtggctctgaaggagaggatcgaaaaacgcagagctgaacgggctgagcaacagagaattagggcagaaaaagagagggaaagacagaataggctagcagaagagaaagctcgccgagaggaggaagacgctaagcggagggccgaggacgatcttaaaaaaaagaaggccctctcctccatgggcgctaattactctagctacctcgcgaaggcagatcagaagagagggaaaaaacaaacagcgcgagagatgaagaagaaaatcttggcggagcggagaaaaccgctgaacattgatcatctgggtgaagacaaactacgcgacaaagcgaaagagctctgggagaccctacaccagcttgaaatcgataagttcgaattcggcgagaagctcaagcggcaaaagtacgacatcaccactctgcggtcacggatcgatcaggctcaaaaacactccaagaaggccggaactcctgccaagggcaaagtaggcggtcggtggaagtag

SEQ ID NO: 245365 - DNA, 777 bp, Artificial Sequence
  Description of Artificial Sequence: Synthetic coding sequence
atgtctgatgaggaagtcgaacaggtcgaggaacagtacgaggaagaggaagaagcccaggaagaagaggaagtgcaggaagatactgccgaggaggatgccgaagaggagaaacctcggcctaagttaacggcccctaaaatccctgagggtgagaaagtggacttcgacgacatacagaagaaaagacagaataaagatttaatggagctccaagcactgatcgattctcatttcgaagcacgaaagaaggaggaagaagaattggttgctttaaaggagagaatagagaagcgcagagcggaaagagccgagcagcagcggattagagcagaaaaagagcgtgaaaggcagaaccggcttgccgaggaaaaggctcggagggaggaggaagacgccaagagacgagctgaggacgatctaaagaagaagaaggcactgagctcaatgggcgctaactacagtagctatctggctaaagcagatcaaaaaaggggtaagaaacagaccgccagagagatgaaaaagaagatattggctgaacggagaaaaccattgaacatagaccatctgggcgaagacaaactacgcgataaggccaaagaattgtgggaaaccctgcaccagctcgagattgacaaatttgagttcggtgaaaagcttaagcggcagaaatacgatatcactacactccgttcccggatcgatcaggcccaaaagcattccaagaaagccggaactccggctaaaggaaaggttggaggcaggtggaaatag

SEQ ID NO: 245366 - DNA, 738 bp, Artificial Sequence
  Description of Artificial Sequence: Synthetic coding sequence
atgtcagacgaggaagtcgagcaggtcgaggagcagtatgaggaagaggaagaggctcaagaggaagaggagaagccgaggcctaagctgaccgcacccaaaattccagaaggagagaaagtcgacttcgatgacatccagaaaaagcgacagaataaagacctaatggaactgcaggcactaattgactcccacttcgaagccagaaaaaaggaggaggaagagcttgtggccctgaaagagagaattgagaaacgcagagcagaacgggcagagcaacagcgaattagggctgaaaaggagagagagagacagaaccgactggctgaggaaaaggcgcgacgcgaggaggaagatgcaaagcggagggcagaggacgatctgaaaaagaagaaggctctatcgtctatgggagccaactattcttcatatttggcaaaagcagatcagaaaagaggtaaaaaacagaccgctcgggagatgaaaaaaaagattctggctgagcggcgtaaaccattgaacatcgaccatctaggcgaagataagcttcgcgataaggccaaggaactgtgggaaactttgcaccaactggagatcgataaattcgagttcggggaaaaactaaagcggcaaaagtacgacatcactacccttcggagtcgaattgaccaggctcagaaacatagcaaaaaggctggaactccagcaaaagggaaagtcgggggaagatggaagtag

SEQ ID NO: 245367 - DNA, 759 bp, Artificial Sequence
  Description of Artificial Sequence: Synthetic coding sequence
atgagtgatgaggaggtggagcaggtggaggagcaatacgaggaggaagaagaggcacaggaggaggccgctgaggtgcatgaggaagaggagaagccacgccctaaactgaccgctccaaagattcccgagggtgaaaaagttgatttcgacgacatccaaaagaaaagacagaataaagatctgatggagttgcaggctttaattgattctcatttcgaggccaggaagaaggaggaggaggagctcgtagcccttaaggaacgcatagagaagagacgtgcagaaagagcggaacagcaacggattcgcgcagaaaaggaaagggagcgtcaaaaccgcctcgcagaagagaaggcgagacgggaggaggaagatgctaagcgacgggctgaggacgacctgaaaaaaaagaaagccctgtcttcaatgggagctaattattcaagctatttggcgaaggcggatcagaaaagagggaagaaacagaccgctagggaaatgaagaaaaagatcctcgcggaaagacgtaagccactgaatatcgaccacttaggcgaggacaaactccgcgataaagctaaagaactctgggagacgctccaccagctggagattgacaagtttgagttcggcgagaaactgaagagacaaaagtacgacatcatgaatgtgagagcacgcgtccagatgttggcaaaattttccaagaaggcaggaacacctgccaagggcaaggtgggtgggagatggaaatag

SEQ ID NO: 245368 - DNA, 783 bp, Artificial Sequence
  Description of Artificial Sequence: Synthetic coding sequence
atgagcgacgaggaggtcgagcaggtggaagaacagtatgaggaggaggaggaagctcaggaggaggctgcagaagtgcacgaggaggataccgccgaggaagacgcagaggaggagaaacccaggccgaagctgaccgccccaaaaatccctgagggagagaaggtagactttgatgatattcaaaaaaagagacagaataaagaccttatggagctgcaagccctaatcgattctcatttcgaagccagaaaaaaggaagaggaagagctcgttgcactcaaggaacgcattgagaagcggagggctgagagggctgagcagcagcggatacgtgcggaaaaagagagagagaggcaaaaccgcttagccgaggagaaagctcggagggaagaggaggatgccaagcgaagagctgaagacgatctcaagaaaaagaaggccctgtcaagcatgggcgcaaattattctagttatttggccaaagcagaccagaaacggggtaagaagcagaccgcaagagagatgaaaaagaagatcttggcggagcgtcgcaagcctctgaacattgaccatcttggtgaggataaactccgggacaaggctaaggagttgtgggagacacttcaccagctggaaattgacaaattcgaatttggtgagaaactgaagcgtcaaaagtacgatattacaacactgagaagccgaatagatcaggcccagaaacatagcaaaaaagcagggactcctgctaagggaaaagttggcggaagatggaaatag

SEQ ID NO: 245369 - DNA, 753 bp, Artificial Sequence
  Description of Artificial Sequence: Synthetic coding sequence
atgagcgacgaggaggtcgagcaagtggaagagcaatacgaggaggaggaagaggcccaagaggaggaggaagtgcaggaagaagagaagcccagacctaaactcactgctcccaagatacccgagggcgaaaaggtggactttgacgatattcagaaaaagaggcagaacaaagacctgatggagctgcaggcactgatcgattcacacttcgaggccagaaaaaaggaagaagaagagcttgtcgcactgaaggaacgcattgaaaagcgcagagccgagagagccgagcaacagaggattagagccgagaaggagagagagaggcagaatcgtttagctgaggaaaaggcccgaagggaagaggaggacgcaaaacgacgggcagaggacgacctgaaaaaaaaaaaagcacttagttcaatgggagctaattacagctcctacctggccaaagcagatcagaagagaggcaagaagcagaccgcaagagagatgaaaaagaaaattctggctgaaaggagaaagccactgaacattgaccacctcggagaggacaagttacgcgacaaggcaaaagaactgtgggaaaccctccaccagttggagatcgacaaattcgagttcggggagaagctgaaaagacaaaaatatgacataaccacactgcggtctcggatcgaccaggcgcaaaaacatagcaagaaagccggaaccccagcaaaggggaaagtaggcggaaggtggaaatag

SEQ ID NO: 245370 - DNA, 786 bp, Artificial Sequence
  Description of Artificial Sequence: Synthetic coding sequence
atgtcagacgaggaggtggaacaggtggaggagcagtacgaagaagaggaggaggcccaagaggaagccgcagaggtacacgaagaaggaatgagaacccaggacttcttccacgaggagaagccccgtcccaaattaactgcccctaagatccccgaaggggaaaaagtggactttgatgacatccagaagaagagacagaacaaggacctgatggagctccaggctctgatcgactcccactttgaagcgagaaagaaagaagaggaggagcttgttgctctcaaggaaaggatcgaaaaaagacgcgcagagcgtgctgagcagcagcggatcagggccgaaaaagaaagggagcggcagaatcgcttagccgaggagaaggcccgacgcgaggaggaggacgcgaaaaggagagcagaagatgatcttaaaaaaaaaaaggccctgtcaagtatgggggcaaactactcatcctacctggcaaaggccgaccagaaaaggggcaagaaacagactgcgagggagatgaagaaaaagattcttgccgaaaggcggaagccactcaatattgaccatctcggcgaggacaaactcagagataaggcaaaagagctttgggagacgctgcaccagttagagattgacaaattcgaatttggagagaagctcaaacgtcaaaaatatgacatcactactttgagaagccgcattgaccaggcacaaaagcattctaagaaagccggtacacctgcaaaaggcaaggtgggcggacggtggaagtag

SEQ ID NO: 245371 - DNA, 786 bp, Artificial Sequence
  Description of Artificial Sequence: Synthetic coding sequence
atgtccgacgaagaggttgaacaggtcgaggaacagtacgaggaggaagaggaggctcaggaagaggccgcagaagtccacgaagaagtccacgaacccgaggaggtccaagaagaggagaaaccccgaccaaaactgaccgcaccaaagatcccagagggggagaaagtcgacttcgacgatatacaaaagaagcgccagaataaggacctgatggagttgcaggccttaattgatagccattttgaggcgaggaaaaaagaggaggaggagctggtggcgctgaaggagcggattgagaagcgtcgggctgagcgtgctgagcagcagagaatacgggctgagaaagagcgagaacgccagaaccgcctcgctgaggagaaggcaaggagggaggaggaggacgccaaaaggagagctgaggacgacctgaaaaagaaaaaagcattgtcttccatgggagcgaattattcctcatacctggccaaagcagaccaaaagaggggaaagaagcagacagcacgggagatgaagaagaaaatcttagccgagagacgaaaaccactcaatatcgatcaccttggcgaagacaaattacgcgataaggcaaaggagctgtgggaaacacttcaccagctggagatagataaattcgagtttggagaaaagctcaagagacaaaagtatgacattacaacacttcgctccagaatagaccaggctcagaaacatagcaagaaggccggaacacccgcaaaggggaaagtcggaggaaggtggaagtag

SEQ ID NO: 245372 - DNA, 753 bp, Artificial Sequence
  Description of Artificial Sequence: Synthetic coding sequence
atgtcagatgaagaagtcgagcaggtcgaagagcagtacgaggaggaggaagaagcccaggaggaagaggaggtacaggaggaagagaagccccgtcctaaactgactgcccctaaaattccagaaggcgaaaaggtggacttcgacgatatacagaagaagagacagaataaggacctcatggagctgcaagctctcattgatagccatttcgaagcccgaaagaaggaggaagaagaactggtagctctaaaggagaggatagagaaaaggcgggctgagcgggcagaacagcagaggattcgggcagaaaaggagcgcgagaggcaaaatcgcttggcagaagaaaaggcgagacgtgaggaggaagatgccaagcggagggctgaggacgacctgaagaaaaaaaaggctctctcatccatgggtgcaaactactcgtcctacctggccaaggctgatcagaagcgcggtaaaaagcagaccgcaagagagatgaaaaagaaaattctagcagagagacggaagccactgaacatcgatcacctgggggaggataaacttagagacaaggccaaggaactgtgggagaccctgcaccaacttgagatcgataagtttgagttcggcgaaaaactgaagcggcagaaatacgacatcatgaacgttagagcccgagtccaaatgctcgccaagttcagtaagaaggcaggtacacccgcaaaagggaaagtgggaggccgatggaagtag

SEQ ID NO: 245373 - DNA, 810 bp, Artificial Sequence
  Description of Artificial Sequence: Synthetic coding sequence
atgagcgacgaggaagtggaacaagtcgaagagcaatatgaagaagaggaagaggcacaggaggaagcggcagaggtgcacgaggaggtccacgagcctgaagaggtgcaggaggacacggcggaagaagatgctgaagaggagaagcctagacctaagctgacagcgcctaaaatccctgagggagaaaaagtagattttgatgacatacagaaaaaacgccaaaataaggacctgatggagttgcaggccctgattgactcacactttgaagcacggaagaaagaagaggaggaactggttgctttaaaagaaaggatagagaaacggcgtgccgaacgggcagagcagcagagaatccgagccgaaaaggaacgcgaacggcagaaccgcctcgcagaggagaaagccaggcgggaggaggaagatgccaaacgacgggcagaggacgatctaaagaaaaaaaaagccctgtcttccatgggcgcaaactattccagttatctagccaaagccgaccagaagagaggcaaaaaacagactgctcgggagatgaagaagaaaattctcgccgaacgccgtaaacctctgaacatcgaccaccttggcgaagacaaattaagagataaagctaaagaactctgggagacactgcaccagcttgaaattgacaaattcgagttcggagaaaaactaaaacgccaaaagtatgatattacaactctgcggagccgaattgatcaggctcagaagcatagcaagaaggccggtacccccgctaaaggaaaggttggagggaggtggaaatag

SEQ ID NO: 245374 - DNA, 813 bp, Artificial Sequence
  Description of Artificial Sequence: Synthetic coding sequence
atgagtgatgaagaggttgaacaagtggaggagcagtacgaggaggaggaggaagctcaggaggaggccgctgaagtgcacgaagaggcccaccctggagaggagagcgtacgggaagataccgcagaagaggatgcagaggaagagaaacccaggccaaagctcacagccccaaaaatcccagaaggagagaaggtggatttcgacgacatccagaagaaacgacaaaacaaagatctgatggagttacaggcattaatcgactcacatttcgaagcgagaaaaaaggaggaggaggagttagtggcgctgaaagagcgaatcgagaagaggagggcagagagggccgagcaacagcggattcgggctgaaaaggagcgtgaacgtcaaaaccgactcgccgaagagaaagctaggcgtgaggaggaggatgcgaagagaagagctgaagatgatctcaagaagaaaaaagccctgtcttccatgggcgcaaattattcttcttaccttgcaaaggctgaccaaaagaggggtaaaaagcagactgccagggagatgaaaaagaagattctagctgagagaaggaagcccctcaatattgaccacctcggcgaggacaagctgcgagataaagcaaaagaactgtgggagactctccaccagttggaaattgataaatttgaattcggagagaagctgaaaagacagaagtatgacattaccactttgcgatcccgaattgatcaggctcaaaaacattccaaaaaggcgggaacacccgcaaagggaaaggttggtgggaggtggaagtag

SEQ ID NO: 245375 - DNA, 435 bp, Artificial Sequence
  Description of Artificial Sequence: Synthetic coding sequence
atgagtgacgaggaggtggaacaagttgaggagcagtacgaagaagaggaggaggctcaggaggaagctgctgaagtacatgaggaggagcgccgagctgaggacgacctgaaaaaaaagaaggcgctctcttccatgggtgcaaattactcgtcgtacctggccaaggcagaccaaaagcggggtaaaaagcagaccgcgagggaaatgaagaagaaaatccttgccgaacggcgaaaacccctgaacattgaccacttgggagaggacaaactccgcgataaagcaaaagaattatgggagccccctcagtcttgccagggactaccagatagtcccggaggtggggaagccattcctggcaggcctcccagactttgcccttgttgtctgcatccactcggtcctgttaacaaagctgcggaaccaccatag

SEQ ID NO: 245376 - DNA, 1617 bp, Artificial Sequence
  Description of Artificial Sequence: Synthetic coding sequence
atggaagagtctgtcaaccagatgcagccgctgaatgagaagcagatcgcaaattcacaggacggctacgtatggcaagtgacggacatgaaccgcctgcacagattcctgtgcttcggaagtgaagggggaacgtactacatcaaagagcagaaattgggcttggagaatgcagaagcgctgattcgcctgatagaagatggcagaggatgcgaggtgatccaggaaatcaaatcgtttagccaggagggtaggaccacaaaacaggagccaatgctttttgctctcgcgatctgcagtcagtgcagcgatatctcaaccaagcaggccgctttcaaagctgtgtctgaggtgtgcagaatcccaacccatctgttcacattcatccagttcaaaaaagacctcaaggaaagtatgaaatgcggaatgtggggaagggccctgagaaaggcaatcgctgactggtataatgagaaggggggtatggccctcgcattagcagttactaaatataagcagagaaacggctggtcccacaaggatctacttaggctgagccacctgaaaccgagctccgagggcctggctatcgtcactaaatacatcaccaagggttggaaagaggtgcacgagttgtacaaggagaaggcgcttagtgtggaaactgagaaactgctaaaatacctggaggcagtcgaaaaggtgaagaggaccagggatgaactcgaggtcatccaccttattgaggaacaccggctggtgcgcgaacacctgctcactaatcaccttaagtcaaaggaagtctggaaggccctgctccaggagatgcctctcaccgctttactgcgtaacctcggtaaaatgacagccaactcggtcctggaaccaggcaactccgaagtaagtttggtgtgcgagaagttatgcaatgaaaagctcctgaagaaggccaggattcatcccttccatatccttatcgcactcgaaacctacaagaccggccacggtcttagaggaaagctgaaatggcgccctgatgaggaaatcctaaaggctctcgatgccgctttctacaagaccttcaagactgtcgagcccaccggaaagcgctttctgctcgcagtagacgtgagcgcgtcgatgaaccagagggttctggggtcaattctcaatgcgagtacagttgctgccgcaatgtgtatggttgtgactcggacagaaaaggattcgtacgtcgttgcattttctgacgagatggtcccgtgcccagtcacgactgacatgacgctgcagcaggttttaatggctatgagtcagatccctgcaggagggacggactgcagccttcccatgatctgggctcagaaaacgaacactcccgctgatgtgttcattgtcttcacagataatgagacttttgccggtggagttcaccccgctatcgcgttgagagagtaccggaagaaaatggacattccagctaaactcatcgtgtgcggtatgacttccaatgggttcactatcgcagaccctgatgatagggggatgctggatatgtgcgggttcgatacaggcgctcttgatgtgatcaggaactttacgctggacatgatctag

SEQ ID NO: 245377 - DNA, 1557 bp, Artificial Sequence
  Description of Artificial Sequence: Synthetic coding sequence
atggaggagtccgttaaccagatgcaacccctgaatgagaagcagatcgccaatagtcaggatggctacgtgtggcaggtgacagatatgaacaggctccataggttcctgtgctttgggagcgaaggcggtacctactacatcaaggagcagaaactaggactggaaaacgcggaagcactgatccgcctgatcgaggatggtaggggctgtgaggtgattcaggagatcaaaagttttagccaggaaggaagaaccacaaagcaggagcccatgctcttcgcactagctatatgttcacagtgctcagatatctctaccaaacaagccgcttttaaggccgtgagcgaagtatgtagaatccctacacacctgttcacgtttatccaattcaagaaagacctgaaggagtcgatgaagtgtggtatgtggggcagagcattacgcaaagcaattgctgattggtacaatgagaaaggcggtatggcactggcccttgcggttacaaagtacaagcaacgtaatgggtggagtcataaggacttgctgcgcctaagccacttgaaaccctcctccgaggggctggctatcgtgaccaaatatataactaagggctggaaggaggttcacgagctgtataaagaaaaggccctctccgtggaaaccgagaaactgctaaaatatctggaggctgtggagaaagtcaagagaactagagacgagctggaagtaatacatctcatcgaagaacatcgcttagtgcgagagcacctcctgactaatcacctgaagagtaaggaagtttggaaagccttgctgcaggagatgccgttaacagctctattaaggaatctggggaaaatgaccgccaacagcgtgctggaaccaggtaactccgaggtctcattagtttgcgagaaattgtgtaacgaaaagctcctgaaaaaggctaggatccatcccttccatattcttatcgcgctagagacctacaagactggacacggcctgcggggaaagctgaagtggagacccgacgaagaaatcctcaaagctctggacgctgcgttttataagacgtttaagactgtggagcctacagggaaacggtttctgctggctgtggatgtaagcgcttcaatgaaccagcgtgtgctcgggtccattttgaatgcatctacagttgctgccgctatgtgtatggtggtgacacggaccgaaaaggacagctacgtggtcgctttctccgacgaaatggtgccctgcccagtgacaaccgatatgactctccagcaagttttaatggccatgagtcagattcccgcaggcggaacagactgcagtctgcccatgatctgggctcagaagacaaatacccccgctgacgtcttcattgtattcacagacaatgaaactttcgccggtggagttcatcctgccattgcattgcgcgaataccgaaaaaagatggatattcctgccaagctgatcgtctgcggtatgaccagtaatggattcaccatcgcggatccggatgaccgtgatactgtgaagtag

SEQ ID NO: 245378 - DNA, 1578 bp, Artificial Sequence
  Description of Artificial Sequence: Synthetic coding sequence
atggaagaatccgtgaaccagatgcagccactgaacgagaagcagattgccaactcccaggatggttatgtgtggcaggttacagatatgaataggctgcaccggtttctatgtttcgggagtgaaggaggaacatactacattaaggagcagaagctggggcttgagaacgcagaggcattaattagactcattgaggatggccgaggatgcgaggtcatccaggagattaaatctttttctcaggaggggcgaacgactaaacaggagcccatgctattcgccttagcaatttgtagccaatgcagcgacatctcgacaaaacaggccgcttttaaggctgtctctgaggtgtgtaggatccccacacatctgttcacatttattcagttcaaaaaggacctgaaggagagcatgaagtgcggtatgtggggtcgagcactgcggaaggccatagccgactggtacaatgaaaaaggaggaatggccctagccttggccgtgacaaagtataaacagcggaacggatggtcacacaaggatttgttacgactgtcccacctcaaaccttctagcgaaggtctggcaattgtaactaagtacattactaagggttggaaagaagtgcatgagctgtacaaagagaaggccttgtccgtggagacagagaagctgctgaagtatcttgaggcagtcgagaaggtgaagcgaacccgtgatgagctcgaagtcattcatttaattgaagaacacagattggtacgcgagcatctgcttacaaatcatctgaagtccaaggaagtgtggaaagctctcctgcaggagatgccactgacggctcttctccgaaatctcggaaagatgaccgcaaattccgttctggaaccaggcaactcagaggtgtctctggtgtgcgaaaagctgtgcaatgagaaactacttaaaaaggcccgtatccaccctttccatattctgattgctctcgaaacctacaagaccggacatgggctgagagggaagcttaagtggcgacctgatgaggagatcctgaaggccttggatgctgcattttacaagacattcaagaccgttgagcccaccggcaaacgctttctgttagccgtggatgtgtccgcgtctatgaatcagcgcgtcctgggctctattctgaatgcttctaccgtggcggcagcgatgtgcatggtggtgactaggactgaaaaagatagctatgtggtggctttcagtgacgagatggtgccttgccccgtgacaacagacatgaccctgcagcaagtgttgatggccatgtctcagatcccagcagggggaacggactgtagtctccctatgatctgggcccagaaaaccaacactcctgccgatgtattcatcgtgttcaccgataatgaaacatttgccggtggtgtccaccctgctatcgcactccgtgagtacagaaagaaaatggacattcctgccaaactgattgtgtgtggcatgacttctaatggctttaccattgctgacccagatgatagggcactccagaatacccttctgaacaagtctttctag

SEQ ID NO: 245379 - DNA, 1605 bp, Artificial Sequence
  Description of Artificial Sequence: Synthetic coding sequence
atggaggagtccgtgaatcagatgcagcctctcaatgagaaacaaatagctaatagtcaggatggttacgtctggcaggtcaccgatatgaaccgtcttcacagattcctgtgtttcggatccgaagggggaacctactatattaaggagcaaaagttgggcttggagaacgccgaggctttgattagactcattgaggacggaagaggctgtgaagtgattcaggaaatcaagagcttctctcaggagggcaggaccaccaagcaggaacccatgctcttcgccctggccatatgcagtcaatgctcagacatatcaaccaaacaggcagcttttaaagcagtgagcgaggtgtgccggattccaactcacctatttacgttcatccagtttaagaaggacctgaaggaatccatgaaatgcggcatgtggggccgtgctctccggaaggcaattgccgattggtacaatgagaagggcggtatggccttggcgttggcagtaactaaatacaagcagagaaatggttggagtcacaaagatctgctgagattgagtcatctgaagccaagttcagaaggtctcgccatagtgacaaagtacattaccaaaggatggaaggaggtgcacgaactctacaaggagaaggctctctcggtggagacggaaaagctgctaaagtacctggaggccgtggaaaaagtgaagagaacgagggacgagttggaggtcatccaccttatcgaagagcaccgtctcgtgcgggaacacctactgacaaaccacctaaagtctaaagaagtgtggaaggcccttctgcaggagatgccactaactgcgctcctgagaaacctgggtaaaatgactgctaactcagttcttgaacccggaaactctgaggtttccctggtgtgcgaaaagctgtgtaacgagaaactgcttaaaaaagctagaattcacccattccacatcttgattgctctggaaacctacaagaccggacacggactccgtggcaagctgaaatggcgtcctgacgaagagattctcaaggctcttgatgctgctttctacaaaacttttaagactgttgaaccaaccgggaagaggttcctcctggcggtggatgtgagcgcctcaatgaatcagcgggtgctgggctcgattttaaatgccagcacagtggcagcggcaatgtgtatggtggtcactcgcacagagaaagattcctatgtcgtggcttttagcgacgagatggtgccctgcccagtgacaacagatatgaccctccaacaagtgctcatggctatgtcgcagattcctgcaggcggtactgattgcagcctgcctatgatctgggcgcagaaaacgaacacaccagcagacgtcttcattgtctttacggacaatgagactttcgcaggcggagtccatccagccattgccctgagagagtataggaaaaagatggacattccagcgaagttgatcgtgtgtggaatgacaagcaatggctttaccattgccgatcctgatgatagaggtatgctcgacatgtgtggcttcgacacaggcgctctggatccttgtaaaataccctattag

SEQ ID NO: 245380 - DNA, 1617 bp, Artificial Sequence
  Description of Artificial Sequence: Synthetic coding sequence
atggaggagtcagtgaatcaaatgcagcccctaaatgagaaacagatcgctaactctcaggatggctatgtgtggcaggtaacagacatgaacaggctgcaccggtttctatgtttcgggagtgaagggggtacatactacattaaagagcagaagcttggactcgaaaatgcagaagccctgatccggctcatcgaggacggaagggggtgcgaagtcatccaggagattaagagtttcagccaggagggaaggaccaccaagcaggagcccatgctgtttgccctggctatttgttctcagtgctctgacatcagcacgaagcaggctgcctttaaggccgtgtcagaggtgtgcaggattcctacacacctcttcacattcatacaattcaaaaaggacctaaaggagtctatgaaatgtggaatgtggggccgtgctctccgcaaggcaattgcagactggtataacgagaagggtggcatggccttggctctggctgttactaagtacaaacagcgaaatggctggtctcacaaagacctgcttcggctctcccatctcaagcctagctccgaagggctcgctatcgtgaccaaatacatcacgaaggggtggaaagaggtgcacgaactgtataaggagaaagcacttagcgtggaaacagagaagttgctgaagtaccttgaagctgttgagaaggtgaaaaggactcgcgacgagctggaggtgatccatttgattgaggaacaccgcctggtccgcgagcatcttctcacaaatcacctgaagagcaaggaggtgtggaaggcattactgcaggagatgccattgacggcactcctgcgtaaccttggcaaaatgacagccaattccgtcctggaaccgggaaacagcgaggtaagccttgtctgtgagaagctgtgcaacgaaaaattgctgaagaaagctcgcatccacccatttcacattctgatcgcgcttgagacctacaagactggtcatggtctgagagggaagttaaaatggcggcctgatgaggaaatcttgaaagctcttgatgccgcattctataaaacctttaaaactgtagagcccacaggtaagaggtttttactggctgtggatgtgagcgcgagtatgaaccagagagtactgggctcaatcctcaatgccagtactgtggccgctgcaatgtgcatggtggtcacaaggaccgaaaaggactcttacgtggtggccttctcggacgagatggtgccttgcccagtgacaaccgacatgacactgcaacaggtgcttatggctatgagccagatccccgcaggcggaaccgattgtagtctgcctatgatatgggctcagaaaaccaatacccccgctgacgtgtttattgtcttcactgacaacgaaacttttgcaggcggtgtgcaccctgctattgctctcagggagtataggaaaaaaatggacataccagcaaagctaatcgtttgcggtatgaccagtaacggattcaccattgcagatccagacgacagggggatgctcgatatgtgtgggttcgacaccggtgctctggatgtgattcgcaatttcacattggacatgatttag

SEQ ID NO: 245381 - DNA, 1617 bp, Artificial Sequence
  Description of Artificial Sequence: Synthetic coding sequence
atggaggagtctgttaatcagatgcagcccctgaacgaaaaacagatcgccaattcacaggatggatacgtctggcaggtgacggacatgaataggctgcaccgcttcctgtgttttggctccgagggcggtacctactacataaaagagcagaaactcggactcgagaatgcagaggcgctcattcggcttattgaggacggcagaggatgtgaagtgattcaagagatcaagtcattctctcaggagggtagaactaccaagcaggagcccatgctgttcgcgcttgctatttgctcgcagtgtagcgacatctctacaaaacaggccgcttttaaggccgtctccgaagtgtgcaggatccccactcatctcttcacattcatccagttcaaaaaggatctgaaggagtccatgaagtgtggcatgtggggaagagctttgcgaaaagcaatcgcggattggtataatgaaaaggggggaatggctctggccttggccgtaactaagtataagcagaggaacggatggtctcataaggacctgttacgtctctcacacctgaaaccttcttcagagggcctcgcaattgtgacaaaatacataactaagggatggaaggaagttcacgagctttataaagagaaggcactgagtgtggagaccgaaaaactgctgaaatatctcgaggccgtggaaaaggtgaagcggacgcgggacgagcttgaggttattcatcttattgaagagcatagactggtgcgggaacacctcttgacaaaccatcttaagagtaaggaagtctggaaagccttactccaagaaatgcccttgactgctctcctgagaaacctgggaaaaatgacggctaacagcgtgcttgaacccggtaatagcgaagtttctctggtctgcgagaaactgtgtaacgagaagttgctgaagaaggctaggattcatccctttcacatcctgatagcactggagacctataagactgggcacggcttaaggggcaaacttaaatggcggcctgatgaggagattctaaaggcacttgacgccgctttttacaaaacatttaagacagtggagccgactggcaagcgcttcctgcttgctgtggatgtcagcgcctctatgaaccagcgggtgctaggaagcattctgaacgcatcaactgtagcagccgctatgtgcatggtggtcacgagaacagaaaaggacagttacgtggtggcattttcagatgagatggtcccatgccctgtcactacggacatgactcttcaacaggtgctgatggcaatgtcccagatcccagctggaggcaccgattgttcgctgcccatgatctgggctcaaaagaccaacactcctgccgacgtttttattgtgttcacagataacgagacatttgccggtggcgtccacccggcaattgcactacgcgagtaccggaagaaaatggatatcccagcaaaactgatagtctgtgggatgacatcaaacggcttcaccatcgcggacccagatgacagaggaatgctcgacatgtgcggatttgacacgggagcccttgatgtgatacggaatttcaccctcgacatgatttag

SEQ ID NO: 245382 - DNA, 792 bp, Artificial Sequence
  Description of Artificial Sequence: Synthetic coding sequence
atgcctttgacagctctcctgcggaacctgggcaagatgaccgctaacagtgtgttagagcctggcaattcagaggtgagcctcgtgtgcgagaaactgtgtaacgagaaattactcaagaaggcacgcattcacccattccacattttgatcgccctcgagacatataaaacaggacacggactgcgtgggaagctgaagtggcgacctgatgaggaaattctgaaggcattggatgccgcattctataaaacattcaagactgtggagccaactggcaagcgtttcctccttgccgtcgacgtgtcggcgtccatgaaccagcgcgtgttaggttctatcttaaatgccagtacggtcgccgcagctatgtgtatggtggttacaagaacagaaaaggactcatacgtcgtggcattttcagacgagatggtcccttgtccagtaaccacagatatgacactgcaacaggtgctgatggctatgtctcagatccccgcaggaggcacagactgctcccttccaatgatctgggcccagaaaaccaacacacctgccgatgtgttcatagtctttacagataacgaaactttcgctgggggagtccatcccgcaatcgccctgcgggagtacaggaagaagatggatataccagcgaaactcattgtgtgtgggatgactagcaacggcttcaccatagctgacccagatgacagaggcatgctagacatgtgtgggtttgatacaggggcactggatgtcatcagaaatttcaccctcgacatgatatag

SEQ ID NO: 245383 - DNA, 126 bp, Artificial Sequence
  Description of Artificial Sequence: Synthetic coding sequence
atggaggagtccgtgaatcaaatgcagccactgaatgagaagcagattgccaattcacaggacgggtacgtttggcaagtgacagacatgaaccggctgcatcgtttcctgtgttttggatcgtag

SEQ ID NO: 245384 - DNA, 1050 bp, Artificial Sequence
  Description of Artificial Sequence: Synthetic coding sequence
atggctgctagtgaggctgctgtggtctctagcccctcactcaagacggataccagtccagtccttgaaacggcagggaccgttgccgcaatggccgctactccaagtgctagggcagccgctgctgtggtggcggctgccgctcgcactggctctgaagcacgagtctcaaaagccgctctggcaactaagcttttgtccctgtccggtgtcttcgcggtccacaagcccaaggggccaacaagtgctgagcttctaaaccggttgaaggagaaacttttggccgaggcgggtatgccaagccccgagtggactaaaaggaaaaagcagaccctcaagatcggccacggcggaacactagacagcgctgctcgtggagttttggttgtgggcattggcagtgggacgaaaatgttaacgtccatgttgtcagggagcaagaggtataccgctattggcgaactggggaaggcaacagacaccctcgattcgacgggaagagtgacagaggagaaaccctacgataaaatcacccaggaagacatcgaaggcatactgcaaaagttcaccgggaatattatgcaggtacctccactgtattcagccctgaaaaaagatggacagagactttccacccttatgaaaagaggggaggtggtagaagcaaagcccgctcgtccagtgacagtgtactctatttctctccaaaaattccaaccgccatttttcacactagatgtggagtgcgggggagggttctacattagaagtctggtgagtgacattggtaaggaattgtcctcatgtgcaaacgtgctggagctgacacgcaccaaacagggcccttttacgctcgaagagcacgctttacctgaagataagtggaccattgatgacatagctcagagtcttgagcattgttcatcactattccctgccgagctcgctctcaagaaaagtaagccagaatctaatgaacaagtcctgtcctgtgagtatatcactctgaatgaacctaagagagaggacgacgtaattaagacatgctag

SEQ ID NO: 245385 - DNA, 996 bp, Artificial Sequence
  Description of Artificial Sequence: Synthetic coding sequence
atgggttcggctggattatcaagattacatgggcttttcgcggtgtacaagcctccagggctcaagtggaaacatttgagggatactgtggaactccaattgctgaaaggactaaacgccagaaagccaccagcacccaagcagagggttagatttctcttagggcctatggaaggaagtgaggagaaggaactgacgctgacggctacatcagttccatcctttattaatcatccactggtgtgtggacctgctttcgctcatctaaaagtaggcgtcggacaccgactggatgctcaggcctcaggagttcttgtcctgggcgtaggacatggctgtcggctgctgacagatatgtataatgcccatctgactaaagactacaccgtgagaggccttttgggaaaggcaaccgatgatttccgggaagatggacgactagttgaaaagacaacttatgaccacgtgactcgagaaaagttggaccgcattctggctgtgattcaaggatctcatcagaaggcactggttatgtatagtaatctcgatcttaagactcaggaagcttatgaaatggcggtacgtgggttaatccggcctatgaacaagagtccaatgctgataacaggaatcaggtgcctgtattttgcgcctcctgagttcctgctggaagttcagtgcatgcacgagacccagaaagagctgcggaaactggtgcacgaaatcggtctcgaacttaaaactactgccgtctgtacccaggtccgccgaacccgcgatggcttctttacgcttgattcagccctgctccgaacacagtgggacttgactaatattcaggatgccatcagagccgctacaccacaggtggctgcagaattagaaaaaagccttagccccggattagacacaaagcagctgccaagccccggttggagctgggatagccaaggaccttcatcaacactcggcctggagagaggagccggacagtag

SEQ ID NO: 245386 - DNA, 828 bp, Artificial Sequence
  Description of Artificial Sequence: Synthetic coding sequence
atggagggctcagaagaaaaggagcttaccctgaccgctactagcgtgcccagcttcatcaatcacccgttggtctgcggccctgccttcgcccacctgaaagtcggggtaggccatagactcgacgcccaagcttccggtgtgctagtgctcggcgtggggcacgggtgcagacttctcactgacatgtataatgcccacttgactaaggactacaccgtgagaggactgctggggaaggcaaccgacgatttcagagaggacgggcgactggtggaaaaaacgacgtatgatcatgttaccagggagaaactggatcgtattctggctgttatccagggttctcaccagaaggccctggtcatgtactccaacctcgatctcaagacgcaggaggcctatgagatggctgtgcgaggccttatacgtcctatgaataagtcccccatgcttatcacaggaattagatgtctatacttcgctcctcctgaattcttgctggaggtgcagtgtatgcatgagacccagaaggaacttagaaagcttgtgcacgaaataggcttagaactgaagacaactgcagtgtgcacacaagtgcgaaggacacgcgatgggtttttcacgctggatagtgctttactccgcacacaatgggatctgactaacatccaagatgccattcgagccgctactccccaggttgcggctgagctggagaagagtcttagccccggattggacaccaagcaacttccctctccaggctggtcttgggatagccaggggccaagtagcaccttggggctggaacgcggtgccggtcagtag

SEQ ID NO: 245387 - DNA, 1701 bp, Artificial Sequence
  Description of Artificial Sequence: Synthetic coding sequence
atgagacggcagtggggctcagcaatgcgggctgcggagcaagctgggtgcatggtctcagcctctcgggcagggcagcccgaggctgggccttggtcctgcagcggagtcatactctcccggtcaccaggcctcgtgctatgccacgggggaatctttgtgccatttttacgagcaggaagcgaagtactgacagcggcaggggctgtttttctccctggcgatagctgtagagacgatttgcggctgcatgtgcagtgggcccctaccgccgctggtcctgggggtggcgcagaaagaggacgaccaggtctctgtacacctcagtgcgcttccctggaacccggaccaccagctccatctcggggacgacctctccaacctcggctgccagcggagctgctgctgttgctgagctgtccagcgttttgggcccatttcgctcgattgtttggcgatgaagcagcagagcagtggaggttttcttccgccgcaagagatgacgaggtgtctgaggacgaagaagccgatcagttgcgcgctctgggttggtttgccctgctcggcgttaggctggggcaggaggaagtcgaagaggaacggggacccgctatggctgtgagccccctgggcgcagtccctaaaggtgctccactgctggtctgtggcagcccctttggcgcattttgccccgacatcttcctgaacacactgtcttgcggagtgctcagtaatgtcgctggccctcttctccttacagatgccagatgcttgcccggaactgagggaggcggagtgttcaccgcccgaccagccggtgcactggtggcgctggttgtggccccactgtgttggaaggcaggagagtgggttggttttaccctgctctgtgctgccgctccactgttccgggctgcacgtgatgcgctgcaccgtctgccccactccacagcagcactcgccgcactgctcccacctgaggtgggggtgccatggggcctgccccttagggattctggtcctctgtgggcggcagccgctgttctggtggagtgcggaaccgtgtggggctccggcgtggctgtggcgcctagactcgtggtgacatgcagacacgtttctccacgagaggcagctcgggtcttagtgcggtctaccacgccaaagtctgtggcaatttggggccgagtagtcttcgccactcaggaaacatgcccctatgatatcgccgtcgtctcacttgaagaggatttggatgacgtgcctatccctgtccctgcagaacattttcacgagggcgaggcagtatccgtggtcggatttggggttttcggtcagtcatgtggaccatccgtgaccagtggcatcttgtcagcagtggtgcaagtgaacggaaccccggtcatgctgcagaccacttgtgccgtgcatagcgggtcatccgggggacctctcttctcgaaccactcgggaaatctcttgggcataattacctccaacacgagagataataacaccggagccacatatccacacttgaatttcagcatccctattacagtcctgcagcccgcattacagcagtacagccaaacccaagatctggggggactgcgcgagctggacagagcagccgagcctgttcgggtggtgtggcgacttcagaggccgctggctgaggcccctcgtagcaagctatag

SEQ ID NO: 245388 - DNA, 1197 bp, Artificial Sequence
  Description of Artificial Sequence: Synthetic coding sequence
atgagacggcagtgggggtccgcgatgcgggctgccgagcaggctgggtgcatggtttcagcctcaagggcaggccagcctgaagcaggcccatggagctgcagcggagtcatcctgtcaaggagtccaggcctagttctctgccatgggggtatctttgtccctttcctcagggctgggagtgaggtcctcacagccgctggtgcagtcttcctacccggtgactcctgtcgggatgacctgagacttcacgttcagtgggcccctaccgcagcagggcctggtggaggagcagaacgaggaaggcctggcctctgtactccccagtgtgctagcctggagcccggacctccagctccctcaagggggagaccccttcagccgcgactccccgctgagctgctgctacttctttcctgccctgccttttgggcccattttgctcgcctgtttggggatgaggcagctgagcaatggaggtttagtagtgctgctcgggatgacgaagttagcgaggatgaagaggctgatcagctaagagctctgggctggttcgctctgctgggcgttcgcctcggccaagaggaggtcgaagaggagcgcggtccagccatggctgtatccccactgggagcggtcccaaaaggtgcccctcttttggtgtgtgggagccccttcggggctttctgccccgacatctttttaaataccctgagctgcggagtgctgagcaatgtcgctggacccctactcctaacagatgcccgatgcctgccaggcactgaaggtgggggtgtttttactgcaaggcctgctggggcactggtcgcacttgtagtggctcccttgtgttggaaagcaggtgagtgggtcggatttaccctgctctgtgccgctgccccattatttagagccgcacgcgacgctttgcaccgactgccacatagtaccgcggctttggccgcattactaccccctgaggtgggcgttccttggggtctgcctcttcgcgactccggcccactctgggctgccgcagcagtcctggttgaatgcgggactgtgtggggcagtggtgttgccgtggctccaagactggtggtaacctgcaggcacgtgtctcccagagaggccgctagagtcctcgtccggtcaacaactccgaaacacaatcatcagcagcatcctggtcagtag

SEQ ID NO: 245389 - DNA, 828 bp, Artificial Sequence
  Description of Artificial Sequence: Synthetic coding sequence
atgttaaatcttctgcttctcgcgttaccagtcctcgctagtcgcgcttatgccgctcccgctcctggccaagccctgcagcgggtgggaattgttgggggtcaggaggcgccacgatccaaatggccttggcaggtcagtctgcgagtgcatggcccatattggatgcacttttgcggcggatcgctgattcatccccagtgggtgctcactgcagcacactgcgttggccctgacgttaaggatttggctgccctgcgcgtgcaacttcgggagcagcatctgtactatcaggatcagctgcttccagtctctagaattattgtccatcctcagttctacacggcacagattggtgctgacattgccctgctcgaactggaggaacctgtcaacgtgtcctcccatgtgcacactgtcaccctgcccccagcgagcgagaccttccctcctgggatgccttgctgggtcacagggtggggtgacgttgacaatgatgaaaggttgccccctccctttcctttaaagcaagtgaaagtgcctattatggaaaaccatatctgcgacgcgaaataccatctgggcgcttatacaggggatgatgtccgaatagtacgcgacgacatgctctgcgcaggaaataccagacgcgattcttgccagggcgattcgggcggaccgctggtgtgcaaagtaaatggtacctggctgcaggctggcgttgtgagctggggcgaggggtgcgctcagcctaaccgcccaggcatctacactagagtcacgtactatttggattggatccaccattatgtgccgaagaaaccttag

SEQ ID NO: 245390 - DNA, 849 bp, Artificial Sequence
  Description of Artificial Sequence: Synthetic coding sequence
atgttgctcttggcccctcagatgctcaacctcctgctgttagcactgcccgtactggccagtagagcgtacgctgctcctgccccagggcaagcccttcagcgggttgggatcgtgggtggtcaggaagccccaaggtcaaagtggccatggcaggtgtctttgagggtgcatgggccatattggatgcacttttgcggtggctcactgatccacccccaatgggtattgaccgctgcgcactgtgtcggaccggatgtgaaggacctggcagctctgcgggtgcagttgcgcgagcaacacttgtactaccaggatcagctcctgccagtctctcgcattatcgtgcatcctcagttctacaccgctcagataggcgctgacattgccctgcttgaactggaagagcccgtaaacgtgtcatcgcacgtccacaccgtgactctgccccctgctagcgagactttcccccctggtatgccctgttgggtgacagggtggggggacgttgacaatgatgagcgcctcccacctccgtttcctcttaagcaggtcaaagttccaataatggagaatcatatatgcgatgcaaagtaccatcttggcgcttatactggcgatgacgtaagaattgtcagagacgatatgctgtgcgcaggaaatacacgcagggattcttgccagggtgattccgggggacccctggtatgcaaggtaaatggcacatggctgcaagctggagtggtctcctggggggagggttgcgcccagccaaacaggccaggcatctatacacgcgtaacatactacctcgactggattcatcactacgtgccaaaaaaaccatag

SEQ ID NO: 245391 - DNA, 2532 bp, Artificial Sequence
  Description of Artificial Sequence: Synthetic coding sequence
atgtgggggcgactgtggcccttacttctctccatattgacggccaccgccgtgccaggtccttcgttgcggaggccatcccgcgagctggacgccaccccgaggatgacaatcccttatgaggaactcagcggcactcggcacttcaaaggacaagcgcagaattattccaccttgttgttggaggaagctagcgcaagactacttgtaggggcacgcggtgctctgtttagccttagtgccaatgacataggagacggagctcataaagagattcattgggaggcgtcacctgagatgcaaagcaaatgtcaccagaagggaaagaataatcagaccgaatgttttaaccacgtacggttcttgcagcgcctcaacagtacccacctatatgcttgcggaacacatgcctttcagccactatgcgcggctatcgatgccgaggctttcaccctcccaacgagctttgaagaggggaaggagaagtgtccctacgatcccgctcgaggattcaccgggctgattattgatggcggactgtatacggccaccagatatgagtttcggtccatccctgatatccggagatccaggcatccccattctctgagaactgaagagacccccatgcactggctcaacgatgcagagtttgtgtttagtgtgctggtgagagaatctaaggcttcagccgtcggcgacgacgacaaggtttactatttcttcaccgagcgcgctactgaggagggaagcggctcctttactcagtccaggtccagccaccgagttgctcgcgtcgcacgagtctgcaagggggatctgggcggaaaaaaaattctacaaaagaagtggaccagctttctgaaagctagattaatttgtcatatccctctctacgaaactttacgtggtgtctgcagcttggacgctgaaaccagctcgcgaacgcacttttatgcagctttcaccctctctactcagtggaagaccctcgaggccagcgctatttgtcgttacgaccttgcagaaatccaggctgtcttcgctgggccttatatggaatatcaggacggctccagacgctggggaagatacgagggtggcgtgcctgaacctagaccgggaagttgtatcaccgattctctgcgctcacaaggttacaactccagccaggatttaccatctctagtgctcgactttgtcaagctgcatcctctgatggcgagaccagttgtgcctactcggggtagacctctcctgctcaaacggaatatcaggtatactcatctgaccggcaccccggtgactacccctgctggccctacgtacgacctgctgtttcttgggaccgctgacggctggattcacaaggcagttgtgctgggcagtggtatgcacatcatcgaggaaactcaggttttcagggagagtcagagcgtagaaaacctggtcattagcctgctgcagcacagcttgtacgtgggggctccgtccggggtgattcagctaccactgtcttcgtgctcccgatataggagttgttacgactgtatcctggcacgagacccctactgcggatgggaccccggaacccacgcctgcgcagcagccactaccattgcaaaccgaagccagggctcccgaactgccctgatccaggacattgagagggggaaccgtgggtgcgagagctccagagatactggacctccccctcccttaaagacacggagcgtactcaggggggacgatgtcctgcttccctgtgaccagccgtccaaccttgcaagagctttatggcttctcaacggatccatgggtctcagcgatggccagggcggatacagagtgggagttgatgggctgcttgttacggacgctcagcctgaacattcaggcaactatgggtgttatgctgaggagaatggcctgagaactttgctggcatcatattctctgactgttaggcccgctacacctgccccagcaccaaaagcccctgccacaccaggggctcagctggctcctgacgtgcgcctcctctatgtgttagcgattgccgctctcgggggtctgtgcctgattcttgctagtagcctgttgtacgtcgcctgcctccgagagggcagaagggggcgtcggcgaaagtactcactgggtagggctagtcgcgctgggggaagcgcggtgcagctgcagactgtgtccggacaatgtccaggcgaggaggacgaaggcgatgatgaaggcgctggcggtttagagggctcctgtctccagattatccccggtgagggtgcacccgcaccgcctccaccaccccctcctccacctccggcagaattaacaaacggtctggtggccctgcctagcagactgagacgcatgaatggcaactcatacgtgcttctgcgtcaaagtaacaacggcgttccagccggtccatgttcattcgccgaagagctctcaaggatcctggaaaagcgtaaacacactcaactagtggaacagttggacgagtcctccgtgtag

SEQ ID NO: 245392 - DNA, 708 bp, Artificial Sequence
  Description of Artificial Sequence: Synthetic coding sequence
atgctgagcctcctgttattagctttacccgtcttggcgagtcccgcatatgtggcgcctgctcctggtcaggctcttcagcagactgggatcgtgggcggacaagaggctccgcgttctaaatggccttggcaagtgtcattacgcgtgcgtgggccttactggatgcacttttgcggcggaagcctaattcatcctcagtgggtactgactgccgcacactgcgtggaaccagacatcaaagatttagctgcgttgagagtgcagttgagggaacagcacctgtactaccaggaccaattgctgccagtctctcgaatcatcgtgcaccctcagttctacattattcagaccggggcagacatcgcactgcttgagctggaagaaccggttaacatatcttcccatatccacaccgtgacactgcctcccgcatctgagacatttccccctgggatgccctgttgggtaaccggttggggggacgtggacaacaatgttcatctgccgccaccctatcccctgaaagaggttgaagtccccgtggtggaaaaccatctgtgcaatgccgaataccacacaggtctacataccggacattcctttcagatagtgcgagatgatatgctatgtgccggttccgagaatcatgactcctgtcaaggggatagtggtggaccacttgtgtgtaaggtgaatggtacttag

SEQ ID NO: 245393 - DNA, 4281 bp, Artificial Sequence
  Description of Artificial Sequence: Synthetic coding sequence
atgcactcctctaaccccaaagtgagatcctcaccctccggtaatacacagtcttcacctaagagcaagcaggaggttatggtgaggccaccaactgtgatgtccccctcaggcaatccccaactggattcaaagttcagcaaccagggaaaacagggaggctcagcgtctcagtcccagcctagcccctgcgatagtaaatcaggagggcatacaccgaaggccctgcctggcccaggtggctccatgggactcaagaacggcgcaggtaatggagcgaagggcaagggcaagcgggagaggagcatttcagccgactcgttcgaccaacgggatccgggtacccccaacgacgactccgacattaaggagtgcaactcagctgaccacattaagagtcaagatagtcaacacaccccgcattcgatgacgcctagcaatgctaccgcccctagatcttcgactccatcacatgggcagacaaccgccacggaaccgaccccagcccagaagactcctgctaaggtagtttacgtgttcagtaccgagatggcaaacaaggccgctgaggcagtcctaaaagggcaagtggagacaattgtctcattccatatccaaaatatcagtaacaacaagacagagagatcaaccgcaccgctgaatacacagatttccgcattacggaacgaccctaaacccctcccccagcaaccgcctgccccagccaatcaggatcaaaatagcagccagaacacacggttgcagccaacacctcccattccggctcctgcacccaagcctgctgctcccccacgtcctctagaccgagaatccccaggggttgagaataaactgattccttccgtcggatctcccgcttccagcactcctctgcctccagacgggacaggacccaattctacccctaataacagagctgtcacacctgtgagtcaaggtagcaattctagctccgcagatccaaaagctccacctccaccaccggtgtcctccggggaaccccctacgctgggcgagaaccctgacgggctgtcacaagaacagctggagcaccgcgagcgctcactccagacgctacgagatatccagcgaatgctgttcccagatgaaaaggaattcacaggtgcccagtccggaggacctcagcagaatcccggtgtcctggacggcccacagaaaaagcccgaggggccaattcaggccatgatggcccagagtcagtctttaggcaaggggccaggccctcgcacggacgttggagccccttttggcccacagggccatcgcgacgttcctttctctcctgatgagatggtaccgccatccatgaactcccagtccggcacgattggtccagatcatctggatcacatgactccggagcagattgcctggctgaagctgcagcaggagttttacgaagaaaaacgacggaagcaggagcaggtggtggtgcaacaatgcagccttcaggatatgatggttcaccagcacgggcctagaggcgtcgttaggggtccaccacccccataccagatgactccgagcgaagggtgggcacctggagggactgaacccttcagcgatggcatcaatatgccccactcgctgccgcctagaggaatggcaccacaccctaatatgccaggctcacagatgcggctgccaggcttcgcaggtatgatcaattcagaaatggaggggccaaacgttcccaaccccgcaagccggccagggctgtcgggcgtgagctggcctgatgacgtccctaagattccagatggcagaaattttccgccaggacaggggatcttctccggcccaggcagaggagaacgattccctaaccctcaggggctgagcgaagagatgtttcagcaacagctggctgagaaacagctggggttgcctcctggcatggctatggaggggatcagaccgagcatggaaatgaatcggatgatcccaggtagccagcgtcatatggagcccggaaacaacccaatttttcctcgcattccagttgaaggtcctctttccccaagtcgcggagacttccctaaaggtataccaccccagatgggacctggacgcgagctagaattcggcatggtgcccagcgggatgaagggggacgtcaacctcaacgtaaatatggggagtaactcacagatgattcctcagaaaatgcgggaggccggagcagggccagaggaaatgctcaaattaaggccaggaggcagcgacatgctgcccgcacagcaaaaaatggtgccacttccgtttggcgagcatccacaacaggagtacggaatgggtcctcggccatttcttccaatgtctcagggcccagggtcaaacagtgggctccgaaatcttagagagcctataggacccgatcaaaggaccaattctaggctctcgcacatgccccctctgccattgaacccaagttctaatccaaccagcttaaacacggctcctcccgtgcaaagagggctcggaaggaagcccctggatatttccgttgccggatcccaagttcattcacctggaattaatcctctgaaatcacccacgatgcaccaagtccagagtccgatgctcgggtccccatctggtaatttaaagtctccacaaacacccagccaattggccggaatgctcgctggtcctgcggctgctgcatctatcaaatccccccctgttctcgggagcgcagctgcctcgcccgtgcacctgaagagtcctagcctgccagcaccatctccaggatggacgtcttctcccaagcctcccctacagagccctggcattccacctaaccacaaagctccactgactatggcatcaccggcaatgctcggcaatgtggagtcgggaggcccaccaccgccaaccgcctcgcagcccgcttctgtgaacatccccggttccctgccttcatctaccccgtacaccatgcccccagagcccactctgagccagaatccgctgtcaatcatgatgtcccgaatgtcaaagtttgcaatgcccagtagcacaccactttatcatgacgctattaaaaccgtggccagttccgacgacgactctcctcctgcacgctcacctaacttaccctctatgaataatatgcccggaatgggaattaacacccaaaaccctcgcatatctggccctaacccggttgtccccatgccaacattgagccctatggggatgactcagcccctgtctcacagcaaccagatgccaagtcctaacgcagtgggcccaaacatcccccctcacggcgtccccatggggccaggacttatgtcacacaaccctataatgggccacggctctcaggaacctcctatggtgccccaaggcaggatgggcttcccccaaggcttccccccagtacagtccccgccacagcaggtacccttcccccacaacggaccaagcggtggacaaggtagcttccccggaggcatgggcttccccggagaaggacccctgggccgacccagcaacctaccccagagtagcgccgacgccgctctttgcaaacccggtggtcccggtggacccgactccttcaccgttctcgggaacagtatgccatcagtgtttactgacccggatctgcaggaagtgattcggcctggagctaccggaatcccggaattcgatctaagcaggattatacctagtgagaagccctcccagacgttgcagtatttccccaggggcgaagtccccggaaggaaacagccccagggcccaggcccaggtttcagccatatgcagggcatgatgggtgagcaggcccctagaatggggctcgcgctgccgggtatgggtggccctggccctgtggggacacctgacatcccactgggaactgctccctccatgcctggccataatcccatgcggccaccggcatttttgcagcagggtatgatggggccacatcatcgcatgatgtcccccgcacagtccaccatgccaggacagccaaccttgatgtcgaatcccgcagctgcggtcgggatgatcccagggaaggatcggggacctgctgggctgtatacccacccaggaccagttgggagccccggaatgatgatgtcgatgcagggcatgatggggccacagcagaacattatgattcctccgcagatgcggccacgagggatggccgctgatgtgggtatggggggtttctcacaagggccagggaatcccggaaatatgatgttttag

SEQ ID NO: 245394 - DNA, 1221 bp, Artificial Sequence
  Description of Artificial Sequence: Synthetic coding sequence
atgagtggctgccctttcctgggtaataattttggatacacattcaaaaaactccctgtggaaggcagtgaggaggataagtcccagactggcgtgaatcgggcatccaagggcggactcatttatgggaactacttacacttagaaaaagtcctcaatgcgcaagaactgcagtcagaaaccaagggtaataaaattcacgatgaacatttgttcattattacccaccaggcctatgagctgtggtttaaacagattctgtgggagctggattccgtgcgagagattttccagaatggtcacgtgcgcgatgagaggaatatgctcaaggttgttagccgaatgcaccgggtgagcgttatcctcaagctcctggtccagcagtttagcatactcgaaacgatgactgccttggacttcaacgattttagggagtacttatctcccgcttcgggctttcaatctcttcagttccggctgctagaaaacaagattggagtacttcagaatatgcgcgtgccatacaatcgccgacactacagggacaacttcaaaggggaggagaacgaactgttactgaagtctgagcaggagaaaactttactcgaactggtggaggcatggcttgaaagaacccccggactagagcctcatggctttaacttctgggggaagctggaaaagaatataacgcgcggtttggaagaagaattcattcggattcaagccaaggaagagtccgaagaaaaagaagaacaggttgccgagttccagaaacagaaggaggtgttgttgtccctgtttgacgagaagagacacgaacacctcttaagcaaaggggagcgcagattatcctatagggcgctgcagggagcactgatgatttacttttaccgcgaggagccaaggttccaggtgccttttcagctcttgacctcgctcatggatatcgattcactgatgaccaagtggcggtataaccatgtgtgtatggtgcatcggatgctgggttcaaaagctggcactggaggctctagcggctaccactacctgcgaagcacagtgtccgacagatacaaagtgtttgtggacctgttcaatctgtcaacttatctgatccccaggcattggattcccaaaatgaatcccactatccacaagttcctctacacagctgagtactgcgactccagctacttctccagcgacgagagcgactag

SEQ ID NO: 245395 - DNA, 1335 bp, Artificial Sequence
  Description of Artificial Sequence: Synthetic coding sequence
atgatcgaagacaataaggagaacaaagatcattcactggaacgaggccgagcaagtttaatcttttccttaaagaatgaagtcgggggacttataaaggcgctcaagatattccaggaaaagcacgttaatcttctgcacattgagagtaggaagtctaaaagacgtaattcggagtttgaaatcttcgtcgattgcgacattaatcgcgagcaactgaatgatatattccatctgcttaagtcccatacgaacgtgttgagcgtgaatctgcccgataattttaccctgaaggaagacggaatggagaccgttccctggtttccaaagaagatctcagatcttgatcactgcgcaaaccgggtcctcatgtacgggagcgagcttgatgccgaccaccctgggttcaaggacaacgtatatcgcaagagaaggaagtatttcgcagatctcgcaatgaattacaagcacggggacccaattcctaaagttgaatttacggaagaagagattaagacttggggtacagtgttccaggagcttaacaagctctacccaacccacgcctgtcgcgagtacttgaaaaacctgcccctgttatccaagtactgcggatatcgcgaagataatattccgcagttagaagatgtgtccaactttctgaaagagcggacgggattttctatcaggcctgtagctggctatctctccccccgagatttcctgagtggtcttgcattccgggtctttcattgcacacagtacgttagacattcctccgaccccttttatacacccgagccagacacctgccacgagctgctcggacacgtgcctctgctggctgagccttcattcgcccagttttctcaggaaataggtctggcaagccttggtgccagcgaggaggcagtgcaaaaactggctacttgctatttctttactgtggaatttgggctctgtaagcaagacggccagctgagggtgttcggagccggtctcttatcatctatctccgaactaaaacacgctctcagcggtcacgcgaaggtgaagccatttgatcctaagattacttgtaagcaggagtgcctgatcactactttccaggatgtctactttgtctcagaaagcttcgaagatgccaaggagaagatgcgcgaatttacaaagactattaaaagaccttttggtgtgaagtacaatccatatactaggtcaattcaaatcttgaaagacaccaaatccatcacctccgccatgaatgagttacaacacgatctggatgtagtaagcgacgctcttgcgaaagtgagccgtaagcccagtatctag

SEQ ID NO: 245396 - DNA, 1401 bp, Artificial Sequence
  Description of Artificial Sequence: Synthetic coding sequence
atgatcgaagacaacaaggaaaataaggaccatagcctggaacgcggacgcgcatccttgatcttctcactgaagaacgaggtcggtggcctcattaaggccctgaagatttttcaagagaagcacgttaatcttctgcatattgaatctcgcaagtcaaagagacgcaactctgagtttgaaatcttcgttgattgcgacattaatagagaacagttgaacgatatctttcacttgctgaagtcgcacacaaacgtgctctcggtgaatttgccagacaacttcactcttaaggaggacggaatggaaacagtgccatggtttcccaaaaagatcagtgatctggatcattgtgccaaccgtgttcttatgtacggaagcgaactggatgcagaccacccgggattcaaggacaatgtttatcgcaaaaggcgaaaatatttcgccgacctcgcgatgaattataagcacggagaccctattcccaaggtggaatttactgaggaggagattaaaacatggggcaccgtgtttcaagagctgaataagttgtaccctacgcatgcatgccgggagtacttaaagaatctgccactcctctctaagtattgcggatacagagaagataatatccctcagctggaagatgtgtctaacttcttaaaggagagaactggtttttccattcgccctgtcgcaggctatctgagcccccgtgatttcctctccggactggcattcagggtgtttcattgtacacaatacgtgcggcactcttcggaccctttctacactccggagccagacacatgccatgagctgctgggacacgtgcccttgttagcagaaccctcattcgctcagttctctcaggaaattgggctggccagcttaggcgctagcgaggaggctgtgcaaaagctggccacatgttattttttcaccgtggagtttggtttgtgtaaacaggacgggcagctccgtgtgtttggcgcagggctgctcagcagtatatctgagctgaagcacgcgctctcaggacatgctaaagtgaagcctttcgaccccaagatcacctgcaaacaggagtgtctaatcaccaccttccaagacgtgtatttcgtgagcgagtcctttgaggacgccaaggagaagatgcgagagtttaccaagactattaagcggccatttggagtgaagtacaacccatatacccgatctatccagatcttgaaggatactaagtctatcacgagtgcgatgaatgaactacagcacgacctggacgtagtgagcgacgctcttgccaagtccctgaatgaggatgtcttgcaggtctccgttttcgctctgctcctgttcctgcctagtctgcacggggaatgccaccccgacacctag

SEQ ID NO: 245397 - DNA, 753 bp, Artificial Sequence
  Description of Artificial Sequence: Synthetic coding sequence
atgcagcctgccatgatgatgttctcctctaaatactgggcaaggcgcggattttcactggacagcgcagtacctgaagagcaccagcttctaggctccagcacactgaacaagccgaattctggaaaaaatgacgataaagggaacaaaggttcatcaaagcgggaggcggcaaccgagtctggcaagacagcagtcgtgttctctctgaagaacgaggttggaggactggtaaaggctctccggctattccaggaaaagagagtcaacatggtgcacattgaaagcaggaaaagcagaagacgaagttctgaggtggaaatattcgtcgactgtgaatgcggcaagacagagtttaacgaactcattcagcttctcaaatttcagacaactatcgtgactctaaaccctcccgagaacatatggacagaggaagaagagctcgaggatgtgccctggtttcccaggaagattagtgaactagacaagtgcagccatagggtgctcatgtatgggagcgagctggacgcagatcaccccggattcaaggacaacgtatacagacaacgcaggaaatactttgtggatgtcgccatgggctacaaatacggaccgcgtctcctggcagctatcggcgattgggagttccagctgttcagtgtgagttcatcactctccagttcaagtctatgcatgctatcagtccatattctgatggatgttcgcagcattgtcgttgccgtagatatatag

SEQ ID NO: 245398 - DNA, 1473 bp, Artificial Sequence
  Description of Artificial Sequence: Synthetic coding sequence
atgcagcctgcaatgatgatgttttcctctaaatactgggctagaaggggcttttccctggactctgctgtccccgaagagcaccagctgctaggaagttccactcttaataaacctaacagcggaaaaaatgacgacaagggaaacaagggctctagtaagagggaagccgctaccgaatccggaaagaccgcggttgtcttcagcctgaagaatgaggtgggcggtctagtaaaagcactacgactgttccaggagaaacgggtgaacatggtgcacatcgagagccgaaagtcgcgaagaagatccagcgaggtagagatttttgtggattgcgaatgtggaaaaacagaatttaatgagcttatacagctgctgaagtttcaaaccacaattgtcacccttaaccctcccgaaaacatttggaccgaggaggaagagctggaggatgtcccttggttcccaaggaagatctccgagctggacaaatgcagccatagagtattgatgtacggctctgaactcgacgccgaccatcctgggtttaaagataatgtctacaggcagaggaggaaatactttgtcgatgtggcaatgggttataaatacggacagccaattccacgggttgagtacaccgaggaagaaacaaaaacatggggcgtggttttccgtgaactcagcaagctctaccctacacacgcctgccgggagtacttgaaaaactttccgttattaaccaagtactgtggctacagagaggataatgtaccccaactcgaggacgtgtccatgtttctgaaggagcgttccggttttacagttcgacctgtcgcaggatatctgtccccaagagatttcctagctggcctggcctatagggtcttccactgtacacaatacatccgccacggaagtgatccactctataccccggaacccgacacatgccacgagttactgggtcacgtgcccctcctcgccgatcccaagtttgcccagttcagccaggagattgggctcgcttcactgggtgcctcagacgaagatgtacagaagttggctacttgctatttcttcacaatcgaattcggactgtgtaagcaggagggacagttgagagcctacggcgctggcctgttatcttcaattggggaattgaagcacgctcttagtgacaaagcctgcgtgaaagcttttgaccccaagacaacttgcctccaagagtgtctgatcacaacctttcaagaagcgtatttcgtgtctgaaagcttcgaagaggctaaggagaaaatgcgggactttgctaaaagcatcacaaggcccttttctgtctactttaacccctacacccagtcaatcgagattctgaaggataccaggtctatcgagaatgtggtccaagacctgagatctgatcttaacacagtttgcgatgctctgaacaagatgaatcagtaccttggaatttag

SEQ ID NO: 245399 - DNA, 525 bp, Artificial Sequence
  Description of Artificial Sequence: Synthetic coding sequence
atgtcctcagccgcagccgatcactgggcctggctcctggtgctgtcctttgtcttcggctgtaacgtgctgcgtatattactgccttcatttagctctttcatgtcgcgcgttcttcagaaggacgctgaacaggaaagccaaatgcgcgcagaaatccaagatatgaagcaggaactttccacggtcaatatgatggacgagtttgcccgttatgccaggctggagaggaaaattaataaaatgacagacaaactgaaaacgcatgtgaaagcccgtacggctcagttggccaaaattaaatgggtgatttccgtcgctttttacgtcctgcaggctgccctcatgatctcactaatttggaagtattactccgttccagtggcagtggtgccatccaagtggataacacctctggatagactggtcgccttccctacgagagttgcaggaggagtgggcatcacctgctggatcctggtgtgcaacaaggtagtggcaatcgtcctgcatcccttttcctag

SEQ ID NO: 245400 - DNA, 423 bp, Artificial Sequence
  Description of Artificial Sequence: Synthetic coding sequence
atgtcacgcgtgctgcagaaggacgctgagcaagagtcacagatgcgcgctgagatccaagacatgaagcaggaactgagcacagttaatatgatggatgagtttgcaaggtatgcacgtctggagaggaagataaataagatgactgacaaactgaagacccatgtcaaggccagaaccgcccagctggctaagatcaagtgggttatatctgtggccttctatgtgctgcaagcagccctgatgatctccttgatttggaagtactatagtgtgccagttgccgtggtcccaagcaagtggattacccctcttgacaggcttgtggcattccccacccgtgtggccggaggtgttggaataacttgctggatccttgtctgcaacaaggtggtcgctatcgtgctccaccctttcagctag

SEQ ID NO: 245401 - DNA, 423 bp, Artificial Sequence
  Description of Artificial Sequence: Synthetic coding sequence
atgagcagagtgcttcagaaggacgctgagcaagaatcccagatgagagccgagatacaggacatgaaacaggagctctccacagtgaatatgatggacgaattcgctagatacgccagactcgagcgtaaaatcaataagatgacagacaagctcaaaactcatgtgaaggcccgtaccgcacaactcgctaagattaaatgggttatcagtgtggccttctacgtgctccaggccgcacttatgattagccttatttggaaatactattctgtgcccgtagccgtcgttcccagcaagtggatcacacctctcgataggctagtggcgttccccacccgggtggcaggcggtgtcggcattacttgctggattctggtatgtaacaaagtggtcgccatcgtgctgcatccattttcatag

SEQ ID NO: 245402 - DNA, 519 bp, Artificial Sequence
  Description of Artificial Sequence: Synthetic coding sequence
atgagctctgctgcagcagatcattgggcatggcttctggtgctctcattcgtgttcggttgcaacgtgctccgtatccttctgccctctttttcttcatttatgtctcgcgtgctgcagaaagacgctgagcaggagtcccagatgagagcggagattcaggatatgaaacaggagctctctacagttaatatgatggacgagttcgcaagatacgcgcgactcgaaaggaaaattaacaaaatgactgacaagttgaaaacccacgtgaaagccagaacagcccagctggccaaaatcaagtgggtgatcagcgtggcattttacgtactccaggctgcgctgatgatttcactgatctggaaatactactccgtgcctgtcgctgtggtgccttccaagtggattacgcccctggacaggcttgtggcctttcccacccgcgttgccgtgttcagctcaagcatctggacatcaaagtgtttctcaagcccagataaaagcatattagaaaagtag

SEQ ID NO: 245403 - DNA, 1083 bp, Artificial Sequence
  Description of Artificial Sequence: Synthetic coding sequence
atggcactgcactcaatgaggaaggccagggagcgctggtcctttataagagcgcttcacaagggctccgctgcagctcctgctctccagaaggattcaaagaaaagagtattcagtggcatccagccaactggaatcctccaccttggcaactatctgggagccatcgagagctgggttcgtctgcaggatgaatacgactccgtgctctacagtatcgtggatctgcattccataaccgttccccaagacccagcagtgctgagacagtccattttggacatgaccgctgtgctattggcatgcgggattaaccctgaaaagtctatcttgttccagcagagtcaggtttcagagcacacacaactatcatggattctctcatgtatggtcagattacccagactgcaacacctgcatcaatggaaagctaagaccacgaagcagaagcacgacgggaccgtaggactcctgacttatcccgtgttacaggccgcagacatcttactttataagtccacccacgtgcctgttggggaggaccaagttcagcacatggagctcgtgcaagatttggcccaaggttttaataagaaatacggggaattcttcccagtccctgagtctatcctaacgagtatgaagaaggtgaagagtctgagagatccctcagcaaaaatgtccaagtctgatcctgataagctcgccaccgtccgcatcacggactcaccggaggaaatcgttcagaaattcagaaaggccgtgacggactttacgtcggaagtgacctacgatccagctgggagggctggggttagcaacatcgtagccgttcacgctgcagtgacaggccttagcgtggaagaagtagtcaggagatcagctggaatgaatactgcgagatataaactcgctgtggcagacgcagtgatcgaaaaatttgcaccaattaaaagagaaattgagaagctgaaactcgataaggatcacctagagaaagtgctccagatcgggtcggccaaagccaaagaactggcatatacggtttgtcaggaggtaaagaagttagttggcttcctgtag

SEQ ID NO: 245404 - DNA, 663 bp, Artificial Sequence
  Description of Artificial Sequence: Synthetic coding sequence
atggctctccactcaatgcggaaggctcgggagcgctggtctttcataagggcattgcacaagggatcagctgccgctcccgctttgcagaaggattccaagaagagagtcttcagcgggatccagcctacaggcatccttcatctcggtaactacctgggagccattgagtcctgggtgcggctgcaagatgaatacgactccgttctgtacagtatcgttgatctccactccataactgtgccgcaagaccccgcagtcctgcgacagtctattctcgacatgaccgcagtactactggcctgcggcattaaccctgaaaagagcatcttgttccagcagtcacaagttagtgaacacacccagttatcatggatcctgtcatgtatggtccggttaccacgcctccagcacctccatcagtggaaagccaaaaccaccaagcaaaaacacgatggtacagtcgggttgctgacttacccagttttacaagcagccgatattttgctctacaagtccacccacgttccagtgggagaagatcaggtgcagcacatggagctcgtccaagatctggctcaaggatttaacaagaagtacggcgagtttttcccagtgccggagagcatcctgagtatgtgcgtgctggtgttcctcacctag

SEQ ID NO: 245405 - DNA, 801 bp, Artificial Sequence
  Description of Artificial Sequence: Synthetic coding sequence
atgactgctgtactactggcttgcggcattaatccagagaagtcaatattgttccagcagtcacaggtgtcagaacacacacagctgagttggattctttcatgtatggtgcgtttgccgagattgcagcacctgcaccagtggaaagcaaaaacaactaaacaaaaacacgacgggaccgtggggctgcttacctatcctgtgctgcaggctgccgacattctgctctataaaagcacacatgtgcctgttggcgaggatcaggtccagcacatggagctggtccaggaccttgcacaaggatttaataagaagtacggtgaatttttccccgtgccagaaagtatcctgactagcatgaagaaagtgaagtctctgcgggacccgagtgccaaaatgtctaaatctgatccagataaattggcaacagttcgtattacagattctcccgaggagatcgtgcaaaagttccgaaaagcagtgaccgactttacgtctgaagtaacctacgatcccgctggcagggccggagtgagcaatatcgtggccgtacatgctgcggtcactggtctgtccgtggaggaggtggtacgaaggagcgctggaatgaacacagccagatataagctggctgttgccgacgccgttatcgaaaaatttgccccaattaagagggagattgaaaagcttaagcttgataaggatcaccttgaaaaggtcctgcaaatagggtcagccaaagccaaagagctcgcctacacagtatgccaggaggtaaagaagctggtgggcttcctgtag

SEQ ID NO: 245406 - DNA, 1293 bp, Artificial Sequence
  Description of Artificial Sequence: Synthetic coding sequence
atgttggttagtctaaagatgtcctacaaagcagcagccggtgaggactacaaagccgactgcccaccaggcaatccagcacccacctctaatcacggacccgacgctactgaagccgaggaagatttcgtggacccttggactgttcagaccagctccgctaaggggatagactacgataagctgattgtgcgtttcgggtctagcaagatcgataaagagctcatcaaccggatcgagcgtgcaaccggccagcggcctcaccacttccttcggagagggatcttcttttcgcacagggacatgaatcaggttcttgatgcctatgaaaataaaaagccattttatctgtacacaggcaggggtccgagtagcgaggccatgcatgtcgggcacctgatcccgttcattttcacaaaatggctccaagacgtgttcaacgtgccattggtgatccagatgaccgatgatgaaaagtatctgtggaaagacctgacccttgatcaggcatactcctacgccgtggagaatgcaaaagatatcattgcttgcggctttgatataaacaaaacctttattttcagcgatctggactacatgggcatgtcttcaggtttttataaaaacgtcgtgaaaattcaaaagcatgtcaccttcaatcaggtcaaaggcatttttggatttaccgacagcgactgtattggcaagatttccttcccagccatccaggcggctccctccttttcaaatagcttcccacagatcttcagagatagaacagatatacaatgtctgattccgtgcgccatcgaccaggacccatactttcggatgacgcgggacgttgccccacgcattgggtatcctaaacctgccttgttacatagcacttttttccccgcattacagggtgcccagactaagatgagcgcctccgatccaaatagtagcatcttcctgactgataccgcaaagcagatcaagacaaaggtgaataagcatgcgtttagcggaggtcgagacacgatcgaagagcatcgtcaattcgggggtaattgtgacgtggatgtgtcctttatgtatttaactttcttcctggaggatgacgataaactcgagcagattagaaaggattatacatctggtgctatgctgactggcgagctgaagaaagcgttgattgaagttctgcagcctctaattgccgaacaccaagcccgacggaaggaggtaacggatgaaattgtgaaggagttcatgaccccgcgtaaactatccttcgattttcagtag

SEQ ID NO: 245407 - DNA, 1416 bp, Artificial Sequence
  Description of Artificial Sequence: Synthetic coding sequence
atgcccaactcggagccggcatccctgttagagctctttaacagcattgccacccagggggagctagtgcggagtcttaaggcaggcaacgccagcaaagatgagatcgatagtgctgtgaagatgcttgtgtcccttaaaatgagttacaaggccgctgccggtgaggattataaggccgactgccccccaggaaacccagcgcctaccagcaatcatgggccagacgcaactgaggctgaggaggattttgttgacccttggacagttcaaacgagctccgcgaaaggtatcgactacgataagttgattgtgcgtttcgggagttccaaaattgataaggaattgatcaataggattgagcgcgcaacagggcaacggcctcaccactttctgcggagagggatctttttttcccacagggatatgaaccaggttctggatgcctacgagaataaaaagcccttctacctctacacaggtaggggaccctcctctgaggccatgcacgtgggacacctgattcccttcatctttaccaagtggctccaggatgtgtttaacgtgcctctggtcattcagatgactgacgacgaaaagtatttatggaaagaccttactctagaccaggcctacagctacgctgtggagaatgcaaaagacataattgcttgtgggtttgatattaataagacatttatcttctcagacctggattatatggggatgtccagcggattttacaagaacgtggttaagattcagaagcatgttacattcaatcaggttaaagggattttcggatttacggatagtgattgtataggaaagatatccttccccgcaatccaggccgctccaagtttctcaaattcatttccacaaatctttcgtgatcgcacagacatccagtgtctgatcccttgcgctatcgatcaagatccttatttccgaatgactcgagacgtcgcccctaggattggttaccccaaacctgcactcctgcactcaacctttttcccagctctgcaaggggcacagaccaagatgtctgcatcagatccaaatagctccatctttctcacagataccgccaaacagattaaaaccaaagtgaacaaacacgcctttagcggcggaagagacacaattgaagagcaccggcaatttggaggtaactgtgacgtagatgtctcattcatgtatctaaccttttttctggaagatgacgataagctggaacagattcgtaaggattacacctcaggcgcaatgctgactggggagttaaagaaagcactgatagaagtgttgcagcctttgatcgcagaacaccaggctcgacgaaaggaagtcacagatgaaatcgtcaaggagttcatgactccccgaaaactgagctttgactttcagtag

SEQ ID NO: 245408 - DNA, 1293 bp, Artificial Sequence
  Description of Artificial Sequence: Synthetic coding sequence
atgctcgtgagtctaaagatgagctataaggcggcagcgggtgaagattacaaggccgactgtccgccaggcaaccctgccccaacttctaaccacggcccagacgccaccgaggctgaggaggacttcgtggacccttggaccgtccaaacgagcagcgcaaagggcatcgactacgacaaactgatcgttcgttttggcagctccaaaattgacaaagaactaatcaataggatcgagcgcgctacagggcagagaccccaccactttctcagacgcggtatcttcttttctcaccgagacatgaaccaagtgctagacgcctacgaaaataagaagccgttctatctttatacagggagaggcccaagttcagaagctatgcacgttggccacttaatccctttcatatttacgaagtggctccaggatgtattcaatgtgccacttgttattcagatgacagatgatgagaaatatttatggaaagatcttacattggatcaagcttatagctatgccgtcgagaatgcaaaagacattattgcatgtggtttcgatattaataagacattcatcttttcagacctggattatatggggatgtcttcagggttctataaaaacgtggtgaaaattcagaagcacgttaccttcaatcaagtgaaaggaatcttcggatttactgatagcgactgcattggtaaaatctcattccctgcaattcaggccgctccgtccttctctaattccttcccacagatcttcagagacaggacagatatccagtgtctcataccttgcgccatcgaccaagatccttatttcagaatgacacgggacgtggcccctcgcatcggctaccctaaaccagcgctgctccacagcacatttttcccagctctgcagggcgctcagacaaagatgtccgcctccgatcccaactcttccatcttcttgacggacaccgctaagcaaatcaagaccaaagttaataaacacgcctttagtggcggacgggatacaatagaggaacatcgtcagttcgggggaaattgtgatgtggacgtgagctttatgtacctgacattcttcctggaagatgatgataagctcgaacagatcaggaaggactacaccagtggagccatgctgacaggggagttaaagaaggccctcatcgaagtcttgcagccactaattgcggagcatcaggcaagacggaaggaagtcaccgatgaaattgtgaaagaattcatgaccccaaggaagctgtccttcgacttccagtag

SEQ ID NO: 245409 - DNA, 1416 bp, Artificial Sequence
  Description of Artificial Sequence: Synthetic coding sequence
atgcccaacagtgaaccagcatctctcctggaactatttaatagcatcgctacgcagggagaactggtcagatccttgaaagctggaaacgcttcaaaggatgaaatcgattccgctgttaaaatgctggtcagtttgaaaatgtcttacaaggcagcagcaggcgaggattacaaagctgactgtccacccggaaatccagccccaacttcaaatcacggaccagatgctacagaggcagaggaagacttcgtcgacccgtggaccgtgcagactagctctgcaaaagggatcgactacgacaaacttatcgtgcggtttggaagctctaagatcgataaagaacttattaatcggatcgagagagctaccgggcagcgtccccaccactttctacggaggggaatcttcttctcccatcgggatatgaatcaagttctggatgcctatgaaaataaaaagcctttttacctgtacacgggcaggggccctagttccgaggcgatgcacgtcggccatttgattccctttattttcactaagtggcttcaagacgtgttcaatgtgccactagttatccagatgaccgacgacgagaagtatttgtggaaggatcttactcttgaccaggcctattcctacgcggtcgagaatgccaaagacatcattgcttgcggcttcgacatcaacaaaacatttatctttagcgacctggattatatgggtatgtcctcaggattttataagaatgtggtgaagatccaaaaacacgtgacattcaaccaggtcaaggggatctttgggtttactgactctgattgtatcggaaagatttcttttccagctatccaggccgctccatcttttagtaatagctttcctcagatctttcgggatcgcaccgacattcagtgtctgatcccgtgcgcgatcgaccaggatccatatttccgcatgacccgggacgtcgctcctcgtatcggataccccaagcctgctttgttacactctactttttttcccgctcttcagggggcacagaccaagatgtcggcaagcgacccaaactcaagtatcttcctgacggacacagccaaacaaatcaagactaaggtgaacaagcacgccttctccggaggcagggatacgatcgaagagcaccgccagttcggaggcaactgcgacgtggacgtgtctttcatgtacctaacatttttcttggaagacgacgacaaattggaacaaatccggaaggattacactagcggagcaatgctgactggagagctcaaaaaagccttgatcgaggtcctacagccactgatcgcggagcaccaggcgagacgcaaggaggtgacagacgagatcgttaaagaattcatgacccccagaaaattgagctttgattttcagtag

SEQ ID NO: 245410 - DNA, 684 bp, Artificial Sequence
  Description of Artificial Sequence: Synthetic coding sequence
atgctcgttagcctcaagatgtcttataaggcagcagcgggagaagactacaaggcagactgtccacctgggaacccagctccgaccagtaaccacggccctgatgctaccgaggcagaggaggacttcgtagatccgtggactgtgcagacttcaagcgcgaaaggcattgactacgacaagctgattgttaggttcggttctagcaagatagataaagaattgatcaacagaatagagcgtgccaccggccagcgcccacatcacttcctgaggcgcggaattttcttctctcatcgcgacatgaaccaggtgttagatgcttatgaaaacaaaaagcctttctacctgtacaccgggaggggccctagtagcgaagccatgcacgtgggccatcttatcccattcatcttcacaaaatggcttcaagacgtattcaatgtgcctttggtgatccaaatgaccgatgacgagaaatacctctggaaggatcttaccctcgaccaggcatattcttatgcagtggagaacgcgaaggatatcatcgcctgtggattcgatatcaataagaccttcatcttcagcgacttggactacatggggatgagctcagggttctacaaaaacgtggtgaaaatacagaaacatgttacatttaatcaggtcaagggcatcttcggctag

SEQ ID NO: 245411 - DNA, 324 bp, Artificial Sequence
  Description of Artificial Sequence: Synthetic coding sequence
atgccaaacagcgagccggcaagtctcctggaactttttaactccatcgctacccaaggggaactagtgcggtccctcaaagcaggaaatgcttcaaaggatgaaatcgattccgcagtgaagatgctggtgagcctgaagatgtcctataaggcggcagcaggagaagattacaaggctgactgtccgccagggaatccagcaccaacttccaatcatggcccagatgctacggaggcagaagaagattttgtggatccttggacagtccagacttccagtgcaaaaggaatagactatgacaagcttatcgtgcgcttctag

SEQ ID NO: 245412 - DNA, 453 bp, Artificial Sequence
  Description of Artificial Sequence: Synthetic coding sequence
atgcctaacagcgaacctgcctccttacttgaactgtttaatagtattgctacacagggcgagctggtccgctcccttaaagcagggaacgcgtcaaaagacgagattgacagtgctgtaaagatgctagtgtctttgaagatgagctacaaggccgctgccggagaggactataaggcagattgccctccaggtaaccccgcaccaaccagtaatcacggtccggatgcaaccgaagccgaagaggattttgtggatccttggactgtccaaacgagcagcgccaaaggaattgattacgacaagctcatcgttagattcggtagctccaagatagataaggagttgataaatcggattgagagagcaacgggccagcgtccccatcactttctccgcaggggaatctttttcagtcacagggatatgaatcaagtgttggacgcctactag

SEQ ID NO: 245413 - DNA, 294 bp, Artificial Sequence
  Description of Artificial Sequence: Synthetic coding sequence
atgcccaacagtgagcccgcatcactcctggagctcttcaattcaatagcaacacagggagagctcgtacgctcactgaaagctggtaacgccagcaaggacgagatcgatagtgccgtgaagatgctcgtgtccttgaagatgagctataaggctgcagcaggagaggattacaaagcagattgcccgccaggaaacccagccccaacctctaaccatggccctgacgctaccgaggctgaggaggactttgtcgacccatggacagtccagacttcgtctgctaaagggtag

SEQ ID NO: 245414 - DNA, 81 bp, Artificial Sequence
  Description of Artificial Sequence: Synthetic coding sequence
atgcctaactctgaaccagctagcctgctggagttattcaattccattgccacccagggcgaacttgtgcggtccctgtag

SEQ ID NO: 245415 - DNA, 318 bp, Artificial Sequence
  Description of Artificial Sequence: Synthetic coding sequence
atgccaaattcagaacctgcatccttactggagctgtttaactcaattgcaacacaaggagagctcgtgcgctcactgaaagcaggcaacgcaagtaaagacgagattgattcagccgtgaagatgctggtgtccctcaagatgtcatataaggccgctgcaggagaggattacaaggcagattgccctcccggaaaccccgcaccaacgagcaaccacggaccagatgccaccgaagcagaagaagacttcgttgacccctggacggtgcagacatctagcgctaaaggtatcgattatgacaagttgattgtttag

SEQ ID NO: 245416 - DNA, 102 bp, Artificial Sequence
  Description of Artificial Sequence: Synthetic coding sequence
atgcctaatagtgaaccagcgtcattgcttgaactattcaattccatcgctacacagggcgaattggtgcgcagtcttaaggccggaaacgcctccaagtag

SEQ ID NO: 245417 - DNA, 207 bp, Artificial Sequence
  Description of Artificial Sequence: Synthetic coding sequence
atgcctaactcggaacctgcctctctcctcgagctgttcaacagcatcgccacacaaggggaactggtgcggagtctcaaggcgggtaatgcctccaaagatgagattgatagcgccgtgaagatgctggtcagcttgaaaatgtcctacaaggcagccgctggggaggactacaaggcagattgtcctcctggcaaccctgcttag

SEQ ID NO: 245418 - DNA, 375 bp, Artificial Sequence
  Description of Artificial Sequence: Synthetic coding sequence
atgcccaactccgaaccagctagtttgcttgaactgttcaactccatcgctacacagggagagctggtccgaagtcttaaagctggaaacgcctctaaagacgagatcgatagtgcagtgaaaatgctggtgtccctcaagatgagctataaagctgcggcaggagaagactataaggccgattgccctcctgggaatcccgcacccactagtaaccacggaccagacgcaacagaggccgaagaggattttgtggacccatggacagtacaaacgtcctctgcaaagggcatcgattacgataagctgatcgtgcggttcggaagtagcaagatcgacaaagaattgattaatcgcattgagcgggcaacatag

SEQ ID NO: 245419 - DNA, 261 bp, Artificial Sequence
  Description of Artificial Sequence: Synthetic coding sequence
atgccaaattccgaaccagcttctttgctagaactgttcaactctattgccacacaaggcgagctggtacgctcattgaaggcaggcaacgcgagtaaggatgaaatcgattctgcagtcaagatgctggttagcctgaagatgagctacaaggctgcagcaggggaggactacaaggctgattgtcccccaggcaaccctgctcctactagtaatcatggaccagacgccaccgaggcagaggaagattttgttgactag

SEQ ID NO: 245420 - DNA, 168 bp, Artificial Sequence
  Description of Artificial Sequence: Synthetic coding sequence
atgccaaattccgaacctgcttctctgctcgagctcttcaatagtattgctactcagggcgagctggtccgctcattgaaggcgggtaacgccagtaaagatgaaatagacagcgccgtgaagatgttggtgagcctaaaaatgagctacaaggccgctgccggatag

SEQ ID NO: 245421 - DNA, 192 bp, Artificial Sequence
  Description of Artificial Sequence: Synthetic coding sequence
atgccaaacagcgaaccagccagtcttctcgagctttttaatagtatcgccacacaaggtgagctcgtgaggtcactcaaggccggaaatgcgagcaaagatgagatagatagtgcggtgaagatgctcgtctctttaaaaatgtcatataaggcagccgctggagaggactataaagctgactgcccgtag

SEQ ID NO: 245422 - DNA, 213 bp, Artificial Sequence
  Description of Artificial Sequence: Synthetic coding sequence
atgccaaatagtgagccagccagcttgctcgaactgttcaacagcatcgctactcaaggagagctcgtcaggtcgctgaaggctgggaatgcctctaaggacgagattgactctgccgtgaaaatgctcgtctctcttaagatgagctataaagcagccgcaggcgaggactataaagcagactgcccccctggcaatccagccccaacctag

SEQ ID NO: 245423 - DNA, 177 bp, Artificial Sequence
  Description of Artificial Sequence: Synthetic coding sequence
atgccaaatagcgagcctgcctccctcctagagttgtttaatagcatagccactcagggcgagctggtacggagcctaaaagccggaaatgcgtccaaagatgaaatcgactctgccgtgaagatgctggtctccctgaaaatgtcctacaaagccgcagctggtgaggactactag

SEQ ID NO: 245424 - DNA, 423 bp, Artificial Sequence
  Description of Artificial Sequence: Synthetic coding sequence
atgctcgtgtctctaaagatgtcctataaggctgccgcaggtgaagattataaggctgattgtccacctggcaatccagccccaactagtaaccacggccctgatgcaacagaggccgaggaagacttcgtagacccttggactgtgcagacctctagcgccaagggcatagattatgacaagttgatcgttagatttggaagtagtaagatagataaagagttgatcaaccggatcgaaagggccactgggcagcggcctcatcatttcctgcgacggggaatctttttctcccatcgggatatgaaccaggtgctggacgcatacgaaaacaaaaagcctttctatctttacacggggagaggcccatcttccgaagctatgcacgtcggtcatctcatccccttcattttcaccaagtag

SEQ ID NO: 245425 - DNA, 462 bp, Artificial Sequence
  Description of Artificial Sequence: Synthetic coding sequence
atgctagttagtttgaaaatgagttataaagccgcagcgggtgaggactataaagctgattgtccccctgggaatccagcacctacttccaatcacggccctgatgcaacagaggccgaagaggattttgtagacccttggacagtccagacatcctccgctaaggggatcgactacgacaagctgatcgtgaggtttgggtcatctaagattgacaaggaattgataaatcgcattgagagggccacagggcaacgccctcatcacttcttgagaagaggcatcttttttagccaccgcgatatgaatcaagtgctggatgcatatgaaaacaagaaaccgttttatctgtataccgggagggggccttccagtgaggccatgcacgtcgggcatctgattcccttcatctttacaaagtggcttcaggacgtgtttaacgtccccctcgttattcagtag

SEQ ID NO: 245426 - DNA, 675 bp, Artificial Sequence
  Description of Artificial Sequence: Synthetic coding sequence
atgctcgtgtctctaaagatgtcatataaagccgctgccggagaggactacaaagctgactgccctcctgggaaccccgcaccaaccagcaaccatggcccagatgccacagaggccgaggaagatttcgtggatccgtggactgttcaaacgtcaagcgcaaaagggatagactacgacaagctgatcgtgcgcttcggctccagcaagatagacaaggaacttataaacagaatagagcgagcaactggacagagacctcaccatttcttacgcagggggatctttttttcacaccgggatatgaaccaggtgctggacgcatatgaaaacaagaaacctttctacctatacacaggcagaggcccaagtagcgaagctatgcatgttgggcatctgattccttttatttttacaaaatggctgcaggacgtctttaatgttcctctcgttatacaaatgacagacgacgagaagtatctgtggaaggatttgaccctcgatcaagcctattcctacgctgtggaaaacgccaaagatatcattgcgtgcggttttgatattaacaagacatttatattctcggatctcgattacatggggatgtcgagtggcttttacaaaaatgttgtaaagattcagaagcacgtgacatttaatcaggtgaagggctag

SEQ ID NO: 245427 - DNA, 1293 bp, Artificial Sequence
  Description of Artificial Sequence: Synthetic coding sequence
atgttagtctccttgaagatgtcctataaagcggctgctggtgaggactacaaagcagattgtcctcctggcaacccagcaccaacttcaaaccacggccctgacgcgactgaagcggaagaggattttgtcgacccatggaccgtgcaaacaagctcagcaaaaggtatcgactatgacaagttgattgtgcggtttgggtcctcaaaaatcgataaggagctaattaatcggatcgagagagccactggacagcgacctcatcattttttgcgccgagggattttcttctcccatagagatatgaaccaggtgcttgatgcatacgagaacaagaaaccattctacctatataccgggagaggaccatcgtcggaagcaatgcatgttggccacttgatcccctttatcttcacaaagtggttgcaggatgtctttaacgtacctctggtgattcagatgacagacgacgagaaatatttgtggaaagatttgaccctggatcaggcttactcctatgcagtggaaaacgctaaagacatcatcgcctgcggattcgatattaacaaaacgttcatttttagcgacctcgattatatgggaatgtcttcggggttctacaaaaacgttgtcaaaatccaaaagcatgtaacatttaaccaggtgaaaggcatcttcgggtttacagactccgactgcattgggaaaatatctttccctgctatccaagccgcacccagcttttccaattcttttcctcagatattcagagatcggactgacattcagtgtctgatcccatgcgcaatcgaccaggacccctactttagaatgaccagagatgtcgccccacggatcggataccccaaaccggctttgttgcacagtaccttttttcctgcccttcagggagcacaaactaagatgtcagccagcgacccaaactccagtatctttctcacggacactgcgaagcagattaagacgaaggtcaataaacatgcattttccggcggaagggatacaatcgaagaacatcggcagttcggcggtaactgcgacgttgacgtctctttcatgtatctcacattcttcctggaggatgatgataagcttgaacagatacggaaagactatacctccggggctatgctcacgggcgaactcaagaaagccctgattgaagtgctacagccgcttatagcagagcatcaggctagacggaaggaggtcactgatgagatcgtgaaggaattcatgacacctagaaagctgtcttttgattttcagtag

SEQ ID NO: 245428 - DNA, 345 bp, Artificial Sequence
  Description of Artificial Sequence: Synthetic coding sequence
atgcctaactcggagccagcctctctcctggaactgttcaattcgatagctacccagggcgaactggtacggagtctcaaggcgggtaacgctagtaaagatgaaattgactccgctgtcaaaatgttggtgtcgctcaagatgagctacaaggccgctgcaggagaagattacaaggcagattgcccaccgggaaacccagcccctacgagcaaccacgggccagacgcaactgaggccgaagaagattttgttgacccatggacggtacaaacatccagcgccaagggtattgactatgacaaactgattgtacggtttggctcatcgaagatagacaaatag

SEQ ID NO: 245429 - DNA, 177 bp, Artificial Sequence
  Description of Artificial Sequence: Synthetic coding sequence
atgcctaatagcgagccagcatccttactggaattgtttaattcaatcgccacccaaggcgagctggtgcggtccttgaaggccggaaatgcctccaaggacgaaatcgactctgctgtgaagatgctggtgtcactgaagatgtcttacaaggcagccgcaggagaagattactag

SEQ ID NO: 245430 - DNA, 459 bp, Artificial Sequence
  Description of Artificial Sequence: Synthetic coding sequence
atgccgaattccgaacccgcatctctgcttgagcttttcaactcaattgctacccaaggagaattggttcgctccctcaaagcaggaaacgcatctaaagacgagattgatagcgctgtgaagatgctggtgagcctgaaaatgtcctacaaagcggcagcgggagaagactataaggccgattgtccgccaggcaatccagccccaacctctaatcatgggccagacgccacagaggcggaggaggacttcgtcgatccttggaccgttcagacctcgtcagctaagggtattgactatgataagcttatcgtgcgcttcggatctagtaaaatagataaggaactcatcaatcggattgaacgagcaactggtcaacgtcctcatcatttcctccgacggggaatcttcttctcacacagggacatgaatcaggttctggacgcatatgagaattag

SEQ ID NO: 245431 - DNA, 1416 bp, Artificial Sequence
  Description of Artificial Sequence: Synthetic coding sequence
atgcctaatagcgagccagctagtctgttagagctgttcaattccattgcgacgcaaggggaactggtacgcagcctcaaggcaggtaatgccagcaaagatgaaattgattccgccgtgaagatgctcgtgtccctaaaaatgtcctataaggccgctgcaggcgaggactacaaagcagactgccctccagggaatccagccccaacatcaaaccacggacctgatgccacagaggccgaggaagattttgtcgatccctggacagtgcagacatctagcgccaagggaatcgactatgataaactgatcgtacgcttcgggtcctccaagattgacaaagagctgattaatcggatcgagagggcgaccgggcaaagaccccaccacttcttaagaagaggcatcttcttcagtcaccgcgacatgaaccaggtcctggacgcatatgagaataaaaagcccttctacttatacactggacgcggtccaagtagcgaagccatgcacgtaggacacctaatcccctttatctttactaagtggctccaggatgtgttcaacgttccactggttatccagatgaccgatgatgaaaagtacctttggaaggacttgaccttggaccaggcctatagctacgctgtcgagaatgccaaagacattatcgcctgcgggtttgatattaataaaacgtttattttctctgacctggattatatggggatgagctctggcttttacaaaaatgtggtcaagatccagaagcacgtgaccttcaatcaggttaagggcatctttgggttcactgactccgattgcattgggaaaatttctttccctgctatccaggccgctccctcgttctctaacagttttccgcaaatattccgggaccgaacagacatccagtgcctgatcccctgcgctatcgaccaggatccctattttcgtatgacccgtgacgtcgctcctcgcattggctacccaaaaccggcactccttcattccacctttttccccgcactgcagggagcgcaaactaaaatgtccgctagtgacccaaacagctctattttcctgactgacactgccaagcaaatcaaaacaaaggttaacaagcacgctttttcaggcggaagagacaccatcgaggagcacaggcaatttggtgggaattgtgacgtagatgtgtcctttatgtatcttaccttcttcctggaggatgacgataaactcgaacagatcaggaaagattatacgagtggcgctatgctcaccggagagctcaaaaaggctctcatcgaagttcttcaaccccttatcgctgagcatcaggctaggcggaaggaggtgaccgacgagattgtaaaggaatttatgactcccagaaaattgtctttcgacttccagtag

SEQ ID NO: 245432 - DNA, 465 bp, Artificial Sequence
  Description of Artificial Sequence: Synthetic coding sequence
atgctggtgtctctgaagatgagctacaaggcggcagctggtgaagactataaggccgactgtccgcctggaaaccctgccccaacctccaaccacggtcccgatgcgacagaagctgaggaggatttcgtcgacccatggacagtacagacaagctctgccaaaggcatcgattacgacaaactgattgtgaggttcgggtcatccaagatagataaggaactgattaaccggatcgaaagggcaacggggcagcggcctcaccacttccttcggagggggatattcttttcgcacagggacatgaaccaggttctggacgcttatgagaataaaaagccattctacctgtataccggcagagggccaagctccgaagccatgcacgtcgggcacttgatcccgtttatctttactaagtggctgcaggacgtgttcaacgtgccacttgtgatccagatgtag

SEQ ID NO: 245433 - DNA, 639 bp, Artificial Sequence
  Description of Artificial Sequence: Synthetic coding sequence
atgcctaattccgagcccgcttctctgctggagctattcaattcgatcgctacgcagggagaattagtgaggtccctgaaggctgggaacgcaagtaaagatgaaatcgacagtgccgtaaaaatgctcgtgtctttgaagatgtcttacaaggcagctgcaggggaggattataaagctgattgccctccgggtaacccagcaccgactagtaatcatgggccagacgctactgaggccgaggaagacttcgttgacccatggacagtgcagaccagtagcgctaaaggaatcgactatgataaactcatagtgaggtttgggagtagcaagatcgacaaggagttaattaacagaatcgagcgtgctacgggacagaggccgcatcactttctgcggagaggcatctttttttcacatagagatatgaatcaagtcctcgatgcctacgagaacaagaaacccttctatctgtacacagggagggggccaagctccgaggccatgcatgtgggtcacttgattcctttcatcttcaccaagtggctgcaagatgtctttaacgtgccattggtgattcagatgaccgacgatgagaagtatctgtggaaggacctcaccctggatcaggcctattag

SEQ ID NO: 245434 - DNA, 1041 bp, Artificial Sequence
  Description of Artificial Sequence: Synthetic coding sequence
atgtccctgctgaggagcctccgggtgtttctcgtggccagaactgggagttatcctgctggtagccttcttcggcaatccccacaacctcggcataccttttacgcaggacctagactgtcagcttcagccagtagcaaggaactcctcatgaagctgagacgtaaaacaggatactcctttgtcaattgcaaaaaagctttggagacatgcggcggtgacctcaagcaggctgagatttggctgcacaaagaggcacagaaggaaggatggagcaaggctgctaaactccaggggagaaagaccaaggaaggcctcattggcctgctccaagagggcaacacaactgtgctggtggaagtcaattgcgagacggactttgtgagtcggaatctcaagttccagttgttggttcagcaggtggccctggggaccatgatgcattgtcaaacattaaaagatcaaccctccgcatattctaaggtgcagtggttaactcccgtcaacctcgccctgtgggaggcagaggcagggggttccctggaaggatttctgaattcttccgaactctcaggacttcctgccggacctgacagggaaggcagcttaaaggatcagttggccttagcgatcggtaagctgggcgagaatatgattcttaaacgagctgcctgggtgaaagtgccctctgggttctacgtcgggtcctacgttcacggggctatgcaatccccatctctacacaaactcgtcttaggtaagtacggcgctctggtcatttgcgagaccagtgagcagaaaacaaacctggaggatgtgggtaggagattaggccagcatgtggtggggatggcccctctgtccgtgggctccctggatgacgaacctggcggtgaggccgagactaagatgctttcccagccatacctcctcgatcccagtatcacactcggacagtatgtccagccacagggcgtctctgtcgtcgactttgttagattcgagtgcggtgaaggggaagaggcggctgaaactgagtag

SEQ ID NO: 245435 - DNA, 858 bp, Artificial Sequence
  Description of Artificial Sequence: Synthetic coding sequence
atggtctactgtaccacaacatgggctatctggaactgccagcttcttttaggttataaaccactgcagaatgtaacgggcctcaataccgttggatcctgcaacactgtggcagaaatatggctgcataaggaggcccagaaagaaggttggtcaaaagcagccaagctgcagggaagaaagactaaagagggacttataggactgttacaggaaggcaacactacagtgctggttgaggtgaattgtgagaccgatttcgttagtcggaacctcaagtttcagctgttggttcagcaggtggcgctcggtactatgatgcactgccagacattgaaggaccagccttcagcctattccaagggattcctgaatagctcagagctgtcgggccttcctgctgggccagacagagaaggaagtctcaaagatcagctagcattggctatcggcaaattaggggagaatatgattctgaaacgcgctgcctgggtgaaagtaccctccgggttctatgtcggatcatacgtccatggtgcaatgcaatccccctctctccacaaactggttttagggaagtacggagctctagtcatttgcgagacatcagaacaaaaaaccaacctggaagatgtcgggcgacgactgggccagcatgtggtaggcatggctcctttgtctgtgggctcgctggacgacgaacccggaggagaagcggagacaaagatgctgagtcagccttacctcctggaccccagcatcacactaggtcagtacgtccagcctcagggcgtctctgtagtggacttcgtaaggtttgaatgtggcgagggggaagaagccgcagagactgaatag

SEQ ID NO: 245436 - DNA, 978 bp, Artificial Sequence
  Description of Artificial Sequence: Synthetic coding sequence
atgtcacttctgcgctcactcagagtatttctggtggctcgcactggctcataccccgctggctccctcctgaggcagagtccacagccaaggcacactttttacgccggacctaggctcagcgcaagcgcatcatcgaaggagctgctcatgaaactgagaaggaaaaccggttactccttcgtcaactgtaagaaagccctcgagacctgcggaggcgacttgaagcaggcggagatttggctgcataaagaagctcaaaaagagggctggagcaaggctgcaaaattacaaggaaggaaaaccaaggagggcttgataggcctcttgcaggagggcaacacaaccgtgcttgtggaagtgaactgcgagactgacttcgtgtcacggaatttaaaattccaactcctagtgcagcaggttgctctggggacaatgatgcattgtcaaacactcaaggatcaaccgtctgcatacagcaagggctttcttaacagctctgaactttctggcctgcccgctgggccagatagggaaggctccctgaaagatcagttagcactggccattggcaaactgggcgagaacatgattctgaagcgtgctgcatgggtcaaagttcctagcggattttacgtggggtcatatgtgcacggagcaatgcagtcaccctcactgcataaactcgtgctcggaaaatatggggctttggtgatctgtgagaccagcgagcaaaagacaaacctggaagatgtaggaagaaggcttggacagcacgtcgtcggaatggcgccacttagcgtgggttcccttgacgatgagcccggaggcgaagccgaaacgaagatgctgtcccaaccctatctcctagatccaagtatcacgctcggtcagtacgtgcagcctcagggtgtttcagtggtcgatttcgtgaggttcgaatgcggagaaggggaggaggccgcagagactgagtag

SEQ ID NO: 245437 - DNA, 504 bp, Artificial Sequence
  Description of Artificial Sequence: Synthetic coding sequence
atgtcacttctgaggtccctgcgtgtgtttctggttgcacggactggatcttacccggctggaagtttgttgcggcaaagcccacagcctaggcacactttttatgcagggcctcggctttccgcaagcgcttcgtctaaagagctgttaatgaagcttcgaagaaagacaggctatagcttcgttaattgcaaaaaggcgctagaaacttgtgggggagacttgaaacaggcagagatttggctacacaaagaagctcagaaagagggatggtctaaggccgcaaaactgcagggacggaaaaccaaggaaggactcatcggcctcctgcaagagggaaacacaacagtgctcgtagaagtaaattgcgaaactgacttcgtgtcccgcaacctcaaattccagctgttagtacagcaggtagctctcggcactatgatgcactgtcagacattaaaagaccagcccagcgcttattcaaaagaaaactgggagaagacttag

SEQ ID NO: 245438 - DNA, 648 bp, Artificial Sequence
  Description of Artificial Sequence: Synthetic coding sequence
atgtctctgctgcgaagcttaagagtgttcctcgtggcgaggacaggaagctacccagctgggagtcttctacggcagtcacctcagccacgccacactttttatgcaggacctcgcctgtctgcctctgcatcaagcaaggagctgttaatgaagttgcgacggaaaacaggatactcctttgtaaattgcaaaaaggctctggaaacttgtgggggagacctcaaacaggctgagatttggctccacaaggaggcccagaaggagggctggtccaaagccgctaaacttcagggtaggaaaaccaaggagggtctgatcggcttgctgcaggagggcaatacaactgttttggtcgaagtaaattgcgagaccgacttcgtgagccgcaaccttaagttccagctcctcgtgcagcaggttgctctgggcacaatgatgcactgtcaaacactgaaagatcagccaagcgcctactcaaagggctttctcaactcctcagagcttagtggacttccggcagggcctgaccgggagggtagcctgaaagaccagctggcactggctattggtttgcctttccagatcggggcagtatcagaactgcaactgcctgaatccaactttctgcagaatacaagctcttag

SEQ ID NO: 245439 - DNA, 435 bp, Artificial Sequence
  Description of Artificial Sequence: Synthetic coding sequence
atgaaaagccagtggtgtcggcctgtggccatggacctgggagtgtatcaattgaggcacttttccatcagtttcttgtctagcctactcggtacagagaatgccagtgttcggctagacaattcgtcatccggtgccagcgtcgttgccatcgacaacaaaattgaacaagccatggaccttgtaaagtctcatcttatgtatgccgtccgcgaggaagtggaggttctgaaggagcagatcaaagaactgatcgagaaaaactcccagcttgaacaagagaacaacctcctgaagacactcgcctctcctgagcaactggcccagttccaggctcagttgcaaactggatcacccccagccaccacccaaccacaggggacgacccagccacctgctcagcctgcttcccagggcagtgggcctacagcttag

SEQ ID NO: 245440 - DNA, 3222 bp, Artificial Sequence
  Description of Artificial Sequence: Synthetic coding sequence
atgcatcagccgccagaaagcactgctgcagcagccgctgctgctgacatctctgctagaaagatggcccaccctgccatgttccccagacggggatccgggtccggatccgcgagtgccctgaatgccgctgggaccggcgtcgggagtaacgctacctctagtgaagatttccctcccccaagtcttttgcagcctccccctccagccgcttcatcgacctctgggccacagcctccgccaccacagagtcttaacttactttcacaggcccagctccaagctcagccacttgcccctgggggtactcaaatgaaaaagaagtcaggtttccaaatcacctccgtgacgccagcacagatcagcgcaagcatttccagcaacaactcaatcgcagaggatacagagagttatgatgatttggacgaaagccacaccgaggatcttagctcgagtgaaatattagacgtgagcctgtcccgggctaccgatctgggcgaacccgaaaggtcctcctccgaagaaaccctaaacaacttccaggaggcagagaccccgggagcagtctcacccaatcagccccatctaccccagccccacctgccccatttaccccagcagaacgtggtaattaacggcaatgcacatccacatcacctccatcatcatcatcagatccatcacggacaccatctccaacacggtcaccatcacccaagccatgtggcagtggccagcgcttcaatcaccgggggaccaccctcatcaccagtgagtcgcaaactttccacaaccggaagcagcgatagtatcacaccagtggcccctaccagcgcagtgtcttcctccggctccccggcaagcgtgatgacgaatatgagggctccgtctactacaggcggtattggcatcaacagcgtgactggtacctccacagtgaataatgtcaatattaccgccgttgggagtttcaatccaaacgttacctccagtatgctgggcaacgttaacataagcacctcaaacataccttctgccgcaggcgtctctgtgggacccggagtcaccagcggtgtgaacgtgaacattctctccggaatgggtaacggcactatctcttcttccgcagctgtgtctagtgttcccaatgctgcagcagggatgactggtggatccgtctcctctcagcagcagcagcctaccgtgaatacgagtcgcttccgagttgtgaagctcgatagctcgtccgagcctttcaagaagggcaggtggacctgtacagagttctatgagaaggaaaatgcagtacccgctaccgagggggtcctaatcaataaagttgttgagacagtgaagcagaatcctattgaagtgacctcagaaagagaatcgacctcaggcagctctgtgagctcttcagtttctaccctgtctcactacacggaaagcgttggatctggcgagatgggagctcctacagtggtggtgcagcagcagcagcaacagcagcaacaacaacagcagcaacctgctctccagggagttaccctacaacagatggattttggtagcaccggccctcaatccatcccagcggtgtctatcccacagagtatttcgcagtcccagatcagccaggtgcagcttcagagccaggagctgtcttatcagcagaaacagggtctgcagcctgtccccctgcaggccaccatgtccgctgccacaggcatacaaccctcacccgtgaacgttgttggagtgacatcagcactcggacaacaaccgagcattagcagtctggcacaaccccagctgccgtactcgcaagcggctccaccagttcagacccccctaccaggggcaccccctccacagcagctacagtacgggcaacagcagcctatggtttccacacagatggctccaggccacgtgaagtctgtcactcagaatccggctagtgagtacgtgcagcagcaaccaattctccagacagccatgagcagtggccagccgtcttcagccggagtaggggcaggaacaaccgtgattcctgttgcccaacctcagggcatccagcttcctgtccaaccgaccgccgtccccgcacagcctgctggggcatcggtgcaacctgtcggccaggctcccgctgccgtctccgctgtgccaacgggcagtcaaattgctaatattggtcaacaagctaatatccccacagccgtgcagcaaccatcaacccaagtcccaccttccgtgattcagcagggtgcccctccttcatctcaggtggtaccccctgctcaaaccgggatcatacatcagggagtgcagacatccgctccctcactgccccagcaacttgtcattgcatcccaaagtagcctcctgactgtacctccacagccacagggtgtcgagcctgtggcacaagggattgtgtctcagcagcttcccgctgtttcaagcctaccctccgcaagctctatctccgtaacaagccaggtgtcatccactggcccttcagggatgccctcagcacccacaaacctcgtcccaccccaaaatatagcccagacccctgcgacccagaacggcaatttagtgcagagcgtgtctcaaccccctttaatagcaactaatacgaacttaccccttgctcagcagattcccctgagctctactcagtttagcgctcagtctctggcccaggccattggcagccagatagaagacgctaggagggccgctgagccatcgcttgtggggctcccacagacgatttcaggcgattctggtggaatgtcagctgtgtccgacggctcaagcagcagcttggcagcctccgcttctctgtttccgctgaaggtgctgcccctgacaacaccacttgttgacggggaggacgagagctccagcggggctagcgtggtggcaattgacaacaagattgaacaggccatggatttggtaaaaagtcaccttatgtacgcggttagagaagaggtggaagttctcaaggaacagatcaaagaactaattgagaagaactcccaactggagcaggaaaacaacttgctcaagacattagcatcgcccgaacagttggctcagttccaggcgcagctgcagacagggtcacctcctgccacaacacaacctcagggtaccactcagcctccggctcagcccgcttctcagggtagcggcccaaccgcttag

SEQ ID NO: 245441 - DNA, 126 bp, Artificial Sequence
  Description of Artificial Sequence: Synthetic coding sequence
atgaagagtcagtggtgtagacccgtcgcaatggatctcggtgtataccagctcaggcacttctcaatttcctttctgagctctcttctcggcaccgagaatgcctccgtgaggctcgacaattag

SEQ ID NO: 245442 - DNA, 429 bp, Artificial Sequence
  Description of Artificial Sequence: Synthetic coding sequence
atgcaccagcccccagaatccacagcggctgccgctgcagccgcagatatatctgcccgtaagatggcacatccagccatgtttccccgacgaggttctgggtccggcagcgccagtgcgctgaacgccgcaggaaccggcgtaggctccaacgcaacaagcagtgaggactttccccctccgtccctcctacagcccccaccgccagccgcttcttccacctccgggccacagcctcctcccccacaaagcctgaatcttctgagccaggcccaacttcaggcgcagcccctggcacctggcggtacccagatgaaaaagaagtcagggtttcagatcacaagcgttacccccgctcaaatctctgcgtctatcagttcaaataattctattgccgaggacactgagagctacgacgacctcgactag

SEQ ID NO: 245443 - DNA, 1713 bp, Artificial Sequence
  Description of Artificial Sequence: Synthetic coding sequence
atgcaccaaccaccggagagcactgctgccgctgccgctgcggctgatataagcgcacggaagatggcccaccctgcgatgttcccaaggcgaggttctgggtcaggttccgcaagcgctctcaacgctgccggaactggagtgggctctaatgcaacgagcagcgaggatttccctccaccctccctcctgcaaccgccaccgcctgcggcaagtagcacatctggccctcagcctcctcctcctcaaagcctcaacctgcttagtcaggcacagctgcaagcccaacctctggcccctgggggaacccagatgaagaagaagagcggattccagataaccagtgtgacaccagcacagatctccgcctccattagcagcaataatagcatcgcggaagatactgaatcctatgacgacctggacgagagtcacaccgaagatctcagctctagtgagatcttagatgttagtttatctagggccaccgatcttggtgaaccggagagatctagctcagaggaaacactgaataatttccaagaagcagagacacccggagccgtttctccgaaccagccgcatttgccccagccacacctcccccatttaccccagcagaacgttgtgataaatggtaacgcacaccctcaccaccttcaccaccaccaccagattcatcacggtcaccatctacaacatggccaccatcacccaagtcatgtcgccgtagcttctgcctcaattactggcggacccccttccagccctgtctccaggaagttaagcacgacaggaagctcagatagcataaccccagtagctcctacatccgccgtgagcagttcaggcagtcccgcaagcgtaatgactaatatgagagctcctagtactacggggggaattggaattaactcagtaacaggcacatctacagtcaataacgtgaacattaccgcagtcgggagcttcaaccccaatgtcacgagcagtatgctcggaaatgttaacatatccacttcaaacatccctagtgccgctggtgtatccgtcggccctggcgtgaccagcggcgtgaatgtaaatattctgtctggaatgggtaacggaactatctcatcctctgctgctgtgagcagcgtgcccaacgcagcggctgggatgactggaggttctgtgtccagtcagcagcagcaacccactgtaaacaccagccgatttagggtggttaaacttgattcttcttcagaacctttcaagaaaggcagatggacctgtacagagttttatgagaaagaaaacgccgtacccgctaccgagggagtgctcatcaacaaagtggtcgaaaccgtgaagcaaaatccgattgaagtgacaagcgagcgggaatctacctcaggctcctctgtttcatctagcgtgagcactctatcacattacacagagtccgtgggatccggtgagatgggcgcacctaccgtggtcgtgcagcagcaacagcagcaacagcagcaacagcaacaacaacccgctctgcagggtgtgactctgcaacagatggactttggcagcacaggtccccagtctataccagctgtatccatccctcagtccatcagccagtctcagatttctcaggtgcagctgcagtcccaggagctttcttacctgacaatgaaagttgtgctgctcatcgtttatctttgtatgtag

SEQ ID NO: 245444 - DNA, 603 bp, Artificial Sequence
  Description of Artificial Sequence: Synthetic coding sequence
atggcccaatccaagctggattgccgttctccagtagggctggattgctgcaattgctgtcttgatctcgctcatagaagtggtctgcagcgcggatcctcaggggagaacaataatcctggaagcccaactgtgagtaactttagacagctgcaagagaagctggtattcgagaatctcaataccgataagttgaatagcatcatgcggcaggacagcctggaaccggttctgagggacccttgttatctgatcaatgaaggcatctgcaatcgaaatatagaccagacaatgctgagcatccttttattcttccattccgcaagcggcgcatctgtggtagcaatcgataataagattgagcaggcaatggatctggtgaaaaatcatctcatgtatgccgtgagagaagaagttgagatcctgaaggagcaaattcgtgagctcgttgaaaagaatagccaactcgaaagggagaataccctgctgaaaacactcgcttcccctgagcagcttgagaaatttcagtcatgtctctcacctgaagaacccgcacccgaatctccacaagtgcccgaggcccctggcggtagtgccgtctag

SEQ ID NO: 245445 - DNA, 333 bp, Artificial Sequence
  Description of Artificial Sequence: Synthetic coding sequence
atggcctttcagcccccatactcctccagcctatttcgcaagcgagacaatgcaagcggcgcttcagtggtggccatagacaataagattgaacaggcgatggatctggtcaagaatcacctgatgtacgccgtgcgagaggaagtcgaaattctgaaggagcagattcgcgaactggtggagaagaacagccagctggagcgtgaaaacactcttctgaaaaccttggcctctcccgagcaactggaaaagtttcagagttgcctttctcctgaggagcctgccccagagtccccacaagtcccggaagcgccaggaggatctgcggtgtag

SEQ ID NO: 245446 - DNA, 603 bp, Artificial Sequence
  Description of Artificial Sequence: Synthetic coding sequence
atggcacagtcgaagttagactgccggagcccggtggggttggactgctgcaactgttgtctggatctggctcatcgtagtggactgcagcggggaagcagtggcgagaacaataatcccggttcgcccactgtgtcgaacttcagacagctgcaggaaaagctagtgttcgagaacttaaacaccgataagctgaactccatcatgaggcaggattctctggaacccgtgttacgcgacccctgttacctgatcaacgaaggcatctgtaaccggaacatcgaccagactatgctcagcatcttactgttcttccatagcgcaagtggcgctagtgtcgtagcaatcgacaataaaatcgagcaggccatggatctggtcaaaaatcatctcatgtatgccgtgagggaggaagtggaaatcctcaaggagcagatcagggaattggtggaaaagaactcccagttggaacgggagaatacactcctgaaaacactggctagtccagagcaactggagaagtttcagagttgtctatcaccagaggaacccgcacctgaatcaccccaagttcctgaggcgccaggtgggagcgccgtctag

SEQ ID NO: 245447 - DNA, 603 bp, Artificial Sequence
  Description of Artificial Sequence: Synthetic coding sequence
atggcccagtccaaactggattgccgctcaccagtgggccttgattgttgcaattgctgcctcgacctcgcccaccgaagtgggttgcagcgaggaagctcaggcgagaacaacaaccctggctcccccacagtgagcaactttcgccagctgcaggaaaaactggtgttcgagaatttgaatacagacaagttaaattcaattatgagacaagatagtctggaacctgttctgcgcgacccctgctacctcatcaacgagggcatctgcaatcggaacatcgatcaaacaatgttgagtatcctgttatttttccactccgcttctggagcatctgtggtggcaatcgataacaaaattgaacaggcaatggacctggtcaagaatcatttgatgtacgctgtgcgcgaggaggtggaaatcctgaaagagcagatccgcgaattagtcgagaagaatagtcagctggagagggagaacactctattaaaaacgcttgcaagccccgaacagctggagaagttccagagctgtctgtcccccgaagaacccgcaccagagtccccgcaagtgcccgaggcccctgggggatcggcggtgtag

SEQ ID NO: 245448 - DNA, 234 bp, Artificial Sequence
  Description of Artificial Sequence: Synthetic coding sequence
atggatctcgttaagaaccacctgatgtatgcagttcgcgaggaggtagagatcctgaaagagcaaattcgggaactggttgaaaaaaatagccaacttgaaagggagaacaccctgctgaagacattggcctcacccgagcagcttgagaaatttcagagctgtctctctccagaggagcctgcgcctgagtctccacaggtgcccgaggcgccagggggaagcgcggtgtag

SEQ ID NO: 245449 - DNA, 405 bp, Artificial Sequence
  Description of Artificial Sequence: Synthetic coding sequence
atgaatactgagatgtatcaaacaccgatggaagtggccgtgtaccagctgcacaatttttccatcagtttcttttcgagcttgctcgggggtgatgtggtaagtgtcaagttggataattccgctagcggcgcttctgtggttgctatcgataataagattgaacaggctatggacctcgtcaagaatcacctgatgtatgccgtacgtgaggaggtggagattctgaaggaacagattcgagagcttgtcgagaagaactcacagctggaacgggagaatacgctcctgaagaccttggctagccctgagcagttggagaaattccagagttgcctgtcacccgaagagcctgcgccagaaagcccacaggttcctgaggctccagggggatctgcggtctag

SEQ ID NO: 245450 - DNA, 540 bp, Artificial Sequence
  Description of Artificial Sequence: Synthetic coding sequence
atggcccagagtaagctggattgtagatccccagtgggtcttgactgctgtaactgttgccttgacttggctcaccgatctgggctgcagagaggaagcagtggagagaataataatcctggaagccctacagtgtccaacttccgacaggactccttggagccagttctaagggatccgtgctacctgattaacgagggtatctgcaatcggaatatcgaccagacgatgttgtctattctgctgttcttccattctgccagtggtgctagtgtggtggccatcgacaacaagatcgagcaggccatggacttggtcaaaaaccatctaatgtacgcagttagggaagaggttgaaattctcaaggaacagattagagaacttgtggaaaagaactcccagctggaacgggaaaatactcttctgaaaacgctcgcaagccccgagcagctggagaagtttcagtcctgcctgtctcctgaggaaccagcgccagaatcccctcaggtcccagaagccccagggggttctgctgtgtag

SEQ ID NO: 245451 - DNA, 372 bp, Artificial Sequence
  Description of Artificial Sequence: Synthetic coding sequence
atggcccagtcaaagctcgactgtcgaagccctgtcggactggactgttgtaattgttgcctggacctggcccatcgcagtggattgcagcgcggaagcagcggagagaacaataaccctgggtctcctacggtgtcaaattttcggcagttgcaggagaagcttgtcttcgaaaacttaaataccgataagctgaactctatcatgaggcaggattccttagagcctgtgctgagagatccttgttacctgatcaacgagggtatctgcaatcggaacatcgatcaaacaatgctgagtatactactgttcttccatagcgcctcaggagccagtgtggtcgcaatagacaacaaaatagagcaagcatag

SEQ ID NO: 245452 - DNA, 78 bp, Artificial Sequence
  Description of Artificial Sequence: Synthetic coding sequence
atggatctcgtaaagaatcacctgatgtacgccgttcgggaagaagtggagatcctgaaggaacaaataagggaatag

SEQ ID NO: 245453 - DNA, 351 bp, Artificial Sequence
  Description of Artificial Sequence: Synthetic coding sequence
atggcacagagtaaactcgattgccgctcaccggtaggactagattgctgcaattgctgcctggatctcgcacatagatctggcctccaacgcggatcatctggggagaacaataatcctggcagtccaaccgtgtccaacttcaggcagctccaggagaagctcgtctttgagaacttaaacaccgataaactgaactccattatgcggcaggattctctagagccagtgttgcgcgacccgtgctacctgatcaatgagggaatatgcaatcgcaatattgaccagaccatgctgagtatcctattattcttccattccgcctctggggcttcagtggttgccatatag

SEQ ID NO: 245454 - DNA, 177 bp, Artificial Sequence
  Description of Artificial Sequence: Synthetic coding sequence
atggctcagagcaagctggattgtcgttcgccagtgggattggattgctgcaattgctgtctcgatctggcacaccgatccgggcttcaacggggttcttctggcgaaaataacaatccagggtctccaacagtgagcaacttccggcagcttcaggaaaagttggtgttcgaatag

SEQ ID NO: 245455 - DNA, 255 bp, Artificial Sequence
  Description of Artificial Sequence: Synthetic coding sequence
atggcccagtccaaactggactgtcggtcccctgtgggccttgattgctgcaactgctgtctcgatctagctcaccgctctggtctccagagaggttcttccggcgagaataataatccaggctcacccactgtgagtaacttcagacaattacaggaaaaactggtctttgagaaccttaatacagataaactgaacagcatcatgagacaggattcactcgagccagtactccgagatccctgttacttgtag

SEQ ID NO: 245456 - DNA, 603 bp, Artificial Sequence
  Description of Artificial Sequence: Synthetic coding sequence
atggcccagagcaagctggactgtagatctccagtggggctcgattgttgtaactgttgtctggatctcgcccacaggtctggcctacagaggggctcctccggcgaaaacaataaccccggatcccccactgtctccaactttcgccagctgcaggaaaagctggtttttgagaaccttaataccgacaagctgaatagtatcatgcggcaagactccctggaacccgtcctgagagatccctgttatttgataaacgaagggatctgcaaccgcaatattgatcagactatgctgagcattctactgttcttccactcggctagcggggcatcagttgtggccatcgataacaagatcgaacaagcaatggaccttgtaaagaaccatctcatgtatgccgtgagggaggaagttgagatcctgaaggagcagatcagagagcttgtggagaagaattcccagctggagagagagaacacattactgaagaccctggcttcgccagagcagcttgagaaattccagtcatgcctcagcccggaggaacccgcaccagagtcaccgcaagtgccggaggcacccggtgggagcgcagtgtag

SEQ ID NO: 245457 - DNA, 303 bp, Artificial Sequence
  Description of Artificial Sequence: Synthetic coding sequence
atggctcagtccaaactcgactgtaggagccctgttgggctcgattgttgtaactgctgtctggatttagcccaccggagtggactccaaagggggtcatcaggcgagaacaataatcctggaagccctacagtgtcgaattttcgacagctccaggaaaagctggtgttcgagaacctgaatacagataagctgaatagtataatgcgacaggacagcctggaaccggtgttgcgggatccatgctatttgattaatgagggcatttgcaaccgcaacatcgatcagacgatgctctcatag

SEQ ID NO: 245458 - DNA, 360 bp, Artificial Sequence
  Description of Artificial Sequence: Synthetic coding sequence
atggctcaatccaaacttgactgtcggtctcccgtgggactagactgctgtaactgttgtctagatttagctcaccgatctggattgcagcggggttcatctggagagaacaataatcctggttcgccaaccgtaagcaatttcagacagctgcaggaaaagctggtgttcgaaaatctcaatacagataagctcaacagtataatgaggcaggacagcttggagcctgtgttaagggacccctgctatctgatcaacgagggcatctgtaacaggaatatcgaccaaaccatgttaagcatactactcttttttcactcggccagcggagccagcgtggttgcaatagacaacaagtag

SEQ ID NO: 245459 - DNA, 399 bp, Artificial Sequence
  Description of Artificial Sequence: Synthetic coding sequence
atgaggcaggactcactcgaacctgttctccgtgacccttgttatctcattaatgaaggtatatgcaataggaacattgaccagacaatgttaagtatcctcttgttcttccacagtgcgtctggcgctagcgtggtggccatcgacaataaaatcgaacaggctatggatctagtgaaaaatcacctgatgtatgctgtaagagaggaggtagagatccttaaagagcagatcagagagctggtcgaaaaaaattcgcaattagaacgagaaaacacccttctgaaaacccttgcatccccagagcagctggagaagtttcaatcatgtctcagccctgaagagccagccccagaaagcccacaagtgccagaggcaccaggagggagcgccgtttag

SEQ ID NO: 245460 - DNA, 375 bp, Artificial Sequence
  Description of Artificial Sequence: Synthetic coding sequence
atggcccagtcaaaactggattgtcggtcccctgtcggcttggattgctgtaactgctgcctggatcttgcgcatcgctctgggctgcaaagggggtcatctggtgagaacaacaatcctggtagcccaacagtcagcaactttaggcagctgcaggaaaaactggtctttgagaatcttaatacagataagctgaacagtatcatgagacaggactccctcgaaccagtgctgagagatccatgctatctgatcaatgaaggcatctgcaaccggaacattgatcagacgatgctatctatcctactgttttttcactccgcttcgggcgcttcggtggtcgctatcgataataagatcgagcaggcaatgtag

SEQ ID NO: 245461 - DNA, 1188 bp, Artificial Sequence
  Description of Artificial Sequence: Synthetic coding sequence
atgtctgggggaaagaagaaaagctcttttcagataacatctgtgacaaccgactacgaaggaccaggttctcccggagcgtcagatcctccaacaccacagccacctacaggaccgcctcccaggttgccaaacggggagccaagcccagacccaggaggaaaaggaacaccaagaaatggctcccctccgcctggtgctccttcttctaggtttcgagtcgtgaaactacctcacggactgggcgaaccttacaggaggggtaggtggacatgcgtggacgtctatgagagggacttggagccccactcctttggaggcctcttagaaggtatccgcggtgcttcagggggtgccggtggcaggagtctggacagcagactcgagctagccagcctcggtctaggagcccctacacccccatctgggctgagccaaggaccaacttcttggctccgtcctccccctaccagcccgggtccacaggcacggagcttcacaggaggtctgggccagcttgtagtcccctcgaaggccaaggctgaaaaacccccactgtcagctagttctcctcagcaaaggccacctgagccagaaaccggcgagagcgcgggaacttcccgagctgctacgcctttgccctcactccgtgtggaggcagaggctggcggttcaggggctagaactccaccgctgtctcggcgtaaggctgtcgatatgcgtttaagaatggagctgggtgcaccggaggagatggggcaggtgcccccactggactccaggcctagcagtcctgcactgtactttacacacgatgctagtctggtgcataagtctccagatccttttggtgccgtagctgcacagaagtttagtcttgcccactcaatgttagccataagcgggcacctggattcagatgacgatagtggatccggctctctggtggggatagacaacaagatcgagcaggcaatggacctggtaaaatcccatcttatgttcgcagtgagggaagaggttgaggttctgaaagaacagatccgggagctcgcggaacgaaatgctgcattagaacaggagaatggtctcctgcgcgcacttgcctctcctgagcagctggcccagctgccgtcgtccggagtcccaagacttggtcctcctgctccaaacggaccaagcgtatag

SEQ ID NO: 245462 - DNA, 1314 bp, Artificial Sequence
  Description of Artificial Sequence: Synthetic coding sequence
atgagtggactggacggagtgaagcgaaccacccctttgcagacccactctataattatcagtgatcaggtcccttccgatcaggatgcacaccaataccttaggttgcgcgaccagagcgaagccacccaggttatggctgagccaggcgaaggaggaagtgaaaccgtggccctgcctccgcctcctccctccgaggaaggcggagttccacaggacgcagctggcagaggaggcactcctcaaatacgagtggtggggggtcgcggacatgtggccattaaggctggccaagaggaaggccagccacctgctgagggtttggctgctgctagcgtggtgatggctgcggacaggtctctgaaaaagggtgtgcaggggggtgagaaagccctggaaatctgcggagcccaacggagcgccagcgagctaacagccggtgcagaggctgaggccgaagaggtaaagacaggtaagtgcgcaaccgtgagtgcagctgttgcggaacgagagtccgctgaggtggtgaaagaaggcctggccgaaaaggaggtaatggaggagcagatggaagtcgaggagcagcctccggaaggcgaagagattgaagtcgcagaggaggatcgactggaggaagaagcacgggaggaagaaggaccatggccgctccacgaggcccttcgaatggatcccctggaggctattcagttggaactagatacagtaaatgcccaagcagacagagctttccaacagctggagcacaagtttggacggatgagaagacattatctagaacggcgaaattatatcatccagaacatccctgggttttggatgaccgcgtttcggaaccatcctcagctgtccgccatgatcaggggccaagacgcagagatgctgcggtatattaccaatctggaggtgaaggagcttaggcaccccaggacagggtgcaaatttaaattcttttttcgaaggaacccctacttccgaaataaactcatcgtcaaggaatacgaagtgcgctcaagtgggagagtcgtttcactgtcgacacctattatctggagaagaggtcacgagcctcagtccttcattcggaggaaccaggatctcatatgctccttctttacttggttttccgaccatagcctgcctgaaagtgataaaatagcagaaatcatcaaggaggatctatggcctaatccgctgcagtactatcttctcagggaaggtgtccgtagggcccgaaggcggccactccgcgaacccgtggaaatcccacgtccatttggttttcagagcggttag

SEQ ID NO: 245463 - DNA, 522 bp, Artificial Sequence
  Description of Artificial Sequence: Synthetic coding sequence
atgtctggactcgatggggtcaagcgcacaacaccccttcaaactcacagtatcattatctcagaccaagttccctctgatcaggacgcccaccagtacctcagactgcgagaccagagcgaggccacccaggtgatggctgagcctggggaggggggttctgaaaccgtagcactcccgcctccgccaccttctgaagaggggggtgtgccgcaggacgcggcaggcagaggcggtacgccacagattcgagtcgttggtggtaggggacatgtggccattaaggccggtcaggaagaaggacagcccccagccgaaggcctcgccgctgcctccgttgtaatggccgctgaccggagcctgaagaagggcgttcaaggcggtgaaaaagcactagaaatctgtggggcacagaggtccgcctcggaactaactgccggagccgaggccgaagctgaggaggtaaagacaggcaaatgcgccaccgtgtctgctgccgtggctaagatgcagcgatgctag

SEQ ID NO: 245464 - DNA, 2082 bp, Artificial Sequence
  Description of Artificial Sequence: Synthetic coding sequence
atggaccgtcccgatgaaggtcctcccgcaaaaacgaggcgcctgagttctagcgagagcccgcagcgcgatccacctccacccccacctcctcccccactcctacgactacctttgccaccccctcagcagcgacctaggctccaggaagaaactgaagccgctcaggttctcgcggacatgcgaggcgtcggtctggggcctgctctgcccccacctcctccctacgtgattctggaagagggaggaatcagggcgtacttcacgctcggcgctgaatgccctggttgggattccaccatcgaatctggttacggcgaggctccccctccaacagagagtctagaagcccttcctactccggaggcttctgggggatctctggaaatcgacttccaagtcgtgcaaagtagttctttcgggggtgaaggcgctcttgagacttgctcagccgtcggttgggctccccagagactagtagatccaaagagcaaggaagaggctatcataatcgtagaggacgaggatgaagacgaaagggagtctatgaggtcctcccgaagaaggaggcggagaaggcgcaggaaacagcgcaaagtgaagcgcgagagtagggaacggaacgccgagcggatggagagcatattgcaggccctcgaggacattcagctggacctggaggctgtgaacatcaaggccggtaaggccttcctgagactgaaacgcaagtttattcagatgagaagacccttcctggagaggcgggacttaattatccagcacatcccaggattttgggtgaaggccttcttaaaccatcctcgcattagtattcttattaaccgtagggacgaagacatctttagatacttaaccaacctgcaggtccaggaccttcgccacatttcaatgggctacaaaatgaagctctacttccaaaccaacccttactttactaatatggtgattgtcaaggaattccaaaggaatagatccggtcggctggtctcacactctacccctatccggtggcaccgtggccaggagcctcaagccagaagacatggcaatcaggatgcaagccactccttcttttcgtggttctccaatcactctctaccagaagcagatcggatcgctgagattatcaagaacgatttatgggtaaatcccctgcggtattatctgcgtgaaagagggtcgagaatcaagcgtaagaaacaagagatgaagaagagaaagaccagaggcaggtgcgaagtggttataatggaagacgcccctgattattacgctgttgaagacatcttttctgagataagtgatatagatgagacaatccatgacataaaaatttcagatttcatggagactacggattattttgaaacaactgacaatgaaataacagacatcaatgagaacatttgtgactcagaaaaccccgaccataatgaagtacctaataacgagaccaccgacaataacgaaagcgctgatgaccatgaaaccaccgacaacaatgagtcagctgacgataataacgagaatcctgaagacaacaacaagaatactgacgataatgaggagaacccgaataacaacgaaaatacatacggaaacaattttttcaagggcggtttctggggaagtcacgggaataaccaagattccagcgacagcgataatgaggctgacgaggccagcgacgatgaggacaatgatggtaatgagggggataatgagggatctgatgatgatgggaatgagggtgacaatgaaggatcagacgatgatgacagggatatagagtactacgaaaaggtgatagaggacttcgacaaggaccaggcagattacgaagacgtcatcgagattatttctgacgaatccgtggaggaagagggaattgaggaaggaattcagcaggatgaagatatttacgaggaggggaactacgaggaagaggggagcgaggacgtgtgggaagaaggtgaagacagcgatgattcagatctcgaggatgtacttcaggtgcctaacggctgggctaaccctgggaagagaggcaaaaccgggtag

SEQ ID NO: 245465 - DNA, 1062 bp, Artificial Sequence
  Description of Artificial Sequence: Synthetic coding sequence
atgccttggcctcttttgctgctgctggctgtgtccggcgctcaaaccacgagaccatgtttccctgggtgtcagtgcgaggtagaaacatttggtctgttcgacagcttttctctgacgcgcgtcgattgcagcgggttagggccacatatcatgcccgtacccatcccactggacacagcgcacctggacctgagctctaatagactggagatggtgaacgagtccgtgctggctggccctggatacaccaccctcgctggcctggatctctcacataatctgttgacttcgatctctccgacagccttctctaggctgcgttacctggagtccctggatctgagccataatggactaacagcactgccagctgaaagctttacttcttcccccctgtccgacgtaaatctgagccacaatcagttgagggaggtgagcgtgtctgcctttaccacccattcacagggcagagcgctacacgtcgacctgtcccacaatctgatccacagacttgttccacaccccacccgggcagggctgccggcaccaaccattcagtctttaaatctggcatggaacagattgcacgctgtgccaaatctgagggacctcccactgcgatatctgagtctcgacggaaatccactagctgtcattggcccaggcgctttcgctggactcggtggactgacacatctctcactcgcttcactgcagcggttgcccgaactggccccatccgggttccgggaattgcctggattacaagtactggacttgtccggtaatccaaagctaaattgggccggtgctgaagtgtttagtggtttgagttccctgcaggaactcgatcttagcgggaccaacctagtacccctgccagaggccttgctgttacacttgcccgctctgcaatcagttagcgtcggacaggacgtgcggtgccgtcgcctggtgagagaggggacttatcctagaaggcccggaagttcccccaaggtggcactacactgcgtggacacacgcgacagtgccgctcgaggccctacgatcctgtag

SEQ ID NO: 245466 - DNA, 966 bp, Artificial Sequence
  Description of Artificial Sequence: Synthetic coding sequence
atgccctggcccttgctgttactgctcgccgtgtccggggctcagaccacacgcccttgcttcccaggctgtcagtgtgaggtcgagacgttcgggctctttgattccttctctctcacacgcgtcgactgctctggtctcggcccacacatcatgcctgtcccgatcccccttgacacggcccaccttgatctgagtagcaataggctagaaatggtgaacgagtctgtgctcgccggacccggatacacgactctggccggacttgatctctctcacaatctgctaacctcaagtccgttatcagatgtgaacctctcccacaaccagctccgggaagtatcagttagcgcttttacaactcattcacaggggagagccctgcatgtggatctctctcacaatctgatccatcgcctggttccccacccgacaagggctggactgccagctcctaccatccagagtctcaacctagcctggaatcgattgcacgcagtgcccaatctgagagacctgccactgagatatctctccctggacggaaatccactcgcagtcatcgggccaggcgctttcgccggattggggggactcacccatctttcactggcgtccctgcagcgccttcccgaattagccccttcagggtttagagagctgcccggtctccaggtcctggatctgtctggaaacccaaagcttaattgggctggagctgaggtcttcagtggactgtcctcacttcaggaactggacctgagcggcaccaaccttgtgcctctacccgaggctctgttgctgcatctgccagctctgcaaagcgtgagcgttggccaggacgtgagatgcaggaggctcgtgagagaagggacctatccaaggcgccctggtagctctccaaaggtcgcactacattgcgtggacacccgtgactccgcagcgagaggcccaactatcttgtag

SEQ ID NO: 245467 - DNA, 318 bp, Artificial Sequence
  Description of Artificial Sequence: Synthetic coding sequence
atgccttggccgcttcttctcctgctcgccgtatccggggctcagaccacccggccatgtttccctggatgccagtgtgaggtggagacgtttggactcttcgattctttctcactgactcgggtcgattgcagtgggctgggtccccatatcatgccggtccccataccattggatactgcccatctggacctctcctcaaacagacttgagatggtgaacgaaagtgttctagccggtcctggttataccacactggcgggtctcgacctatcgcataatctcctaactagtattagcccaaccgcctttagttag

SEQ ID NO: 245468 - DNA, 1062 bp, Artificial Sequence
  Description of Artificial Sequence: Synthetic coding sequence
atgccttggccgttgctgctgctcctcgctgtatcaggagcccagacaacaagaccatgctttccagggtgccagtgcgaggtggagactttcgggttatttgactcatttagtctgacacgcgtcgactgctccgggctcggaccccatattatgcccgtgcctattcccttggataccgcacacctggacttgtccagcaatcgcttggagatggtcaatgagagtgttctcgctggtcccggatataccactctggccggtcttgacctttctcacaacctgctcactagtatttcgccaaccgcattctcccggttgaggtatctcgaatctctcgatcttagtcacaacggactaaccgctctgccggcagagtcttttacttcctctcccttgtcagacgtgaatctgagccacaatcagctgcgtgaggtaagtgtgtccgcattcactacccacagccaaggcagggcccttcacgtggacttatctcacaaccttatccacaggctcgtgccccaccctactcgggctgggctccccgcacctacaatccagtctttaaatctcgcctggaaccgtttgcatgcagtcccaaatctgcgggatctgccattgaggtatctctctctcgatggtaaccctctcgccgtaatcggtcccggtgccttcgcgggactgggtggcctgacacacctttccttggcttctcttcagcggctgcccgaacttgctccctctggctttcgcgagctccctgggcttcaggttcttgatctctctggcaatccgaagcttaattgggccggtgctgaagttttcagcgggctctcctccctgcaggaactagacctgtcaggcactaatctggttcctttacccgaagcactcctccttcacctcccagcccttcagtccgtgtccgttggtcaggatgtgcgctgtagaaggctggtccgagagggaacttacccacgcaggcccggatcttcccccaaggtggcactccactgcgtggacacaagggacagcgccgctagggggcctacaatattgtag

SEQ ID NO: 245469 - DNA, 453 bp, Artificial Sequence
  Description of Artificial Sequence: Synthetic coding sequence
atgccctggcctctgctcctcctactggctgtgtccggagcccagactacaagaccttgtttccctgggtgccagtgcgaggtggagaccttcggactctttgattccttctccctgactagagtggactgcagcggacttggcccacacatcatgcctgtgccaataccactggacactgcccacttagacttgtcatcaaaccggctcgagatggttaacgagtctgtgctggcagggcctggatataccactttggcgggtctggatctgagtcacaatctgctcacatctatcagtcccacagccttttctcgactgcgatatctcgaatcattggacctgtcgcacaatggcctgactgcacttccagcagaatcctttacctcaagcccgttatctgacgtcaatctgagccataaccagctgagggaagtctccgtcagtgcctag

SEQ ID NO: 245470 - DNA, 2574 bp, Artificial Sequence
  Description of Artificial Sequence: Synthetic coding sequence
atggagtccgaagatctgagtggcagggagttaaccatagatagcattatgaacaaggtgagagacattaagaacaagtttaagaatgaggatctcaccgacgaactgtcattgaataagatctcggccgatacaactgacaacagtggtacggtgaatcagatcatgatgatggctaataaccccgaagattggttatcgctgctcctcaagcttgaaaaaaactctgtcccactgtccgacgcactgctgaacaagctcattgggcgttactctcaggcgattgaagccctgccgcctgataaatacgggcagaacgagtccttcgccaggatacaggtgaggttcgctgaattaaaagcgattcaggagcccgacgatgctcgtgattactttcagatggcaagagccaattgcaaaaaatttgccttcgtccatatctccttcgcccagttcgagctgagccagggaaacgtcaaaaagagcaagcaactgctccagaaggctgtcgagaggggggcagttccactggagatgctcgagattgccctgcgcaacctcaacctgcagaaaaaacagctcctgagcgaggaggagaaaaagaacctgtcggcctcaactgttctgactgcccaagagagttttagcgggtcactcggtcacctgcagaatcgaaacaatagctgtgattccagaggtcagaccaccaaggcaaggtttctatacggggagaacatgcccccacaagatgctgaaatcggttaccgtaactccctgaggcagaccaataagacaaaacagagctgcccttttggaagagtgccagtgaatctcctaaacagtcctgactgtgatgttaaaaccgatgattccgttgtgccctgtttcatgaaaaggcagaccagtcggagtgaatgccgcgacctggtggtacctgggtcaaagcctagcggcaatgacagctgcgagctccggaatctgaaatctgtacagaatagccacttcaaggaacctttggtctccgacgagaagagcagtgagttgattattactgactctattacactgaagaataagaccgagtcctcactcctggccaagctggaggagactaaggagtatcaggagccagaagtgccagagagtaatcagaaacagtggcagagcaaaagaaagagtgaatgtattaatcagaaccctgcagcttcttcaaatcactggcaaatacctgaacttgcccgaaaagttaataccgagcagaagcataccactttcgaacagccggtgttctctgtttcaaagcagtcgcctcctataagcacctctaaatggttcgatccgaagtccatttgcaaaacgcccagttctaatacgctggacgactacatgtcatgtttcagaactccggtggttaaaaatgattttccacctgcctgccagctcagtacaccttatggacagcctgcatgctttcagcagcaacagcaccagatacttgccactcctctgcagaacttgcaggtgctggcctccagctccgccaacgagtgcatctcagttaaaggaagaatctacagtattctcaaacagattgggagcggcggtagctcaaaggtattccaggtgctgaatgaaaaaaaacagatttacgcaattaaatatgtcaatctggaagaggcagacaaccagacattggactcataccggaacgaaattgcttatctgaacaagctgcagcaacactctgataaaattattcgcctgtatgactatgagataactgaccagtacatttacatggtgatggaatgcgggaatatcgacttgaactcttggttgaagaagaagaaatccatcgacccttgggagaggaaaagttattggaaaaacatgctggaagcagtccataccatccaccagcacggcattgtgcactcggatcttaagccagccaacttccttatcgtcgatggaatgctcaaactcatagattttggcattgccaaccagatgcagccagatacaaccagtgtcgttaaggatagtcaagtggggacggttaattatatgcctcccgaggcgattaaggacatgagtagttctagggagaacggcaagtccaagagcaagatttctcccaaatctgacgtgtggtctctgggctgcatactctactatatgacatatggaaagaccccgttccagcagatcatcaaccagatcagtaaactacacgccattatagatccaaaccatgagatcgaattcccagacattccggagaaggacttacaagacgtcttgaagtgctgtctgaagcgagaccccaagcagcgaatcagcattccagaactcttggctcacccttatgttcagattcagacacaccccgttaatcagatggccaagggtacaaccgaggagatgaagtacgtgctaggtcagctcgtcgggctcaattcccctaatagcatcctgaaagccgcaaagaccctgtacgaacattacagcggaggcgaaagtcataacagcagctcgtcgaagaccttcgagaaaaagagagggaaaaaatag

SEQ ID NO: 245471 - DNA, 420 bp, Artificial Sequence
  Description of Artificial Sequence: Synthetic coding sequence
atggaatctgaggacctgtcagggagagagctcacaattgattctattatgaataaggtgagggacatcaagaataagtttaagaacgaagacctgaccgacgagctatccttgaataagatctctgctgacactaccgataattccggcaccgtgaaccagattatgatgatggctaataatccagaggattggctgagccttcttctgaagctcgagaaaaacagcgtgccacttagtgacgcactcttgaataagttaatcgggcgttactcacaggcgattgaggctctcccccctgacaagtacggccaaaatgagagcttcgcaaggatacaagtaaggttcgccgagctgaaagccattcaagaaccggatgacgcacgggactactttcagatggcccgagctaattgctag

SEQ ID NO: 245472 - DNA, 531 bp, Artificial Sequence
  Description of Artificial Sequence: Synthetic coding sequence
atggaatccgaggatctgagcggccgtgagctcacaatagattcaattatgaacaaagttagggatattaaaaacaagtttaaaaatgaagatctaaccgatgaactaagtctcaataaaattagcgccgacaccactgataacagcggcacagtgaaccaaattatgatgatggcaaacaatcctgaagactggctgtcattgctgttgaagcttgaaaagaattctgtccccctttcagatgccctgcttaacaagctgattgggcgatacagccaggccattgaagccttgccccctgacaaatatggacagaacgaaagcttcgccagaattcaggttcgattcgctgaactcaaagcgatccaggagcccgacgacgccagggattattttcagatggcaagagctaactgtaagaaatttgcatttgtgcacatcagtttcgcacagttcgaattaagccaaggcaatgttaaaaagtctaaacagcttctgcagaaagctgttgagcgcggagcagtcccgtag

SEQ ID NO: 245473 - DNA, 453 bp, Artificial Sequence
  Description of Artificial Sequence: Synthetic coding sequence
atggagtctgaggatctcagcgggagagagctgactatcgactcaatcatgaacaaggtgagagacatcaagaacaagttcaagaacgaagatcttacggatgaactatcactcaataagatatccgccgatacaacagataattccggcacggtgaaccagatcatgatgatggccaataatcctgaggactggctgtcccttctgctgaagttggagaaaaatagcgtacctttgagtgatgccctgctgaacaaactcattggtcggtactctcaggcaattgaggcattgccccctgataagtacggacaaaacgaatcattcgctagaattcaggttcgatttgctgagctaaaagctatccaagagcccgacgacgctagagattacttccaaatggccagggcgaattgcaaaaagtttgcttttgtccatatctccttcgcatag

SEQ ID NO: 245474 - DNA, 492 bp, Artificial Sequence
  Description of Artificial Sequence: Synthetic coding sequence
atggcggaaggcggaggtcaaaaccaccacgaagtggtaaagttcatggatgtttatcagaggtcctattgccaccctatcgagactctcgttgatatattccaggaataccccgacgaaattgagtatatcttcaagccctcttgtgtgccactaatgcggtgcggaggctgttgcaacgacgaaggacttgaatgtgttccgacagaggagtccaatatcacaatgcagatcatgaggattaaaccacaccagggccaacatatcggggaaatgtcttttttgcagcacaataaatgtgagtgtcgtccgaagaaggatcgggctagacaggaaaatccatgtggcccttgctccgaacggaggaagcatttatttgtacaggaccctcaaacttgtaaatgcagctgtaagaacacggactctagatgtaaagctcgacagctggagctgaacgaacgaacatgccgatgtgacaaaccgcgtaggtag

SEQ ID NO: 245475 - DNA, 1368 bp, Artificial Sequence
  Description of Artificial Sequence: Synthetic coding sequence
atgaccacaatggccgcagcaaccctgctaagggccaccccgcatttcagtggcctagccgctggcagaacttttctgctgcagggcctgttaaggttgcttaaagcacccgctctccccctactgtgtaggggcctggcggtggaggccaagaagacatatgtgagggacaaaccacatgtgaacgtgggaaccatcggccatgtggatcatgggaaaacaaccctgacagctgccataaccaagatccttgcggaaggcggtggtgccaagttcaaaaaatacgaggaaatcgataatgctcctgaggagagagcacggggtataaccattaacgcagcccacgtggagtacagcacagcagctcggcattatgcccacaccgattgcccaggtcacgcggactacgtaaagaatatgatcacgggaaccgcacccctcgatggatgcatccttgttgtggctgccaatgacggcccaatgccgcagactagggagcacctccttttggcaagacagataggcgtagagcacgtcgttgtatatgtcaataaagcagacgcggtccaggattcagagatggtggagttggtcgagctggagatccgtgagctcctgacggaattcggatacaagggtgaagagactcccgtgattgttgggtctgccctgtgtgctctggagggcagagaccccgagcttggcctcaagagcgttcaaaagctcctcgatgcagttgacacgtacatccctgtgcccgcaagggacttggagaaaccgttcctcctgcccgtggaggctgtttactcagttcccggacgcggaactgtagttacaggaacgctggagcggggaattctcaaaaagggcgacgaatgcgagctcttaggacacagtaagaacatcaggactgtggtgaccggcattgaaatgttccataagagtctagagcgagcagaggccggtgacaatcttggcgctctggtgagaggcctcaagcgagaggacctgagaagaggactggtcatggtgaagccaggttcaattaaacctcatcagaaggttgaggcccaggtttatattttgtctaaggaagaggggggacgccacaagccctttgtgagtcattttatgcccgtgatgttcagccttacctgggatatggcctgtaggattatcctgcctcccgaaaaggagttagctatgccaggcgaggatctgaaattcaacctcatcctccgacagccaatgatcctggaaaagggacagcgtttcacgctgcgggacggtaaccgtaccattggcaccggcttggtgactaacacactcgcgatgactgaggaagaaaagaacataaagtggggttag

SEQ ID NO: 245476 - DNA, 1611 bp, Artificial Sequence
  Description of Artificial Sequence: Synthetic coding sequence
atggcaaccccagacgctggcctgccaggagcggaaggggtcgaacctgcaccttgggctcagctggaggctcctgccagattgttgctgcaagcactgcaggccggtcctgagggggctcgacggggactcggtgttctgagggctcttggttcccgcggttgggaaccttttgattggggacggctcctggaggcattatgtagggaagagccggtggtgcagggcccagacggacgcttggagctgaagcccctactcctgagactgcctcggatttgtcagagaaatctgatgtctctcctaatggcggttcgtccgtccctcccggagtcaggactactgagcgtgctgcagatcgctcagcaggacctagctcccgatcctgacgcttggttacgggcactgggcgagctattaagacgcgaccttggagttggaaccagcatggaaggcgcaagtccgttgtcagaaaggtgccagcgccagcttcagtcactgtgtaggggcctaggtcttgggggtcggagacttaagtcccctcaagcgcctgatccagaggaagaagagaaccgcgattctcagcagccgggaaaaagaaggaaggatagtgaggaagaggcagccagccctgagggaaagcgtgttcccaaaagactgcgctgctgggaagaggaagaagaccacgagaaggaaagacctgagcataagagcttagagtccctggccgacggcggttcagcttctcctattaaagaccaacctgtgatggcggtcaagaccggcgaggatggtagtaacctggatgatgcaaaagggttagccgagtccctggagctgccgaaggctattcaagaccagctgccccgactgcaacagctgttgaaaactctggaagaagggctcgaagggcttgaggacgctcctcctgtcgaactgcagctgttacatgagtgtagcccaagccagatggatctcctctgcgcgcaactgcagctgcctcagctgtcggacctcgggcttctgcggctttgcacctggctgctggccctctctcccgatctgagtttgagcaacgccaccgtgctgacaagatccctgtttctaggtcggattctgtcgctgaccagttctgcgagcaggctgcttacaactgcgcttactagtttttgcgctaagtatacgtaccctgtctgctctgcactcttagatcccgtcctgcaggctcccggaaccgggccagcacagactgagctgctctgctgtctggtgaaaatggaatcgctagagcctgatgcccaggtgctgatgttgggccagattttagaactcccatggaaggaagaaacgtttctcgtgctgcagtcattgttggaacgtcaggtggagatgactcctgaaaagttttcagtcctcatggagaaactctgtaaaaaaggcctggcagccactacgtccatggcatatgcaaagcttatgctgacagttatgacgaagtaccaggctaacattacggagactcagcgacttggtctcgccatggccctagagccaaacacaactttcttgcgaaaaagcctcaaagccgcacttaaacatctaggtccctag

SEQ ID NO: 245477 - DNA, 1470 bp, Artificial Sequence
  Description of Artificial Sequence: Synthetic coding sequence
atgccgctgagggacgaaactttaagagaagtttgggctagcgatagtggccacgaagaagagtccctgtctcccgaggcccctcggagaccgaagcaacggccagctcccgcacagaggcttcggaagaagcggaccgaggcccctgagagcccctgccctacgggctccaagcctaggaaaccaggcgaagaggaggaggaagaggaggatgaagaggacgaagaggaagaggctgaggagaaaaaggagaagatactcctacctccaaaaaaaccgctgagggagaaatctagcgctgatctgaaggaaaggagggccaaagcacagggtccacgcggtgatctgggcagccctgatccacccccaaaacctctgcgagtccgaaacaaggaggctcccgcaggtgaaggcaccaaaatgcggaagacgaagaagaaggggagtggagaggcagacaaggaccccagcggctctccagccagcgctaggaagagccccgctgcaatgtttctggtcggggaggggagtcccgacaagaaggcactgaaaaagaaggggactcccaagggagcgaggaaggaggaggaggaggaagaagaggccgcaacggtcatcaagaaaagcaatcagaaagggaaggccaagggtaagggtaaaaaaaaggcaaaggaggagagggcaccttctcctcctgtcgaggtcgacgaaccacgagagttcgtactccggccagccccacagggaaggaccgtgaggtgccggctcaccagagacaaaaaagggatggatagaggaatgtacccttcttactttctacatctagacactgagaagaaggtatttctactcgccggaaggaagaggaagaggagtaagactgccaactacctgatctcaattgacccaacgaatctgagtcgaggaggtgagaacttcattggcaaacttcgcagcaatctccttggcaaccggttcacagtgtttgacaatggccagaatcctcaacggggttattcgacaaatgtggcttctctgaggcaggaactcgccgcagtgatttacgagaccaatgtgctcggctttagagggccacgacggatgacagtgatcattccaggcatgagtgcagaaaacgagcgcgtgcctatccgccctcgcaatgcaagtgacggtctgttggtacggtggcagaataagacccttgagtctctgatcgagttacataacaagcctcccgtgtggaacgatgacagcggttcctatacacttaactttcagggacgcgtgacacaagcaagcgtgaagaattttcaaattgtccatgccgacgaccctgattatattgtcctacaatttggccgagtggctgaggatgcgtttaccctcgactataggtatcctctctgtgcgcttcaagctttcgccatagccctgtccagctttgatggaaaattggcctgtgaatag

SEQ ID NO: 245478 - DNA, 561 bp, Artificial Sequence
  Description of Artificial Sequence: Synthetic coding sequence
atgcctctgcgggacgaaactttgagggaggtgtgggcctctgacagcggccacgaggaggaatctctgagtcccgaagcccctagacggccaaagcagcggcctgcacctgcccagcgattacggaagaagcgcacagaggctccggagtccccttgccctacagggtcaaaaccccgtaagcctggtgaagaggaagaggaagaagaggatgaggaagacgaggaagaagaagccgaagagaagaaagagaaaatccttctccctcccaaaaagccattacgtgagaagtcaagcgcagaccttaaagaacggagggccaaggcacaaggccctagaggagatctcggctcacccgaccccccacctaaacctctcagagtccggaacaaagaagcccctgcaggggagggaacaaaaatgaggaaaacaaagaaaaaagggagcggagaagccgataaggatccctccggctcccccgcatccgccagaaagagccccgctgccatgtttctagtgggagagggttcccccgataagaaagctctcaagaagaaatag

SEQ ID NO: 245479 - DNA, 3033 bp, Artificial Sequence
  Description of Artificial Sequence: Synthetic coding sequence
atgggagcctacgcacgcgctagcggggtgtgtgccagaggttgtctggactccgccggtccatggactatgtccagggccctgcgcccacccctgcctcccctgtgcttttttctgctactgcttgccgctgcgggagccagggccggtgggtatgagacttgcccaaccgttcaaccaaatatgttgaatgtgcacctcctgcctcatactcatgatgacgttggctggttgaagaccgtggaccagtatttctacggcattaagaatgatatccagcacgctggggtgcagtatattctcgactctgtgatttccgctctactggcagacccaaccagaaggtttatctatgtagagatcgccttcttctcacgctggtggcaccagcagacaaatgcgacgcaggaagtggtgagagatcttgtgagacaggggcgtttggagttcgccaatggcggttgggtaatgaacgatgaagccgcaactcactacggagccatcgtcgatcagatgacactaggccttaggtttctggaagacactttcggcaacgacggtcggcctagggtggcctggcatatagatccctttggccatagcagggaacaagctagtctgtttgcccagatgggcttcgatgggtttttcttcggaagactggactaccaagacaaatgggttcgcatgcaaaaattggagatggagcaagtgtggagggccagcacaagcctcaagccacctaccgccgatctgttcaccggcgtgcttccaaatggatacaacccccctagaaacctgtgttgggacgtgctctgcgttgatcagccactcgtggaggaccctcgtagtccagaatacaatgcgaaggaactcgtggattacttcctgaatgtcgctacagcgcaaggacgctactaccggaccaatcatacagttatgacgatggggagcgatttccagtatgagaacgccaacatgtggtttaagaatctcgataaattgattcggctggttaacgcccaagccaagggttccagtgtccatgtgttgtacagcacacctgcctgctacttatgggaattgaacaaggccaacctgacctggtcggtgaaacatgatgattttttcccctacgctgacgggccacatcagttctggacgggatacttctctagtcgccctgccctgaaacggtacgagaggctgagttataattttttacaagtgtgtaaccagttggaggcactggttgggttggccgcaaatgtgggaccctatgggtccggggactcagccccactcaacgaggctatggccgtactgcagcatcatgacgctgtaagcggcacaagtagacagcacgtggctaatgactatgcgagacaactcgcggcaggctggggtccctgcgaggtactgctgagcaacgctctcgctcgactgcgcggtttcaaagatcattttacgttctgccagcagctcaatatctcaatctgtccgttgtctcaaacagcggcaagattccaggtcatcgtttacaatcccctggggagaaaagttaactggatggtccgactgcctgtctcagaaggcgttttcgttgtgaaggacccaaatgggaggaccgtgcctagtgacgtggtcatcttcccttccagtgattcccaagctcacccccctgaacttctgttttccgcttctcttcctgcactggggtttagcacatattctgtggcacaggtccctcgctggaaaccacaagcaagagccccacagccaatcccacgtagaagctggtctccggctctcaccattgaaaatgagcatatcagagcaacctttgatcctgataccggacttctcatggagatcatgaacatgaaccagcaactgctgttgccagtgaggcagacattcttctggtataacgcctccattggagacaacgagagcgaccaggcttccggcgcatacatttttcgacctaatcagcagaaacctctgccagtgtctcggtgggcccagatccatctggtgaaaacaccacttgtgcaggaagtacaccagaatttctccgcctggtgctcacaagtggtgcgcctgtatcccggacaacggcatctggaactcgaatggagcgtcgggccaattcccgtgggagacacttggggtaaggaggttattagcagattcgatacacccctagagaccaagggccgtttctatacggactctaacggccgtgagatcctggaaagacggagagattatcgacccacctggaaactcaaccagactgaaccagtggctgggaactattaccccgtcaatacaaggatttacattacagatggaaacatgcagctcaccgtcctgaccgaccgctcccaggggggatcctctctgcgagatggctcgttggagttaatggtgcacagacgattgctgaaggacgatggtaggggtgtgagtgagccacttatggagaacggaagcggagcatgggttagaggccgacatttggttctcctggatacagctcaggccgctgctgcaggccaccggctgctcgcagagcaagaggtcctcgcaccccaagtcgtcctggcgcctgggggtggagccgcatataatttgggcgcaccacccagaacgcagttttccggcctgaggcgtgacctgccaccttccgtgcatctgctgacattggctagttggggacctgaaatggtgttgctgcgattagaacatcagtttgctgtaggagaggactccgggagaaacttgtccgcacccgtgaccttaaacttgagggatttattttctaccttcacaattaccaggcttcaagagacaaccctggtcgccaaccagttgagagaagccgcatcacggctcaaatggactactaatacagggcctactccgcaccagacaccctatcagctggaccccgcaaatatcacgctggaacccatggaaatccgcactttcctcgcgagcgtgcagtggaaggaggtggacggatag

SEQ ID NO: 245480 - DNA, 1158 bp, Artificial Sequence
  Description of Artificial Sequence: Synthetic coding sequence
atgcacgtgtgtgtgtgtgtctgtgtctgtgtgtacatgcctgtgtgtgtggatgcgtgcatgtgctgcgaggcgggacgccctgcctttcgctcattcctgttcagtctatgctctgatctgggggcagtgatcagtctgctcttgtggggtagacaactgtttgctttatacagtggtaacgatgttaccgatatcagcgatgataggttccccaagccacctgaaattgccaatggctacgtggaacacctgttcaggtaccaatgtaagaattattacagacttcggaccgagggcgacggcgtctacacactgaatgataagaagcagtggataaacaaggcagttggggataaattgccggagtgtgaagccgtatgtggtaagccaaaaaaccccgctaaccctgtacaaaggattttgggcggacacttggacgctaaaggcagtttcccgtggcaggccaagatggtgtcccaccataatctcaccactggcgctactctaattaatgagcaatggttactgactacagccaagaatctctttttaaaccacagcgaaaacgctactgccaaagatatagcccctacactcaccctttacgtcggcaaaaaacagctggttgagattgagaaggttgtgctacaccctaactaccatcaagtcgacattgggctgattaagctaaagcagaaggtcctggttaatgagcgcgtgatgcctatatgtttgcctagcaagaactatgctgaagttgggagagtgggctacgtgtctggatggggccagagtgacaactttaagctgacagatcatctgaagtacgtgatgctgccggtggctgaccaatatgattgcatcacacactacgagggctctacctgtccaaagtggaaggcgcctaaatccccagttggggtgcagcctatccttaacgaacacactttctgcgtgggcatgagcaaataccaggaagatacatgctatggagacgcaggcagcgctttcgctgtccacgatctcgaggaggatacgtggtatgccgcaggcatcctgtcatttgacaagtcatgcgccgtggccgagtatggagtgtacgttaaagttaccagtatccaacactgggtgcagaagaccatagctgagaattag

SEQ ID NO: 245481 - DNA, 1329 bp, Artificial Sequence
  Description of Artificial Sequence: Synthetic coding sequence
atggaggcctcacgttgccgtttgagtccatctggtgacagcgtctttcatgaggaaatgatgaagatgagacaagctaagctcgactaccaaaggctgctgcttgagaagagacaaaggaagaagcgccttgaaccattcatggtgcagccgaatcctgaagctcgcctgcgccgagcgaagccacgggcatctgacgagcaaacaccattggttaattgccataccccacactctaacgttattctccacggaatagacggcccagccgcagtgctgaagcctgatgaggtgcacgctcctagtgtcagcagcagcgtggtcgaagaggacgcagagaataccgtcgacactgcaagtaagcctggcctgcaggaacgtttgcagaagcacgatatttcagagagtgttaatttcgacgaggagaccgatggcattagtcagagcgcttgtctggagagacccaactctgcctctagccagaatagcacggacacaggaacaagcggaagcgccacagctgcccaacctgccgacaacctgctgggggatattgatgacctggaggacttcgtgtacagccctgcaccccagggtgtcaccgttagatgtcggataatccgcgacaaacgcggaatggaccgaggtctgttcccgacatactacatgtatctcgaaaaggaggagaaccagaaaatttttttattggctgccagaaaacgcaaaaaatccaagactgccaattatctgatctcaatcgatcctgtggacctgagtagggagggggaatcatacgtaggaaagctaagatctaatctcatgggcactaagtttaccgtgtatgataggggcatttgccctatgaaaggtagaggactggtgggggcagcccacactagacaggagctggcggcaatctcatacgaaactaacgtcctcggattcaaaggccctcgaaaaatgtccgtgataattccaggaatgaccctgaaccataaacagattccatatcaaccgcaaaacaaccacgattctctcttatctcgctggcagaaccggacgatggagaatctggttgagctccacaacaaggctccagtgtggaattccgatacccaatcttacgtgttgaacttcagaggccgtgtcacccaggcctctgtgaagaactttcaaatcgttcacaagaatgaccctgactatattgtgatgcagtttggtcgggtggcagacgatgtattcaccttagattacaattaccctctgtgtgccgttcaggctttcggaatcggcctgagttccttcgattccaaattggcttgcgagtag

SEQ ID NO: 245482 - DNA, 513 bp, Artificial Sequence
  Description of Artificial Sequence: Synthetic coding sequence
atgatgaaaatgagacaggcaaaactggattatcaacgcctgctgctcgaaaagaggcaacgtaagaagagactggaaccattcatggtgcagcccaaccccgaagccagattgagacgagctaaacctcgagcttccgacgagcaaaccccattggtgaattgccataccccccatagcaatgtcatccttcacggaatagatggaccagccgcagttctcaaaccagacgaggtccatgcaccatccgtgtcctctagcgtagtggaagaggatgctgaaaataccgtcgatacggcgtccaagccaggtctccaagagcggctgcagaaacatgacatcagtgaaagcgtcaactttgacgaggagactgatggtatttcccagtcggcctgtctcgagcgccctaacagtgccagctctcaaaatagcacctttagctcattctgtcagaaaacagaagatactggttatcgccattttagattttgctattgcagacccacatcgtag

SEQ ID NO: 245483 - DNA, 801 bp, Artificial Sequence
  Description of Artificial Sequence: Synthetic coding sequence
atgctgaagaccccatggatacttctgcccagtcaggactttcgtagtgtgagtaaaagtatggacaccggaacaagtggctccgccaccgccgcacaaccggcagataatctgttgggggacatcgacgacctggaggactttgtctattcccccgctccacagggagtgacggtgcggtgccggattatccgggacaagagagggatggatcggggattatttccaacatactacatgtacctggaaaaggaagaaaaccagaaaatttttttgctggctgctcgcaaacggaaaaagagtaaaaccgcgaattaccttatatcaatcgatccggtggacctgtctagagagggggagtcatacgttggcaagctgaggtccaacctgatgggtactaaatttacagtttatgatcgtgggatttgtcccatgaaaggcaggggcctggttggtgcggctcatacccgccaggagctggcggctatctcctataaccacgactctctgctctctcgctggcaaaacaggaccatggagaatctggtggaactccataataaggccccagtctggaactctgatacccagtcttacgtgctcaattttagaggtcgcgtgacccaggcctccgtgaagaatttccaaatagtgcacaagaacgatcccgactatatcgtcatgcagttcgggagagtcgccgatgatgtgtttacactggattacaactaccctctgtgtgctgtccaagcgttcggcatcggcctgtcaagcttcgactcaaaactggcttgtgaatag

SEQ ID NO: 245484 - DNA, 1506 bp, Artificial Sequence
  Description of Artificial Sequence: Synthetic coding sequence
atggaggcctccaggtgccgactctcgcctagtggcgacagtgtttttcatgaagagatgatgaagatgcgacaggctaaactggattatcagagactgcttctggagaaacgtcagaggaaaaaaaggctggaaccctttatggttcagccaaatccagaggctcgcctacggcgagccaagcccagggctagcgatgaacaaactccgcttgtgaattgtcacaccccgcacagcaatgtgatcctgcacggaatagatggcccagctgctgtactcaagcctgatgaggttcacgctcctagcgtgtcatctagcgtggttgaagaagatgcagagaacactgtggatactgcatcaaagccaggtttacaggagcgattgcagaaacacgatatttccgagtcagtcaactttgatgaagagacagacggcattagtcagtcagcttgtcttgagaggcctaattcagcatcatcccagaattctactgacacaggcacatcaggtagcgccaccgctgcccagcccgctgataatctccttggcgatatcgacgatctggaagacttcgtgtatagcccggcaccacagggtgtcaccgttaggtgccgaatcattcgcgacaagagaggcatggaccgaggcttatttcccacctattacatgtatctagagaaggaggagaatcagaagattttcctgctggctgctagaaagagaaagaagtctaagactgcaaattatctgatttctatagatccagttgatttaagcagagagggggagagctatgtcggaaaactccggtccaacctgatgggaaccaagttcacggtttatgataggggcatctgcccaatgaagggcagggggctcgttggagccgcacacactcgacaggaactcgccgcaatttcttatgagaccaatgttctagggtttaaagggcctcgaaagatgagcgttatcattcccggaatgacccttaatcataagcagattccatatcaaccacagaataaccatgactctctcctgtcacgatggcagaatcggacaatggagaatcttgtcgagctccacaacaaggcacctgtatggaatagtgacacacagtcatacgtgctcaactttaggggtagagtaactcaggccagcgttaagaattttcagattgtgcataagaacgaccccgactatatcgttatgcagttcgggagagttgcagacgacgtttttactttggactacaactatcccctctgtgcagtccaagcttttgggatcggcctgtcgtccttcgataaatgcatacagactctgcgcatgcaggaactctgtgagctgcacaggcagcaccactccgccgcatctctagttcataggaccgtgtgtcagcggtgggtgggccacccctggcgactgctcccccaaacatcccttctttggactgacctctcacccccacccgtggtgcccgcaccccatcaaatttccatgtag

SEQ ID NO: 245485 - DNA, 1269 bp, Artificial Sequence
  Description of Artificial Sequence: Synthetic coding sequence
atggctctgagcgacgagccagctgctggaggcccagaagaggaggccgaggatgagaccctggctttcggcgctgccctggaggcttttggagaaagtgctgagacgagagctctcttgggacgtctccgggaggtccacggagggggtgcagagcgagaagttgccctcgaacggttcagggaatggatgatgaatttactgttggatatcgtacaggatcagactagtcctgctagcttggtgcatctcgcgtttaaatttctatatataattaccaaagtccggggttacaagactttcctcagactctttcctcatgaggtcgctgatgtggaacctgtgcttgacctggtcactatccagaacccaaaagaccatgaagcctgggaaacacggtatatgctgctcctgtggctgtccgttacctgcctcatccccttcgatttcagtaggctcgatggtaacctcctgacccagcccggtcaggctcgtatgagtataatggaccggattcttcagatcgcagagtcttatttgatagtgtcagataaggctagggacgctgctgctgttctggtgtcaagatttataacaaggccagacgtgaagcaatccaaaatggccgagtttctggactggtcgctgtgtaatttggctcgttcctcatttcagacaatgcagggcgtgattaccatggatggtacgcttcaggctttggcccagatttttaaacacggaaaacgagaagattgcctgccctacgccgctaccgtccttagatgcctggatggctgccggctgcctgagagcaaccagactttgctgcggaaacttggggttaagctagtgcagcgcctgggacttaccttccttaagccgaaagtcgccgcatggcgataccagaggggatgtagaagcttggccgcaaatttgcaactgctgacacaaggacagagcgagcagaaaccattaatccttaccgaggacgacgatgaagacgacgacgtgcccgaaggagtggaacgggtgattgagcagctgcttgtgggtctgaaggataaagataccgtcgtcaggtggagcgctgccaagggcataggtaggatggcagggagactgccgagagcgttagcagacgatgtggtgggttcagtgctagattgtttctcctttcaagagacagacaaggcctggcacggaggatgtctggctttagcagaactgggcagacgagggctgctactcccctccaggctcgtagattag

SEQ ID NO: 245486 - DNA, 2997 bp, Artificial Sequence
  Description of Artificial Sequence: Synthetic coding sequence
atggacggaactcttcaggcccttgcacagatctttaagcacggcaagagagaggactgcctgccttacgctgctactgttctccgctgcttagacggctgccgattaccagaatctaatcagacactccttcgtaaactcggcgtcaagctggtacagaggttgggtctcacttttctgaaacccaaggtggctgcctggaggtaccagcgtggttgtcggagcttagctgcgaatctgcagttactgacacaaggccagtcggagcagaagccactcatcttaaccgaggatgatgacgaggacgatgacgtgcccgagggggtcgaaagagtaatagaacagttgctcgttggactgaaagataaggacactgtggtgaggtggagcgccgcaaagggcattggcaggatggccggtaggcttccacgggctctagctgatgatgtggtgggatcagtactggattgtttctccttccaggagaccgacaaagcgtggcatggcggatgcttggctttggcagagctcggcagaagaggactactactgccctcccggctcgtcgatgtcgttgctgtaatcctcaaggctttaacctacgacgaaaagcggggtgcatgttcagtcggaactaatgtgagggatgccgcttgctacgtgtgttgggccttcgctagggcctatgagccccaggagctgaagccgttcgtgacagcaatttcttctgccctggtgatcgccgcagtcttcgacagagatattaactgtagacgcgcagcatcggcggcattccaggagaacgtggggcgacagggtacattccctcatgggatagacattttgaccactgcagactactttgcagttgggaacaggtctaactgctttctggttatatctgtattcatagctggctttcctgaatacactcaacccatgattgaccacttggtcactatgaagatatctcactgggacggtgtgattcgagagcttgctgcgagagcgctccacaacttggcgcaacaggcgcctgaattctccgcaacacaggtcttcccacgtttgttgagcatgacactgagtcctgacctgcacatgagacatggttctattttagcttgcgcagaagttgcctacgctctatataaactcgccgctcaggaaaataggcctgttaccgaccacctcgacgagcaggcagtccagggcttgaaacaaatccatcagcagctctacgatcggcaactgtatcgtggcctcggtgggcagcttatgcgccaagccgtctgcgtcctaattgagaaactttccctgtcgaagatgccttttcgtggtgatacagttatcgacgggtggcagtggctgattaacgacactctccggcaccttcacctaatctcctcccacagccgacagcagatgaaagatgctgctgtgagtgccctggccgctttatgttcagaatactacatgaaagaacccggagaggcggatccggctatccaggaagaattgatcacccagtatctggccgagctcaggaacccagaggaaatgactcgatgtggatttagtctggccttgggagcattgcctggttttttgttgaaaggccgtcttcagcaggtgttgacggggcttcgggctgtcacacacaccagcccggaagatgtttcattcgctgagtcccgccgtgacggactcaaggctatcgcaaggatctgtcagacagtgggagtgaaggccggtgcacccgatgaagccgtgtgtggagagaacgttagccagatctactgtgcactgctagggtgcatggatgactacaccaccgattctcgaggagacgtcggcacttgggtacgcaaggctgccatgacgagcctgatggatctgacactgttgctggcgaggtcacagcctgagctgattgaggcacatacttgcgagaggatcatgtgttgtgttgcacagcaagcaagtgagaagatcgaccggttccgggcacatgcagcaagcgtattcctgactcttttgcattttgatagtccgccaattccacatgtgccccatcggggtgagcttgaaaaactcttccctcgctctgacgtggcatctgtgaactggtctgcaccaagccaggcttttcctaggattacgcaattgctgggtctccctacctaccgctatcatgtgttgcttggcctcgtggtgtccctgggcggactgactgaaagtaccataaggcatagtacccagtccctcttcgagtacatgaagggtattcaatccgaccctcaggcactaggctcctttagcgggacactcttacagatctttgaggacaaccttctaaacgagagggtgagcgtgcctctactgaaaaccctggaccacgtgttgacacacggatgttttgatatcttcactacagaagaggaccatccattcgccgttaaattgctggccctttgtaaaaaagagatcaaaaacagtaaagatattcagaagctcttgagcgggatcgcagtagacttcccctccgcgacacttgtttgcgtgggcacagtgcagatgtatgcccatacccatcttcggttgggcgcaccaggtccccactgtgctcatggctctgccttacccaggttttgcgagatggtgcagttccctggcgacgtacggagacaagcactgctgcagctatgcctgctactgtgtcaccgcttccccctcatcagaaaaacaaccgcctctcaagtttacgagacattgctaacgtactctgacgtagtcggtgcagatgtgctggacgaagtagttactgtattatccgacaccgcctgggatgcagaactggccgtcgtgcgggagcaaaggaacagattatgtgatctcctaggggtccccccttcttggtgcccaacatggtgcctgttgaaaccggtgctggagccgatcccacacccttgtctggtgaggatgtcatgttcttag

SEQ ID NO: 245487 - DNA, 3579 bp, Artificial Sequence
  Description of Artificial Sequence: Synthetic coding sequence
atggctctgtccgacgagccagcagctggagggccagaagaagaggccgaagacgagaccctcgcttttggagctgcgcttgaggccttcggggagtccgccgagactcgggcactcctcgggaggctgcgtgaggtccatggcggaggtgcagaaagggaagttgcgctggaacgtttccgagtaatcatggataaataccaggagcagcctcacctgcttgacccccatctcgagtggatgatgaacctgctgctcgacatagtccaagaccagaccagcccagccagcctcgtccatcttgcctttaaatttctctacataatcaccaaggtcagaggatataagacgtttctccgcctgtttccccatgaggttgcagatgtggaacccgtgctcgacctagtaactattcaaaatcccaaggatcatgaggcttgggaaaccaggtacatgctattgctgtggctgagcgtgacatgtttaatccctttcgatttctcgcggttagacggaaacttgctaacacaacccggacaggcaagaatgtccattatggacaggatcttacagattgctgagtcctacttgatcgtgtcagataaggccagggatgccgcagccgtccttgttagtaggttcataacccgccctgacgttaaacaaagcaagatggctgaattcctggattggtcactgtgtaacttggcgcgaagttcattccaaacaatgcagggcgtgatcaccatggatggcactctgcaggctcttgcccagatttttaagcacggcaagcgcgaggattgtttaccctatgctgccactgtgctgagatgtctcgatggctgtcgactccccgagagcaatcagacgttgcttagaaagctaggcgtgaaactcgtgcaacggcttggattgacattccttaaaccaaaggtagcagcctggaggtatcaacgaggctgtcggtcactagccgcaaacctgcaactgctcacacagggccaatcagaacagaaacccctgatccttacggaggacgacgatgaggatgacgacgttcctgagggcgtagaacgcgtcatagaacaacttcttgtgggtctgaaagacaaggataccgtggttagatggtccgccgctaagggaatcggtcggatggctggtcggctcccgcgtgccttagccgatgacgttgtcggaagcgtcctggactgcttttcctttcaggagacggataaagcctggcacgggggatgcctggcattagctgaacttgggagaagaggtctgcttctgccatctcgtctcgtagacgtggtagcagttatcctcaaagcccttacttatgatgaaaagagaggcgcttgtagtgtgggtacaaacgtaagagatgccgcttgctacgtgtgttgggccttcgctcgggcatatgagcctcaagagttgaagccgtttgtgacagccatcagctccgccctggtaattgccgctgtttttgacagagacattaactgtcgtcgggcagcctctgccgctttccaagagaatgtgggcaggcagggcacattccctcacggcatcgacattttgacgaccgcagattacttcgccgtggggaacagaagcaactgcttcctggttatcagcgtctttattgctggcttccctgagtatacacagcccatgatcgaccacctggtaactatgaagatcagccactgggatggtgtgatcagggagttggcagcaagggcgttgcacaacttagctcagcaggctcctgaattcagcgctactcaggtgttccctaggttgttgtctatgaccttatcacctgacctgcatatgaggcacggatctatcctcgcttgtgccgaagtggcctatgccctttataagctggcagctcaggaaaatagacccgtgaccgaccatttagacgaacaggccgtacagggacttaaacaaattcatcagcagctctatgacagacagctttatagaggactgggtggacagctcatgagacaggctgtttgtgtcttaattgaaaaactctctctatctaagatgccattccgcggtgacacagtcatcgatggctggcagtggctgattaacgatacacttaggcatcttcacctgatctctagccactcccgtcagcagatgaaagatgcggcagtctcagcactggctgcgttatgcagcgaatattatatgaaggaaccgggagaggccgatcctgctatacaggaggaactgattacccaatacctggccgagctccgcaaccctgaggaaatgacacggtgtggattctccctggcccttggggctctgcctggcttcctcttgaaggggagactgcagcaagttctgacagggctccgagccgttactcacacctctccagaggacgtctcattcgcagaaagcagaagggacggcctcaaggccatcgccagaatttgtcagactgtgggcgtcaaggcaggggcacctgacgaggcagtttgcggagaaaacgtgtctcaaatatattgcgctctcctcggctgcatggacgattataccactgattctaggggagatgtggggacttgggtgcggaaggcggctatgacaagccttatggatctgacactcctgttggcgaggtctcagccagaattgattgaggcccatacctgtgagcggattatgtgctgcgtagcgcagcaggcctctgaaaagatagataggtttcgggcacacgcagcctccgttttcttaaccttgcttcattttgactctcctcctattcctcacgtccctcacagaggcgagcttgagaagttgtttccaagatccgatgtcgcctccgtgaactggagcgccccttctcaggcatttcccagaatcacacagctgctgggtcttccgacgtaccgatatcacgtgctgctcgggttggtggtgagcctggggggtctgactgagagcacaatcaggcattctacacagagtctctttgagtacatgaagggtatccagagtgatccccaggctcttggttcattttccggaaccctgctgcaaattttcgaagataatctccttaatgaacgagtttctgtgcctctgcttaaaaccctcgaccatgtgctgactcatgggtgtttcgacatcttcacaacggaggaggaccatccttttgcagtcaaattgctggccttgtgcaagaaagaaataaagaatagcaaagacatccagaagctgctgagcggcattgccgtattctgtgagatggtgcagtttcctggagatgtgagacgccaggcactgctccaactgtgcctgttgctctgccaccgttttcctctcatcagaaagactacagccagccaagtgtacgagacactgcttacttattcggatgtcgttggtgcagatgtactggacgaggtagtgaccgtgctctcggacacagcttgggatgcggagcttgccgtcgtcagagaacagagaaaccgactctgcgatctgttaggggtgcccagaccacaactagtgcctcaacccggtgcttgttag

SEQ ID NO: 245488 - DNA, 936 bp, Artificial Sequence
  Description of Artificial Sequence: Synthetic coding sequence
atggccggacgactacccagagccctggcagatgatgttgtggggtccgttctggactgcttcagtttccaggagactgacaaggcatggcatgggggttgcctggctcttgctgagctcggccgacggggtttgctgctgccgtcccgtctcgtagatgtggtggctgtaatcctgaaagccctcacatacgacgagaagaggggtgcctgttctgtcggcaccaatgtacgggatgccgcatgctatgtgtgctgggctttcgctagggcatacgaaccacaagagctcaagccctttgttaccgcaatttcaagcgccctagttatagctgccgtgttcgaccgggacattaattgcaggagggctgctagtgcggcttttcaggagaatgtcggacggcagggaaccttcccacacggtatagacattctgacgactgctgattattttgcggtggggaatagatccaactgctttctggtgatttcagtgttcatcgccggtttccctgagtacacacaaccgatgattgatcacctggtgacgatgaagatttcccattgggatggtgtgattcgcgaactggcggcaagagcccttcataacttagcacagcaggcgccagagttttccgcaacccaggtcttccccagattactaagcatgactttgagtcctgacctccacatgaggcacggatctatcctggcatgcgccgaggtggcttacgccttatacaaactggcagcccaggagaaccggcctgtgaccgaccaccttgacgagcaggccgtgcagggactgaaacaaatccaccagcagccatgtatatgcagttgggggctcatgtcccctgagagcaaagctgagttctgcgtctgcgtctgcagaattagcctgggaagacaatgtgttcaccttagcggcctctag

SEQ ID NO: 245489 - DNA, 2253 bp, Artificial Sequence
  Description of Artificial Sequence: Synthetic coding sequence
atggccctcagtgacgaacctgcggctggagggccagaggaagaggccgaggacgaaactctagcttttggagccgctctggaagcctttggagagagcgccgaaacacgcgctctcttaggcaggttacgagaggtacatggtggaggggctgaaagagaagtagcgctggagagattccgggtgatcatggacaaatatcaggagcagccacatctgctcgatccacatctcgaatggatgatgaatctccttttggacatcgtccaagatcagacttcccccgcatccctggttcacctggctttcaagtttctttacattattactaaggtccgtggttacaagactttcttacggctgtttcctcacgaagtagcagatgtagagcctgtgctcgacctggtcacaatccaaaacccgaaggaccacgaagcgtgggagacaaggtatatgctgttattatggctgtccgtgacgtgtctcatcccctttgatttttcaaggttggacggcaacctgctgacccaacccggtcaggcgaggatgtccattatggatcgaattctccaaatagccgaatcgtatttaatcgtatccgacaaggcaagggacgcagcagccgtgctggtctcccgttttataacccgtcccgatgtcaagcagagtaagatggcggagtttctggactggtcactgtgtaatcttgcccgatccagcttccagacaatgcaaggcgtgataaccatggacggcactcttcaagctctggcccagatctttaagcacggcaagagagaagattgtctgccgtatgccgctacagtgctgagatgccttgacggttgtcgccttccagagtccaatcagaccttactgcggaagttaggggtcaagcttgttcagagactcgggctgacgtttctcaaacccaaggtagcagcctggagataccagcgcggatgtcggtctctagccgctaaccttcaactcttaacacaaggccagtctgaacagaagccactcattctaacagaggatgatgatgaggatgatgatgtcccggagggcgtcgaaagggtgattgaacagttgctggtgggtttaaaagataaggatactgttgtccgctggtccgccgctaaaggaattgggaggatggctggcagattacctcgggctctcgcagacgatgttgtggggtcggttctcgattgcttcagcttccaggagactgataaagcctggcacggtgggtgcctggccttggctgaactgggaagaagaggactactgttgccatcaaggcttgtggatgttgtggccgtgattttaaaggctctaacgtacgatgaaaaacgaggtgcctgtagcgtgggcacgaatgttagggatgcagcttgttacgtgtgctgggccttcgcaagggcttacgagcctcaagaactgaagccttttgtgaccgctatatccagtgccctggtcattgccgctgtgtttgatcgggacattaactgtaggcgggcagccagtgcagccttccaggagaacgtcggccgacaggggacatttcctcatggtattgatattctgacaacagccgactatttcgcggttggcaaccgctctaattgctttttggtcattagtgttttcatagcgggattccccgaatacacccagccgatgattgaccacctcgtgacaatgaagatatcgcactgggacggggttatcagggaattagcagccagggccctccataatttggcccagcaggctcctgagtttagcgccacccaggtcttcccacgactgctctctatgacgttatctcctgatctccacatgcggcatgggtctatccttgcgtgtgccgaggtggcatatgctctgtataaactagctgcccaagaaaaccgccctgtgaccgaccatctagacgaacaggctgtgcagggactcaagcagattcaccaacagctttatgaccgccagctctataggggactcggtgggcagctgatgagacaggccgtgtgcgttttgatcgagaaactaagcctatcaaaaatgccttttcgcggagacaccgtcattgacggatggcagtggttaattaacgactctctttggctactcgtgggactcggacggccaagccgcctgccctcggaacggcctgcaccagccggaagtcacagattcaagtcttcctatccacatttcccccgtggcaggaaattttgctag

SEQ ID NO: 245490 - DNA, 555 bp, Artificial Sequence
  Description of Artificial Sequence: Synthetic coding sequence
atgaaaggaatccagtctgaccctcaggccctcggctcattttccgggactttgctgcagatctttgaggacaatctgctaaacgaacgcgtgagcgtaccactgttgaagactttggatcacgtactaacgcatggctgtttcgatatcttcaccaccgaggaagatcatccttttgccgtcaagctcttggccctgtgtaagaaagagattaagaacagcaaggacattcaaaaacttctgagcggaattgccgtattctgcgagatggtgcaattcccaggtgatgtgaggaggcaagcgctgctgcaattgtgtctgcttctttgccacagatttcccctgattcgaaagacaactgctagccaggtatatgagacgttactgacttactcagatgtggtgggagccgatgtgttagacgaagttgtaaccgtcctgagtgataccgcctgggatgcagaactagccgtcgtcagagaacagcggaaccggctgtgtgacctgctgggggtcccccgtccacaactagttccccagcccggtgcttgctag

SEQ ID NO: 245491 - DNA, 1584 bp, Artificial Sequence
  Description of Artificial Sequence: Synthetic coding sequence
atgtcggatacattaactgcagatgttattggcaggagggtcgaagtgaatggtgaacatgcgactgtaagattcgccggagtggtcccgcctgtggctggcccatggctgggggttgaatgggataaccccgaaagaggcaagcacgacggcagccacgaaggcaccgtgtactttaagtgtcgccaccctacaggcggttctttcataaggcccaataaggttaattttggtacagactttctgactgctattaaaaacagatacgtactcgaggatggaccagaagaggatcgaaaagagcagatagtcacaatcggcaacaagccggtggaaacaatagggtttgattcaataatgaagcaacagagccagctttctaaacttcaggaagtaagtctgcgcaattgcgcagttagttgtgccggagagaagggcggtgtggctgaagcctgcccgaacatccgtaaggtggacctgtcaaagaacctgctgagctcttgggacgaggtgattcatatagcagaccagctcagacacctggaggtcctcaacgtctccgagaataaactgaagttccccagtgggagtgtcctcacgggtacgctgagcgtattgaaggtattagttcttaaccaaaccgggatcacttgggctgaggtgctgagatgcgtggccggttgtccaggactggaagaactgtatttagaatcaaataacatatttatttctgagcgccctaccgacgtcctgcaaaccgtgaaactgttggacttgtcttctaaccagctcatagacgaaaaccagctttacctcattgcgcaccttcctagactggagcagttgattctgtcggatactggcatttcatctttgcactttcccgacgccggaataggatgcaaaacaagcatgttcccttcacttaaatatcttgtggtaaatgataaccagatatctcaatggtccttctttaacgagctcgagaaactgcccagcctgagagccctcagttgcctccgcaaccccctgacaaaagaggataaggaggccgagaccgccagactgttaatcatcgcctcaatcgggcagctcaaaacactcaacaagtgcgagattctgcccgaagaaagaagaagagccgagctcgactaccgaaaagcattcggcaacgaatggaaacaggccggagggcacaaggatccggagaaaaaccggttgtcagaggaatttttgactgctcaccctcgctaccaatttctctgtctaaagtacggagctcccgaggattgggagctgaaaacccaacagcccctcatgctcaagaaccagttactgaccttgaaaataaagtacccgcatcagctcgatcagaaggtgttggagaagcagctccccggttctatgaccatacagaaagtgaaaggtctcttgtcgaggctgttgaaggtgccagtctccgacctcctgctctcctatgagtcgccgaagaagccgggacgagagatcgaactggagaacgacttgaagtccttacagttctactctgtggagaatggggattgtttactagtgcgttggtag

SEQ ID NO: 245492 - DNA, 1584 bp, Artificial Sequence
  Description of Artificial Sequence: Synthetic coding sequence
atgtccgacactttgacagccgatgtgatcggcagacgcgtggaggtaaacggagaacatgctacagtccgctttgctggggtagtgcctccggtagctggaccctggctcggagtggagtgggacaaccctgagcgagggaagcacgatgggtctcatgagggtaccgtttacttcaagtgccggcatcctaccgggggaagcttcattagaccaaataaggttaattttggaaccgattttttaacagccattaaaaataggtatgtgctcgaagacggtcctgaggaggacaggaaggagcaaattgtcactatcggcaataaaccagttgagaccatcggctttgacagcataatgaagcaacagtcacaactcagcaaactacaggaggtgtccctgcggaactgcgccgtctcttgtgccggagaaaaaggtggagtggccgaagcatgtcccaacatccgaaaagttgatctgtccaaaaacctgttaagctcctgggatgaggttattcatatcgcggatcaattgcggcacctggaggtactcaacgtgtctgaaaacaagcttaagtttccgtctgggtcggtgctgaccggcactctttccgtgctcaaggtcctcgttctaaatcagactggcatcacgtgggcagaagttttgaggtgcgttgccggatgtcccggtctggaggagctgtatctggagagtaataacatctttatctccgaacgccctaccgatgtcctacagaccgtaaaactgctggatctcagctcaaaccagctgatcgacgagaatcagctctatcttatagcgcatttgccacgtctggagcagctgattctaagcgataccgggatttcatccctccacttccccgacgctggaatcggttgtaagactagtatgtttccgtcattgaaatatctggtagtcaatgacaaccaaatctcacagtggtccttcttcaatgagctcgagaagctgcctagtctgcgcgcactcagctgcctcagaaaccccttaacaaaggaagacaaagaggctgagacagcacgattgctgattatcgccagtataggacagctgaagaccctgaataaatgcgaaattctgcccgaagagcggcgacgcgctgaactcgattaccgaaaggcttttgggaacgagtggaagcaagctggaggacataaagaccccgaaaagaatcgactaagcgaggagttcctgactgcacatccacgatatcagtttctgtgcctcaagtacggggcacccgaggattgggagctgaaaacgcagcagccactcatgctgaagaaccagctcctgactttgaaaattaagtatcctcaccagttagatcagaaagtgctggagaagcagctaccgggatccatgactatccagaaggtgaagggcctgctctcgagattattgaaggttccggtgagtgatctgttactcagctatgaatctcccaaaaagccagggagggaaatagaacttgaaaatgacctcaaatccctacagttctatagtgtggagaacggcgattgcttgctggtccggtggtag

SEQ ID NO: 245493 - DNA, 1737 bp, Artificial Sequence
  Description of Artificial Sequence: Synthetic coding sequence
atgagtgacacacttacggctgacgtcataggcagacgcgtggaggtaaacggagagcacgccaccgtcaggttcgcaggtgtggtccccccagttgccggaccctggctcggtgtggagtgggataatcctgaacgaggcaaacacgacggctcccacgaagggactgtgtacttcaaatgcagacatccaacaggcggaagttttatcaggcccaataaggtgaattttggcactgactttctcacagccattaagaatcgttatgtcctggaggacggccctgaggaggataggaaagagcagatcgtgacaatcggaaacaagccagtggagactatcggatttgatagcatcatgaaacagcagtcccagctgtctaagttacaggaagtttccctgaggaactgcgctgtgtcttgcgcgggtgagaagggtggggtcgctgaggcatgccccaatatccgcaaagtcgatctgtccaagaatttactgtccagttgggatgaggtgatccacatagcagatcagttgcgacacctggaagtcctcaatgtcagcgagaacaagttaaaattcccctcaggatcggttctgacaggcactttaagcgtattgaaggtgcttgtgctgaatcaaacaggtatcacctgggcagaggcacatgcacagtgcggtggctcaaggcatgggctggatatgcagaaggacgcgagcaaatttgttgatttgtgcgtgcttcagaaatgtagcacatctaactgcattatttctgcgaaggaccacacctcaatgcggatgaatgttgccaaagttcttaggtgtgttgcaggctgtccagggctggaggaactgtacctagagagtaacaatatttttatctcagagcgacctaccgacgtgctgcagaccgtgaagctgctggatctctctagtaaccagttaatcgatgagaaccagctgtatctaattgcccacctgcctcggttagaacagctgattctgtccgatactggaatttctagtctgcacttcccagatgctggcatcgggtgtaaaaccagcatgttccccagtctaaaatatctcgtggtgaatgacaatcaaataagtcagtggtcctttttcaatgaactggagaagcttccaagtcttagggcactgtcctgtctgaggaatccactgacaaaagaagacaaagaggccgagacagcgaggctgttgattattgcaagtataggacaattgaagacgttgaataaatgcgaaattttaccagaggagcggaggcgggctgagttggattaccgcaaagcgttcggtaacgagtggaaacaggcgggaggccacaaggaccctgaaaaaaaccggctgagcgaagagtttttgactgcccatcccaggtatcagtttctttgcctgaaatatggtgccccagaagactgggagcttaagactcagcagcctttgatgttgaaaaaccaacttctcacacttaagatcaagtaccctcaccagctggatcaaaaggtactggaaaaacaactccctggatctatgactatccaaaaagttaagggcctgctctcaagactcctgaaagttcccgtttcggacctacttctgtcttatgagtccccgaaaaagcccggaagagaaatcgagctggagaacgatttgaaaagcctgcagttttactccgtcgagaacggggattgtctcctcgttcggtggtag

SEQ ID NO: 245494 - DNA, 2001 bp, Artificial Sequence
  Description of Artificial Sequence: Synthetic coding sequence
atgatccacgaacttctcttagctctgtccggttatcctggctccatctttacatggaacaaacgttccggcctgcaagtgtcccaggacttccctttccttcatccgagcgaaactagcgttctcaatagattgtgcagactcggaaccgattacatccggttcaccgagttcattgaacaatacacagggcatgtccagcagcaggatcaccatccctctcagcagggccaagggggtctgcacggcatctacttgagggcattttgtaccggactcgactcagtgctgcagccctacaggcaggccctgctcgatctcgaacaagagttcttgggggatcctcacctgtctatctcccatgtgaattatttcttggaccagtttcagcttctgtttcccagcgttatggtggttgtcgagcagattaaatcacagaagattcatggatgtcagattctcgagactgtctacaagcacagttgtggaggcctccccccagtgagatcagctctggaaaagattttggccgtatgtcacggtgttatgtacaagcagttgagcgcatggatgttacatggtctcttgctcgaccagcacgaagaatttttcataaaacagggacccagtagcggcaatgtctctgctcaaccagaggaagatgaggaagaccttggtatcggcggattgaccgggaaacagctgcgcgagctgcaggacctgcggctgatcgaagaggagaacatgctggccccttccctgaagcagttcagtcttagggtggagatcctcccgagttatatacctgtcagggtggccgagaagatcctgtttgtgggagagagtgtacagatgttcgagaaccagaatgtcaatctgacacgcaaagggtccatccttaaaaaccaggaggatacttttgccgctgaactgcacagactgaagcaacaaccacttttctctctcgtagacttcgaacaggtcgttgatcgcatacgttcaactgtggccgagcacttatggaaactcatggtggaggagtctgatttacttggacagctcaaaatcatcaaagatttctacctcctgggacggggtgagctttttcaggcatttatagataccgctcagcatatgttaaagacacctcctactgctgtcaccgagcacgacgtgaatgttgcgtttcagcaatcagctcacaaggtcctactcgacgacgataacctgctgccactgcttcatctgaccattgaatatcacggcaaagaacataaggacgctacccaggccagagagggcccaagccgagaaactagccctcgcgaggctcctgcctcagggtgggccgctctagggttaagctataaggtacaatggccgctccatatccttttcacgcctgccgtgctggaaaaatacaatgtcgtgtttaaatatcttttaagcgtccggagggtccaagctgagttgcagcattgttgggctctccagatgcagcgcaaacatctgaaaagcaatcaaacagatgcaattaaatggcgcctccgcaaccacatggcattcctggttgacaatctacagtactatttgcaggtcgatgtcctggagtcacagttcagccagcttttgcatcaaatcaactcaacacgtgacttcgaaagtatccgactggcccatgatcattttctgtctaatttgcttgcccagtcgttcatcttactgaaacccgtgttccactgcctcaatgagatcttagatctgtgccacagtttctgttccttggtgtctcaaaatctgggacccctggatgaacgaggcgcagcacagcttagcatcctcgtgaagggtttctcccgacagtcgagcttattgtttaaaattttatcttctgttaggaaccaccagatcaattcagacttagcacagctgctgctcagacttgactataataaatattatacacaggctggcggaacactagggtcctttggcatgtag

SEQ ID NO: 245495 - DNA, 660 bp, Artificial Sequence
  Description of Artificial Sequence: Synthetic coding sequence
atggccgataaggcgaagcctgctaaggcagccaacaggacaccaccaaagtcacccggagaccccagcaaggaccgggcagccaagcgcctgagtctagagtcggaaggcgcaggtgagggggctgccgcttccccagaactgagcgctctggaggaggcctttaggcggttcgcagtgcacggcgacgctcgcgcaacaggtcgagaaatgcacggaaagaattggagtaagctttgcaaggactgccaggtcatcgacggaaggaatgtgactgtgaccgacgttgacatagtgttttctaagataaaaggaaaaagctgccgtacaataacctttgagcaattccaggaggcactggaagagctggcaaagaaacgttttaaagataaatcctcagaggaggctgtaagagaggtgcatcgcctgatcgaaggcaaagccccaattatcagcggagtgacaaaagccatttcctcacctactgtcagtcggctgacggatactactaagtttacagggtctcacaaggaacggttcgacccttccggcaagggaaaaggaaaggcgggaagggtggatttagtggatgagtccggctatgtgtccggctacaagcacgcagggacatacgatcagaaggtgcagggagggaagtag

SEQ ID NO: 245496 - DNA, 1071 bp, Artificial Sequence
  Description of Artificial Sequence: Synthetic coding sequence
atgagcaaattgtggcgcaggggctctacaagtggcgcaatggaggcgcctgaacccggtgaggctctggagcttagtctggcgggtgcgcatggacatggagtgcacaagaagaagcacaaaaagcacaaaaaaaaacataaaaaaaagcaccaccaggaggaagacgccggtcccacccagcccagccctgcaaaacctcagttaaagctcaaaatcaaacttggaggtcaggtgctaggcacaaaatccgtgcctacctttactgtcatcccggaaggaccacggagtccaagccctctaatggtcgtagacaacgaggaggaacctatggagggcgtcccactcgagcagtaccgagcatggctggatgaagattctaacctgagcccatcaccactgcgagacttgtcaggcggtcttgggggacaggaggaggaagaggaacagcggtggcttgacgcgctggaaaagggcgagctcgacgacaacggggatctgaagaaggaaatcaatgaacgcctgttaactgcgcgacagagggcccttttacagaaggccaggtctcagcccagccccatgctcccactccccgtagccgagggttgcccaccaccagctttgacagaggagatgctgctaaagcgcgaggaacgcgctcgaaaacggaggttgcaagctgcaagaagggccgaggaacataagaaccagactattgagcgccttactaagacggccgctacgtcaggacgagggggaagggggggtgctagaggcgagcggcgaggcggacgcgctgcagccccagccccaatggtgcgctactgttccggtgcccaggggagtaccctgtcctttcctccgggagtccctgcgcctaccgccgtgtcccaacgcccttcaccaagcggccctcccccaaggtgcagcgtccctggttgcccacatccaagacgatatgcatgctctcgcaccggccaagcattgtgctcccttcagtgttacaggatcaacctacaaatgcgtctcggcggacccgagggacccggatcccctcttctggctacctag

SEQ ID NO: 245497 - DNA, 1272 bp, Artificial Sequence
  Description of Artificial Sequence: Synthetic coding sequence
atggctggcaaggtgaagtgggtgacagacatcgaaaagtctgtgctgatcaacaacttcgaaaaaagaggttgggttcaggtaaccgagaacgaggactggaacttttactggatgagtgtgcagactattcggaacgtgtttagtgtggaagcgggataccgcctgtcagatgaccagattgtgaatcactttcccaaccattacgagttgaccagaaaagacctgatggttaaaaatattaagcgctatcgaaaagagctggagaaggagggctcccccctggccgagaaagacgaaaatggaaaatatttgtacctggacttcgtgcccgtgacatacatgctgcccgcagactacaacctgtttgtggaggaattccgaaagtcccccagcagtacatggatcatgaagccctgcggaaaggcgcaggggaaggggatatttctgattaacaaattgtcacagataaaaaagtggtcaagggactcgaaaacctccagctttgtctctcagtctaataaggaggcctatgtgattagcttgtacataaacaaccccttgctgatcgggggacggaaattcgaccttcgactgtacgtgcttgtgagcacctataggccactgagatgctatatgtataaactcggattttgtagattctgcacagttaagtatacgccttctacatccgaactggataacatgttcgtgcacctgactaatgtggcaattcagaagcacggcgaggactataaccacatccatggcggaaagtggactgtgtccaatctaagactgtatcttgagtccacccgcggtaaggaggtgacctctaaattgttcgacgagatccattggatcatcgttcagagtctgaaagcagtggccccagtcatgaacaatgataaacactgttttgagtgctatggctacgacattatcattgacgataagctgaaaccatggttaatcgaggttaacgctagtcccagcttgacgtcctcgacagcaaacgatagaatactaaagtataatcttatcaacgacacactcaatatcgccgtgccaaacggagaaattcctgattgtaagtggaacaaatctcccccaaaggaggtgctgggtaactacgaaattctgtacgatgaagagctggcccaaggggatggggctgaccgcgaactccgatccaggcagggccagtccctgggcccacgggctggcagatcacgtgattctggcagagctgtcctgacgacatggaagtag

SEQ ID NO: 245498 - DNA, 1185 bp, Artificial Sequence
  Description of Artificial Sequence: Synthetic coding sequence
atggctggaaaggtcaagtgggtgaccgacattgaaaaatccgtgctgattaacaacttcgaaaagcgcggatgggtgcaagttaccgagaatgaagattggaatttctactggatgtccgtacagacaatcaggaatgtattctcagtggaagccggataccggctgagtgatgaccagatagtgaatcacttccctaaccactacgagctaaccaggaaggacctgatggttaagaatattaagcgatatcggaaggaactggagaaggagggaagcccactggccgagaaagatgagaacggaaagtacttgtatctcgacttcgttccagtgacatatatgctgccggctgattataatttgtttgttgaagagttccgcaaaagcccctccagcacctggatcatgaaaccttgtgggaaggcgcagggaaagggaatttttctgatcaataaactatcccagatcaagaagtggtcacgggactcgaaaacctcttcctttgtgtcacaatctaataaagaggcatacgtgatttcgctgtacatcaataatcctctgctgataggcggtcgcaagttcgacctgagactttacgtcttggtctcaacctatcggccattgaggtgttacatgtacaaactgggcttctgccggttctgcacggtcaaatataccccatccaccagtgagcttgataacatgttcgtacatcttactaatgtggctatccagaagcatggagaggattacaatcatatccacggaggcaaatggaccgtttctaatctgcgactgtacctggaatctactagaggaaaagaagtcaccagcaagctgtttgacgagatccactggataatcgtacagtctctcaaagcagtggccgtaaatgcctcccctagtctgacttcctctacggccaatgaccggattctaaagtacaatctcattaacgacacacttaacatagcggtgcctaatggcgagattcccgactgcaaatggaataaaagcccacccaaagaagtgctaggaaattatgaaattttatacgacgaagagctggctcagggtgatggagctgaccgcgaacttcggtctagacaggggcagtcactcggtccccgagctggccgtagcagggattccggaagggctgtcctgactacgtggaaatag

SEQ ID NO: 245499 - DNA, 180 bp, Artificial Sequence
  Description of Artificial Sequence: Synthetic coding sequence
atggctggtaaagtgaaatgggtgacagacattgagaagagcgttttaatcaataattttgagaagcgaggttgggtgcaagtgaccgaaaacgaggattggaatttttattggttactggacctccctgagttcaggtaccgctcatgcctgaatgagttcccagattttagagtgtag

SEQ ID NO: 245500 - DNA, 1068 bp, Artificial Sequence
  Description of Artificial Sequence: Synthetic coding sequence
atgccacatcagcccactatcttgctgaatacagtttcggccagcgcttctccatgcctgcaccccggtgcacagaacattccctcacccaccgggctgcctcggtgccggtctggcagtcacaccattggaccctttagttcgttccagtccgccgcacatatttactcacaaaagctgtccagaccctctagtgcgaaagctgccggatcttgctatctgaataaacaccatagtggtattgctaaaacacagaaggagggcgaagatgcttccctctactcgaagagatataatcagagtatggtcaccgcagaattacagagactggctgagaaacaggccgctcgacagtattcacctagctctcatataaaccttctgacccagcaggtgacgaacctgaatctagccacgggcataatcaatcgctcttccgcctctgcgccaccgacactgaggcccatcatctcaccgtcaggcccaacgtggagcactcagagcgacccacaggcaccagagaatcacagctccagccccggatcacgtagcctgcagacggggggatttgcctgggagggggaagtagaaaacaacgtgtactcccaagcaacaggagtagtccctcagcacaagtatcatccaaccgccggtagttaccagcttcagtttgcccttcagcagctcgaacagcaaaagttacagagtcggcaactgctggaccagagccgagctaggcaccaggctatattcggtagccagaccctgcccaattccaatttgtggaccatgaacaacggagcaggctgtcgcatttccagtgcaactgcatcggggcagaaacccaccacacttccgcagaaagttgtgcctcctccatcctcctgcgcatctctggtgcccaagccaccacccaaccatgagcaggtccttcgcagagctacatctcagaaagcttccaaaggtagctctgctgaagggcagctgaacggcttgcaatcttctctgaaccccgcagcatttgtcccaattacctcgtccaccgtgaattcccataccgcattgtag

SEQ ID NO: 245501 - DNA, 3846 bp, Artificial Sequence
  Description of Artificial Sequence: Synthetic coding sequence
atgccgatcgtcatggcgagggacttggaggaaaccgcctcctccagcgaggatgaagaggtaatcagccaggaggatcatccatgcatcatgtggaccggcggatgccgcaggattcccgttctcgtctttcacgccgacgcaattttaactaaggataataatataagggtaatcggtgagcggtaccacctgagctacaagatcgtcaggaccgattctcggcttgtgcgctcgatcttgactgcgcacggttttcatgaagtacaccctagcagcactgattataacctaatgtggaccggcagccacctcaaaccctttcttcttcggacactctctgaggcccagaaggtgaaccatttcccgagaagctacgaactgacccggaaagaccgcctctataagaacatcattagaatgcaacacacacatggctttaaagcctttcatatactgcctcaaacgttcctgttgccagcagagtatgctgaattttgtaactcgtactctaaggatcggggaccctggatcgtaaaacctgttgccagctcccggggaaggggtgtctatttgataaataacccaaaccagataagcctggaagaaaatattctggttagccggtacatcaacaacccgctcctcattgacgacttcaagttcgatgttcgcctttacgttctggtgacctcatacgaccccctggtgatatacctctacgaagagggcctcgctcgatttgctactgtacggtacgaccagggcgctaaaaatattcggaatcaattcatgcacctgaccaattatagtgtcaataaaaagagcggcgactacgtgagttgcgatgaccccgaagttgaagactacggaaacaagtggtccatgtcagctatgctgcgttatctcaagcaggaggggagggataccacagccctgatggcacacgtagaagatttgataatcaaaactataatttcagctgagctcgccatagctacggcttgtaagacatttgtgcctcatcgatctagctgctttgaactgtatggctttgacgtgctgattgactccacgctaaagccatggctgttagaagtgaatttgtctccctctctggcctgcgatgcaccgttggatctaaaaattaaagcttccatgatatcagacatgtttactgtggttggtttcgtgtgccaggatcccgctcaaagggcctccacgagacccatctaccctacattcgaaagctctagacggaacccttttcaaaagccgcaacgatgtcgacccctgagcgcttccgacgccgagatgaagaatctggttgggtctgctcgggagaaggggcctggtaaactcggcggttctgttctggggttgtcaatggaggagatcaaggttttgagacgggttaaggaggagaacgacaggaggggcggttttatccgaatctttcccactagcgaaacttgggagatctatggcagctacctagagcataaaacaagcatgaattatatgcttgccacacggcttttccaggacaggatgactgctgatggtgctcctgagttgaaaatcgagagcctgaattccaaggctaagctacatgccgctctgtatgagcggaagctgttgagtctggaggtgcgtaaacggaggagaagatcgagccgcctcagggccatgcgcccaaagtacccagtgatcacacaaccagccgaaatgaacgttaaaaccgagaccgagtcagaggaggaggaggaagtggccttagacaatgaggatgaggaacaggaagcttcccaagaggagtcagcagggtttctgagagagaatcaagcaaaatatacccccagcctgactgcactcgtcgaaaatactccgaaggagaactcaatgaaggtacgtgaatggaataacaaaggcggacattgctgcaagctggaaacccaggagctggagccaaaatttaacctgatgcagatcctgcaggataatggaaacctctccaaaatgcaggccaggatcgccttctctgcctatttgcaacatgtgcagatccgccttatgaaggattctggaggtcagacattctccgctagttgggcggctaaagaagatgagcagatggagctggtggtgagattcctgaaacgggcttccaacaaccttcagcacagtctgagaatggtgctgcctagcagaaggttagccctgctagaacggaggaggattctagcccaccagctcggagactttattatcgtctataacaaagagacagagcagatggcagaaaagaagtctaagaagaaggttgaggaggaggaagaggacggtgtcaacatggagaacttccaagagttcattcggcaggcgtccgaggctgagcttgaggaagtactgactttttatacacaaaagaataaatctgcctccgtcttcctgggaacgcactccaagatttccaagaacaacaacaactatagcgacagtggagccaaaggggatcaccccgagacaatcatggaagaagtgaaaatcaaacccccaaagcagcagcagactactgagatccactccgacaaactgtctcgcttcacgactagtgctgagaaggaggctaagctggtttattcaaactcctctagtgggcctactgctaccctccaaaagattccgaacacacatctgagctcggtaaccacatctgatcttagccctggcccttgccatcattcttccctgtctcagatcccgtcagcaattccttccatgccgcatcaaccaaccattcttctgaacacggtgagcgcttcagcatcaccttgtctgcaccccggagctcagaacattccttcacccactggcctgccgcgatgtagatcggggagccacacaatcgggccattttcaagttttcagtctgcggcacacatctacagtcagaaactgtccaggcccagcagcgccaaggccggttcttgttacctgaacaaacaccacagcggaatcgcaaagacacagaaggaaggggaggacgcctccttgtacagtaagcgctataaccagagtatggtgaccgccgaactgcagaggctcgccgaaaagcaggcagccagacagtactcgccttccagccacatcaatcttctgactcaacaggtcaccaatctcaacttggccactggcatcattaatcgctcttcagcaagcgccccaccaaccctcaggccaattatatccccaagcggacccacatggtccacacagtcagatccccaggcccctgagaaccatagttcatcacccggttctcgtagcctccagacagggggtttcgcttgggaaggcgaagttgaaaataatgtctattcccaggccacaggagtcgtgccacagcataaatatcaccccacagctgggagttatcaactccagtttgctttgcagcagctggagcagcagaagctgcagagccggcaattgcttgaccaatcccgcgctaggcaccaggctatctttgggtcccagacactgccaaatagtaatctgtggactatgaacaatggagcagggtgtcgaattagttcagctactgcatccggacagaaacctacgactttgccacaaaaggtggtgccccctccttcctcttgtgctagtctggtacctaaacctccgccaaaccatgaacaagttctgcgcagagctacctcacagaaagcttctaagggctcctccgctgagggacagcttaatggtttgcaatcctcactcaatccggcagcctttgtgccaatcactagcagcacagatcctgcacacaccaaaatctag

SEQ ID NO: 245502 - DNA, 2454 bp, Artificial Sequence
  Description of Artificial Sequence: Synthetic coding sequence
atgaaagagatcaaggttttgcgtagggtcaaagaagaaaacgatcgcagagggggttttatacgcatttttcccacttccgaaacatgggaaatctacggatcatacctcgagcacaaaacctctatgaattacatgctggccaccaggctgttccaagacagggggaatcctcgcagaagcttacttactgggaggacgaggatgacagcagatggtgcacctgaactcaaaatcgagagcctgaacagtaaggccaagctgcatgcagccctctacgagagaaagctactgtctctagaggtccgcaagcgcagacgccgatcctccagactgcgggctatgaggcctaagtacccggtaattacacagcctgctgagatgaacgtcaagactgagaccgagtcagaggaagaagaggaagttgcactggacaacgaggatgaggagcaagaagccagccaggaggagtctgccggattcctcagggaaaaccaggctaagtatacaccaagtttaacggcactcgtggaaaatacccctaaggaaaatagcatgaaagtaagggagtggaacaataaagggggacattgttgtaagctcgagactcaggaattggagcctaaatttaacctgatgcagattctgcaggacaatggcaacctatctaaaatgcaagctcgcattgcattcagcgcctacctgcagcatgtccagatccgtttgatgaaggatagcggaggacaaacattttcagcttcatgggccgctaaggaggacgagcagatggaactggtggtgcggtttttgaagcgcgcatccaataacctccagcactccttaaggatggtccttccctcgaggcgcctcgcactcctggaaaggcgacggattctggcgcaccaactaggggattttattattgtatataataaggagaccgaacagatggccgagaagaaatcaaaaaaaaaagttgaggaggaggaagaagatggtgtcaacatggagaattttcaggaatttatccggcaggcatcagaggctgagctcgaagaggtgcttacgttctatacgcaaaaaaacaaatccgcttctgtctttctgggcacacatagcaagatctccaaaaacaataacaactactctgacagcggcgcaaaaggtgaccatcctgaaacaataatggaagaggttaagatcaagcctccaaaacagcagcagaccacagaaattcactcggacaagctcagcagatttaccacgtcggctgagaaagaagcaaagctagtgtactcaaatagttcgtctggcccaaccgccacactgcagaaaatccccaacactcaccttagcagcgtgactacgagtgatctgtctcctgggccttgccaccactcctctcttagccagatcccttccgctatcccatccatgccacaccagcctacaattttgttaaataccgtctctgcctcagcttctccatgcctgcatcccggagcacagaatattccttcccccacgggcttacctagatgcagatcaggctctcacacaatcgggccattttcttccttccagtcagccgctcatatttacagtcagaagctctctagaccgtcttctgcaaaggctggcagttgctatttgaacaagcatcatagcggcatcgcaaagacccagaaagagggcgaggatgccagtctatactccaagagatataatcagagcatggtgacagcagagctccaacggttggcagaaaagcaggcagcaagacagtatagcccgagctcccatatcaatctcctgactcagcaggtgactaatctgaaccttgcaacaggtattatcaatcgcagcagcgccagcgccccacccaccttgcgacctatcatatctcctagcggcccaacctggagcacgcagtctgaccctcaggctccagagaaccattctagttcacccggttcacgctctctccagacaggcggatttgcctgggaaggcgaggtggagaataacgtgtatagccaggcgactggggtggtacctcagcataagtatcatccgacagctggcagctatcagctacagtttgcactccaacagttagagcagcagaagctgcagagcaggcaactcctcgatcagtcccgggcacgtcatcaagccatctttgggagtcaaaccctgccgaactccaacctgtggacaatgaataatggcgctggatgtaggatcagctcagccacagcgtcgggccagaagcctactactttgccccagaaggtggtgccaccgcctagcagctgcgccagcttagttcccaaaccaccgccaaatcacgagcaggtgcttagaagggcaacatcacagaaggcttccaacaccagatttcgctccagttttcagaactacctttggtatttcttccaggccgtatcttag

SEQ ID NO: 245503 - DNA, 2337 bp, Artificial Sequence
  Description of Artificial Sequence: Synthetic coding sequence
atggcccacgtagaagacctgattattaagactatcatcagcgccgagcttgccattgctaccgcctgtaagacctttgtgccccataggtcttcgtgttttgagctatacgggttcgacgtgctgatcgattcaacgctgaaaccctggttgctggaggtgaacctcagccccagtcttgcctgcgacgcccctcttgacttaaaaatcaaagcctctatgatcagtgacatgttcacagtggttggctttgtgtgtcaagatcccgctcagcgggcaagcacacgtcctatctatcccacattcgaaagctcccggagaaacccattccagaaaccacaaagatgcagacctctcagtgcttcagatgctgagatgaagaacctggttgggtccgccagagagaagggacccggtaagctgggcggttctgttttaggtctttccatggaagaaattaaggtgctgcgccgagttaaggaggaaaacgataggaggggcggattcatcaggatctttcccaccagcgagacgtgggaaatttacggaagctaccttgaacacaagacatcaatgaattatatgctggccacccggctgttccaagaccgcatgaccgcggacggagcccctgagctgaagatcgagtcactcaattccaaggcaaagttgcatgctgccttatacgagcgaaaactcctttccctggaagtccgcaagcgtaggcggcgatcaagtcggctgagagccatgcggcctaagtacccagtgataacccagcccgcagaaatgaacgtcaaaactgaaacagagagcgaggaggaagaagaggtcgctttggacaatgaagacgaagaacaagaggcaagtcaggaggaaagtgccggatttctccgagagaatcaagcaaagtatactccttcactgacagccctggttgagaatacccctaaagagaactctatgaaggtgcgggagtggaataacaaaggagggcactgttgcaagctcgagactcaggaactggaacctaaatttaatctgatgcagatcttgcaggataatggaaacctgtctaaaatgcaggcacgaattgccttcagcgcttaccttcaacatgtgcagataagactgatgaaggattctgggggacagactttcagtgcctcgtgggctgccaaggaagacgagcagatggaactggtagtcaggttcctgaagagagcgtcaaacaatctccaacactcacttcgcatggtgctgccatcacgcagactggcacttctggaaaggcgccgaatcttagcacatcagctgggcgattttattattgtctataacaaagagaccgaacaaatggcagagaagaagtcaaaaaagaaggtcgaggaggaagaggaagatggggtaaacatggaaaacttccaagagttcattagacaggccagcgaggcagaactggaagaagtgcttactttctatacacaaaagaataaaagcgcgtccgtgtttttgggaactcatagtaagatctccaagaataacaacaactatagcgatagcggagcaaaaggtgaccacccagaaactattatggaagaagtgaaaataaaacctccaaagcagcagcaaactaccgaaatccatagtgacaagttatcccggttcacaactagcgcagaaaaggaagcaaaattggtctatagcaatagtagcagtggtccaaccgccacattacagaaaattcctaacacccatctgtcctcagtgacaactagcgacctttccccaggcccatgccatcactcgtcccttagtcagattcccagcgcaataccgtccatgcctcatcagcccactatactgttgaataccgttagtgccagcgctagcccctgtctgcacccgggagcccaaaacattccatctcccacaggattgccgagatgtcggagcgggagtcacacaattggtcccttctctagtttccaaagcgccgctcacatctatagtcagaagctgagtaggccatcctctgccaaggccggtagctgttacctgaacaaacatcattccggcatcgccaagacacagaaggaaggagaggacgcgtctctctactcgaagcgctacaatcagagtatggtgaccgccgaattgcagcgcctcgctgaaaagcaggctgccagacagtattccccatcctctcataccgatccctggaagtacgaccgatccatcaggatgtgcagccccctgaacatcctggaaccagagtttaagaaatacctgatgggaatttatagcccgcacagctcgaaaaaaaagaagaagtag

SEQ ID NO: 245504 - DNA, 1755 bp, Artificial Sequence
  Description of Artificial Sequence: Synthetic coding sequence
atgcgcattgggactcctaccgctggacccggtcccagcgcagtgatggaggggtgcctgggcgtggcagaacttagaaaactctctaccttttccgcttacctggaagatcactcctacaacgtggagcagatatggagggacattgaagatgtcataataaaaacgctcatctcagcccacccaatcattaggcataactaccacacttgcttccctaaccacaccctcaactccgcttgctttgaaatacttggatttgatatcctgttggatcacaaattgaagccctggttgttagaggtcaaccactctccgagtttctcaactgacagtaggcttgataaagaagtgaaagatggtttgctgtatgacactcttgttttaatcaatctcgaaagctgcgacaaaaagaaagtgctcgaagaggaacggcagcggggacaattcctgcaacagtgttgctcccgcgagatgcggattgaggaggcgaaggggtttcgggcagtccagctgaaaaaaacggagacatatgagaaggagaattgtgggggatttcggcttatctacccttccctgaattcagagaaatacgaaaaatttttccaggacaacaattccctgtttcagaacacagtggcctctagggcacgcgaggagtacgcaaggcagctgattcaggagctgcgccttaagcgggaaaagaaaccttttcagatgaaaaagaaagtggaaatgcagggcgagagcgcaggcgagcaagtgcgtaaaaaagggatgcggggatggcagcagaaacagcaacaaaaggacaaagccgctacccaagccagcaagcagtatatccaacctctgactttggtgtcctatactcccgatttgctactgtccgtgcgaggcgaacgaaagaacgaaaccgatagctctctgaaccaagaggctcctaccgaggaagcctctagcgtcttccccaagcttaccagtgccaagcctttctcgtccctgcccgatttgcgcaacattaacctgagtagcagcaagctggagccgtcgaaacctaattttagcataaaggaagctaagtctgcctcagccgtgaacgtcttcaccggcacagtgcatctaacctccgtggagactacccccgagtcaaccacacaactgagcatctcaccaaagtccccaccgactctcgctgttaccgcgtcatccgagtatagcggacccgaaaccgatcgcgttgtgtcattcaagtgcaaaaagcagcagactccgcctcatctgactcagaaaaagatgctcaaatctttcctccccaccaaatccaaatccttttgggaatctccaaacactaattggacactcctcaagtcagatatgaacaagcctcatctgataagcgagctgttaacaaagttacagctgtccgggaaactgtcattttttcccgctcactacaaccccaagttaggaatgaataacctgtcacaaaatccctccttgccaggagaatgtcattccagatccgactcttccggcgaaaagcgacagctggacgtttcttctttgctcttgcaatcaccccagagttacaacgttaccctgagagatctactcgtaattgcaaccccagctcagcttgatccaagaccatgccgatcgcacgcttcagcgatgagagacccatgcatgcaggatcaggaggcctactctcattgcctcatcagtggacaaaagggatgcgagcggagttag

SEQ ID NO: 245505 - DNA, 2532 bp, Artificial Sequence
  Description of Artificial Sequence: Synthetic coding sequence
atgccacagtgcccaacactcgagagccaggaaggagagaactcagaggagaagggtgattcctctaaggaggaccctaaagagacagtagccctcgccttcgtccgggagaaccccggagcccagaatggcctacagaacgcgcaacagcagggcaagaaaaaacgcaaaaaaaaacgcttggtaattaacctctcttcctgtcgctacgaaagtgtcagacgggctgctcagcaatatggttttcgggagggcggtgaggacgatgattggaccctgtactggactgattacagtgtctcccttgagcgtgtgatggagatgaaaagctatcagaagatcaatcactttcccggaatgtcagagatctgtcggaaagacttacttgccaggaacatgtcgaggatgctgaaaatgttccctaaggatttcaggttcttccctaggacatggtgccttcctgccgattggggcgacctgcaaacttatagccgaagcaggaaaaataaaacctacatttgcaagccagacagcgggtgccaaggcaaaggaatttttatcacacgcacagtgaaggagataaaaccaggggaagacatgatttgccagctgtatatctccaagcccttcatcatcgatgggttcaagttcgatctgaggatctatgtgctggtcaccagctgcgaccctttgcgtatctttgtttataatgagggcctagcccgatttgccaccacaagttattctcggccatgtaccgataatttggatgatatctgtatgcacctgaccaactactccatcaacaagcattctagcaatttctctagagacgcccactccggatccaaaagaaaactgtcaacgttttcagcttatctcgaggatcacagttacaacgtcgaacagatatggcgcgatatcgaagatgtcatcatcaagactctcattagcgcccaccctatcattcggcacaactaccacacctgtttccctaaccacaccctaaactctgcatgtttcgagatcctgggttttgatatcctcttagaccacaaattgaagccatggctgctggaagttaaccatagcccttccttctctacagatagcagattggacaaagaggtcaaggacggtctgctgtacgatactctggtgctcataaacctggagtcttgtgacaaaaaaaaggtcttggaagaggagcgccagcgcggtcagtttcttcagcagtgttgctccagagagatgcgcattgaggaggctaaaggcttcagggctgtacaactcaagaaaaccgagacctacgaaaaggaaaattgcgggggattcagacttatatatcctagcctgaattctgagaaatacgaaaagttttttcaggataacaacagcttgttccaaaacactgtggcttcccgcgcacgagaagagtacgctcgccaactgatccaggaactgcgcctgaagcgtgaaaagaaaccattccagatgaagaaaaaggttgagatgcagggcgaatcagccggtgaacaagtccggaagaagggtatgcggggatggcagcagaagcagcagcagaaggataaggcagcaacacaggccagcaagcagtacattcaacctctgactctggtttcctacacaccagatttactcctgagcgtgaggggcgaaaggaaaaatgagacggactcatccttgaatcaggaggctcctaccgaagaggcatcttccgtattcccaaagctgacctctgccaagccgtttagctctctaccggatctcaggaacattaacctgtcctcaagtaaactagaacccagcaagcctaattttagtatcaaggaggccaaatctgctagcgccgtcaatgtttttacaggtaccgtccatctaaccagcgtagagacgacacccgagagcaccacgcagctgtccatctcccccaagtctccaccgaccctggccgtgaccgctagttcagaatattccggcccagagactgaccgtgtggtcagcttcaagtgtaagaagcaacaaacccctcctcatctaacacagaaaaaaatgttaaagtcgttcctgcccacaaaaagcaaatcattttgggaatccccaaacacaaactggacactgctcaaatccgatatgaacaagcctcacctcatttctgagctgctgacgaaactgcagctctctggaaagctgtcattcttccccgcacattataatcctaagctgggaatgaacaacctctctcagaatccttcactccccggagagtgccactcccgctccgatagttcaggagagaagcgtcaacttgatgtttcatcactgttactgcagtcacctcaatcctataacgttacactccgcgacctgttggtgattgctactccggcacagctcgaccccagaccatgtaggagccacgcgagtgcaatgcgagatccatgtatgcaggaccaagaggcttactctcattgcctcatcagcggtcagaagggctgtgaaagaagttag

SEQ ID NO: 245506 - DNA, 558 bp, Artificial Sequence
  Description of Artificial Sequence: Synthetic coding sequence
cagcccatgggcgcactgcttctgcaccctagtcggagagggcctgctggagtggtcgctagctggaccagcagccccgcaggaagagatgggggtgtgggcatagctggagcgtggtattttcccagggcttctagccaggctcgggaaatgccacagtgtccaaccctagaatctcaggagggtgagaactctgaggaaaaaggcgacagcagcaaggaagatcctaaagaaaccgtagctctggctttcgtccgagaaaaccctggagcccagaatggcctccagaacgcccagcaacagggcaagaaaaaaagaaaaaagaagagaatgcccctgaagaactctagaaaacgccgttttccctgtttcaagaaagcactcatatgtcccggaaatctcgttaggttgcagtacgactcaaccatattgacataccaagatcctacagccgcttgcgcctttcagttcctgttcaacatctcaccctgtctggccccttttcgactcattgatgagggtaaattggtccacttcttgatacatagttttccttag

SEQ ID NO: 245507 - DNA, 1710 bp, Artificial Sequence
  Description of Artificial Sequence: Synthetic coding sequence
atggaggggtgtcttggagttgcagagttacggaaacttagcaccttttcagcttacttggaggaccacagctacaacgtggagcagatttggcgagacattgaagatgtgattataaaaactctcatctccgctcatccgattatcagacacaactaccacacttgtttccccaatcacaccctgaactccgcttgttttgagatactcgggtttgacatcctgttagatcacaagctgaagccctggctacttgaggtgaaccactcgccatccttcagcacagattcaaggttggacaaagaagtgaaagacggccttctgtacgatactttagtcctgatcaatttggaatcgtgtgacaagaagaaggttttggaggaagaacgacagagaggacagtttctccagcagtgctgctcccgagagatgaggattgaggaagccaaaggctttcgagcggtccagcttaagaaaaccgaaacttacgagaaagagaattgtgggggttttaggctgatttatccatcccttaacagtgagaagtatgagaagtttttccaagacaataactcacttttccagaatacagtggccagtcgtgctagagaggagtatgccaggcagttgatccaggaattgcgtctgaaaagagagaagaagccattccaaatgaaaaagaaggtcgagatgcagggtgaaagtgccggagaacaggttcgaaagaaaggaatgcgtggctggcagcagaagcaacaacagaaagacaaagctgccactcaggcttctaagcaatatatccagccgctaactctggtcagctataccccagacctactattgtccgtgaggggtgagagaaagaatgaaactgacagctctctgaatcaggaagctccgacagaggaagcgtcctcagtattccctaaacttactagcgctaaaccattttcctcacttcccgatttgcggaacatcaacctgagtagttcaaaacttgagccatccaaaccaaactttagcatcaaagaggccaaatccgcgtccgccgtaaatgtgttcacaggaaccgtgcacctcacatcagtggagaccacccccgaatctacaacacagctatcaatttcccccaaaagtccaccaaccttggcggtgacagcgtctagcgagtactcgggtcccgaaacggacagggtagtgtcatttaaatgcaagaaacagcaaacaccaccccacttaacccaaaaaaagatgctgaagtctttcctaccaactaagagtaagtccttctgggagagccccaataccaattggaccctcttgaagtcagacatgaacaagccccatctgatctctgagctgctgaccaagctgcagctgagcgggaagctgagcttttttccagcacactataaccctaagctgggaatgaataatttgtcccagaacccaagcttgccaggcgagtgccatagtaggagcgacagcagtggagagaaaaggcagctggacgtatcgtctttgctgctccagtctccacaaagttacaatgttacactgcgtgatctattggtaattgccactccagcccaactggacccccgtccctgtcgaagtcacgcctccgccatgcgggacccttgtatgcaggaccaagaggcatactcacactgtctaatctcgggacaaaagggctgcgagagatcctag

SEQ ID NO: 245508 - DNA, 2676 bp, Artificial Sequence
  Description of Artificial Sequence: Synthetic coding sequence
atgggcgcactactgctgcacccctccaggcgcggaccagccggagtggtcgcttcatggacgtccagccccgcaggtagggatgggggtgtaggaatcgccggagcttggtatttccctcgggcaagtagccaggcccgtgagatgccccagtgtcccaccctcgagagccaagaaggcgagaatagtgaagagaagggggactccagcaaggaggaccccaaagagaccgtagcactcgctttcgtaagggagaatcccggagcgcagaatgggctgcaaaacgctcagcaacaggggaaaaagaaaaggaaaaaaaagcgtctggtcatcaatctctctagctgtcgttatgagagcgttcggagggcagcccagcaatacgggttcagagaaggcggtgaggacgatgactggaccctctattggactgactatagcgtctcccttgagagagtgatggagatgaagtcgtatcagaagattaaccattttcctggcatgagtgagatctgtcgcaaagacctgttagccaggaacatgtctcgtatgctaaaaatgtttccaaaggactttaggttttttcctcgcacttggtgcctgccagcagactggggcgatctgcagacctacagcaggagcaggaaaaataaaacctacatctgcaagccagattccggctgccagggaaaaggtattttcatcacacgaaccgttaaagaaatcaaaccgggtgaggatatgatatgtcagctgtatatcagcaagccttttataatcgatggattcaagttcgacctccgcatttatgtcctggttactagctgcgatcccctacggatctttgtatacaacgaaggcttggcgcgattcgcgactacttcatactctcggccatgtacggacaatcttgatgacatctgtatgcatctgaccaattattccatcaacaagcactcatcaaatttctcccgggacgcccactctggaagtaaacgaaaactgtctacctttagcgcttatctggaggaccattcgtacaatgttgagcagatctggagagacattgaggacgttattataaaaacacttattagcgctcaccccattatacgacataactatcacacgtgcttcccaaaccatacacttaactcggcctgtttcgaaatcctcggctttgacatactattagatcataagctgaaaccgtggctccttgaggtgaatcactcccccagcttcagtacagattcacggctcgataaagaggtaaaagatggcctgttgtatgacacactcgtactcatcaatctggagtcctgtgataagaagaaagtgctcgaagaggaaaggcagagaggccagttcctgcaacagtgttgttcccgggagatgaggatcgaggaggctaagggattcagagctgttcagctgaagaaaaccgagacgtacgaaaaggagaactgcggaggatttagacttatctacccatcactaaactcggagaagtatgaaaaattctttcaagacaacaattcgctgtttcagaatacggttgcgtctcgagctcgtgaagaatatgccaggcaattaattcaggagcttcgcctaaagcgcgagaagaagccttttcagatgaagaagaaagtagagatgcagggcgaaagtgctggagagcaggttaggaaaaaggggatgaggggatggcagcagaagcagcaacaaaaggataaggctgccactcaggcgtccaagcagtatattcagccccttacgcttgtctcatacactcctgacttactcctcagcgttaggggtgagcgcaaaaacgaaaccgacagtagtcttaatcaggaggccccaaccgaggaggcaagtagcgtgttcccaaagcttacatccgccaagccgtttagctctttgcccgacctacgaaatattaacctctccagcagcaagttagaaccaagtaaaccaaatttttcaataaaagaagctaaaagcgctagcgctgtaaatgtttttactgggaccgtccatctgaccagcgtggagacgacacctgaaagtacaacccagctatcaatatcgcctaagagtccacctaccctggccgtaacagctagctccgagtactccgggccagaaacagacagagtggtaagctttaaatgtaaaaagcagcaaacccctccccacttgacacagaaaaagatgctcaaaagttttctgccaacaaagtccaaatctttttgggaatcccctaacaccaattggacactcctcaaaagcgacatgaataaaccccacttaatatctgagctgctcactaaacttcagctttcaggcaagctgtctttcttccccgctcactataaccctaaattgggcatgaataatctgtcacaaaacccttccctgcctggcgagtgccactcacgtagcgactcatctggagagaaacgtcaactcgatgtgtcgagtctgctgttacagtctcctcaatcttataacgtgactctgagagacctgttggtcatcgctacccctgcccaattagaccctcgcccttgccgatctcacgcctcagccatgcgggatccttgtatgcaggaccaggaggcttactctcattgcctgatatctggccaaaagggatgcgaaagatcatag

SEQ ID NO: 245509 - DNA, 306 bp, Artificial Sequence
  Description of Artificial Sequence: Synthetic coding sequence
atgcctcagtgccctaccctggaatcccaggaaggtgaaaacagtgaggagaagggcgattcctccaaggaagatccgaaagagacagttgctctggcttttgtgagagaaaacccaggcgctcagaacgggttgcagaacgcccagcagcaaggtaagaagaagcggaagaagaagcgcctggtgatcaatctttcttcctgccggtacgagagcgtgcgtagggccgctcagcagtatggatttcgagaagggggtgaagatgacgactggacactgtattggacagattacagcgttagttag

SEQ ID NO: 245510 - DNA, 1356 bp, Artificial Sequence
  Description of Artificial Sequence: Synthetic coding sequence
atgagggagtgtatttcaattcacgtcggccaggcgggtgtgcagattggcaatgcgtgctgggagctttactgtctagagcacggtattcagcccgatggtcaaatgcctagcgacaaaactataggagggggtgacgactcctttaacactttcttttcagagactggtgccggaaagcacgtaccgagggctgtgttcgtagacctcgagcccactgttatcgatgaagtgcgcactggaacttatagacagctgttccatccagagcaattaatcacgggcaaggaggacgcagccaacaattatgctaggggccactatacaattggcaaagagattattgatcttgtgctggacaggattcgtaagctcgcggatcagtgcacgggtcttcaagggttcttagtgttccattcctttgggggaggaaccggatcggggtttacgtcgttattgatggagcgcttgtcagttgactacgggaaaaagtcaaagctcgagttctctatctaccccgctccccaggtcagtactgcagtggtggagccatacaattcaattctcaccactcataccacgttggagcattcagactgcgcgttcatggtggataatgaggccatctacgatatttgtagacggaatttggacatcgagcgcccaacctacacaaatttaaaccggctgattggtcagattgtgtcatctattacagcatccctccgtttcgacggagctctgaacgtggatctgactgaatttcagactaatctcgtcccgtacccaaggatccacttccccctcgccacatatgccccagtcatctctgctgagaaggcatatcacgaacaactttctgtagccgaaattacaaacgcttgttttgaacctgccaaccaaatggtgaagtgcgaccctaggcatggcaagtatatggcttgctgcctcctctacagaggcgatgttgtgcctaaggacgtgaacgcggcaatagcaacaataaagacaaagcgcaccatccagttcgtggactggtgtccaacgggttttaaagttgggattaattaccagcctcccaccgtggtgcccggaggagacctcgctaaggttcagcgcgctgtttgcatgctgtccaacaccactgccatcgcggaggcttgggccagactggatcacaaattcgatctcatgtacgctaagcgtgcttttgtccactggtacgtgggagaaggaatggaggagggagaattctccgaagcgcgagaagacatggccgctttggaaaaggactatgaggaagtaggagtggactcggtggaaggtgaaggagaggaggagggagaggaatactag

SEQ ID NO: 245511 - DNA, 1356 bp, Artificial Sequence
  Description of Artificial Sequence: Synthetic coding sequence
atgcgagaatgtatatctattcatgtggggcaggctggggttcagataggcaatgcgtgttgggaactgtactgcctggaacacgggattcagcccgatggtcaaatgccgagtgataagaccatcggcggtggggacgactcgttcaacacgttcttttctgagaccggggcaggtaagcacgtgcctagggcagtctttgtagatctcgagccgaccgtgatagacgaagtcagaaccggtacctataggcagcttttccatcccgaacagctgattaccgggaaggaggacgcagccaacaattatgccagaggccactataccattgggaaggagatcatcgacctggtactggatcgaattagaaagctggcagaccagtgtacaggcctgcaggggttcctggtcttccattcattcggtggcggaactggtagtggcttcacaagcctgctgatggaacgcctttctgtggattatggcaagaagagcaagctggagttctctatctaccccgcacctcaggtgtccaccgccgttgtcgagccatataactcaatactgaccacgcacacgactctagaacattccgactgtgccttcatggtggacaacgaagctatctacgacatttgcagacggaacttagatatcgagcgtcctacctacactaatcttaatcgtctgattggccagatcgtttcaagtatcaccgccagtctcagattcgacggcgcattaaatgtggacttgactgagtttcagaccaatctggttccctacccccgaattcattttcctttggccacatatgcccctgtgatatcggccgaaaaggcttatcacgaacagctaagcgtggctgagatcacaaacgcatgcttcgagccggctaatcagatggttaaatgcgaccctcgccacgggaagtatatggcgtgttgtctgctctacagaggcgacgtggttcctaaagatgtgaacgccgctattgcaacgataaaaactaaaagaacaatccagtttgtggactggtgtcctactgggttcaaggtcggtatcaattatcagcctcctacagtggtgccaggcggagatctggccaaagtacagcgcgctgtgtgtatgttgagcaatacgacagcaatcgctgaagcatgggcgcgactggatcataaatttgacttaatgtacgcgaagcgagctttcgttcattggtatgttggcgagggcatggaagaaggggagttctccgaggcacgcgaagatatggccgcattagaaaaggattacgaggaagtgggcgtggatagcgtggagggagagggggaggaggagggtgaagagtactag

SEQ ID NO: 245512 - DNA, 1152 bp, Artificial Sequence
  Description of Artificial Sequence: Synthetic coding sequence
atgatcgatcttgagcctacggtagtggacgaagtgcgggctggtacctaccgccaactgtttcatcctgagcagttaataaccgggaaggaagatgctgcaaataactacgccagaggtcattatactgtgggaaaggagtctatcgatcttgtattagatcgcatccgtaaactgacagatgcctgtagcggactgcaaggatttctcatctttcacagtttcggcggtggtaccggaagcggctttaccagtctcctgatggagagactgtctctcgactacggcaaaaagagcaagctggagtttgctatataccccgctccacaggttagcacagctgttgtggaaccctacaacagcatcctcactacacacaccacactcgaacacagcgactgcgcatttatggtggataatgaagccatctacgatatctgcaggcgaaatctcgacatagagagacctacctacaccaacctgaataggctaatctcacaaattgtgtccagcatcacagccagcctgcgctttgatggggcactgaatgtggatctgaccgaattccagactaacttggtgccttatcccagaattcatttcccactggtgacctacgcccctattatatcagctgaaaaagcttaccacgaacagctgagtgtcgctgagattaccagctcatgtttcgagcccaattcacagatggttaagtgcgatcctcggcacggcaaatacatggcctgttgcatgctgtatcgcggagacgttgttcccaaggacgtgaatgtggccatcgctgccataaagaccaagcgcacaattcagttcgtcgattggtgtcccacaggattcaaggtcggcatcaactaccagccaccaacagtcgttcctggaggggatttggcaaaggttcaacgtgctgtctgcatgctatcaaacaccactgccattgcagaggcttgggcacgcctggatcacaaattcgacctgatgtatgccaagagagccttcgtccactggtatgtgggcgaagggatggaagaaggggagttctctgaagccagggaggacctagccgctttggagaaagattacgaagaagtagggacagacagtttcgaggaggagaatgagggagaagagttttag

SEQ ID NO: 245513 - DNA, 1350 bp, Artificial Sequence
  Description of Artificial Sequence: Synthetic coding sequence
atgcgcgaatgcattagcgtgcacgttggccaggccggtgtccagatcgggaatgcctgttgggaattgttttgcctggagcacggaatccaggccgatgggacttttgacgcacaggcgtctaagatcaatgacgatgattccttcactaccttcttctccgagaccggcaatggaaagcatgtgcctcgcgctgttatgatagacctcgaacccaccgtggtggacgaggtccgcgctgggacctatcggcagctcttccatcccgagcaactgatcaccggcaaagaagacgcggctaataactacgctcggggacattacacagtgggcaaagagtcaattgatttagttcttgaccgaatacgtaagctgacagatgcttgctctgggttgcaggggttcttgattttccacagtttcggcggtgggacagggtcagggtttacttctctgctcatggagcgcctaagcttggactacggtaagaagtcgaagctggagtttgcaatttaccctgcccctcaggtgtcaaccgccgtggtcgagccttataattcaatactgacaacccatactaccctggaacattctgattgtgcctttatggtggataacgaagcaatctacgatatatgccgccgaaatctcgatattgagcgccctacatacaccaacctgaaccgcctaatttcccagatcgtttccagcatcacagcctccctgaggttcgatggagctctaaacgtggacctgaccgaattccagactaatcttgtgccctaccccagaatccacttccccctcgtcacatacgcccctatcatctccgccgaaaaagcgtaccacgaacagctgtcagtcgcggagattacaagcagctgctttgagccaaatagtcaaatggtgaagtgtgaccctagacacgggaaatatatggcctgttgtatgctatatcgcggtgatgttgttcccaaagatgtgaatgttgctattgcagctattaagactaagcggaccatccaatttgtggactggtgtccaaccggttttaaggttggtattaattatcagccaccaaccgtggtccccggaggggacttggcaaaagtgcaacgagccgtgtgcatgctctcgaacactacagcgattgcggaggcctgggctaggttggaccacaagttcgaccttatgtacgccaagagggctttcgtccactggtatgtcggagagggcatggaggaaggggagttctccgaggcacgagaggatctggcggctctggagaaggactatgaggaggtcggaacagactcatttgaagaagaaaacgagggagaggagttctag

SEQ ID NO: 245514 - DNA, 912 bp, Artificial Sequence
  Description of Artificial Sequence: Synthetic coding sequence
atggccagacgaggcccaggctggagaccacttctcctgttggtgcttctcgccggagctgcacagggaggcctctactttcgcagagggcagacgtgttatagaccactcagaggggatgggctagctccgctcggacgctccacatatccaagacctcatgaatacctaagccctgccgaccttccgaaaagctgggactggcgcaacgtggacggcgtaaactacgcaagcatcactcgaaaccagcacatcccacagtattgtggcagctgctgggctcatgcatccacctcagcgatggctgatcggattaacatcaagcgaaagggagcctggcctagcaccctgctcagcgtgcagaatgttatcgactgcggcaacgccggtagttgtgaggggggaaacgatttatccgtatgggactacgcccatcaacatggtatcccagatgagacttgtaataattaccaggctaaagaccaggagtgtgataagtttaaccagtgcggcacatgcaacgagtttaaagagtgccacgccattcgcaattataccctttggcgagtcggcgactacgggtccctgtccggcagagagaagatgatggcagaaatctatgccaatgggccaatttcctgtggtatcatggccacagagcgcctggcaaactatacaggcggaatctatgcggagtaccaggatactacttatatcaatcatgttgtgtccgtggccggatgggggatctccgacgggaccgagtattggatcgtgaggaactcctggggagagccatggggtgagcggggatggctgcggattgttacgtccacctataaggatgggaaaggggcacgctacaatctggcaatcgaagaacactgcacctttggagaccccatcgtttag

SEQ ID NO: 245515 - DNA, 1338 bp, Artificial Sequence
  Description of Artificial Sequence: Synthetic coding sequence
atgcgggagatcgtccatattcaggccggacaatgcggaaaccagattggggctaaattttgggaggtcattagcgacgagcatgggatcgacccaactgggtcataccacggcgattccgatcttcagcttgagagaattaatgtgtactataatgaagcaaccggtaacaagtacgtgccgagagctatcctagtggatttggaacctggcaccatggactctgtgagaagcgggcctttcggacagatcttcaggccagataatttcgtgttcgggcaatccggagccggtaacaattgggcgaagggtcactacaccgagggagcagagctggtcgactcagttctggacgtggtaaggaaagaaagcgaatcctgtgactgtctgcaagggtttcaactgactcacagtctcgggggaggaacggggtctggcatggggacactgctgattagtaaaattcgggaggaataccccgacaggatcatgaacactttttccgtcatgccgtcgccaaaagtctctgacacagttgtcgagccatacaatgcaacgttgagcgtgcaccagttagtggaaaacacagacgagacctattgcatcgataacgaagctctatatgacatttgctttcgcactctgaagctgaccactccaacctatggcgacctgaaccatctggtatccgcaactatgtcgggggtgacaacctgcttgaggttccccggtcagctaaacgcggatttgcgcaagttggccgtgaatatggtgccattcccacggcttcacttctttatgccgggttttgccccactgacaagcagaggcagccagcagtaccgagcattgacggtccccgaacttactcagcagatgtttgactcgaagaatatgatggcagcctgcgatcccagacatggaagatatctgaccgtggctgcaatctttcggggacgtatgagtatgaaggaggtggatgaacagatgttgaatgtccagaataagaattctagctactttgtcgagtggataccgaacaatgttaagaccgcggtgtgcgatatccccccaaggggcctcaaaatgtcggcaacttttatagggaactctaccgctatacaagaactgtttaagcggatttcggaacagttcaccgcgatgtttcgcagaaaggcattccttcattggtacactggcgaggggatggacgagatggagtttactgaagctgaatcaaacatgaatgacctggtaagtgagtaccagcaataccaggatgccaccgccgacgaacaaggagaattcgaggaagaagaaggcgaagatgaggcctag

SEQ ID NO: 245516 - DNA, 1353 bp, Artificial Sequence
  Description of Artificial Sequence: Synthetic coding sequence
atgagagaaattgtgcacattcaggccggtcagtgcgggaatcagattggagccaagttttgggaggttatatcagacgagcacggaattgatccatctggtaattacgtaggcgattccgatctgcaactggaacggatcagtgtctactacaatgaggcctcgagccacaaatacgtgccccgtgccattttggtcgacctggagccgggtaccatggactcagtgaggtcgggcgcatttggccaccttttccggcctgataatttcatcttcggacaaagcggcgctgggaataactgggctaaagggcattataccgagggtgcggagttggtggattccgtcctcgatgtggtgaggaaagagtgcgaaaactgtgactgtctgcagggcttccaactcactcactctttaggcggtgggaccggcagcgggatgggcaccctgctaatttcaaaggtccgcgaggagtaccccgaccgaattatgaataccttctcagtcgtaccaagccctaaagtaagtgacacggtggtcgagccatacaacgctacactgtccattcaccagctggtcgagaacaccgatgaaacctactgcattgacaacgaagcactgtacgacatctgcttcagaacgctaaaacttgctacccctacatatggggatcttaaccaccttgtcagcgccaccatgtcgggcgtgacaacgtcgttgaggtttccagggcagcttaatgctgacctcaggaagcttgctgtcaacatggtcccgtttcctagactacactttttcatgcctggctttgctcctctaactgccagggggagccagcaatatagagctctcactgtacctgaattgacccagcagatgtttgatgccaaaaacatgatggccgcatgcgaccccagacacggacgctatctgactgtagccacagtgtttaggggcagaatgagcatgaaggaggttgacgagcaaatgctcgccatccaatctaagaatagcagctattttgttgagtggattcccaataacgtcaaggtcgcagtttgcgacatcccacccagaggtctgaagatgagcagcactttcattggaaacagtactgccatacaggagctgtttaaacgtatctctgagcagtttacagccatgttccgcaggaaggcctttttacattggtataccggggagggcatggacgagatggagttcacggaggcagagagcaatatgaatgatttagtgtcagagtatcagcagtaccaggatgccaccgctgaagaggaaggggagatgtacgaggacgacgaggaagagtcagaggcccaaggtccaaagtag

SEQ ID NO: 245517 - DNA, 1137 bp, Artificial Sequence
  Description of Artificial Sequence: Synthetic coding sequence
atggacagtgttcggagtggagcattcggccacttgtttaggcccgataacttcatcttcggccaaagcggagcaggaaacaactgggctaagggacattacactgagggcgctgaactcgtcgactccgttttagatgtcgttaggaaggaatgcgagaattgtgactgtctacagggctttcaactgacacactcactggggggaggtactgggagtggcatgggtacgcttttaatcagtaaggtacgagaggagtaccctgaccgcatcatgaacaccttctccgtcgtccccagccctaaagtgtccgacacagtggtggagccgtacaacgccaccctctccatccatcagctcgtggagaatactgacgagacatattgcattgacaatgaggccctgtatgatatttgttttcgtactctgaagcttgcgacccctacatatggggacctgaatcatctcgtcagtgctactatgagcggcgtaacgacctcacttagatttccaggacagctcaatgccgacctgagaaaacttgctgtcaatatggtccctttccctaggctacatttcttcatgccaggcttcgcccctctcaccgcccgtggcagccagcagtatcgcgcactcactgtccccgagctgactcaacagatgtttgacgccaaaaatatgatggctgcgtgtgatcccaggcatggacgctacctcaccgtggcgaccgtatttcgagggagaatgtctatgaaggaggtcgatgagcagatgctggcgatccagagtaagaatagctcctactttgtagagtggatccccaacaacgtgaaagtagctgtttgtgatattcccccaagaggcctgaaaatgtccagtacgtttatcgggaactcaaccgccattcaggagctgttcaaacgcatcagtgagcagtttaccgctatgtttagacgcaaggcctttctgcactggtacacaggggaggggatggacgaaatggaatttactgaggccgaatcgaatatgaatgacctggtgtccgagtatcagcagtatcaggatgccactgccgaggaggaaggggagatgtatgaggatgacgaagaggaatcagaagcgcaggggccaaaatag

SEQ ID NO: 245518 - DNA, 1335 bp, Artificial Sequence
  Description of Artificial Sequence: Synthetic coding sequence
atgcgcgaaatagtgcacattcaggccggtcaatgcggcaatcaaattggagctaaattctgggaggtgatttcggacgaacacggcatcgacccaaccggaacctaccacggggacagcgacctccagctcgacaggatatctgtgtattacaacgaggccacagggggaaaatatgttccacgtgctatcctggtggatttagagccagggaccatggattctgtgcgttctgggccttttggtcagatcttccggccagataactttgtctttggccagagtggggctggcaacaattgggccaagggccattataccgagggtgccgagttagtcgatagtgtcttggacgtggtgcggaaggaagccgaaagttgtgactgcttgcagggctttcaactgacccactcactgggcggagggactggcagcggtatgggaaccctcctgatttcaaaaatcagggaggaatacccggatcgcatcatgaacacattcagcgttgtgccctcacctaaagttagcgacactgtggtcgaaccttacaatgctaccctcagcgtgcaccagttggtggagaacacagatgagacctactgcattgataacgaagccctgtacgacatttgttttaggacccttaaactaacaactcccacatacggagatctgaaccacctggtgtcagcaaccatgagcggtgtaactacgtgcctgcggtttccaggtcagctcaatgctgacctgcgcaaactcgctgtgaatatggtcccatttccgcgactccatttcttcatgccagggttcgcccctttgacctctcggggatcccagcagtacagggctctgactgtgcctgagctgacccagcaggttttcgacgctaagaacatgatggccgcttgtgaccccaggcatggacgatatctgacagtcgccgcagtcttcagaggccgtatgagtatgaaagaggtcgatgagcaaatgctgaatgtccagaataagaactccagctacttcgtggaatggatcccgaataatgtgaaaactgctgtgtgcgatattcctccccgagggctgaaaatggccgtcactttcatagggaacagcacggccattcaggagctatttaagcgcatcagtgaacaatttacagccatgtttcggagaaaagcctttctgcattggtacacaggggagggcatggatgaaatggagttcacggaagcagagagcaatatgaacgacctcgtgagtgagtatcaacagtatcaagatgccaccgccgaagaagaggaagacttcggcgaggaagcggaggaggaggcctag

SEQ ID NO: 245519 - DNA, 1119 bp, Artificial Sequence
  Description of Artificial Sequence: Synthetic coding sequence
atggactcagtgcgatcagggcctttcgggcaaattttccgacccgataacttcgtttttggccagtcaggagctgggaacaactgggcaaaaggtcactacacagagggggcagagttggtagacagtgttctcgacgttgtcagaaaagaagctgagagctgtgattgtctgcagggctttcagctgacccattcactgggcggaggcaccggatccggcatgggaaccctcttgatctccaagattcgagaggagtatcccgaccgaatcatgaacacatttagcgtggtcccctcacccaaggtaagcgacactgttgtcgaaccatataatgctaccctctccgtgcatcagttggtcgagaatacggacgagacttactgtatcgataacgaagccctatatgacatatgctttagaacgctgaagcttacaactcctacctacggggacctgaatcacctggtgtccgcgactatgagcggcgtcacaacgtgccttcgatttcctgggcagttaaacgcggaccttcggaaactggccgtaaacatggtgcccttccccaggcttcatttcttcatgccaggatttgccccacttacaagccggggttcccagcagtaccgcgctctaacagtgcccgagttaacccagcaggtgttcgacgctaagaacatgatggcagcatgtgaccccaggcatggccgatacctcaccgtggctgctgtattcaggggaagaatgagcatgaaggaggtggacgagcagatgttgaatgtgcaaaataagaactcttcctatttcgtcgagtggatccccaataatgtaaaaaccgctgtttgcgacattcctccgagggggctgaagatggcggtgacgttcattgggaacagtactgcaattcaagaacttttcaagcgtattagtgagcagtttactgccatgtttagaaggaaggcctttctacattggtatacaggggagggaatggacgagatggaattcacagaggccgaaagcaatatgaatgacctggtgtctgaataccagcagtatcaagatgccacagctgaagaggaggaggatttcggggaggaggccgaagaggaggcttag

SEQ ID NO: 245520 - DNA, 1335 bp, Artificial Sequence
  Description of Artificial Sequence: Synthetic coding sequence
atgagagaaatcgtgcatatccaggcaggccagtgtggaaatcagatcggagccaagttctgggaggttatcagtgacgaacatggcatcgatccaacaggcacctaccacggagacagcgatcttcagctggaccgcatctcagtttattataatgaggccaccggaggtaagtacgtaccccgtgctatcctggtcgatctggaaccgggaactatggatagtgttcggagcgggccattcggccagatcttcaggcctgacaatttcgtatttggacagagcggggctggaaacaattgggccaagggccactatacagaaggcgcagagttagttgattccgtgctcgacgtggtgcggaaagaggcagagtcatgtgattgcctccaaggattccagctgactcatagccttgggggtggcaccggatccggtatgggcaccctgttgatttccaaaatcagggaggagtacccagacaggatcatgaacaccttttcagttgtgcccagccctaaggtgtcagacactgtagtggaaccttacaatgctaccctttctgtgcaccaactggtggaaaatacagatgagacgtactgtatcgataatgaggccctgtacgacatatgttttagaactttgaaactaacaacacctacgtacggggacctcaatcatctcgttagcgccacgatgagcggggtgacaacctgtctcagattccccggtcagttaaatgccgatctgagaaagctggcggtgaatatggttccattcccccgattgcattttttcatgcctgggtttgctccccttacgtcacgaggctcacagcagtatcgggcactcacggtgccagagttgacccagcaggtatttgacgctaaaaatatgatggcagcttgtgatcctcgccacggtcgatatctgacggttgctgccgtattcaggggtagaatgagcatgaaagaggtggacgaacagatgctgaatgtgcagaacaaaaacagctcctactttgtggaatggatacccaataatgtgaaaacagcagtttgcgatatcccaccccgaggtctgaaaatggcggtcacattcatcggtaattccaccgcgattcaggagctgttcaaacggatctctgaacagttcacagccatgtttaggagaaaagcctttctgcattggtatacaggtgaaggaatggatgaaatggagttcaccgaggcagagtccaacatgaatgacctagtgagtgaatatcaacaatatcaagatgctacagccgaggaagaggaagatttcggcgaagaggctgaggaggaagcttag

SEQ ID NO: 245521 - DNA, 1119 bp, Artificial Sequence
  Description of Artificial Sequence: Synthetic coding sequence
atggattcagtgcgaagtggcccattcggacagattttccggcctgataactttgtgttcgggcaaagtggcgcagggaataactgggccaagggccactacacagagggggctgagctggtggactcagtcctcgatgtcgtgagaaaggaggctgagtcttgtgactgtctgcagggttttcagctgactcactccctggggggagggaccggtagtggcatgggtactctcttgatctcaaagatcagagaggaataccccgaccggatcatgaacacctttagcgttgtgccgtctccaaaagtaagcgacacagttgtcgaaccatataacgccacactcagcgtgcatcagttagtggagaataccgacgaaacttactgcattgataatgaagccctttatgacatttgcttcagaaccctgaagctcaccacaccaacttacggggatctcaatcacctggtgagcgcaactatgtcaggagtcactacctgcctgaggtttccgggtcagctgaatgctgatctgaggaagctcgccgtgaatatggtgccctttccccgattacactttttcatgccagggttcgcacccttaacctcgaggggctctcagcagtatcgggcactgactgtccccgaacttactcagcaagtatttgacgctaaaaatatgatggctgcctgtgacccacgtcatggtaggtacttgaccgtggcagccgtgttccgaggccgtatgtctatgaaagaagtggacgaacaaatgctaaatgttcaaaacaaaaattccagctactttgtcgagtggattcctaataacgttaagactgctgtgtgtgatattcccccaagaggtctgaagatggccgtgacatttatcggtaactcaacggctatacaggaactcttcaagcggatctcagaacaattcactgccatgtttagacgtaaagcctttttgcactggtacaccggcgagggcatggacgagatggagttcaccgaagcggagtccaacatgaacgacctggttagcgagtaccaacagtatcaggatgcaacagccgaagaggaagaagatttcggtgaagaggcagaggaagaggcttag

SEQ ID NO: 245522 - DNA, 1281 bp, Artificial Sequence
  Description of Artificial Sequence: Synthetic coding sequence
atgttttgggaggtcatctcagacgagcacgggattgatccaacaggaacgtatcacggggattccgatttacagctggatcggatcagtgtttattacaacgaagccaccggaggcaaatacgtgccgcgtgcgatcttagtggatctcgagcctggtacaatggatagtgtgagaagcgggccattcggccagatcttccgacccgataatttcgtgtttggccagtcaggcgcaggcaataactgggccaagggtcactatacagagggcgctgagctggtggactctgtactggacgtagtgcgcaaggaggccgagtcttgtgactgtctccagggcttccagctgacccattccttgggcggagggaccggatcaggaatgggtaccctactgattagcaagattcgggaagagtatcccgacagaattatgaacaccttttcggtcgtgccatctccgaaggtgagcgacactgtcgttgaaccatacaatgccaccctcagcgtgcaccaactggtggaaaatacagacgagacttattgtattgacaacgaggctctatatgatatttgtttccgaacactgaaattgacaactcccacctacggggacttgaaccatctcgtatccgccacaatgtccggagtgactacctgtcttaggtttcccggtcaactgaacgcagacctcagaaagctcgcagtgaacatggtcccctttcccaggcttcactttttcatgccagggttcgctccgttaacgtctagaggaagccagcagtaccgcgctctaacagtgcccgagctgacccagcaagtgttcgatgccaaaaacatgatggctgcgtgcgatccacgacacggcaggtatctgacagtcgcggcagtctttcgcggaagaatgagtatgaaggaggtggatgagcaaatgctgaatgtccagaataaaaattcttcttatttcgtcgaatggatcccaaataacgtgaagacagccgtgtgtgacattccgccaagagggctgaagatggcagttacattcatcggcaattcaacagctatccaagagctctttaagagaatctcagagcaattcacggcaatgttccgcaggaaggcatttcttcactggtatacaggcgagggaatggatgagatggagtttacagaggccgaatccaatatgaatgacctcgtgtctgagtatcaacagtaccaggatgctaccgctgaagaggaggaggactttggggaggaggcagaggaggaggcatag

SEQ ID NO: 245523 - DNA, 1119 bp, Artificial Sequence
  Description of Artificial Sequence: Synthetic coding sequence
atggattcggtgaggtccgggcctttcggccaaattttcaggccggataatttcgtttttggtcaatctggcgctggcaataactgggccaaaggccattacactgagggggcagagctggtcgactctgtgttagatgtcgttagaaaggaagccgaatcttgtgactgtcttcaaggtttccagctcacgcacagcctgggcggtggcacgggctctggaatgggaactctgctcatcagcaaaattcgggaggagtatccagataggataatgaatacattctcggttgtgccttcccccaaggtgtcagatacagtggtggagccttacaatgcaaccttgtccgtacaccaactcgttgaaaacacagatgaaacgtactgcatcgataacgaggccctgtacgacatttgcttccgcactctgaagctgactacacccacttatggcgacctcaaccatttggtttcggcaaccatgtccggagtcaccacgtgtctgcgatttcccggtcaactcaacgccgatctgcgaaagttggctgtaaacatggtgccgtttccccgtctgcacttctttatgccagggttcgccccactgacttcaaggggctcccaacaatacagggctcttactgtcccagagctgacacagcaggtgttcgacgctaagaacatgatggccgcatgcgacccaaggcacggtcgatacctgacagtggcggctgttttccgcggaagaatgagtatgaaggaagtggacgaacagatgcttaatgttcagaacaagaatagctcttattttgtcgagtggattcccaacaacgtgaagaccgcagtgtgtgatatccctccaaggggcctcaagatggcggtgacatttattggaaattcaactgcaatccaagagctgtttaaaaggattagcgaacagttcacggccatgttcaggcgaaaggcctttttgcactggtacactggagaagggatggatgagatggaatttactgaggcagagtccaatatgaacgatctggtctccgagtaccaacagtaccaggatgctacagcagaagaagaggaagacttcggagaagaggctgaggaggaggcctag

SEQ ID NO: 245524 - DNA, 1119 bp, Artificial Sequence
  Description of Artificial Sequence: Synthetic coding sequence
atggacagcgtgcgaagcggtcccttcggacagatttttaggccagacaacttcgtgttcggccagtcgggggctggcaacaactgggctaaggggcactacaccgagggcgcagagctggtcgactccgtgctggacgtcgtccggaaggaggccgaaagctgtgactgccttcaaggatttcagttgacccacagtttgggcggtgggactggttccgggatgggaaccctcctgattagtaaaatccgggaggagtacccggatcgcattatgaacacattcagcgtcgtgcccagccctaaagtcagtgatactgtcgtcgagccatacaacgcaaccttgtccgtgcatcagctggtggaaaatactgacgagacttattgcattgataacgaggctctttatgacatctgctttcgcactttgaaactcactactccgacatatggtgatctgaatcatctggttagcgccacaatgtcaggagttaccacttgtctgagattcccaggacagctgaacgctgacctccgtaagctcgcagtgaatatggtcccttttccacgcttacactttttcatgcccggattcgctcctctcacctcacggggatcacagcagtatcgggctctgaccgtgcctgagctgacacagcaagtgtttgatgcaaaaaatatgatggctgcttgtgacccacgacatggacgctacctgaccgtagccgctgtgtttcggggtcggatgtctatgaaggaggtggatgaacagatgctcaacgtgcagaataagaattcgtcctacttcgtggagtggattccaaacaacgtgaaaaccgccgtgtgtgacataccgcctcgtgggctcaagatggctgtgacctttatcgggaactccactgcaatccaggagctcttcaaaagaatttcagagcaatttaccgcgatgtttcggaggaaggccttcttacattggtacaccggggaaggtatggatgagatggagttcactgaagccgagagtaatatgaacgatctggtgagcgaatatcagcaatatcaagacgcaacagctgaagaggaggaggatttcggggaggaggccgaggaggaggcgtag

SEQ ID NO: 245525 - DNA, 1281 bp, Artificial Sequence
  Description of Artificial Sequence: Synthetic coding sequence
atgttctgggaggtgattagcgatgagcatgggatagatcccacaggaacttatcatggagactctgaccttcagctggatcgcatttccgtctactacaacgaagccactggcggaaagtatgtgccacgggcaattctcgtggacctcgagcccggtacaatggactcagtacgcagtggtccatttggacagatattcagacccgataatttcgtgtttggacaatccggggctggtaataactgggcaaaaggacattatactgaaggcgctgaattggtagattcagtactggacgtcgtgcgaaaggaggccgagagctgcgattgcttgcagggctttcaacttacccacagcctggggggtggaaccggttccggaatgggtactcttctgatctcaaagattcgggaggagtatcccgatcgcataatgaacacattctctgttgtgccctcgcccaaggttagcgatacagtggtggaaccctataatgcaacgctctctgtgcaccagcttgtcgagaataccgatgagacatactgcatcgacaatgaagccctgtacgatatatgcttccggactctgaagctcactactcctacttatggcgaccttaaccatctggtgagcgctactatgtccggagtgaccacttgtttgcgatttcctggtcagctgaatgcagaccttcgcaagctcgccgttaatatggtcccattcccacggctccatttctttatgcccggattcgctcccctgacgagccgcggatcccagcagtaccgagctctgacagtgccagagcttacacagcaggtattcgatgcgaagaatatgatggccgcttgtgaccccagacatgggaggtaccttactgtagccgctgtgttcaggggcagaatgtctatgaaggaagtggacgaacagatgctcaatgtacagaataaaaacagcagctacttcgtggagtggattccaaacaacgtcaagaccgccgtgtgcgatataccaccccgtggcctcaaaatggccgtgactttcatagggaactctacagcgattcaagaactgttcaagaggatttcagagcagtttacagctatgttccggagaaaagcttttctgcactggtacacaggcgaaggtatggacgagatggagttcaccgaggccgagtcgaacatgaacgatctcgtctcggaataccagcagtaccaggatgcgacagccgaagaggaagaggacttcggagaggaagccgaggaggaagcttag

SEQ ID NO: 245526 - DNA, 1281 bp, Artificial Sequence
  Description of Artificial Sequence: Synthetic coding sequence
atgttctgggaggtgatttccgacgaacacggtatcgaccccactggaacatatcacggtgatagtgacctgcagctggaccgcatcagcgtgtattataatgaggccacgggagggaaatatgtgccccgagctatccttgtcgatttggaaccgggaacgatggattccgtgaggagtggcccattcgggcaaatttttcggcctgacaattttgttttcggtcagtcaggcgctggtaacaactgggccaagggccattataccgaaggggcagagctggtcgattccgtcctggatgtggtgaggaaggaggcagaaagctgtgattgcttgcaaggcttccagttaacccacagtctcggaggaggaacaggctccgggatgggaacactcctgatctccaagatcagggaggagtatccagatcggatcatgaacacctttagcgtagttccaagtcctaaagtttctgacacagtggtggagccgtacaacgcaaccctatcagtgcatcagctagtggagaatacagacgaaacctattgcatcgacaacgaagccctgtatgacatttgcttccgaaccctgaaactgaccacacctacttacggagatctgaaccacctcgtgagtgccaccatgagtggtgtcaccacctgtttacgtttcccgggtcagctcaacgcagacctaaggaaacttgccgtgaacatggtgccctttccccgactccacttcttcatgcctggatttgcgcctctaacgtcacgcggaagccagcagtaccgcgcacttactgtgcccgaactaactcaacaggtttttgacgcaaagaatatgatggcagcgtgtgatcctcgccatggccgatatctcactgttgctgctgtgtttcggggtcgcatgtcaatgaaagaggtcgatgaacaaatgctcaatgtccagaacaaaaatagttcttatttcgtcgaatggattcctaacaacgtgaagaccgccgtatgtgacatcccaccccgtggactgaagatggcggttaccttcattgggaattccaccgctatccaggagctgtttaagaggatttccgaacagttcaccgccatgtttcgcagaaaggcatttctgcactggtataccggcgaggggatggacgagatggagttcactgaagcagagtctaacatgaacgacctcgtttctgaataccagcaataccaagacgcgaccgctgaagaggaagaagacttcggcgaagaagcagaagaggaagcctag

SEQ ID NO: 245527 - DNA, 1119 bp, Artificial Sequence
  Description of Artificial Sequence: Synthetic coding sequence
atggactctgtgagatctggaccttttggccagatcttccgcccagataatttcgtgttcggacagagcggtgcaggcaataactgggctaagggccattatactgagggcgcagaattggtggactcagtgctggatgtggtgcgcaaggaagcagaaagttgcgattgtctgcaaggatttcagttaacccatagcctgggcggtggtacaggttctgggatgggcacgctgttaattagcaagatccgggaagaatacccggaccggataatgaatactttctccgtcgtcccctcccctaaagtttctgacacagtggtggaaccgtataacgcaactctatcagtccatcagttagtggaaaacactgatgaaacatactgcattgacaacgaggcactgtatgacatatgttttcgaacactgaaactgaccacgccgacatatggcgatctgaaccacctcgtatcagccaccatgagcggtgtgactacctgtctaaggttcccaggtcagctaaatgccgatcttcggaagctagctgtaaatatggtgccatttccacgcctgcatttcttcatgcctggtttcgcccctcttacaagccggggatctcagcaatacagggctttaactgtccccgaactcactcagcaggtgtttgacgccaagaacatgatggcagcatgcgatccgaggcacggcagatacctcaccgtggcagcagtctttagggggcgaatgtctatgaaggaagtggacgaacagatgctgaacgtgcagaacaagaatagcagttattttgtagaatggatcccaaataacgttaagaccgccgtttgcgacattcccccaaggggactgaaaatggccgttactttcatcggaaattcgaccgctattcaggaattattcaagaggatttccgaacagttcacggcaatgttccgtagaaaggcattcttgcactggtacactggggagggcatggatgagatggagttcaccgaagctgaatcaaacatgaacgacttggtaagcgagtatcaacagtatcaggacgctacggccgaggaggaagaggacttcggagaagaagcagaggaagaagcatag

SEQ ID NO: 245528 - DNA, 1281 bp, Artificial Sequence
  Description of Artificial Sequence: Synthetic coding sequence
atgttctgggaggtgattagcgacgaacacggtatagatcccaccggaacttatcatggcgatagtgacctgcagctagacagaatctcagtttactacaatgaggcaactgggggaaagtacgtcccgagggccattcttgttgatctcgagcctggaacaatggactctgtaagaagtggaccattcggacagatatttcggcctgataatttcgtgttcggccagtcaggggctgggaacaactgggccaaggggcactacaccgaaggcgctgaattggtagatagcgtactggatgttgtgcggaaagaagctgagtcctgcgattgcctgcaggggttccagctgactcattccttaggagggggaacgggttccggtatgggcactttgctgatttctaaaatacgagaggaataccccgaccgaattatgaacacattttctgttgtgccctcccctaaagtgagcgacacggtcgtggagccatacaatgccacgctctccgtgcatcagctggtagagaataccgacgaaacatactgtattgataatgaggcattgtacgatatttgctttagaacactgaaactgaccacacccacatacggtgatctgaaccatctcgtttccgctactatgagcggcgtgactacgtgcctgcgatttcccggacaattgaatgcggatctgaggaagctggcagtgaacatggtgccgtttccaaggctgcactttttcatgcccggatttgcgcctctcacatccagaggatctcagcagtaccgcgctttaacagtgcctgaacttactcagcaggttttcgatgccaagaacatgatggcagcgtgtgatcctagacatggacgatacttgactgtggctgctgtgttcaggggcagaatgagcatgaaggaggttgacgaacagatgctaaacgtgcagaacaaaaacagtagctatttcgtggaatggattccgaataacgttaagacagccgtgtgcgatatccctccgcgtgggttgaaaatggccgtgactttcataggtaactctactgccattcaagagttgttcaagcggatatcagaacagtttacagcaatgtttcggcgaaaggcatttctccactggtatactggagaggggatggacgaaatggagttcactgaggccgaaagcaacatgaatgatcttgttagcgagtaccaacagtaccaggacgccaccgccgaggaagaggaggatttcggtgaggaagcggaggaggaagcctag

SEQ ID NO: 245529 - DNA, 1335 bp, Artificial Sequence
  Description of Artificial Sequence: Synthetic coding sequence
atgcgggagattgtccacatccaggcaggacagtgtgggaatcaaatcggcgcaaaattctgggaagtcatatcagacgagcatggtatagatccgaccgggacctaccatggcgatagcgacctgcagctggacaggataagtgtgtattacaacgaagccacgggtgggaagtatgtgccccgtgcaatcctggtggacctggaaccagggactatggactccgtgaggtcaggccctttcggtcaaattttccggccagataactttgtatttggccagtccggggcagggaacaactgggctaagggacactataccgaaggcgcagagctggtggattccgtcctggatgtagtccgcaaggaagctgaaagttgtgactgtctccagggcttccagctgacacactccctcggaggtggaactggaagcggcatgggtacgctgctcatctcaaaaatccgcgaagagtaccctgatcgaatcatgaacacattttctgtcgtgcccagccctaaagtttcggacacagtcgtcgaaccttacaacgccactctctctgtccaccagttggtggagaacacagacgaaacatattgtatcgataacgaggctctttatgatatatgcttcaggactttgaaactgaccacgcccacatacggcgacctgaatcacttagtttccgccacaatgagcggggtgaccacatgcctgcgattccccggacaactgaacgcagatctccgcaagttggccgtgaatatggtacccttccccagactccactttttcatgcccggatttgcgcctctgacatctcgcggaagccagcagtacagggcattgacagtccccgagctgacacaacaagtgttcgatgctaaaaatatgatggctgcttgcgaccctaggcatggacggtacctgaccgtggccgctgtatttaggggcagaatgagcatgaaagaggttgatgagcagatgctgaacgtgcaaaacaagaactccagctactttgtggagtggattcctaacaacgtgaagactgctgtgtgtgatatcccacccagaggactgaagatggctgtcaccttcattggcaattctaccgctatacaggaactcttcaagagaatttccgagcaattcaccgccatgtttcgcaggaaggcctttctgcactggtacactggagaaggtatggacgagatggagttcactgaagctgagtcaaacatgaatgacctggtgtctgagtaccagcagtaccaagatgcaacagccgaggaagaggaggacttcggggaggaagctgaggaagaagcgtag

SEQ ID NO: 245530 - DNA, 1281 bp, Artificial Sequence
  Description of Artificial Sequence: Synthetic coding sequence
atgttttgggaggtgatctctgacgaacatggcatcgaccctaccggtacctaccacggcgacagtgaccttcagctggatagaattagcgtctactataatgaagctacggggggtaagtatgtccccagggcgatacttgtggacttggaacctgggacaatggactccgtcaggagtggtccctttggtcaaatctttcgcccagacaatttcgtcttcgggcagtctggggctggaaataattgggctaagggacattataccgagggcgctgagctggtggacagcgtcctggatgtggtgcgcaaggaggcagagagctgcgactgcttgcagggcttccagcttacccattcactgggcggtggcactgggtcggggatgggcaccctcttaatttcgaagatccgcgaggagtatcccgaccgtatcatgaacactttttcggtggtacctagtccgaaggtgagcgatacggtggtggaaccttacaatgcaacactgagcgtgcatcagctagtcgagaacacagacgagacttattgtattgacaacgaagctctctacgacatttgctttaggacactgaaactgactaccccaacctacggcgacttgaaccacctggtcagcgccaccatgtcaggggtgactacatgcttgaggtttcctggacagctcaatgcagacctgaggaaactggctgtgaatatggtccccttcccaaggcttcacttcttcatgccaggctttgctccactaaccagcagagggtcccagcagtatagggcgttgacggttcccgagctgacgcaacaagtttttgacgctaagaacatgatggctgcatgcgatccccgacacggaagatacctcaccgtcgccgcagtattcagggggaggatgtcgatgaaggaggtcgacgagcaaatgctgaacgttcaaaacaaaaactcatcctactttgtcgagtggatcccaaacaatgtcaaaacggcagtatgcgatatcccgccaagaggacttaagatggccgttacttttattggaaactcgacagccattcaagagctattcaagcggatctcagagcagttcacggcaatgttccgccgtaaggctttcctgcattggtataccggagaaggcatggacgaaatggagtttactgaggccgagtccaacatgaatgatctggtgtctgaatatcagcaataccaggacgctactgccgaagaggaggaggatttcggcgaggaggccgaagaggaggcctag

SEQ ID NO: 245531 - DNA, 1119 bp, Artificial Sequence
  Description of Artificial Sequence: Synthetic coding sequence
atggattctgtccgctcagggccatttgggcagatattcagacccgataacttcgtattcgggcaatccggtgcagggaacaactgggcaaagggacactatactgagggcgcagaactggtcgactccgtgctggatgtcgtgcgcaaagaggctgaatcctgcgactgtctgcagggctttcagctgacacattccctggggggtggcacaggctctggtatgggaaccttgttgatcagcaaaatccgggaagagtatcccgatcgcatcatgaataccttcagcgttgtgccctctccgaaagttagcgacacggtcgtggagccatataatgctacactgagcgtgcaccaactggtcgagaataccgatgaaacatattgcattgataatgaagccctctatgatatctgttttcgaactttgaagctgacgactcccacttatggcgatctgaatcacttggtgagcgctactatgagtggcgtgacaacctgcctgagatttcctggccagttgaacgccgatctccgtaagctggcagtgaacatggtgcccttccctcgcctgcacttttttatgccaggctttgcacctctgacgtccagggggtcccagcagtaccgcgctctgaccgtcccagagctgacacagcaagtgtttgacgccaagaacatgatggccgcttgtgaccctcgacatggtaggtacttgactgtggccgcagtgtttaggggcaggatgtccatgaaggaggtagatgagcagatgctcaatgtgcagaataaaaactccagctactttgtggaatggatacctaataacgtgaagaccgcggtttgtgacatcccaccccgtggactcaagatggccgtaacgtttatcgggaattctactgcgatccaagagctgttcaaacggattagtgaacagttcacagccatgtttcgaagaaaggcattcctacattggtatactggagagggaatggacgaaatggagtttactgaagccgaatccaatatgaacgatttggtgtcggagtatcagcagtatcaagatgcgaccgcggaggaagaagaggacttcggcgaggaagcagaagaagaggcttag

SEQ ID NO: 245532 - DNA, 1335 bp, Artificial Sequence
  Description of Artificial Sequence: Synthetic coding sequence
atgagggagatcgtccacattcaggccggacagtgtggcaatcagattggggctaagttctgggaagtgattagcgatgagcacggcatcgatccaacaggcacttatcacggagacagcgacctccagctggataggatttccgtttactacaacgaagcgaccggtggaaagtatgtgcccagggctatcctggttgatctggaacctggcaccatggattcagtacgctctggaccttttggtcagatttttcggccagacaatttcgtattcggccagagcggggctggaaataattgggccaagggccattacacagagggggcagagctcgtcgactctgttttagatgtcgtgcggaaggaggccgaatcatgcgattgtctacaggggttccagctgacacactcacttggcggtggaaccggctctggaatgggaactcttctcattagcaaaatccgggaggagtaccccgatcgaattatgaacacattctccgtcgtgccctcacccaaggtgtctgacactgtagtggaaccgtacaacgctactctgagtgtgcatcagctggttgaaaacactgacgagacttactgcatagataacgaagcgctatacgacatctgcttccggactctgaaactcaccaccccgacctacggtgatctgaatcaccttgtgtccgcaactatgagtggcgtgaccacatgcctcaggtttccagggcagctgaatgccgacctgaggaagctcgccgtgaacatggtaccatttcctagactgcacttctttatgcccggattcgccccactgaccagccgcggatctcaacagtaccgtgccctaacggtgcctgaactgacacagcaggtctttgacgcgaagaacatgatggccgcttgtgatcccagacacgggaggtaccttacggttgctgccgtgtttcggggacggatgtctatgaaagaggtggatgagcagatgttaaatgtacaaaacaagaactcttcatattttgttgagtggataccaaataacgtgaagacggcagtctgcgacatccctcccagaggtcttaaaatggctgtgactttcatcggaaattccacggcaatccaggagctgtttaaaagaatctcagagcagttcactgcaatgtttcgcagaaaggcttttctacattggtatacaggggagggcatggacgaaatggagttcactgaagcagaatccaacatgaatgaccttgtaagcgaataccagcaatatcaggacgcaactgccgaggaggaggaggactttggcgaggaggctgaagaggaggcgtag

SEQ ID NO: 245533 - DNA, 1335 bp, Artificial Sequence
  Description of Artificial Sequence: Synthetic coding sequence
atgagagaaatcgtgcatattcaggcaggccaatgtggtaatcagattggcgcaaaattttgggaagtgatttcagatgaacacggcattgaccctaccggaacttatcacggagactctgacctacaattggaccggatttcagtatactacaatgaggcgaccggcggtaaatatgtgccaagagccatattagtggacttggagcccggtaccatggattctgtgcgaagtgggcctttcggacagatcttcagacctgataactttgtgttcggacaaagcggcgctggcaataactgggctaagggacactatactgagggcgcagaattagtggactcagtgctggacgtagtcaggaaggaggcagagtcttgcgactgcctccagggtttccaactgactcatagcctaggcggaggcacgggatctgggatggggacactactgatctccaaaatcagggaagaatatccggatagaattatgaacacgttttccgttgtgccatcgccaaaggttagtgatacggtggtcgaaccatacaatgctacactgtccgtgcatcaactggtagagaatacggacgagacctattgcatcgataatgaggcgctgtatgacatctgctttcgaacgctcaagttgactaccccaacgtacggcgacctgaaccatctcgtcagcgctacaatgtctggagttacaacctgcctgagattccccggacagttgaatgctgatctgcggaaactggctgttaatatggtccccttcccgaggctgcatttctttatgccaggattcgcgccactgacgtctcggggtagtcagcaatatagagccttaacagtgcctgagctcactcagcaggtgtttgacgcaaaaaacatgatggctgcttgcgatccgaggcacggcagatacctgacggttgccgcagtgtttaggggcaggatgagtatgaaagaggtggacgaacaaatgctaaacgtgcaaaataagaacagttcatattttgtggagtggatccctaacaacgtgaagaccgccgtctgtgatattccacccagggggctgaaaatggcagtgacttttattggaaattccaccgcgatccaggagctgttcaagcgcatatcagaacaatttacggccatgtttcgcagaaaggcctttctccattggtacaccggcgagggaatggacgaaatggagtttactgaggccgagagtaatatgaacgacttagtttcagaataccagcagtatcaggacgctacagccgaggaagaggaggattttggcgaagaagcagaggaggaagcgtag

SEQ ID NO: 245534 - DNA, 1335 bp, Artificial Sequence
  Description of Artificial Sequence: Synthetic coding sequence
atgcgggagatcgttcacatccaagcaggccagtgtgggaaccagatcggcgctaagttctgggaggtaatctcggacgagcacggaattgacccaacgggtacttatcatggggatagcgaccttcaacttgataggattagcgtctattataatgaggctacaggcggaaaatacgtgccaagggcgatcctcgtggatttggaacccggaaccatggactccgttagaagtggcccatttggccaaatctttagacctgacaacttcgtgtttggccagtctggagccggaaataattgggctaaagggcactatactgagggtgccgaattggttgattctgtcctcgacgttgtgaggaaggaagcggaaagctgcgattgcctccagggttttcagttgacacattcattaggagggggaacaggttctggcatgggaacactattaatctcaaaaattagagaagagtacccagacaggataatgaatacgttcagtgtggtgccctcccccaaggtgtccgacaccgtagtcgaaccatacaatgcgacattaagtgtacaccaattggtggagaatacagacgaaacatattgcatcgacaacgaggccctctacgatatctgcttcagaacacttaaactcaccactcctacgtatggagacctgaatcatctggtgtcagccactatgtccggcgtgaccacctgcctgcgattccccggacagcttaatgccgacctgcgaaagttagccgttaatatggtgccattcccgaggctgcactttttcatgccaggtttcgcgccactgacctcccggggaagccagcagtaccgcgcactcactgtccctgagctgacacaacaagtgtttgacgccaaaaatatgatggccgcttgtgatccaagacatgggcgatatctgaccgtggcagctgtgttccggggtcgcatgtcgatgaaggaggttgatgagcaaatgctaaacgttcagaataagaactcatcgtattttgtggaatggatccctaacaatgtgaaaaccgccgtgtgcgacattccgccaaggggtctgaaaatggcagtgacctttatcggcaactccactgcgatacaggagctttttaaacgtatttccgaacagttcacagccatgtttcgcaggaaggccttcctgcattggtacaccggtgagggtatggatgaaatggaattcactgaggctgagagcaacatgaacgacctggtatctgaatatcagcagtaccaggacgccaccgccgaagaggaagaggattttggggaggaggccgaagaggaggcatag

SEQ ID NO: 245535 - DNA, 1062 bp, Artificial Sequence
  Description of Artificial Sequence: Synthetic coding sequence
atgcgggaaattgtccatatacaagctggccagtgcgggaaccagattggtgccaagttttgggaggtgatttcagacgagcatggcattgatcccactggcacctaccacggcgattccgacctgcagcttacacatagtctggggggtggcaccggcagcggtatggggaccctgttgatcagcaagattagggaggaatacccggacaggattatgaatactttcagcgttgtgcccagcccaaaggtatctgacaccgttgtggaaccctataacgcgacgctctcggtccaccagctcgtggaaaatacagacgaaacctattgtattgacaacgaggcactatacgatatttgctttcgtacactcaaactcactacgcctacatatggggatctcaatcacctggtgtccgccaccatgtctggggtgacaacatgcttgagattcccagggcaattgaacgctgatttgcggaaactggctgtgaacatggttcctttcccacgtctgcatttttttatgccagggttcgcccctctgacgtctcgtggttcacagcaatatcgcgcacttaccgtccctgagctgacacagcaggtgttcgatgctaaaaatatgatggccgcttgcgatccacgccacgggagatacctgaccgttgctgccgtgtttaggggcagaatgtccatgaaggaggtcgatgagcagatgctgaatgtgcaaaacaagaattcgagttatttcgtggagtggatccctaacaacgtaaagacagcagtgtgcgacatccccccacggggtctaaagatggcagtgaccttcatagggaattccacggctattcaggagctgttcaaacgcattagcgagcaatttaccgccatgttccgaagaaaggcctttctccattggtataccggtgaggggatggacgaaatggagttcaccgaggccgagtctaacatgaatgacctcgtttcggagtaccagcagtaccaagacgcaacggctgaggaagaggaggatttcggggaggaggctgaggaagaggcctag

SEQ ID NO: 245536 - DNA, 1281 bp, Artificial Sequence
  Description of Artificial Sequence: Synthetic coding sequence
atgttctgggaagtgatttctgacgagcatggaattgatcccacagggacataccatggagattccgacttacagctggatcggattagtgtctattacaacgaggcaacaggtggaaaatacgtacctcgcgcaatactggttgacctggagcctgggaccatggactcagtccgctctggtcccttcgggcagatttttaggccagataattttgttttcggtcagtccggggctggcaacaattgggccaagggtcactatactgagggggcagaattagtagactctgtgctggatgtggtccgcaaggaagcggagagctgtgactgcctccaaggattccagctgactcattctctgggcggaggcacaggttctgggatggggaccctcctgatctccaagatccgggaggaatacccagatcggatcatgaatacatttagtgtcgtgccctcgccaaaagtcagcgacaccgtggtagagccctacaacgccacgctctccgtccaccaacttgtcgagaatactgatgagacatattgtatcgataatgaggcactgtacgatatttgtttccggaccttgaagctgaccaccccgacatacggcgacctaaatcatctggttagcgcaacaatgagcggagtaacaacttgcctacggttccctggacaattgaacgccgacttaagaaagctcgctgttaacatggtccccttcccacgtcttcacttcttcatgcccggatttgccccacttacgagccgcggtagccagcagtatcgcgcactcacagtcccagaactaacccaacaggtcttcgatgccaagaacatgatggctgcctgcgaccccagacatggcagatacctcacagtggctgccgtgttcaggggtcgaatgtcaatgaaggaggtcgacgagcagatgctgaatgttcaaaataagaatagcagctattttgtcgagtggatccctaacaatgtgaaaacggctgtgtgcgatatcccccctcgcggtctgaagatggccgttacttttattggaaattccacagccatacaggagctgtttaaacgcataagcgaacaattcacagctatgttccggagaaaggccttcttacactggtacaccggggagggaatggacgagatggaattcacagaggctgaaagcaacatgaatgatctagtgtcagagtatcagcaataccaggacgccacagcagaggaagaggaagacttcggcgaggaagccgaggaggaggcatag

SEQ ID NO: 245537 - DNA, 1119 bp, Artificial Sequence
  Description of Artificial Sequence: Synthetic coding sequence
atggacagtgtgcgcagtggacctttcgggcaaatctttcgtccagataattttgttttcgggcagagcggagccggtaataattgggcaaagggccattatactgaaggggcagagctggttgacagtgtcctggacgtcgttcgaaaagaggcagaatcttgtgattgcctccaaggatttcaattgactcatagcctgggcggtggcacagggtctggtatgggtactctgctcatatctaagattcgcgaggaataccccgacaggatcatgaatactttcagcgtggtaccgagtcccaaggtgtccgatactgtggttgaaccctacaacgccaccctgtccgtgcatcagctggtagaaaacaccgacgagacttattgcatagataatgaagctctctatgacatatgcttccgcaccctaaagctgacaacacccacctacggagatctgaaccacctggtatccgccactatgagcggcgttactacctgtttacgctttcctggccaactaaacgccgaccttcggaaattggcagtaaacatggtaccattcccacggcttcacttcttcatgccaggtttcgcccctcttacctctcgcggaagtcaacagtatcgggctctgaccgttccagaactcacccagcaggtgttcgacgctaagaacatgatggcagcatgtgatccgaggcacggtagatacttaaccgtcgcagctgtcttcaggggaaggatgagtatgaaagaggtggacgagcaaatgctgaatgtgcagaacaagaattcttcatatttcgtggagtggattcccaataatgtgaagactgccgtttgcgacatacctccacggggtctgaaaatggctgtgacctttataggcaattcaacagcaattcaggagttattcaaacgaatttccgagcagttcacggctatgtttcgacgaaaagcatttctccactggtacacgggcgaaggaatggacgagatggagtttactgaagccgagtccaacatgaatgaccttgtcagcgagtatcaacagtaccaggacgccactgccgaggaggaggaggatttcggcgaggaggcagaggaagaggcttag

SEQ ID NO: 245538 - DNA, 1281 bp, Artificial Sequence
  Description of Artificial Sequence: Synthetic coding sequence
atgttctgggaggtgatctcagatgagcacggcatagaccctactggtacctaccacggtgattccgacctgcaactggacagaatctccgtgtattataacgaagctactgggggaaaatatgtgccccgtgctatcttggtcgacctggagccaggcactatggactcagttcgcagcggtccctttggacagatttttaggcctgacaattttgtgttcgggcaatctggtgcgggaaataattgggccaagggtcactacacagagggtgcagagctggttgacagtgtcttggatgtggttagaaaagaagctgaaagctgcgattgtctacaaggatttcaactgacacactctctggggggaggcaccgggtcaggtatggggacccttctgatatccaagatcagagaagagtaccccgatcgcatcatgaatactttctccgtcgtgccatcaccaaaggtcagtgacacagtggtggagccctacaatgctactctgtcagtacatcaattggtggagaataccgacgagacatactgcatcgacaatgaggcattatatgacatttgctttaggacacttaaactcacaactcctacctatggcgaccttaatcacttggtaagcgctaccatgagtggagttacaacatgcctcaggttcccaggacagctgaacgcagatctaaggaagttggccgtcaacatggtgccatttccaaggctccacttctttatgcctggctttgccccacttacttcacgcggatcacagcagtatagggccctcacagtgcccgagttaactcagcaagtattcgatgctaagaatatgatggccgcttgtgaccctcgacatgggcgatacttgaccgttgccgctgtctttaggggcaggatgtctatgaaagaagtcgacgagcaaatgctaaacgtgcagaacaagaattcctcctatttcgttgagtggatccctaacaacgtgaagacagccgtctgcgatattccgccaagaggactgaagatggccgttaccttcatcggcaattctactgcaatccaggaattgtttaaacggatctccgaacagtttaccgctatgttccgacgcaaggcttttctgcactggtacactggggagggaatggacgaaatggaatttaccgaggcagaaagcaatatgaacgatttggtctccgagtatcagcagtatcaggacgctaccgctgaggaagaggaagacttcggcgaggaggcggaggaagaggcgtag

SEQ ID NO: 245539 - DNA, 1281 bp, Artificial Sequence
  Description of Artificial Sequence: Synthetic coding sequence
atgttttgggaggtcatttccgacgaacacggaattgaccccactgggacatatcacggtgacagtgatttgcaactggaccgaatatcagtttactataacgaagctaccggtggcaagtacgtccctcgtgccattctggttgacttagaacctggaaccatggattctgtcagatccggtccattcggccagatatttcggcctgataactttgtgtttgggcagtcgggcgcaggcaacaattgggcaaaaggacactatacagaaggagccgaactggttgattccgtattggacgtcgtacgcaaagaagctgagtcctgcgattgtctgcaggggtttcagctgactcactctctaggaggagggacaggcagtggtatgggcacactgctgatatcgaaaatccgagaagagtaccctgatcgcattatgaacacattctccgtggtacccagccccaaagtctcggacactgttgtggaaccttacaacgcgacgttgagcgttcaccagcttgttgagaataccgacgagacatactgcattgacaacgaggctctctatgacatctgcttcagaactctgaagttaaccaccccaacctatggggacctaaatcacttggtttccgcaacaatgtctggggtgactacctgcctgaggttccccggacagctgaacgccgatttgagaaagctcgctgtaaacatggtgccgttcccacgccttcactttttcatgcctggcttcgcccctttgacatccagagggtcccagcagtaccgggctctgaccgtccccgagctgacgcagcaggtcttcgacgctaaaaacatgatggccgcatgcgatccacgtcatggcaggtacctgactgtggcagcagtctttcgtggaaggatgtctatgaaagaggtggacgagcagatgctcaatgtccagaacaagaactccagctatttcgttgaatggattcccaacaacgtaaagacagccgtctgcgatatcccaccacgcggtctcaagatggctgtgactttcataggcaatagtaccgctattcaggaactgtttaagaggatatccgagcagtttacagctatgttcagacgaaaagcattcctccattggtacaccggtgaaggcatggacgagatggagtttacagaagctgagtcaaatatgaacgatttagtctcagagtatcagcagtaccaggatgctacggcagaagaagaggaagatttcggtgaagaagctgaagaagaagcatag

SEQ ID NO: 245540 - DNA, 1119 bp, Artificial Sequence
  Description of Artificial Sequence: Synthetic coding sequence
atggatagcgtgaggtcaggccctttcgggcagatcttccggcctgataactttgtgtttgggcagagtggggctggcaataactgggcaaaggggcactatacagaaggcgctgaacttgtggattctgttctggacgttgttcgcaaggaagctgagtcttgtgattgcctgcagggatttcagctcacacactctctagggggtggtacgggaagcgggatgggaaccctgctgatttcaaaaattagggaggaatatcctgacaggattatgaacactttttccgtcgtgccttcgcccaaagtgagtgacaccgtcgtggagccttacaatgcaacgttatcagtgcaccagctggtggagaacaccgacgagacctattgcatcgacaacgaagcattatacgacatctgcttccgaaccttgaaactgactactcctacatacggtgatctcaaccacctggtttccgcaacaatgagtggagtgaccacgtgtttgcgtttccccggtcagttgaacgcggacttaaggaaactggctgtgaacatggttccgtttccacgcctacactttttcatgcctggattcgcaccattaacttctcggggatcacagcagtatagagctttaaccgtgcctgaactgacacagcaagtgttcgatgccaagaacatgatggcggcttgtgatccgcgtcatggccgatacttgacagttgcagccgtgttcaggggaagaatgtccatgaaggaagtggatgaacagatgctgaacgttcagaacaaaaacagctcttacttcgtggagtggatacctaataatgtgaaaactgcagtttgcgacattccgcctaggggattgaagatggctgtgactttcattggcaatagtaccgcgatccaggagctgtttaagaggatcagtgaacagttcaccgctatgtttagaaggaaggccttcctgcattggtatacgggtgaaggaatggacgagatggaatttactgaagctgaaagtaacatgaatgatttggtttcagaataccagcagtaccaggacgccacagcagaagaagaagaggacttcggagaggaagccgaggaggaggcttag

SEQ ID NO: 245541 - DNA, 1335 bp, Artificial Sequence
  Description of Artificial Sequence: Synthetic coding sequence
atgagagaaatcgtccacattcaagcaggacagtgtggcaatcaaattggcgctaagttttgggaggtcataagcgatgaacacgggattgaccccactggcacataccatggtgatagtgatctccagcttgatcggattagcgtttactataatgaggctaccggcggaaagtacgttcccagggctatccttgtggacctcgagcctggcaccatggattctgtgcggagtggcccttttggccagatatttagacccgataacttcgtattcggccagagcggggctggtaacaactgggccaagggccattacacggagggtgctgagctcgtggactccgtgttggatgttgtacgcaaagaagcagaaagttgtgactgcctccaaggatttcagctcacacacagcttgggcggaggcacaggctctggcatgggcactctgctgattagtaaaattcgggaagagtaccctgatcggataatgaatactttttccgtagtgcccagccctaaggtgagcgacacagtggtagagccttataatgcaacactttctgtacatcagcttgtggagaacactgacgagacatactgcatagataacgaagctctgtatgatatatgctttcgtaccctcaagctgaccacaccgacgtacggagatctgaaccacctcgtatcagcaaccatgagcggcgtcacaacgtgtctccggtttcctggccagctcaacgccgatcttcggaaactggccgtgaatatggtgcctttccctcgcctacattttttcatgcccggattcgccccactgacctcgaggggtagccagcagtatcgcgctctgactgtaccagaattgacacagcaggttttcgacgctaagaatatgatggcggcatgtgaccctaggcacgggagatacctgactgtggccgcagtttttagagggcgtatgagcatgaaggaagtagacgagcagatgttaaatgtgcagaataagaatagctcctattttgtggagtggattcctaataatgtcaagactgctgtgtgcgatatacccccacgcggattgaagatggcagtgaccttcatcgggaactctacagcaattcaggagctgttcaagagaattagtgagcaatttacggccatgttcaggcggaaagccttcctgcactggtacaccggagagggcatggacgagatggaattcaccgaggcagagtcaaatatgaacgacctcgtgagcgaataccaacaatatcaggacgcaaccgccgaggaggaagaggatttcggagaggaagcggaagaggaggcatag

SEQ ID NO: 245542 - DNA, 732 bp, Artificial Sequence
  Description of Artificial Sequence: Synthetic coding sequence
atgcgcgagattgtgcatattcaagccggacagtgtggaaatcagatcggcgcaaagttttgggaggtgatctccgacgaacatggcatcgaccctacaggtacctatcatggggatagtgacctgcagctcgaccgtatttcggtgtactataatgaggccaccggaggaaagtacgtcccaagggcaattctagtggatcttgagcccggaaccatggactccgtccgctcggggccttttggacaaattttccgaccagacaactttgtgttcgggcagtctggtgctggtaataattgggcaaaaggccactacacggaaggggcagaactggtggattctgtgctggacgtggtcaggaaagaggaggtggatgagcagatgcttaacgtccaaaacaagaactccagttactttgtggaatggatacctaataatgttaagaccgctgtgtgtgacattccacctagagggctgaaaatggccgtaacctttatcggaaactcaaccgccattcaggaactgttcaagaggatcagcgaacagtttaccgccatgttcagaagaaaggctttcctgcattggtatacaggggaaggaatggacgagatggaattcacagaggccgagtcaaacatgaacgatctggtgtcagagtatcagcagtaccaggatgctactgccgaggaggaggaggactttggggaggaggctgaagaggaggcttag

SEQ ID NO: 245543 - DNA, 1119 bp, Artificial Sequence
  Description of Artificial Sequence: Synthetic coding sequence
atggattctgtgagaagcggacctttcggccagattttccggccagataactttgttttcgggcaaagcggcgctgggaataactgggctaaaggccactacaccgaaggcgctgagctggtggacagcgtcttggatgtggttcggaaggaggccgagtcctgtgattgtctgcaaggcttccaattaacccactcactcgggggaggaacagggtcaggtatggggaccctgttgatctctaagattcgtgaagagtaccccgaccgcatcatgaacactttctcagttgtgcccagcccaaaggtttccgacactgtggttgagccctacaacgctacactcagcgtccatcagctcgtcgaaaacactgatgagacctactgtatcgataacgaagctctctacgatatctgcttcagaactctcaagcttactacaccaacatacggagacctcaaccatttagtctccgctacaatgtctggagtgacaacatgcctgcgcttccctggccaactgaatgcagaccttaggaaactcgccgtgaacatggtgcctttccctcgccttcatttcttcatgcctggcttcgctccactcaccagccggggaagtcaacagtatagagcactgacggttcctgagctcactcaacaagtttttgacgcaaaaaatatgatggcagcctgcgatccaagacacggtcgttaccttaccgtcgcagctgtcttcagaggtcggatgtctatgaaagaagtcgatgagcagatgttgaatgtccagaacaaaaacagctcatactttgtcgagtggatcccaaataacgtgaagaccgccgtttgtgacatccccccaaggggcctgaaaatggccgtgaccttcatcggtaattccaccgcaattcaggaacttttcaaacgcattagtgaacagttcactgccatgtttagacgaaaggcctttctgcactggtataccggcgagggcatggatgagatggagttcacagaggcagagtcaaatatgaacgatctcgtctccgaatatcagcagtaccaagacgccaccgcagaagaagaggaggatttcggggaggaggcggaagaagaggcgtag

SEQ ID NO: 245544 - DNA, 1119 bp, Artificial Sequence
  Description of Artificial Sequence: Synthetic coding sequence
atggacagtgttcgatccgggccttttgggcagatttttagacccgacaactttgtcttcggtcagtcaggcgctggtaataactgggctaagggacattacactgagggagcggagcttgtcgactcggttctcgacgtggtcagaaaagaggccgagagctgcgattgcctgcagggtttccaactgacccactccctgggcggaggaactggctctggcatgggaacgcttctcatctctaagatcagggaggagtacccagacagaatcatgaataccttctccgtagtgccctctcccaaggtgtcggatacagtcgtggagccatacaacgctacactgtcagtccatcagctcgttgagaataccgatgagacatactgtatcgataatgaggcactgtacgatatctgcttcaggaccctgaagctgactacgccaacatatggggacctgaatcatctcgtctccgctactatgagtggtgtcaccacctgcttgcgctttcccggtcagctgaatgctgatctgagaaagttagcggtgaacatggtgcctttccctagattgcacttttttatgcccggattcgcacccttgacctctcgcggttcacagcagtaccgggctctgaccgtgccggagctgacacagcaggtcttcgacgctaagaacatgatggcagcatgtgacccgaggcatgggaggtaccttaccgttgctgccgttttccgtggcagaatgtctatgaaagaagtagatgagcagatgttgaacgtacagaacaaaaattctagctacttcgtggagtggatcccaaacaacgttaagacagcagtgtgcgatattccaccaagaggattaaagatggctgtgacttttattggcaactccacagcaattcaagagctcttcaagcgcatctccgagcagtttaccgccatgtttaggagaaaggctttcttgcactggtatacaggagaaggaatggacgagatggaatttactgaggccgaatccaatatgaatgatctggtgtcagagtaccagcagtaccaagacgctaccgcggaggaagaggaagactttggagaagaggccgaggaggaggcatag

SEQ ID NO: 245545 - DNA, 1335 bp, Artificial Sequence
  Description of Artificial Sequence: Synthetic coding sequence
atgcgtgagattgtgcacatccaagccggtcagtgtggaaatcagattggtgcgaagttctgggaggtcatctccgacgagcacggcatcgatcctaccgggacatatcacggtgacagcgatctccagttggataggatcagcgtctattataacgaagcgacgggtggaaagtacgtgccgcgtgcaatattggtggatctcgaaccaggcacgatggacagtgtacgtagcggtcccttcggtcagattttcagacctgacaacttcgtgttcggtcagtccggagccggaaataactgggcaaagggccactacacagaaggagccgagctggtagatagcgtcctcgatgttgttcggaaggaagctgagagttgtgattgcctccagggcttccagcttacccattctcttgggggagggaccggctccggtatgggaaccctcctgatttctaagatcagggaggaatatcccgacagaatcatgaacactttttctgtcgttccgtcaccgaaggtgtctgatacggtggtggaaccatacaacgcgacactttccgtccaccagctagtggaaaataccgacgagacctattgtatcgacaatgaggcgttgtacgacatttgcttccggactctaaaactcacgaccccaacatacggggacttgaatcatctggtgagcgcaacaatgtcgggcgtgacgacttgcctgcggttccctggccagctgaacgcggatctaagaaagcttgcagtaaatatggtgccttttccacggcttcatttttttatgccaggattcgctccattgacctccagaggtagtcaacagtaccgggctctgaccgtgccagagcttactcaacaggtttttgatgctaagaatatgatggcggcatgtgacccaaggcatgggaggtacctgactgtggctgccgtctttagaggtagaatgtctatgaaagaggttgacgaacagatgttgaacgtgcagaacaaaaattctagttattttgttgaatggatcccgaacaatgttaagactgccgtctgtgacataccaccacggggacttaaaatggccgtgactttcatcgggaatagtacggccatacaagagcttttcaagcgcatcagcgaacaattcaccgccatgtttcggagaaaggcctttcttcattggtacacaggggagggtatggatgagatggagtttacagaagctgagagcaacatgaatgatctggtttcagagtatcaacagtatcaagacgccaccgccgaagaagaggaggactttggagaggaggccgaagaggaagcttag

SEQ ID NO: 245546 - DNA, 1119 bp, Artificial Sequence
  Description of Artificial Sequence: Synthetic coding sequence
atggatagtgttcgaagtggtccgtttggacagatttttaggcctgacaacttcgtctttggccagtctggcgcagggaacaactgggccaagggtcactacactgagggtgcagagctcgtggacagtgtcttagatgtcgtccggaaggaagcagaatcctgcgattgccttcaggggttccagcttacccatagtctgggtgggggaactggctctggaatgggtactctgcttatttctaaaattagggaggagtaccctgaccgcattatgaacaccttctccgtggttccgtcccccaaggtctccgacaccgtggttgagccttacaacgctactttgtcagtgcaccagctggttgagaataccgacgaaacctattgtatagacaacgaggcattgtatgatatctgttttcgcacactcaaactgactactcctacatatggtgacctcaatcacctggtgtccgccacaatgagtggcgtgacaacctgcttgagatttccgggacaactcaacgccgacctgaggaagctagcagtgaacatggttcctttcccaagattgcatttctttatgccgggttttgccccactgaccagtcgcggatcgcagcagtacagggcactgacagttcccgagctaacccagcaagtgtttgatgcaaagaatatgatggcggcatgcgaccccaggcatgggagataccttactgtggctgctgtatttagaggtagaatgtcgatgaaggaagtggatgagcagatgctcaacgtccagaacaaaaacagctcatacttcgtagagtggattccaaacaacgtgaaaacagccgtctgcgatatcccccctcggggtttaaaaatggctgtgacattcattggcaacagcacagcaatccaagaactgttcaagcgtattagcgagcagttcacagccatgttcaggcgtaaagcttttctgcattggtatacaggagagggaatggatgagatggaatttactgaagccgagtccaacatgaacgatcttgtgagcgagtaccagcagtaccaagatgccacagccgaagaggaagaagacttcggagaggaagcagaagaggaggcttag

SEQ ID NO: 245547 - DNA, 1119 bp, Artificial Sequence
  Description of Artificial Sequence: Synthetic coding sequence
atggacagcgtgaggtccgggccttttggacaaatttttaggcctgataacttcgtcttcggccagtcaggtgccggtaacaactgggctaaaggtcactatacagagggcgcagagttggttgattccgttctggacgttgtgcgaaaggaagccgaatcctgtgactgcttacagggcttccagctcacacatagccttggcggtgggacaggaagcgggatgggaactcttctgatttccaagatacgtgaggaatatcccgacagaatcatgaatacttttagcgttgtgccatcaccgaaggtgagcgacacagtggtagagccatacaatgccaccctgagtgtgcaccagctggtcgaaaacactgatgaaacctactgcatagacaacgaggctttatatgatatatgcttccgcactctcaaattaaccacgcctacttatggggacctgaaccatcttgtgtctgcgacgatgagcggagttaccacctgcctgcgtttccccggtcagctgaacgccgatcttcgaaagcttgctgtgaatatggttcctttcccgcgtctgcatttctttatgcccggtttcgcccctctgacctcccggggaagtcaacagtaccgagcattaactgtcccggaattaacccagcaggtgttcgatgccaaaaatatgatggctgcttgtgatcctaggcatgggaggtacttaacggtggcggcagttttccgcggaaggatgtccatgaaagaagtggatgagcagatgttaaatgttcagaataagaacagttcttatttcgttgagtggattccgaacaacgttaagaccgcggtttgtgatattcctccgagaggcctgaagatggccgtgacattcatcggcaactcgaccgctatacaagagctgttcaagaggatcagcgagcagtttaccgctatgtttagacggaaagccttcttgcactggtacaccggggaagggatggatgagatggagttcacagaggcggagagcaacatgaatgatttagtatccgaataccagcagtatcaggatgcaacggccgaggaagaagaagacttcggagaagaagcagaagaggaggcgtag

SEQ ID NO: 245548 - DNA, 1119 bp, Artificial Sequence
  Description of Artificial Sequence: Synthetic coding sequence
atggattccgttcgatcgggaccattcggccagattttcaggcccgacaattttgtttttgggcagtcaggcgcagggaacaattgggctaagggtcactataccgaaggcgcagagctggtggacagtgtgctggacgtggtacggaaggaggctgagtcctgcgattgtttgcagggattccagctgacccacagtctaggcggtgggacggggagtggcatgggaacactactgatcagtaagattcgggaggaatatcccgacagaatcatgaacacctttagcgtggtgcctagtcccaaggttagtgacacggtagtagagccgtataatgctacactgtctgtccaccagcttgtcgagaacactgacgaaacatattgtattgataatgaagctctgtacgatatttgcttccgcactcttaaactgaccacccccacttacggagaccttaatcacctggtctcagcaaccatgagcggagttaccacatgcctccgtttccccggacagttaaatgccgacctgcgaaagctggctgttaacatggtgcctttcccacgcttgcatttctttatgccagggttcgcacctctgacttcccggggaagtcagcagtatcgggctctgaccgtcccggagttgactcagcaggtgtttgatgccaaaaatatgatggcagcatgtgacccccgacacgggcgttacctcacagtcgctgctgtgtttaggggtaggatgtccatgaaggaggtggatgaacaaatgttgaatgttcagaacaaaaacagctcctacttcgttgagtggataccaaacaacgtgaaaaccgcagtatgtgacatccctccaagagggctgaaaatggcagtcacctttatcggcaatagcaccgccatccaggagctcttcaagcgcataagcgaacagttcacggcaatgttccggagaaaggcttttctgcactggtacactggcgagggtatggatgagatggagttcactgaggccgagtctaatatgaacgacctggtttccgaatatcaacagtaccaggatgcaaccgcggaagaagaggaagactttggagaagaggcggaggaggaggcctag

SEQ ID NO: 245549 - DNA, 1119 bp, Artificial Sequence
  Description of Artificial Sequence: Synthetic coding sequence
atggattcggtgcggtccgggcctttcggtcagatctttcgccctgacaacttcgtgttcgggcagtccggcgctggaaacaactgggctaagggccattatacagagggagcagagttggtcgactccgtcctggacgtggtccggaaggaggctgaaagctgcgattgtttacaggggtttcagcttacccattcccttggaggcggaacaggcagtggaatgggtacacttctgattagcaagatcagagaagaatacccagatcgaataatgaacacatttagtgttgtgccttcaccaaaggtctctgatacagttgttgagccctacaatgctacattaagtgtccaccagttagtggaaaacaccgacgagacttactgtatcgacaatgaagctctgtacgatatttgtttcaggacactcaagctgactactcctacctatggcgacctcaaccatctggtcagcgcaacaatgagcggagtcacaacctgcttacgcttcccgggacagctgaatgcagacctaagaaagctggctgtgaacatggtgccgttcccaagactgcacttctttatgccgggtttcgccccactcacctctcggggttcccaacagtacagggccctgacggtgcccgagctgacacagcaggtcttcgacgctaagaatatgatggcggcttgtgacccccgtcatggacgatacctgactgtggctgcagtgttccggggaagaatgagtatgaaagaagtggatgagcagatgttgaatgtccagaataaaaattctagctactttgtggaatggatccccaataacgtgaagacagctgtgtgtgatattcccccaaggggcctgaaaatggctgtgacttttattggtaactccactgccatccaggaattattcaagagaatatcagaacagtttaccgctatgttccgacgcaaggccttccttcactggtacaccggagaaggcatggatgaaatggagttcacagaggcagaatcaaacatgaacgatctggttagtgagtatcagcagtaccaggatgctaccgccgaagaggaggaagattttggtgaagaagctgaggaggaggcttag

SEQ ID NO: 245550 - DNA, 1119 bp, Artificial Sequence
  Description of Artificial Sequence: Synthetic coding sequence
atggacagcgttcggagtggtccgttcgggcagatctttcgccctgataattttgtattcgggcagtccggagccggaaacaactgggcgaaaggacactataccgagggcgctgagcttgtggactctgtcctggatgtggtgcgtaaggaagccgaatcttgtgattgcctgcagggctttcagctcacacactccctcggaggtggcacaggtagcggtatgggaaccttactaatttctaagatacgggaggagtaccctgatagaataatgaataccttcagcgtcgtgcccagtccaaaggtgtccgacactgtcgtggagccttacaacgctacactatccgttcatcagttagtcgagaatacagacgagacatattgcattgataatgaggcgctttatgatatttgctttcggacactgaagctgactacccctacctacggagatctaaaccacctggtgtcagccactatgagcggcgtgaccacatgcctgcgatttcccggtcagctgaacgctgacttaaggaaactggcagtgaacatggtgccattcccacgattgcatttctttatgccgggattcgctcctttaacaagccgtggaagtcagcagtatagagcacttaccgtaccggaactcacacagcaagttttcgatgccaagaacatgatggccgcttgcgacccccgacacgggagatacctcactgtggcggcagtcttcagaggtagaatgtctatgaaagaggtggatgaacagatgctgaacgtacaaaacaaaaacagctcatacttcgtcgagtggattcccaacaatgttaaaaccgctgtttgtgacatacctcctcgaggattgaagatggccgtgacctttatcgggaattctaccgcaattcaggagctgttcaaacggatctcagagcagttcactgcaatgtttcggagaaaagctttcttgcactggtataccggtgaaggcatggacgagatggaatttacagaagccgaaagcaacatgaacgaccttgtcagcgaataccagcagtatcaagacgcgactgctgaggaagaggaggacttcggagaagaagccgaagaagaagcctag

SEQ ID NO: 245551 - DNA, 1119 bp, Artificial Sequence
  Description of Artificial Sequence: Synthetic coding sequence
atggattctgtcaggtcagggccattcggacaaatcttccgcccagataattttgtgttcggacagagcggcgctggcaacaattgggcgaagggacattacaccgagggagctgagttagtggattcagtcctggacgtcgtacgcaaggaggcagaaagctgcgactgtctgcagggcttccagctcacccattccctaggcggaggaacaggttctgggatggggactttgttgatctccaagatcagggaagagtaccccgatagaatcatgaacactttctcggtggtgccctctcctaaggtcagcgataccgtggttgaaccttataatgccaccctgtccgtccatcagctcgtggagaacaccgatgagacatactgcattgacaatgaggccctctacgatatctgtttccggacactcaaattaactactcccacttacggagacttgaaccacctggttagcgctacaatgtccggggttaccacgtgtctgcgattcccaggacagctgaacgcagatctgcggaaactcgcagtcaacatggtgccgtttcccaggttacacttttttatgccaggatttgccccattgacatctcggggaagccagcagtatagggcactaacagtcccggaactgacgcagcaggtattcgacgccaagaatatgatggctgcttgcgatcccagacatggcagatatctgaccgtcgctgctgtattccgaggtcggatgagcatgaaggaggtcgacgagcagatgctgaacgttcaaaataaaaatagttcatactttgtagagtggatcccaaacaacgtaaaaacagcagtttgcgatataccaccgaggggcctcaagatggccgtaacttttattggcaacagcactgccatccaggagctcttcaagaggatttccgaacagtttactgcgatgtttcgccgaaaggcgttcctgcattggtacaccggtgagggcatggatgagatggagttcaccgaagcagagtctaatatgaacgacctggtaagtgagtaccaacagtatcaggatgctactgctgaagaagaggaggacttcggcgaagaggccgaagaggaagcctag

SEQ ID NO: 245552 - DNA, 624 bp, Artificial Sequence
  Description of Artificial Sequence: Synthetic coding sequence
atgggcacactgctcatatccaaaatccgcgaagaatatccggatcgcattatgaatacattttcagtggttccatcgccaaaggtcagtgacacagtcgtggagccgtataatgctacgctctcagttcatcagctggtggaaaataccgatgaaacttactgcattgacaacgaggccctatacgacatctgcttcaggacactaaaattgaccactccaacttacggcgacttgaaccaccttgtcagtgccaccatgagtggcgtgacaacgtgcctgaggttccctgggcagctgaatgccgacctgagaaagttggctgtgaacatggtgccgttcccacgccttcacttttttatgcctgggttcgcccctctgacttcgcggggttcccaacagtaccgcgcactgactgtgcccgaacttacccagcaggtttttgatgcaaagaatatgatggctgcctgtgatccccgtcatggcagatacctgactgtggctgccgtgttcagaggaagaatgtcaatgaaagaggtcgacgagcaaatgcttaacgttcagaataagaatagtagttatttcgtcgaatggcctcaacagtgccaggactcccgactatag

SEQ ID NO: 245553 - DNA, 1248 bp, Artificial Sequence
  Description of Artificial Sequence: Synthetic coding sequence
atgagggaaatcgtccatatccaggcaggccagtgcggcaatcagataggcgcaaaattttgggaagttataagtgacgaacacgggatagaccctaccggcacctatcacggcgattcagatttacagctggataggatctccgtctattataacgaagccaccggaggaaaatatgttccaagagccatactggtggatcttgaacccggtacgatggattccgtgcgttcagggccattcgggcagattttcaggccggataacttcgtttttgggcagtccggcgctggaaacaattgcctgcaaggctttcaattgacgcattcgcttggtggaggaaccggcagcggtatgggcacgctgctcatttcaaaaatacgagaagagtaccccgatcggataatgaatacgttctcagtggtgcccagccccaaggtcagcgatactgtggtcgaaccatataacgctactctcagtgtgcatcagctggtggagaacaccgacgagacgtactgtattgataatgaagccctctacgacatatgcttcagaacactcaaactgacaacccctacctatggtgacttgaaccacttggtgtccgccaccatgtccggcgtaactacctgtctgagatttcccggtcaactcaatgccgatctcagaaaactggcagttaacatggtgcctttcccacggctgcatttcttcatgccaggctttgcacctctaacctctcgcggatctcagcagtacagggcactcacagttcccgagctgacccaacaagtgtttgatgcgaaaaacatgatggcagcatgcgatcccagacatggaaggtacctgaccgtggctgctgttttccgcggaaggatgagcatgaaagaggtggatgaacagatgctcaatgtgcaaaacaaaaattctagctattttgtggaatggattccaaataatgttaagacagcggtgtgtgatatacccccacgcggactgaagatggccgtgacgtttatcggaaactcaacagccatacaggagctgttcaaacgcatctcagagcagttcactgccatgtttagacgcaaggcctttttacactggtatactggggaggggatggacgagatggagttcacggaggcagaatccaacatgaatgacctcgtgtccgaatatcagcagtaccaggatgctactgccgaagaggaggaagactttggtgaggaggcagaggaagagtag

SEQ ID NO: 245554 - DNA, 1062 bp, Artificial Sequence
  Description of Artificial Sequence: Synthetic coding sequence
atgcgcgagattgtgcacatacaggcgggtcagtgtggcaatcagatcggcgcaaaattttgggaggtgattagcgatgaacatggcatcgaccccacaggaacataccacggcgattccgacttgcagctgacccattcccttgggggaggcactggcagcgggatgggcacccttcttatcagcaagatcagagaagaatatccagatcgcatcatgaatacattttcagttgttccatcacctaaggtcagcgacactgtggtcgagccctataacgccacactctctgtccaccagctggtggagaatacggatgagacatactgtatagacaatgaggcactgtacgacatatgttttaggaccttaaaacttacaacgcctacctacggggaccttaaccatttggtgtctgccactatgtctggtgtcacaacctgcttgcggttccctggccagctgaacgccgacctccggaaactggcagtgaacatggttccttttcccagacttcacttttttatgcccggattcgccccactgacctccaggggctctcagcaataccgggctctgacagtgccggagcttacacaacaggttttcgatgcaaagaatatgatggcagcctgcgatccgaggcatgggcgatacctgactgtagccgctgtgtttcggggaaggatgtcaatgaaagaagtggacgagcagatgcttaacgtgcagaacaagaatagttcatattttgtcgagtggatcccaaataatgtaaagacagccgtgtgtgatatcccccctcggggactaaaaatggccgtgacctttatcggcaactctacggcaatacaggagctgtttaagagaatttctgagcaatttacagccatgtttagaaggaaagcctttctccactggtacacgggggagggtatggacgagatggagttcacagaagctgaatcgaatatgaatgatctggtaagtgagtatcagcaataccaggatgccactgccgaagaggaggaagacttcggagaggaggcagaagaggaggcatag

SEQ ID NO: 245555 - DNA, 1062 bp, Artificial Sequence
  Description of Artificial Sequence: Synthetic coding sequence
atgcgtgagatcgttcacatccaggctggccagtgcggcaatcagattggagccaaattctgggaagtgattagtgatgagcacgggatcgaccctactggtacataccatggtgactccgacctgcaactgacgcacagccttgggggtggaactggcagtggtatggggacacttctaatcagcaaaattagagaagagtatcccgaccgaataatgaacacatttagcgtggtgccaagtcccaaggtttctgatacagtggtggagccatataacgctactctcagcgtgcatcagctggttgaaaacacagacgagacctattgcatcgataatgaggcactctatgatatttgctttcgtacgctcaagctaacaacaccaacatacggggatttgaaccaccttgtgtcagccacaatgagtggagtgactacttgcctgagatttccaggacagcttaacgccgacctgcggaagctggccgtgaacatggtccccttccccaggcttcacttttttatgccgggattcgctccgctcactagtagggggagccagcagtatcgggcactcacagtgccggagctgacccagcaggttttcgatgccaaaaatatgatggccgcttgcgatcccaggcacggtcgctacctgacagttgcagccgtgtttaggggccgaatgtcaatgaaggaagtggacgaacagatgcttaatgtccaaaacaaaaatagctcgtattttgtcgaatggatccctaataatgtgaaaactgcagtctgtgacatccctcctcgtggcctcaaaatggccgtcacatttattggcaatagcaccgccattcaggagctgtttaagcgcatctctgaacagttcacggccatgtttcggagaaaggcttttctacattggtacacaggagagggcatggacgagatggagtttacagaagctgagtccaatatgaatgacctggtgtccgagtaccaacaatatcaggacgcaacggctgaggaagaggaagatttcggggaagaagccgaggaagaggcctag

SEQ ID NO: 245556 - DNA, 1308 bp, Artificial Sequence
  Description of Artificial Sequence: Synthetic coding sequence
atgcgcgaaattgttcatatccaggccggtcagtgtggtaatcagattggcgctaagttttgggaagtgatatcggatgagcacggcatcgatccaaccggcacctaccacggtgattcagaccttcaattggaccgcattagcgtgtactacaatgaagccacgggtggaaagtatgtccctcgggctattctagttgatctggagcctggcacaatggattccgtcagaagtggcccattcgggcagattttccggcctgacaacttcgtctttggccagtccggtgctgggaataattgggcaaagggtcactacacagagggagccgagttggttgatagcgttctcgacgtagttagaaaggaggcagagagttgtgactgtcttcaggggttccagctgacccacagtctaggtggcggtacgggcagtggcatgggcacgctcttaatctccaagatccgtgaggagtatcccgaccggatcatgaatacgttcagtgtggttcctagccccaaggtcagtgacaccgtagtggaaccttacaatgcaaccctctccgtccaccagctggttgagaataccgatgaaacttactgtatcgacaacgaagcattgtatgatatctgctttagaacactgaaacttacaactccaacctatggggatctcaaccacctcgtctctgcaaccatgtcaggcgtgactacatgccttcggttcccagggcagctgaacgcagatctgcggaagctagccgttaatatggtgcccttccccaggctgcacttctttatgcccggtttcgctccacttacctcacggggttctcagcagtacagggctctgacagttcctgaactcacccagcaagttttcgacgccaagaatatgatggccgcatgcgacccacgccacggccgttacctgaccgtagccgctgtgttccgcggacggatgtctatgaaagaagtcgatgaacagatgctgaatgtgcagaacaagaacagctcatatttcgtcgaatggatcccaaataatgttaaaaccgctgtgtgtgacattccgccacgtggtctgaagatggccgtgacttttatcggcaactccaccgcaatccaagaactcttcaaacgcatcagcgaacagtttacggccatgttccgtagaaaggcctttctgcattggtacacgggcgaagggatggatgaaatggagttcaccgaggccgaatccaatatgaatgacctggtcagtgaataccaacagtatcaggatgctaccgccgagggcggtggcctttag

SEQ ID NO: 245557 - DNA, 1308 bp, Artificial Sequence
  Description of Artificial Sequence: Synthetic coding sequence
atgcgcgaaattgtgcatattcaggcaggccagtgcggaaatcaaatcggagccaagttttgggaggtaattagcgacgagcacgggatcgaccccaccggtacataccatggcgattccgatctgcagctggataggatatcagtatactacaatgaggccactggtggtaagtatgtgccacgagccatccttgtggaccttgagcccggtacgatggactctgtacgctcgggcccattcgggcagatatttcgccctgacaattttgtgtttggacagagtggagccggaaataactgggctaaagggcactatacagaaggcgctgaacttgttgattccgtcctcgatgtagtgcgaaaagaagcagaaagctgtgattgcctgcaggggtttcagctgacacactctttaggtggcggaaccgggagtggaatgggaacattgcttatctccaaaatccgtgaagagtaccccgatagaattatgaacaccttcagcgtcgtgccctcccctaaggtgtccgacactgttgtggaaccctataacgctacgcttagcgtccatcaactcgtggaaaacactgacgaaacgtactgcattgacaatgaagcactgtacgatatctgctttcggactctcaaactgaccactccaacctacggcgatctgaaccacttggtttcagccacaatgtcaggcgtaaccacttgtctaagattcccaggccagcttaacgcggacttgcggaagcttgcggtaaacatggtccctttcccaaggctacacttttttatgcccggattcgcgccactcaccagccggggatcacagcagtaccgtgccctgaccgtgcccgagctaacccagcaggtgtttgacgcaaagaacatgatggctgcttgtgacccaaggcatggtcgctatctcacagtcgccgcagtttttcgcggtcgtatgtctatgaaggaagtggacgagcagatgctcaacgtccagaacaagaacagctcctattttgttgagtggattcctaataacgtgaagacagctgtgtgtgacatacctccaagaggcctgaagatggccgtgacattcattggaaacagcacagcaattcaggagctcttcaagcggatctcagagcagtttacggctatgtttcgtcggaaggccttcctccattggtacacaggggagggcatggatgagatggaattcactgaggcggagtctaatatgaacgacctggtctctgaataccagcagtaccaggatgcaactgcagaagggggtggtctgtag

SEQ ID NO: 245558 - DNA, 1308 bp, Artificial Sequence
  Description of Artificial Sequence: Synthetic coding sequence
atgcgggagattgtgcacattcaggctggccagtgcggcaatcagatcggcgcaaaattttgggaagtgatttctgatgagcacggcattgatcctaccggtacttaccacggtgacagcgatctgcagcttgatcgcatctcggtgtattataacgaggctaccggcggtaagtatgttcccagggcaatcctggtggacctggaacccggaaccatggacagcgtcagatccggtcccttcggtcagatttttagacctgataatttcgtgtttggtcagagcggcgctggaaataactgggccaagggccattatactgaaggagccgagctggtagactcggttctggacgtggtgcgaaaggaagccgaaagctgcgattgtttgcagggttttcagttaactcacagtctaggcggaggcacgggtagtgggatgggaactctcctaatttcaaagataagggaggagtatcccgataggatcatgaatacgtttagcgtggtccccagtcccaaagtgtctgacactgtggtggagccctacaacgcgacactgtctgtgcatcaactggtggagaatactgacgagacatactgtatcgataacgaggccctatacgatatatgtttccgaacactaaaactgactacccccacatacggcgacctcaatcacctggtctcggctaccatgtcaggggtgacgacttgtctgaggtttcctggccagctgaacgctgatctacgcaagttggccgttaacatggttccgttcccacgactgcacttctttatgcccggattcgcccctctgacatctaggggcagtcaacagtatagggccctgacggttccggagcttacacaacaggtgtttgatgccaaaaacatgatggctgcgtgcgaccctaggcacggcaggtacctcactgtagctgctgtcttcagaggacgcatgtccatgaaggaagtcgatgagcagatgctgaacgtacaaaacaagaacagctcctactttgtggaatggatccccaataacgtcaaaaccgccgtgtgtgacattccacctcgaggtctgaaaatggctgtcacgttcattgggaattccaccgccattcaggaactctttaagagaatatccgagcagttcactgccatgttcagaaggaaggctttccttcactggtatacaggagaagggatggacgagatggaattcacagaagcagagagcaacatgaatgatctggtgagtgagtatcaacagtaccaggacgctactgccgagggaggagggctgtag

SEQ ID NO: 245559 - DNA, 1248 bp, Artificial Sequence
  Description of Artificial Sequence: Synthetic coding sequence
atgcgcgagatcgtgcacattcaagccggtcaatgcgggaatcaaatcggtgccaaattctgggaggtgatctctgatgaacatgggattgatccgactggcacttaccatggcgactcagatctgcagctggatcgcatctcagtttactacaatgaagccactggcggaaagtacgtccctcgggctatattagtagacttggaacccggaaccatggacagcgtgcgatctggtccgtttggacaaatcttccggccagacaattttgtctttggtcagtcaggcgctggcaacaactgcctgcagggcttccagcttacccatagcctcggtgggggtactggatcagggatggggaccctcctcatttcaaaaatccgagaagagtatcccgatcgaataatgaacaccttctctgtcgttcccagcccaaaagtatcggatacagtggtagaaccttataacgctacattgagcgtccatcagttggtcgaaaatactgatgagacctattgtattgataacgaggcactctatgatatatgttttagaactcttaaattgacgacaccgacttatggggatctgaatcatctcgtgtcggccaccatgagcggcgtgaccacctgcctgcggtttcccggtcagttgaacgcagacttgcgtaaactggccgtgaatatggtgccatttccgcgtttgcatttcttcatgcctgggttcgctcctcttactagcagggggtcgcagcagtacagggccttgactgtgcctgagctcacacaacaggtgtttgacgctaaaaatatgatggctgcgtgcgatcccaggcacggccgatacctaactgtggcagcagtgttcaggggcaggatgtcaatgaaagaggtcgatgaacaaatgctgaacgtgcagaataagaattcctcatactttgtggaatggatcccgaacaatgtcaagaccgcggtgtgcgatatcccacctcgaggcctcaagatggcggtaactttcataggaaatagtacagccatacaggaactctttaagcgcattagcgaacaatttaccgccatgttccgcaggaaggcgtttctgcattggtacacaggagaggggatggacgaaatggagtttactgaggccgaatctaacatgaacgacctggtgtctgagtaccagcagtaccaggatgctacggcggaggaagaggaggatttcggcgaggaagccgaagaggaatag

SEQ ID NO: 245560 - DNA, 1248 bp, Artificial Sequence
  Description of Artificial Sequence: Synthetic coding sequence
atgagggagattgtgcacatccaggcaggacagtgtggcaatcagatcggagcaaagttctgggaagtgattagcgacgaacacggtatcgatcccacaggcacctaccacggtgactccgacttgcagctcgaccgtattagtgtctactacaatgaagctacaggaggtaaatatgtgccaagagccatactcgtggatctcgagcccggtaccatggactccgtgcgaagcggaccttttggacagatattcaggcccgacaacttcgtgtttggacagagcggagctggaaataattgcctgcaaggctttcaattgacccattcattagggggaggcactggctccggaatgggcacactgctcatcagcaagataagagaggagtatccagataggatcatgaataccttctccgtggttccaagccctaaggttagcgacacagttgtagagccgtacaacgcaactctctccgtgcaccagctggtggagaatacagacgaaacttattgcatcgacaatgaggcactgtatgacatatgcttccgaacattgaagttgacaactccaacttatggcgaccttaaccacctggtgtccgctaccatgagtggcgttacaacatgtctgagatttcccggtcagttaaacgccgatcttcgaaagctcgcagtgaatatggtcccctttccgcgtctgcacttcttcatgccaggcttcgccccactgacaagtcgcggatctcagcagtacagagctctgaccgtcccagagctgacacagcaagtcttcgacgcgaaaaacatgatggcagcctgtgatcctcggcacggacggtacctcactgtggccgctgtgttccgtggaagaatgagcatgaaggaggtggacgagcagatgctgaatgtgcaaaataagaacagtagctatttcgtagaatggattcctaacaatgtgaaaactgcggtgtgtgacatcccacctcgaggtctgaagatggcagtgacgttcatcgggaactctacagctatccaagagttatttaagcggatctctgagcagtttaccgccatgttccgtcggaaggcctttctccactggtacacgggcgaaggaatggatgagatggaatttaccgaagctgaatccaacatgaatgacctggtgtcggaataccagcagtaccaggacgccaccgcagaggaggaggaagattttggcgaggaggccgaggaagagtag

SEQ ID NO: 245561 - DNA, 1248 bp, Artificial Sequence
  Description of Artificial Sequence: Synthetic coding sequence
atgagggagatagttcatattcaggcaggccaatgcgggaaccagattggcgcaaaattttgggaggtgatttccgacgagcacggcattgacccaaccgggacgtaccatggggatagcgaccttcaactggataggattagcgtctattataacgaagcaaccggagggaagtatgtcccacgcgctatcctggttgatctggagcctggtactatggactccgtaaggagcggaccgttcggccagattttcaggccagacaatttcgtgttcggtcaatccggcgctggaaataattgcctccaaggcttccagctgacgcactctctgggtgggggaaccgggagcggcatgggcactctccttatatcaaagataagagaggagtaccccgacaggattatgaacacttttagcgtggtgcctagccccaaggtgtcagacacggtggtagagccatataacgcgaccctcagcgtacaccaactcgtggagaataccgacgaaacatactgtattgacaatgaagcattatatgatatctgctttagaactctgaagctaacaacccccacctatggggatctgaaccatttggtcagtgccacgatgtcaggtgtgaccacatgtctgcgattccccggtcaactcaacgcggaccttaggaagctggcagtgaacatggttccattccccagactccatttcttcatgcccggttttgcgcctttgacatccagagggtcccagcagtatcgcgcattaacagtgcccgagcttactcagcaggtgtttgacgcaaagaacatgatggctgcttgcgacccaagacacggcaggtatctcaccgtggccgcagtgttcagagggcgaatgtcgatgaaggaagtagatgagcagatgctgaatgtgcagaataagaatagctcttactttgtggagtggatcccaaacaacgttaagacagccgtgtgcgacatacctcccagaggtctgaaaatggccgttacctttattggaaactccactgctattcaagagctctttaagcgcatatcagagcagttcaccgcaatgttccgacgtaaagccttcctgcactggtataccggcgaagggatggacgagatggaatttaccgaagccgagtctaatatgaacgatttggtatcagaataccagcagtaccaggatgccactgccgaggaagaagaggatttcggagaagaggctgaggaggagtag

SEQ ID NO: 245562 - DNA, 1308 bp, Artificial Sequence
  Description of Artificial Sequence: Synthetic coding sequence
atgagagagatagtgcacatccaggccggacagtgtggaaaccagattggggctaagttctgggaggttatttcagacgagcacggcattgacccaacagggacatatcacggcgactcagacctccagctagaccgcatcagtgtctactataacgaggccaccggcggtaagtatgtaccccgagctattcttgttgacctagaacctggaacgatggactctgtgcgatctggtccattcggtcagatctttcgccctgataatttcgtgtttggacagagcggcgctgggaacaattgggccaaaggccactacactgagggggctgagctggttgactccgtgttggacgtagtcagaaaagaggctgagagctgcgactgtttgcagggcttccaactgactcacagcctcggaggaggcaccggaagcggaatgggcaccctactcattagtaagatacgagaagagtacccagacaggattatgaacacattcagcgtagtgcctagccctaaggtgtccgacacagtggtggagccatacaacgctaccctgtctgtccatcagcttgttgagaacactgacgaaacatactgtatcgataatgaagccctctatgatatttgcttcaggactttgaagcttactacacccacatacggagacttaaaccatctggtaagcgctactatgtccggagtcactacatgccttcgctttccgggacagttgaacgctgatctgaggaagctggccgtcaatatggtcccctttcccaggcttcatttttttatgcctggctttgcacccttgacatcccggggatcccagcagtaccgagccctgacggtcccggagctgacgcagcaggtgttcgacgccaaaaatatgatggccgcttgtgatcccagacatgggcgttatctgaccgtcgcggcagtgttccgcggtagaatgagcatgaaggaagtagacgagcagatgctgaatgtgcagaacaaaaattctagctatttcgttgaatggatcccaaataacgttaaaaccgccgtgtgcgatattcccccacgcggtctgaagatggcagtgactttcatcggaaactcaacagccatccaagaattattcaaaagaatcagcgagcaatttacggccatgtttcgcaggaaggcctttttgcactggtatacaggagaaggcatggatgagatggaatttacggaggccgaatccaacatgaacgatctggtatccgagtatcagcagtaccaggacgccactgccgagggagggggtctttag

SEQ ID NO: 245563 - DNA, 1308 bp, Artificial Sequence
  Description of Artificial Sequence: Synthetic coding sequence
atgagagaaattgtgcacattcaggctggtcagtgtggcaatcagattggcgctaagttctgggaagtcatcagcgatgaacacggtattgaccctaccggcacttaccacggagacagcgatctgcagttggatcgtatcagcgtgtactacaatgaggccacggggggaaagtatgtccctagggcgattctcgtagacctcgaacctggaacgatggactcggtcagatcaggtccattcggtcagattttcagacccgataatttcgtgtttgggcagtccggagccggaaataactgggctaaaggccactacacagaaggagcagagttagtggactctgttctggacgtggtccgaaaggaagccgagtcctgcgactgtctccaggggttccagctaacccacagcctcggcggtggcacgggcagtggcatgggcacgctgctgatctcgaaaataagagaagagtatcctgatagaattatgaacacatttagcgttgtcccatccccaaaggtctctgatacagtagtggagccgtacaacgcaactctgtctgtgcaccagcttgtagaaaacacagacgaaacgtactgcattgacaatgaggccctttacgacatttgtttcagaaccctcaaactgaccacacctacctacggcgatcttaaccatctggtgtctgctaccatgagcggggttacaacctgcctacgctttccaggacaattgaacgcagacctccgcaagcttgctgtcaacatggtgccctttcccaggctgcatttctttatgcccggatttgccccacttacaagcaggggcagccaacagtatagagccctcacggtgcctgagctcacccagcaggtttttgacgccaaaaacatgatggctgcatgcgatccccgtcatggtcgctatctgactgtagcagccgtgtttaggggaagaatgagcatgaaagaagtggacgagcaaatgctgaatgtgcagaataagaactcatcttatttcgtggaatggatccctaacaatgtcaagactgccgtgtgtgacatacctcccaggggactgaaaatggccgtaacatttattggaaacagtactgcgattcaggagctgtttaagcggattagcgagcagtttactgcgatgttccggagaaaggcctttctgcactggtatacaggtgagggtatggacgagatggaattcacagaagcagaatccaacatgaatgacctggtatcagaataccagcagtatcaggacgcgaccgcagagggaggaggattatag

SEQ ID NO: 245564 - DNA, 1308 bp, Artificial Sequence
  Description of Artificial Sequence: Synthetic coding sequence
atgcgggagatagttcatatccaagccggtcagtgtgggaaccagattggagctaaattttgggaagtgatctctgatgagcatggtattgaccctaccggcacttaccacggtgactccgatctgcagctggaccgcatcagcgtatactacaatgaagcaaccggtggaaagtatgtccctcgggctatactggtggatttggaaccaggcactatggactcagtgcggagcggacctttcggtcagatcttccgcccagataatttcgtgtttgggcagtctggggcagggaataattgggctaaaggacattatacagagggagcagagctagtagacagtgtcctcgacgtggtgcggaaggaggcagagtcttgcgactgcctgcaggggtttcagcttacccattccttggggggaggaacaggcagcggcatgggcacccttctgatcagtaagattagggaagagtatccggaccggatcatgaataccttctctgttgtgccatcccccaaggtctctgataccgttgtcgagccgtataacgcaacgctgtccgtgcatcagctagtggaaaatactgacgagacctattgcatcgacaacgaggccctgtatgacatttgttttcggacactcaagctgaccaccccaacttatggcgacttgaatcatcttgtctccgcaacaatgagcggcgtcaccacctgcttgcggtttcctgggcaactgaatgccgatctcagaaagctggctgtgaatatggttccattccctcggctgcacttttttatgccaggctttgcacctctgacgagtcggggtagtcagcaatacagagcgctgacagtgcccgagttaacccagcaggttttcgacgcaaagaacatgatggctgcctgtgaccctagacacggacgatatctgacagttgccgctgtgtttagagggcgtatgtcaatgaaagaagtggatgaacagatgctgaacgtacagaacaaaaacagcagttatttcgtcgaatggatccccaacaacgtgaagaccgccgtgtgcgatattccaccaagaggcctgaaaatggcagtgacattcattggcaactcgactgctatccaggaattgtttaagcgaatctcagaacagttcaccgctatgtttcggcgaaaggcgttcctgcactggtacaccggggagggcatggacgaaatggaattcacagaggctgagagcaatatgaacgacttagtttccgagtatcagcaataccaagacgctaccgccgaggggggtggcttgtag

SEQ ID NO: 245565 - DNA, 1062 bp, Artificial Sequence
  Description of Artificial Sequence: Synthetic coding sequence
atgcgagagatcgtgcatattcaagctggacagtgcggtaaccaaataggcgctaaattctgggaagtgatctcagacgagcatgggattgaccccaccggcacataccatggggattcggatcttcagctaactcatagtctcgggggagggacagggtctggaatgggaacactgcttatctcaaaaattagagaagagtatcccgaccgcatcatgaacacattttccgtcgtcccatcacccaaagtaagcgacacagttgtcgagccatacaacgccacactttcagtccaccaactggtggaaaacactgatgaaacatactgtattgataacgaagccctctacgatatttgctttagaacacttaagttgaccacccctacgtacggcgacctcaaccacctcgtatccgctaccatgagtggagtgacaacatgcctgagatttcctggacagttgaatgcagatttaagaaaactcgccgttaacatggttccttttcctcgcctccacttttttatgccgggtttcgcacccctgacctcccggggttcgcagcaataccgggctctgacagtgcccgagctaacgcagcaggtcttcgatgccaaaaacatgatggctgcctgtgatcccagacacgggagatacctgaccgtggccgcagttttccgcggtcgtatgagtatgaaggaggtggatgaacagatgttgaatgtccaaaacaagaatagttcttacttcgtcgaatggatacctaacaacgtgaagaccgccgtgtgtgacataccgccacgaggcctgaagatggcggtgaccttcatcggcaatagtacggccatccaggaactcttcaagcggatttccgagcagttcaccgcgatgttccggagaaaagccttcctacactggtacacgggagaaggaatggatgaaatggagttcacagaggcagagagcaatatgaacgaccttgtaagtgaatatcagcagtatcaggacgccacagcagaagaggaagaagatttcggcgaggaggccgaggaggaagcgtag

SEQ ID NO: 245566 - DNA, 1248 bp, Artificial Sequence
  Description of Artificial Sequence: Synthetic coding sequence
atgcgcgagatcgtacacattcaagcagggcagtgcggcaatcaaatcggcgctaaattttgggaggtgatctccgacgaacacggcattgaccccaccggcacctaccatggcgattccgatttgcagctggaccgcatctcagtctattataacgaggccacgggagggaagtacgtacccagagccatacttgtggacctggagccgggaaccatggactccgtgcgaagcggaccctttgggcagatatttcgccctgataactttgtctttggccagagcggggctggtaacaactgtcttcagggatttcagcttacacattcgctcggaggtggtacaggttctgggatgggcactctcctcataagtaagataagagaggagtacccagaccgcattatgaatacctttagtgtggttccttctcctaaagtgtccgataccgtagtggaaccctacaacgccaccctcagtgtgcaccagctggtggagaatacagacgaaacctattgtatagataatgaagctctgtatgacatctgttttagaaccctgaaactcaccacaccaacatatggcgacctaaatcacctcgtcagtgccactatgtcaggtgtaacgacttgtctacggttccctggacagctgaatgccgatttgagaaaattagcagttaacatggtgccattccccagactgcacttttttatgcctggctttgcgcctctgacgtcaagggggtcccagcagtaccgcgcactaacagttcctgaattgacccaacaggtgtttgacgccaaaaacatgatggcagcttgcgatcctcgacatggacgctacctcacggtcgcagccgtgtttagggggagaatgagtatgaaggaggtggatgagcagatgctgaatgtgcaaaataagaatagctcatattttgttgagtggattcctaacaacgtcaagacagccgtctgtgacattccaccaagaggactcaagatggctgtgactttcatcggtaactcgaccgctatccaggaactgttcaaaagaatcagcgagcagttcacggctatgttcaggcgtaaagcttttcttcactggtacacgggggaggggatggacgagatggaattcactgaggcggaaagtaatatgaatgacctggtgtcagagtatcaacagtatcaggacgcgacagctgaggaagaagaagactttggcgaggaggccgaagaggaatag

SEQ ID NO: 245567 - DNA, 1308 bp, Artificial Sequence
  Description of Artificial Sequence: Synthetic coding sequence
atgcgagagatcgttcacatacaagccggtcagtgcggtaatcagatcggcgcaaagttctgggaggtgattagtgacgaacatggcatcgaccccaccggcacatatcatggggatagtgacctccaattagataggatatctgtgtattataacgaggcgaccggtggaaaatatgtgccacgcgcaattctcgttgatttggaaccaggcacaatggattcggtgcgctccggtcctttcgggcagatattccggcctgacaattttgtgtttggtcagtctggcgctggcaacaactgggcgaaaggtcactatacggaaggcgctgaacttgtagacagtgtgctggacgtggtgcgcaaagaggcagagagctgtgattgtctacaggggttccagttgacacacagccttggcggtgggactggctccggcatgggtactctcctcataagtaagatccgggaagaataccctgatcgaatcatgaatactttcagcgtcgttccaagccccaaggtgtccgatactgtcgtcgaaccttataacgccacactgtccgttcaccagcttgttgaaaatactgatgagacttattgcattgataatgaagccttatacgatatttgcttccgaactttgaagctaacaacgcccacctatggcgacctgaaccacctggtctctgcgaccatgtcaggagtgactacgtgtctgcggtttccaggtcagctgaacgcagacttgcgtaagcttgctgtaaacatggtgccctttccacgattacacttcttcatgcccggatttgcacccctaacaagcagaggtagccaacagtacagagctctcactgtgccagagctgacacagcaagtgttcgatgctaagaacatgatggccgcatgtgatcctcgacacggaagatatcttaccgttgccgctgtctttcgcggaagaatgtccatgaaggaggttgacgagcagatgctgaatgtccagaacaagaactcttcttattttgtggagtggatccccaacaatgtcaaaactgccgtgtgcgatatccctcctaggggcctgaaaatggcagtcacattcattgggaattcaaccgcaattcaggagctattcaaaagaatttcagagcagtttactgccatgtttcgcagaaaggcatttcttcactggtacactggcgagggaatggatgaaatggagttcactgaggctgagtctaacatgaacgatcttgtttctgagtatcagcagtaccaggatgcgaccgctgaggagggtggagtgtag

SEQ ID NO: 245568 - DNA, 1062 bp, Artificial Sequence
  Description of Artificial Sequence: Synthetic coding sequence
atgcgagagatcgtgcacatccaagctggccaatgcggaaatcaaatcggcgctaagttctgggaagttatctccgatgagcatggaatcgatcctacgggaacctaccatggtgattctgatctgcagctcacccactcactcggcggaggtactgggtctgggatgggaaccctgctgatatcgaaaattcgagaggagtatcccgacaggattatgaacaccttcagtgtagtcccctctcctaaggtgagtgataccgttgtggaaccctacaatgctacacttagcgtgcaccagctggtggagaacaccgatgaaacctactgtattgataatgaagccctgtacgatatatgtttccggactctgaagctcacaactccaacatacggggaccttaaccacctcgtgtctgcaaccatgtcaggcgtcactacttgtctgcgatttccaggtcagctgaatgccgacttacgcaagctggccgtgaacatggtcccattcccgagactccattttttcatgcccggtttcgctcccctgacatctagaggatctcaacaatatagggcgttgactgtgccggagctgacacagcaggtgtttgacgctaaaaacatgatggctgcttgtgatccccgtcatggccgttacctgacagtagccgctgtgtttaggggacgcatgtccatgaaagaggtggatgaacaaatgttgaacgtgcaaaataaaaacagttcatattttgtggagtggatccccaataatgtcaaaacagctgtttgtgacatacccccaaggggcttaaaaatggccgtgacgttcatcggcaattccactgccattcaggaattattcaaacgtatttctgagcaattcacggccatgttccgtcggaaagcctttcttcattggtacactggcgaggggatggacgaaatggagtttaccgaggcagagagcaacatgaacgatctggtttcagagtaccagcagtatcaggatgccactgcggaagaagaagaggattttggcgaggaagccgaggaagaggcctag

SEQ ID NO: 245569 - DNA, 1062 bp, Artificial Sequence
  Description of Artificial Sequence: Synthetic coding sequence
atgcgagagattgtgcacatccaggctggacaatgcggcaatcagataggggcaaagttctgggaggtgatcagcgacgagcacgggatcgatccaacaggaacctaccacggagactcagacctgcaactaacacacagtctcggtggagggacagggtccgggatggggacactcctcatcagcaagatccgcgaggagtatcccgatcggattatgaacacctttagtgtggtgccatccccaaaagtttctgatacagtagtggaaccctacaacgctacgttatccgtgcaccagctcgtggagaacacggacgagacctactgtattgataatgaagcactttatgacatatgctttcgtacattgaagctaaccaccccgacttatggtgatctcaaccatttggtcagtgcaacaatgtcaggagtgacaacatgcctgcggttccctggtcagctaaatgccgacctcaggaagcttgccgtgaacatggtgccatttccccgactgcacttctttatgccaggcttcgccccattgacttcccggggatctcagcagtaccgcgcactcacagtcccagaactaacacagcaggttttcgacgccaagaatatgatggccgcttgcgatcctcgtcacgggaggtacttgactgtggcagcagtttttagaggccgaatgagtatgaaggaggtagacgagcagatgttgaatgtccaaaacaagaacagtagctacttcgttgagtggatccccaataatgtgaagacggcggtctgcgatattccaccaagggggcttaaaatggcagtcacatttatcgggaactcaaccgccattcaggaactattcaaacgaatttcggagcaattcacagcaatgtttaggcggaaggcttttttgcactggtataccggggaaggcatggatgagatggaatttacagaagccgagagtaacatgaatgacttggtttctgaataccagcaataccaagacgctaccgcagaggaggaggaagattttggcgaagaggctgaggaggaggcctag

SEQ ID NO: 245570 - DNA, 1062 bp, Artificial Sequence
  Description of Artificial Sequence: Synthetic coding sequence
atgagagagatcgtgcacatacaggcaggccaatgtggaaaccaaattggggctaaattctgggaggtaattagcgatgagcacgggattgaccctacaggcacctaccacggtgacagtgacctgcaattaacacactccctggggggtggtactggcagcggcatgggtaccctcctgatatctaaaataagagaagaatatcctgaccgaatcatgaataccttcagcgttgtcccgtcacctaaagtttctgacactgtagtggagccatacaatgcgaccctgagtgtgcaccagctcgtggaaaacaccgatgagacatactgcattgacaatgaagcactctatgacatctgtttcagaacacttaagctgacaactccgacttatggcgatctgaatcacttagtctcagctacaatgtcaggggtcaccacgtgtctaaggtttccaggacagctcaacgcagatctgcgtaagctggcagtgaatatggtgccctttcccagacttcactttttcatgccgggattcgcccctctgaccagtcgcggaagccaacagtatcgagctctgacagtgccggagctcacccaacaagtgttcgatgccaagaacatgatggccgcttgcgacccacgccacggcagatatctgactgtggctgctgtgttccgaggcaggatgagtatgaaggaggtcgatgagcaaatgctgaacgtacagaacaagaattcatcctattttgtcgagtggataccaaataatgtgaagaccgccgtatgcgatatcccgcctcgcggactgaagatggcagttactttcattgggaatagcaccgcaattcaagagctgtttaagagaatcagcgagcaatttacagccatgttccgccgtaaggccttccttcactggtatacaggcgaggggatggacgaaatggagttcaccgaagccgagtctaatatgaacgacctcgtcagtgaataccagcaataccaggacgctacggcagaggaagaggaggacttcggagaagaggctgaagaggaagcatag

SEQ ID NO: 245571 - DNA, 1248 bp, Artificial Sequence
  Description of Artificial Sequence: Synthetic coding sequence
atgcgagaaatcgtgcacatccaggcgggacaatgtggtaatcaaattggagcaaagttctgggaggtcatctccgatgagcatggtattgaccccacgggcacttatcacggcgattcagacttgcaactcgataggataagtgtctactataacgaggcaaccggaggcaagtacgtgccgcgtgcaatacttgtggacctggagcctggaacgatggattctgtcaggtccgggccattcggacaaatctttaggcctgacaatttcgtcttcggacagtcaggggctggaaataactgtctccagggtttccagctgactcattcacttggtggtggcacggggagtggcatgggcaccttactgatttccaagatacgagaggaataccctgaccgaattatgaatacattctctgttgtgccgagtcccaaagtgagtgacacggtggtggaaccttacaatgctactctctcagttcaccagctggtagaaaataccgacgagacatactgtatcgacaacgaagccctctatgacatttgcttccgtacgctgaagctgaccacacctacctacggagacctgaaccatctagtctctgccaccatgtctggggtgactacatgcttaaggttcccgggacaattgaacgcggatctgaggaaactggcagttaatatggtgcccttccccaggctgcatttcttcatgccaggatttgctcccctgacttcaagaggctcacaacagtaccgcgctcttacggtcccagagctgacccagcaggtatttgatgccaaaaatatgatggccgcttgtgatccgcgacacggcaggtatctgaccgttgccgctgtctttcgaggccgtatgtccatgaaagaggttgacgagcaaatgttgaacgtccagaacaaaaattctagttactttgtcgaatggatcccgaacaatgttaaaactgccgtctgcgacatccccccacgcggactcaagatggccgtgacattcatcggtaattccactgccatccaggaactgtttaaacgtattagtgaacagttcaccgccatgttcaggcgaaaagccttcttgcactggtatacaggggaaggcatggacgaaatggagtttacggaagctgagtcaaatatgaatgacttggtcagtgagtatcagcagtaccaagacgcaacagctgaggaggaggaggacttcggggaagaggctgaggaagaatag

SEQ ID NO: 245572 - DNA, 1248 bp, Artificial Sequence
  Description of Artificial Sequence: Synthetic coding sequence
atgagggaaatcgtgcatattcaggcaggccagtgcggaaaccagatcggtgcaaagttctgggaggtcatctctgatgagcacggaatcgaccccaccggaacataccacggggactccgatctgcaactagaccgtatcagcgtgtattacaacgaagccaccggaggtaagtatgtgccgagagcaattctcgtggacctggagccaggtactatggattctgtgcgctctggcccttttggtcagatttttcgccctgataacttcgtattcggccaaagtggggctggaaacaattgccttcagggcttccaattgactcattccttaggaggcggaactggtagcggcatgggaaccctattaatttccaaaattagagaggagtacccagataggattatgaacaccttctctgtcgtacctagtcccaaggtttccgacactgtcgtcgaaccatataatgctactttaagcgtgcatcagctcgtggagaataccgatgaaacttattgtattgacaacgaggcgctatacgacatttgttttcgcactctgaagcttacgactcctacatacggtgacctgaaccatctggtcagcgccaccatgtccggagtcactacctgtttacggttccccggacaactgaatgccgacttaaggaaactcgctgttaacatggtgcctttcccgaggctgcactttttcatgcctggattcgcacctctgacaagccgcggttcacaacagtatcgggcactcaccgtccctgaattgacccagcaggtgttcgacgctaaaaacatgatggctgcttgtgatccacgccacggcagatatttgactgtcgcagcagtctttagaggacgcatgtccatgaaagaggtcgacgagcagatgttaaacgttcaaaataagaattcttcatatttcgttgagtggatcccaaacaatgtgaaaaccgccgtatgcgacatccctcccagaggactgaagatggcagtaacgttcattggcaattccacagcgatacaggaactgttcaagaggatttccgagcagttcaccgcaatgtttcgacggaaggcctttctgcactggtacacaggggaaggaatggacgaaatggagtttactgaagctgagtccaacatgaatgacttggtgtcagagtaccaacaatatcaggatgccactgccgaggaggaagaagatttcggagaagaagctgaggaggagtag

SEQ ID NO: 245573 - DNA, 1062 bp, Artificial Sequence
  Description of Artificial Sequence: Synthetic coding sequence
atgcgcgagatcgtgcacattcaagccggacaatgtggcaaccagattggcgcaaagttttgggaggtgattagtgacgagcacggcatagaccccaccggcacgtaccatggcgattctgacctgcagctgacacatagtctgggaggtggaactgggtccggtatgggcaccctcttaatatccaagatccgtgaagagtaccccgatagaataatgaacacattcagcgtggtgccatcccctaaggtcagtgataccgtcgtggagccctataatgctaccctctctgtccatcagctggtcgaaaacactgatgagacatactgtattgacaacgaggcgctctatgatatctgttttcgtaccttgaagctgaccacaccaacatacggcgatctcaatcacctcgtgtcagcaacgatgagcggcgtgaccacctgcttacggtttcctgggcagctgaatgctgacttgcggaagctggccgtgaatatggtcccttttcctaggttacatttttttatgccagggtttgcacccctcactagtaggggatcccagcagtacagggctctgacggtacccgaacttacccagcaggtatttgatgcaaagaacatgatggccgcttgcgatcccagacacgggagatacctcacagttgcggctgtttttcgaggccgaatgagtatgaaggaggtggatgagcaaatgttaaatgtgcagaacaaaaactccagctatttcgtcgagtggatcccaaataacgtcaaaacagctgtgtgtgatattccgccaagaggattgaaaatggccgtgacatttattgggaactctaccgctatacaggagctttttaagagaatcagcgagcagtttacagcaatgttccgccgtaaagcattccttcactggtacaccggggaaggcatggatgaaatggaatttactgaagccgaatcaaacatgaacgatcttgtttccgagtatcagcagtatcaagatgcaaccgccgaagaagaggaggatttcggtgaggaggccgaggaggaggcctag

SEQ ID NO: 245574 - DNA, 1362 bp, Artificial Sequence
  Description of Artificial Sequence: Synthetic coding sequence
atgtctatcgttacagtgcagctgggtcagtgtggaaaccaaatcggcttcgaggtgtttgatgccctattaagcgactcacattcctcacaaggcctctgctccatgcgcgaaaatgaagcatatcaggcttcttgcaaggagcgttttttttctgaagaggagaatggagtgccgatcgcccgagccgtactggtggacatggaaccaaaggtcatcaatcaaatgcttagtaaagcagcccaaagtggacagtggaagtacgggcaacatgcttgcttctgccagaagcagggatctggtaataactgggcgtacggctacagtgtgcatgggccacggcacgaggagagcattatgaatattattcggaaggaggtggagaaatgcgacagcttcagcggattttttatcataatgagcatggcaggcggaacaggctcaggcctaggcgctttcgtaacacagaatctcgaggatcagtactcgaactctctgaaaatgaaccagattatctggccttatgggaccggtgaggtaattgtacagaactataactcaattctgaccctctctcacctgtaccggagtagcgatgcccttctgctgcatgaaaatgatgctattcacaagatctgcgctaaactgatgaacatcaaacagatttcattttccgacataaatcaggtccttgcgcaccaactgggctctgtcttccagccaacttacagtgccgaatcaagtttccattataggaggaatcccctcggcgatctaatggagcatctcgtaccccatcccgagttcaagatgctctcagtgagaaatatccctcacatgagtgagaattcacttgcttacaccacctttacctgggctgggctgctgaagcatcttcgccagatgctgatttcaaacgcgaaaatggaggaaggcatagacaggcacgtttggccgcctctgtccgggcttccacccctcagcaaaatgagccttaataaggatctgcactttaacactagcattgcaaacttggtgatacttcggggtaaagatgtgcaatctgcagacgttgagggcttcaaggacccggcactctacacatcgtggctcaagcccgtgaatgcctttaatgtatggaagacacagcgcgcttttagcaagtatgagaagtccgcggtgttggtgtctaattctcaattcctagtaaagccactcgatatgatagtcgggaaggcttggaatatgttcgcttctaaggcctatatccatcagtataccaagttcggcatcgaggaggaagacttcctggattcttttacttctctggagcaggttgtcgctagttactgcaacctgtag

SEQ ID NO: 245575 - DNA, 1197 bp, Artificial Sequence
  Description of Artificial Sequence: Synthetic coding sequence
atgagtatcgtcactgtccagctgggacaatgtggcaaccagattggcttcgaggtgttcgatgcgctactgagtgatagccactcaagtcagggcctgtgtagcatgcgtgagaacgaggcctatcaagcgtcgtgtaaagagagattctttagtgaagaggagaacggagtgcccatcgctcgcgcagtgctcgtagatatggagcccaaagtcattaaccagatgctctctaaagctgctcagtcagggcagtggaaatacggtcaacatgcttgcttctgccagaaacaggggtccggaaataattgggcctatggctacagcgtgcacggcccacggcacgaagagagtatcatgaatatcatccgaaaagaagtggaaaagtgtgacagcttcagtggtttcttcatcattatgtccatggctggcggaaccggctctggcctcggcgctttcgttacacagaacctagaagaccagtactccaattcactcaagatgaaccaaataatatggccatacggtaccggagaggtcattgtgcagaactacaatagtatcttaactctcagtcacttataccggtcctctgacgctctgctcctgcacgaaaacgacgctatacacaaaatttgcgcgaagctgatgaacatcaagcagatctctttcagtgatataaatcaagtgctggcccatcagctaggcagcgttttccagcccacgtattcagccgaaagctcgttccattatagacgaaatcccttgggaattgaccgccatgtttggcctccgttgtccggcctgccaccgttgtccaaaatgtctttgaacaaagatttacatttcaacacatctatagctaatttggtgatcctgaggggcaaggatgttcagtccgcagatgttgaagggtttaaggatcccgcattgtacaccagttggctaaagcccgtgaatgcttttaacgtgtggaagacacaacgagctttcagcaagtacgagaaatcagccgtgttagtgagcaattctcaattcctggtaaagcctcttgacatgattgtcggaaaggcttggaacatgtttgcctctaaagcatatattcaccagtacaccaagtttggaattgaagaggaggacttcctggactccttcacgtcactggaacaggttgttgcgtcttattgcaatctgtag

SEQ ID NO: 245576 - DNA, 600 bp, Artificial Sequence
  Description of Artificial Sequence: Synthetic coding sequence
atgagcattgtgaccgtgcagctgggccaatgtggtaaccaaatcggctttgaggtcttcgatgccctgttgtcagactctcatagcagccaaggactctgttccatgcgggagaatgaggcataccaggcaagctgtaaggagcggttcttttcggaagaggagaacggaggcatagatagacacgtatggccaccactctccgggctgcctccactatctaagatgtcccttaataaggacctgcatttcaacacctccatcgcaaacctggtgatcctgcgcggaaaagacgtccagtctgctgatgtcgagggctttaaagacccggcactttatacctcatggctgaagccagtcaacgcctttaacgtttggaagacccagagggcattttcgaaatatgagaagtcggctgtcctggtgtcaaactcgcagtttctagtcaagcccctcgatatgatcgtcggtaaggcttggaatatgttcgcttcgaaggcttacatacaccagtataccaagtttggtatcgaggaggaggattttttggactcattcacaagcttggaacaggtcgttgccagctactgcaatctgtag

SEQ ID NO: 245577 - DNA, 1056 bp, Artificial Sequence
  Description of Artificial Sequence: Synthetic coding sequence
atgtctatcgtcactgtccaactaggacagtgcggaaatcagattggctttgaggtgttcgatgcgctgttgtccgattcacattccagtcaggggctgtgctccatgcgtgaaaacgaggcataccaggcatcttgcaaagaaagatttttttccgaggaagaaaacggggtaccgattgctcgggcagtgcttgttgacatggagcctaaagttattaaccaaatgctctcaaaagcagcacaaagcggccagtggaaatatgggcagcacgcctgcttttgtcagaaacaagggagcggcaacaactgggcgtatgggtactcagtgcacgggccacggcacgaggaaagtattatgaatatcattcggaaggaagttgaaaaatgcgatagtttcagcgggtttttcattattatgtctatggccggtggcactggttctggtctcggcgcttttgtgactcagaacctggaagaccagtattctaatagccttaagatgaaccagatcatttggccatacggaacaggggaggtcatcgttcaaaattataactccatcctcaccttatcccatctttatcgttctagcgacgcgctgctcctgcacgagaatgacgccattcataagatttgtgctaaactgatgaacattaagcagatcagcttctctgatatcaaccaagtcctggcccaccaactcgggtcagtctttcagccgacctatagtgctgaaagctcatttcattacagacggaaccctctggaaggctttaaggaccccgcactctacacatcttggctgaagccagtgaacgcattcaatgtgtggaagacacagagggctttctcaaagtacgaaaagagcgccgttttagtgtctaattctcaatttctggtgaagccgttggatatgatcgtaggcaaagcttggaacatgtttgccagtaaggcatatattcaccagtataccaagttcggaatagaagaggaggactttctcgatagtttcacaagtctggaacaggtggtggcctcatattgcaatctctag

SEQ ID NO: 245578 - DNA, 1191 bp, Artificial Sequence
  Description of Artificial Sequence: Synthetic coding sequence
atgtcaatcgttaccgtgcaactggggcaatgcggcaatcagattggctttgaagtgtttgacgccttactgtctgacagtcattccagtcagggcctgtgttctatgcgcgaaaatgaagcttatcaagcttcctgcaaagagcgcttcttttcagaagaggagaacggtgtcccaatcgctcgcgctgttctggtggatatggaacctaaggtgattaaccagatgctcagtaaggcagctcagagcggacagtggaaatacggtcagcatgcgtgtttctgccagaaacagggttctggaaataattgggcctatgggtattctgtccatggccctcgacatgaggaaagtatcatgaatatcattagaaaggaagttgagaagtgtgacagttttagtgggttcttcattataatgagtatggcgggagggacaggtagcggcctcggggcattcgtcacacaaaatctcgaggaccagtatagtaattcccttaaaatgaatcagataatttggccctacgggactggtgaagttattgttcagaactataattccattctcacgctttcacacctgtatcgcagcagcgacgctctgctgttgcatgagaatgacgcgatccacaagatctgcgcaaagctaatgaacatcaaacagattagcttctccgacatcaaccaagtgctggcccatcaattaggctcggtgtttcagccaacctactccgcggagtcttccttccactaccggaggaatcctcttggagacctgatggagcacctcgtccctcaccctgagtttaagatgctcagtgtgcgaaatatccctcatatgagtgagaattcactcgcctacacgacattcacctgggccggactcttgaagcacctgcggcagatgctgatttccaacgccaaaatggaagaaggaatcgatcgacacgtgtggcctcccttatcaggcttaccccctctgagcaaaatgagcctaaacaaggatcttcacttcaacacctcaatcgccaacctcgttatcttacggggtaaggatgttcagagcgctgatgtgggtaagaagttccgggcttacatccaccagtacacgaaatttggaatcgaggaagaagacttcctggatagcttcactagtttggaacaagttgtggcatcttactgtaacctgtag

SEQ ID NO: 245579 - DNA, 714 bp, Artificial Sequence
  Description of Artificial Sequence: Synthetic coding sequence
atgaacataaaacagatctctttttccgatatcaatcaggtgctagcccaccaactgggcagcgtcttccagcccacgtacagtgctgagtcatccttccactaccggagaaaccctcttggcgatttaatggagcatctcgtcccacatcccgaattcaagatgttgtcagtgaggaacattcctcacatgagtgaaaacagccttgcctatactacttttacttgggcgggtctgctgaaacacctgaggcagatgctcatatcaaacgccaagatggaagagggcatcgaccgacacgtgtggcctccccttagtggattaccgcctctcagcaagatgtcgctgaacaaagacttgcatttcaatacatctatcgccaatttggtcatcctaagagggaaggacgttcagtcagcagacgtcgaaggctttaaggacccagctctgtatacaagctggcttaagccagtgaatgcctttaatgtctggaagacccagagggcattcagtaaatacgaaaagagtgccgtgctcgtgtccaactctcaatttctcgtcaaacctctggacatgattgtgggcaaggcctggaacatgtttgcttcaaaagcgtatatccatcagtacactaagttcggtattgaagaggaggattttctcgattcgttcacttcgctggagcaagtggtggcctcgtattgcaacttgtag

SEQ ID NO: 245580 - DNA, 378 bp, Artificial Sequence
  Description of Artificial Sequence: Synthetic coding sequence
atgagcatcgtaactgttcagctcggacaatgtggtaaccagattggcttcgaggtgttcgatgccttgctcagcgattcgcacagtagccaggggctctgtagtatgagagaaaacgaagcatatcaggcctcttgcaaggagcggttcttttccgaggaagagaacggcgtacccatcgcaagggcagtattggttgatatggaacctaaggttattaaccagatgctcagcaaggcggctcagtccggtcagtggaaatacggacagcacgcttgcttctgtcagaagcagggcagcggcaacaactgggcctacgggagggacaaagattctgcgtgttacccagactggtcaggcacaccaggtctgcagtag

SEQ ID NO: 245581 - DNA, 492 bp, Artificial Sequence
  Description of Artificial Sequence: Synthetic coding sequence
atgacccagtctgtggtcgtgcaggtcggccagtgtgggaatcagatagggtgctgtttttgggatctggcgctgcgagagcatgccgctgttaaccaaaaaggaatctatgacgaggccatctctagtttctttcgcaacgttgatacccgcgtggtgggcgacggcggaagtataagcaaaggcaagatttgttcgcttaaggcaagggcggtgctcattgacatggaggagggggtggtgaacgaaattctgcagggaccccttcgcgacgtttttgatacgaaacagctcattaccgatatcagcggctcgggcaacaattgggccgtggggcataaagtgttcggcagcctgtaccaggatcagattctcgagaaattcaggaagtctgccgaacactgtgactgccttcagtgcttcttcataattcacagcatgggaggcggaaaaatcttccacagtttcgcctgcaattctgtgaaagggtag

SEQ ID NO: 245582 - DNA, 621 bp, Artificial Sequence
  Description of Artificial Sequence: Synthetic coding sequence
atggagtccgatcagaggaaagtggtgggcgatggtggaagtattagtaagggtaagatatgtagtcttaaagcacgcgctgtgttaattgatatggaggaaggggtggttaatgaaattcttcagggtccgctccgtgacgtcttcgatactaaacagctgattaccgacatttcaggatctgggaacaactgggccgtgggacataaagtgttcggatccctatatcaggaccagatcttggagaagtttagaaaatcagctgagcactgtgactgtctgcagtgcttttttatcatacacagcatgggaggcggaacaggttcaggccttggcacatttctgctaaaggtgctggaagacgaattccccgaagtctatagatttgtgaccagcatctacccttcgggcgaggacgatgtcatcactagcccatacaattcaatccttgccatgaaggagctgaatgagcacgccgattgcgttttacccatcgacaaccagtcactgttcgacatcatttcgaagattgatctgatggtgaacagcggcaaactcggtacaactgtgaagcctaagagcctggtcacctcctcctctggagcactaaagaaacaatag

SEQ ID NO: 245583 - DNA, 1428 bp, Artificial Sequence
  Description of Artificial Sequence: Synthetic coding sequence
atgactcaaagcgtcgtggttcaggttggccaatgtggtaaccagatcggctgttgcttctgggacctggctctgagggaacatgctgcagtgaatcagaagggaatctacgacgaagctatctcttccttctttcgtaatgtcgacaccagggtggtgggagacgggggttccattagtaagggaaaaatttgctctctgaaggcacgcgctgtgttaatcgatatggaagaaggcgtcgtgaacgagatcctgcagggacccctgagggacgtcttcgacactaaacagttgattacagatattagcggctcaggaaataattgggctgtgggtcacaaggtttttggttccctctatcaggaccagatactggagaaatttaggaagagtgccgagcattgtgattgcctccagtgttttttcatcatccactcaatgggcggtggcaccggttcagggctgggaacttttctcctgaaagtattagaggacgagttcccagaagtctaccgatttgttacatccatctacccatccggcgaagatgatgttataacctctccttacaatagcattctagcaatgaaagaacttaacgagcatgcggattgtgtgcttccaattgacaatcaaagccttttcgatattataagcaagattgatcttatggtgaactcagggaaattgggcactacggttaaacctaaaagtttggtgacttcatcaagcggggctttgaaaaagcaacataagaagccttttgatgctatgaacaatattgttgcaaatctgctgttgaacctgacttcaagtgcccgatttgaagggtccctcaatatggacctgaatgaaatctcgatgaacctcgtgccatttccacagctgcactaccttgtctcaagcctaactccactgtacactctaacagacgtcaacatcccaccaaggcggctcgatcagatgttttcggacgccttcagcaaggatcatcaattgttgagagccgacccaaaacattccctctatctagcttgcgccttgatggtccgcggaaacgttcaaattagcgaccttaggagaaatatcgagcgacttaagcccagcctgcagtttgtgagctggaaccaggaggggtggaaaacctcattatgctccgtgccacccgtgggccactcacacagtctactggcactggcgaataacacctgcgtgaaaccaaccttcatggaattgaaggagcggtttatgagactctataaaaaaaaggcgcacttacatcactatttacaggtggaagggatggaggaatcttgcttcacagaggcagtcagctctctgagtgccctgatccaggaatatgaccagctcgatgccacgaagaacatgcccgtgcaggatctgccacgcctgtctatagccatgtag

SEQ ID NO: 245584 - DNA, 621 bp, Artificial Sequence
  Description of Artificial Sequence: Synthetic coding sequence
atggaatctgatcagcgaaaggtggtgggagacggcggatctatctcaaaggggaagatttgcagcctgaaggctcgggcagtgctgattgacatggaggagggtgtggtgaatgagatcctccagggcccattgcgcgacgtgttcgatactaaacagctcattaccgatattagcggtagcggtaataactgggccgtcggtcacaaagtgtttggctctctctaccaagatcagatcctggaaaagttccggaaaagcgctgaacactgtgactgcttgcagtgcttttttattatccattcaatgggcggtggcacgggctcggggctcggcacctttctcctgaaggttttggaagatgaattcccagaggtttatcgatttgttactagtatctaccctagcggtgaggatgacgtgatcacgtcgccttacaatagcatcctggcaatgaaagagctgaacgagcacgccgactgcgtcctgcctatcgacaaccagtccctgttcgacattatttccaagatcgatttaatggtgaacagtggtaaactgggcacaaccgttaagccaaagagcctcgtgacatctagctccggggctctcaagaaacagtag

SEQ ID NO: 245585 - DNA, 1356 bp, Artificial Sequence
  Description of Artificial Sequence: Synthetic coding sequence
atgccaagagaaataataacgctgcaactcgggcaatgtggcaaccagataggattcgagttctggaagcaactctgcgctgagcacggtatatctcccgaagggatagtggaggagttcgctaccgagggcaccgatagaaaagatgttttcttctatcaggccgacgatgaacactacatccctagggcggtgctgctggatctcgaacccagagtgattcacagcattctaaacagcccttacgcaaaactgtacaatccagagaatatttacctctccgaacacggtggaggggctggaaataactgggcctcaggcttttcgcagggtgagaaaattcacgaggatatattcgatatcatcgaccgcgaggctgacggaagtgactccctggaaggcttcgtgctgtgtcactccatcgccggtggaacgggtagtggtctcggcagctaccttttggagagattgaacgatcgctatccaaagaagcttgtccaaacgtacagtgtgtttcctaatcaggacgagatgagtgatgtggtcgtgcaaccatacaatagccttctgaccctgaagcggcttactcagaatgctgattgcgttgttgtgctggataataccgctctaaaccggattgctactgacaggttgcatatccaaaacccttcttttagccaaattaatcagcttgtgtcaaccattatgtcagcttcaaccacaactctgcggtatccagggtatatgaataacgacttgatcgggttgattgcctctttgatcccaaccccacggctgcacttcttaatgacaggctacacccctctgacaactgaccaatcggttgcttccgtgcgcaaaaccaccgttctggatgtcatgcgaagactgctgcagcccaagaacgtcatggtgagcactgggagggatcggcagactaatcattgctacattgccattctaaatattatacagggggaagttgaccccacacaagtccacaaatcccttcagaggattcgtgagcgcaagctagccaattttattccttggggacccgctagtatacaggtggccttaagcagaaaaagcccttacttgccatccgcccacagggtgtctggcttgatgatggccaaccatacaagcatctcaagcctttttgaaaggacttgccgtcaatacgacaagctgcgcaaacgtgaggcttttcttgagcagtttagaaaagaagacatgtttaaggacaacttcgacgagatggacacttcccgcgagattgtgcaacagctcattgacgagtaccatgccgctacaaggcctgattatatttcctggggaactcaggagcaatag

SEQ ID NO: 245586 - DNA, 1356 bp, Artificial Sequence
  Description of Artificial Sequence: Synthetic coding sequence
atgcctcgggagatcatcaccctccagcttggccagtgcgggaaccagatcggttttgaattttggaaacagttgtgcgccgaacacgggatatcccccgaggggatagtggaggagttcgccaccgagggtacagacaggaaagacgttttcttttaccaggccgatgatgagcattatatcccgagagccgttctgctagacttagaacctcgggtgattcacagtatccttaatagtccatatgccaagttgtacaatccagagaacatctatttgagcgaacacgggggaggcgctggcaacaactgggcgagcggcttcagccaaggcgagaaaatccacgaggatatattcgatataatcgaccgagaggctgacgggtccgacagtttggaagggtttgtcttgtgccattccatcgccggaggtaccgggtccgggctgggaagttacctgctggaacgtctgaacgacaggtaccctaagaagctcgtacagacttattctgtgttcccttatcaagacgaaatgagcgatgtcgtcgtacagccttataactcactactgaccttgaagcgtctaacccagaatgctgattgtgtggtagtgctcgacaataccgccctgaacagaatagcaacagatcggctgcatatccaaaacccgagttttagccagattaaccagttagtctccactatcatgtcagcctccacaactactctcaggtaccccggatacatgaacaatgacctgatcggtctcatcgccagcttgattccgacccctaggcttcacttcctgatgactggatatactcccttgacaacagaccagagcgtggcttcagtgcgaaaaacgacggtgctggatgtgatgcggagattgctgcagccgaagaacgtcatggtctcaactggaagagacagacagacaaatcactgttatattgctattctcaatatcatccagggtgaagtggaccctacccaggtacacaaaagcctccagagaatcagggagcgaaagctcgctaacttcattccttggggccctgcatcaatacaggtcgcactctccaggaagtctccataccttccctccgcacatcgcgtttctgggctaatgatggccaaccacacgagtatctcctcgctgttcgagtcttcttgtcaacaattcgacaagttacgcaagcgcgacgcctttttggagcaattcaggaaagaagacatgttcaaagacaatttcgacgaaatggacagatcccgggaagtcgtccaagaactgattgacgaataccacgctgccactcagccagactacatctcctggggaactcaggagcaatag

SEQ ID NO: 245587 - DNA, 2001 bp, Artificial Sequence
  Description of Artificial Sequence: Synthetic coding sequence
atgatccatgaactgctgcttgcattgtccggataccccggtagcatctttacctggaataagaggagcggactgcaggtttcccaggattttcccttcctccacccttctgaaacgtccgtgctgaacaggctatgtcgcctgggcaccgactatatccgcttcaccgagttcatcgagcagtatacaggccatgtacagcagcaggatcaccacccgtcccagcagggacagggaggcctgcacggaatttatttacgggcattttgcaccggcctggacagcgtgcttcagccttatcgccaggctctccttgacctggagcaggagttcctgggagacccgcatctttcaatcagccacgtgaactacttcctggatcagtttcagttgctgtttccatctgttatggtggtcgtcgagcagattaagagccaaaaaatccatggttgtcagatccttgagactgtctataagcactcttgtggaggactgcctccggtccgtagcgctctggagaaaatcctggccgtctgccatggggtgatgtacaagcagctttcggcttggatgttgcatgggctacttctggaccagcacgaggagttctttataaagcaggggccatcatccggcaatgtgtctgcccagcccgaggaagacgaggaggatctgggaatcgggggacttaccgggaaacagctccgggaactgcaggacctccgtctgatagaggaggagaatatgctcgcacctagcctgaaacagttttctttgagggtagagattctgccaagctatattccagtgagagtcgccgagaaaatcctttttgtcggcgaaagcgtgcaaatgttcgaaaatcagaacgttaatctgacaaggaagggcagcatactgaagaaccaggaggacacttttgcggctgagttacatcgcttgaagcagcaaccactcttctctctggtggactttgaacaggttgtggacagaattcgctcaacggtggcggagcatctgtggaagttaatggtggaagaaagtgacctcctcggacagcttaaaatcataaaggatttctacctcctaggcaggggtgagttattccaagcattcatcgatacggctcagcatatgctgaaaacccctccaaccgccgtgacagaacatgacgtgaatgtggccttccaacagtcggcccataaagtgctcttggacgatgataatctgttacctcttttacacctgactattgaatatcacgggaaagagcataaggatgcaacccaggcccgagaaggaccttctcgtgaaaccagtccacgtgaagctcctgcctctgggtgggccgctcttggcctgagctacaaagtgcagtggcccttacatattttgtttacccccgctgtcctggagaaatacaatgtggtattcaaatacctcctttcagtgcgcagggtgcaagccgagctacagcactgctgggccctccagatgcagcgcaagcatctgaagtctaatcagacagatgctataaaatggagactgcgtaaccacatggccttccttgtggacaaccttcagtactacctgcaagtggatgtgctggagtcacagttctctcagctgcttcatcagatcaatagtacacgagatttcgagagtatcagactcgcccatgatcattttttgtccaatctgctggcacagagcttcattttacttaaacctgttttccactgccttaacgaaattttggacctgtgccatagtttttgttccctggtgagccaaaacctgggaccgttggacgaacggggtgccgctcaactttccattctggttaagggcttctcccgtcaatcctctctactcttcaagatcttatccagtgtgagaaaccaccagatcaacagcgatctggctcagctattgttaagacttgactacaataagtactacacccaggccggagggactctggggagctttgggatgtag

SEQ ID NO: 245588 - DNA, 1029 bp, Artificial Sequence
  Description of Artificial Sequence: Synthetic coding sequence
atggtcgtggtagagcagataaagagccagaagattcacggttgccagatcctagagactgtgtacaagcacagttgtggaggactcccacccgttcggtccgctcttgaaaagatccttgctgtatgccacggagtaatgtataagcagcttagcgcatggatgcttcacggtctcctcctggatcagcacgaggagtttttcattaaacaaggaccctcctcgggtaatgtgtctgcccagccagaagaggatgaagaagacctcggcatcggtggcctgacaggcaagcagttgcgagagctgcaagacctacgactgatcgaggaagagaacatgctggcaccatctcttaagcagttttcactgagagtagagattctgccgtcgtacatccctgtgagagtggccgagaaaatcctatttgtcggggaatctgtgcaaatgtttgaaaatcaaaacgtcaatttaacccggaaaggatccattttaaagaaccaagaggacacattcgcggctgaactccaccgtctcaaacagcagccactcttcagtctcgtggactttgagcaggtagttgacagaatccggtctaccgtggccgagcatctgtggaaactgatggtggaggaatccgacttgcttggtcagctcaagattattaaggatttctaccttctgggaaggggcgaactgttccaagcattcattgatactgctcaacatatgctgaagactccaccaactgccgtgactgaacatgacgtgaacgtagccttccaacagagcgcgcataaagtactgctggatgacgacaacctgctcccactcctgcatcttaccatcgagtaccacggaaaggagcacaaggcagacgctacacaagcccgagaggggccatctagggaaaccagtcccagggaggcccctgcaagtggctgggctgccctgggcctgtcctacaaggtccaatggccgcttcatatcctttttacaccagccgtgctggagaaaaatcggcagttttag

SEQ ID NO: 245589 - DNA, 3075 bp, Artificial Sequence
  Description of Artificial Sequence: Synthetic coding sequence
atggcccgacacggtccaccttggagtaggctggatgctcagcaggagagggatgtacgcgagctggtgagaggagttgcgggtctgcaggacgaagctgaccctaattttcagctcgctctcaacttcgcgtggagtaattttcggttccatcgatttctcgacgtaaactcacacaagatcgagaaaacgatcgagggtatttatgagaaattcgtgatccacagcgacctgtcaaaggcagcctcctggaagaggctgacagaagagttcctcaatgccccactgcctagcataaaggaaattaaaacagatgcacactattccatcttgagcttattgctctgtctgagcgactctccctctaactccagctacgtggaaacacccagaaataaagaagtggagaaaaaagatgatttcgactggggaaaatacctcatggaagacgaagagatggacatcggaccatacatggacacccctaattggagtgaggagtccgaagaagagaatgatcaacagccacttagtcgggaggatagcgggatccaggtcgacagaacacccctggaggaacaggaccaaaaccgcaagcttgatccatgtatcagttggaaggacgaaccggacgatcggtcttggcttgagcaccacgttgtccatcagtactggaccgcccgtccgtcccagttcccgcactctctgcatcttcactccaatctcgccgctgtctgggatcagcacctgtacagttcagaccccctctacgtcccagatgacagggtccttgtgactgaaacccaggtaatccgcgaaactctatggctgttgtctggcgtaaaaaagctgttcattttccagctgattgatggaaaggtcacagtgcggaataacattattgtcacacacctgacccattcctgccttcgctctgtcttggaacaaattgcggcatacggacaggtggttttccgcttgcaagagttcatcgacgaggtcatgggtcatagtagtgagtctatgctgcctggctctggaagcgtacctaagaaatctaccgaagctccattcagaacctaccaggcatttatgtgggcactgtataaatacttcatttcatttaaagaggaacttgcagaaattgagaagtgcattatcaacaacgatacgacaatcacgcttgccatcgtagtcgataagctggcgccaagattgagtcagctaaaggtgcttcacaaggtcttcagtaccggcgtggccgaggtgccacctgacactaggaatgtggtcagggccagtcacctgctcaacactttgtacaaagcaatcttggaatatgacaacgtcggggaggcctccgagcagaccgtgtcactcctcttctccctgtgggtggagaccgtacgcccttacctgcagacagtggatgagtggatcgttcatggccacctctgggatggagccagggaatttatcatccagaggaataagaacgtgccagtcaaccatcgtgacttttggtacgcaacctacacactgtacagcgtctcagaaaagactgagaatgaggagaaaatgtccgacaatgccagtgcatcttctggatccgatcagggcccatccagtcggcagcacacaatggtttcatttctgaaacccgttctcaagcaaattattatggccggtaaatccatgcagctgctgaaaaacctccagtgcgcggaatcgacaacctgccaggcaggagcacgagatgccgagcgcaagagcctctacaccctcttcctggagagtgtgcagtcaaggctccgacacggggaagacagcacaccccaggtactgaccgagcaacaagccacaaaggagaatctgatgaagatgcagagtatcgccgaatcacacctggaactggacgacgtgcacgacccactgcttgctatcaactttgcacggatgtatctggagcaaagcgactttcacgaaaaatttgccggaggcgatgtgtgcgtggatcgctcctccgagtccgtgacttgccagacgttcgagttgaccctgagatcatgcttatacccccacatcgacaagcaatacctggattgttgtggaaatctgatgcagaccctgaagaaggactataggttagtcgagtatttacaggccatgcgcaatttcttcttgatggaaggaggggacactatgtatgatttttacactagcatcttcgataaaattagagaaaaggagacttggcagaacgtcagtttcctcaacgtgcagctgcaggaagcggtgggacagagatatcccgaagattcaagccgtctcagcatatccttcgaaaacgtcgacacagcaaaaaagaagcttcccgtacatatcctggacggactcacactgagttacaaggtcccatggcctgtcgatattgtaatatccctcgagtgccagaaaatctacaatcaggtgtttttgcttttgctgcaaattaagtgggccaagtactcactagatgtgctgctgttcggagaactggtgagtactgctgaaaagcctagactaaaagagggtctaatccacgaacaggatactgtcgctcagttcgggcctcagaaggagcccgtccgccagcagattcacagaatgtttctgttgcgcgtgaaactaatgcattttgtgaattcattacacaattacattatgacccgaatcttacacagcacgggattagaattccaacaccaggtagaggaagccaaggacttagatcagctgataaaaattcattaccgatatctgtccactatccatgatagatgcctgttgcgtgagaaagtaagctttgtcaaggaggcgatcatgaaggtcttaaatcttgccttgatgtttgcagacgggtggcaggcagggctggggacatggcggatggaaagcattgagaaaatggaaagcgattttaaaaattgccatatgtttttagtgaccattctaaacaaggctgtgtgtaggggatctttcccgcacctggagtctctcgccctatctctgatggccggtatggagcaatcttag

SEQ ID NO: 245590 - DNA, 3075 bp, Artificial Sequence
  Description of Artificial Sequence: Synthetic coding sequence
atggcaagacatggaccaccatggtccaggttggatgctcagcaggaaagggatgtcagagaactagtgcgaggtgtggctggtctgcaggacgaagctgaccctaatttccagttggccctgaatttcgcatggtccaacttcaggtttcaccgattcctggacgtaaatagtcacaaaatcgagaagaccattgaagggatctacgagaaatttgtcatccatagtgatctgtctaaagctgcctcatggaagcgtcttaccgaggagttcttgaatgccccacttccttctatcaaggagatcaagaccgacgcacattactccatcctctctctgttactgtgcctgtcagacagcccttctaacagctcctatgttgagactccgaggaataaagaggtggagaaaaaggatgattttgactggggcaagtacctcatggaagatgaagagatggatatcggaccttatatggatacgcccaattggagcgaagaaagtgaggaagagaacgaccagcagcctctgtcccgagaggattcgggtattcaggtggaccggacaccacttgaagaacaggaccagaacagaaagttggacccctgtatttcttggaaggatgagcctgacgaccgaagctggctcgaacaccacgttgtccatcaatactggacagctaggcctagtcagttcccccactctctgcatctacactctaatctggctgctgtctgggatcaacatctttattccagtgaccccctgtacgtgcccgacgacagggtgttggtcacagagacgcaggtgattcgggagaccctctggctgctctcgggagtcaagaaactgtttatatttcagctgatcgatgggaaagtcactgtgcgtaacaacatcatagtcacgcatctcacccatagttgcctgcgatctgttcttgaacagattgctgcttacgggcaagtggtcttccgtctgcaggagtttattgatgaggtgatgggccattcatcagagtccatgctacccggtagcgggtccgtgcctaagaaatccacagaggctcctttccgaacttatcaggcatttatgtgggctctgtacaagtacttcatttccttcaaggaggaacttgccgagatcgagaaatgtattatcaacaatgacaccactataacgctggctatagtagtggacaagttagcaccaaggctgagccagcttaaagttctccacaaggtgttctctaccggcgtggcggaggtcccccctgatacccggaacgtggttagggcatcacacctacttaatactctatataaggcgatcctcgagtacgacaatgtcggcgaggcctccgagcagacagttagcctgttattcagcctctgggtagagactgtcagaccttatttgcaaacagtggacgagtggattgttcatggccatctatgggacggcgcacgcgagttcatcatccagagaaataagaacgtgccagtgaatcatagggatttctggtacgccacatacacgctgtactctgtgagtgagaagaccgagaacgaggagaagatgagcgataacgcttcggcaagcagtggtagtgatcagggcccatcctctcggcagcacacaatggtatcttttcttaaacctgtgctgaaacaaatcattatggccggaaaatctatgcaactcctcaagaatctgcagtgcgccgaaagtaccacatgccaggctggcgcacgggatgccgaaagaaaatccctctacacactattcttggaatctgtacagagccgactgaggcatggcgaggattctactccacaagtgctcaccgagcagcaggctacaaaggagaacctgatgaaaatgcaatctatcgccgagagccacctggaactggatgacgttcatgaccccctgctagccattaacttcgctcgaatgtacttggagcagtccgattttcacgaaaagttcgctggtggtgacgtgtgtgtcgaccggagcagcgagtccgtcacttgccagactttcgagctcacgctccgctcgtgtttatacccccacattgacaagcagtatctcgattgctgcggaaatctgatgcaaacgctgaagaaagattaccgcttggtggaataccttcaagccatgaggaacttctttcttatggagggcggagacactatgtatgatttctatacttccatctttgacaagattagagagaaagaaacctggcagaatgtgtcatttttaaacgtgcaactccaggaagctgttggtcagcggtaccccgaggacagctcaagattgtcaatttcttttgagaacgtggacactgctaagaagaagctgcctgtccatattctggatggtctgacactcagttataaagtgccctggccagttgacattgtgatttctctggaatgtcaaaagatatacaaccaggtgtttctgctcttactccagattaagtgggctaaatacagccttgatgtccttctgtttggggagctcgtctcaacagccgagaaaccccgtttaaaagaggggctcatccacgaacaggatacggtggcccagtttggccctcaaaaagagccggtccgacagcaaatccaccgcatgttcctcttgcgggtaaaactcatgcactttgtaaacagcctacacaactatatcatgacacggattctgcactccactggtcttgaattccaacatcaggttgaagaagcaaaggacctggatcaactgattaaaattcactatagatatctgagcactattcacgaccgctgcctcctccgcgaaaaagtgtcttttgttaaagaggccatcatgaaggtccttaatttggctctgatgtttgctgacggttggcaggccggactcggaacctggcgaatggaatccattgagaaaatggaatctgactttaagaattgccatatgttcctcgttaccatactgaacaaggcggtctgccgaggctctttcccacactgtgagtatattatgctgaaatatttttacctctgtatcagcctgtag

SEQ ID NO: 245591 - DNA, 1431 bp, Artificial Sequence
  Description of Artificial Sequence: Synthetic coding sequence
atgtggaccgggtacaagatcctcatcttctcttacctgaccacagaaatttggatggaaaaacaatatttatcccaaagggaggtcgacttggaagcttatttcaccagaaatcacaccgtgttacagggcacacgctttaagagagctatcttccaaggccagtactgtaggaatttcggatgctgcgaggatcgggacgatggctgcgtgacagagttctacgcagcaaacgccctgtgctactgcgacaagttttgtgatagagaaaactccgattgttgtcctgactacaaatcattttgtcgcgaagaaaaggagtggcctccccacacccagccctggtaccccgagggatgctttaaagatgggcagcattacgaagagggatctgtgataaaggagaactgtaactcctgcacctgttccggccaacagtggaaatgcagccagcacgtgtgcctggtacgttctgagctcatcgaacaggtgaacaagggcgactacggctggaccgcccagaactactcacaattctgggggatgacactagaagacggatttaagtttaggctgggcactctgcctccatcccctatgctgctttccatgaacgagatgacagctagtctgcccgcaacaacagatttaccagagttttttgtggctagttacaaatggcccggatggacccatggaccactggatcagaagaactgcgctgccagttgggcctttagcacagcctcagtagctgctgaccggatcgcaatacagtccaagggccgatataccgccaacctgagccctcagaacctgatctcatgctgtgccaagaatcgccatggatgcaattctggctcaatagatcgtgcctggtggtacctgagaaaacggggtctcgtgtctcacgcctgctatcctctcttcaaagaccagaacgctacaaataacgggtgcgcgatggcctcccgcagtgacggtcgcggaaaaagacatgctactaagccttgccctaacaacgtcgaaaagtccaacagaatctaccagtgcagcccaccctatcgcgtatcgagcaatgagaccgagatcatgaaagagattatgcagaacggtcccgtgcaagccatcatgcaagtgagagaggacttctttcactacaaaactggtatctatagacacgttaccagcaccaacaaagagtctgagaaatatagaaaactgcagacacatgctgtgaagctgactggttgggggactctgcggggtgcacaaggccaaaaagagaagttctggatcgcagcgaatagctggggaaaaagttggggggagaatgggtacttccgaattctgaggggagtgaatgaatctgatatcgagaagttgatcattgctgcctggggccagctcaccagcagtgacgagccatag

SEQ ID NO: 245592 - DNA, 1008 bp, Artificial Sequence
  Description of Artificial Sequence: Synthetic coding sequence
atgtggacaggatacaagatcctcatcttttcttatcttacgaccgaaatttggatggaaaagcagtatctctcccagcgagaagtcgacctcgaggcatacttcacccgcaaccacaccgtcctgcaaggaactagattcaagcgggctattttccagggccagtactgtcgaaacttcggatgttgcgaggatagagacgacggttgtgtgacggagttctatgccgcaaatgcactctgttattgcgacaagttctgtgacagagaaaattcagactgttgccccgactacaaaagcttttgccgagaggagaaggaatggcctccccatacccaaccatggtatcctgaaggccgttggacagcacagaattactcccaattttggggcatgaccctggaggacgggtttaagtttcgcctaggcaccctgccaccgagccccatgcttctgagtatgaatgaaatgacccggctggtctcacatgcttgctaccccctcttcaaggatcagaacgcgacgaacaatggctgtgccatggcgagtcggtctgacggcagaggtaagcggcatgctacaaagccatgtcctaacaatgtggagaaaagtaacaggatttaccagtgcagccctccttatagggtcagcagcaacgagacagaaatcatgaaagaaataatgcagaatgggccagtgcaggcgatcatgcaggttcgagaggattttttccactataaaaccggcatatatcggcatgtcacctccactaataaagagtccgagaagtaccgcaaattgcaaacccacgccgtgaaattgaccggctggggcaccctgaggggtgcccaaggccagaaggaaaaattttggattgccgctaactcatgggggaagtcatggggggagaacggatactttaggattttgcggggtgtgaacgagagcgatattgaaaagctgatcattgcagcttggggtcagctgacgtctagcgacgaaccatag

SEQ ID NO: 245593 - DNA, 612 bp, Artificial Sequence
  Description of Artificial Sequence: Synthetic coding sequence
atggagaagcagtatcttagccaacgggaggtcgacctcgaggcctactttacccgcaaccacacagtactgcaggggactaggttcaaaagggctatatttcagggccagtactgcagaaattttggctgctgtgaagaccgagatgacgggtgcgtgacggagttttatgccgcaaatgcactctgttattgtgacaaattttgcgaccgagaaaactctgactgctgccctgactataagagcttttgtagggaagaaaaagaatggcccccacacactcaaccttggtaccccgagggatgtttcaaagacgggcagcactatgaggagggctccgtgatcaaggaaaactgcaactcttgcacgtgctctggacagcagtggaagtgcagccaacacgtctgtctagtgcggagtgagctaatagaacaagtgaataagggcgactacgggtggactgcccagaactacagccagttctggggcatgactttggaggatgggtttaaattcaggcttggtactctccctccttccccaatgctactaagtatgaacgagatgactgtgtcggtgccctcagattcgcgcatgtgtatgtacctctag

SEQ ID NO: 245594 - DNA, 468 bp, Artificial Sequence
  Description of Artificial Sequence: Synthetic coding sequence
atggccagcagatcagacggccgtggtaaacgacatgcgaccaagccatgccctaataacgtagaaaagagcaatcgcatctatcaatgcagccccccatacagagtaagcagtaatgagacggaaataatgaaagagatcatgcagaatggccctgtgcaagccattatgcaggtaagagaagatttctttcattacaaaactggaatctaccgccatgtaacatccaccaacaaagagagtgagaaataccgaaagcttcagacccacgctgttaagctgactggttggggcaccctgcgaggcgctcaggggcagaaggaaaagttttggatagcggcaaactcttgggggaaatcctggggagagaacgggtatttccgtatcctgcgaggagtgaacgaaagcgacatcgagaaacttatcatcgctgcatggggacaactgacttcatcagacgagccgtag

SEQ ID NO: 245595 - DNA, 618 bp, Artificial Sequence
  Description of Artificial Sequence: Synthetic coding sequence
atgcgcgcatggatgttcgtttcaatgcaggccgagatttggatggagaaacagtacctctctcagcgcgaggtggacctggaggcttatttcacaagaaatcacacagtcctgcagggcaccaggttcaaaagagcgatctttcagggccagtattgccggaacttcggatgttgcgaggatagagacgacggatgtgtaaccgagttttacgcggctaacgctctgtgttactgtgataagttctgcgatcgggaaaattcggattgttgtccagattacaagagcttctgcagagaagagaaagagtggccaccacacacccagccatggtatcccgaagggtgttttaaggacggccagcattacgaggagggttctgttatcaaagaaaactgcaatagctgtacctgcagtggacaacagtggaagtgctctcagcacgtttgcctagtgcgatctgaactgattgaacaagttaataaaggggactacggatggaccgctcagaattattcccaattttggggaatgacactggaggatggcttcaagttccgccttgggactttgccccctagtcctatgctgctgtcaatgaatgagatgactgaatag

SEQ ID NO: 245596 - DNA, 3570 bp, Artificial Sequence
  Description of Artificial Sequence: Synthetic coding sequence
atgtccgtgaagtcccccttcaatgtgatgtcacgtaataatctagaagctcctccgtgcaagatgacagaaccctttaacttcgagaagaatgagaacaaactgcctccccatgaaagccttagatctcccggtactttacccaatcatcccaactttaggctcaagtctagcgagaacgggaacaaaaaaaacaatttcctcctgtgtgagcagacaaagcagtacctggcttctcaggaagataattccgtcagcagcaacccgaatgggatcaacggagaggtggttgggtcaaaaggcgacaggaagaaactgccagcaggtaactcagttagccctccttccgctgaatcaaattcgcctccaaaggaggtgaatatcaagccaggaaataacgtccggccagctaagtctaagaaactaaacaagctcgtggagaactctctgagtatctccaatcctggtctgttcacttctttagggcctccactgagatcaactacatgtcacagatgtggcctgttcggtagcctgcggtgttctcaatgcaaacagacgtactattgcagcaccgcctgccagaggcgagactggtccgcccactcaattgtgtgccgccctgtgcagcctaacttccacaagctggagaacaagagtagtatcgagactaaagatgtcgaagtcaacaataaatccgactgccccctgggcgtcactaaggaaatcgcaatttgggccgagaggattatgttctctgatctccgttccctccagctcaaaaagaccatggagatcaaaggcaccgtgaccgagttcaagcaccccggagacttctatgttcagttgtacagctcagaggtgctggaatatatgaatcagctctccgcaagcttgaaagagacgtatgctaacgtgcacgaaaaggactatatccctgtaaaaggagaagtttgtatcgccaagtatactgtggatcagacatggaatagagcaatcattcaaaacgtggacgttcagcaaaagaaggcccatgtactgtatatagactatggaaacgaggaaattatacctctgaataggatctatcaccttaacagaaacattgatctcttccccccatgtgctattaagtgtttcgtagctaatgtaatccctgcagagggaaattggtcctcagactgcattaaggctactaaacccctcttaatggagcaatactgcagcattaagattgtcgacatactggaggaagaagtggtgacatttgccgttgaggttgagctgcctaacagcggcaagcttctggaccatgtgttgattgagatgggctacggccttaaaccatccgggcaggactcaaaaaaagagaacgccgaccaatcagaccctgaagacgtcggaaaaatgacaaccgagaataatatcgtcgtggacaaaagtgatctcattcctaaggtccttaccttgaatgttggggatgaattttgcggagtggtcgcacacattcagacccctgaggatttcttttgtcagcaactgcagtccgggcgaaagctcgctgagttacaagcaagcctttccaagtactgtgaccagttaccgccaagatctgacttctacccagcaatcggtgatatttgctgtgctcaatttagcgaggacgaccagtggtaccgggcatcggtattagcttatgcaagcgaagagtccgtgctcgtgggctatgtggattacggcaatttcgagatcctgtccctgatgaggctgtgtcccattattcccaagttgctcgaattacctatgcaggccataaagtgcgtgttggcaggtgtgaaacctagcctcgggatctggacaccagaagcaatctgcctgatgaagaagctggtgcaaaataaaatcatcaccgtgaaagtggtggacaagctggaaaatagctctctggtggaactcatcgataaaagcgaaacccctcatgtttctgtcagcaaggtgctcttggatgcaggctttgccgtaggagagcagagtatggtgactgataagccctcagatgttaaagaaacaagcgtacccctgggagtggagggtaaggtgaaccccctggaatggacttgggtcgaactgggcgtcgaccagactgtagacgtggttgtgtgtgtgatttatagccctggcgagttttattgccacgtgctcaaagaagatgcgctcaagaaacttaacgaccttaataagagtttggcagaacactgtcagcaaaaactgcccaatgggttcaaagcagagatagggcagccttgctgcgctttcttcgctggagacggcagttggtatagagctttggttaaggaaatcctgccaaatggccacgttaaagtgcacttcgtggactacgggaacatcgaggaagtgaccgctgatgaactgcgtatgatcagtagcacatttctaaatctaccctttcaaggaatccgctgccagctggcagacatccagagtcgcaacaaacactggtcggaagaggccatcaccagatttcaaatgtgtgtcgctggcatcaagctgcaagccagagtggttgaggtaaccgaaaatgggataggggtggagctcaccgatctctctacgtgttacccgcgaatcatctcggacgtgctgatcgatgagcatctcgtgctgaagagcgcctccccccacaaggatctccctaatgaccgcttggtcaacaagcacgaactccaggtgcacgtgcaggggctccaggcaacctcctctgcggagcagtggaagacaatcgagcttcccgtcgataagacgatccaagccaatgtgctggagattatcagccccaaccttttctacgcgttgcctaaaggcatgccagagaatcaagaaaagctctgtatgttgaccgcagagttgctcgagtactgcaacgcccctaaaagcaggccaccctatagacccaggatcggagacgcctgttgcgctaaatataccagcgacgacttctggtaccgcgctgtggtcctgggaacatcagacactgacgtcgaagtcctctatgctgactacggcaacatcgagactctgcctctgtgtagggttcagcccatcacctcttcacatctggcgttacctttccaaatcatccgctgcagtctcgaaggtctgatggagctgaatggcagctcatcacagctcattatcatgctgctgaagaatttcatgctgaatcagaacgtaatgttaagcgtgaagggcatcactaagaatgtgcacacagtaagcgtggagaagtgctccgagaacggcacggtggacgtcgccgacaaactagtgaccttcggtttagcaaagaatatcaccccccagaggcaaagtgctctgaataccgaaaagatgtaccggatgaactgctgttgtaccgagctccaaaagcaggtggagaaacacgaacacattctactgtttctcttgaacaatagcacaaatcagaacaagtttatcgagatgaagaagctcttgaaaaaaacagcttctttggggggtaaaccactgtag

SEQ ID NO: 245597 - DNA, 3315 bp, Artificial Sequence
  Description of Artificial Sequence: Synthetic coding sequence
atgtccgtaaaatcgccatttaacgtgatgtccaggaacaacctggaagcccctccttgcaaaatgaccgagccgttcaacttcgaaaagaacgagaataagttgccgcctcacgaaagtttgaggtcacctggtacactgcccaatcacccaaattttcgactgaagtcttccgaaaatgggaacaaaaagaacaacttcctgctgtgcgagcagactaaacaatatctggcctcccaggaggataatagcgtaagctctaatccaaatggcatcaacggagaggtggtggggtccaagggcgatcgcaaaaagctccctgccggaaactccgtaagcccaccctccgccgagtccaactcccctcccaaggaggttaacatcaaacctggcaacaacgtgcgaccggctaagtcgaagaaactgaataagctggttgaaaactccctctctatctctaacccgggtctgtttacaagtctgggcccacccctgaggagcaccacatgccacagatgtggtctcttcggcagcttgaggtgctcccagtgtaagcagacatattattgtagtacggcctgccagaggcgtgactggagcgcgcatagtatcgtgtgcaggccggtgcaacccaacttccataaactggaaaacaagtccagtatagaaaccaaagatgtggaggttaataataagagtgattgtcctctcggagtgacaaaggaaatcgcaatttgggctgaacgcatcatgttcagtgacctcagaagcctgcagttgaaaaagaccatggagataaaaggcaccgtcactgaatttaagcatcccggagatttttacgtgcagctgtacagctctgaggtgcttgagtatatgaatcaattatccgcatccctgaaggagacgtatgcgaatgtccacgagaaagactacatccccgtcaaaggcgaggtgtgcattgccaaatacacagtggaccagacttggaaccgcgcaatcattcagaatgtcgatgtccagcagaaaaaggctcatgtgctgtatatagattatggcaacgaagagataatccctctgaaccgaatctatcatttgaaccggaacattgacctctttcccccttgcgcgatcaagtgcttcgttgctaacgtcattcctgcggagggaaactggagtagcgattgcatcaaagctaccaaacctcttctcatggagcagtactgcagcatcaagattgtagatatcctagaggaggaagtggtaactttcgcagtggaggttgaacttccaaattcgggcaaactgctggaccacgtcttgattgaaatgggctacgggctcaagcccagcggacaggattccaagaaagagaatgcagaccagagtgatcccgaggacgtggggaaaatgactaccgagaacaacattgttgttgataagagcgacttgatccccaaagtgctgaccctgaatgttggcgacgagttttgcggtgtcgtcgcccatattcagacccctgaagacttcttctgccaacaattgcagagcgggagaaaacttgccgagctgcaggcctcacttagcaaatattgtgatcagttacctcctcgctcagatttttaccccgcaatcggcgatatttgctgtgcacagttttccgaggacgatcagtggtatagggcctccgtcctagcctacgcaagcgaggagtcagttctcgtcggctacgtggactatggaaatttcgagatactttcccttatgcggctctgccctatcatcccaaaactgctcgagttgccaatgcaggccatcaagtgcgtcctggctggggtcaagccctctttgggaatatggaccccagaagccatttgtcttatgaagaagctggttcagaataagattatcactgtcaaagtggtggacaagctggagaattcctccctggtggagctgatcgataagtctgagactccccacgtaagtgtctcgaaggtgctcttggatgccggatttgcagtaggggagcagagcatggtgactgacaaaccttcggacgtcaaggaaacttccgttccactcggcgtagaaggcaaggttaatcctcttgaatggacttgggtcgagttgggcgtggaccagaccgtggacgttgttgtgtgcgtcatctattcccccggagaattctactgtcatgttttaaaggaagacgccctcaaaaaactgaatgacctcaacaaaagcctggcagaacattgtcagcagaaacttcctaatggctttaaagcagaaatcggccaaccttgttgtgccttcttcgctggggacggatcttggtatcgcgctctggtgaaggaaatccttccaaacggccatgtgaaagttcactttgtcgattacggcaacatcgaagaggtaaccgccgatgagctaagaatgatctccagtacctttctcaatttgccgttccaaggcattcgctgccagctcgcagacatacagtcaagaaataaacactggtcggaagaggcaatcacacgatttcagatgtgcgtggccggaattaaacttcaggcacgtgttgtcgaagtgacagaaaatggtatcggtgtggagctgacagacctgtccacatgttaccctcgaataatctctgatgtgttgatcgacgagcatcttgtattgaagagcgccagcccacacaaggacctgccaaacgataggcttgtgaacaagcatgaactgcaggtgcacgtacagggacttcaggccacctccagcgccgaacaatggaaaactattgagctccccgtggacaaaacgatccaggcgaacgtcctcgaaattatttcccccaatctgttttacgcattacccaaaggaatgcccgagaaccaggaaaagctctgtatgctgaccgcagagcttctagaatactgcaatgctcccaaatctcgtccaccatatagacctcggatcggtgatgcatgttgcgccaaatacactagcgacgacttctggtaccgggctgtggttcttggaacaagcgacacggacgttgaagtgctgtacgccgactatggtaatatcgaaaccttgccattgtgtagggtgcagcccattacatcaagccatctggcactgccctttcagattatcaggtgctccttggaggagaaaatgtaccgtatgaactgttgttgtaccgagctgcagaaacaagtagagaagcacgaacatatcctactcttcctccttaacaactctactaatcagaacaaatttattgagatgaagaagctcctcaagtcctag

SEQ ID NO: 245598 - DNA, 3228 bp, Artificial Sequence
  Description of Artificial Sequence: Synthetic coding sequence
atgagcgtgaagtccccttttaacgtcatgagccgaaacaatttggaagccccaccgtgcaagatgaccgaacccttcaactttgagaaaaacgagaacaagttgcccccacacgaatctctcagaagtcctgggactctgccgaaccaccctaattttaggctgaaaagcagcgagaacgggaacaaaaagaacaacttcctgctgtgcgaacaaaccaaacagtatctggccagccaagaggataattccgtgtccagcaatcccaatggaatcaacggtgaagtcgtgggttctaaaggcgatcggaagaaattgcccgcagggaacagcgtgtctcctccttccgccgaaagcaatagcccacccaaggaggttaatatcaaaccagggaataatgtccgtccagccaagtcaaagaagctcaacaagctggtcgaaaattcgctcagcatcagcaaccctggcctcttcacaagccttggccctccgttgcggagtactacctgtcaccgttgtggtctgtttggatctctgcgctgttcacaatgcaagcagacatattattgtagcaccgcctgtcagagacgcgattggtccgcacattcaatcgtttgtcggcctgttcagccgaacttccacaagctggagaacaaatcaagtatcgaaaccaaggacgttgaggtcaataataagtctgattgtcccctgggcgtgacaaaagagatcgccatctgggcagagaggattatgttcagcgacttgcggagccttcagctgaaaaagacgatggaaatcaagggaactgtgaccgaattcaagcatcccggagacttttatgtgcaactgtactcaagcgaagtgctggagtacatgaaccagctctctgctagtctcaaggaaacgtatgctaatgttcatgagaaagactacatccctgtcaaaggagaggtgtgcattgctaaatatacggttgaccagacttggaacagagctatcatccaaaacgtagatgtgcaacagaagaaagcacacgtgctctacattgactatggaaacgaggaaattattccactcaacaggatctatcatctcaaccgaaacatagacctctttccaccttgtgctattaagtgtttcgtggctaatgtaattcctgctgaggggaactggagtagcgactgtatcaaagccacaaagccgctgctaatggaacagtattgttctatcaagattgtggatattctggaggaagaggtggtgacattcgctgtggaggtggagctccccaattccggaaaactgctggaccacgtcttaatcgaaatgggctacggcctgaagcctagcggccaagatagcaaaaaggaaaacgccgatcagagcgatccggaagacgtaggtaagatgactaccgagaataacatagtagtggacaagagcgacctaataccaaaggtgctcactctgaatgtcggcgacgaattctgtggcgtcgtagcccacatccagactccagaggattttttctgtcaacagctacagtctgggaggaaactggcagaactgcaggctagtctgtccaagtactgtgaccagctacctccacgtagcgatttctaccccgcaatcggggacatctgctgcgcacagttctctggggtgaaaccttcactaggcatatggactcctgaggctatatgcctcatgaagaagctggtgcagaataaaatcataacagtgaaagtagtggacaaactggaaaactcaagcctcgtggaattaattgacaagtccgaaaccccccatgtgagtgtttctaaggtgttacttgacgcaggcttcgctgtcggagagcagtccatggtgactgataagcccagcgatgtcaaggagacttcggtccctctgggcgtagagggcaaggtgaatcccctggagtggacttgggtggaattgggggtcgaccaaacagtcgatgtggtggtttgtgtgatttattcaccgggagagttctactgtcacgtcctgaaggaggatgctctgaagaagttgaacgatttgaataagtctttggctgagcattgtcagcagaaactccctaatgggtttaaagccgaaatcggacaaccctgctgcgctttctttgccgacatacaatctagaaacaagcattggtccgaagaggcaatcacaagatttcagatgtgtgttgccggtatcaaacttcaggcaagagtggttgaggtcaccgaaaacgggatcggagtggagttgactgatctgagcacttgttatccaagaattatcagtgacgttttgattgatgagcatctggtcctgaagtctgcctcaccccacaaagaccttcccaatgatcgcctggtgaacaagcacgagcttcaggtccatgtgcaaggcctgcaggccaccagctccgctgagcagtggaaaacgattgagttaccagtggacaaaactatccaggccaatgtcctggagattattagtccaaatcttttttacgcgctgcccaagggcatgccagagaaccaggaaaagctgtgtatgctaacagccgaactgctggagtattgtaacgccccaaagtcaagacctccgtataggccacggattggcgacgcttgctgtgccaagtatacatccgacgacttttggtaccgcgcagtggttctggggacatctgataccgatgtggaggttctgtatgcggactatggaaacatcgaaactcttcccttatgtcgggtgcagcctattacaagctctcacttagccttacctttccagatcattagatgttctctggagggtctgatggagctgaatggctcaagctcgcagcttatcattatgctgctgaagaacttcatgctcaatcagaacgttatgctctcagtgaagggaataacaaagaatgtccacacggtaagcgtagagaaatgttccgagaacgggaccgtggacgtcgccgataagctcgtgacattcgggctggcaaagaatataacgccccagcgacagagcgctctgaataccgagaaaatgtatcgtatgaattgttgttgcacggaattgcagaagcaggtcgaaaagcatgaacatatcctgctattcctcctgaataatagtacaaaccaaaacaagtttatcgaaatgaaaaagcttcttaagaagactgcttccctcggtgggaaacctttgtag

SEQ ID NO: 245599 - DNA, 3342 bp, Artificial Sequence
  Description of Artificial Sequence: Synthetic coding sequence
atgagcgtgaagtctccattcaacgtcatgtcaagaaacaatcttgaagcgcctccgtgcaagatgaccgagcctttcaactttgaaaaaaacgaaaataagcttccccctcacgagtccctccggtcaccgggaacactccccaatcatccaaactttagattgaagtcctctgaaaatgggaataagaagaacaactttttactctgtgaacaaactaaacagtatttggccagccaagaggacaatagcgtatcgtctaatcccaacggcattaacggagaagttgtgggctccaaaggagaccgcaaaaagttacccgcaggaaactcggtgtcgccaccaagcgccgaatcaaatagtccgccaaaggaggtgaacataaagcctggcaacaatgtgcgacctgcaaagtcgaaaaagctgaacaagctggtggagaactcactgtccatctccaaccctgggttgttcaccagtctagggccaccattgagatcaaccacctgccaccgatgtggcctgtttggcagtctgcgatgtagccagtgcaagcaaacctattactgctccaccgcctgccagagacgggattggtccgcccactctattgtgtgccgtccagttcagcccaactttcacaagcttgaaaataagtcatccatagaaactaaggatgtagaggttaacaacaagtcagactgccccctgggagtgacaaaggaaattgccatctgggccgaaagaataatgttctcagatctcaggtccctccagttaaaaaagactatggaaattaagggcaccgttactgaattcaagcatcccggtgatttttatgtacagttatattccagcgaggtgctcgagtacatgaaccagctgtccgctagcctgaaagaaacatacgccaatgtgcacgagaaagactatatccctgtgaagggggaggtgtgtatcgcaaagtacaccgtggaccagacatggaacagggccattatacagaacgtagacgtccaacagaaaaaggcccacgtgctgtatatagattatggaaacgaggagatcattcccctaaaccggatttaccacctgaatagaaacattgacctgttccccccatgcgctatcaaatgcttcgtagccaacgttatacctgctgaaggtaactggtcttccgattgcataaaggcgaccaagcctctgcttatggagcagtattgctcaatcaagatcgtggacattctagaagaggaggtggtgacatttgctgtggaggtggaactacccaattctggcaaactgctggaccatgtgctcatcgagatgggctatggcctgaagccatccggacaggactctaaaaaggagaatgctgaccagtccgacccagaggacgttggtaagatgaccacggagaacaacatcgtcgtggacaaatccgacctgatcccaaaggtcctgacactgaatgtgggcgatgaattctgcggcgtggtggcacatattcaaacacccgaggacttcttctgccagcaattacagtccggacgcaagctggccgagttacaggcttcgctgtctaaatactgtgaccagctcccacctcgatcggatttctatcctgctatcggggatatctgctgcgcccagttttctgaagacgatcaatggtatcgagcctccgttcttgcctatgcttctgaagagtctgtgctcgtgggctacgtagattatggcaatttcgagatcttatccctgatgaggctctgcccaattatccccaagctgctagaactgcctatgcaggcaatcaagtgcgtgttagccggagtgaagcctagcctgggaatatggacgcctgaggcaatttgtctgatgaaaaagctggtgcagaacaaaataatcacggtcaaagtggttgataaattggagaacagcagccttgtggagctgatcgataaatctgagaccccccacgtgagcgtcagtaaggtgttacttgatgccggatttgccgtgggggaacagagtatggtcacagacaagcccagcgacgtcaaggaaacctccgtgcctctgggcgtggaaggaaaggtgaatcctctggaatggacttgggtcgagttgggcgttgaccagacagttgacgttgtcgtttgtgtcatttactccccgggtgagttctattgtcatgtgcttaaggaggatgccttgaagaagttgaacgacctcaacaagagcctcgccgagcattgtcagcaaaagctgccaaacgggttcaaagccgagatcggacagccttgttgcgccttcttcgcgggagacgggtcgtggtaccgggctctggtgaaggaaatacttcctaacgggcacgtcaaggtacattttgtggactacgggaatattgaggaggttacagccgatgagttaaggatgatatctagcactttcctgaacttgcccttccagggcatccggtgtcagttggccgacatccagtctcggaacaaacattggtctgaggaggcaattacgagatttcagatgtgtgttgctggaattaagttacaggccagagtggttgaggttacagagaacgggataggggttgaactgactgacctttctacttgctatcctagaatcatctccgatgtgctcattgacgaacacctggtgctgaagtctgcctcaccacataaggatcttcctaacgaccgactggtgaacaaacacgaactccaggtacatgtgcagggcttgcaggctaccagctctgctgagcaatggaaaacaatagaactgccagttgacaagactattcaggccaatgtgctggagatcatctcaccgaacctgttttacgcactgcctaagggtatgccggaaaaccaggagaaactatgtatgctaacggctgagctcctggaatattgcaacgcaccaaaaagccggccaccgtatcgccctcgcattggggacgcatgctgcgcgaagtatacttctgacgatttctggtatcgggctgtagtcctgggtactagtgacactgacgtagaagtgctatacgcagactacggcaatattgagacgcttcccctgtgtagagttcagccaatcacgagctctcatcttgccctgccttttcagattatacgctgctccctggaggaaaaaatgtatagaatgaactgttgttgtacagaactgcaaaaacaggtcgagaagcacgaacacatcctactattccttttgaacaactctaccaatcagaataaattcatagaaatgaagaaattgctgaaaaaaacagcctcactgggcggaaaaccactgtag

SEQ ID NO: 245600 - DNA, 2154 bp, Artificial Sequence
  Description of Artificial Sequence: Synthetic coding sequence
atgaatcagttaagtgcgtccttaaaagaaacctatgccaatgtccatgagaaggattatatcccggtgaagggggaagtgtgtatcgccaagtacacagttgatcaggctataaaatgtttcgtggcaaatgtcatccccgcagagggaaactggtctagcgactgcatcaaagccaccaagccgctcctgatggaacagtactgttccattaagatagttgatattttagaagaggaggtagtgacctttgccgtggaggttgagttgcctaatagcggaaaactgttggaccacgtgctgatcgagatgggctacggcttgaagccaagcgggcaggacagtaagaaggaaaacgctgatcaaagtgatccagaggatgttggcaagatgaccacagagaacaacatcgtggtggacaagagcgacctgattccgaaggtcctcaccctgaatgtcggcgacgaattctgtggagtggtggctcatattcaaactcccgaggattttttttgtcagcaactgcagagcggtagaaagctggccgagctccaagcaagcttatctaaatactgcgaccagctgcctcccaggtccgacttctacccggcaatcggggatatctgctgtgctcagttttcaggtgtgaaaccttccttagggatatggaccccagaggctatttgcctgatgaagaagttggtgcagaacaagattatcacagtgaaggtggtggacaaacttgaaaacagctctttagtggagctaattgacaagagcgagacccctcacgtgtccgtgtccaaagtattgttggacgccggattcgccgtgggtgagcagagcatggtcaccgataaaccgtcggacgtgaaggaaacgagcgtgccacttggagtggagggcaaggtgaatcccttggagtggacatgggtggagttgggtgtcgaccagaccgtggatgtggtcgtgtgcgtgatctattctcccggagaattttattgccacgtgcttaaggaggatgcgcttaagaagctgaacgacctgaataagagtctggctgagcactgtcaacaaaagcttcccaatgggttcaaggctgaaattgggcaaccttgttgtgccttttttgctggcgacggatcttggtaccgcgctttagtgaaggagatactcccgaacggccatgtcaaggtccacttcgtcgattacggaaatatcgaggaagtcactgcagacgagctcaggatgatcagctcaacattcctgaatttgccttttcaggggattcgctgccaactcgccgatatacagagtcggaataaacattggagtgaagaggctatcactcgtttccagatgtgcgttgcgggtatcaaactgcaagcgagggtcgtcgaggtcaccgagaatggtattggagtggagctaaccgacctctccacatgctaccctaggataattagcgacgttctcatcgacgaacatcttgtacttaagtccgccagtccccacaaagatctgccaaacgacagactggtcaataaacacgagctacaggttcacgttcaggggctccaggccacatcatccgcagaacagtggaagacaatcgagcttcctgtcgataaaacaatccaggcaaacgtactcgagatcatttcacccaatctgttttacgcactgccaaagggaatgccggagaatcaggaaaagctctgcatgctgacagcagaactactggaatattgcaatgcgcctaagagtcggcctccttataggcccagaatcggcgacgcctgttgcgcaaagtacacatccgatgatttctggtatcgcgctgtggtgttaggtacctcggatactgacgttgaagtcttatacgccgattatgggaacattgaaaccctccccctctgccgagtccagcctattacatcctcacaccttgccctgccatttcagatcattcggtgcagtctggaagagaaaatgtatcggatgaattgttgctgcactgaacttcagaaacaggtcgaaaagcatgaacacattttgctattcttgttgaacaactccaccaaccaaaacaaattcatagagatgaagaagctgctaaaaaaaaccgcgtcactgggcggaaagccgctgtag

SEQ ID NO: 245601 - DNA, 1956 bp, Artificial Sequence
  Description of Artificial Sequence: Synthetic coding sequence
atgctgcgcctccagatgacagacggtcatattagctgcactgcagtcgagtttagctacatgagtaagatttcactcaacaccccacccggaacgaaggtgaaactgtccggaatcgtggatatcaagaacgggtttttactcctgaacgacagtaatacaacggtgctgggcggagaagtcgagcacctcatagagaaatgggagctccagagatcactttcgaaacataacaggtcaaacatcggaactgaggggggtccacccccattcgttccattcggtcaaaagtgcgtatcccacgttcaggtcgacagccgggagctcgataggaggaaaactctgcaagtgacaatgccggtgaaaccaacaaacgacaatgacgagttcgagaagcaacgcacggcagccatcgcagaagtcgctaaatctaaagaaaccaagactttcggaggtgggggagggggagcgcgatctaatctgaatatgaatgctgccggtaatcgcaatagagaagtgctacagaaggaaaaaagcactaaaagtgaaggaaaacacgagggcgtgtatagggaacttgtggatgagaaagcactaaagcacatcacagagatgggtttctctaaggaggcatctaggcaagctctgatggacaatgggaataatttggaggccgctctaaacgtcctgttgacttctaataagcagaagcctgtgatgggccctcccctgaggggcagaggtaaggggagaggcagaattaggtctgaggacgaagaggaccttggtaatgccaggccatcagctccctctactttatttgatttcctcgaatcaaagatgggaacactgaacgtggaggaacccaaatctcagccccagcaactgcatcagggacagtacagatcctcgaacactgaacagaacggtgtgaaagataataatcatctgaggcaccctccacgtaacgacacccgacagccaaggaatgagaagccacctaggttccagagggatagtcagaacagtaagagcgtgctggaaggatctggacttcctcggaatagaggatccgaacggccaagcactagtagtgtgtcagaggtttgggcggaggacagaattaagtgcgatcgtccatactctaggtatgacaggacgaaggatacctcctatccactcggctcccagcacagcgatggggcatttaagaaaagagataattccatgcagtcaaggagcgggaaggggccttcttttgctgaggcaaaggagaaccctctccctcagggcagcgtggattacaataaccagaaaagaggaaagcgcgagtcccagacaagcatccccgattacttctatgaccggaagagtcagaccattaacaacgaggcattttcaggaataaaaattgaaaaacacttcaacgtgaatactgactaccaaaaccccgtaaggtccaactcgtttatcggcgtgccaaatggggaagtggaaatgccactcaaggggcgtagaattggaccaattaaaccggctggacccgtgactgcggttccatgcgatgataaaatcttttataactctggccctaaacggcgaagtggaccaatcaaaccagagaagatcctggagagttccattcccatggaatatgcaaagatgtggaagcctggtgatgaatgctttgcgctgtattgggaagacaataaattctatcgagccgaggtggaagccctgcacagctctgggatgacagccgtggtgaagttcatcgactacgggaattatgaggaagttttactgtcaaacatcaagcccattcagaccgaggcctgggaagaggaaggaacctacgatcagacgcttgaatttcggaggggtggtgatggacaacctcgacggtccacaagacccacccagcagttctatcagccgccacgagctagaaactag

SEQ ID NO: 245602 - DNA, 1956 bp, Artificial Sequence
  Description of Artificial Sequence: Synthetic coding sequence
atgttgcggttgcaaatgaccgatggacacatatcttgcaccgccgtggaatttagctacatgtctaagatcagtcttaacactcctccaggcactaaagttaaactgtctggcattgtagacatcaaaaacggtttccttctcctgaatgactcaaacaccacagtgcttggcggagaggtggagcatctcattgaaaaatgggagctgcaacgaagcctttcgaaacacaacaggtccaacataggaaccgaaggaggaccccctccgttcgtgcccttcgggcagaaatgtgtgagccatgtccaagtagattcccgagagttagatcggagaaagactctccaggtaacgatgccagtgaagcccacaaacgacaacgatgaatttgagaaacagcggactgcagctattgcagaagtcgcaaagagcaaggagaccaagacattcggcggaggaggcggaggcgctaggagcaacctgaatatgaacgccgctggcaaccgcaaccgtgaagtcctccagaaggagaaatcaacaaagtccgaaggaaagcatgagggagtttaccgcgaattagtggatgaaaaggccctgaagcatattacagagatggggttttccaaggaagcaagcaggcaggctctgatggacaacggcaacaatttggaagctgctcttaatgttctcctgaccagcaataagcagaaaccagttatgggtcccccactgagaggacggggaaaagggaggggtcgcatccgctctgaggacgaggaggacctggggaatgctcgtccttctgcccctagcacactttttgattttttagagagtaagatggggaccctgaacgtggaggagcccaagtcccaaccacagcaactgcaccaggggcagtaccggtcaagcaacaccgaacagaatggtgtgaaagataacaaccatctgaggcatcctcccaggaacgataccagacagccaagaaacgaaaaacccccacgctttcagagggactcccaaaattcgaaatctgtgctggaagggtcaggtctgccccgaaacagaggctcagaacgaccgtccacaagctcagtatcggaagtttgggccgaagaccgcatcaagtgcgacagaccttattccaggtatgacagaacaaaagacacctcataccctctcggctcacagcacagcgacggagcgtttaagaaacgggataactccatgcaatctagatccggcaagggaccttcttttgctgaggccaaggagaatcccctgccacaagggtcggtggactataacaatcagaagcgcggaaagagggaaagtcagaccagtataccggattatttttacgatcgaaagagtcagactataaataatgaggccttttccgggatcaagatcgaaaagcatttcaatgtcaataccgactatcaaaatcctgtgaggtccaactcattcatcggtgtgcctaacggggaggttgaaatgcccctcaagggacgacggatcggtcccatcaaacctgcgggtccagtaaccgccgtgccatgcgacgacaaaatcttctataacagcggaccgaagcggagatctgggccaatcaaaccagagaagatactcgaaagttcaattccaatggagtatgctaagatgtggaagcccggtgatgagtgcttcgctctctactgggaggacaacaagttttatagagccgaagtagaagccctgcacagcagcggaatgaccgctgtcgtgaaattcatcgattatgggaactatgaagaggtactcctatccaacattaaaccaatccagaccgaagcttgggaggaggaagggacatacgatcagaccctcgagttcagacgcggtggtgatggtcaaccacggcgatctactcgcccaacacagcagttctatcagccacctagggcaagaaattag

SEQ ID NO: 245603 - DNA, 390 bp, Artificial Sequence
  Description of Artificial Sequence: Synthetic coding sequence
atgttgcggttacaaatgaccgatggtcacattagctgcacagccgtcgagttctcctacatgagcaagatcagcctaaacacacctcctggcactaaagtgaagctgtctgggatcgtggacatcaaaaatggattccttcttctgaatgacagcaacactaccgtattaggaggtgaagttgagcacttgattgaaaagtgggaactgcagaggtctttgtctaaacacaatcgatctaatattgggacagaaggcggtcctccccctttcgtaccatttgggcagaagtgtgtctcgcacgtgcaggtggacagcagagagctggatagacgcaaaacccttcaggtgactatgccagtgaagccaaccaacgacaacgacgagtag

SEQ ID NO: 245604 - DNA, 1956 bp, Artificial Sequence
  Description of Artificial Sequence: Synthetic coding sequence
atgctgaggttgcagatgactgacggtcacatctcctgtacagctgtcgaattttcatacatgagcaaaatttcattgaacacacctcccggaacaaaggtgaagctgtctggtattgtggacatcaagaacggattcttgcttcttaatgactccaatacaacagtgcttggcggagaggtggaacatcttatagaaaagtgggagctacagagatcattatcaaaacataacaggagtaacatcgggacagagggaggccctcccccattcgtgccattcgggcagaagtgcgtgtcacacgtacaggtggactcgcgcgaacttgatcgccgaaagactctgcaggtcacgatgccagtaaagccaacaaatgataatgacgaattcgagaagcagcgcactgccgctatcgcagaagtggccaagtccaaagaaacaaagacttttgggggtggagggggaggggctaggagcaacctgaacatgaatgccgctgggaacaggaacagggaagtcttacagaaagagaagagcactaaatcagaaggcaagcacgagggcgtttatcgggagctggtggacgaaaaggccctgaagcacatcactgagatggggtttagcaaagaggctagcaggcaggccctcatggacaacggcaataatcttgaggctgctctgaacgtcctacttacatccaataagcagaaaccggtgatgggtccccctctcaggggcaggggcaaggggagaggacgcatccggtctgaggacgaggaggatcttgggaatgccaggcctagtgccccatcaactctatttgacttccttgagtcgaaaatgggtaccctgaatgtggaggagcccaagtcccaacctcagcagctgcaccagggacaatacagatcgtccaacacagagcagaacggagttaaggacaacaaccacttgcgccacccccctagaaacgatactcggcagcctcgaaacgagaagccaccaagatttcagcgtgactcacagaattcaaaaagcgttctggagggtagcggcctccctcggaatcgtggctctgaaaggccctcaacctccagcgtgtctgaggtgtgggcagaagaccgtatcaagtgtgatcgaccatattccaggtacgatcggactaaggacacctcttacccattaggcagtcaacacagcgatggcgcttttaagaaacgggataatagtatgcagtcccggagcgggaagggcccatcttttgctgaggctaaggaaaaccccttgccccagggcagcgtggattacaataaccagaaaagaggtaaacgtgagtcacagacatctattcccgattacttctatgatagaaagagtcagacgatcaacaacgaggccttctccgggattaagatcgagaagcatttcaacgtcaatacagactatcaaaaccccgtcagatctaactcctttatcggggtgccaaatggggaagtggagatgccactaaagggcagacgcatcgggccaatcaaacccgctggtcccgtgaccgccgtcccttgcgacgacaaaattttttacaacagcgggccaaaaaggcgttccggacccattaaaccggaaaagatccttgagtcttccatccccatggaatacgcgaaaatgtggaaacccggagacgaatgcttcgctctctactgggaagacaacaagttttaccgcgcagaagtcgaagcactgcattcaagtggaatgactgccgttgtgaagttcatagactatggcaattacgaagaagttctactgtcaaatatcaaaccaatccagactgaggcgtgggaggaggaagggacctacgaccaaaccctggagtttcggcgagggggagatggtcaacctcgcagatccacccgtcccacgcagcaattttatcagcctcctagagcgcgaaattag

SEQ ID NO: 245605 - DNA, 2235 bp, Artificial Sequence
  Description of Artificial Sequence: Synthetic coding sequence
atggcccaggtcgcaggagctgctctctcacaagccggttggtacctgtcagacgagggcatcgaagcatgtacctcgtccccagataaggtgaacgtgaacgacatcatcttgatcgcattgaatacagacctgagaactatcgggaagaagtttctcccaagtgacatcaactccggcaaggtggaaaaactggagggtccctgcgttcttcagattcagaagatccgaaacgttgccgcacccaaagataacgaggaatcccaagctgctcctagaatgctgagactgcagatgactgacggacacatttcgtgcacagcagtggagttcagctacatgagcaaaatctcactcaatactcctcctgggaccaaggtgaaactgtcggggatcgtagatattaaaaatggattcctgctcctgaatgattcaaataccacggtgctcggtggagaggtcgagcatctgattgagaagtgggaattgcaacggtccctgtctaagcataatcggagcaacattggcacggagggtggaccgccaccattcgtgccattcggtcagaagtgcgtatctcatgtccaggtcgacagtcgggaattggacagacggaaaacattgcaggtaaccatgcctgtgaagccaactaatgataacgatgaatttgaaaaacagcgcacagctgcaatcgccgaggtggctaaatctaaggaaacaaaaacctttggcggagggggagggggagcgcgaagcaacctgaacatgaatgccgctggtaatcggaatcgcgaggtactccagaaagagaaatcaacgaagagcgagggaaaacacgagggagtttatagagaacttgtcgatgagaaagcattgaaacacattaccgaaatgggcttctctaaagaagcctccaggcaggcgctcatggacaacggcaataatctcgaggctgccctcaacgtcctattaacctccaataaacagaagccagtaatgggtccacccctccgagggcgaggtaaaggccgaggacgcatacgatccgaggacgaggaagatcttggcaacgccaggccttctgctcccagtacacttttcgacttcctggaaagcaagatgggtaccctgaatgttgaagaaccaaaaagccagccccagcaacttcaccaggggcagtataggtcttcaaatacagagcagaatggggtgaaagataacaatcacctgagacacccgcctcgcaatgatactcggcagccacgcaacgagaagccaccgcgtttccaacgggattctcagaactccaagagtgttctcgagggctcaggattacctcgcaatagaggaagtgaacggccaagcacttcgtccgtcagcgaggtctgggcggaggaccgtattaaatgcgacaggccctactctcgttacgacaggactaaggatacaagctatcctctgggatcccagcattcagatggagctttcaagaagcgagacaatagcatgcagtcgcgaagcggaaaaggaccttcattcgccgaggccaaagagaatccccttccccagggctcagtcgattacaacaaccaaaaacggggaaagagggaatctcagacatcaatccccgattacttctacgaccgaaagagtcaaacgatcaataatgaagcgttttctggaatcaagattgaaaaacattttaatgtcaatactgattaccagaaccccgtgcgcagcaatagctttatcggcgtacccaatggcgaagtggagatgccccttaaaggcaggcgaattggccctatcaagcccgctggtcccgtcacagctgtgccatgcgatgacaaaatcttctacaactccggtcccaagcgtcgtagtggccctatcaagccggagaagattctggaatcctccatcccaatggagtatgccaaaatgtggaagcccggagatgaatgcttcgcactgtattgggaggacaataagttttaccgggctgaggtggaggctctacactcttctgggatgaccgcagtcgtgaagtttatagattacggcaactacgaagaagtgctgctgtccaacattaaacccattcagacggaagcttgggaggaggagggcacatacgatcagacactagagttcaggcgcggtggggatggtcaaccgagacgttctactagacctactcagcagttctatcagccacccagagctagaaactag

SEQ ID NO: 245606 - DNA, 3297 bp, Artificial Sequence
  Description of Artificial Sequence: Synthetic coding sequence
atgctcgaaggtgatctcgtgtcaaaaatgttaagggcagtgctgcaaagtcataaaaacggcgttgccctgccgaggttgcaaggggagtacaggagtttaacaggtgactggatacctttcaagcagttgggatttcctactctggaggcttatctccggtctgtccccgctgtggtgcgtatcgagaccagcaggagcggggagatcacctgttacgccatggcttgtactgaaacagcccgaattgcccaactggtggcacgccagaggtcctccaaaaggaagaccggcagacaagtaaactgccagatgagggtgaaaaagacaatgcctttttttctagaaggtaaacccaaagcaaccctgcgacagccgggattcgcctctaacttctctgtcgggaagaagcctaatccagcgcctctgcgtgataaagggaactcagttggggtaaaacctgatgcagaaatgtccccatatatgttgcatactacactgggaaacgaggcgttcaaggacatccccgttcagcgtcatgttacaatgagcacaaacaacagatttagccctaaagcctctttgcagcctccacttcagatgcacctctctcgaacctccaccaaagagatgtcagataatttaaatcagaccgtggagaaaccaaatgtgaaaccacctgccagctacacttacaaaatggatgaggttcaaaataggataaaagaaatccttaacaaacataataacggcatctggatttctaagctgccgcacttctataaggagttgtataaagaggacctcaaccaggggatcctgcaacaattcgaacactggccccacatttgcacagtggagaagccttgcagcgggggtcaagacctgctgctgtaccctgcaaaacgcaaacagcttctgcgatctgaactcgacactgaaaaggtacctctgtctcctttaccgggtcctaaacagactccaccgcttaaaggctgccccaccgtgatggctggggattttaaagagaaggtcgcagatctgcttgtgaagtacacttctggcctttgggcttccgcgctgcccaaggcttttgaagagatgtataaagtcaagttccctgaggatgcactaaagaatttagccagtctctccgacgtgtgctcgattgattatatttctggcaacccccagaaggccattctctacgctaagctgcccctgcctacagacaaaatccaaaaggatgcagggcaggcgcacggggacaatgatattaaggccatggtagagcaagaatacttacaggtggaggagtctattgcagaatccgctaatactttcatggaagatatcaccgtccctcctctgatgattccgacagaggccagtccttccgtgctggtagtcgagctgtccaataccaacgaggtggtgatccgatacgtcggaaaagattattcggccgctcaagagctgatggaggacgaaatgaaagagtactatagtaagaatcccaagatcactcctgtgcaagctgtcaacgtgggccaacttttagcggtcaacgcagaagaagacgcttggttacgcgcacaggtgatttcgaccgaggaaaataagatcaaagtgtgctacgtggactacggcttctcagaaaatgtggagaagtcaaaggcatataaactgaaccccaaattctgctcactctcctttcaggcgactaagtgcaaactggccggactggaggtgttgagcgacgatccagacttggtgaaggtagtggagtccctcacctgtgggaaaatctttgccgtcgagatcctcgataaagctgacatcccccttgttgtgctgtatgacacttctggcgaggacgatatcaacatcaacgctacttgcctgaaagccatctgcgataagtcccttgaggtccacttgcaggttgacgctatgtacacgaacgtgaaggtgaccaatatctgcagtgacggtacattatattgtcaggttccctgcaaaggactgaacaagttaagcgacctcctgcggaaaatcgaagactactttcactgcaaacacatgacaagcgagtgttttgtgtctctaccattttgcggtaaaatctgcttgttccattgcaaaggtaagtggcttagagtggagatcactaatgtgcactcatccagagcacttgacgtgcagtttctggactcagggactgtaacctccgttaaggttagtgaactgcgtgagattccacctcggtttctccaggaaatgatcgccatccctccgcaggccatcaaatgttgtttggctgacctgccgcaaagtattgggatgtggacgcctgatgccgtactttggctcagagactctgtcttgaattgtagcgattgcagcataaaagtgacaaaggtcgacgaaacccgcggaatcgcacatgtatatttgtttaccccaaagaattttcctgatcctcaccgctcgattaatcgccagattaccaacgctgatctgtggaaacaccagaaggatgtctttctgtccgccatttcttccggagctgactcccccaattcaaagaatggcaatatgcctatgtctggcaacacaggcgagaattttagaaagaatctgacggatgtgattaagaagtctatggtcgatcacacctccgctttcagtacagaagaacttccacctcctgtgcacctctctaaaccaggtgaacatatggacgtttacgttcctgttgcctgccatcccggttatttcgtcatccaaccatggcaggaaatccacaaactcgaggtgctgatggaggagatgattctgtattactctgtctccgaagagcgacatattgctgtcgaaaaggaccaggtatacgcagctaaagtcgaaaataagtggcatcgggtgctgctcaagggaatcctcaccaacgggcttgtgtcagtttacgaactcgattacgggaagcatgaactcgtgaacataagaaaagtgcagccactagtagacatgttccgcaagctccctttccaggccgtgactgctcagctcgccggtgtgaagtgtaaccagtggagtgaggaggcatccatggtgttcaggaaccacgtggagaagaaaccactggtggcacttgttcagactgtgattgaaaatgcaaatccctgggatagaaaggtggtggtgtacctggtggatacttctcttcctgacaccgatacgtggatccacgactttatgtccgagtacctgattgaactctccaaggtaaattag

SEQ ID NO: 245607 - DNA, 3075 bp, Artificial Sequence
  Description of Artificial Sequence: Synthetic coding sequence
atggcgtgcactgaaactgcacgtatcgcacaattggtagcgcgtcagcgcagctcaaagagaaaaaccggcagacaggtgaattgccagatgcgggtgaagaagaccatgcccttctttctcgaaggcaaacccaaggccacgctgcggcagcctggcttcgcgtccaacttctctgtgggaaaaaaacccaaccccgcacccctgagagacaaaggaaattccgtcggcgtcaaacccgatgcggagatgagtccctatatgctgcatacgactctcgggaatgaggcctttaaagacatcccagtgcaaaggcatgtcacgatgtcaaccaacaatcgcttttcacctaaggccagtttacagcccccacttcagatgcacctgagcaggacaagtactaaagagatgtccgataacctgaatcagactgtggaaaagcccaacgttaaacctcccgctagctacacatataagatggatgaagtccagaaccgtatcaaggaaatactgaacaaacataataatggcatttggatttcgaagctgccccacttttataaagaactgtacaaagaggatctgaatcagggaatccttcagcagtttgagcattggccacacatatgtacagtggaaaaaccttgtagtgggggtcaggacctactgctctaccctgcgaagagaaaacaactgctccggtccgaactggacacggaaaaagtgcctctgtctccattgccagggccaaagcagactcccccactgaaaggatgtcctacagttatggccggagattttaaggagaaagttgcggacctgcttgttaagtacactagcggactgtgggcaagcgccttgcccaaggctttcgaggagatgtacaaggtgaagttcccagaggatgcactgaagaatctggctagcttgtctgacgtatgctctatcgattacattagcggcaatcctcagaaagctattttgtacgcaaaacttcctctgccaaccgacaagatccaaaaggacgcaggtcaggcccatggcgataacgatattaaggctatggtggaacaggaatacctgcaagtcgaggaatctattgcggagtccgcaaacacatttatggaggacatcacagtcccgcctctaatgatcccgactgaggcctccccaagcgtgctggtagtggaactgagtaataccaacgaggttgtgatcagatatgtgggcaaagactacagcgctgcacaggaactgatggaagacgagatgaaagagtattactcaaagaatcctaaaatcacccccgtccaagccgtgaacgtcggacagcttctcgccgttaacgccgaggaagatgcatggctaagagcacaggtcatatctacagaggagaacaaaatcaaggtctgctatgtggattacggcttctctgaaaacgtcgagaagtccaaagcttataaactgaaccccaagttttgctccctctcattccaagccacaaaatgcaagcttgctgggttagaggtgctcagcgacgaccctgatcttgttaaagtagtggaaagtctcacctgcggaaaaattttcgcagtggaaattttggacaaagctgacatccctctcgtagtgttatacgacactagcggggaagacgacattaacattaatgctacatgtctaaaggcgatatgcgataagagcctagaagttcacctgcaggtcgacgctatgtacaccaatgtgaaagtgaccaatatttgcagcgatggcactctttactgtcaagtgccctgtaagggactcaataagttgtctgatctgctgcggaagatcgaggactatttccactgcaagcacatgactagtgaatgctttgtgtccctgccattctgcgggaagatatgtctatttcactgcaagggcaagtggctccgggtggaaatcacgaatgttcactcatcccgagcccttgatgtgcaattcctggatagtggcacagtaacttcagtgaaagtctcggaactgagagaaatcccacccagattcctgcaggagatgatcgccattcccccacaggcgattaagtgctgcttggcagacctgccacagagcatagggatgtggaccccagatgcagtactgtggttgcgggactcagtcctcaactgcagcgactgctctattaaggtaaccaaggtcgatgaaacaagggggattgctcacgtgtatttattcacgcccaagaacttcccagatcctcaccgctccatcaaccgacagatcactaacgcagacctgtggaagcatcagaaggacgtctttctgagtgcgattagcagcggggctgacagccccaatagcaagaacgggaatatgcctatgtcaggtaacactggtgaaaacttcagaaaaaacttgaccgacgtgatcaaaaaaagcatggtggatcacaccagcgccttttccaccgaagaattgccacctcccgttcacctaagtaaacccggagaacatatggacgtgtacgtgcccgtggcttgtcatcctgggtactttgttatccaaccttggcaagagattcataagctcgaagtgctaatggaagaaatgatactgtactattcggttagcgaggaaaggcacatcgctgtcgagaaggatcaggtatatgcagcgaaagtggaaaacaagtggcaccgagttttgcttaaaggcatactgactaacggcctcgtctccgtgtacgagctggactatggtaagcatgaactggtgaacatccgtaaagtgcaacccctagtggatatgttccgaaagttgcccttccaggctgtgacagcacagttggccggtgtcaaatgcaatcagtggagcgaggaggcttcaatggtttttaggaaccacgtggaaaaaaaaccgctagtcgctctcgtgcagacagtgatcgaaaacgccaacccgtgggacagaaaagtagttgtgtatttggtagatacatccctgcccgatacagatacgtggattcacgacttcatgagtgagtacctgatcgagctttccaaggtcaactag

SEQ ID NO: 245608 - DNA, 1257 bp, Artificial Sequence
  Description of Artificial Sequence: Synthetic coding sequence
atgtatacgaatgttaaagtaaccaacatctgctccgatggaacactctattgtcaggtgccctgtaaaggcttgaacaagctgtccgaccttctgcgaaaaattgaggactacttccactgtaagataactaatgtgcacagtagccgagctttggatgtccagttcctggattcaggcaccgtgacctctgtgaaggttagtgaactgagggagatacctcctaggtttttgcaggagatgatagctatcccacctcaagcaattaaatgttgtctggctgacttgcctcagtctatcggcatgtggacgccagatgcagtgctgtggttgagagattctgtgctaaattgctccgattgctccatcaaggtgaccaaagtggatgaaactagagggatcgcccatgtatatctgtttacacctaaaaacttcccagaccctcaccgctccatcaaccgtcaaattacaaacgctgatttgtggaagcatcagaaagatgtcttcctcagcgccattagctcaggagcagattcacccaattctaaaaacgggaacatgccaatgtctggtaataccggtgaaaacttcaggaagaacctaacagatgtgattaaaaaaagtatggtggaccatacaagcgctttctccacggaggagttaccccctcctgttcatctctctaagcctggagagcacatggatgtctatgtgcccgttgcttgtcacccgggttacttcgtcattcagccttggcaggagattcataagctagaggtgttgatggaggaaatgattttgtactactcggtctccgaagaaagacatatcgccgtggaaaaagaccaggtgtatgccgcaaaagttgagaacaagtggcaccgagttctactgaaagggatcctgacaaatgggctggtgtccgtgtacgagctcgattacggcaagcacgaactcgtgaacatcaggaaagtgcagcccctggttgacatgtttaggaagcttcccttccaggccgtgactgctcaactggccggagtcaaatgcaatcagtggtctgaggaggcttctatggttttcaggaatcatgtcgaaaagaagcctctggtggcgcttgtgcagactgttatcgagaatgccaatccttgggacaggaaagtggttgtttacctggttgacaccagcctgccagatacggatacttggatccatgacttcatgtcagaatacctgatcgagcttagtaaggtcaactag

SEQ ID NO: 245609 - DNA, 2514 bp, Artificial Sequence
  Description of Artificial Sequence: Synthetic coding sequence
atgtctctgtcacacctatacagagatggagaagggcgtatcgatgacgacgacgacgagcgggagaacttcgaaattaccgactgggacttgcagaacgaattcaatcctaatcggcaacggcactggcagactaaggaagaggccacatacggagtatgggctgagcgcgattctgatgatgagcgaccaagtttcgggggtaaacgtgccagagactatagtgcccctgtgaattttataagcgccggactgaaaaaaggagccgctgaggaagctgagctggaggattcagatgatgaagagaaaccagtgaagcaagatgattttcccaaagactttggcccaagaaagctgaaaaccgggggaaactttaaaccgtcccaaaaggggtttgccggtggaactaagtcttttatggatttcggctcttgggagcgccacacaaagggaatcggccagaaactgctccagaagatgggatatgtgcctggtagaggtctcggaaaaaatgcccagggaatcatcaatccaattgaggcgaagcagcgcaagggaaagggagctgtcggcgcatacgggtctgagaggaccacgcaatctatgcaggactttccagtggtcgactcagaggaagaggcagaagaagagttccagaaagaactctcccagtggcggaaagacccttctggctccaaaaagaaaccgaaatacagttataagacagtggaagagctgaaagcaaaagggaggattagcaaaaagttaacggcaccccagaaagaattatcgcaggtcaaagtcatcgacatgacgggtagggagcagaaggtctactattcttacagtcaaatatcccacaaacacaacgtcccagatgacggcctccctctgcagtctcagcagcttccacagtccggcaaagaggctaaggcccctggtttcgcactccctgaacttgaacacaatctgcagcttctaattgatcttaccgagcaggagattatccagaacgaccggcagctgcagtatgaacgcgatatggtcgttaacctgtttcacgagctggaaaagatgacggaggtcctggaccatgaggagagggtgatctctaaccttagtaaagtgttggaaatggtagaagaatgcgagcgacggatgcagccagactgtagtaacccactgaccctggatgaatgcgccagaatcttcgagactttgcaagataagtactatgaggagtaccgcatgtctgacagggtggacctggccgtggctatagtataccctctcatgaaagagtatttcaaggaatgggaccctctaaaagactgcacttacggtactgaaatcatctccaaatggaagagtctcttagagaatgatcagttgctgtctcacggcggtcaagatctgtctgccgacgcgtttcacagacttatttgggaagtttggatgccttttgtccgcaatatcgttacgcaatggcagccaaggaactgcgaccccatggtggatttcttagactcctgggtgcacataattccagtctggatccttgataacattctcgatcagctgatcttccccaaactacagaaagaagtcgaaaattggaacccattaactgatacggtgcctatccacagctggatacatccctggcttcccctcatgcaggcgaggcttgagccactctattctcccatccggtccaagctgagcagtgctctgcagaaatggcaccccagtgattcctcagcaaagctgatcttgcagccctggaaagacgtctttacgcccggttcctgggaggcttttatggtcaagaacatcgtgcccaagctagggatgtgcttgggcgagctagttatcaatccccaccagcagcacatggacgccttctactgggtgatagactgggaggggatgatctctgtctcgtctcttgtgggcctgctggagaagcatttctttccaaagtggctgcaggttctgtgctcttggctgtctaattcacctaactacgaggagataacaaaatggtacctgggatggaaatcaatgttcagtgatcaggtcttggcccatccatctgtgaaggataagttcaatgaggctctggatatcatgaatcgagctgtctcctccaacgttggggcttacatgcagcccggtgcccgtgagaatattgcctatctgacccacacagagcggaggaaagatttccagtacgaagccatgcaggaacggagagaagcagagaacatggctcaacgcggaataggtgtcgctgcaagttctgtccctatgaactttaaagacctaatcgaaacgaaagcagaagaacataatatcgtatttatgccggtcatcggcaagagacacgaggggaagcagctttacacattcgggaggatcgtgatttacatcgacagaggtgtagtgtttgtgcagggcgagaaaacttgggttcctacatccttgcaaagccttattgacatggcaaaatag

SEQ ID NO: 245610 - DNA, 2514 bp, Artificial Sequence
  Description of Artificial Sequence: Synthetic coding sequence
atgtctttatctcatttatatagagatggcgagggcagaatcgacgatgacgatgacgagagagagaattttgagattactgactgggacctgcagaatgagttcaatccaaacaggcagcgccactggcagaccaaggaggaggcaacctacggagtctgggccgagcgcgacagtgacgatgagcggcctagcttcggcggaaaacgggcaagggactattcagcacctgtcaactttataagcgcgggactgaagaaaggtgccgctgaggaagcggagcttgaggactccgatgatgaggaaaagccagtcaagcaggacgactttcccaaagatttcggaccgagaaaactaaagacaggcggtaatttcaagccatcccagaagggctttgcgggtggcaccaagtcgttcatggacttcggttcatgggaaagacacaccaaagggatcgggcaaaagctcttgcaaaagatgggatacgtcccagggcgaggcttaggaaagaatgcacaggggattataaatccaattgaagcaaaacagaggaagggaaaaggcgcagtgggagcttatggcagtgaaagaaccacacagtcaatgcaggattttccggtggtcgactctgaagaagaggctgaggaagagtttcagaaggaactgtctcagtggaggaaagatccttctggatccaagaaaaagcccaagtatagctataagaccgtcgaagagttgaaagcaaagggcagaattagcaaaaagctcacagcacctcagaaagaattgtcacaggtgaaggttattgacatgacaggtagggagcagaaagtgtactactcatactcacagatttcccataagcacaatgtgcccgatgacgggctgcctctacaaagccagcagctgccccagtctggtaaggaggccaaggcccctgggtttgctctgccagaattagagcacaatctccaactccttatagacctaacggagcaagagattattcagaacgatcgccagctccaatatgagagggatatggtagtcaatctgttccacgaactggagaagatgaccgaggtacttgaccacgaagaaagagtgatctccaacctcagtaaggtccttgagatggtggaggaatgcgagcgccgaatgcagccagactgttctaaccccctaaccctggatgaatgtgctcgaattttcgaaactctgcaggacaaatattacgaagagtaccgtatgtctgatcgagtggacctagcggtggctattgtgtaccccctcatgaaagaatactttaaagaatgggatcccctgaaggactgtacatacgggaccgagatcatctcaaagtggaagagtcttctcgagaacgaccagctgttgagtcacggtgggcaagacctgagtgccgacgcgttccatcgcctaatttgggaagtgtggatgccattcgtgcgcaacatcgtgacgcagtggcaacctcgcaactgcgatcctatggtagactttctggactcctgggtacacataatccctgtgtggattctagataatatcctggaccagctgatctttcccaaactccaaaaggaagtggaaaactggaatccactcacagacactgtgcctattcattcatggatccatccatggcttccgctgatgcaggccagactcgaacccctctactctcccataagatccaagttgagcagtgccctccagaaatggcatccatcggatagctcagccaaactcattctgcaaccttggaaggacgtattcacccccggaagctgggaggctttcatggttaagaatattgtgcccaaactcggtatgtgcttgggcgaattggtgatcaaccctcaccaacagcacatggacgccttttattgggtgatcgactgggaggggatgatcagcgtatctagcctggtgggcctgttagagaagcacttctttcctaaatggcttcaggtgctctgttcatggcttagcaactcccccaactacgaggaaattacaaagtggtacctcggatggaaatccatgttcagtgatcaggtgttggcccacccatctgtgaaggacaaatttaatgaagccttggatatcatgaaccgggctgtgagctctaacgtcggagcttacatgcagcccggtgcacgcgaaaatatagcctatctgacacacacggagcgcagaaaggatttccaatacgaggccatgcaggaaaggagggaagccgaaaacatggcccagagagggattggtgtggccgcttcttccgtgcccatgaatttcaaggacctgatcgaaacaaaagccgaagagcacaatatcgtgtttatgcctgtcatcggtaaaagacacgaaggcaaacaactgtatacctttgggcgtattgtaatatatattgatcgcggtgtagtgttcgttcagggggagaagacttgggttcccactagcctacagtctctgatcgatatggctaaatag

SEQ ID NO: 245611 - DNA, 2514 bp, Artificial Sequence
  Description of Artificial Sequence: Synthetic coding sequence
atgtcgctgagccacctgtaccgcgacggtgaagggcgtatcgatgacgacgacgacgaacgagagaactttgaaattactgattgggatctgcagaacgaattcaatcctaacaggcagcgccattggcagacaaaggaggaggcaacatacggcgtgtgggccgagcgcgattctgacgacgagagaccctcattcggtggaaaacgcgctcgcgattattcagcccctgtgaattttattagcgccggactgaagaagggcgctgctgaggaagctgaactggaagactccgatgatgaagaaaaacccgtcaagcaggatgatttccccaaggatttcggcccacggaagctgaaaacaggtggcaacttcaagccctcccagaaggggttcgcaggaggcaccaagagctttatggactttggttcatgggagcgccatacgaagggaattggacagaagctgttgcagaagatgggctacgtgcccggtagggggctaggcaaaaacgctcagggcattatcaaccccatcgaagcgaaacaacgcaaaggaaaaggcgcagtgggcgcttacggttctgaaagaactacacaatctatgcaggatttccccgtggtcgattcagaggaggaggccgaggaggagtttcagaaggaactctctcaatggaggaaggaccctagtggtagcaaaaagaaaccaaagtattcctataagacagtggaggaattaaaggccaagggtcgaatctcaaagaaactgacagctcctcaaaaggagctaagccaagtgaaggtgatcgatatgacagggcgtgaacagaaggtgtactatagctactctcagatttcgcataagcacaatgtgcctgacgatggactcccactgcaaagccagcagctgccacaatcgggcaaggaggccaaagccccaggattcgcactgcccgagctggagcataatctccagctattaatcgatttgaccgaacaagaaattattcaaaatgacagacagcttcagtacgaacgcgatatggttgtgaatctgtttcatgaactcgaaaaaatgactgaggtgctggatcacgaagagcgggtgatttccaacttgagcaaggtgttggagatggtcgaggagtgtgagcggaggatgcagcccgactgcagcaaccccctgactctcgatgaatgtgcccgaatatttgaaaccctacaggacaaatattatgaagaatatcgtatgtccgacagagtggatctagccgtggctatcgtgtacccactgatgaaagagtactttaaagaatgggaccccctcaaggattgtacttacggtacagagattatttcaaaatggaagtctctgcttgagaatgaccagctcttaagccacggcggtcaggacctctccgcagatgcatttcatcgactgatttgggaagtctggatgccgttcgtgaggaatattgttactcagtggcagccaaggaattgcgaccctatggtggactttttagactcatgggtccacataatccccgtttggatcctagataatatcttggatcagctcatattcccgaaactccagaaagaggttgagaattggaaccctttaactgatactgtgcctatccattcctggattcatccatggctgcctctaatgcaggccaggctcgagccactgtattcccccatccggtctaagttgtcctctgcccttcagaaatggcacccttcggactctagcgccaaacttatcctacaaccttggaaggatgtcttcaccccgggatcctgggaggcctttatggtcaaaaacatcgtcccaaaactcggcatgtgtctgggtgaacttgtcattaatcctcaccagcaacatatggatgcgttctactgggtgattgattgggagggcatgatatccgtcagtagtcttgttggtttgctagagaaacatttctttcccaagtggctgcaagtgctgtgcagctggctcagcaatagcccgaattacgaggaaattaccaaatggtacctcggatggaaaagtatgttttctgatcaagtgttggcccacccgtcagtgaaggataagtttaatgaggcgttggatattatgaaccgggcagtgtcctccaatgttggggcttacatgcagcccggtgccagggaaaacattgcctatctcacacacactgagcgacggaaagattttcaatacgaagcaatgcaagaaagaagagaggcagagaatatggctcaaaggggcattggagttgccgcttccagcgtgccaatgaacttcaaggacttaattgaaaccaaggccgaggagcacaatattgtctttatgcccgttatcgggaaacggcatgagggaaaacagttgtatacgttcggacgaatcgtcatctacattgaccgcggagttgtctttgtccagggtgagaagacatgggtgcctaccagccttcagagtttgatagacatggccaagtag

SEQ ID NO: 245612 - DNA, 2514 bp, Artificial Sequence
  Description of Artificial Sequence: Synthetic coding sequence
atgagcctgtctcatctgtacagagacggcgaaggcagaattgacgatgatgatgatgagcgagagaatttcgagattactgactgggacctgcaaaatgaattcaaccctaaccgacagcggcattggcagacgaaagaagaagctacctatggcgtgtgggccgagcgcgattctgacgatgaacgccctagtttcggaggtaagcgcgcacgcgattattctgccccagtaaactttatcagtgcgggactgaaaaagggagccgctgaggaggcagagttagaagacagtgatgacgaggaaaagccagtgaagcaagatgacttcccgaaagatttcggccctcgcaaacttaagaccggtgggaactttaaaccaagccagaaggggtttgccggtgggaccaaaagctttatggattttgggtcctgggagcgccacactaagggcattgggcagaagttgctgcaaaagatgggctatgtgccagggcgaggattgggcaaaaacgctcagggcattataaaccctatcgaggccaagcagagaaaaggcaagggagctgtaggggcttacggtagcgaacgaaccacacagtcaatgcaagatttcccggtggtggattccgaggaagaagcagaagaggagtttcaaaaagaactatcgcagtggcggaaggaccctagcgggagcaagaaaaagccgaaatacagctacaagaccgtggaggagctgaaggccaaggggcgaatcagtaagaagctcacggcacctcagaaagagttatcgcaggtaaaggtcatcgacatgacggggagggaacagaaggtgtattacagttacagtcaaatcagtcataagcataatgtgcccgatgatgggctgccccttcaatctcagcagctccctcagtcggggaaggaagccaaagcaccaggttttgcgctccccgagttggagcacaacctccagctcttgattgatcttactgaacaggagattatccagaatgaccgtcaactgcagtacgaacgggacatggtggtgaacctgttccacgaactcgagaaaatgacagaggtcctggatcatgaggaaagagtgatttctaacctaagtaaagtgctggagatggttgaagagtgcgaacgacgcatgcaacctgattgcagcaatcccctcacacttgatgagtgtgcacgcatctttgaaactttgcaggataaatattatgaggaataccgcatgtccgacagggtggatctggccgtggctattgtgtaccccctcatgaaagagtatttcaaggagtgggaccctctcaaagattgcacctacggcaccgagatcatcagtaaatggaagagtctgctcgaaaatgatcagctgctttctcacggtggccaggacttgtctgccgacgcctttcatagacttatctgggaggtgtggatgcccttcgttagaaatatcgtaacacagtggcagccacgaaattgcgatcctatggtcgactttctggatagctgggtgcacatcattcccgtctggattctggataatatcctggatcaactgatttttccgaagctgcagaaggaagtggaaaattggaaccccctgacagataccgttcccatccactcgtggatccatccctggctgccactgatgcaggcgcgactggagcccctctactccccgattcgaagtaaattatcctctgccttacagaagtggcacccttcagactcatcagcgaagctaattttgcagccgtggaaggatgtgtttacccccggaagctgggaagcttttatggtgaagaacatagtaccgaagctgggtatgtgcctcggagaactcgtgatcaacccccaccaacagcacatggatgccttttactgggtaatcgactgggaggggatgatttcggtgagcagtctcgtggggctcctggagaaacattttttccccaaatggcttcaggtcctgtgctcctggctgagcaattctcctaactacgaggaaatcaccaaatggtacctgggctggaaaagcatgttctcggatcaggttctggctcatcctagtgtcaaagataaatttaatgaggcactggacatcatgaaccgtgccgtgtccagcaacgtcggggcatacatgcaacccggagccagagaaaatattgcctacctgacccacacagaacgtcgcaaagatttccagtacgaggccatgcaggagcgtcgcgaggcggaaaatatggcccagcgcggaatcggggtggccgcatcttcagtccctatgaattttaaagacctgatagagaccaaggcggaggagcacaacatagtgtttatgcccgtgattgggaaacggcatgagggcaagcaactctacacctttggtcggatagttatttatatcgacaggggggtagtgttcgtccagggagagaagacatgggtccccacatccctgcagtctcttatagacatggccaagtag

SEQ ID NO: 245613 - DNA, 267 bp, Artificial Sequence
  Description of Artificial Sequence: Synthetic coding sequence
atgagcctgtcccatctgtatagggacggggaaggaaggattgatgacgatgacgacgagagggaaaactttgagataactgactgggacctgcagaacgaatttaaccccaataggcagaggcactggcagaccaaggaagaagccacttacggtgtgtgggctgagcgagactctgacgatgagcggcctagctttgggggaaagcgggcaagggattattctgccccagtgaatttcatatcagctgggctgaagaagggttag

SEQ ID NO: 245614 - DNA, 261 bp, Artificial Sequence
  Description of Artificial Sequence: Synthetic coding sequence
atgtcgctcagtcacctctatagggacggagaaggcagaatagacgatgacgatgacgaacgagaaaatttcgaaatcaccgactgggatctgcagaatgaattcaacccaaacaggcagcgccattggcagactaaggaagaagccacctacggagtgtgggccgaaagagactccgacgacgaacggccttcatttggcggaaagcgggctagggactacagcgctcccgtcaactttatctctgctggactcaagtag

SEQ ID NO: 245615 - DNA, 129 bp, Artificial Sequence
  Description of Artificial Sequence: Synthetic coding sequence
atgagcctgtcccatctctaccgcgacggtgagggtcggattgacgacgatgacgatgaacgggagaattttgagatcaccgattgggacttgcaaaatgaattcaatcccaacaggcagcggcactag

SEQ ID NO: 245616 - DNA, 1569 bp, Artificial Sequence
  Description of Artificial Sequence: Synthetic coding sequence
atgagcctttcacatctgtacagggatggtgaagggaggatcgatgatgacgacgacgaacgtgagaacttcgagatcacggactgggacctgcagaacgagttcaacttatttcatgaactggaaaaaatgacagaagtcctcgaccatgaggaacgcgtcataagtaatctgagcaaagtgctggaaatggtcgaggaatgcgagcgacgcatgcagcctgactgcagcaacccccttacgcttgatgaatgtgctagaatttttgaaaccctccaagacaagtactatgaggagtaccgcatgagtgatcgggtcgacttggctgtcgccatagtgtaccctctcatgaaagaatattttaaggagtgggaccccctgaaagattgcacctacggaactgagatcatcagcaaatggaaaagcctgttggaaaacgatcagttactgagtcacggagggcaggatctgtcagctgatgctttccacaggctcatctgggaggtttggatgccgttcgtgagaaatatagtcacccagtggcagccacgcaattgcgacccaatggttgattttttagacagctgggtgcatattataccggtctggatactggacaacattctggatcaactgatatttcctaagttacagaaagaggtggaaaattggaacccattgaccgacaccgtgccaattcactcctggattcatccatggctgcccctcatgcaggctaggctggagcctttgtacagtccgatccggagtaaactgagctcggccctgcagaagtggcatccttccgacagctccgcaaagctgatcctgcagccttggaaagatgtattcacccccggatcttgggaagcctttatggttaaaaacattgtaccaaaactcggcatgtgtctcggagaactcgtcattaatccccatcaacagcacatggacgctttctattgggtgatcgactgggagggtatgatcagtgtgtcctctttggtgggacttctagagaagcattttttccctaagtggttacaagtcctctgctcttggctatccaattctcccaactatgaagaaattaccaagtggtacttaggctggaagagcatgttttctgatcaggttctcgcacacccaagtgtcaaagataagttcaatgaggccctagacatcatgaaccgggctgtttctagcaacgtaggtgcttatatgcaacccggtgccagggaaaatatcgcctacctcacccacaccgagaggaggaaggatttccagtatgaagcaatgcaggagcggagggaagcagaaaatatggcacagagaggaattggtgtggccgcaagttctgtgccaatgaactttaaagacctcattgagacaaaggccgaggagcataatatagtcttcatgccagttataggcaagagacacgaaggcaaacagctttatactttcggcagaatcgttatatacattgaccggggagttgtttttgtacagggtgagaaaacctgggtccccacttccttgcagtcactcattgacatggctaaatag

SEQ ID NO: 245617 - DNA, 576 bp, Artificial Sequence
  Description of Artificial Sequence: Synthetic coding sequence
taaggaaggggtctgggcaaaaatgcacagggaattatcaaccccatagaagccaagcaacggaaaggcaagggagcagtaggtgcttacggctctgaacggacaacccagagcatgcaggactttcctgtagtggactccgaggaagaggctgaggagtggctgtttctcgcagcctccgactgcattttactggtgcaggaattccaaaaagagctgtcccagtggcgaaaggatccctcaggaagtaaaaaaaaaccgaaatatagttacaaaactgtggaggaactgaaggctaaaggcaggatatccaagaaattaaccgcaccccaaaaagaattaagccaagtaaaagtgattgatatgaccggcagggaacagaaagtttactactcatactcacagataagccacaagcacaacgtccccgacgatggcctccctctccagtcccagcagctgccccaatccggtaaggaagctaaagcccctggcttcgcactgcctgagctggaacataatctgcaactgcttatcgatctgactgaacaggagatcatccagaacgatcgttag

SEQ ID NO: 245618 - DNA, 366 bp, Artificial Sequence
  Description of Artificial Sequence: Synthetic coding sequence
atgtctctttctcacctttaccgcgacggagaagggcgaatcgacgacgatgacgatgagagggaaaatttcgagatcacagactgggatctgcagaacgagttcaatcccaaccgacaacgccactggcagacgaaggaagaagctacgtatggggtctgggccgagagggattcagacgatgagcggccatctttcggaggcaaaagggctagagattattccgcccctgtgaatttcatctcagctggactcaagaaaggggcagccgaggaggctgagctggaagactcagatgatgaagaaaaacctgtgaaacaggatgacttcccgaaagatttcgggccacgcaagctgaagacctag

SEQ ID NO: 245619 - DNA, 723 bp, Artificial Sequence
  Description of Artificial Sequence: Synthetic coding sequence
atggaagagagcgtagtgcggcctagtgtattcgttgtggacggacaaaccgatattcccttcactcgcttggggagaagtcacaggagacagtcctgcagtgtggctagagtcggcctgggtctgctgctgttgttgatgggagctggcctggctgtccagggctggtttttattacaacttcattggcgcctgggagagatggtgacccgcctgccggacgggccagcgggttcctgggagcagctcattcaggaacgcaggtcacacgaggttaatccggcagctcacttgacgggagctaattccagtctgactggttcaggagggcctctgctttgggagacgcagctgggtctggcttttcttagagggttgagctaccacgacggcgcactagttgtgaccaaggccggatactattatatctactctaaggtgcagctggggggagtgggttgccccctgggacttgcttctacgatcacccatgggctctacaaacggacaccacgctatcccgaggaattggaactattagttagtcagcagagtccttgtggtcgagctaccagttcctcacgcgtgtggtgggactcctcatttctcggtggcgtggttcatctcgaggctggggagaaggtggttgtaagggtactggacgagcgcctagttagactgagggatggcacccgatcatacttcggtgccttcatggtatag

SEQ ID NO: 245620 - DNA, 954 bp, Artificial Sequence
  Description of Artificial Sequence: Synthetic coding sequence
atgagaagggcatcgcgggattacaccaagtacctcagaggctcagaggaaatgggaggagggccaggtgcccctcatgaaggccctttgcacgctccaccacctcccgctccccaccaacctcccgctgcaagtcgcagcatgtttgtggctctcctgggacttgggctgggtcaggtcgtgtgtagcgtggctctgttcttttacttccgcgcacagatggaccccaacaggattagcgaagatggaactcattgcatttatcggatactgcggctccatgagaacgccgatttccaggatactaccctggagagccaggacacgaagctgatccctgatagctgcagaaggataaaacaggcttttcagggcgctgtgcagaaggagttgcagcacatcgtcggctcgcaacacatacgagctgagaaggcgatggtagatggatcctggctggatctagcaaagaggagtaagctagaggcacagccgttcgcccacctgacaattaatgcaacagatataccctctgggtcccacaaggtcagtttaagtagctggtaccacgatcgcggatgggccaaaatttctaacatgacattctctaacggcaaacttatcgtcaaccaggatgggttctattatctctacgccaatatttgctttcgccaccacgaaaccagtggggatctcgccaccgaatacttacagctgatggtgtatgttacaaaaacttcaatcaagatccctagctcccacactctgatgaagggagggtccaccaagtactggtctgggaactcagagttccacttttactctattaacgtgggaggattttttaaacttaggtccggggaagaaatatccatagaagtgtcgaaccccagcttactggaccctgaccaagacgcaacatactttggagcgttcaaagtccgggatatcgattag

SEQ ID NO: 245621 - DNA, 735 bp, Artificial Sequence
  Description of Artificial Sequence: Synthetic coding sequence
atggaccctaacagaatcagcgaggatgggacacattgcatctaccgcatactccgcctccatgagaacgcagacttccaggacacgacactggagagccaggataccaaactgattcccgactcatgcaggagaatcaagcaggcgtttcagggcgctgtgcaaaaagaattacagcatatagtaggcagtcagcatattcgcgcagaaaaagccatggtagacggttcttggctggatttggccaaaagatcaaaacttgaggctcagccttttgcacacctgactattaatgccaccgatatcccaagcgggtctcacaaagtgtccctatctagctggtaccatgataggggctgggccaaaatttccaatatgactttttccaacgggaagctgattgtcaaccaagacggattttattatttatacgccaatatctgtttccgccatcacgaaacctccggggacctcgcaaccgaatacctgcagctgatggtatatgtgaccaagactagcataaaaataccgagctcacataccctgatgaagggagggtccaccaaatactggtctgggaacagtgaattccacttctattccattaacgtcggcggtttcttcaagctgaggagcggcgaagagatatcaatcgaggtatcaaacccctccctgctggaccctgatcaggacgcgacttatttcggagcttttaaggttcgtgacatcgactag

SEQ ID NO: 245622 - DNA, 735 bp, Artificial Sequence
  Description of Artificial Sequence: Synthetic coding sequence
atggatccaaatcgcatctcagaggatgggactcattgtatctataggatcctgaggctccacgagaacgcagatttccaagataccacacttgagtcccaagataccaaactaatccctgactcatgtagacgaatcaagcaagctttccagggcgcagtccagaaggaactccagcacatcgtcggatcacagcatattagagccgagaaggccatggtcgacgggtcttggctggacctggccaaaagatcgaaactggaagctcagccattcgcacacctcaccatcaacgcgaccgatattccctctggtagtcacaaagtttctttaagttcatggtaccacgatcgtggctgggcaaaaatatctaacatgacattctccaacgggaagctgatagtgaaccaggatggcttttactacctgtatgcgaatatctgctttcgacatcatgaaacttcgggagatcttgccaccgagtatctacaactgatggtctacgtgactaagacgtctattaaaatacccagctcacacacccttatgaaggggggttcgaccaagtattggtctgggaacagcgaattccacttctattccattaatgtagggggtttctttaagttgcgcagtggggaggagataagcatcgaagtgtctaacccaagcctcctggacccggatcaagacgcgacttactttggagcctttaaggttagggatattgattag

SEQ ID NO: 245623 - DNA, 735 bp, Artificial Sequence
  Description of Artificial Sequence: Synthetic coding sequence
atggaccccaatcggatcagcgaagacggaacacactgcatctataggatcttacgacttcatgaaaatgctgatttccaggataccaccctggagtcccaagataccaagctcattccagacagctgtcgacgtattaagcaggcatttcaaggagcagttcagaaggagctacagcatatcgtggggtcgcagcacatccgcgcagaaaaggccatggtcgatgggtcctggctggacttagccaagcggagcaaattagaggctcagccctttgctcatctgaccatcaatgccaccgacatcccctccggttctcataaagtgagtctgagttcttggtatcacgacaggggttgggccaagatctccaacatgacattctccaatgggaaactgattgtgaatcaggatggtttttattacctctacgcgaatatctgtttcaggcaccacgaaacatccggggacctggccacagaatacctgcagcttatggtgtatgtgaccaaaacctctatcaagattccttccagccacactctgatgaaaggcggatcaacaaaatattggagcgggaactcggaattccacttttatagcattaatgtcggcggtttttttaaactccgcagtggagaagaaatttctattgaggtctctaatccatctctgctggatcctgatcaggatgccacctactttggtgcctttaaggtccgcgacatagattag

SEQ ID NO: 245624 - DNA, 735 bp, Artificial Sequence
  Description of Artificial Sequence: Synthetic coding sequence
atggacccaaatcgtattagcgaggacgggacccactgtatctatcggatcctgcgactgcatgaaaacgccgactttcaggacacaaccctggaaagtcaggatactaagctgataccagactcctgtcggcgtatcaagcaggcttttcaaggcgcagtgcagaaggagctgcagcacattgtagggtctcagcacataagggccgagaaggccatggtcgacggttcctggctggatcttgcgaaaaggtctaagctggaagctcagcccttcgcacacctgacgatcaatgcaactgatatcccatccggctctcacaaggtgtcattgtcctcgtggtatcatgatcggggttgggccaaaatcagcaacatgacgttctcaaacgggaagctgatcgtaaaccaggacggcttctactacctgtatgctaatatctgctttagacatcacgagaccagcggagacctggccaccgagtatctccaactcatggtgtatgtgactaagacaagcataaaaatcccatctagtcacaccctcatgaaagggggttcaaccaaatattggagcggtaattctgagtttcacttctactccatcaatgtcggcggtttcttcaagttgaggtctggtgaagagattagcatcgaagtgtccaatccatcacttctggaccctgaccaggatgccacctactttggagccttcaaagtaagggacatcgactag

SEQ ID NO: 245625 - DNA, 750 bp, Artificial Sequence
  Description of Artificial Sequence: Synthetic coding sequence
atggcggcaagacgttcgcagagacgcagagggagaaggggcgagcccggaactgcactgctggtgcccttagctctggggctgggcctggcgttagcgtgcttgggcctcctgttggccgtcgtttcgctcgggagtagagcaagtctctcagcccaggagcctgcccaggaagaactggttgcggaagaggatcaggatccgagcgagcttaacccacagacagaagagtctcaggacccggcaccttttctaaatcgcctggtccgccctcggaggtccgctccgaagggacgaaaaacccgtgctcgcagggccattgctgcccactacgaggtgcacccgaggccgggacaagacggggcacaggcgggagtggatggcactgtatccggctgggaagaagctcgaattaactccagttctcctctgcggtacaataggcaaatcggggagttcatcgtcactagggccggtctgtactacctctactgccaggtgcattttgacgagggcaaagctgtgtatttgaaacttgacctgctcgtcgacggggtgctggcactgcgctgcctcgaggagttttctgcaaccgcggctagctcactgggaccacagttaaggctgtgccaagtctcagggttattggcacttcgtcctggatcaagcctacgcatacggactctgccctgggcgcatctgaaagcagcaccattcctcacttattttgggttgttccaggtgcactag

SEQ ID NO: 245626 - DNA, 993 bp, Artificial Sequence
  Description of Artificial Sequence: Synthetic coding sequence
atggctgcacgccgaagccaaaggcggagggggagaaggggggaaccgggtacagccctgctggtgcctctggccttgggcctgggtttggcattggcatgcctcggactcctgctggctgtggtcagtctgggcagcagggcaagcctgtcggcacaggagccggctcaagaggaactcgttgcggaggaagaccaggacccctccgagcttaacccacaaaccgaggaatcccaggatcccgctcctttcctgaaccgcttggtgcggcctcggagaagcgccccaaaggggagaaaaacaagggccagacgcgcaatcgccgcacattacgaagttcaccctcgccctggacaggacggagcgcaggccggagtggacggtaccgtttcaggttgggaagaggctagaatcaacagttctagtccactgcgttacaatagacagattggagagttcatcgtcacacgtgcagggttatactacctgtactgtcagagctccgatgcactggaggcttgggagaacggtgaaaggtctcggaaaaggagagccgtattaacccaaaagcagaaaaaacagcacagtgtgctgcatctcgttccaatcaacgctacgtctaaagatgacagcgacgtgaccgaggtaatgtggcagccggcactccggagagggagggggctgcaggctcaggggtacggagtgcgaatccaggacgctggggtgtacctactgtactcccaagtcctttttcaggacgtgacatttaccatgggccaggtcgtgtctagagagggccaaggtagacaagagacactgtttaggtgcatccgatcgatgccttcccacccagatcgggcatacaattcgtgctactccgcaggtgtttttcatctgcatcaaggggatatcctttctgtgattatccctcgtgctagggccaaacttaatcttagccctcatggcacgtttttgggctttgtgaaactgtag

SEQ ID NO: 245627 - DNA, 723 bp, Artificial Sequence
  Description of Artificial Sequence: Synthetic coding sequence
atggaagaaagcgtggttcggcctagcgtttttgtggtcgatggtcagaccgatattcccttcaccagactgggccgaagccatcgacgccaatcctgctccgttgcaagggtcggattgggcctgctactcttactgatgggcgctggtctcgctgttcagggatggttccttttgcagctccattggcgtctaggggaaatggtcacccggctgcctgacggacccgctggctcctgggaacaactgattcaggagaggcgaagccacgaggtgaacccggcagctcacctgaccggggctaattctagtctgacaggtagcgggggacctctcctgtgggagacacagctgggtctcgcttttcttagggggctaagttaccatgacggggcactcgttgttacaaaggccggatactattacatttactccaaagtgcagttgggaggagtagggtgtccacttggattagcgagtactatcacacatggtttgtacaaaagaacccccaggtaccccgaggagcttgagctactcgttagtcaacagtcgccttgtggaagggctacaagttcatccagagtgtggtgggatagtagttttctgggaggcgtggtgcatttagaggctggcgagaaggtcgttgtccgggtcctggacgaacgcttggtgaggctacgcgatgggacccgctcctacttcggagcattcatggtgtag

SEQ ID NO: 245628 - DNA, 615 bp, Artificial Sequence
  Description of Artificial Sequence: Synthetic coding sequence
atggaggagtctgtggtgcgcccatctgtattcgtagttgacggccaaacagacatcccttttacgagactcgggcgttctcacaggcggcagagttgttccgttgcaagggacggaccggcaggttcttgggagcagctgatccaggaaagaagatctcacgaggtgaatccggctgcacatctgaccggtgccaacagctccctgacagggagtggtggccctctactctgggaaacacagctcggtctggcttttctcagaggattgagctatcatgacggagccttagttgtgactaaggccggatattactatatttattccaaagtgcagcttggtggcgttggctgtcccctggggctggcaagtaccatcactcacggattgtataagcggacccctcgctaccccgaagagctagagcttcttgtctcccaacagtctccatgcggacgggctactagtagcagccgagtctggtgggactcgtcattcctaggaggcgttgtacatctggaagccggagagaaggtggtggttcgggtgctggatgagaggctcgtgagactccgcgatgggactcgttcgtactttggcgcattcatggtgtag

SEQ ID NO: 245629 - DNA, 525 bp, Artificial Sequence
  Description of Artificial Sequence: Synthetic coding sequence
atgcgacattttctcagtaaagtctattccttcccgatgcgcaaacttatcctgtttttggtgttccctgtcgttagacaaacgccaactcagcacttcaaaaaccagttccctgccctgcattgggaacacgagctgggactggcctttacaaagaacagaatgaactatactaataagtttttgttgatacccgaatctggggattacttcatctacagccaggtgaccttccggggaatgactagtgagtgttccgaaattagacaggccggtaggccaaataagcctgattcgatcacagttgtaataacaaaggtcaccgacagctaccctgagcccacccagttactaatggggacaaaatctgtgtgcgaagttggatcgaattggttccagccaatttacctcggagctatgttttccctgcaggaaggggataaactgatggtgaacgtgtccgatatctcccttgtcgattacacaaaagaagataagactttctttggggcttttctgctttag

SEQ ID NO: 245630 - DNA, 756 bp, Artificial Sequence
  Description of Artificial Sequence: Synthetic coding sequence
atggccgaagatttgggtctgtccttcggcgaaacagctagtgtggagatgcttcccgaacacgggtcctgcagacctaaagcaaggtccagctcggccagatgggctttgacctgctgtttggtcctcctcccctttcttgccggtctgacgacatatctgttggtgagtcaactgagggcgcagggtgaggcttgcgtgcagtttcaagccttaaaagggcaggaatttgccccttcacatcagcaagtctacgcgccattgagggccgacggcgacaagccgagagctcaccttacggttgtgcgccagacacccacacagcatttcaaaaaccagtttcccgcattgcactgggagcatgagctcggcctggcctttacaaaaaacagaatgaattacaccaacaagtttcttcttatccccgaaagcggcgattacttcatttattcccaagtgacgttccggggaatgacctcggagtgcagcgagatccgacaggcaggcaggcctaacaaaccagatagcatcacagtggttataaccaaagtcaccgactcatacccggaaccgacacaactcctgatgggtacaaaaagtgtttgcgaggttgggtccaattggtttcagcccatttacctgggagctatgttctctttgcaggagggcgacaagttaatggtcaatgtttctgatatttcacttgttgactatacaaaggaggacaaaacgttcttcggggctttcctgctgtag

SEQ ID NO: 245631 - DNA, 534 bp, Artificial Sequence
  Description of Artificial Sequence: Synthetic coding sequence
atgtgtctgtctcatctagagaatatgccgctgagccatagccgaacgcagggcgcacagcgctccagttggaagctgtggttgttttgttcaatcgtcatgctgctgttcctatgttcttttagctggctcattttcatctttttgcaactcgagactgcaaaggagccatgtatggccaaatttgggccactaccatcaaagtggcagatggccagcagcgaaccgccttgcgtcaacaaagtcagtgactggaagctagagatcctgcagaacggactgtaccttatttatggtcaggtggcacccaacgccaactacaacgatgtggctccttttgaggtccgtctctataagaataaggacatgatccagacactaacaaataaatctaagatccaaaatgtcggcggaacatatgaattgcatgtgggagatactattgatctgattttcaatagtgaacatcaggtacttaagaataacacttattggggcataatcttgcttgccaacccccagtttatttcctag

SEQ ID NO: 245632 - DNA, 600 bp, Artificial Sequence
  Description of Artificial Sequence: Synthetic coding sequence
atgaccctccacccttctcctatcacctgcgagttcctgtttagcactgccctcatatctccaaagatgtgcttgagccatctagagaacatgccactgtcacactctagaactcagggcgcacagagatcatcctggaaactgtggctgttttgtagcattgtgatgctgctctttctgtgttctttttcatggctcatcttcatcttcctgcaactcgagacagccaaagagccatgcatggcaaagttcgggccattgccctcgaagtggcagatggcatccagcgaacctccctgcgtgaacaaggtgagtgactggaagcttgaaatcctccaaaacggtctctacttgatatacggacaagtagccccaaacgcaaactacaatgacgttgccccattcgaagtgaggttgtacaagaacaaggatatgatccagactttgaccaataaatcaaagatccagaatgttggcggtacatacgagctgcacgtgggagataccatcgatctgatattcaactcggagcatcaagttctcaaaaacaatacatattggggaatcattcttctggccaatcctcaatttattagctag

SEQ ID NO: 245633 - DNA, 552 bp, Artificial Sequence
  Description of Artificial Sequence: Synthetic coding sequence
atggagcgggtccagcccctcgaggagaacgttggtaatgccgcacgtcccaggtttgaacgcaacaagctgctgttggtggccagcgtcattcaggggctgggtttgttgctgtgcttcacttacatctgtctgcattttagtgcactccaggtgtcccaccgctacccccgtatccaatccattaaagtccaatttaccgaatacaaaaaagagaagggtttcattcttacctcccagaaggaggatgaaattatgaaggtgcagaacaattctgttatcatcaactgtgacggattctatctgatttcactgaagggatacttttcccaggaggtgaacatcagtctgcattatcagaaggacgaagaaccgctttttcaactgaagaaggttaggagtgtgaactccttaatggtagccagcctgacatataaggacaaggtatatctgaacgtcaccactgataacacctctttagacgattttcatgtaaatgggggagaattgatactcattcaccagaatccgggtgagttttgtgttctgtag

SEQ ID NO: 245634 - DNA, 402 bp, Artificial Sequence
  Description of Artificial Sequence: Synthetic coding sequence
atggtctcacaccggtacccccgtatccagagtattaaggtgcaattcacggagtataaaaaagaaaagggattcattctgacgtctcagaaggaagatgagatcatgaaggtccagaacaattctgtgatcattaattgcgatggattttatctgatttcacttaaaggatatttttcccaggaggttaatatcagtttgcactatcagaaagacgaggagccattattccagctgaagaaggtgagatcagtgaatagcctgatggttgcgtcactgacgtataaagacaaagtttatctaaacgttaccactgataatacatcccttgatgattttcatgtgaacgggggtgaactgatccttatacaccagaaccccggagagttctgtgtgttgtag

SEQ ID NO: 245635 - DNA, 402 bp, Artificial Sequence
  Description of Artificial Sequence: Synthetic coding sequence
atggtatcccatagatacccacgtattcaaagcattaaggtgcagttcacagagtacaaaaaggagaagggtttcatactgacgtcacagaaggaggacgagataatgaaggtgcagaataatagtgtgatcatcaattgtgatggattctatttgatcagcctcaaaggttatttctcacaggaagtcaacatttccctgcactaccagaaggacgaagagcctttgtttcagctgaagaaggtgcgctcagtgaacagtttgatggtagcctccctaacttataaagataaagtttatctgaacgtgacaaccgataacacatccctggacgactttcacgtcaatggaggtgagttaatcctgatccatcagaatcccggagaattctgcgttctttag

SEQ ID NO: 245636 - DNA, 765 bp, Artificial Sequence
  Description of Artificial Sequence: Synthetic coding sequence
atggaatatgcatcagacgccagtctggatcctgaggcaccctggccaccagccccaagggctagagcttgcagagtgctgccttgggcccttgtcgctggcctcctgctgctgctattactggcggctgcttgtgctgtcttcctggcatgcccatgggcagtctccggggcaagagcctccccaggatctgctgccagccctcgcttgagggaagggccagagctttcgcctgatgaccctgccggtctgttggatcttcgccaggggatgttcgcacagcttgtggcccagaacgtgctcttgatcgacggacctctgagttggtatagcgaccccggtctggctggagtgagcctcacagggggtctgtcttacaaagaggacactaaggaacttgtagtagctaaggctggcgtatattacgtgttctttcagttggagctgcggagagtcgtggcaggagaaggctccggtagcgtatccctggccctacatctccaaccacttcggtcagcagccggagcagctgctttggctctgactgtggacttgccgcctgcctcaagtgaggcccgaaacagtgccttcggctttcaggggaggctgctacacttaagcgcaggccagcggctgggggtccacctgcataccgaagcgcgagcacgacatgcctggcagcttactcagggggcaaccgtgctgggcctctttcgcgtgacccctgagatcccggcaggactgccaagccctagatccgagtag

SEQ ID NO: 245637 - DNA, 1851 bp, Artificial Sequence
  Description of Artificial Sequence: Synthetic coding sequence
atggcccctagagctcgtcgtcggagaccactctttgcactgcttctcctgtgtgcgttacttgctagattgcaggtcgccctccagatagctcctccctgtactagcgagaaacactacgagcatctgggcaggtgttgtaacaaatgtgagcccggaaaatatatgagttccaaatgcactacgacctcagatagtgtgtgtctcccatgtgggccagatgaataccttgactcatggaatgaggaggataagtgtctcttgcacaaagtttgtgacactggaaaagcacttgtcgccgttgtggccggaaacagcacaactccacgtagatgtgcttgcacagcaggataccactggagccaggattgcgagtgctgccgcagaaacacagagtgcgctcccggtctgggggctcagcaccctctacagctaaacaaagatactgtgtgcaaaccatgtctcgctgggtactttagcgatgctttctcctcgacagataagtgcagaccctggacaaactgcacgtttctgggaaagagagtagaacatcatggcaccgaaaaatctgacgctgtgtgttcttccagcttaccggctcgcaagcctcctaacgagccccacgtgtacttgcccggactgattatcctcctgctgttcgcgtctgtagccctggtcgcagccattattttcggcgtgtgctataggaaaaaaggcaaggctctgaccgccaatctgtggcactggatcaacgaggcatgtggacgcttgagcggcgataaggagtcgtccggcgactcctgtgttagcacacataccgccaatttcggccaacagggcgcatgcgagggggtgttactcctgaccctcgaagagaagaccttccccgaggatatgtgttatccagatcagggcggagtgtgccaggggacttgcgtgggcggtgggccttatgcacagggggaagacgctcgtatgttaagtctggtaagcaagacagagatcgaagaagactctttccgtcagatgcccaccgaggacgagtatatggaccgtccatcacaacccacagatcaactgctttttcttaccgagccgggatcgaagtccaccccccctttcagcgagccccttgaggtgggcgaaaacgactctctatcccagtgttttacgggaactcagtcgaccgttggcagcgagtcttgcaactgcaccgaaccactctgcagaacagattggaccccaatgtcttcagagaattatctgcagaaagaagtcgattctggacattgccctcattgggccgcatcccccagccccaattgggccgatgtgtgtactggatgtcgaaacccaccaggcgaagattgtgagcctttggtggggtccccaaaacgtgggccactcccccagtgtgcttacggcatggggttgccacctgaggaggaggcctcacgtacggaagcacgcgatcagccggaagatggtgccgatggcagactcccgagctcagctagggccggtgcaggatcgggctccagcccgggtggtcaaagcccagcctccgggaatgtcacggggaactccaactccaccttcattagttcaggtcaggtcatgaattttaagggagacatcatcgtggtctatgtaagtcaaacatcacaagagggtgccgcagcggctgcggagcctatgggccgtcctgtgcaagaggagaccctcgctcggagggatagcttcgctggcaatggcccaagattccccgatccctgcgggggtcctgaaggactgagggaaccagaaaaggcaagcaggccggtacaggagcagggcggtgccaaggcatag

SEQ ID NO: 245638 - DNA, 780 bp, Artificial Sequence
  Description of Artificial Sequence: Synthetic coding sequence
atggcgaggataccgaaaacgttgaaattcgtggtggtgattgtagccgtcttgctgccagtcttagcctactctgcgacaaccgcaaggcaggaagaggttcctcagcaaactgttgccccacaacagcagcgacacagctttaagggcgaagaatgccctgcaggctcacacaggtctgagcacaccggcgcatgcaatccatgtactgaaggcgtagattatacaaatgcatctaataatgaaccatcctgctttccatgcacagtgtgtaagtccgatcagaagcacaagtccagctgcactatgaccagggacacagtttgtcagtgtaaagagggaacttttcgtaacgagaactcacccgaaatgtgccggaaatgttctcggtgcccctccggagaggttcaggtgagcaactgcacaagctgggatgacatccaatgcgtggaggagttcggggctaatgccaccgtggagaccccagcagctgaggaaactatgaacacttctcccggaacccccgctccagccgcagaggaaactatgaacacttcccccggtacaccagcccctgcagccgaggagacaatgactacaagccccggaacccccgcacctgcagcagaggaaacaatgacgactagccctgggacaccggcacccgcagccgaagaaactatgatcacctccccgggaacgccagcctcgagccactatctgtcatgcaccattgtgggtatcattgtgttgattgtcttacttatagtgttcgtgtag

SEQ ID NO: 245639 - DNA, 474 bp, Artificial Sequence
  Description of Artificial Sequence: Synthetic coding sequence
atgactcgagataccgtgtgccagtgtaaggaaggtaccttcagaaatgaaaatagccctgagatgtgccgtaaatgcagccggtgtccctcaggcgaagtgcaggtgagtaattgtacatcctgggatgacatacagtgtgtggaagaattcggtgccaacgcgaccgtcgaaacccccgcagctgaggagaccatgaacacaagcccaggtactccagctcccgcagccgaggaaactatgaacacctcccctggaactcctgcccctgcagccgaagaaacaatgacaacttctcccggtactccagctcccgcagcagaggagacaatgactacttccccgggaacacccgctcctgccgctgaggagactatgatcacaagcccgggtacccctgcttccagccattatctttcctgtaccatagttggtatcatcgtactgatcgtcctgctgattgtgtttgtctag

SEQ ID NO: 245640 - DNA, 834 bp, Artificial Sequence
  Description of Artificial Sequence: Synthetic coding sequence
atggccaggatccctaagacgttaaagttcgtcgtcgtgattgtggccgtcctgctcccagtcctggcatatagcgcaacaaccgccagacaggaagaggtgccccaacagactgttgcacctcagcagcagaggcacagcttcaagggggaagaatgccctgctggatctcatcgaagcgaacataccggagcgtgtaacccctgcactgagggggtggattataccaatgcttcaaataacgagccatcatgcttcccttgtaccgtctgcaagtcagatcagaaacacaaatctagctgcacaatgaccagggatacggtgtgccaatgtaaagagggcacttttcgcaatgaaaatagtcccgagatgtgcagaaaatgttccaggtgtccttctggtgaagtgcaggtgagtaactgcacctcctgggatgacattcaatgtgtcgaagagttcggagccaatgctaccgtggagacccctgccgctgaagagaccatgaatacctcccccggaacacccgctccagcggcagaagaaactatgaacacctctccaggaactcccgctcccgcagcggaggagaccatgacgacatccccagggaccccagcacccgcagctgaggaaacaatgaccacaagccccggtaccccagcgcctgctgcagaggaaacaatgatcacaagccccggaacaccagcttcttcccattacctcagttgcaccattgtgggcattattgtgctcatcgtgctgctcatcgtgccgtatctgaagaagaaaaaaaagaaaaaactgaagaagaaacagaagaggaaaagcaagtag

SEQ ID NO: 245641 - DNA, 1851 bp, Artificial Sequence
  Description of Artificial Sequence: Synthetic coding sequence
atggccccacgggctcggaggcgaaggcctctgttcgcccttctgctactttgtgctcttttagccaggttacaggtggccctgcagatcgctcccccttgtaccagcgagaagcattacgaacacctgggacgctgctgcaataagtgtgaaccagggaagtacatgtctagcaaatgcacgacaacgtctgatagtgtgtgtttgccctgtggaccagatgaatatctcgacagttggaatgaagaggacaaatgtctgctacacaaggtgtgtgacacgggcaaggcccttgttgctgtcgtggctggcaactcaactacccccagacggtgtgcctgtacggccggataccattggagccaggactgcgagtgttgcaggcggaatacagagtgtgccccaggcctgggagcccagcatccccttcagctgaataaggacacagtgtgtaagccatgtttagccggatacttttccgacgcattcagcagtacagacaagtgtagaccatggaccaattgtacttttctgggcaaaagagtcgagcatcacggtacagagaaaagcgacgccgtgtgttcctcctcactgccagccagaaagccaccgaacgaacctcacgtgtatcttcctggcctaatcatattactgctgtttgcgtctgtggccctggtggctgcaattatctttggcgtgtgctatcgtaagaaagggaaggctttaactgctaatctgtggcattggattaacgaagcatgcgggaggctatccggggataaagagtcatctggcgattcctgtgtgtccacccacaccgccaatttcggacagcaaggtgcctgcgagggcgtgctgctcctcaccctagaggaaaaaacctttccagaagacatgtgttatcctgaccaaggcggtgtgtgtcagggaacttgcgtgggcggagggccatatgcgcaaggagaagacgcgcgtatgctatcacttgtgagcaaaacagaaatagaagaggacagttttaggcaaatgcctacggaggatgagtacatggacaggcctagccaaccgaccgaccagctactgttcctcacggagccgggttccaagagcaccccaccattctcagagcccctggaggtcggagagaatgactctctgtcgcaatgttttaccggaacgcagtcaacggtcgggtcagagagttgcaactgtactgagccactctgcaggaccgactggaccccaatgtcaagcgagaattatctccagaaggaggtggactccgggcactgtccccactgggctgcatctccgagcccaaattgggcggatgtttgtacggggtgccgaaatcctccaggggaggattgtgagcccttggtgggctcccctaaaagaggaccgttgccacaatgcgcctatgggatgggacttcccccagaagaggaagcctctagaaccgaagcgagggaccagccggaggacggcgctgatggcagactgccgtccagcgccagagctggcgcaggcagtggatccagcccaggtgggcagagtcccgcttctgggaacgtgactggaaatagcaacagcactttcatttcatccggtcaggttatgaactttaaaggagatatcatcgttgtgtacgtttcccagacatctcaggagggtgcggctgcagctgctgaacccatggggagacccgtacaggaagaaactttggccagacgcgattccttcgcgggaaatggccctcgcttcccagacccctgcggcggacccgagggactgagagagccagagaaagcctctaggcctgtgcaggagcagggaggtgcgaaagcatag

SEQ ID NO: 245642 - DNA, 966 bp, Artificial Sequence
  Description of Artificial Sequence: Synthetic coding sequence
gggagcagggctcgctgggcaaccgaggccgcagaggctgctgcacccgcatctctgagtagggcgatggcgccacgggcaagaagacggaggccactgtttgccctgctgttgttgtgtgcactcttagccaggttacaggttgcccttcagatcgcgcctccttgcacatctgaaaagcattacgagcatctagggaggtgttgtaacaagtgcgagccgggaaaatatatgtcatcaaagtgtactactacttctgattcagtttgcttaccttgcggcccagacgagtatctggattcctggaatgaggaagataagtgtctgctgcacaaggtgtgcgacaccgggaaggcacttgtggctgtggttgccggaaatagcaccacccccaggcgctgtgcctgcaccgccggttatcactggagtcaggactgtgaatgctgcaggcgaaacaccgagtgtgcccctggattgggagctcagcatccactccagttgaataaagacactgtatgcaagccctgcctcgctggatatttttcggatgccttctcctccacggacaagtgccgaccttggactaattgtacattccttgggaaacgagttgaacatcatggaacagagaaatcggacgcagtatgctcttcatcgttgcctgcgaggaaacctcccaacggcaacgtgaccggtaactcaaactcgaccttcatttccagcggccaggtcatgaacttcaaaggtgatatcatagtggtctacgtctcccagacatcccaagaaggcgctgcagccgctgcagaaccaatgggacgccctgtgcaggaggagacgctcgccagacgcgactccttcgcgggaaacggaccacggttcccggatccatgtggcggtcctgaaggactgagagaacccgagaaggcctctagacctgtccaagaacagggcggtgccaaagcttag

SEQ ID NO: 245643 - DNA, 1206 bp, Artificial Sequence
  Description of Artificial Sequence: Synthetic coding sequence
atgaataacctgctctgctgcgccctagtattccttgacatctccattaaatggaccacacaagagacgtttcctcctaaatacctgcattacgacgaagagaccagccaccagctgctttgtgataagtgcccgcctgggacgtacctgaaacagcactgcactgccaagtggaagaccgtgtgcgcaccgtgcccggaccattattatactgacagctggcacacctcagacgagtgtctctattgcagccctgtgtgcaaagagctgcagtacgtgaagcaggaatgcaatcggacccataatcgagtgtgcgagtgtaaagagggccgttatttggaaatcgagttttgtctcaagcatagatcctgcccaccaggcttcggagtcgttcaagctgggaccccagagcgaaatactgtttgcaaacggtgtcctgacgggtttttctccaatgagacaagcagcaaggctccttgccgcaagcataccaattgctccgtcttcggtttattacttacccaaaaaggcaatgccacccacgataacatctgcagcggcaactccgagtccacccagaaatgtggaatagacgtgactctttgcgaggaggcatttttcagatttgccgtgccaaccaaattcacccctaactggctatctgttctcgtggataatctccctggaaccaaggtgaatgccgagagcgtcgaacgcataaaacggcagcatagtagtcaggaacagacattccagctccttaaactttggaagcaccagaataaggaccaggacattgtcaagaagattatacaggatatcgatttgtgcgaaaatagcgtgcaaaggcatattggccacgccaatcttacctttgagcagctgcgcagcctgatggagagcctccctggtaagaaagtcggggctgaggatattgagaagactataaaggcctgtaagccgagcgaccagattttgaagctgctttccttgtggcggatcaagaacggagaccaggatacactgaaaggcctgatgcacgcactaaagcactcgaagacttaccacttccccaagacggtgactcaatcacttaaaaaaactatccgctttctccattcctttaccatgtataagttataccaaaagttgtttctcgaaatgatcggcaatcaggttcagtctgtaaagatctcatgtctctag

SEQ ID NO: 245644 - DNA, 390 bp, Artificial Sequence
  Description of Artificial Sequence: Synthetic coding sequence
atggctagaggctccctcaggcgactgctccgactcctcgtcctgggactttggctggcactgctgcggtcagtcgctggagagcaggcccctggcaccgctccatgctccaggggttcttcctggtctgccgacctggacaaatgcatggactgcgcctcctgtagagctaggcctcattcagacttctgcctcggctgcgcggcagctcccccagccccttttcggctgctatggccgatcctcggtggtgccctttctttgacatttgtgctgggtcttctctccggttttctggtgtggcgcaggtgccgcaggagagagaagttcactacacctatcgaagagacgggcggagaaggctgccccgctgtcgcactgatccaatag

SEQ ID NO: 245645 - DNA, 285 bp, Artificial Sequence
  Description of Artificial Sequence: Synthetic coding sequence
atggcgagaggttctctcagacggctcctgcgtttacttgtgctcggcctatggcttgcattgttgaggtcggtggccggagaacaggcaccaggtgcagcggctcctcccgcaccctttcgacttctctggcctatcctggggggtgctctgagtctgacctttgtcctgggcctgttgagcgggtttctggtgtggagaaggtgtcgtagacgcgaaaaatttaccacacctattgaggagacaggcggagaggggtgccccgctgtggcactcatccagtag

SEQ ID NO: 245646 - DNA, 882 bp, Artificial Sequence
  Description of Artificial Sequence: Synthetic coding sequence
atgagcggattaggaaggagcagacgcggaggcaggtcaagggtcgatcaagaggagcgcttccctcagggcctgtggacgggggttgcaatgaggtcatgccctgaagaacagtattgggatccccttcttggtacatgcatgtcctgtaagacaatatgcaaccaccagtcccagagaacctgtgccgctttctgcaggagtctgagctgtcgaaaggagcaaggcaagttctatgaccatctgctgcgggactgcatcagttgtgcttcaatctgcggccaacacccaaagcaatgcgcatacttttgtgagaacaaattaaggtcgcccgtgaatctgccgccagagttaaggcggcagcgaagcggggaggttgaaaacaattccgacaacagtggacgctaccaaggactggagcacagggggtctgaggcctctcccgctttgccgggactcaagctgtctgctgaccaagtggctctggtatacagtactctaggcttgtgtctgtgtgccgtcctatgctgtttccttgtggccgtagcttgcttcctgaaaaagcgcggtgatccatgttcatgccaacccaggtcccgacccaggcaaagtcctgctaagagttcccaggatcacgctatggaagcaggatctcctgtatccacaagcccagaaccagtggagacttgtagcttctgtttccccgaatgtcgggctccaacgcaggagtcagccgtcacgccaggtacgccagatccaacgtgtgctggaaggtggggctgccacactcgaactaccgtgctgcagccatgtcctcatattcctgacagcggcctgggcatagtttgtgtaccagctcaagagggcggtccgggagcatag

SEQ ID NO: 245647 - DNA, 747 bp, Artificial Sequence
  Description of Artificial Sequence: Synthetic coding sequence
atgtccggactgggcagatcaagacgcggaggcagaagtcgggtggaccaggaagagaggtggagtctctcgtgcaggaaggagcaaggaaagttttacgatcacctgctacgcgattgcatatcctgtgctagcatttgcggacaacacccaaagcagtgcgcctacttttgcgagaacaagctgagatcaccagttaacctgccgcctgaactgcgcagacagcggagtggcgaggtcgaaaataattcagacaacagtggacgctaccaaggtttagaacatcgcggtagcgaggcgtctcctgctctcccgggtctcaagttatccgccgaccaggtggccttggtgtactcaacacttggactatgtctgtgtgctgtgctctgctgttttttggtggctgtagcgtgcttccttaagaagcggggagacccttgtagctgccagccaaggtctcggcctcgccagtccccagccaagagttcacaggaccatgccatggaggctggaagcccagtctctactagtcctgagccagtggaaacatgctccttctgttttcccgagtgccgtgcgccaacgcaggagagcgccgtgaccccagggacaccagaccctacctgcgctggacgaaagactaaacctccaccagttctgaccgccggaaactgtggggtgcaccgacctccaccggagacttccacgggctcacctcgcggtcagcgcctgctatggactcagtag

SEQ ID NO: 245648 - DNA, 555 bp, Artificial Sequence
  Description of Artificial Sequence: Synthetic coding sequence
atgcggcgaggcccacgatcattgaggggaagggatgctccggcaccaaccccctgcgtccccgcagagtgtttcgacctattggtgcgacactgtgtcgcctgcggccttttgaggacccctcgcccaaaaccagcaggggcttccagtcccgcacctaggactgccctgcagccacaggagagtgtgggagcgggagccggtgaagccgcactgcccctgcccggtttgctgtttggcgcacccgctttgctcggattggcattggtgctggccctcgtgctggtgggcttagtatcatggcgtaggcggcagcggaggctccgaggggcttcttcagcggaggccccagacggcgataaagatgcaccagaaccattggataaggtgattattcttagcccgggtattagcgatgccactgcacccgcatggccaccacccggagaagacccaggtacgacacctcccggacactctgtccctgtgcccgcaacggagctggggagcacagagctagtgaccaccaagaccgcaggcccagaacagcagtag

SEQ ID NO: 245649 - DNA, 852 bp, Artificial Sequence
  Description of Artificial Sequence: Synthetic coding sequence
atggagcctcctggggattggggccctccaccatggcgtagtacccccaaaaccgacgtgctgcggctggtgttgtacctaacatttctgggcgcaccctgctatgccccagccctcccttcatgcaaagaagatgaataccccgtgggatctgaatgttgcccaaaatgctctcccggatatcgggtgaaagaggcttgtggagagttgacgggaaccgtgtgcgagccatgccccccaggcacatatatcgcacatttgaatggtctgtccaagtgccttcaatgtcagatgtgcgatcccgctatgggcctgagagcgagtagaaattgctcccgaacagagaatgcggtatgtggctgtagtcctggtcatttctgtatcgttcaggacggggatcactgcgcagcatgtagagcttacgccacttcttccccagggcagagggtccagaagggaggcacagaaagccaggatacgctgtgccagaattgtcccccaggcactttctctcctaatggcacattggaggagtgccagcaccagacaaagtgctcttggctcgtcacaaaagctggagccggaacatcctcaagccattgggtttggtggttcttaagtgggtcactagtgatcgtgattgtgtgtagcacagtagggctgatcatctgtgtgaagaggaggaagccccgtggagatgtagttaaggtaatcgtgtcggtccagcggaaacgtcaggaggccgagggggaggctactgtcatagaagcgttgcaggcacctcccgatgtgacaacggtggccgtggaggagacaatcccctcatttactggtagaagccccaatcattag

SEQ ID NO: 245650 - DNA, 522 bp, Artificial Sequence
  Description of Artificial Sequence: Synthetic coding sequence
atggagccacctggggactggggaccccctccttggagaagtactccaaagacggatgttctgaggctcgtgctatacctaacattcctgggagccccttgttacgcccctgctctgccgagctgcaaggaggacgagtatcccgtaggttccgagtgctgccccaaatgcagtcccggttatagagtgaaggaggcctgcggcgagctgactggcactgtgtgcgaaccttgtcctccgggtacttatatcgctcacctgaacggactgtctaagtgccttcagtgtcaaatgtgcgaccccgacatcgggtcaccctgtgatctgcggggaaggggccacctggaggccggtgcccacttatcccccggacgccagaaaggtgagccggatcccgaagtggctttcgaatcactcagcgctgagcctcacgcccgactgagtatggctagcgcaccttgtggacaagctggcttacatcttcgggaccgcgcagatggaaccccagggggtagagcttag

SEQ ID NO: 245651 - DNA, 552 bp, Artificial Sequence
  Description of Artificial Sequence: Synthetic coding sequence
atggaaccgcctggagattggggtccaccaccatggagatcaacacccaagactgacgttctgcgtctggtgttgtacctcaccttcttaggcgctccttgctatgcgccagccttaccgagttgtaaggaggatgagtatccggtgggatctgaatgctgtcccaaatgttccccaggttatcgcgtaaaggaggcctgtggagagctcactgggacagtctgtgagccgtgtccgcctggaacttacattgcccatcttaacgggttgtcaaaatgtctgcagtgtcagatgtgcgatcccgctatgggcctaagggctagtcggaactgcagtagaactgagaatgccgtgtgtggctgcagtcctgggcatttctgcatcgttcaagacggcgaccactgtgccgcatgccgagcgtatgccacaagcagcccaggacagcgggttcagaaggggggtacggagtcccaggacacactctgccagaattgtccacctgggacgttcagccccaatggaaccctggaggagtgtcagcaccagacatag

SEQ ID NO: 245652 - DNA, 696 bp, Artificial Sequence
  Description of Artificial Sequence: Synthetic coding sequence
atggagccgccaggggattggggcccacctccatggcgctcaacccccaaaaccgatgttttaagactcgtattgtatctgaccttcttgggggctccatgttacgcgcctgcccttccgtcatgcaaagaagacgagtaccccgtgggttccgagtgctgccctaagtgttctcccggatatcgcgtgaaagaggcctgcggggagctaactgggactgtctgcgagccctgtcctccgggaacctacattgctcacctgaacgggctgtccaagtgcttgcagtgccagatgtgtgatcccgctatggggctgcgggcttcacggaattgttctcgcacggagaatgctgtttgtggttgcagccccggacacttttgcatcgtgcaggatggggaccactgcgcagcgtgcagggcttatgcaactagttcgcccggtcagcgggtccagaaaggagggacagaatcacaagatacgttatgtcagaattgtccgccaggaacatttagtcctaacggcaccctggaagagtgtcagcaccaaactaagtgttcctggctggtgaccaaagctggtgctggcacaagctcatctcactgggtttggtggttcctgagtggcagcctggtgattgttattgtttgtagcacagtagggctcatcatatgtgttaaaaggagaaagcctcgttag

SEQ ID NO: 245653 - DNA, 696 bp, Artificial Sequence
  Description of Artificial Sequence: Synthetic coding sequence
atggaaccacctggcgactggggcccacccccttggaggagcacccccaaaactgacgttctgcggctcgtgctgtatctgacattccttggagctccatgctacgcgcctgccctcccctcctgcaaggaggacgaataccccgtggggagtgaatgctgtcctaagtgctcacctggctaccgcgtgaaggaggcctgtggagaactgaccggtacagtgtgcgaaccttgtccgccaggaacttatatcgcccacctaaatggtttgtcgaagtgcctgcagtgtcagatgtgtgaccccgctatggggctaagagcctcacgtaattgcagtagaaccgagaacgctgtctgcggatgcagccccggacacttttgcatagtgcaggatggggatcactgtgccgcttgtcgggcttacgctactagcagtcccggtcaacgggttcaaaaaggagggactgagtcgcaggataccctgtgccagaactgtcccccaggcacgttcagtcctaacgggacactcgaggaatgccagcaccagacgaagtgcagttggttagtgaccaaggcaggagcaggcacaagctcctctcattgggtgtggtggtttctgtccgggagtttagttatcgtcatcgtgtgcagcaccgtgggactcatcatttgcgtcaagcggcgaaagccccgttag

SEQ ID NO: 245654 - DNA, 696 bp, Artificial Sequence
  Description of Artificial Sequence: Synthetic coding sequence
atggaacccccaggcgactggggtccaccgccttggagaagcacccctaaaacagacgtgctgcgactcgtgttgtacctgaccttcctcggtgctccttgctacgccccagctttgcctagttgcaaggaggacgaatatccggtagggtctgagtgctgcccaaaatgctcccctggctatcgcgtcaaagaggcctgcggcgaacttacgggaactgtatgcgaaccatgtccaccaggcacttatattgcccacctgaacggtctttcgaaatgtcttcagtgccaaatgtgcgatcctgccatgggactaagagcttcccgcaattgtagccgcaccgaaaacgccgtctgcggctgttcgcctggccatttctgcatcgttcaggatggagatcattgtgcagcgtgtagagcatacgcaaccagctcaccaggtcagagggtgcagaaaggaggtacagagtcccaagatacgctgtgccagaattgtcctcctggcaccttctctcccaacggcacactggaggagtgccaacaccagactaaatgttcctggctggtgacaaaggctggagcgggaactagcagctctcactgggtgtggtggttcctatcggggtccctggttatagtcatcgtgtgtagcactgttggactcatcatctgtgttaagcgacggaagccgcgatag

SEQ ID NO: 245655 - DNA, 555 bp, Artificial Sequence
  Description of Artificial Sequence: Synthetic coding sequence
atgctgcaaatggccggacaatgtagccagaacgagtatttcgattccttactgcatgcttgcatcccctgtcagctgaggtgcagcagcaacacccctccattaacctgtcaaagatattgcaacgcgtcagtcaccaattcagtgaaggggaccaacgcgattctgtggacgtgcttggggctaagcttaatcatcagtctcgccgtatttgttctcatgtttctcttaaggaaaatcaattcagaaccccttaaggatgagtttaagaacaccggatcagggctgctgggaatggctaatattgatctggaaaaaagtaggactggggacgagattatactgccacgtggcctcgaatacactgtggaagagtgcacttgcgaagactgtatcaaaagcaagccaaaagtcgactcagaccattgttttcccttaccggcaatggaggagggcgctaccatcctggtgactacaaagacaaatgattactgcaagagtttacctgcggcactcagtgctacagagatcgagaaaagtatttctgctcgctag

SEQ ID NO: 245656 - DNA, 408 bp, Artificial Sequence
  Description of Artificial Sequence: Synthetic coding sequence
atgctgcagatggccggacaatgtagccagaacgaatactttgatagtctactgcacgcatgcatcccatgtcagttgagatgttctagtaatacacctcctctgacctgtcagaggtactgtaatgccaggtccggtctgctgggaatggcgaacattgatcttgaaaagtcaagaaccggagatgaaattatactgcctcgcggattagaatacaccgttgaagaatgcacctgcgaggattgcattaagtccaagccaaaagtcgacagtgatcactgtttccccctcccagcaatggaggaaggcgctactattctcgtgaccacgaagactaatgattattgtaaatcgttacccgcagcgctgagtgccaccgaaatcgagaagagcatcagcgctagatag

SEQ ID NO: 245657 - DNA, 417 bp, Artificial Sequence
  Description of Artificial Sequence: Synthetic coding sequence
atggcaggccagtgctctcagaacgagtacttcgacagcctgctgcatgcttgcatcccatgtcagctgcgctgtagttctaatacacccccattgacctgccagcgctactgtaatgcgagtgttaccaactcggttaaggggaccaacgcaattttgtggacttgcctgggcctgtctctgattatctctctggctgtgttcgtgctgatgttcctcttacggaagattaatagtgagcctctgaaggatgagtttaaaaatacagaaatggagtcccggtcagtggcgcaagctggtgtgcagtggagggatctgaacagcttgcagcccttgcccctgggattcaaacagttctcacatcttagtttacttagcaactgggattataggatcagaagtccaggacatgggtag

SEQ ID NO: 245658 - DNA, 768 bp, Artificial Sequence
  Description of Artificial Sequence: Synthetic coding sequence
atggctcagcatggggcaatgggtgcattcagagcactgtgtggactggccttgctctgcgctttatctctgggccagcggcctactggcggaccagggtgtggccctgggagactgctcctcgggacgggaactgacgccagatgttgtagagttcatacgacccgctgctgtcgagactatcctggagaggagtgctgctcagagtgggactgtatgtgcgtccagccggagtttcactgtggcgatccgtgttgcacgacatgtagacatcatccgtgcccgcctggacaaggcgttcagtcacaaggaaagttctccttcggctttcagtgcattgattgtgcctcgggaacatttagcgggggacatgaaggacattgtaaaccctggacggactgttgttggcggtgccgacggcgacccaagacgcccgaagccgcttcctccccaagaaagagcggtgctagcgatcggcagaggagaagaggagggtgggaaacttgcggctgcgaacctggcaggcctccgggacctcctacagcagcgtcccccagccccggagccccacaagcggctggagctcttcgctcggctctggggcgagccctgttgccatggcagcagaaatgggtgcaggaggggggaagcgatcagcgcccagggccatgcagttctgctgctgccgcaggtccttgtcggagggagagagagacacagagttggcccccttcttctttggccggaccagacggtgtgggttcgtag

SEQ ID NO: 245659 - DNA, 705 bp, Artificial Sequence
  Description of Artificial Sequence: Synthetic coding sequence
atggcacaacatggcgcaatgggggcttttagggcactctgcgggttagcactcctgtgtgctttgagcctgggacaacgacctactggagggccagggtgtgggccaggaagattgctgcttggcactggaacagacgccagatgttgccgagtccacaccacaaggtgctgcagagattatccgggtgaggaatgttgttctgaatgggactgtatgtgcgtgcaacctgagttccattgcggagatccatgttgtacaacctgccggcaccacccatgccctcctggccagggtgttcagagccaagggaagttcagttttggtttccagtgtatagactgcgcgagtggcacgttttcggggggtcatgaaggccactgtaagccgtggacggactgcacacagttcgggttcctgacagtttttccgggaaacaaaacacataatgctgtgtgtgtcccagggtcacctcccgcagagccccttggctggctgacagtagtgctgcttgctgtcgcggcttgtgttttactcctcaccagtgcccagctcgggcttcatatatggcagctccgcaagactcagttgctcctcgaggttccccctagtaccgaggacgccaggagctgccagtttcccgaggaggagaggggggaaagatccgcagaggagaaggggcgtctcggggacttgtgggtttag

SEQ ID NO: 245660 - DNA, 726 bp, Artificial Sequence
  Description of Artificial Sequence: Synthetic coding sequence
atggcacaacatggcgcaatgggagcattcagagctttgtgcgggctggccctgctctgtgccttgtccttaggacagcgacccaccggcggacccggttgcggtcccggtcgattgttattgggaaccggaaccgatgctaggtgctgtcgagtgcatactactcggtgctgtagggattacccaggggaggagtgttgcagcgaatgggactgcatgtgtgtgcagcctgagttccactgcggcgacccttgctgcaccacctgtcgacaccacccttgcccccctggccaaggggttcagtcccaagggaaatttagctttggtttccagtgcatcgactgtgcaagtggcacatttagtggtggccacgaagggcactgtaagccatggaccgattgtacccaatttggtttccttaccgtttttcccggtaacaaaacccacaatgccgtttgcgttccaggttcacctccagcggagcctcttggttggcttacagttgtcctccttgctgttgccgcttgtgtattactgttgacgtccgctcagcttggactacacatttggcaactcagatctcagtgtatgtggcctcgggaaacccagctgctgttggaggttccacccagcacagaagacgcaaggagctgccagttcccagaggaagagagaggagaaagatcggctgaagagaaaggtagacttggcgatttatgggtgtag

SEQ ID NO: 245661 - DNA, 834 bp, Artificial Sequence
  Description of Artificial Sequence: Synthetic coding sequence
atgtgcgtgggcgcacggaggctcggtaggggcccttgcgctgccctgctgctattgggcctgggtctcagtacagtgactggcctgcattgtgtgggggacacttacccgtcaaacgaccggtgttgtcacgagtgccgcccagggaatggtatggtgtctagatgtagcaggtctcagaataccgtgtgcaggccttgcggacctggcttttacaacgacgtggtcagctcgaagccatgcaaaccttgcacctggtgcaacctgagatcaggctctgaacggaaacagttgtgcaccgcaactcaggacactgtctgccggtgcagggccggtacacaaccacttgactcctataaaccaggcgttgattgcgcaccgtgtccacccggtcactttagcccaggcgataatcaagcctgtaaaccctggaccaactgtacactggcaggcaagcataccctgcaacccgctagcaattcctcagatgctatttgtgaagatagggatccccctgccacacagccccaggagacacagggaccccctgctcggccaatcaccgtgcagcccacagaggcctggcccaggacctcacaaggcccaagtacgcgccctgtagaggtccccggaggcagggcagtggccgctatcttggggctgggattggttcttggactgctgggccctcttgcgatcctgctggccctgtacctcttgaggagagatcagcgcctgcctcccgatgcccataagcccccagggggaggtagctttcgtactccaatacaggaggaacaggcggatgcgcatagcactttagccaaaatctag

SEQ ID NO: 245662 - DNA, 399 bp, Artificial Sequence
  Description of Artificial Sequence: Synthetic coding sequence
tgaccaggcgcacctccactgcccccaggcgctcagacaaggcccagacctaggggggtgggtgaaacaaccttagcaatgtggccaggattggccggtctttctcggtcggggagtgaacggaagcagttgtgtaccgcaacacaggataccgtctgtagatgcagggctgggactcagccattagattcttacaaaccaggcgttgattgtgcgccatgccccccaggacacttcagtccaggagacaatcaagcttgcaagccctggacaaactgtacactggcagggaaacataccttgcagcctgctagcaattccagcgacgctatttgcgaggatagggaccctccagcaacgcagcctcaggaaacccagggcccacccgcacgcccttag

SEQ ID NO: 245663 - DNA, 423 bp, Artificial Sequence
  Description of Artificial Sequence: Synthetic coding sequence
atgagagccctggaggggcctggcctgtctctcctgtgtctggtccttgctctcccagccctgctcccagtccccgctgtgcgcggagtggccgaaacgccaacctacccatggcgagacgccgaaacaggtgaacgcctggtatgtgcgcaatgccctcctgggacttttgtgcaacgcccttgtcgacgggacagccctactacgtgcggaccttgccctcccagacattacacccagttttggaactacctcgagcggtgtagatattgcaacgtcttatgtggtgagcgggaggaggaagcgcgtgcgtgccacgcaactcataaccgcgcttgctgtgggtgttgcagacggtgtgcctggccagggtgccccggatggtcaggggcttcggtctccgcaagctcgctgtgtacatag

SEQ ID NO: 245664 - DNA, 903 bp, Artificial Sequence
  Description of Artificial Sequence: Synthetic coding sequence
atgagagctcttgagggaccgggtctctctctactatgcctggtactggccttacccgctttgcttccagtacctgcggtgaggggagtggctgagaccccaacatatccttggagggacgcagagaccggggaacgcctggtctgtgctcagtgtccaccaggtacattcgttcagcggccttgccggagggattcgcctactacttgcggcccatgtcccccacgccattatacacaattctggaattacctggaacgatgccggtactgtaatgtgctctgcggggaaagagaagaggaagccagggcttgtcacgctacccacaaccgggcttgccgatgcaggaccggctttttcgctcatgctgggttttgtctggagcacgccagttgtccacctggtgccggagtgatagctcctggtacgcctagccaaaatactcaatgtcaaccctgtccaccagggacgtttagcgcttcttcatcctccagcgagcaatgtcaaccacaccgaaactgtacagctttaggtctggctttaaacgtgcccggaagttcaagccacgacaccttgtgcacatcatgcacgggtttcccactgtctactcgcgtgcccggtgccgaggaatgcgaacgagctgtgatcgattttgttgcctttcaggacattagcatcaaacggctgcagcggctcctgcaggcccttgaagcacccgagggttggggcccaactccacgtgccggtcgagcagccctccagttaaagctgcgtcgcaggttgactgagctgctgggggctcaggatggggcactgctggtaaggctactgcaggcactgcgcgtcgctcgtatgcctggcttggagcgaagcgtgagagagcgtttcctacccgttcattag

SEQ ID NO: 245665 - DNA, 903 bp, Artificial Sequence
  Description of Artificial Sequence: Synthetic coding sequence
atgcgcgcactcgaggggccaggattgtcattgctttgccttgtgctcgcgcttcccgctcttctacccgtacctgccgtccgcggagtcgccgagacgcctacctatccatggcgtgacgcagagaccggggaacgccttgtatgtgcccagtgcccaccaggcaccttcgtgcagcgcccatgtcgccgagacagcccgaccacttgcggaccatgtccccctagacactatactcaattctggaattacctggagcggtgtagatactgcaatgttctgtgtggcgagcgggaagaagaagccagagcttgccatgctactcataaccgagcatgcagatgccgtactggattcttcgctcacgccggtttttgcctggaacacgcttcctgcccccctggcgctggagtcattgcccctggaactccttctcagaacactcagtgtcagccctgccctccgggaaccttcagtgctagctcaagctcatctgaacaatgtcaaccgcaccgcaattgcacggcgctgggcctggccctcaatgtgcccggaagctccagtcacgatactctgtgcacgtcgtgcacgggctttcctctctcgactagggtgccaggcgctgaggagtgtgagagggccgtgatcgattttgtcgcgttccaggacatatccattaagcgtctgcaaagactgctacaggccctcgaggcacccgagggttggggaccaacccccagagctggacgcgcagcccttcagctcaaactccgtaggaggcttaccgaactgctgggcgctcaggacggtgccctcctcgtacggttgcttcaggctctccgagtggcacgcatgcccggactggaaaggagcgtccgagagcgatttcttcctgttcactag

SEQ ID NO: 245666 - DNA, 1788 bp, Artificial Sequence
  Description of Artificial Sequence: Synthetic coding sequence
atgagagtgctattagccgcactaggtcttctcttcctcggcgcactgagagcgtttccacaggataggccatttgaagatacgtgtcacggcaatccttcccactattatgataaagccgtgaggcggtgctgctacagatgccctatgggtttatttccaacacagcagtgcccgcagcgtccgaccgactgtcggaagcagtgtgagcccgactattacctggacgaggccgacagatgcacggcctgtgtgacatgtagtcgggacgacctggtcgaaaagactccatgtgcttggaattcttcgcgggtgtgtgaatgcaggcccggtatgttctgtagcacaagcgcagtaaattcttgtgcaaggtgtttctttcattctgtttgcccggcagggatgattgtgaagttccccggtactgcccagaagaatacggtttgtgagcccgctagcccaggagtgagccctgcctgcgcctcccccgagaactgcaaagaacccagcagcgggacgatcccccaggcaaaaccaaccccagtgagcccagctacttcctccgcaagcaccatgcctgtcagggggggaaccaggttggcccaagaagccgcaagtaagttgacacgggcacctgactccccgagcagtgtgggcagaccatcttccgaccctggtttgagccccactcagccttgtcctgagggttctggagactgcaggaaacagtgtgagcctgactactacttagatgaagctgggaggtgcaccgcttgcgtctcatgcagtcgggacgatctggtggagaagactccatgtgcttggaattctagccgcacgtgcgaatgtcgaccaggaatgatttgtgcgacctcggctactaatagccgagcccgatgtgtgccatatcctatctgtgccgcagagaccgtaacgaaacctcaggatatggcagaaaaggacacaaccttcgaagcaccgccacttggcacacaacccgactgtaacccgacccccgagaacggcgaagcacccgctagtacttcacctacgcagtccttactggttgactcacaagcaagcaaaaccctgcccatccccacctcagccccagtggcccttagcagtactggtaaacccgttttggacgcgggtccagtactgttttgggttatcttggtcctggttgttgtggtcggctcgagcgcctttctgttatgccataggcgggcttgccgcaagagaatcaggcagaagctgcacctgtgctacccagtacaaacctctcagcccaaacttgaactcgtcgattcaaggcctagacgctcgagtacacagctaagaagcggagccagtgtgaccgagccagtcgcggaggagcgcggactgatgtcgcagccgttgatggaaacatgccacagtgtgggggctgcctacctggagagcctgcccctgcaggacgcatctccggctggtggaccctctagccctcgcgacctgccagaacctcgtgtctctaccgagcacaccaacaacaagatagaaaaaatctacattatgaaggccgacacagtgatcgtggggacagtgaaggctgaactgcccgagggcagaggtctcgctggaccagctgagcctgagcttgaggaggagctggaggcagatcatacaccccactatcccgagcaagaaacagagcccccattaggctcatgttccgacgtcatgctctctgtggaagaggagggaaaagaagatcccttgccaactgctgcctccggcaagtag

SEQ ID NO: 245667 - DNA, 399 bp, Artificial Sequence
  Description of Artificial Sequence: Synthetic coding sequence
atgagtcagcctctgatggagacgtgccactctgtgggtgcagcatatctggagtctctcccccttcaggacgccagccctgctgggggaccaagttctcccagggatctgcccgaaccaagggtttccacggagcacaccaacaataagatcgaaaagatttacatcatgaaagcagatactgtcattgttggtaccgttaaagccgaattgcctgaggggcgtggcctagctggtccagccgagccggaattagaagaggagctcgaggctgatcacactccccactacccggaacaagagacagagcctcctctggggtcttgtagtgacgtcatgctgtcagtcgaggaggaaggcaaagaggaccccttacctacagctgcttcaggaaagtag

SEQ ID NO: 245668 - DNA, 1452 bp, Artificial Sequence
  Description of Artificial Sequence: Synthetic coding sequence
atgttttgttccacttcagcagtaaactcttgtgcacgctgcttcttccatagcgtatgccctgcaggcatgatcgtcaagtttcctggcaccgctcaaaagaacactgtatgtgagcccgctagcccaggtgtgtcccctgcctgtgcctcccccgagaactgcaaggagccttcctccgggaccattcctcaggcaaagccaacaccagtcagcccggctacatcatccgcctctaccatgcctgttaggggaggtactcgcctggcccaagaagccgcatctaagctgactagagctccagattctcccagtagcgtggggaggccatcatcggaccctgggctgtcgccaactcagccttgtcctgagggctctggggactgtcgaaaacaatgcgagcctgactattatctggacgaggctggtaggtgtactgcctgtgtatcttgctctagagatgacctcgtagagaagacgccgtgcgcatggaactccagtcgcacatgtgaatgtcggcctgggatgatttgtgccacgtccgcgactaattcccgggctcgctgcgtgccttatcctatctgtgctgcagaaacagtgactaaacctcaggacatggcagagaaggataccacttttgaagccccacctttgggcactcagccggattgtaacccaactcctgagaacggcgaggctccggctagcacctcacccacccaaagccttcttgttgattcccaggcctccaaaacactgcccatccctaccagcgccccagtcgctctcagctcaacgggtaaacccgtcttagatgccggacctgtgcttttctgggtaatccttgtcttggtggtagtggtcggttcttcggctttcctgctctgccatagacgcgcatgcagaaagcgcattcgccagaaactgcatctgtgctatccagtgcagacatctcagccaaagttagagctcgtggactctaggccccgaagatcatcgacattgcgttctggggctagcgtgacggagcccgtggccgaagagagggggttaatgagccaaccactcatggaaacttgtcacagcgtcggcgcagcctaccttgagtccctgccgttgcaggatgcctcaccggcagggggtccgtctagccctcgagatctccccgaaccaagggtgagcacagaacacaccaataacaaaatagagaagatatatatcatgaaggctgacactgtgatcgtggggactgtgaaggccgagttgcctgaaggtagggggctagctggacctgcagagcctgagctcgaggaagaactggaggctgatcacaccccccactatcctgaacaggagaccgagccccctctgggctcttgctcggacgtcatgctgtccgtggaggaggaggggaaggaggatcccttacctacagccgcatccgggaaatag

SEQ ID NO: 245669 - DNA, 1437 bp, Artificial Sequence
  Description of Artificial Sequence: Synthetic coding sequence
atggcccctctcaggccgctgcttatccttgctctgctggcttgggtggccttggctgatcaagagagctgtaagggccgttgtacggaaggctttaatgttgacaagaaatgtcaatgtgacgagctctgcagctactaccagtcctgttgtacagactacacagcagagtgcaagccacaggtgacacgtggagacgtctttaccatgcccgaggatgagtatactgtctacgatgacggggaggagaagaataatgccaccgtccatgaacaggtcggaggcccatccctgacatcagatctccaggcccagtccaagggcaaccctgagcagacccctgtcctgaaacctgaggaggaggctccggcacctgaagtgggggcaagcaaacctgagggcatagatagcagacccgagactctgcacccaggcagaccgcagcctcccgcagaagaagagctttgcagcggcaagccattcgacgccttcacagacctcaaaaatggcagcctgtttgcatttcggggacagtactgctacgaactagatgaaaaagcagtccgacctggataccccaaactgattcgggacgtttggggtatcgaagggcctattgatgccgcatttactagaattaattgccagggtaagacttacctctttaagggctcccagtactggcgcttcgaggatggggtgctggacccagattatcctcggaatatctcagatgggtttgacgggattcctgacaacgtagatgccgctctcgcactcccggctcacagctatagcggcagagagcgagtgtatttctttaagggcaaacagtactgggagtatcaatttcagcatcagccgtcccaagaggagtgtgagggctcttcactgagtgcagttttcgaacactttgctatgatgcagcgtgactcctgggaggacatcttcgaactgcttttttggggacggacaagcgcgggaacccggcagccccagttcatttctagggactggcacggggtacctggccaggttgacgccgcaatggctggacgaatttatataagcggaatggcccctcgaccaagtctggccaagaaacaacggtttcgccaccgcaaccgtaaaggttaccgatcacagcgcggtcactccagaggccgaaaccagaatagcagacgaccatcaagggctacctggttgagcctcttctccagcgaggagagtaatttaggagccaataattacgacgattacaggatggactggctggtgccagctacttgcgaaccaatccaaagcgttttctttttttctggcgacaagtattaccgggtgaacctcagaacaagacgtgtggatacagtcgaccccccttaccccaggtctattgcgcagtactggcttgggtgccctgcaccaggccatctgtag

SEQ ID NO: 245670 - DNA, 639 bp, Artificial Sequence
  Description of Artificial Sequence: Synthetic coding sequence
atggcagaggccaaatattacctgatacagggcctggtgaacatgtgccaaagcgccttgcaggacaaaaaagattcttatcagcctgtctgtaacattccaatcatcacgagccttaaggaagaggaacgactgattgagagttctaccaagccggtcgtgaagttgctctacaatcgatcaaacaataaatattcctatacgtcaaatagtgacgatcacttgctgaagaatatcgaacttttcgacaaactgagcttgaggttcaatggacgggttctattcatcaaggacgtcatcggcgacgaaatttgctgttggtccttttatggccagggcaggaagctcgcagaggtgtgctgtactagcatcgtatacgccaccgagaaaaaacagacgaaagtcgagttcccagaggctcgcatttacgaggagacattgaacgtgctgttatacgaaacgccccgagtcccagataattctctcctggaagctaccagccgctccaggtcccaggcttcccctagtgaagacgaggaaacatttgaattaagggatcgcgtccggcgtattcacgtcaagagatactctacatacgatgaccggcagcttggccaccagtccacccatcgcgactag

SEQ ID NO: 245671 - DNA, 1965 bp, Artificial Sequence
  Description of Artificial Sequence: Synthetic coding sequence
atgtctgaagcaagctccgaggatctggtcccccctctggaggcaggagccgctccttaccgggaagaggaggaagcggcaaaaaaaaagaaggagaaaaagaagaagtctaagggccttgcaaacgtgttttgcgtcttcaccaagggcaagaagaagaaaggacagcccagctcagcagagcccgaagacgcagcaggctccaggcagggactggatgggccaccacctacagtggaggagctcaaagcagccctggagcgcggacagctggaggccgcacggccactgttagcactggagcgggagcttgccgcagcagccgcagcaggcggtgtctccgaagaggagctggtgagaaggcaaagcaaagtggaggctctttatgagctgctgagggaccaagtcctgggggtcctaagaagaccgctcgaagccccacctgaaagactgcgacaggctctcgccgtggtggcagagcaagaacgcgaggatagacaggccgcagctgcgggtccagggacctccggcctggccgctactaggccaagaaggtggctgcaactttggcgaaggggagtggctgaagctgctgaagagcgaatgggacagcgcccagccgcaggagcagaggtgcctgaaagcgtgttcctccatcttggacggacaatgaaagaggacctggaagcagtcgtggagaggctgaaacccctgttcccagctgagttcggcgtagtggccgcttacgcggaaagttatcaccagcacttcgctgcccatttagctgccgttgcacagtttgaactctgtgagcgcgacacgtacatgcttcttctgtgggtgcagaacctgtacccaaatgacattattaattcgcctaaactggtgggagaactgcagggcatgggactgggcagtttgctgcccccaagacagattcggctgctggaagctaccttcctgtcaagcgaagcggctaatgtgagagaactgatggatagagcacttgagcttgaagcaagacgttgggcagaggatgtgccaccgcagcgacttgatggtcactgtcatagcgaactagccattgacattattcagattactagccaggcacaggctaaagccgagtcgatcaccttggacctaggctcacaaatcaagagggtcttacttgtagaacttccagccttcctaagatcataccagcgcgctttcaacgagtttctggagagggggaagcagttgaccaactatcgagctaacgttatagcaaacatcaacaactgtctgagttttcggatgtctatggagcaaaactggcaagttccacaagacacactctctttgttgctgggccctttgggggagcttaaaagtcatgggttcgatacgctattacagaacctccatgaggacctgaagccattattcaaacgattcacacacacccgttgggctgctccagtcgaaaccctcgagaatatcatcgcaactgtcgatactcggctgccagagttttctgagcttcaaggatgctttagggaagagctgatggaagcactccacctgcacttggtcaaagagtacatcatccagctcagtaaagggagactagtgctcaagacagcagagcagcagcagcagcttgctggatacatcctggccaacgccgacacgattcaacatttctgcactcagcatggctctcccgcaacctggcttcagcctgctttaccaaccttggcagaaattattagactccaagaccctagcgccatcaaaattgaggtggcaacctatgctacttgctatcccgattttagtaaaggccatctcagcgccatactggctataaaaggaaatttaagcaactcagaagtcaagagaattaggtccatcctcgacgtcagcatgggggcacaggaaccaagcagaccacttttttcactgatcaaagttggctag

SEQ ID NO: 245672 - DNA, 972 bp, Artificial Sequence
  Description of Artificial Sequence: Synthetic coding sequence
atggatagggccctcgagctagaagccagaaggtgggccgaggacgtgccaccccagagactggacggacattgccactcagaactggcaattgatattatccagatcacatctcaagcccaagccaaagcagagtctatcacactggacctaggttcacagatcaagcgggtgctgctagtcgagctgcctgccttccttcggtcatatcaacgggcatttaatgaattcttagaaaggggtaaacagctgacaaactatcgggctaacgtgatcgctaacattaacaactgtctttctttcagaatgtcgatggaacagaattggcaggtgccacaagacacgctctccctgctgcttggccctttaggagagttgaagagccatgggtttgatactctcctgcagaacttgcacgaagacctgaagcctctgttcaagcggttcactcatactcgctgggccgcaccagttgagaccctcgaaaatattattgccaccgtagacacgaggctgcccgagttttcagagctgcagggctgcttccgcgaagagttgatggaagcactgcatctgcatctcgttaaggagtacatcatccagctgtcaaaggggcgacttgtacttaagaccgcagagcagcagcaacagctggccggatacattctggccaatgctgatactatccagcatttttgtacccagcatggctcgcccgctacatggctccagccagccctcccaaccctcgctgagatcatcagactgcaagatccgtccgcaatcaaaattgaagtcgcaacttatgccacctgctatccggacttctccaaaggccatctgtccgccatacttgccataaagggaaatcttagtaatagcgaggttaagagaatccggagtatactcgatgtctcaatgggggctcaagaacctagcaggcctctgttcagtctgataaaggtcggttag

SEQ ID NO: 245673 - DNA, 600 bp, Artificial Sequence
  Description of Artificial Sequence: Synthetic coding sequence
atggaggcacttcacctgcatctggtcaaagaatatataattcaactcagcaaaggacggctggtgttaaagacagcagaacagcagcagcaattagctgggtacattttggctaacgctgatacaatacagcatttttgcacacagcatggaagtcccgctacatggctgcagccagccctccctacactcgctgagattatccgcctgcaggacccatctgcaattaagattgaagtggctacgtacgccacctgttaccctgactttagcaaaggccacctgtcagcgatccttgccatcaaaggaaatctgtctaactccgaggtcaagcgaatacggagcatcctggatgtcagcatgggtgctcaggagcccagccgccctctgttcagtctcatcaagccaagagctgccgtgagtgggatacagcagtggtggaacggacggcagaattggaaacgtaaaaaggagaaaatgtcaagccgtcttgctggagcctttagggtactctggagggcagtttccactgcgagtatccggagacatatccaggtcgcccctaggcctttgcaggcgggaccagccatgggcccatag

SEQ ID NO: 245674 - DNA, 120 bp, Artificial Sequence
  Description of Artificial Sequence: Synthetic coding sequence
atgagtgaggcttcttccgaggacctcgtgcctcccctggaggccggagccgctccctatcgggaggaggaagaggccgctaagaagaagaaggaaaagaagaaaaagtctaaggggtag

SEQ ID NO: 245675 - DNA, 1965 bp, Artificial Sequence
  Description of Artificial Sequence: Synthetic coding sequence
atgagtgaggcatccagtgaagacctcgttcccccactcgaggcaggagcagcaccctatcgagaggaggaggaggctgccaagaaaaagaaggagaaaaagaaaaagtctaaaggactagcgaatgtattttgtgtgtttacgaagggtaagaagaagaaaggccagcctagcagtgccgagcctgaagatgccgctggaagcaggcagggactggatggcccacccccaaccgtggaggagcttaaagccgctctggagcggggtcagcttgaggcagcgcgtcccttgcttgccctagaaagggaattagctgccgcagcagctgcagggggtgtgtctgaagaggaattagtgcggagacagtctaaggtggaggctctctatgaactgctacgcgaccaggttctaggcgtcctcagacgcccactggaagcccctcccgagcggctcaggcaggcgctcgctgttgtggccgagcaagagcgagaggacaggcaagctgctgccgcagggccagggacctctggtttagcggctacgagaccacggagatggctgcagctatggcgccgtggagtggccgaagccgctgaagagcggatgggccagcgccctgccgcaggcgctgaagtgcctgagtccgtttttttgcacctgggccgaacaatgaaagaagatctggaagctgttgttgaacggctgaagcccctctttccagcggagttcggagtagtagccgcatacgcagaatcctaccaccaacatttcgctgctcacctggccgcagtggctcagttcgaactgtgtgagcgggacacctatatgttgctcttgtgggtgcagaacctgtatcccaacgatatcattaactctcctaagttggttggggaactccagggaatgggacttggatccttattacccccacgccagatccgtctgctggaggccacttttttgagctctgaggctgctaatgtgagggaattgatggatagggcacttgagttggaggctcgacgctgggctgaggatgtgccccctcagcgcctagacgggcattgtcactcggagttagccattgatatcatccagataaccagtcaggcccaggccaaggcagaaagtatcacgttagatctaggttctcagattaaacgcgtcctgcttgtggaattaccagcatttctacgatcataccagagagcatttaacgaattcttagaacggggaaagcagctgacgaactacagggccaacgttatcgccaatattaacaactgtctctcttttagaatgagcatggagcaaaactggcaagtgccacaggatactctcagcctccttctcgggcctcttggcgagctgaaaagccacggctttgacacactactgcagaaccttcacgaggacctaaagccgttgttcaaacggtttacccatactagatgggccgctcctgttgaaacgctggaaaatatcatcgcaaccgtggacacccgccttcccgaattctctgaactgcaggggtgctttcgggaagagctgatggaggcgctccatttgcatctggtcaaagagtatataattcaattgtcgaagggacggctggtgttgaagacagccgaacagcagcagcagctggccggttatattctagctaatgccgatacgatccaacatttttgcacccagcatgggagccctgctacgtggctacaacctgctctgcccaccctagcagagatcatcaggctacaagacccgagtgctattaaaattgaagtcgccacgtatgccacatgttacccagactttagcaaaggccacctcagcgctatcttggccatcaaaggtaacctcagtaattctgaggtaaagagaatcagatctatcttagatgtttctatgggagcccaggaacccagccgacccctgttctctttgattaaggtcggttag

SEQ ID NO: 245676 - DNA, 2373 bp, Artificial Sequence
  Description of Artificial Sequence: Synthetic coding sequence
atggcagagcaggtgctgccacaggctctctatctgtctaacatgaggaaggccgtgaaaatcagggagaggacccccgaagatattttcaaacctacgaatggcataatccaccacttcaagactatgcatcgatacacgctggagatgttccggacttgccagttctgtcctcagtttagggagataattcacaaagcgctcatcgacaggaatattcaggcaacactagagtcccagaaaaagctgaactggtgtagggaggtcagaaaactggtggccctgaaaactaatggagacgggaactgcctaatgcacgccacaagtcagtacatgtggggagttcaggacactgacttggttttgcggaaggctttgttctcaactctcaaagaaacggacaccagaaactttaaatttaggtggcagctggagtcactgaagtctcaggagttcgtcgagaccggactttgttacgatacacggaattggaacgatgagtgggataacctaattaagatggcctcgaccgatactcccatggccagaagcggcctgcagtacaacagcctggaagagatccacatcttcgtcctgtgtaatatcctgcggagacctatcattgtgatttccgataaaatgttgaggtcactcgagtctggttccaatttcgcgccactcaaggtcggagggatttatctgccccttcactggcctgcccaggagtgttacagatacccgattgtcctgggctatgactcccaccacttcgttcctctcgtgaccctgaaggacagtggaccagagattcgggctgtgccattagtgaaccgcgatcggggacgatttgaagacttgaaagtgcattttttaacggaccccgagaatgagatgaaagagaagctgcttaaggaatacctgatggtaatagaaatcccagtgcagggctgggaccacggaaccacccaccttattaacgccgcaaaacttgacgaagcgaatctgccaaaggaaattaacctggtggatgactattttgagcttgtccagcacgagtataagaaatggcaggaaaattcagagcaggggcgacgcgagggccatgcccagaacccaatggagccctctgtgcctcaactcagtttaatggatgtcaaatgtgagacgccaaattgccccttcttcatgagtgttaacacacagccactttgccatgagtgttcagagcgacgacagaaaaatcagaataaactccccaagcttaatagtaaacccggtccagaagggctgcccggaatggccctgggagctagccgcggtgaggcatatgaacccttagcatggaatccagaggagtccacggggggaccccatagtgctccacctaccgccccatcaccctttctgtttagcgaaactacagccatgaagtgtcggagtccagggtgtccttttaccctcaacgtccagcataatggtttttgtgagagatgccacaatgccagacagctgcacgcatcccatgctcccgatcacacgaggcacctggacccaggaaagtgccaggcttgtctgcaggacgtaacacgaaccttcaacggaatttgtagcacttgcttcaagcgtacaactgctgaggccagcagcagccttagcacctctctgccgcctagctgccaccaacgtagtaaatctgaccccagtaggctggttcggtccccgtctccccactcatgccaccgagccggtaatgacgccccagccggttgtctatcccaggcagctcgaacccccggtgaccgtactggaacgagcaaatgcagaaaagccggatgcgtctatttcgggaccccagaaaacaaagggttctgtaccctttgtttcatcgaatatcgcgagaacaaacacttcgctgccgcttcaggcaaggtgagccctaccgcttcgagatttcagaacaccatcccctgcctggggagagagtgtgggaccttgggtagcaccatgtttgaaggctactgtcagaagtgttttatcgaagcgcaaaatcagagatttcacgaggctaaacgcaccgaagagcagcttaggagtagtcagagacgggacgttcctagaacaacccagagcacatcccgccctaaatgtgcacgagcctcctgtaaaaacattctggcttgcagatcggaagagctgtgcatggagtgccagcaccccaaccagcggatggggccaggcgctcacaggggagagcctgcgccagaagacccccctaagcagaggtgccgggcacccgcttgtgaccactttggcaacgcgaaatgcaatgggtattgtaatgagtgcttccagtttaagcagatgtatggctag

SEQ ID NO: 245677 - DNA, 489 bp, Artificial Sequence
  Description of Artificial Sequence: Synthetic coding sequence
atggctgaacaggtattgccgcaagcgctctacctgtccaatatgcggaaagcagtgaaaatacgggaaaggactccagaagatatcttcaaaccaacgaacggaatcatccaccacttcaaaaccatgcatagatatactctcgaaatgttcagaacgtgccaattttgtccccagttccgcgagattatacacaaggccctgatcgaccggaacatccaagccaccctggaatctcagaaaaagctgaattggtgtcgggaggtgcgcaaattagtcgccctcaagactaatggggatggtaattgcctgatgcacgccacctcacaatatatgtggggggtccaggacaccgatctggtgttgagaaaagctctattctccaccctgaaggagactgacacacggaattttaagttccgttggcagctagagagcctcaagtcacaggagttcgtcgaaaccggcctctgttacgataccaggtag

SEQ ID NO: 245678 - DNA, 81 bp, Artificial Sequence
  Description of Artificial Sequence: Synthetic coding sequence
atggctgaacaggttctccctcaggccttgtacctttcaaacatgcggaaggccgttaaaatacgggagcgtacgccatag

SEQ ID NO: 245679 - DNA, 297 bp, Artificial Sequence
  Description of Artificial Sequence: Synthetic coding sequence
atggccgagcaggtcttgccgcaggctctttacctgagcaatatgaggaaggccgtcaagatccgtgaaaggacacctgaggatatattcaaacctaccaacggaattatccatcacttcaagacaatgcaccgatatactcttgagatgttccgaacctgtcagttctgcccccagttcagggaaattatccataaagccctcattgatcggaatattcaagccaccttagagtcccagaaaaaactcaattggtgtagagaggtgcgcaaactggtcgcccttaaaaccaattag

SEQ ID NO: 245680 - DNA, 813 bp, Artificial Sequence
  Description of Artificial Sequence: Synthetic coding sequence
atggcggaacaggtgctgccgcaggccctgtacctttccaatatgaggaaggccgtgaagattcgggagaggacgcctgaagacatcttcaagcccaccaacggaatcatccatcactttaaaacgatgcacagatacacccttgagatgttccggacttgtcagttctgcccacagttccgtgagatcatccacaaagcgctaatcgacaggaacatccaagctactctagagtcccagaagaaacttaactggtgtcgtgaggtgcgcaaattagtggccttaaagacaaacggggatgggaactgtttgatgcacgccacctcacagtacatgtggggggtccaggacaccgatctcgttcttaggaaggctctgttttccaccctgaaagagaccgatactcgcaacttcaaatttcggtggcagctggagtcactgaagtcccaggagtttgtggaaaccggactctgctacgatacacggaactggaatgacgagtgggataatctgattaaaatggcatcgactgacacacccatggcacgatctggtcttcagtacaatagcctggaagaaatccacatttttgtgctctgtaacattctcagaagacccattatcgtcatttccgacaaaatgctgcgatccttagagagtggaagcaatttcgcccctctcaaggtcggtggcatctacctgcccctgcactggcccgcacaagagtgttatcggtatccgatagtgcttggatatgacagtcaccattttgtcccgttagtcacgctgaaagactcaggacctgatatctag

SEQ ID NO: 245681 - DNA, 2250 bp, Artificial Sequence
  Description of Artificial Sequence: Synthetic coding sequence
atggccgaacaggtgctcccccaagccctgtatctttccaacatgcgcaaagcggttaaaatccgggagcggacaccagaagacatatttaaaccaacaaatggcatcatccaccatttcaagaccatgcaccggtacacacttgaaatgtttcgaacctgtcaattttgcccccagtttcgtgagatcatacataaggctcttatagaccgaaatatccaggcaacactggagtcacagaaaaagctgaattggtgcagagaagtgcgcaaattggttgccctcaagacgaacggggacgggaactgtttgatgcacgcaaccagccagtacatgtggggggtgcaagatacagacctggtgctgcgaaaggctctgttctcaactctgaaggagaccgatacccgcaactttaaatttagatggcagttggaaagcctcaaaagccaggaattcgtcgagaccggactttgttatgatacacggaattggaatgatgagtgggataatctgattaagatggccagcacggatactcccatggcccgaagcgggctgcagtataactctctggaggagattcatatcttcgtgctctgcaacattctccgaaggcccattattgtaatcagcgataaaatgttgaggtccctagagtctgggtcgaatttcgcaccactgaaggtcggcggtatttacctgcccttacactggccagcacaggagtgctatcgctatcccatcgtactggggtacgactctcatcacttcgtccctctggtcaccctgaaagattctgggcctgagatcagagcagtgcccctggtgaaccgtgacaggggccgtttcgaagatctgaaagttcactttctgactgaccctgaaaacgagatgaaggaaaagttactgaaggagtacctcatggtaatcgagatccctgtacagggctgggaccacgggaccacacacctgattaatgccgcaaagctggacgaagccaacctgcccaaagaaataaacctagtggacgattatttcgaactggtccaacacgagtacaagaaatggcaagaaaactccgaacagggcaggcgcgaggggcatgcccagaacccaatggagcccagtgtaccacagttgtcgctcatggatgtgaaatgcgaaacaccaaactgcccattcttcatgagtgtgaatacccagccgctgtgccacgaatgtagtgagagaagacagaagaatcagaacaagctgccaaagttaaatagcaaacctggtccagaaggcctgcccggaatggcgcttggggcttcacggggagaggcttatgagcctttggcgtggaacccagaggaaagcaccggcggaccacactctgcccctccaacggctccttctcccttcctcttctcagagaccaccgccatgaagtgcaggagtcccggttgcccgtttactttaaacgtgcagcataacggattctgtgaacgatgtcataacgcaaggcagctgcatgctagccacgccccagatcacacacgccacctcgatccagggaagtgccaggcctgcctgcaggatgtgactcggacctttaatgggatttgcagtacatgttttaagaggacaactgccgaagcgtcaagctctctgagcacttcactcccacccagttgtcatcagaggtccaaatcagatccgagtagactggtacgctcacccagccctcacagttgccatagggctggcaacgacgcccctgcgggatgcctcagccaagcggcacgtacacccggagaccgaacaggaacttccaagtgccggaaggccggatgtgtgtactttgggactccggagaataagggtttttgcacattgtgtttcattgaataccgggaaaacaagcacttcgcggcagcgtctgggaaggtgagtccaactgctagtcgtttccagaacaccatcccgtgtctagggcgtgagtgtggaactctgggctcaacaatgttcgaggggtactgtcagaagtgcttcatcgaagcccagaatcaaaggttccatgaggccaaaagaactgaggagcagctgcgatcaagccagcgacgcgacgtacccaggactactcagtcgacatccagacccaagtgcgcacgagcaagctgcaagaacatactggcatgccgaagtgaggagttatgcatggagtgccagcaccagccagaagacggaccctgggggcctccaggatag

SEQ ID NO: 245682 - DNA, 459 bp, Artificial Sequence
  Description of Artificial Sequence: Synthetic coding sequence
atggcagaacaggtacttccacaggcactgtatctgagcaatatgcgcaaagcagtgaagatcagggagcgtacccctgaagacatcttcaagccaaccaacggcattatccaccacttcaagacaatgcatcgctacacactcgagatgtttcggacatgccagttctgcccccagtttagagaaattatccacaaagctctgatagacaggaacattcaggcaaccttggaaagtcagaagaaactgaattggtgtagggaggtcaggaaattggtcgccttgaaaactaacggtgacggaaactgcctgatgcatgccacttcccaatacatgtggggagttcaggatactgacctggtgttgagaaaagccctgttctctaccctgaaagagaccgatacacgaaattttaaatttcgctggcagcttgaaagtcagatttctggtatctgctag

SEQ ID NO: 245683 - DNA, 645 bp, Artificial Sequence
  Description of Artificial Sequence: Synthetic coding sequence
atggcagagcaggtgctgccacaggctctctacctgtccaatatgagaaaagctgtgaaaatcagggaacgcacccctgaggatatctttaaacctaccaatgggatcatacaccacttcaaaactatgcatcgctacaccctggagatgttcagaacgtgtcaattctgtccacaatttcgggaaattatccacaaggccctgatagatagaaatattcaggcaactctcgagtctcagaagaagttgaactggtgccgtgaagttcgaaaacttgtcgctttgaagaccaacggtgatggcaattgtttgatgcacgccacatctcagtatatgtggggggtgcaggacaccgaccttgtgttgcggaaggcgttgttctcgaccttgaaggaaacggatacccgcaactttaagttccggtggcaactggagtctctcaaaagccaggaattcgttgaaaccggtctgtgctatgacactaggaactggaatgatgaatgggacaaccttatcaagtggttgccccagacccatccctggcccgaagtcgattttagtacaactcactggaagaagtacacctacctgtctttcgcgaccagctcagaaggtcagtccctatcttttcaaactaagtgttag

SEQ ID NO: 245684 - DNA, 2010 bp, Artificial Sequence
  Description of Artificial Sequence: Synthetic coding sequence
atggcagaacaggtgctacctcaggccttgtacctttccaatatgcggaaagccgtgaaaatcagagagagaaccccggaagatatttttaagcctaccaacgggattattcaccactttaagaccatgcacaggtacaccctggaaatgttccggacgtgccagttctgcccccagttccgcgagatcattcataaggccctgattgacaggaatatccaggcaacactggaaagccagaaaaagctgaactggtgcagagaggtgcggaagttagtcgccctcaaaactaacggtgacggcaattgcctgatgcatgctaccagccagtacatgtggggtgtccaggacaccgatcttgtactgcgtaaggccctcttttccactcttaaagaaacagatactcggaactttaaattcagatggcagctagagtctctgaagtcccaggaattcgtggagaccggtctgtgctatgacactagaaactggaacgatgagtgggacaacctgattaaaatggccagtaccgacacacccatggctcgcagtggactgcaatataacagtctcgaagagatccacattttcgtgttgtgcaatattctgaggagacctatcatcgtgatctcagacaagatgctccgatctcttgaaagcggctccaactttgcccctctgaaagtggggggtatatacttaccccttcactggccagcacaagaatgctatcgataccccatcgttttgggctacgactcacaccactttgtgcccttggtgactctgaaggacagtggccctgagattcgggcagtccctctggtgaaccgggaccgcggtcggtttgaggatcttaaagtgcattttctgactgatcccgaaaacgagatgaaggagaagctgctgaaggagtatctgatggtcatcgaaatcccagtacagggctgggaccacggaacgacgcatctcatcaacgccgctaagcttgacgaggcgaacctgcccaaggagatcaacctggtagacgactatttcgaattggtgcagcatgagtataagaaatggcaggagaattctgagcagggcaggagagagggccatgcacagaatcccatggaaccatcagtgcctcagctgtctcttatggacgtgaagtgtgaaactcctaactgtccctttttcatgagtgtgaacacacaaccgttatgccatgagtgtagtgaacggcgtcagaaaaaccagaacaagctgccaaagctcaacagtaagccgggacctgaaggattaccaggaatggcgctgggcgcttcccgcggtgaagcttatgagccacttgcttggaaccccgaggaatccactggaggtccccacagcgcaccacctaccgccccttccccctttctcttcagcgagaccaccgccatgaagtgtcggtctcccggttgcccttttacattaaacgtccagcacaacggcttctgcgagcgctgccacaatgccagacaactgcacgcatctcacgcgcctgaccacactaggcatcttgaccccggaaagtgccaggcgtgtctgcaggacgttactaggacctttaacggtatatgttcgacctgcttcaaacgcaccacagctgaggcttcttcgagcttgtcgacatcgctgcctcccagctgccaccagcggagtaaaagtgaccccagccggcttgtgaggtctcctagcccacactcgtgccaccgagccggtaatgacgcgccagcaggctgtctgtctcaggctgctcggaccccaggagatagaacaggcacaagcaagtgcaggaaagccggatgcgtgtactttgggacaccagaaaataaagggttttgcaccctgtttcacagggtgcaacgaaaacagacattttgctgttgtctgagggagtcccagtcccactccgtgcaggtgcccgagcatcacagcgtgcccggtgagggtatgagacatccatggaagcatcacgtctag

SEQ ID NO: 245685 - DNA, 834 bp, Artificial Sequence
  Description of Artificial Sequence: Synthetic coding sequence
atgatcatattgatttatctattcctgctactgtgggaggatactcagggatggggcttcaaggatggtatatttcacaattcaatttggctcgaaagagccgctggtgtttaccacagagaagcaagatcaggcaagtacaaactgacatacgcagaggcaaaggccgtgtgtgagttcgaggggggtcacctggcgacatacaaacagctggaagccgctcggaagatagggtttcatgtgtgcgccgcaggctggatggcaaagggacgcgtcggctacccaatcgtgaaaccaggccctaattgcggtttcggcaagaccgggattatcgactatggaatcagactgaatagatctgagcgctgggatgcctactgctacaacccccacgcaaaggaatgcggaggggtcttcacagatccaaagcagattttcaagagcccaggctttccgaatgagtacgaggacaatcaaatttgttactggcacatcaggctcaaatacggccagcggatccatctgtcatttctcgacttcgacttggaggatgatcccggttgccttgccgattacgtggagatatatgactcctacgatgacgtacatggcttcgtaggaaggtattgtggcgacgaactccccgatgacattatctcaactggaaacgttatgactcttaagttcctatctgatgcttctgtgaccgcaggcggattccagataaagtacgtcgccatggaccctgtgtccaagtcatctcaggggaagaatacatctacaacttcaacaggtaacaaaaatttcctggcagggagattcagtcacctctag

SEQ ID NO: 245686 - DNA, 567 bp, Artificial Sequence
  Description of Artificial Sequence: Synthetic coding sequence
atggcaacagatgtctttaatagcaaaaacttggctgtccaagctcagaagaagatccttggcaaaatggtgagcaaatcaatcgccacgactcttatcgatgacacttccagcgaagtgctcgacgaactctacagagtcacacgggaatacacccaaaacaagaaagaggcggagaaaatcatcaaaaatctcatcaagacagtcattaagctggcgattctttatcggaacaaccagttcaatcaggacgaacttgccctgatggagaagtttaagaagaaggtgcatcaactggctatgacggtggtttccttccaccaagtggattatactttcgatagaaacgtcctttcacggttgctgaatgagtgtagggagatgctacaccagatcattcaaagacatctaaccgcaaagagtcacggcagggtcaataacgtgttcgatcatttctccgattgcgagttccttgccgcactttacaacccttttggcaattttaaacctcacctgcagaaactttgtgatggaatcaacaaaatgctggatgaggaaaacatctag

SEQ ID NO: 245687 - DNA, 597 bp, Artificial Sequence
  Description of Artificial Sequence: Synthetic coding sequence
atgcattctgaggctgaagaatcgaaggaggtagctaccgatgtcttcaactccaaaaatctggcagtgcaggcccagaaaaaaattctggggaagatggtgtctaaatccatcgctactactctcattgacgacacctcatctgaggtccttgacgaactgtacagagtgacccgggaatatacccagaataagaaagaggctgagaaaatcatcaaaaatcttatcaagaccgtgataaaattggcgatcctgtatcgaaataaccaatttaatcaggacgagcttgcattgatggagaagttcaaaaagaaggtccatcagctggccatgacagtggtgagcttccaccaggtcgactatactttcgacagaaacgttttaagtagattgctgaacgagtgtagggagatgctccatcaaataatccagcgacacctgacagccaagagccatgggagagtaaataacgtgtttgatcattttagcgattgcgagtttctggccgcactttacaatcctttcggtaacttcaaacctcacctgcagaaactctgtgacgggatcaataagatgctggacgaggagaacatttag

SEQ ID NO: 245688 - DNA, 597 bp, Artificial Sequence
  Description of Artificial Sequence: Synthetic coding sequence
atgcactccgaggccgaggaatccaaggaggttgctacagacgtattcaattcaaagaacctggcagtccaagctcagaaaaagattctgggaaagatggtaagcaaatccattgctactacgctgatcgacgatacatcctctgaggtgcttgatgagctctacagagtgacccgggaatacacacagaataaaaaggaagccgaaaagataatcaagaacctcattaagaccgttatcaagttggccattctataccgcaataaccagttcaatcaggatgagctggcactgatggagaaattcaaaaaaaaggtgcatcagctggcaatgaccgtcgtttcattccaccaggtggactacacatttgaccgcaatgtgctcagtcggctgctgaatgaatgtagggagatgctacaccagatcatccagaggcatttgactgccaaaagtcatggaagagtgaacaacgtattcgaccacttctccgactgcgagttcttggccgcactctacaacccctttggcaattttaaaccccacctgcaaaaattatgtgacgggatcaataaaatgcttgatgaagagaacatttag

SEQ ID NO: 245689 - DNA, 555 bp, Artificial Sequence
  Description of Artificial Sequence: Synthetic coding sequence
atggaatccttcagctcaaagtcactggcactgcaggccgagaaaaagctccttagcaagatggccggtcgctctgttgcccacctgttcatcgatgagacttcctctgaggtgctggacgaactgtacagagtaagtaaggagtacacgcattcaagaccacaggcccagcgggttattaaagatctgatcaaagttgcgataaaggttgccgttcttcacaggaacggtagctttgggccaagcgagttggcactggctactcgttttcgccagaaactgcgccagggagccatgacagccctgagctttggcgaggttgactttacattcgaggccgcagtcctcgccggactgttgaccgaatgtagagatgtgttgctggaacttgtggagcaccatctcactccaaagagccacgggagaattagacatgtatttgatcattttagtgacccaggcctgctgacggctctatatggcccagacttcactcagcatctcggcaagatatgtgatggactgagaaagttgctggatgagggaaagctgtag

SEQ ID NO: 245690 - DNA, 1296 bp, Artificial Sequence
  Description of Artificial Sequence: Synthetic coding sequence
atgtacagaacgaaggtgggccttaaggatcgccagcagctctacaagcttattatctcccagcttctgtatgatggttacatctcaattgctaatgggctgatcaatgaaatcaaaccccagtcagtttgcgcgccatcggagcagctgctgcacctgatcaagctcgggatggaaaacgatgataccgctgtccagtacgcaatcggacggtccgataccgtcgccccaggaactggtatcgacttggaattcgatgcggacgttcagactatgtctccggaggcgtccgagtacgaaacctgctacgtgacctcgcataagggcccttgccgggtggcgacctacagtcgcgacggccagttgatcgcaaccgggtcagccgatgcttcaataaaaattctcgacaccgagcggatgttagccaaaagcgcaatgcctattgaagtgatgatgaatgagacagcccaacagaatatggagaatcaccctgtgatccggaccctgtatgaccacgtcgacgaggtgacctgtttggctttccacccgaccgaacaaatccttgcgagtggctcaagggactatacactgaagctcttcgattatagtaagccatctgccaaaagagctttcaagtacatacaggaagcggaaatgctgaggtcaatcagtttccatccctctggagactttattctggtgggcactcagcatcctactctgcggctctacgatataaacaccttccagtgttttgtgtcctgtaatcctcaggatcaacatacagatgctatttgttctgtgaactacaactcaagtgccaacatgtatgtgaccggctcaaaagatggatgtatcaagttatgggacggagtgagcaacagatgcatcacgacattcgaaaaagcccacgacggggcagaggtgtgtagcgctattttctccaaaaactctaaatatatcttatccagtggaaaggactccgttgccaaactgtgggagatttcaaccggtaggactttggtgagatatacaggtgccggactgagtggacggcaagttcaccggacccaggcagtattcaaccatacagaagactatgttctgttacccgatgaacgaaccattagtctgtgttgttgggactcaagaaccgccgagaggcgcaacctgctaagcctgggccataataacatagtcaggtgcatagtccacagccccaccaatcccggttttatgacttgtagtgatgacttccgggcacgattttggtatcgtagatcaactaccgactag

SEQ ID NO: 245691 - DNA, 621 bp, Artificial Sequence
  Description of Artificial Sequence: Synthetic coding sequence
atggacagcgccggacaggacatcaacctcaattccccgaataagggactactcagcgacagcatgaccgacgtgcctgttgatactggcgtggcggcacgaacgcccgcagtcgagggcctgaccgaggccgaagaggaggagttacgcgctgagttaaccaaagtggaggaggaaatagtaaccttacgccaagtcctagccgcaaaggagaggcattgcggcgagctgaaaagaaggttaggcctcagcactctcggcgagctcaaacagaatctttctaggagctggcatgatgtccaggtgtccagcgcgtatgtgaagaccagtgagaaattgggagaatggaacgaaaaagtgactcagtctgatctttacaagaaaacacaggaaacgctcagccaggccggtcagaagacttccgcagcactgagtaccgtagggtctgccatctcaaggaagctcggagatatgcggaacagcgccaccttcaagtcgttcgaggatcgggtaggaactattaaaagcaaagtggtgggtgaccgcgagaatggtagcgataacctgccttcgagcgctggcagcggtgataagccgctctccgatccagctcccttctag

SEQ ID NO: 245692 - DNA, 561 bp, Artificial Sequence
  Description of Artificial Sequence: Synthetic coding sequence
atggactctgccggtcaggacatcaacctcaatagcccaaacaagggacttctgtccgactctatgactgacgttcctgttgatactggagtggctgcccgtacccctgctgtggaagggctgacagaagccgaggaggaggagctgagagccgagttaacaaaggtggaagaggagattgtaaccctccgacaagttctagctgctaaggagcgtcactgtggggagttgaagagaagattaggactgtcaacgctcggcgagctcaagcagaatctgtcccggagctggcacgacgttcaggtcagttccgcctataagaagacccaggaaactctcagccaagctggccagaagacgtcagccgcattaagtactgtcggatccgccattagcaggaagctgggtgacatgcgtaacagcgccacctttaaaagcttcgaggatagggtgggcactattaagagcaaagtcgtcggtgaccgtgagaacggaagtgataatctgccaagtagtgctggttcaggggataagcccttgagcgatcccgctcccttttag

SEQ ID NO: 245693 - DNA, 630 bp, Artificial Sequence
  Description of Artificial Sequence: Synthetic coding sequence
atggattccgccggacaagacatcaaccttaactcccctaacaagggactgctctccgattcaatgacagacgtccccgtcgataccggagtcgccgctagaacccccgctgtggaaggactgacggaggcagaagaagaagaactcagagcagagctgacaaaggtagaagaggaaatcgtgacactcaggcaggtccttgctgcaaaggagcgccactgcggagagctaaagcgccgtctgggcctatccacactcggtgagcttaagcagaatctttctcgtagctggcacgatgtgcaggtgtcttctgcctataaaaagacccaagagacgctaagtcaggccggacagaagacaagcgccgcactgtccaccgtgggtagcgcaatctctagaaagttgggtgatatgcgtgcacatcctttctcacatagcttctccagttacagcattcggcacagcatctctatgcccgcaatgcgcaacagcgccacttttaagtcgttcgaggaccgtgtgggaacgatcaagagtaaggtagtgggcgatcgagagaacggctccgataacctcccctcgtcggcagggagtggggacaaacctctctctgaccctgccccattctag

SEQ ID NO: 245694 - DNA, 663 bp, Artificial Sequence
  Description of Artificial Sequence: Synthetic coding sequence
atggactccgctggtcaggacataaacctcaactctccaaacaagggcctgctttcagacagcatgacagacgttcccgtggacaccggcgtggccgcacgtacgcctgccgtggaaggactaactgaagcagaggaggaagagctgcgtgcagagttgaccaaagtggaggaggagattgtgaccctccggcaggtgctcgcagctaaagagaggcactgcggcgaactcaagaggcggctgggattgtccacattgggtgagctgaaacagaacttgagccgatcctggcacgacgttcaggtgagcagcgcttacgtgaaaactagtgaaaagctgggggagtggaacgagaaagtcacacaaagcgacttgtacaaaaagacccaggagaccttaagccaggccggtcaaaaaacatccgcagccctcagcaccgttgggtctgctatcagtagaaagctgggcgatatgagctcctatagcatcagacattctatcagtatgcccgctatgaggaattcggccacttttaagagctttgaggacagggtgggtaccattaagagcaaggttgtgggggaccgagaaaatgggagcgataatttgccatcttctgccggttccggcgacaagcccctgagcgatcctgcccctttttag

SEQ ID NO: 245695 - DNA, 603 bp, Artificial Sequence
  Description of Artificial Sequence: Synthetic coding sequence
atggactccgccggtcaggacatcaacctaaatagccccaacaagggtctgctgtcggattctatgacggacgtgcccgtggataccggcgtggcggctagaacacctgccgtggaagggcttactgaagctgaggaggaggagcttagagccgaactgacaaaggtggaggaggaaatcgtgacccttcgacaggtgcttgcggcaaaagaaagacattgtggcgagttaaagagacgcctgggcttgagcaccttgggggaactcaaacagaacctaagccgctcttggcatgatgtgcaagtttctagtgcttacaaaaagacccaggagacactgagtcaagctgggcagaagacatccgcagccctttccaccgtggggtccgctatatcccgcaaactgggagatatgtcttcttatagtattcggcattccatctccatgccagcaatgcggaacagtgctacctttaaaagcttcgaggaccgggtgggtactattaagagtaaggtggtcggtgaccgcgagaacggcagtgacaatttgccttcttctgccggatcgggtgataagccactgtcagaccctgcacccttttag

SEQ ID NO: 245696 - DNA, 492 bp, Artificial Sequence
  Description of Artificial Sequence: Synthetic coding sequence
atggactccgccggacagggcgtggcagcccgaacccccgctgtagaaggacttaccgaggccgaggaagaagaattacgagctgagcttaccaaggtcgaggaagaaatcgtgactctgaggcaggtgctggcagctaaagagagacattgtggcgagctgaaacgcaggctgggacttagtacactcggggagctcaagcagaacttaagcaggtcttggcacgatgtccaagttagcagtgcctacaagaagacccaggaaaccctctcacaagccggacagaagacttccgctgcactctcaaccgtgggcagcgcaatcagcaggaagttgggggacatgcggaacagtgcgacattcaagtcattcgaagaccgcgtgggcaccattaagtccaaggtcgtgggagatcgcgagaatggaagtgacaacttgcctagtagtgccggatccggcgacaaacctttatcagatccagcaccattctag

SEQ ID NO: 245697 - DNA, 3405 bp, Artificial Sequence
  Description of Artificial Sequence: Synthetic coding sequence
atgaggttcgggagcaaaatgatgccgatgtttctcactgtgtacttgtccaacaacgaacagcacttcacagaagttccagtcactcccgaaacaatttgtagggatgtggtcgatctgtgcaaggaacccggagagtcggattgccacttggctgaagtctggtgcgggtccgagagaccagtggccgataacgagaggatgtttgatgtgttacagaggtttggaagtcagcgtaatgaggttcgattcttcttgcgtcacgagcgtccacctggacgtgacattgtgagtgggcctcgctctcaggatcctagtctgaagagaaatggagttaaggtccccggagagtatagacggaaagaaaatggagtgaattcaccgagaatggacttaactctcgctgagctgcaagaaatggcgagccggcaacaacagcagatcgaagctcagcaacagctattggccacgaaggaacaaagactgaagttcttgaagcagcaagaccagcgacaacagcaacaagtcgccgaacaggagaagctgaagaggctgaaggaaatcgccgagaaccaggaggcgaaattaaaaaaggttagagctctcaaagggcatgttgagcaaaagagactgtccaatggaaagcttgtagaggagatcgaacagatgaataacttatttcagcaaaaacagcgggaattagtgttggcggtgtcaaaggtggaggagctcacaaggcagcttgaaatgctcaagaacggtcgtatagactctcaccacgataaccagtctgcggttgctgaactcgatcggctgtacaaggagctacaactcagaaataaactcaaccaagagcagaacgccaagcttcagcaacagcgcgaatgtctgaacaaacggaactccgaggtagctgttatggataagcgagttaatgagctcagagaccgtctatggaaaaaaaaggccgctctccagcagaaggagaatcttcctgtgtcttccgatggcaatctaccccagcaggcagcttcggcaccaagccgtgttgctgccgtcggaccatacatccaaagctcgactatgccacggatgccgtctaggcctgagctgttagtgaagcctgctttgccagacggcagtttagtaatccaggcatcggaaggtcccatgaagatccagaccctccctaatatgcgttcgggagccgcttctcagactaaggggtctaaaattcaccccgtgggacctgactggtctccaagtaatgcggatctgttcccatctcaggggtcagcctctgtgccccaaagcactggtaatgccttggatcaggttgatgatggcgaggtacccctgcgcgagaaggaaaagaaggtgcggccattctcaatgtttgacgccgttgaccagtccaacgccccaccgtccttcggcactcttcggaagaatcagtctagtgaagatatcctgcgcgacgctcaggtggccaacaagaatgtagctaaggtgccaccgccagtgcccactaaacccaaacagattaacttgccatacttcgggcaaacaaaccagccaccttctgatattaagcccgacggctcttcccaacagctgtcaactgttgtgccatctatgggcacaaagccgaaaccggctggacagcaacccagggtcctactgagcccctctatcccttcagtgggccaggaccagaccctctctcctggaagcaaacaggagtcacctccagcagcagccgtcaggccttttaccccacagccatccaaagataccttactcccgccattccgcaaaccgcagacagtagctgcgagctcgatctattccatgtatacacagcagcaggctcccggtaagaacttccagcaggccgtccaatctgccctgactaagacgcatacacgcggaccacatttctcatccgtctacggaaaacccgtaatagccgcagctcagaatcagcagcagcacccggaaaacatctattccaatagtcagggcaaacccggaagcccggagcctgaaaccgaacccgtgtctagcgtgcaggagaatcacgaaaacgagagaattcccagacctttatcacccactaagcttcttccgtttctcagcaacccttatcgtaaccaaagcgatgccgatctggaagccctcaggaagaagctgtcaaacgccccacggcctcttaagaaacggagtagcataacggaaccagaaggcccaaacgggcctaacatccagaaacttctgtaccaacgtacaaccatcgcggcaatggaaacaatttcggtgccttcatatccctcaaaatcagccagtgtcaccgctagcagcgagtctcccgttgaaattcaaaatccgtatcttcatgtggaaccagaaaaggaagtagtgtctctagtgcccgagagtttatcccccgaggatgtgggcaacgcttctaccgagaattctgatatgccggctccaagtcccggactcgactatgagccagaaggagtaccggacaatagtccaaacctacagaacaatcccgaagagcccaatcccgaagctccacatgttctcgatgtgtacctcgaggagtatccaccttacccaccccctccgtatccaagcggcgaacccgagggccctggcgaggactccgtgagtatgaggccaccagagattacagggcaggtatcgcttcctccaggaaaacgcacaaacctaagaaaaactggtagcgaaaggattgcccacggcatgagagttaagttcaatccactggcgctcttactcgattctagcttagagggcgagtttgatctggtgcagcgtatcatctacgaagtggatgacccgtcactcccgaacgacgaaggtataaccgcgctacataacgcagtgtgtgccggtcatacggaaatcgtgaagttcctggtgcaatttggtgtcaatgtaaatgccgctgactccgacgggtggacaccacttcattgcgcagctagctgtaacaatgtgcaggtatgcaagttccttgtggaatcaggggcagcagtatttgcaatgacctatagcgacatgcagactgcagccgataaatgcgaagagatggaagaaggctacacccaatgctcccagttcctctacggtgtccaggaaaagatgggcataatgaataagggggtgatctacgctctgtgggactatgaaccacagaacgatgacgagctccccatgaaagaaggggattgtatgaccattatccatagggaagatgaagacgagatcgagtggtggtgggcccgactcaacgacaaggagggctacgtgccacggaacctcctcggactctatccgcgtatcaagcccagacaacggagcttagcttag

SEQ ID NO: 245698 - DNA, 3018 bp, Artificial Sequence
  Description of Artificial Sequence: Synthetic coding sequence
atggacctgactctggctgagcttcaggagatggcgagccgacagcagcagcaaatcgaggcccaacagcagttgttggctaccaaggaacagagacttaaattcttaaaacagcaggaccagagacaacagcagcaagttgcagaacaagaaaagcttaagaggctcaaggaaattgccgagaatcaagaggcaaaattaaagaaagttcgcgcactcaaaggccacgtggaacaaaaaagactgtcgaatggcaaactggtagaagaaatcgagcaaatgaataatctcttccagcagaagcagagagagctggtgcttgcagtgtccaaagtcgaagagttgaccagacagctggaaatgctcaaaaatggccgtattgattcccaccacgacaaccaatctgccgtcgccgagttggatcgactctataaggagctccagctgcgcaataaactcaaccaggaacaaaatgcgaaactgcaacaacagcgtgagtgtcttaataaacgcaacagcgaggttgccgtcatggacaagcgtgtgaacgagctacgtgaccgcctctggaagaaaaaggccgctctgcaacagaaggaaaacctgcctgtatcaagtgacggtaaccttccccagcaggccgcatctgctccttcacgcgtggctgctgtgggaccatacatccagagctcaacgatgccgcgaatgccatctcggcctgaactcctggtgaagcccgcactgcctgacgggagcctggtcatccaagcaagtgagggtcctatgaagatacaaacacttcccaatatgaggtctggagcagctagccaaacaaagggtagcaagatccaccccgtgggcccagactggagcccctcgaacgccgacttgtttcccagccaaggctctgcttcggtgccacagtccacaggcaacgcgcttgaccaggttgatgacggggaggtgccgcttcgggaaaaagagaagaaagttagacctttttcaatgttcgacgccgttgaccaatctaacgcaccgccttccttcggaactctccggaaaaaccaaagttctgaggacatcctgcgtgacgcacaggtggcaaataagaacgttgccaaagtgccaccacctgtgcctaccaagccaaaacagatcaacctgccttattttgggcagacaaatcagccgcctagtgacattaaaccggacggcagctcccaacagctctccacagtcgtgccatctatgggaaccaaaccaaaacctgcgggtcagcagccgagagttctgttgagtcctagcatccccagcgtgggccaagatcagacattgagccccggatcgaaacaagagtctccccctgccgctgccgtgagacccttcacaccgcagccctcaaaagatactttactgccccctttccgaaaaccccagactgtggcagccagttcaatctattcgatgtacacccagcagcaggctcccggtaagaacttccagcaggccgtgcaaagtgcactaactaagacacatacccgtgggcctcacttttcaagtgtgtacggcaaacccgttatagccgctgcccagaatcagcagcagcatcctgagaacatctattcaaacagccagggcaaacctgggagtcccgagccagagaccgaacctgtttcaagcgtacaagagaaccacgagaatgaaaggattcctagacccctgagcccaactaagttacttcccttcctatctaatccataccgcaaccagtcagacgctgacctggaggcattgaggaaaaaactgtctaacgccccacgcccacttaaaaaaagatcaagcattactgaacctgaaggtcccaatggaccgaacattcaaaaactcctctatcagagaactacgatagccgctatggagaccatcagcgtcccttcataccccagcaaatccgcctcagtcacggctagctctgaatcccctgtagagattcagaatccatacctccatgtggagcccgagaaggaggtagtttctttggttcccgagtctttatcccccgaagacgtaggcaatgcgtcaaccgagaattccgacatgcctgccccatcccctgggctggactacgagcctgaaggagtccccgataactccccgaatctccaaaataaccctgaggaaccaaatcccgaggcccctcatgttttggatgtatacctggaggagtacccaccttatcctcctccgccatatccctctggagaacctgaggggcctggagaagatagtgtctctatgcgcccacctgagatcaccggtcaggtgtccctgccgcctggcaaacggaccaacctgcgaaagaccggttctgagcgaatagcccacggcatgagagtgaagttcaatcctttagccctcctgctggatagcagccttgaaggggaattcgatctcgtccagagaatcatttatgaggtggatgacccttcactccctaacgacgaggggataaccgcgctgcataacgcagtctgcgcaggccatacagagatcgttaagtttctagttcagttcggtgtgaatgtgaatgccgctgactcagatggttggacgccactgcactgtgccgcaagctgtaataatgtgcaggtgtgcaaatttctggtggagtcgggcgcagccgtgtttgccatgacctacagcgatatgcagacagcagctgacaaatgtgaagaaatggaggaggggtacacccagtgcagccagttcctttacggggtgcaggagaaaatgggaataatgaacaaaggggttatttacgctctgtgggattatgaacctcaaaatgacgacgagctgcctatgaaagagggcgactgcatgacaataatccatagggaggatgaggatgaaatcgagtggtggtgggctcgtctcaacgacaaggaaggatacgtaccaagaaacttactcggactgtaccctcgcattaaaccaaggcagagatccctcgcatag

SEQ ID NO: 245699 - DNA, 1104 bp, Artificial Sequence
  Description of Artificial Sequence: Synthetic coding sequence
atggaaacaatcagcgtgccatcctacccaagtaaaagcgctagcgtgaccgcctccagtgagagcccggtggaaatccagaacccttatcttcacgtagaaccagaaaaggaggtagtgtcactggtgcccgaaagtctcagccccgaagatgtgggtaatgcctccacagagaacagtgacatgccagctccctcccccggtctggactacgagccagagggggtccccgataactcacccaatctccagaataaccctgaggagcctaaccctgaggcccctcacgtcctcgacgtttatcttgaagaataccccccttaccctccacccccataccccagcggagagcccgaaggaccaggcgaggactcagtgagcatgaggcccccagagattactggacaggtgtctcttcccccaggaaaaaggactaatctaaggaagacgggcagcgagaggatagcccacgggatgagggttaagttcaaccctctggccctcctcctcgacagcagcctcgagggggagttcgacttagtgcagagaatcatctatgaagtagatgatcccagcctgccgaacgatgagggaatcactgccctccacaatgccgtatgcgccggacacactgagattgtgaaattcctggtgcagttcggggtgaacgtcaacgctgccgattccgatggttggacacccctccattgtgcagcaagctgcaacaatgtgcaggtgtgtaaattcctggttgaatctggggcagctgtgttcgcaatgacctattctgacatgcagactgccgctgacaagtgcgaggaaatggaggagggatacacccagtgtagtcagttcctatatggcgtgcaggaaaaaatgggcatcatgaacaagggtgtaatctacgcactgtgggattatgagccgcaaaatgatgatgaattgccaatgaaggaaggtgattgcatgaccatcatccaccgcgaggacgaagatgagattgagtggtggtgggccaggctgaatgacaaagagggatatgtacctcggaacctattggggctgtaccccaggattaagccaaggcagcgctcccttgcatag

SEQ ID NO: 245700 - DNA, 2043 bp, Artificial Sequence
  Description of Artificial Sequence: Synthetic coding sequence
atgaacttcgagacatcaagatgtgctacgcttcaatactgccccgacccgtacatccagagattcgtagagaccccagcccattttagctggaaggagtcctactatcggtccacaatgagccagtctactcaaacaaatgagttcttaagtccagaagtattccaacatatttgggactttctcgaacagcccatttgcagcgtgcagccaatcgaccttaatttcgtcgacgagccatctgaagatggggctactaataagatcgaaatttctatggactgcatcaggatgcaggacagcgacctgtctgatccaatgtggccccagtacactaaccttgggctgctgaattctatggaccaacaaatacagaacggcagcagcagcaccagcccctataataccgatcacgcacagaatagcgtgaccgctccaagtccctacgcacagccctcgagcactttcgatgccctcagccccagccccgctataccctctaacactgattacccaggaccgcatagtttcgatgtttcttttcagcagagcagcaccgcaaagtcagccacctggacatactccaccgagttaaaaaagctgtactgtcagatcgctaaaacttgccctatccagatcaaagtaatgactccgccaccccagggcgcagtaattagagccatgcctgtgtacaagaaggcagagcacgtgactgaggtggttaagaggtgtccgaaccacgagctcagccgggaatttaatgagggacagattgctccgccaagccatcttattcgggttgagggtaactcacacgctcagtacgttgaagatcccataaccggtcgccagtccgtcctggttccatacgagcccccacaagtgggcaccgagttcaccaccgtactgtataattttatgtgcaactcttcctgcgttggtggtatgaatcgcagacccatcctcataattgtcaccctggagacgcgagacgggcaggtgctggggagaaggtgtttcgaagctcgcatctgcgcctgcccgggtcgggatagaaaggccgatgaagacagcatacggaagcaacaggtctccgactctacgaagaacggagacggcacaaagagaccctttcgccaaaatactcacggcatccagatgacatccatcaagaaacgcagatcgcccgatgacgaattgctctacctgccggtcagaggccgtgagacctacgaaatgcttttgaagattaaagagtcactagaactgatgcaatatctacctcagcacacaattgagacctacaggcagcagcagcaacagcagcatcagcacctgctgcagaaacagacatctattcagtcaccctcatcgtacgggaacagttcacctcccctcaataaaatgaattccatgaacaaactaccctccgtttcccagttaattaacccacagcaacggaatgctctcacgcctaccaccatccctgacggaatgggcgctaatattcccatgatggggacacacatgccaatggcaggcgatatgaatggcctgtcccctacgcaagccctccctccaccgctgagcatgccgagcacttcccattgtacaccacctcccccttacccgactgattgtagtatagttagcttcctcgccagactgggctgtagcagttgcctagactatttcaccacccaaggtctgaccacgatctaccagatcgagcactattccatggatgatctggcttccctgaaaattcctgaacagttcaggcacgctatatggaaaggtattctcgatcacagacaactgcacgaattttctagcccctctcacctgctgcgaacgccctcatcagccagcactgtaagcgtaggttcctcggagacgcgcggagaacgggtaattgacgctgtccggttcacactgcgacagacaatctcctttccaccgagagatgaatggaatgatttcaacttcgatatggacgctcgaagaaataaacagcagagaatcaaagaggaaggcgaatag

SEQ ID NO: 245701 - DNA, 1533 bp, Artificial Sequence
  Description of Artificial Sequence: Synthetic coding sequence
atgaattttgagacttcaaggtgcgctacactccagtattgtccggacccttatatccaaaggtttgtggaaactcccgctcatttcagctggaaggagagctattatcgttcgactatgagccagtccactcagacaaatgagttcctttctcccgaagttttccagcacatctgggatttcctagagcaaccaatctgctctgtgcagccgatcgatttgaattttgttgacgagccaagcgaagatggcgcaactaataagatagagattagtatggattgtatccggatgcaggacagcgacctttccgacccaatgtggcctcagtatacaaacctcggactactgaatagtatggaccagcagattcagaatggctcttcatccacatcaccgtacaacactgatcatgctcagaactccgtgaccgcccctagtccgtatgcccagcccagctcaacctttgacgccctttccccttccccggcaatcccctcaaacaccgactatcccggtcctcattccttcgacgtcagcttccagcagagcagtacggccaaatctgccacctggacttattcaaccgagctaaagaagctgtactgccagattgcaaagacatgcccgatccagatcaaggtcatgacgccaccccctcagggtgctgtgattagagcgatgccagtgtacaagaaggcagagcatgtcacggaggttgtaaagcgctgtccaaaccacgagctgtctcgggaatttaatgagggccagattgctcctccttctcatctcattagagtcgaggggaacagccacgcccagtacgtcgaagaccccatcacgggcaggcagtccgtgctggtgccatacgaaccaccacaagtgggaactgagtttaccacagtgctgtataactttatgtgtaactcttcctgtgtgggcggaatgaacaggagaccgattctgataatagtgaccctagagaccagggatggccaagtgctcggccgtcggtgttttgaggcccgtatctgtgcatgccccggtcgggatcggaaagctgacgaagatagcatccggaagcagcaagtttccgacagtactaaaaatggcgacgggacaaagagaccttttagacagaatacacatggcatacaaatgacctccatcaagaagaggcgatcgccagacgatgagttgctttatctgccagtgcggggaagggaaacctatgagatgttgttgaagataaaggagagcctggaactgatgcagtatctgcctcagcacactatcgagacataccgtcagcagcaacagcagcaacaccagcatctgttgcaaaagcagacctcaatacagagccccagtagctatggcaatagcagcccacctcttaacaaaatgaacagtatgaataagctcccttccgtgagtcagctaatcaatccccaacagagaaatgcattgacccctaccaccataccagacgggatgggggctaacaggagtggaaagtctgaaaatccatag

SEQ ID NO: 245702 - DNA, 1761 bp, Artificial Sequence
  Description of Artificial Sequence: Synthetic coding sequence
atgttatatctggagaataacgctcagacacagttcagcgagcctcagtatacaaacctgggactgctaaactcaatggatcagcagatccagaatggctcttcttccacatccccctataacaccgaccacgcccaaaactcggtcacagctccgtctccttacgcccagccatcatccactttcgatgcgctgagcccctcccctgctatcccctccaacactgattaccctggacctcatagctttgatgtgtcattccagcaatcttccaccgcgaagagcgccacctggacttacagcacggaacttaaaaaactttactgccagatagccaaaacttgccctattcagattaaggtgatgactcctccacctcaaggagccgtcattcgcgcaatgccggtatacaagaaagccgagcatgtgaccgaagtggtgaagaggtgcccaaatcatgagctgagccgggaatttaatgagggccagatcgccccaccaagccacttgatacgtgtcgaaggcaatagccacgcgcagtatgtggaagacccaatcacagggcgtcagagcgtactcgtaccttacgaacctccacaggtcggaaccgaatttacaaccgttttatataactttatgtgcaatagctcttgtgtgggcggaatgaatcgcagacccattttaataattgtgactctggagactcgcgacggccaggtgctgggtcgcaggtgttttgaagcacgcatttgtgcgtgcccgggacgggaccggaaagccgatgaggatagcatcagaaagcagcaagtgagcgacagtacaaagaatggtgacggtactaaaaggcctttccggcagaatacccatgggattcagatgacttccattaagaagcgacgcagtcccgacgatgaattgctctatttgcctgtgcggggaagggagacatacgaaatgctgttgaagatcaaagaaagcctcgagctcatgcagtacctgccccagcacaccatcgaaacatatagacagcagcagcagcagcagcatcagcacttgctacagaagcagacgagcatacagagccctagcagttatggcaattcctcgccaccgctgaataaaatgaattccatgaacaagctcccctcagttagccaattgattaaccctcaacagaggaatgcccttacccctacaacgatccccgatgggatgggagcaaacattcccatgatgggcacacatatgcccatggccggagatatgaatgggctcagccccacccaagccctccccccacccctgagcatgccttctacttcccattgcacaccccctcccccataccctactgactgcagcatcgtcagcttcctggcccgactgggatgttcctcctgtctcgactactttactacgcaaggcctgacgacaatataccagattgagcactattcaatggacgacttggcttctctcaagattcccgaacaatttcggcacgcaatatggaaagggatcctggaccataggcagttgcacgagttcagctcgcctagccacttacttagaacaccttcctcagcgtcaactgtttcagtcggctcatcggagaccagaggtgagcgcgtcatagacgcagtccgattcacactgcggcagaccattagctttccgccaagggatgagtggaacgattttaatttcgacatggacgctcggaggaacaagcagcagaggatcaaggaggagggcgagtag

SEQ ID NO: 245703 - DNA, 1788 bp, Artificial Sequence
  Description of Artificial Sequence: Synthetic coding sequence
atgaacttcgaaacctctcgctgcgccactttgcaatattgtccagacccctacattcagcgcttcgtggagacacccgctcacttctcttggaaggagtcctattacagatcaactatgtcccagtcaacccagaccaatgaatttctgtctccagaggtgtttcaacatatttgggactttctcgaacagcccatatgttcagttcagcctattgacctgaattttgtcgacgagccatctgaggatggagccacaaataagatcgagatctcaatggactgcatccggatgcaggattcggatctcagcgaccctatgtggtactcgactgaactaaagaaattatactgccagattgccaagacttgccccatacagattaaggtcatgacacccccacctcaaggggcagttataagggctatgcccgtatacaaaaaggctgaacatgtgaccgaggtcgtaaagaggtgtccgaaccacgaactctcccgggagttcaatgaaggacagattgctccccctagccaccttatccgcgtggaaggcaactcgcatgcccagtatgttgaagatcctatcacagggaggcaaagtgttcttgtaccttacgagccgcctcaggtcggtaccgagttcactactgtcctttacaactttatgtgcaatagttcttgcgttggcggaatgaaccggaggcccatcttaatcatcgtgaccctcgagacgagggacggacaggttctgggacgacggtgcttcgaagccaggatctgcgcatgccccggtagagatagaaaggccgatgaggactcgattcgaaaacaacaggtgagtgactccaccaagaatggggatgggacaaagcggccttttcggcagaacacacacggtatacagatgaccagtatcaaaaagaggcgatcccccgacgatgaactgttatatctgccagtgcggggtagagagacatacgaaatgttgctgaaaatcaaagaatctctggaacttatgcagtatcttccccagcatacaatcgagacatatcgacagcagcagcagcagcagcatcagcatctgttgcaaaagcaaaccagcattcagtccccatctagttacggaaacagcagcccacctctgaacaagatgaactcaatgaacaaattaccgtctgtgagccagttgataaacccccagcagcggaacgccttgacccctaccactattccagatgggatgggcgcaaacattcccatgatgggcactcacatgccaatggccggtgatatgaacggcctctcccccacacaggctctgccacctcccctctccatgccctctacgagtcattgtacccctcccccaccgtacccaacggattgctccattgtgagtttcttagcacgcttggggtgtagcagttgtctcgactactttaccacccaagggctgacaacaatctaccaaattgaacattattctatggacgatttagcttccttgaagattcctgagcagttccgacatgccatctggaaaggaattcttgatcaccgacaactgcacgaattttccagcccctctcatcttctgcggacccctagcagtgcatcaactgtgtctgtgggctccagtgaaacacggggtgaacgggtcatagacgccgtccggttcactcttcgccagaccatctcatttccccctagggacgaatggaacgactttaatttcgacatggatgcccgaagaaataagcagcaaagaattaaggaagagggggagtag

SEQ ID NO: 245704 - DNA, 1668 bp, Artificial Sequence
  Description of Artificial Sequence: Synthetic coding sequence
atgaatttcgagactagccggtgcgccactctgcagtattgccccgacccttatatccagcggttcgttgagacccctgcacatttttcctggaaagagtcctactataggagtacaatgtcccagagtacacagaccaacgaattccttagccctgaagtctttcagcacatctgggacttcctggaacaacctatctgctctgttcaacctatcgaccttaatttcgtcgatgagccgagcgaagatggcgcaaccaataagattgagatatcaatggactgcattaggatgcaggatagcgacctcagcgacccaatgtggccccagtacactaatctggggctgctcaacagcatggaccagcagatccagaacggaagtagcagcacaagtccatacaatacggaccatgcccagaactcggtcactgcaccttccccctacgcgcagccgtctagtaccttcgacgctctgagccccagtccagctatcccctccaacaccgactatcctgggcctcactccttcgacgtgtcgtttcagcaatccagcactgcaaaaagtgcgacatggacttacagcacagaacttaagaaactatattgtcagatcgcgaaaacgtgtcccatccaaattaaggttatgacccctccccctcagggagccgtaattcgcgctatgcctgtctacaagaaggctgagcacgttaccgaggtggttaaacgctgcccaaatcacgaactgtcgcgagagtttaacgagggccagatcgctcccccaagccacctaatccgtgtcgaggggaactctcacgcccaatacgtcgaggaccccataactggccgacagtcggtactggtcccttacgaaccacctcaagtgggtacagaattcacgacggtgctctataacttcatgtgcaattcatcttgcgtgggtgggatgaaccgaagaccgattcttataatcgttactctcgagactcgggacggccaagtgctaggacgccgatgcttcgaggccagaatctgcgcctgcccaggacgcgacaggaaagctgacgaggacagtatcaggaaacaacaggtgtcggattcaactaaaaatggggatggtacaaagcgaccttttcgacagaatacccacgggatccagatgacttccatcaagaaacggagatctcccgatgatgaactgctctatttgcccgtgcgcggacgagagacttatgagatgctcctaaagataaaagaaagccttgagttgatgcagtacttaccccaacacacaattgagacgtatcggcagcaacagcagcagcagcaccagcacttactgcagaaacagaccagcattcagtccccatcgtcttatggtaactcctcccccccactgaataaaatgaatagcatgaataagttgccaagtgtgtctcagcttattaacccccagcagcgaaacgcacttacgccaaccacaatccccgacggtatgggagctaatattccaatgatgggaacgcatatgcctatggccggtgatatgaacggcctcagccctacacaagctctgccaccacctctgagcatgcccagtacatcccattgcacaccgccaccaccataccctacagattgttctatcgtccggatctggcaggtctag

SEQ ID NO: 245705 - DNA, 1251 bp, Artificial Sequence
  Description of Artificial Sequence: Synthetic coding sequence
atgctatacttggaaaacaatgctcaaacacagttctctgagcctcaatatacaaacctgggcttgttaaattcgatggatcagcagattcagaacgggagttcctcaacatcaccttacaatactgaccacgcacagaattctgtcacagccccatccccatatgcacagccttcgagcactttcgacgccctgagtccttcccccgctatcccctcaaatacagattaccctgggccacattccttcgacgtgtccttccagcagagcagcaccgcaaagagcgcaacatggacctattctactgagttaaagaagctgtactgccagatcgcaaagacctgcccaatccagattaaggtgatgacccctcctccccagggggcagtgatccgcgcaatgcccgtgtataaaaaagcagagcacgtcaccgaagtggtgaaaaggtgtccaaatcacgagttgagcagggagttcaacgaaggacagatcgcgccacccagccacctgattagagtagaggggaattctcatgcacagtatgtcgaagatccaatcacaggtagacaatcagtgctggtgccgtacgagccccctcaagtggggaccgagtttaccacagtcctgtataactttatgtgcaactccagctgcgtcggaggaatgaacagacggccaattcttatcatcgtcacccttgagaccagggacggccaggtgttaggccgaaggtgtttcgaggctcgcatttgtgcctgtccagggagggacagaaaagcggacgaggattccatccgaaagcaacaggtatcagattctactaaaaatggggatggtaccaagagaccatttcgccagaacacccacggtatccagatgacaagtatcaaaaaacgcagaagcccagatgacgagctcttgtacctgccagtgagaggcagggagacatatgaaatgttgttgaaaattaaggaaagcctcgaactgatgcagtacctcccacagcatacaatcgagacttacagacaacagcagcaacagcaacaccagcacctcttacagaaacagactagcattcagtcaccatccagttacggcaattcatcacctcctctcaataaaatgaattccatgaataaactcccaagcgtatcccagctgatcaatccgcagcagaggaatgctctgacccccaccaccatccccgatgggatgggcgctaacaggagcggtaagtcagaaaacccttag

SEQ ID NO: 245706 - DNA, 1386 bp, Artificial Sequence
  Description of Artificial Sequence: Synthetic coding sequence
atgctgtatctcgagaacaacgcacagactcagtttagcgagccacagtacacaaacttggggctgcttaatagtatggatcagcagatccagaacggctcctcctcaaccagtccctacaacaccgaccacgcccagaactccgtgacagccccatctccttatgcgcagcctagtagtacgttcgatgcactatctccttctccagccatcccgtcaaatacggactatcccggacctcactcatttgacgtttcttttcagcaatctagcacagcaaagagcgctacgtggacttattccacagagctgaagaaactgtactgtcaaattgctaaaacatgccctatccagattaaggtgatgaccccaccaccccaaggagcagttatccgagcaatgcctgtttacaagaaggccgagcacgtgaccgaggtagtgaaaaggtgtcccaatcacgagctgtccagggaattcaacgaaggccagatagcccctcccagccaccttatcagggttgagggaaattctcacgcacagtatgtagaggatccaattacaggacgccaatcggtcctagtaccgtacgagcctccccaggtaggtactgagtttaccaccgttctgtacaactttatgtgtaacagttcatgcgtcggaggcatgaatcggcgtccaatactgattattgtgaccttggagaccagagacggccaggtcctcggaaggcggtgttttgaggcaagaatctgtgcttgccccggaagggacagaaaggccgatgaagactctatcagaaagcagcaggtgtcggattccacaaaaaacggcgacggcaccaaacgacctttccgtcagaacacgcacgggatccagatgacatctatcaaaaagaggcgcagccccgatgatgagctgctgtatctccctgtcagggggagggagacatatgagatgcttctaaagataaaggaatcactcgaactgatgcaatatctcccccaacacacaatagaaacctataggcagcagcagcagcagcaacaccagcatctactgcagaagcaaacaagcatacaaagtccctcctcttacgggaatagcagcccccctctgaataaaatgaatagcatgaacaagttaccatcagtttcgcagctgattaaccctcaacagcgtaacgcgctcacacccacaactattcccgacgggatgggcgcaaacatccccatgatggggacacacatgccgatggccggagatatgaatggtctgtcaccaacacaggccctacctcctccactgtctatgccatctacatctcactgtactccaccacccccttatcctaccgactgtagtatcgtgcgtatttggcaggtctag

SEQ ID NO: 245707 - DNA, 1464 bp, Artificial Sequence
  Description of Artificial Sequence: Synthetic coding sequence
atgaattttgaaaccagtcgatgtgccacgcttcaatactgtccagacccctatattcagcgcttcgtggaaacccccgcacactttagctggaaggagtcctattatcgttccaccatgtctcagtcaacacaaaccaatgagttcttgtcccccgaagttttccagcatatctgggacttccttgaacagcccatatgtagtgtgcagcctatagatctcaacttcgttgacgagccaagtgaagatggggcaaccaataagatcgaaatcagcatggattgtattcggatgcaggactccgacctgagcgatcctatgtggcctcagtataccaatcttggcctgctgaattccatggatcagcagatccaaaacgggtcctccagtacctccccatacaatactgaccatgcccagaattctgttacggcaccctccccttacgctcagcctagcagcacattcgacgcactctccccgagcccggctatcccttcaaacaccgactaccccggaccccattcttttgacgtttcgttccaacagtctagtactgccaaaagtgctacttggacatactctacagaactcaaaaaactttactgccaaattgccaaaacctgccccatccagataaaggttatgacaccacctccccagggggcagtgatccgtgcgatgcccgtttacaagaaggcagaacacgtcaccgaggtagttaaaaggtgcccaaatcacgaactgtcgcgcgagtttaatgaagggcagatcgcccctccttctcacctcatcagggtggaagggaactctcacgcacaatacgtcgaagatccgatcactggcagacagtccgtcctcgtaccctatgagccgcctcaggtgggcactgagttcacaacagtgttgtataacttcatgtgtaattcctcctgtgtgggagggatgaatcggaggccaatcctcattatcgtcaccctcgagacccgggatggtcaggtgctgggcaggcgctgtttcgaggctcgtatttgcgcctgtccaggccgagacaggaaggcagacgaggacagcattaggaagcagcaggtctccgacagcacgaaaaacggggacgggacaaagcgcccttttcgtcagaacacacacgggatccagatgacgtctattaaaaaaagaagaagcccagatgacgagttgctctacctgccagtgcggggtcgggagacgtacgaaatgctcctgaaaattaaagagtcattggagctcatgcagtacctgccccagcacaccattgagacatacagacagcagcagcagcagcagcaccagcacctgctgcaaaaacatttgttatcggcatgctttcggaacgagctggtagaaccaagacgcgagactcctaaacaaagtgatgtttttttccggcacagcaaaccaccaaaccgcagcgtgtacccttag

SEQ ID NO: 245708 - DNA, 1182 bp, Artificial Sequence
  Description of Artificial Sequence: Synthetic coding sequence
atgctgtatttagagaataacgctcaaacccagttctccgagcctcaatacactaacctcgggttattgaacagtatggaccagcagatccagaacggttccagtagtacgtcaccctacaataccgatcacgctcagaacagtgtcactgccccatctccctatgcacaaccttcctctacgttcgacgctttgtccccgtcccccgcaattccttctaatactgactatcccggtccacactcattcgatgtgtcttttcagcagtcttcaactgccaaaagtgctacttggacttacagcacagagctgaaaaagctgtattgtcagattgccaagacatgcccgatccaaattaaagtgatgacacctccgcctcagggagcagtgatccgcgcaatgccagtttataaaaaagcagaacacgtcacagaagtggtgaaaagatgtcctaatcatgagcttagccgggagtttaacgagggacagattgcaccccctagtcacctgataagggtcgagggcaactcacatgcccagtacgtcgaggacccaattactggccgtcaatccgtcctcgtgccctacgagcctcctcaggtggggacagaatttaccacggtcctctataacttcatgtgcaattcttcatgtgtgggcggaatgaatagacgtccgattctgatcatagtgacgttagagacccgagatggccaggtcctcggtcggcgttgctttgaagccaggatttgcgcctgcccgggaagagacagaaaggcagatgaggactcaatcagaaagcaacaggtgtctgatagtacaaagaacggcgatggaacgaagcgacccttccgccagaacacccacggaatacagatgaccagcatcaagaagcggaggtcccctgacgatgaactcctttacctgcccgtgagaggtagggaaacttacgagatgctcttaaagatcaaggagtctctggaactcatgcagtacttaccacagcacaccattgagacctataggcagcagcagcagcagcagcaccagcacctgctgcaaaagcatttattaagcgcctgcttcagaaacgagcttgttgagccacgccgagaaacaccaaagcagtctgacgtcttttttcggcattccaagccgccaaatagaagcgtgtatccttag

SEQ ID NO: 245709 - DNA, 2031 bp, Artificial Sequence
  Description of Artificial Sequence: Synthetic coding sequence
atgaatttcgaaacaagcaggtgtgctaccctccaatattgtccagatccttatattcagagatttgtggaaactccagcccactttagctggaaagagtcatattacagatccaccatgagccagtcaacccaaactaacgagtttctgtcgcccgaggtgtttcagcacatctgggatttcctggaacagcctatctgcagcgtgcagccaatcgacttgaattttgtagacgagccatcggaggatggggctacaaataaaattgaaatatccatggactgcatcagaatgcaggattccgacttgtcagatccaatgtggccccagtacaccaatctgggactgctcaatagcatggatcagcaaatccagaacgggtcctcttccaccagcccttataatacggatcatgctcagaacagtgtgaccgctcccagcccgtatgcccagccgagctctaccttcgatgccctgtcccccagcccagccattccgtccaatactgactatccgggacctcattcctttgatgtgtcctttcagcagagcagtacggccaagagcgctacctggacctactccactgagctcaaaaaattgtattgccagattgccaaaacctgccctatacagattaaagtcatgaccccacctcctcagggggctgtcatccgggctatgcctgtgtacaaaaaggcagagcacgtgaccgaagtggttaagcgttgtccaaatcacgagctgagccgagaattcaatgagggccagattgcacctccgagccaccttatcagagtggaggggaatagtcacgctcagtacgtggaagatcctattaccgggaggcagtccgtgctggtcccgtatgaaccacctcaggttggaaccgaatttacgacggtcttgtacaatttcatgtgcaatagtagctgtgttggaggaatgaatcgacgacccatacttataattgttaccctagagaccagggatggacaggtactggggagacgttgcttcgaggcaagaatttgcgcatgcccgggtcgggacagaaaggccgacgaggatagcatccggaaacagcaggtaagtgactcaactaagaatggtgatgcatttcgccagaatacgcatggcatccagatgactagtatcaagaagcgcagatccccagacgatgagctgttataccttccggtgaggggaagggagacatacgagatgcttctaaagatcaaagagagcctggagctcatgcagtacctaccccagcacactattgagacttacagacagcagcagcagcagcagcatcagcacctgctccagaaacagacatccattcagtctccttcctcctacggcaatagttcacccccactgaataagatgaactcaatgaacaagctacctagcgtgtcccaactcattaacccccagcagaggaacgcactcacccccaccaccattcctgacggcatgggggcaaacattccaatgatggggacccacatgcctatggccggagatatgaatggcttaagtcccacgcaagctttgccgccacccctgagcatgccttccacaagccactgcacgcccccacccccttacccaaccgattgctccatcgtgtcatttttggcacgtctgggatgctctagctgcctcgactactttacaacccaaggtttgacaaccatttatcaaatcgagcactactccatggatgacctcgcttctctgaagattcctgagcaattcagacacgccatctggaaaggcatcctggaccatcgtcagttacacgagttctcatctccctctcatcttctgcggaccccaagcagcgcctcaacagtcagtgtgggctcctctgaaacacgcggagaacgagttattgacgccgtgaggtttacactgagacaaacgatcagctttcctcccagagacgagtggaatgactttaactttgacatggacgccaggagaaataaacaacaacggatcaaagaggagggggagtag

SEQ ID NO: 245710 - DNA, 1506 bp, Artificial Sequence
  Description of Artificial Sequence: Synthetic coding sequence
atgctctatctggaaaataacgcgcagacccagttctccgagtattctactgaactgaaaaaactctactgtcaaattgctaaaacctgtccaatccagattaaagtgatgactcctccaccccagggcgctgtgattcgagctatgcccgtgtataagaaggcagaacacgttaccgaggtagtaaagcgctgtccaaaccatgaactgtctagggagttcaacgaggggcagatagcaccacccagccacctcataagggtggaaggaaatagccacgcccagtatgttgaagaccccattacaggacgccagtctgtgcttgtgccgtatgaaccccctcaggtcggcacggagttcactactgtgctgtataactttatgtgcaatagctcttgcgtcggaggaatgaatcgtcgccctattctgattattgtgacactcgaaacacgggatgggcaagtcctcggcagacgatgcttcgaggcgaggatctgcgcttgtcccggaagggatcgcaaggcggacgaggactccatcaggaagcaacaggtgtctgacagcactaaaaacggagacggaacaaagaggccgtttcgtcagaacactcatgggattcagatgacaagtataaagaagcgcagaagtcccgatgatgagctgctctatttgcccgtccggggacgcgaaacctacgagatgctgctgaagatcaaggaatctttggagctgatgcagtatcttccccaacacactattgagacctacagacaacagcagcagcagcagcatcagcaccttctgcagaagcagacttccatacagtctccatcatcctatggtaactcttctcctccactgaacaagatgaactccatgaacaaacttccaagtgtctctcaactcattaacccccagcagcggaatgccctgacccctactacaataccagacgggatgggtgccaacataccgatgatgggcacacatatgccaatggctggagacatgaacgggctcagtccaacgcaggccctgcccccaccccttagcatgccctccacatcccactgtacgccaccacctccctatcctacagactgctctattgtatctttcctggctagattaggctgcagctcatgcctcgactactttactacccaagggctgactacaatttaccagattgaacactacagtatggatgatctcgcctcattaaagattcccgaacagtttagacatgctatatggaaaggaatcctggaccatcgccagctccatgaattctccagtccatctcacctgctgagaacaccatcttcagccagcacagtgtcagtcggctcaagcgagacgcgtggagagagagtgatcgatgccgtgcgcttcacgcttcgacaaaccatctccttccccccaagggacgaatggaatgactttaactttgatatggatgcacggagaaataaacagcagcgcattaaagaggagggcgagtag

SEQ ID NO: 245711 - DNA, 1749 bp, Artificial Sequence
  Description of Artificial Sequence: Synthetic coding sequence
atgttgtacttggagaacaatgcacagacccagttctccgaaccgcagtacacgaacttgggtttactgaacagcatggaccagcagatccagaacgggagcagtagtacctctccttacaataccgatcatgcccaaaatagtgtcaccgcgccatcaccctatgctcagccttcctctacattcgatgcactcagcccatccccagctatccccagcaacactgactaccccggaccacatagctttgacgtgtcctttcagcagtcttcaacagccaagagcgctacttggacttactcaacggagttgaagaaactatactgccaaatcgcgaagacgtgtccgattcagataaaggtgatgacaccccctccccagggcgctgtgatacgcgctatgccagtatataagaaggccgaacatgttaccgaggtcgtgaaacggtgcccaaatcacgaactctctagagaattcaacgaggggcagatagccccacctagccatttgatcagggttgagggtaacagccacgcacaatacgtcgaagaccctatcaccggtcggcagtccgtgctggtcccgtatgaaccaccacaggtgggtacggaattcactactgtactgtacaactttatgtgcaacagtagctgcgttgggggtatgaatcgcaggcccatactgatcattgtaacattagaaactagagatgggcaagttttgggacgccgttgcttcgaggccagaatttgcgcatgcccagggagagatcgcaaggccgacgaggattccatcagaaaacaacaggtgagtgattcaacaaagaacggcgatgcctttaggcagaacacccacggaatccagatgacttcaatcaaaaagcgacgtagtccggacgatgagttgctgtacttgccagtgcgtggtcgtgagacttatgagatgctgctcaaaataaaggagtctctggagcttatgcaatacctcccacagcacaccatagagacatacaggcaacagcagcagcagcagcatcaacacctgctacagaagcaaacctcgattcagagcccttcctcatacggaaactcatcaccaccgctgaataaaatgaatagcatgaacaagcttcctagcgtgtctcagttgatcaatccccagcaacgtaacgctcttactcccacgacaatcccagatggtatgggtgcaaatattccgatgatggggacacatatgcctatggcaggtgatatgaacgggctgtctcctacgcaggccttgccaccgcctctcagcatgccttcgacttcgcactgcactcccccaccgccatatcctaccgactgttcaatcgttagcttcctggcacgcttggggtgcagtagctgcttggactattttacaactcagggcttgaccactatataccagatcgagcactatagtatggatgatctggctagcctaaaaattccggagcagttcagacacgctatatggaaggggatcctagaccataggcagctgcatgagttttccagcccaagtcacctgcttaggactccatcctctgctagcacggtgagtgttggaagttccgaaacaaggggggagcgagtgattgatgccgtgcgtttcacattgcggcagaccataagcttccccccacgggatgagtggaacgattttaatttcgatatggatgccaggcgaaataagcagcagcggatcaaagaggagggagagtag

SEQ ID NO: 245712 - DNA, 567 bp, Artificial Sequence
  Description of Artificial Sequence: Synthetic coding sequence
atgatcatctatcgcgacctgattagccacgatgagatgtttagcgatatctacaaaatacgagagattgctgacggcctgtgcctggaggtggagggaaaaatggtcagccgcaccgagggaaatatcgacgactcactgattggcggtaatgctagcgccgaggggcctgaaggtgagggaaccgagtccacagtgatcaccggggtagatatcgttatgaatcaccatctgcaagaaacttcgttcactaaagaggcgtataaaaaatatatcaaagattatatgaagagtattaaaggcaagctggaagagcaacggcctgaacgcgtgaaaccctttatgacgggcgctgcagagcagatcaagcacatcctggcaaatttcaaaaactaccagttctttatcggggaaaacatgaaccctgatgggatggtggccctcctggattaccgcgaagatggcgtgacaccatacatgattttcttcaaggacggccttgagatggagaagtgcgtcagcacgcgcaagtgggtgaaaattaacaatgtaaaaaagactttctag

SEQ ID NO: 245713 - DNA, 417 bp, Artificial Sequence
  Description of Artificial Sequence: Synthetic coding sequence
atggtgtcaagaacagaaggaaatatagacgactcgctaatcggaggcaatgcctctgccgagggccctgaaggcgaagggaccgaaagcaccgtgatcactggagttgatatcgtgatgaatcatcatctgcaggaaacctctttcacaaaagaagcgtacaaaaagtatatcaaggactacatgaagtccatcaagggtaaacttgaagagcagaggcccgagagagtcaaaccttttatgaccggagcagctgaacaaatcaagcacatcctggccaatttcaagaactaccagtttttcattggagaaaacatgaaccctgacggcatggttgccctgttggactatcgagaagacggggtgaccccatatatgatcttttttaaggacgggctcgaaatggagaagtgttag

SEQ ID NO: 245714 - DNA, 417 bp, Artificial Sequence
  Description of Artificial Sequence: Synthetic coding sequence
atggtttcgagaaccgaagggaacatcgatgactccctcattggcggaaacgcctctgctgagggacctgaaggcgagggtaccgaaagcacagtgatcaccggagtggacatcgtgatgaaccaccacctgcaggagacatcatttacaaaggaagcctacaaaaaatacataaaggactacatgaagagcattaaagggaagctggaagagcagaggcccgagagagtgaagccctttatgacaggagccgcagaacaaattaagcatatcctggctaacttcaagaactatcagttttttatcggagaaaatatgaaccctgatggtatggtggcgctgctggactatagagaagacggcgtaacgccatacatgattttcttcaaagacgggttggaaatggagaaatgttag

SEQ ID NO: 245715 - DNA, 483 bp, Artificial Sequence
  Description of Artificial Sequence: Synthetic coding sequence
atgttctcagatatttataagattcgggaaattgccgatggcctatgcctggaggtggaagggaagatggtttccaggacagagggtaacatcgacgatagtctcataggagggaacgcctctgcagagggccctgaaggcgaagggaccgagtctactgtgatcactggggtggatatcgtcatgaatcaccatctgcaggagacaagtttcaccaaggaggcctacaaaaaatatatcaaggattatatgaagtccattaaggggaagcttgaggagcaacgacccgaaagggtgaagccattcatgaccggtgcggctgaacagatcaagcacatactcgccaattttaagaactaccagttttttatcggcgagaatatgaaccccgacggcatggttgccctgctggattaccgcgaggatggtgtcaccccgtatatgattttctttaaggacggccttgagatggagaagtgctag

SEQ ID NO: 245716 - DNA, 519 bp, Artificial Sequence
  Description of Artificial Sequence: Synthetic coding sequence
atgataatttaccgtgatcttatctctcacgacgaaatgttttcagatatttataaaatccgcgaaattgctgacgggttatgcctcgaggttgaaggcaagatggtttcaagaactgaaggcaacattgacgactctctgattggtggaaacgccagcgctgaggggccagagggtgaaggaactgaatctacagtgattactggggtagatatcgttatgaaccaccacctgcaggagacgtcttttacgaaagaagcctataagaaatacatcaaggactatatgaagtccatcaaaggaaagctggaagagcagcgtcctgaaagggtcaaacccttcatgaccggggcagccgagcagatcaagcatatcctggctaacttcaaaaactaccagttctttatcggcgaaaatatgaaccccgacggcatggtcgctctgctcgactatcgcgaggacggcgttacaccttatatgatcttcttcaaggatgggcttgaaatggagaagtgctag

SEQ ID NO: 245717 - DNA, 1164 bp, Artificial Sequence
  Description of Artificial Sequence: Synthetic coding sequence
atggaggatgacgcccctgtcatctatggtcttgaattccaggccagagccctcaccccacagacagcggaaacagacgcaattagattcttggtgggcacccagtcattgaaatacgataaccagattcatataatcgacttcgacgacgagaacaatattattaacaaaaacgtgcttctccaccaggccggtgagatctggcatatctctgcaagtcctgctgaccggggagtgctgaccacatgctataaccgcaccagcgacagtaaggtgctcacgtgcgccgcagtgtggcgcatgcccaaggaactcgagagcggcagccatgagtcacccgatgacagtagctctacagctcagaccctcgagttgctgtgccatctggataataccgcccacggaaatatggcttgtgtagtgtgggagccaatgggagatggtaaaaagatcatcagcctagccgacaaccatatcctgctttgggatttgcaagagtccagttcacaagccgttttggcatcatccgctagtctggagggaaaggggcagctgaagtttaccagcggacggtggagtccccaccacaactgcactcaggtggccaccgctaatgacaccaccttacgcggttgggacacacggtccatgagtcagatttattgtattgagaatgcccacgggcagttagttcgcgacctcgattttaatcctaacaagcagtattacctagcgtcttgcggcgatgactgtaaggtgaagttctgggacacccgtaacgttacagaaccagtgaagaccctggaggagcacagtcactgggtttggaatgtcaggtataaccactcgcatgatcagttggtcttgacaggtagcagcgattcaagggttatactctctaacatggtgtctatttcttcagaaccttttggccacctggttgatgatgatgacattagcgatcaagaggatcaccggagcgaggaaaagtccaaagaaccgttgcaggacaacgtaattgcgacctacgaggaacacgaagacagcgtgtacgctgtcgactggtccagcgcagacccatggctattcgcctcgctcagctatgacggtaggttggttattaatcgtgttccacgtgcattgaagtaccacatactgttgtag

SEQ ID NO: 245718 - DNA, 990 bp, Artificial Sequence
  Description of Artificial Sequence: Synthetic coding sequence
atggccgaagccggaaccggagaaccctcccctagcgtggagggtgaacatgggacggagtacgacacccttccatcagatacagtctctttgagcgactccgattctgacctctcactccctggaggcgctgaggtcgaagctctcagcccaatggggttacctggcgaagaagactctggcccagacgagcctccttcgccgccatctggactgctgcccgcaactgtgcagccctttcatctccgcggtatgagctctaccttttcccagcggtccagggacatctttgactgtctggaaggtgcggctcgacgtgcaccttcctcagtcgcacacacatctatgagcgacaacggaggctttaagagacccctcgccccatccgggagaagccctgttgaaggcttgggccgagcgcaccggtctcctgccagccccagggtgcctcctgttccagattatgtcgcccaccccgaacgctggaccaaatactctctcgaagacgtaactgaagttagcgaacaaagcaatcaggcgacagcccttgcatttctcggcagtcaatcccttgccgctccaactgactgtgtcagcagctttaaccaggatccttcatcgtgcggcgagggtcgtgtgatctttacaaaacctgtccgcggtgtagaggcacggcacgagcgcaagcgcgtgctggggaaagttggggagccaggcagaggcggtctagggaatccagcaacagaccggggagaaggcccagtagagctggctcacctggccggaccaggctccccagaggctgaggaatggggaagccaccatggcggattgcaagaggttgaagctctgagtggctctgtgcacagtggcagcgtgcccggactgcccccagtggaaacagtcggcttccatgggtcaaggaaaaggagccgtgaccactttaggaataaatcatcctctcctgaagaccccggtgccgaagtttag

SEQ ID NO: 245719 - DNA, 798 bp, Artificial Sequence
  Description of Artificial Sequence: Synthetic coding sequence
atggctgaggccggaaccggcctgctgccggcaaccgttcaacctttccacctgcggggtatgagtagtaccttctcgcagagaagcagggatatttttgattgtttggaaggcgcagcacgcagagctccttctagcgtggctcacaccagtatgtcagataacggtggattcaagcgaccattggccccttcaggcaggagtcccgtggaaggactggggagagcccatagatcacctgcctcaccgagggtaccacccgtgccagactatgtggcacacccagaaagatggacaaaatattcactggaagatgtcaccgaggtcagcgaacagtcgaatcaggcaacagccttggcgttcctcggttctcagagccttgccgctcctaccgattgcgtgtcctcttttaatcaggatccttcatcttgcggagaggggagagtgatttttactaagcccgtcaggggtgtggaagccaggcacgagcggaaacgggtacttggcaaagtgggagaacctggaaggggtggcctgggtaatcctgctacggaccggggagaaggcccagttgaacttgcccacctggcaggcccaggatcccccgaagccgaggagtgggggtctcaccatggcggactccaggaagtggaggccctgagtggctcggttcactcaggctcggtgcccggtcttccacccgttgagacggtgggattccacggttcccgaaaacgttcccgtgaccattttaggaataaaagttcctcccctgaagacccaggcgcagaagtttag

SEQ ID NO: 245720 - DNA, 339 bp, Artificial Sequence
  Description of Artificial Sequence: Synthetic coding sequence
atggccgaggctggaaccggggagcctagcccctcagtagaaggggagcacgggacagagtacgacacgctcccatctgacacggtgtccctgtccgattctgattccgacctgtcccttccaggaggcgctgaggtcgaagcgctgagccccatgggactgccaggagaagaagactctggtcccgatgaacccccatcacccccttcggggctgcttcccgcaactgtgcagcccttccatctgagaggaatgagttctaccttttcccagcgctccagagacattttcgactgtctggaaggggctgccaggagggctccctcttccgtggcttag

SEQ ID NO: 245721 - DNA, 612 bp, Artificial Sequence
  Description of Artificial Sequence: Synthetic coding sequence
atggcagaagccggtacgggggaaccaagccccagtgtggaaggagagcatgggacagaatatgatactctgccttctgatacagtcagcttgtctgattcagattctgacttatcactgccgggtggagctgaagtcgaggccctgtcccctatgggcctgccaggggaggaagattccgggccagacgaaccaccaagtcccccatccggcctcctgcctgccaccgtgcaaccatttcacctgcgtggtatgagctcaacatttagccaacggagcagggatatcttcgattgtttagaaggtgccgctcgacgtgcccctagtagtgtagctcacacttccatgtcagacaacgggggttttaagcgacccttagctcctagcggacgctctcccgttgaaggtctcgggagagcccataggagccctgctagccccagggtgccaccggtgcccgactacgttgcacaccccgagagatggacgaagtattcattggaggacgttaccgaagtgtcagagcaatccaaccaggcgacggccctggcatttctcggcagccagtcgttggcggctcccaccgactgtgtctcttccttcaaccaatag

SEQ ID NO: 245722 - DNA, 627 bp, Artificial Sequence
  Description of Artificial Sequence: Synthetic coding sequence
atggccgaagccggaacggggctgttacccgcaacagtccaaccgtttcacctgcgtgggatgagcagtacttttagccagcgatcgagggacattttcgactgcctcgaaggcgcagccagacgggctcctagcagcgtcgctcacaccagcatgagcgacaacggcggttttaaaagaccccttgccccaagcggacgctcgcccgtagaaggactcgggagagcccacagaagcccagcgagtccacgagtgcctcctgtgccagactatgtagcccaccccgagagatggacaaagtatagtctcgaagacgtgactgaggtaagcgaacagtcaaatcaggctaccgcactggccttcctcgggtctcaatctctggcagctcccacagactgtgtgagcagctttaaccaggacccatcatcatgcggcgaaggtcgcgtgatctttacaaagcctgtgcggggtgtggaggccagacacgaaagaaagcgggtcttagggaaagttggcgaaccagggaggggaggtttgggtaaccccgctactgacagaggggaaggtccagtggagctggcacacttggctggccctggaagcccagaagccgaagaatggggatag

SEQ ID NO: 245723 - DNA, 990 bp, Artificial Sequence
  Description of Artificial Sequence: Synthetic coding sequence
atggccgaagccggtactggggagccgtctccgtcagtcgaaggagaacacggaacagaatatgacacactccctagcgacacagtctccctgtcggatagcgactctgatctttccctgcccggtggagcagaggttgaggccttaagtccgatgggactcccaggggaggaggatagtggtccagacgagcccccaagtccaccctccggcttattgcccgctacagtgcaacctttccacttgagaggaatgagttcaaccttcagccagcggtcacgcgacatctttgactgcctggaaggcgcagctcggagggctccgagtagcgtcgctcatacctctatgtccgacaacggcggtttcaagaggcccctggccccttctgggagaagcccagtggaagggctgggacgcgcacatcgatcccctgcaagtccaagagtaccccctgtgcctgactacgtggcacacccagaacggtggacgaaatactcgctcgaggatgtcacagaagtatccgaacaaagtaaccaggccacggcccttgcctttctagggtcccagtctttggctgcacctaccgactgtgtgagcagcttcaaccaggacccttccagctgcggcgagggtcgggtaatcttcacgaaacccgtgcgtggagtcgaagcccgacacgagagaaaaagggtactgggcaaggtgggggagcctggacggggagggcttggcaatccagctacagacaggggcgaaggaccagttgagctggctcacctcgccggaccaggctctccagaagctgaggagtggggctcgcaccacggcggattacaggaggttgaggccctctctggcagcgtacattcgggctccgtccccggactgcctccggtggagactgtaggattccatgggtctcggaagcggagtcgggatcactttcgcaataagagcagctcaccagaagaccctggagccgaggtctag

SEQ ID NO: 245724 - DNA, 333 bp, Artificial Sequence
  Description of Artificial Sequence: Synthetic coding sequence
atggccgaggccggtaccggggaaccaagtccctctgtagagggagagcacggcactgagtatgacactctacctagcgatacagttagcctctcggactccgactccgacctgtccctgcccggaggcgctgaggtggaagccctgagtccaatggggttgccaggcgaggaggatagtggtcccgatgagcctccctccccaccttctggactcctgcctgcaactgttcagccgtttcatctgaggggcatgtcttctacgttctcacaaaggagccgggatatcttcgactgtctggagggcgcagctcggcgtgccccatcaagctag

SEQ ID NO: 245725 - DNA, 576 bp, Artificial Sequence
  Description of Artificial Sequence: Synthetic coding sequence
atggcggaagccggaactggtgaaccttcaccttctgtggaaggagagcatggcaccgaatatgatactctgccctctgataccgtgtccctgagcgacagtgactcagatctctccttgccaggaggagccgaagtggaggctctgtccccaatggggctgcccggagaggaagattccggccctgacgagccgcctagccctccgtcagggcttctgcctgcgaccgtacagccctttcatctgagagggatgagctccactttttcccaacgttcaagggacatcttcgactgccttgagggcgctgcacgtcgcgcaccatcgagcgttgcccacacgtccatgtctgataacggtggctttaagaggcctctggcaccctcagggcgtagccccgtggaagggctggggagggcccaccggagccctgccagccccagggtgcctcccgttcccgattatgtcgcacacccagaaaggtggactaagtacagtcttgaggatgttaccgaggtcagcgaacagagcaaccaggcaaccgccctggcttttcttgggtctcagtcactgtag

SEQ ID NO: 245726 - DNA, 639 bp, Artificial Sequence
  Description of Artificial Sequence: Synthetic coding sequence
atgggaccaatgtggaggatgagaggaggagccactcggagagggtcttgttgcggaggcgatggggcagccgacggtcgcggacctggacggtcaggaagggccaggggcggaggtagccctagcggcggaggtgggggagtgggttggcggggtagggcagacggagccaggcagcagctagaagagcggttcgccgacctggctgccagccatctggaggctatccgcgctcgggatgaatgggataggcagaatgcaagactgcgacaggaaaatgccagactgcgcctcgagaatcgtaggttgaaacgcgagaatagatcactctttcgccaggcgctgcggcttcctggggaagggggaaatggcacccccgcagaggcacggagagtccccgaagaggcatcaaccaaccgtagagcgagagactcagggagggaggacgagccaggctcacctagagctctgcgagctcgactcgagaagctggaggcaatgtacagaagagcgctgcttcagctccatcttgagcagagaggacctcgcccttcaggcgacaaagaagagcagccactgcaggagcctgattcaggactcagaagcagagattctgaaccctcgggaccttggctttag

SEQ ID NO: 245727 - DNA, 1047 bp, Artificial Sequence
  Description of Artificial Sequence: Synthetic coding sequence
atgggagctcgtggggcaccgtctaggcgcaggcaggcaggtcgcaggctccgatacttgcccaccggttcgttcccctttctgttgctgctgctcctcctctgtatccaattgggcggtggccaaaaaaagaaggaaaatctgctggcagagaaggttgagcaactcatggagtggtcttcgagacgatcaatctttagaatgaatggggataaattccggaaatttatcaaagcccctccccgaaattactcgatgattgttatgttcactgccctccagccacagaggcagtgctcagtctgtcgccaggccaatgaagagtatcaaatcctcgccaatagctggcggtatagctcggcattctgcaacaaacttttcttttctatggttgactacgacgagggcactgacgtttttcagcagctcaacatgaactccgcccctacttttatgcacttcccaccgaaaggcaggccaaagcgggcagacacttttgacctgcagcggatcggttttgccgcagagcagctagccaagtggatagccgaccggactgacgtccacataagggtttttcggccacccaactattctggcacaatcgccctggcccttttagtgtctcttgttgggggactactttatctgagacgcaacaacttggaatttatttataataaaaccggctgggctatggtgtctttatgcatcgtcttcgcgatgacgtccggccagatgtggaatcatatcagagggccaccctacgcacacaaaaatccacacaacggccaggtaagttacatccatggatcttcgcaagcccagtttgtagcagagagccacattatacttgtgcttaatgcagctataacaatgggtatggtgttgttaaatgaggcggcaacttctaaaggcgacgtcggaaagagacgaatcatttgcctggtcggcttgggactggtggtcttcttcttctcatttttgctgtccattttccggagcaaatatcatggatatccgtacagcgatctcgacttcgagtag

SEQ ID NO: 245728 - DNA, 1044 bp, Artificial Sequence
  Description of Artificial Sequence: Synthetic coding sequence
atgggcgcacgtggcgctccctctagaagaaggcaggccggtcgccgactcagatacctgcccacaggttcattcccattcctgctgctgttgcttttattgtgcatccaactgggcggaggtcagaagaagaaagagaatttgctggccgaaaaggtagagcagctgatggaatggtcttcgcgtaggtccatctttagaatgaatggagacaaattccgcaaatttatcaaggctccccctcggaattactctatgatcgtcatgttcacggccttacagccacagaggcaatgttccgtgtgccgtcaagcaaacgaggaataccagatcttagccaactcctggcgatatagctctgcattctgtaacaaactgtttttttccatggttgattacgatgaaggcaccgacgtatttcagcaacttaatatgaattctgccccaacatttatgcatttcccacctaagggaaggccaaaaagggctgacacctttgaccttcagcggattggattcgccgcagagcagctagctaagtggattgccgacagaactgacgttcatatccgggtgttccgaccgcctaactatagtgggaccatagccctagccctcctcgtgagtcttgtgggcggtctgctgtaccttcggagaaacaatctcgagtttatctataacaaaaccggatgggctatggtgagtctctgcatagtttttgctatgacctcaggacagatgtggaatcacattcggggtccaccttacgcccacaagaatcctcataacgggcaagttagctacattcatgggagctcacaagcccagtttgtcgcagagtcccacataatactggtcctgaatgccgcaattactatgggcatggttttgctgaacgaggcggcaactagtaagggagacgtcggcaagaggaggattatatgtcttgtgggtttgggcctggtggtcttttttttcagtttcttattaagcatcttccgctccaaatatcatggctatccctacagttttctcattaaatag

SEQ ID NO: 245729 - DNA, 1047 bp, Artificial Sequence
  Description of Artificial Sequence: Synthetic coding sequence
atgggggcacggggagccccttcccgaaggagacaggccggacgtagactgagatatctaccaacaggcagctttccctttctcctgcttcttctgcttttatgtatccagttgggcggaggccagaaaaagaaggaaaacctactggccgagaaggtagaacagctgatggaatggagctctcgcagatcaatcttccggatgaatggggacaaattccgtaagtttattaaagccccaccccgtaactatagcatgatcgtgatgtttaccgcactgcagccccagcgacaatgcagcgtctgtagacaagccaacgaagagtaccagattcttgccaactcttggagatactcctcagcattctgcaataaactgttcttctccatggtggattatgatgagggtaccgatgtcttccagcagttaaacatgaattccgccccaaccttcatgcatttccctcccaaaggtcggcctaagcgtgccgacacattcgacctccagagaattggcttcgcagcagaacagttagcgaaatggattgctgacagaaccgatgtgcatatcagagttttccgtccgcctaattattctggcacaatcgctctggcgctcctcgtcagcctggtgggtggcctgctctacctgcgcaggaacaacttggaattcatatacaataaaaccggatgggcaatggtctccttgtgtatcgtcttcgcgatgacttcaggtcagatgtggaaccacatacggggaccaccgtacgcacataagaatccccacaacggtcaggtctcatacatccacgggtccagccaggctcagtttgtggccgaatctcatattatcctagtcttgaatgccgcaatcacgatgggtatggtgctcctcaacgaggccgctacatccaaaggagacgttggcaagaggcgcattatttgtctcgtgggccttggactcgtggtgtttttcttctcttttttgctcagcatttttcggagcaagtatcacggctatccctactcagatctggacttcgaatag

SEQ ID NO: 245730 - DNA, 1047 bp, Artificial Sequence
  Description of Artificial Sequence: Synthetic coding sequence
atgggcgcacgcggtgctccttccaggcgccgacaggcagggagaagattgcggtatctccccacaggctcttttccattccttctcctcctgttactactgtgcattcagctggggggtggccagaaaaagaaagagaatctgctggctgagaaggtcgaacagctgatggaatggagtagcaggaggtccatcttcagaatgaatggggataaatttcggaagtttatcaaagctcctccgagaaactacagcatgatcgtcatgtttacagcccttcagccccagcggcaatgctcagtttgccgacaagcaaacgaagaatatcagattttggcaaatagttggaggtacagctctgctttctgtaataagttatttttctccatggttgactacgatgaggggaccgatgtgtttcagcagctgaatatgaatagcgccccaacattcatgcattttcccccaaaaggtagacccaagcgggcagatacttttgacctccagcgcatcgggttcgcagctgaacagcttgcaaaatggatcgcagatcgaactgatgtccatattagggtctttcgccctcccaattactcgggcaccatcgccctggcgttattggttagccttgtgggcggactgctgtacctgaggcgaaacaacttagaattcatctacaataaaacagggtgggcaatggtttctttgtgcatcgtgttcgcaatgactagcggccagatgtggaatcacatccgcggtccgccatatgcacataaaaatccacacaacggccaggtgtcttatattcacggttcctcacaagcgcaattcgtagcggagagccacatcattttggtgcttaacgctgccattacaatgggcatggtcctgctgaacgaggccgctaccagtaaaggggacgttggcaaacgacggattatctgcttggtgggcctgggcctcgttgtgttctttttcagctttttactgagcattttccggagcaagtatcacggttatccctattcagacctggattttgaatag

SEQ ID NO: 245731 - DNA, 534 bp, Artificial Sequence
  Description of Artificial Sequence: Synthetic coding sequence
atggcccatccagttcagtccgagttcccatcggcacaggagcctgggagcgccgcattcttagatctcccagaaatggagattctgctgacaaaggccgagaataaagacgataagacactgaatctgtctaagacactgtccggccctttagacctggagcagaactcgcaggggctccctttcaaagctatttctgagggtcatctcgaggcaccactgcctcgaagccctagcagggcctcgtccaggcgagctagttctattgccaccacgtcctatgctcaggatcaggaggccccacgtgactatctcatcctggccgtggtggcctgcttctgcccggtgtggcccctcaatttaattcctctgattattagtattatgagccggagctcaatgcaacaggggaacgtggatggcgctcgcaggctggggcgtttagccagactgctgtccattacattgatcattatgggtatcgttataatcatggtggccgtgaccgtgaatttcacggtgcagaagaagtag

SEQ ID NO: 245732 - DNA, 1173 bp, Artificial Sequence
  Description of Artificial Sequence: Synthetic coding sequence
atggccgtgtccgaatctcagctgaagaagatggtgtccaaatataaatacagagaccttactgtgagagagacagtgaacgtgataacgctctacaaagacctgaagcccgtcctggatagttacgtgttcaatgacggatctagtagagaactaatgaaccttaccggtaccatacccgtgccatatcggggaaacacttacaatattcccatctgcttatggctactggatacatacccatataaccccccaatctgttttgtcaagcctacctctagcatgacaatcaagactggtaagcatgtggacgctaacggtaagatatacttaccttacctacacgagtggaaacacccgcagtcggacctacttggccttatacaggtcatgatcgtggtgtttggagatgagcctcctgtgttttctcgaccaatctcggctagctatcccccatatcaagctacggggccacccaacacctcctacatgccgggaatgccaggtggcattagcccatatccatctgggtaccctcccaatccttctggctacccgggatgtccatacccgcctggcggaccatacccagcaacaactagctcccaatatccgtcacaaccacccgtgacaaccgttggaccttcacgcgatggaacgatctcggaggacacgattcgcgcaagcctgatctccgccgtgtccgataagttaagatggcggatgaaagaggagatggaccgggcacaggctgaattgaatgcgcttaaaagaacggaggaggatctcaagaaagggcatcagaagctggaagagatggtaacacgcttagatcaggaggttgccgaagtagataagaatattgaactgttgaagaaaaaggacgaagagcttagctccgcccttgaaaaaatggagaatcagtctgaaaataacgacattgacgaagtcatcattccgactgcccctttatacaagcaaattctcaacctgtacgctgaggaaaatgcaatcgaagatactatcttttacctgggagaggccctgcggcgaggcgtcatcgacctcgatgtgttcctgaagcatgtgaggcttctctctcgtaagcagttccaattgcgagcattaatgcaaaaggccaggaaaacagccggacttagcgacctatactag

SEQ ID NO: 245733 - DNA, 858 bp, Artificial Sequence
  Description of Artificial Sequence: Synthetic coding sequence
atggccgtgtcagagagtcagctcaagaaaatggtgtcgaagccccaaagcgaccttctcggcctaatccaagtgatgatcgtggtttttggagacgagccgccagttttctcacgacctatctcagcaagctaccccccatatcaggctaccggtcctcccaatacgagttatatgcctggcatgcctggtgggatctccccttacccttccggatacccacccaatcccagcggttacccaggatgtccttacccgccaggaggcccatatcctgcgaccacatcttcacagtatcccagtcagccaccagttacaacagtgggaccaagcagagatggaactattagcgaggacactattagggcctcgctcatctccgctgttagcgataaactcagatggcggatgaaggaggagatggatagggcacaggccgaactcaacgccttgaagagaacagaggaagacttgaagaagggccaccaaaaactcgaggagatggtgactaggctagatcaggaagttgccgaagtagacaagaatattgagctgttaaaaaaaaaggatgaggagctgagctccgcccttgagaagatggaaaaccagagtgaaaataatgatatagacgaggtaattatccctactgccccattatataagcagatcctcaacctgtatgctgaagaaaacgccattgaggatacaatcttctacctgggggaagccctgagacgtggcgttatagaccttgacgtttttttgaagcacgtgcgtctgctgtctcgaaagcagtttcagctgagagctctgatgcaaaaagcacgaaagactgcaggactctccgacctttattag

SEQ ID NO: 245734 - DNA, 972 bp, Artificial Sequence
  Description of Artificial Sequence: Synthetic coding sequence
atggctcggggacctggcctggccccacccccactcagactgccactgttgctcctcgtcctcgccgctgtgactggccacactgccgctcaagacaactgcacttgccccacaaacaagatgacagtgtgttctccggacggaccaggcggtcggtgccagtgtagggcactcggtagcggaatggccgtggactgttctacactcacctccaagtgtttactcttgaaagcccgtatgtcagccccaaaaaacgctcgcaccttggtcaggcccagcgaacacgcgttagtcgacaacgacggactgtatgatccagactgcgatcccgagggcagattcaaagccaggcagtgcaatcagacatctgtgtgttggtgcgttaactccgtgggtgtgagaagaactgacaaaggcgatctgtctctgaggtgtgacgagctggttcgaactcatcacatcctgatcgacttaaggcacagacccaccgccggagcctttaatcatagtgatctggacgctgaactgaggcgcctgttcagagagcgttatcggctgcacccaaaatttgtggctgccgttcactacgagcagccgaccatccagattgaattgaggcagaatacatcccaaaaagcagcaggagacgtcgacatcggggatgcggcatattacttcgagcgcgacatcaagggggaaagtctgtttcagggtcgaggcggactggatctgagagtgagaggagagcccctgcaggtcgagaggacccttatctactacctagatgagattccacccaagtttagcatgaaaaggcttacggccggacttatcgctgtcatagtcgtcgtggtggtcgccctcgtggcaggaatggccgtcttggtgattacaaatcgacggaaatcgggaaagtacaaaaaagtggaaattaaggagctgggagagctgagaaaggagcccagcttatag

SEQ ID NO: 245735 - DNA, 1353 bp, Artificial Sequence
  Description of Artificial Sequence: Synthetic coding sequence
atgggagccccacctgggtacaggccctcagcctgggtgcacctccttcaccaactgcctagagccgattttcaactcaggccagttccatctgtctttgcaccccaggaacaggaataccagcaggcactcctccttgttgccgctttggcaggactgggcctgggtcttagcctgatcttcatagctgtctacctgatccggttttgttgttgcaggccacccgagccccctggaagtaaaatccccagccccggaggcggatgtgtcacatggtcatgtatcgtcgccttacttgccggttgcacaggtattggtattggattctacggaaattccgaaacaagcgacggcgtgtctcagttgtccagtgccctcttgcacgctaatcatactctttccacgattgaccacctggttcttgaaacagtggagcgcttgggagaggcggtacggaccgagctcaccactttggaagaagtgttagaacctagaacagagcttgtggcggcagccagaggagctaggagacaagcagaagccgctgcccagcagttacagggtctggccttttggcagggcgtgccactgtctccgcttcaggtggccgaaaatgtgtcttttgtggaggagtaccggtggctggcttatgtgctccttctgctgcttgaactcttggtgtgtttgttcactttactgggactggctaaacagtcaaagtggctggtgatcgttatgactgtcatgagcctgctcgtcctggtgttgtcgtggggatctatgggcctcgaagcagccacagccgtagggctgtctgacttctgctcaaaccctgacccatacgtgttaaatctaacacaggaggaaacgggactgtcctccgatatcctctcatattacctgttatgcaaccgggcagtgtccaatccatttcagcagagactgacactgtctcagagagccctggcaaacatccacagccagctcctcggcctggagcgtgaggctgtcccccagtttccttcggcacaaaagcctctgctatctctggaggaaactctaaacgtgacagaggggaactttcatcagctggtagccctgctgcattgtcgctctttgcacaaggactacggagccgctctgcgaggtctctgcgaagatgctctcgagggcttgttgtttctgctgttattttccctcctgtccgcaggggcattagccaccgccctgtgttcgttgccgcgagcctgggcactgtttcctccgtccgatgattacgatgatacggatgatgacgaccctttcaacccccaggaaagcaagcgattcgtccagtggcagtcttctatttag

SEQ ID NO: 245736 - DNA, 1383 bp, Artificial Sequence
  Description of Artificial Sequence: Synthetic coding sequence
atgggtgcaccacccggatacaggccgtctgcatgggtccaccttctgcatcagctcccccgtgccgacttccagttaaggcctgtcccttctgtgttcgccccacaggagcaagaataccagcaggctttgctcctggtagccgcattggcaggccttggtcttggacttagcctaatttttatagctgtgtatcttattcggttctgttgttgtcgcccaccagaacctcccggatcaaagatcccaagtcccggagggggttgtgtgacttggtcctgtattgtggcccttctcgcaggatgcactgggattggtatcggattttatggtaattccgagaccagtgacggtgtcagccaactctctagcgccctgctgcatgccaatcatacactttccacaatagatcacctggtgttagagaccgttgaacggttaggcgaggctgtcaggaccgagctgacgactctggaggaggtgttggaaccacgtacagaactggtagctgccgcacgtggtgcgaggagacaagcagaggcggcagctcagcagttacaagggctcgctttttggcagggcgtgccgctgtctcctctgcaggtggctgaaaatgtcagctttgtggaggagtacagatggctcgcctacgtcctgttactgctgctggagctgttagtctgcctttttacgttgctaggactggccaaacagtctaagtggctcgtgattgtcatgaccgttatgtccctgctggtactggtgctttcatggggtagcatgggactggaggccgcaactgcagtcggactgtctgatttctgtagcaacccagatccctatgtgctgaacttaacccaggaagaaaccggactgtcaagtgacatcctgagctattatctcctgtgcaatcgcgctgtgtctaacccattccaacaaaggttgacgctgagtcagcgcgctctcgcaaacattcattcccagttactgggcctggagagagaggcagtgcctcagttcccatcagcgcaaaaacctttgctgtccctggaggaaaccctaaatgtcacagagggcaattttcaccagctcgtcgccctcctccactgccggtcactccataaagattacggggcagcgctgcgcggtctctgcgaggacgccctggagggactgttgttccttctcctgttcagtctactgtcagccggagctctcgccacagccctgtgttctctccctcgagcgtgggccctattccccccacgcaatcccagtgctctgtgctctgggagccggttaagcgagccgctgctgcccgctgggctggagccgggaagtccactgaggtccttccctggatgccggcgacgtccacactag

SEQ ID NO: 245737 - DNA, 1362 bp, Artificial Sequence
  Description of Artificial Sequence: Synthetic coding sequence
atgggagcaccacctggttacaggccatctgcctgggttcatctgctccaccagctgccgagagccgatttccaattgagacctgtgccttcggtgttcgctccacaggagcaagaatatcaacaggaccagagttcactggctgttacccagagaccccctcccaccactccactacaccggcttcggcctcgcccaaggctcacccctgctcttgcgagacgacccccagaggccgcaaggggtgacccaagaccccagagtccccctgaagctctcctgctggtagctgcgctggctggcctcggtctgggcctgagtctaatcttcattgccgtgtacctcattaggttctgctgctgtcgacctccggaacctcctggctcaaagattcccagtcccggaggagggtgtgttacctggtcgtgtatagtcgcattactggctggctgcactggcatagggatcggcttttatggtaactcagagacgtcagatggcgtctcacaactcagcagcgcattactccatgcgaaccataccttgtcgaccatcgaccacttggtcctggagaccgtcgagcggctgggagaagccgtccgtactgagctcacgacacttgaggaggtcctcgagcccaggacagaactcgtggccgcagccagaggggcaaggcgacaggcggaggctgcggcacagcagttgcagggcttggcattctggcagggagtgcctttgagccccctgcaggttgcggaaaacgtctctttcgtggaggaatacagatggctggcctacgtgctgctgttgctgttagaactgctggtttgtttatttacgttgttaggattggcgaagcagagcaagtggcttgtgatcgtgatgaccgttatgtccttactggttctcgtgctgagctggggcagtatgggcctggaggctgccaccgccgtgggcttaagcgatttctgcagtaatccggatccctacgtgctgaatcttacccaggaagaaaccggacttagctccgaagccgactccgtgccagcctcatccggccaacatcccctgccggctgccggtccgggagcgaggagctgtgcatccgtcccgttttctgccgaggcgtcagcagtgctgggaggcgacagtgagtgcgaccgcagaaaatttccgccagtaggcggtactgcaaccttacctcagcccgctcaagggttgtggtgttctcctgccggacctgtgcgcaggcgtccagggagacccgctcttcctgccaccctgctgccagccgtgtgtcggtccgcaggacattgtcccctgcagcccgcacctagcctaggcccactacctacgcagtag

SEQ ID NO: 245738 - DNA, 1356 bp, Artificial Sequence
  Description of Artificial Sequence: Synthetic coding sequence
atgggggctcccccagggtatcgcccttcagcctgggtacacctgttgcaccaactcccacgagcagactttcagctgcgcccagtccctagcgtatttgccccacaggaacaggagtaccagcaagccctgctgcttgtcgctgcactcgccggactcgggctcgggctaagcctgattttcattgcagtgtacctgatccgtttttgttgttgtagaccacccgagcctccaggatccaagatcccctctccaggaggaggctgcgtgacttggtcatgtattgtggcacttttagccggttgtactggtataggtatcggtttctatggtaactccgagaccagcgacggagtgtctcagctaagctctgctttgctccatgcaaatcatacactcagcaccatcgatcaccttgtgttagagactgtggagagattgggtgaagctgtgagaactgaactgacaacactggaggaggtcctggaaccaaggactgagctggtggccgctgcaaggggggctcggagacaggctgaggccgcagctcagcagttacaaggactggccttctggcagggcgtgccactgagccctctccaggtcgccgaaaacgtgagcttcgtcgaggaatacaggtggctggcatacgtgctgctgcttctgctcgagctgctggtctgtctctttactctgttgggcctggccaaacagagcaaatggcttgtgatcgtgatgaccgttatgagcctgttagtgctggtgttgtcatgggggagcatgggactcgaggccgctaccgccgtcggactctccgatttctgctctaatcctgatccttacgtgctgaatctcacccaagaggagacaggcctgagttcagacatcctgtcttattacctcctgtgcaatcgagccgtgagcaatccatttcagcagagactgaccttaagccagagagctctggctaatattcactcgcagttactggggcttgaaagagaggctgtgcctcagtttccgtcagctcaaaagcccctcctatctctggaggaaaccctgaatgtgactgagggcaattttcatcagctggtggcattactgcattgtcgaagcctccacaaggactacggggcagccctgcggggactctgcgaggatgcgctcgagggcctgttgtttctcctactgttttctctgctgagtgctggcgctctggccacagcactctgctctttacccagagcctgggccctgtttcctccatcagatgattatgatgacacagatgacgatgatcccttcaacccgcagcaggaatctaagagatttgtccagtggcagtctagcatctag

SEQ ID NO: 245739 - DNA, 1155 bp, Artificial Sequence
  Description of Artificial Sequence: Synthetic coding sequence
atgactaggcgtgggagacgcagatccagtcatttcctcgggcctcctgctggggctgcgggatgcacacagagaagaagtcgggaactggccgctgccgcaatgtcccaccagaccggcattcaagcctctgaggacgtgaaggagatcttcgctagagccagaaatggcaagtataggctgctgaaaatctcaattgagaatgaacaactcgttatcggatcttattctcaacctagtgatagctgggataaagattacgatagctttgtgctgccgctcctcgaggacaagcagccgtgttacattctgtttaggctggacagccagaatgctcagggttatgagtggatttttatagcctggtcccctgatcattctcacgtgagacagaagatgttatacgcagctacgagggcaactcttaagaaggaatttggaggtgggcacattaaagatgaagtatttggaactgtaaaggaggatgtgagcctacatgggtacaagaagtacctactcagccagagcagtcccgctcctctcaccgcggcagaggaagagctgaggcagatcaagattaacgaggtacagactgacgtaggggtggacactaagcatcagacactgcagggagtggctttcccaatatctagagaggccttccaggcgctcgagaaacttaacaatcgccaactgaattacgtgcagctcgagatcgatataaagaacgagattatcatactggccaatacaacaaacacagagctgaaagacctgcccaagcgaattcccaaggactccgcaagataccactttttcctatataaacactcccacgagggagactatctcgagtctattgtctttatttatagtatgcctgggtacacttgctctatccgggagcgaatgttatacagcagctgcaaatccaggttactggagatagtcgagaggcagcttcagatggatgttattcgtaaaattgagatcgacaatggggatgaactgaccgccgactttctgtatgaggaggtgcaccccaagcagcacgcccataaacaaagcttcgcgaaaccaaagggcccagctggcaagcgcggtatcagaagattaatccggggtcctgcggagactgaggccactacagattag

SEQ ID NO: 245740 - DNA, 1053 bp, Artificial Sequence
  Description of Artificial Sequence: Synthetic coding sequence
atgagtcaccagactgggattcaggctagtgaggatgtgaaagagattttcgcacgtgctaggaacggaaagtaccgattgctgaagatttcaatcgagaatgaacagctcgtgatcgggagttatagccagccttctgactcgtgggataaagactatgacagttttgttctccctctcctggaggacaagcaaccttgttacatactgtttagattggacagtcagaacgcccagggatatgagtggatcttcattgcttggtcccctgatcactcacatgttagacaaaagatgctgtatgcagcgaccagggccacactcaagaaagaatttggaggaggccacatcaaagacgaggtttttggtacagtcaaagaggacgtgtctctacatggctataaaaaatatttgctctcacagtccagtcctgctcccctgacagctgctgaagaggaattacggcagatcaagattaatgaggtccagactgacgtgggggttgacaccaagcatcagacccttcaaggcgtcgcatttccaatttctagagaggcctttcaagccctggagaagcttaacaacagacagctaaactatgtccagctagaaatcgatattaaaaacgaaatcattatccttgcaaacactactaacaccgagctcaaggacctccctaaaaggattccaaaggattctgctcgctaccacttctttctatacaaacacagtcacgagggggactatctggagagcatcgtgtttatttacagcatgcccggatacacctgttctatacgggagagaatgctgtactcatcctgcaaatcccggctgctggagattgtagaaagacagttacagatggatgtcatccgtaagatagaaatagacaacggggacgaacttactgccgacttcctatatgaagaggtccacccaaagcagcacgcgcataaacagtccttcgccaaacctaaggggccagccggaaaacgcggaatccgcaggcttatccgcggtcccgctgagactgaagcgaccactgactag

SEQ ID NO: 245741 - DNA, 1074 bp, Artificial Sequence
  Description of Artificial Sequence: Synthetic coding sequence
atgtcacaccaaaccgggattcaggcatctgaggacgtcaaggaaatcttcgctagggcccgaaacgggaagtatagactgctgaaaattagcattgagaacgaacagcttgtgattgggagttactcacagccatccgacagctgggataaagactacgacagctttgtattacctttattagaagacaagcagccttgttatatcctgttccgcctggattcgcaaaacgcacagggttacgaatggattttcattgcctggtccccagatcattcacatgtccggcagaagatgctctacgctgctacaagagccacactaaagaaagagtttgggggaggccatattaaggatgaggtgtttggcacggtgaaagaagacgtctctcttcacggttacaaaaagtatctcctatcacagagtagtccagctcctttgacagctgccgaagaagaactcaggcagatcaagatcaacgagtctccagaggaccacataggtgtccagaccgatgtgggcgtggacacaaagcatcaaacgttgcagggggtggcattccctatttccagggaggcatttcaggctctcgaaaaactgaataaccgccaactgaactatgtgcagctggagatcgacattaagaatgaaatcatcatcctcgccaacacgactaatactgagctcaaggatcttcccaaacgcatacccaaagactccgcgaggtatcactttttcctctataagcacagccatgagggcgactacctggagagtatcgtgttcatttattcaatgccaggatacacctgctccattcgagaaagaatgctttacagttcttgtaagagccgattgttggagatcgtggaacgtcagctgcagatggacgtgatccggaaaatcgaaatagataatggggacgagttgaccgcagacttcttgtacgaggaagtgcatccaaagcaacacgctcacaagcaatcttttgctaaaccaaagggcccagccggaaagcgagggatcaggcggctgatccgcggtcctgccgagacagaggcaaccacagactag

SEQ ID NO: 245742 - DNA, 1050 bp, Artificial Sequence
  Description of Artificial Sequence: Synthetic coding sequence
atggctcaccagacaggtatccacgcaacagaggaactgaaagaattttttgcaaaggcccgagctggtagcgtccgacttatcaaagtggtcattgaggacgaacaactggtgctcggagcttcccaggagccagtgggcagatgggaccaggattacgatagagctgtcctgccgcttctggatgcacagcaaccttgttacctcctctaccgcctggattctcagaatgcccagggatttgagtggttattcctggcctggagtcccgataattcacctgtacggttgaagatgctatacgctgccacgcgagcaaccgtgaaaaaagaattcggaggtggtcacatcaaagacgagctgttcgggacggtcaaggatgacctctctttcgccggttatcagaagcacctttcctcatgcgcggctcctgcaccactgacatcagccgaaagggaactgcaacagatacggatcaacgaggtcaaaactgaaatatccgtggaaagtaaacatcagactctccaggggcttgcctttccacttcagcccgaagctcagcgggctctccagcagctcaaacaaaaaatggtcaactacattcagatgaaactagacctggaacgtgaaactattgagctggtccacaccgaacctacagacgttgctcaactgccttcccgggtgccacgcgatgccgctaggtatcacttctttctctataagcatacacacgaaggagaccctttggagtccgtggtattcatctactccatgcctggttacaaatgtagcattaaagagcgtatgctgtatagctcctgcaagagtcgccttttggacagcgttgaacaggactttcacctcgagatagctaagaagattgagatcggggacggcgcagaactgaccgctgagtttctgtacgatgaggtccatccaaaacagcatgcatttaaacaggcttttgcgaaacctaaggggcctggcggtaagcggggtcacaaacgtctgattagagggcctggcgaaaatggggatgattcatag

SEQ ID NO: 245743 - DNA, 483 bp, Artificial Sequence
  Description of Artificial Sequence: Synthetic coding sequence
atggaagagggttcgagctctcctgtttccccagtagattctttgggaacgtctgaagaggaattggagcgacagccaaagcgattcggacggaagcggaggtacagcaagaagagcagcgaagacggaagccctacaccagggaagcgagggaagaaaggtagtccctccgctcaatccttcgaggaactgcagagccagcggattctggccaacgtccgagagcggcagagaacacagtctttgaacgaggccttcgcagctctccgcaaaataattcccacattgccgtctgacaaactgtccaagatccagaccctcaagttggccgctcgctacatcgattttttataccaggtcttgcagagcgatgagatggataataagatgacttcatgcagttacgtggcccacgaacggctatcctatgcctttagtgtgtggaggatggaaggcgcatggtccatgtccgcgtcgcactag

SEQ ID NO: 245744 - DNA, 1476 bp, Artificial Sequence
  Description of Artificial Sequence: Synthetic coding sequence
atgaaccccgcagcagaagcagagttcaacatactgttagctactgacagctacaaggtgacgcattataaacaataccctcccaacacatcgaaggtgtacagctatttcgagtgcagagagaagaaaactgagaattctaaactgcggaaagtgaaatacgaagagactgtcttttatggactgcagtatattctgaacaaatacctcaaagggaaagtagtaactaaggagaaaatccaggaggctaaggatgtctacaaggaacacttccaagacgatgtgtttaacgaaaaggggtggaattatatacttgaaaagtatgacggtcacctgcccatcgagataaaagcagtgcccgaaggcttcgtgatccccagagggaacgtcctttttacggtggaaaatacagaccctgaatgttattggctgactaactggatcgaaacaatacttgtccagagctggtatcccattacagtggccaccaactcacgagagcagaagaagattttggctaagtacctcctcgagaccagtggaaacctcgacggtctggagtacaagcttcatgattttggctatcggggagtatcgagccaggagacagctggcatcggagcctctgcccaccttgtgaacttcaaagggacggacaccgtcgcaggtctggcactaattaagaagtactatggaacaaaagatcccgttccaggctactcagtgcctgctgctgagcacagtacaattacagcctggggaaaggatcacgaaaaggacgcattcgagcacattgtgacccaatttagctctgtgccggtaagtgttgtgtcagacagctacgacatctacaacgcctgcgagaaaatttggggagaggacttgcgccaccttattgtgtcccggtctactcaggctccactcataatccgccctgacagtggtaaccctctggacactgtgctgaaagtcttagaaatccttggaaagaagttccccgttaccgagaatagtaagggttataaactcctccctccttacctcagagtgatacaaggcgacggggttgacataaataccctccaggaaatcgtcgagggtatgaaacaaaaaatgtggagcatagaaaatatcgctttcggttccgggggaggtctgctgcagaagctcacgcgtgatctgttgaattgctcttttaagtgtagctatgtggttacaaacgggttgggaattaatgtgtttaaagatcctgtcgcagaccccaacaagaggtctaagaagggcagactgagcctgcatcgcacaccagcaggcaactttgttacactggaggagggcaagggtgacttggaggagtacggccaggatctgctccatacagtatttaagaatggtaaagtgacaaagagctattcctttgatgagatccgaaaaaacgcccagttaaacatcgagttagaggccgcacaccactag

SEQ ID NO: 245745 - DNA, 672 bp, Artificial Sequence
  Description of Artificial Sequence: Synthetic coding sequence
atgaagctccactacgtggcggtgctgactctggccatcctgatgtttctgacttggctaccagagtctttgagctgtaacaaggccctgtgtgcttccgacgtgtctaagtgtttgatccaggagctgtgccagtgccggccaggggaagggaattgctcctgctgtaaagaatgcatgctctgtctaggtgcactgtgggatgagtgctgcgattgcgttggcatgtgcaatcctcgcaactactctgacactcctcctacgtccaagagtaccgtggaggaattgcacgaacctattccaagcctgttccgcgcacttaccgaaggggacactcagctgaactggaatattgtgagttttccggtggctgaggagctcagccaccacgaaaacttggtgagcttcctcgagactgttaatcagccgcatcatcagaacgtgtctgttccatccaacaatgtgcatgcgccttattccagcgataaggagcacatgtgcacggtagtgtatttcgatgactgcatgtctattcaccagtgtaagatcagctgcgagtctatgggcgctagcaaatatcggtggttccacaatgcttgttgcgaatgtatcgggccagagtgtatcgactacggttcaaagaccgttaagtgtatgaactgcatgttctag

SEQ ID NO: 245746 - DNA, 2451 bp, Artificial Sequence
  Description of Artificial Sequence: Synthetic coding sequence
atggcggtgagtctggacgatgacgtgcccttgattctcactctcgacgagggtggctcagccccattggcccctagcaacggtcttggccaagaggagttgcctagcaagaacgggggaagctacgccattcatgatagccaagcacccagtctgtccagcggaggcgagtccagtccctctagtccagcccacaactgggagatgaattatcaggaggcggcaatatatctgcaggaaggcgagaacaacgataaatttttcacgcatcctaaagacgctaaagccttagctgcctacctcttcgctcacaaccacctgttctatctcatggagttagcgactgccctgctcctgctgctgctaagcctttgcgaagctcctgcagtgccggctctgcgactgggaatctacgtacatgccacccttgagctttttgcacttatggtggttgtgtttgagctgtgtatgaagctgcgctggctggggcttcataccttcatccggcataagcgtacaatggtgaagacaagcgttttagtggtgcagttcgtggaagctattgtcgttctggttcgtcagatgagtcacgtccgcgttacgcgcgctctgagatgtatattcctcgtggactgccggtattgcggcggagtgcggaggaatcttagacagattttccagagcttgcctcccttcatggacattctcctgctactgttgttctttatgatcatttttgctatcctcggtttttacctgttttcccccaacccgtctgatccatacttttcaaccctggaaaatagcattgtttctctctttgtcctcctcacgaccgctaattttcccgacgtaatgatgccctcctacagccggaacccttggtcttgcgttttcttcatagtttatctgtccatagagctgtactttattatgaacctcctcctggctgtggttttcgacacatttaacgatatcgagaagaggaaattcaagtcactactgctgcacaaaagaactgccatacagcacgcttataggctactgattagtcaacgccgacccgcaggcattagctaccgccagtttgaaggcttgatgcggttttataaacctaggatgagcgccagggagcgctatctcaccttcaaagcccttaatcagaacaatactccactcttaagcctcaaagacttttatgacatctacgaggtggccgctctgaaatggaaagccaagaaaaatcgcgagcactggttcgacgaactccccaggactgccctcctcattttcaaaggaatcaacatcctcgtcaaaagtaaggccttccagtacttcatgtatcttgttgtggcggtgaatggcgtatggatcctcgtggaaaccttcatgctgaagggcggaaactttttctctaagcacgtcccctggagctacctggtctttctgactatttacggagtcgaactctttctcaaagtggctggacttggacctgttgagtacctctccagcggctggaatctgtttgacttcagcgtaacagtgtttgctttcctgggtctgctcgcccttgctcttaatatggagcctttttatttcattgtcgtactccggccactgcagcttctgagactgtttaaactgaaagagcggtacaggaatgtcctggatactatgttcgaactgctgcccagaatggcctctctagggctcacccttctgattttttattactcgttcgcaatcgtcgggatggagttcttttgtgggatcgtttttcccaattgctgtaacacgtcaacggtggccgacgcatatcggtggaggaatcacaccgttgggaatcgcactgtggttgaagagggatattactatctgaacaacttcgacaacatcctcaactcatttgttacccttttcgagctgacagtggtgaacaactggtacataatcatggagggtgtcacctcacagacttcccattggtctcgactttatttcatgaccttttatatcgtcaccatggtggttatgactatcatcgtggcctttatcctcgaggcattcgtgtttagaatgaattactcacgaaagaaccaagactctgaggtggacggaggaattaccctagagaaagagatcagcaaggaggagctggtggccgtcctagagctttatcgggaagcgcgaggggcaagttccgatgtcacccgcctgctggaaacccttagtcaaatggagcggtaccaacagcacagcatggtttttctcggccgacggtccagaacaaagtcagatctgtcactcaaaatgtatcaggaggagatccaggagtggtacgaggaacacgctcgcgagcaggagcaacagcgtcagctctcttcatcagctgcaccagcggctcagcagccacccggatctagacaaaggagccagactgtgacatag

SEQ ID NO: 245747 - DNA, 2247 bp, Artificial Sequence
  Description of Artificial Sequence: Synthetic coding sequence
atgaattaccaggaagccgcaatataccttcaggaaggcgagaataatgataaattttttactcatcccaaggacgcaaaggcgctggcagcatacctgtttgcgcataaccatttgttttatctgatggaattagccacagcactgcttttattactcctttccctgtgcgaggccccagccgtcccagcactgcgactgggtatttacgtccatgctaccctggagttgttcgcgctaatggtggttgtttttgaactgtgtatgaagttacgctggctggggctccacacattcattaggcacaagagaacaatggtcaagacaagtgtcctggtggtgcagtttgtcgaagcaatagtggttcttgtgcgacagatgtctcatgttcgtgtcacaagagccctgagatgcattttcctcgtcgattgtaggtactgtgggggagtgcgtcgaaacctgcgacaaatcttccagtccttacctcccttcatggacatattgctcctcctgctcttctttatgatcatatttgccatcctcggattctatcttttctccccgaatccttcggacccctacttcagcacgctcgagaactcaatcgtgtccctgtttgtgctactgacgacagccaatttcccagacgtgatgatgccatcctacagccgaaacccctggagctgtgttttttttatagtctatctcagtattgagctgtacttcataatgaacctactgctagccgtcgtctttgataccttcaatgatatcgaaaagaggaagtttaaatccttgctgttgcacaagcgtaccgcaattcagcacgcttatagattactgatttcccaaagacggcctgcagggattagctatcgccagtttgaaggcctgatgcggttctacaaaccgagaatgagcgccagggaacgctatctgacattcaaggccctgaaccagaacaacacgcccctcctgtcactgaaagatttctatgacatctatgaggtcgctgcactaaagtggaaggcgaagaagaatcgagagcactggtttgatgagttacctcgcactgccctgcttatttttaaaggcattaacattctcgttaaaagtaaggccttccagtacttcatgtatcttgtggtcgctgtcaatggcgtgtggattctcgtggaaacttttatgttgaaggggggaaactttttttccaagcacgtcccgtggtcatacctggtgttcctgactatttatggggtggagcttttccttaaggtcgccggactcgggcctgttgaatatctatcgagcggctggaacttattcgatttcagcgtcactgtatttgccttcttgggactattagcattggcactgaatatggaaccattctactttatcgtcgtactcagaccgttgcagcttctgcggcttttcaaactgaaggagagatatagaaatgtactggatacaatgtttgaactgctgccacggatggcctctctcggcctgaccctgctcattttttactacagctttgctatcgtgggcatggaattcttttgtggaatcgtgtttccgaattgctgtaacacgtccactgtcgccgacgcctacagatggcgcaatcatacagtgggaaaccggactgtcgttgaggagggctattattatctcaataatttcgataacatcctgaattcatttgtgactttgtttgaactcactgtggtcaataactggtacatcatcatggagggcgtgacatctcagacctcgcattggagtaggctgtactttatgacattctacatcgtcaccatggtcgttatgactatcatcgttgcatttatcctggaagcattcgtctttagaatgaactattcacggaagaaccaggactccgaggtcgacgggggaatcacgttggagaaagagatctccaaggaggagcttgtggcggtgctggaactctacagggaagccagaggcgcatcatcagatgtgactcggctgcttgagacgctctcacaaatggagaggtaccagcagcattcgatggtctttttaggtagaaggtcccggaccaagtcagacctctcactgaaaatgtatcaggaggaaatccaggagtggtatgaggagcatgctcgcgaacaggagcagcaaagacagctgtcttcaagtgctgctcccgcagcccagcaacctccaggatcccgccagcgatcccagaccgtcacttag

SEQ ID NO: 245748 - DNA, 2667 bp, Artificial Sequence
  Description of Artificial Sequence: Synthetic coding sequence
atggagtcatgctacattgcccaggcaggcctggaattgttgggatctagttcctcaccaacacttacttcccagtcagcagaaatcacagaagacgcctcaaatgggggtgtcagtgagcagcatccatggcccagtggctttgagcgcgagctgaaacccgaaaccatcagctcaccaggctatcacatcctccgggctacaggagaggaaaacatggccgtctctttggacgacgacgtgccgcttatactaaccctcgatgagggcggtagcgcacccctagccccaagcaacgggctgggacaagaggaactcccttccaaaaacgggggtagctatgcaattcacgacagccaggcacccagtctgagctccggcggtgagtctagcccttcctccccagcacacaactgggagatgaattaccaagaagccgctatctacctgcaggaaggcgagaacaacgataaattcttcactcatcccaaagatgcgaaagccctcgcagcctacctttttgcacacaaccacctgttttatcttatggagctagctaccgccctgttgctcctgcttctatccttatgcgaagcacctgcagtcccagctctcaggctgggaatctacgtacatgcgactctggaactgtttgcactgatggtagtcgtatttgagctgtgtatgaagctgcggtggcttggccttcacactttcatccggcataaaagaaccatggtcaagacgtctgtgctggtggtacagtttgttgaagcgatcgtcgtgctggttcgccaaatgagccacgttagagtcacccgcgctctgcggtgcatattcctggtggattgtcgctattgcgggggtgtgagaaggaacctgcgacagatatttcagtctttgcccccttttatggatattctcttgttattactgttctttatgataatcttcgctattctcggtttctacttattttctcctaaccctagcgacccgtacttctctaccctagagaactccatagtgtctctattcgtcctcttaaccaccgccaattttccagatgtgatgatgccttcatactctcgcaatccatggagttgcgtgtttttcattgtctatctctccatcgagctctacttcattatgaatctcttgctcgccgtggtgttcgatacttttaatgatatcgaaaaacgaaaatttaagtccctgctgctccataagcgaactgccatccaacacgcttatagactcctgatatctcaacggaggccagctgggataagttacaggcagtttgagggattgatgcgattctataaacctaggatgtcagccagggaaaggtatctgacattcaaggctctgaaccagaataacaccccactgctgtcactaaaggatttctatgacatctacgaggtggctgccctgaagtggaaagctaagaagaatcgcgagcattggttcgatgagctgccccgaaccgccttgctgatctttaagggcataaatatccttgtaaagagcaaagcctttcagtatttcatgtacttggtggtagccgtcaatggcgtatggatcctcgtcgaaaccttcatgctgaaaggcggaaacttcttttcgaaacatgtgccatggtcgtatctcgtgttcttgaccatctacggcgtcgaactcttcctgaaagtcgcgggattaggccctgtcgagtacctctcctcgggttggaacctttttgatttctccgtgaccgttttcgcattccttgggctgctcgccctggcactcaatatggagcctttttattttatcgttgttctgcggccactacaactcctgagactgtttaagctgaaggagcggtacaggaacgttctcgacactatgttcgagcttctgcctaggatggcgtcacttggactgaccttgctgatcttctattattctttcgccatagtgggtatggaatttttttgtggcattgtcttcccgaattgctgtaacacaagcaccgtagctgacgcctacagatggcgcaatcacaccgtgggcaacagaacagtggtcgaggagggctactattacttaaataattttgacaacattctaaattcatttgttacattattcgagctgaccgtcgtcaataactggtatattatcatggagggcgttacgagtcagacaagccactggagccgactgtatttcatgactttctacatcgtgactatggtggttatgacgatcattgttgcattcatcctggaagcattcgtattcagaatgaactactctcgtaaaaaccaagattcagaagtggatggcggtattacattggagaaggagatttctaaggaagagcttgtggccgtcttggaactctaccgcgaagcgaggggagccagcagcgatgtgactagactgttggaaaccctgagtcagatggaaaggtaccagcagcattcgatggtttttctaggaagacggtcccgaaccaaatcagatctgtctctgaaaatgtatcaagaggaaattcaggaatggtacgaagaacacgctcgggaacaggagcaacagcgccaactgtcttccagcgccgcacctgctgcccagcagcccccaggctcccggcagcgatctcagacggtgacttag

SEQ ID NO: 245749 - DNA, 2667 bp, Artificial Sequence
  Description of Artificial Sequence: Synthetic coding sequence
atggagagttgttatatcgctcaagccggtttggagctcttgggctctagcagttcaccaacactgacaagtcagagcgctgaaattacagaagatgcgtcaaatggaggagtgtctgagcagcatccctggccttctggattcgagagggagttgaagccagaaaccatttccagtcctggataccacatcctcagggccactggcgaggagaatatggcggtatccctggacgatgatgtcccccttatcctcacgctggatgaaggaggctcggctccactggccccaagtaacggtctgggacaggaggaacttccttccaaaaacgggggaagctatgccattcacgactcccaggcaccaagcctgagcagtgggggagagagctctccgtcttcccctgcccataactgggaaatgaactaccaggaggccgctatctacctgcaggaaggcgaaaacaatgataagttttttacacaccctaaagatgcgaaagcgctggccgcttatctattcgcccataaccacctcttctacctgatggaattggccacggccttattgctcctcctcctgagcctgtgcgaggcgccagccgtacccgctctccgcctgggaatttacgtgcatgcaacattggagctctttgccttgatggtggtagtgtttgaattgtgcatgaaactgcgctggctgggcctccacacattcatccgacacaagaggactatggtgaagacttccgtgttggtcgttcagtttgtcgaggccattgtggtgctggtcagacaaatgtcacacgtaagagttactcgagccctcaggtgcatctttctggtcgactgtcgctactgtggcggtgtccggaggaatcttagacaaatatttcagtctttgccacccttcatggacattctgttactgttgctgttctttatgattatttttgcgatactgggcttctacctcttttcacccaatccctctgacccatatttctccactctcgaaaactcaattgtcagtctttttgtgcttctaactacagccaatttccctgatgtcatgatgccaagctactcaagaaacccttggtcctgtgttttcttcattgtatatctttccatcgagctttactttataatgaaccttctgcttgcagtggtttttgacacattcaacgatattgagaaacgcaaatttaagtccctgttgctgcacaaacggaccgctatccagcatgcataccggcttctgatttcacagcgcaggccggcagggatatcttatcggcagttcgaaggcctgatgcgcttttataagcccagaatgagtgccagagagcgctacctcactttcaaagccttgaatcagaacaacacacccctgttgagcctcaaagatttctacgatatctacgaagtagccgctctcaagtggaaagccaagaagaacagggaacactggtttgacgaactcccaagaacggcactcctcatattcaaaggtattaacatcctggttaagtccaaggcttttcagtattttatgtatctggtggtggccgtgaacggggtgtggatcctggttgaaacgtttatgcttaaagggggtaatttcttttctaagcatgtgccttggtcctacttagtcttcctgactatctacggggttgagctcttcttgaaagtagccggacttgggccagttgagtatctttcttcgggttggaatctatttgacttttcggtcactgttttcgcctttctcggacttcttgccctggctctcaatatggaacctttttattttatagtggtgctgaggcccttacagctgttgcgcttatttaaactcaaggagcggtatcggaatgtgttggatacaatgttcgagctcttgcccagaatggcaagcctcggcctgacactgctgatattttattatagcttcgcgatcgtcggcatggaatttttctgtggaattgtgttccccaattgctgcaatacttcgacggttgccgatgcctaccgctggagaaatcataccgttggtaataggaccgtggtggaagaaggctattattaccttaacaactttgataatatcctaaactctttcgttacactgtttgaattgaccgtagttaataattggtatataattatggaaggtgtgacgagccaaacctcccattggtcccggctctactttatgaccttctacattgtcactatggtagttatgacaattattgtggcctttattctggaagccttcgttttccgcatgaattactcacgtaaaaaccaggattctgaggtggatggcggaatcacactagaaaaggaaatcagtaaggaagagctggtcgccgtgcttgaactctacagagaggctcgcggagcatctagcgacgtgaccaggcttcttgagaccctgagccagatggagagataccagcagcactccatggtctttctggggaggaggtcccggacaaagagtgatctcagtttaaaaatgtaccaggaggagatacaggagtggtacgaggaacacgccagagaacaggagcaacagcgacaactgtctagctccgcagcaccagctgcccaacagcccccaggatcccggcaaaggagccaaactgtgacctag

SEQ ID NO: 245750 - DNA, 258 bp, Artificial Sequence
  Description of Artificial Sequence: Synthetic coding sequence
atggccgtgtctctggatgatgacgtgcctcttattttaaccctcgacgaagggggtagtgccccactggcaccatctaatgggctcgggcaagaagaacttccctctaagaacggtgggagctacgccatccatgactcccaggcaccctccctcagttctgggggagagtctagcccgtcctccccagctcataattgggagatgaattaccaggaagcagcaatttatttgcaggagggagagaataacgattag

SEQ ID NO: 245751 - DNA, 303 bp, Artificial Sequence
  Description of Artificial Sequence: Synthetic coding sequence
atggcagtcagcttggatgatgatgtgcctctaattctcacattagacgaagggggatccgccccactggccccatcaaatggactggggcaggaagagttgccctccaaacgtaggtgttgtatgctttgcagctcaaagcagaaaccatggattccatgtagggtgatctccgatgttgcctgcaaggccgcttcttgttttgagggcgctagcggcccttgcgacatctccatgtgggaatgctatagagtttgtaagcaaatggctgctgctatgccctctaccacaccccgaccctag

SEQ ID NO: 245752 - DNA, 2259 bp, Artificial Sequence
  Description of Artificial Sequence: Synthetic coding sequence
atggccgaaccgcaggcagaatcagagccactcctgggaggtgctcggggaggcggtggggactggcccgctggtcttaccacgtacagatcgatacaggtgggcccaggtgccgctgcaagatgggatctttgtatcgaccaggccgtggtgtttattgaggacgcaatccagtaccgttccatcaatcatagagtcgacgcctcttcaatgtggctgtataggcgatactattcgaatgtgtgtcaacgaaccttgtcctttacgatcttccttatattgtttctggccttcatcgaaactccaagctccttgacatcgaccgctgacgtaaggtatagggctgcaccctgggagccaccatgcgggctgaccgagtcagttgaggttctgtgtctcctggtgtttgctgcagatctgtccgtgaagggctacttgttcgggtgggcccatttccaaaaaaacctttggttactcggatacctggttgtcttggtggtgtcgcttgtcgactggaccgtaagcctgagcctggtctgccacgaacctcttcggatcagacgtctattgagacctttttttcttctgcagaattcttcgatgatgaaaaagacattgaagtgtattcgttggtccttaccagagatggcaagcgtgggtttactgcttgccatccatctctgcctcttcacaatgttcggaatgctgttattcgccggaggaaagcaggacgatgggcaagaccgcgaacgactcacctacttccagaacttaccggaatccctaacctctctgctggtgctgttaactaccgctaataacccagatgtgatgatcccagcgtactccaagaaccgcgcttacgccattttctttatcgtgttcaccgtcataggctcccttttccttatgaaccttttgacagccatcatctacagtcaattccgcggatatcttatgaagtcacttcagacgtcactatttcgtcggagactgggcaccagggcggcttttgaggtattaagttcgatggtcggggaaggcggtgcctttcctcaggcagtgggggtgaagccacagaatctgctccaggtcttgcaaaaggtacagttggactcttcccacaaacaggccatgatggaaaaggtaaggtcatatggctctgtgctactcagtgccgaggagttccagaaactgttcaacgagttagatagatccgttgtcaaggaacacccgccacgaccggagtatcagtccccctttctgcagtcagctcagtttctgtttggccattattacttcgattacctgggtaacctgattgctcttgcaaacctagtctctatttgcgtgtttcttgtgcttgatgccgatgtcttgcccgcagaacgagatgactttattcttgggattcttaattgtgtgtttatagtatactacctgctggaaatgctgctgaaggtgttcgcgctcgggttaagaggctacctctcgtaccccagcaacgtgttcgatggcctgctgactgtcgtgctgctcgtgcttgagattagcaccctagctgtgtaccgcctgccccaccctggctggaggcctgaaatggtaggcctgctaagtctctgggacatgacccgcatgctgaacatgctgatcgtcttccgatttctccgcattatcccctcaatgaaactgatggcagtggtggccagcaccgttctcgggctcgtgcaaaatatgagggcattcggtggaatactggtggtggtgtactacgtcttcgctatcattggtatcaacctattccgaggcgtgatcgtcgccctacccggaaattcaagtttagccccagccaacgggtccgccccatgtgggtcattcgaacagctggagtactgggccaataactttgacgacttcgccgcagctctcgtaactctctggaacttaatggtggtcaataattggcaagttttcctcgatgcctaccgaaggtatagcggcccttggagtaaaatttacttcgtcctgtggtggctcgtctccagcgttatctgggtgaacctgttcctggccctgattctggagaactttttacataaatgggacccgagaagtcatctgcagccactcgcgggtaccccggaagccacctaccaaatgaccgtggaactgttatttagggacattcttgaggaacctggcgaggacgagctcaccgaacggctctcccagcacccccacctgtggctctgtcgatag

SEQ ID NO: 245753 - DNA, 1407 bp, Artificial Sequence
  Description of Artificial Sequence: Synthetic coding sequence
atgtggctgtacagaagatactactccaatgtctgccagaggaccttatcttttactatttttcttatcctgttcctggctttcatcgaaacccctagcagcctcacgtccacggccgacgtgagataccgagccgctccatgggagccaccatgcgggcttacagaatcagtggaggttctgtgtttattggtgttcgctgcggatctcagcgtgaaggggtacttgttcggatgggctcacttccagaagaatctatggctcttaggctacctggtagttctggtcgtgtcccttgttgactggaccgtgtcattgtcacttgtttgccatgagcccctccgcatccggaggctgttacgccctttctttctgctgcagaattcatccatgatgaaaaaaaccctcaagtgcattagatggtccctcccggagatggcttcggtgggactcttgttggctatacacctctgcctgttcactatgtttggcatgctactgttcgccggaggaaaacaggatgacgggcaagatagggaaagactaacatatttccagaacctgcccgagtccctcaccagtctcctggtcctcctgaccacagcgaataatccagacgtgatgatccctgcctactcgaaaaaccgcgcatacgctatcttcttcatcgttttcacagtgattggatctctcttcctgatgaatcttctgaccgctattatttacagccagttccgtgggtacctgatgaagtcgcttcagacaagcctgttccggaggcggttgggaaccagggctgccttcgaagtgcttagttctatggtgggtgaggggggagccttcccgcaggcaacaagacgcggaccctctacctctctgagattctgccgcgctcccagttcttcttctgcaaccacaacattaacgacctggggaacctctagtccctggcagacctggtgtccattcgcttgctcctggtgctggatgcagatgtgctgcttattgagtgtgatgacaagctcctggggcttttcgactgcatcgtccctgtgtactacctgttggcgctgctgtagccgcagcctgccctgggcttgtgaaggaacgtgtcccacccctgctacatgcttaactggatccagccctttatcctgctggcggcctgagatggtgggcttactgtcgctttgggatatgactaggatgctaaatatgttaattgttttccggtttctgcggattattccctccatgaaacttatggccgtcgtggcatccacagtgctcgggttagttcagaacatgagggctttcggaggtattctcgtacctggcccatgccagtggctgggggctctgtgggagctgcgagcggctggtgtactgggacagcagctgaggtag

SEQ ID NO: 245754 - DNA, 1584 bp, Artificial Sequence
  Description of Artificial Sequence: Synthetic coding sequence
atgattctatctagttataacaccatacagtccgtcttctgttgctgttgctgttgtagcgtccagaagcggcagatgcgtacccaaattagcctctccacagacgaggaactgcctgagaagtatactcagcgacgcagaccgtggctgagccagttgtctaataagaagcagtcaaatacaggcagagtccagccctcaaaaagaaaacctctgcctccgctgcccccaagtgaagtggccgaggagaagatacaggtgaaagctctgtacgacttcctgccacgtgaaccttgtaacctggcactgaggcgggcagaggaatatttgatcctggagaaatacaacccacactggtggaaggccagggacagacttggaaacgaaggtcttattcctagcaactatgtaacagagaataaaataactaacctcgagatttatgagtggtaccacagaaatattacccgtaaccaggccgaacacctgttaaggcaagagagcaaggaaggggcttttatcgtgcgggactctcggcatctgggatcttataccataagtgtgtttatgggtgctcgcagaagtactgaggccgctatcaagcactaccagatcaaaaagaatgacagcggccagtggtatgtagccgagaggcacgcttttcagtcaattcccgaattgatatggtaccaccagcataacgctgccggtctgatgaccaggttacgttacccggtgggactgatggggtcatgcttgcccgcaacggccggattctcttatgaaaagtgggaaattgacccaagcgagctcgcttttataaaggagatagggagcgggcaatttggcgtagtgcacctgggcgaatggaggtcccatattcaggtggccatcaaagctatcaacgaggggtccatgtccgaggaagattttatcgaagaagcgaaagtgatgatgaaattgagtcattctaaactggtgcaactgtatggagtctgcatacagagaaagcccctgtacatcgttactgaattcatggaaaatggctgtctactgaattacctgagggaaaacaaaggcaagcttaggaaagagatgttgctgtcggtgtgtcaggacatttgcgagggtatggaatacctggagaggaatggatacattcatcgggacttggcagctaggaactgtcttgttagcagcacttgcatcgttaagatcagtgacttcggcatgacccgctacgtgctggacgacgagtacgtaagcagttttggtgcgaaatttccaatcaaatggtccccacctgaggtgtttctgtttaataaatacagcagcaagagtgatgtgtggtcctttggggtcctgatgtgggaggtttttacagagggaaaaatgcccttcgagaataaatcaaatcttcaggtcgtcgaagctattagtgaaggatttaggttataccgaccccacctcgccccaatgagtatttacgaggtgatgtactcatgctggcacgaaaaaccagagggaaggccgacttttgccgagctccttagagccgtgacagagatcgctgagacctggtag

SEQ ID NO: 245755 - DNA, 342 bp, Artificial Sequence
  Description of Artificial Sequence: Synthetic coding sequence
atgggtggcctagaaccctgttcaaggctgcttctgctgccgctgctactggcggtcagcgggctgcgtccggtccaggcgcaagcacagagcgattgctcttgttcaacagtcagcccaggcgtcttagcagggatcgttatgggtgatttggtgctcactgtgctcatcgctctggccgtgtatttcctgggacgcctggttcccaggggcaggggcgctgcagaggcggcaacgaggaagcagagaatcaccgaaacagagagcccttatcaggagctgcaaggacagcgctccgacgtgtattctgaccttaatactcagaggccctactacaaatag

SEQ ID NO: 245756 - DNA, 339 bp, Artificial Sequence
  Description of Artificial Sequence: Synthetic coding sequence
atgggcggtctcgagccatgttctaggcttctcctgcttcccctgttgctcgccgtctcggggctgaggccagtgcaggcgcaggcacagagcgactgtagctgttcaaccgttagcccaggcgtacttgccggaattgtcatgggcgacctagtgctgacggtgctgatagccctggccgtttatttcctgggaagactggttcctcgtgggaggggcgctgccgaggccacacgaaagcaacgcatcactgagactgaatctccctaccaggaactccagggccaaagaagcgacgtctactccgatctgaacacacagaggccatactataagtag

SEQ ID NO: 245757 - DNA, 309 bp, Artificial Sequence
  Description of Artificial Sequence: Synthetic coding sequence
atgggaggtttagagccatgttcacggctgttgctacttcctctgctactggccgtgagcgattgtagctgttccactgtttcgcccggagtacttgccggtatagtaatgggcgacctggttttaacagtgctcatagcgctggccgtatactttctggggcgattagtgccccgtggccgtggggctgcggaggctgccaccaggaaacagaggattactgaaaccgagagcccataccaggagttgcagggacaaaggtccgacgtgtattctgacttaaacacccagcggccatactacaagtag

SEQ ID NO: 245758 - DNA, 339 bp, Artificial Sequence
  Description of Artificial Sequence: Synthetic coding sequence
atgggcggactggaaccatgtagtaggctcctgctgttacctctgcttctggccgtctctggcctccggccagtgcaggcacaagcccagtctgactgtagctgttcgaccgtatcccctggtgtgcttgctggcatcgtgatgggcgacttggttctcaccgttttgatcgccctcgctgtttacttcctcgggagactggtcccgcgaggcaggggggctgccgaagcaacacggaaacagcggatcacggaaaccgaatccccatatcaagaactccagggccaacgaagcgacgtgtatagcgatctgaacacacagcggccatattataagtag

SEQ ID NO: 245759 - DNA, 2673 bp, Artificial Sequence
  Description of Artificial Sequence: Synthetic coding sequence
atggccctgcgcagaagcatggggcgacccggacttcctccactacccctcccaccccctcctaggctcggtttgctgctggctgccctagcaagtcttcttctccctgagtctgcagccgctggcttgaagctgatgggcgctccagtgaagcttactgttagccaagggcagcccgttaagctcaactgtagcgtagaagggatggaggagcccgacattcagtgggttaaggatggggcagttgtgcaaaacctcgaccagctctatatcccagttagcgagcagcactggattggcttcctgtcactaaagtcagtggagagatccgatgccggacggtactggtgtcaggttgaggatgggggtgaaacagagattagtcagcctgtgtggctaactgtggagggagtgcccttttttaccgtcgaaccaaaggacctcgcagtccctcccaatgccccattccagttgtcctgcgaggcagttgggccacctgaaccagtaaccatcgtgtggtggaggggcactacaaagattggcggtcctgcgcctagcccttccgtactcaatgtgactggagtgacccagagcaccatgttctcttgcgaggctcacaacctaaagggccttgcctcttccaggacagcaaccgtccacttacaggcactgcccgcagccccattcaacatcactgtcacaaagttgagttcctctaatgcgagcgtggcttggatgccaggtgcggacggccgagcactgcttcagtcctgcaccgtacaggttactcaggcccctggcggatgggaggtgcttgcagtcgtggttcctgtgccccctttcacctgtctgctccgggatttggtgcccgctacaaactatagcttaagagtgagatgcgctaacgcccttggcccttccccctacgcagactgggtcccattccaaactaagggcctggcccctgcatccgcgccacagaatctgcacgccatccgcaccgactcaggactcattttagagtgggaggaggttatccccgaggctcccctcgaaggccctttgggaccgtacaaattgtcctgggtgcaagataacgggactcaagacgaactcaccgttgagggaactcgggctaatctgactggatgggacccacagaaggacttaatcgtgcgggtgtgtgtgtctaatgcggtggggtgcggtccatggagccaacctctggtggtgagtagccacgacagggccggacagcagggcccaccacatagtcgtacctcttgggtgccggtggttctcggcgtgctgaccgcgctggtgactgcagccgcattggccctgattttactacggaagagaagaaaggaaacccgctttgggcaggccttcgacagtgtgatggcgcgaggcgagccagcggtgcacttcagggcagccagaagttttaatagagaacgccctgagaggatcgaggccaccttggattccctgggtattagcgatgagctgaaagaaaagctggaggatgtgctgatccctgagcagcagttcacgctgggtcggatgctgggcaagggcgagttcgggagcgtgagggaggcacagcttaagcaggaggatggctcgttcgtcaaggttgcagtgaagatgctgaaggctgacattatagcatcttccgacatcgaagagttcctgagggaagccgcttgtatgaaggagttcgaccatccacacgtcgccaagctcgtgggcgtctcactgcggtctcgggctaaaggcagacttccaatccctatggtcattcttccattcatgaagcatggtgatttgcacgcattcctactggcaagccggattggtgagaatccattcaatctgcccctccaaacgctgatccgttttatggtagacattgcttgtggaatggaatatctgtctagtagaaattttattcacagagacctcgcggcacggaactgtatgctcgctgaggacatgacagtctgtgtggccgatttcggtctaagcaggaaaatttatagtggagactattaccgccagggatgtgcaagcaaactccctgtgaagtggctggccctggagagtctcgctgataatctctatacagtccaatcagatgtgtgggccttcggagtaaccatgtgggaaataatgacacggggacagacaccctatgccggtatcgagaacgctgagatttacaattacttaattggcggtaaccggttgaagcagccacctgagtgtatggaagacgtgtacgacctgatgtaccaatgttggtctgcagatcctaaacagcgcccatcttttacctgtctgcgtatggaacttgaaaatattttggggcagcttagtgtgctttccgcttcccaggaccccctgtatatcaatatcgaaagggcggaagaaccaaccgcaggaggatccttggagctgccaggacgggaccagccttatagtggcgcaggggacgggagtggaatgggtgccgttggcggaactccgagcgactgtagatatatcctgactccaggcggtctggccgaacaaccaggacaagcagagcatcagcccgagagtcccctgaacgagacccaacggctgcttctgctgcaacaggggctgcttccgcactcaagctgctag

SEQ ID NO: 245760 - DNA, 2529 bp, Artificial Sequence
  Description of Artificial Sequence: Synthetic coding sequence
atggaagaacctgatatacagtgggtgaaggatggtgctgtggtccagaacctcgatcaactgtacatccctgtgtctgagcaacattggattggttttcttagcctgaagtcagtcgagcgcagtgatgccggacgttactggtgccaggttgaggacggcggtgagaccgaaatcagccagcctgtatggctgactgtggagggtgtacctttttttaccgttgagcctaaggacttagctgtgccgcctaatgccccattccaactttcctgcgaggctgtcggtcccccagagccggtcacaatcgtttggtggcgcggaacgactaagatcggcggacccgctcccagcccgagcgtcctaaacgtgacaggcgtcactcagtctacaatgttctcgtgcgaggcccacaacttgaagggactcgcttccagcagaactgccacagtgcacctgcaggccctccctgctgcccctttcaatatcaccgtgacaaagctcagctcatctaacgcttcggtggcctggatgcccggagcagatggcagagccctgctgcaatcttgcacagtacaggtgacacaggcccctggcggatgggaagtgctggccgtcgttgttccggtaccaccatttacatgcctcctcagggatctggtgcctgctaccaactattccctgagagttagatgcgccaacgcccttggaccatccccctacgccgattgggtcccgtttcagaccaaaggattagcgcctgcttccgctcctcagaatcttcatgccataagaacagattctggtctcatattggagtgggaagaagtgattcccgaagcgccactggagggacctctcggtccctataaactctcctgggtgcaagataacggcacacaggatgagctgactgtggagggaactcgggcaaacctaaccggctgggatccacaaaaagatcttattgtccgagtatgcgtctcaaacgcagttgggtgcggcccatggtcccaaccactcgtggtgtcttcccacgatagggcaggtcagcaggggccaccgcactccaggacttcatgggtcccagtggtgttaggagtgttgacagcccttgtcaccgcagcagccctggccttgatcctgctccggaagcgaaggaaggagaccaggttcggtcaagcttttgactcagttatggccagaggggagcctgctgttcactttcgagcggcacggagcttcaaccgggaacgcccagagagaatcgaggccaccctcgattctctcggcatcagtgacgagttgaaagagaagctggaggacgtcctcatccccgaacagcagtttacgctgggtagaatgctcggtaagggggagttcggcagcgtgcgggaggctcagctgaagcaggaagatgggtccttcgtcaaagtggcagtcaaaatgctgaaggcagatattatagcctcttcagacatagaagagttcctgagggaagctgcatgcatgaaagaatttgatcatccccatgtcgccaagctggtgggcgtgtccttgaggtcccgagccaaggggagattgccaattcccatggttatactcccgttcatgaagcatggggatctccacgcatttctcctagcatcgcgcatcggagagaatccattcaacctgccgctgcagacactaattcgcttcatggtcgatatcgcttgcggtatggagtatcttagtagccgcaattttatacatagggatctcgctgccagaaattgtatgctggctgaagatatgacagtgtgtgtggccgacttcgggcttagccggaagatctactccggcgattattaccgacagggatgcgcctccaagttgcccgtgaagtggctggctctggagagtttagccgacaatctgtacaccgtccaaagcgacgtctgggcatttggcgttactatgtgggagatcatgacacgcggtcagaccccatacgccggaatcgaaaacgcagaaatctacaattacctgattggagggaacaggctcaaacagcccccagaatgcatggaagatgtgtacgatctgatgtaccaatgctggagcgccgatccaaagcaaaggcctagctttacctgtctgcggatggagttggaaaatattctgggtcaattgtctgtcctcagcgctagccaggaccctctctatatcaatatagaacgcgcagaggagccgaccgctggcggttcactcgaacttcctggaagggaccagccatacagtggggctggagacggctcaggcatgggtgcggtaggcggtactccatccgattgtcgctacatccttacccccggaggtctggccgagcagccgggacaggccgagcaccagcccgaatcccctctcaacgaaacccagcgtctgttattattgcagcaggggcttcacactgtggcggtttctccccaggccgagggcatcggcgcaatctggcccgcactcgttgccactgagctggcagattag

SEQ ID NO: 245761 - DNA, 741 bp, Artificial Sequence
  Description of Artificial Sequence: Synthetic coding sequence
atgacaatggacaagtccgagttagttcagaaggcgaaactcgctgaacaggcggaaagatacgatgatatggccgcagcaatgaaggcagtgacggagcagggccatgagctgagtaacgaggagcgtaatcttcttagcgtagcttacaagaatgtggtgggtgcacggcgttctagctggcgggtgatctcatccattgaacagaaaacggaaaggaacgagaagaaacaacagatgggtaaagagtatcgcgaaaagattgaagccgagctgcaggacatttgcaatgatgtgctggaactcttggacaaatatctgattcccaacgctactcaacctgagagcaaggtgttctatcttaagatgaaaggcgactattttagatatctcagcgaggttgcttcaggcgataacaaacagaccaccgtctcgaattcccagcaggcttaccaggaggccttcgaaatctctaaaaaggaaatgcagcctacccaccctattaggctcgggcttgcgctcaatttctccgtgttctattacgaaattttgaacagcccagaaaaggcatgttccctcgccaagacggctttcgatgaggctattgctgaactggatacactgaacgaggaatcttacaaggattctactttaatcatgcagctgctgagagataatttaactctgtggaccagcgaaaatcagggggatgagggagacgccggtgagggcgagaactag

SEQ ID NO: 245762 - DNA, 741 bp, Artificial Sequence
  Description of Artificial Sequence: Synthetic coding sequence
atgactatggacaaatccgaactggtgcagaaagccaagctggccgaacaggcagaacggtacgacgatatggccgctgccatgaaggccgttactgagcagggccacgaactgagcaatgaagaacgtaatctcctctctgtagcctacaagaacgtggtaggggctcgcaggtcttcatggcgggttatcagttcaattgagcagaagaccgagagaaacgaaaagaagcaacagatgggcaaagagtacagagagaaaatcgaggccgagctgcaggacatttgtaatgacgtgctggagctgcttgataagtatttaattcctaatgcaacacagcccgaatcgaaggttttctacttgaagatgaagggagattacttccgatatttgtcagaagtggcatcaggtgataacaaacaaacaactgtgtcaaattcacagcaggcataccaagaggcattcgaaattagtaagaaggagatgcagcctacccaccccattaggctggggcttgccctaaattttagtgtcttttactacgaaatcctcaactctccagagaaagcctgtagtctggccaagactgcctttgatgaagccatcgccgaactggacacactcaacgaggagtcgtataaagatagcacactgatcatgcagctcctgagagataacctgactttatggactagcgagaaccagggtgacgagggagacgccggagagggcgagaattag

SEQ ID NO: 245763 - DNA, 303 bp, Artificial Sequence
  Description of Artificial Sequence: Synthetic coding sequence
atgacgatggacaagagcgaacttgttcagaaggctaagctggccgagcaggccgagcggtatgacgatatggcagcagcaatgaaggccgtgaccgagcaggggcacgaactgagcaatgaggaacgcaatctactgtccgttgcgtataaaaatgtggtcggcgcacggaggtcctcttggcgcgttattagctccatcgagcagaagaccgagagaaatgaaaaaaagcaacagatgggcaaggaataccgggagaaaattgaggccgaactacaagatatctgtaatgatgtgctgtag

SEQ ID NO: 245764 - DNA, 225 bp, Artificial Sequence
  Description of Artificial Sequence: Synthetic coding sequence
atgacgatggacaaatcagagctcgtgcaaaaggctaaactcgccgagcaggctgaacgatatgacgacatggcggctgcaatgaaagcagtcaccgagcaggggcatgaattgtcaaatgaggaaaggaacctgctgagcgtcgcctataagaatgtcgttggagccaggcgatcaagttggagagtgatttctagtatagagcagaagactgaaagaaattag

SEQ ID NO: 245765 - DNA, 768 bp, Artificial Sequence
  Description of Artificial Sequence: Synthetic coding sequence
atggacgaccgagaggacttagtttaccaggccaagctggccgaacaggcagagcggtacgatgaaatggtcgaatccatgaagaaggtggccggaatggacgtggaattaactgtggaggagcgtaacttattaagtgttgcatacaagaacgtgatcggggctcgtcgcgcttcatggcgaatcatctcgtcaatcgagcagaaggaggaaaataagggcggtgaggataagttgaagatgatccgggagtataggcagatggttgagaccgagctgaagcttatatgctgcgacattttggatgtgttggacaaacatcttatcccggctgctaataccggggagtctaaagtcttctactacaaaatgaagggtgactaccacagatacctggctgaattcgcgactggaaatgatcgcaaggaagctgctgagaactcactcgtcgcttacaaagcagcatctgatatcgccatgactgagctgcccccaacccacccaattcgattaggcctggctctgaacttttcagtgttctactatgagatcctgaactctcccgatagggcatgcaggttggccaaggcggcattcgatgacgccatcgctgagctggatactcttagtgaagagtcttataaagatagcactctgataatgcagttattgcgcgacaatctgactctgtggacctccgatatgcagggcgacggcgaagaacaaaacaaggaggcactgcaggatgtcgaggatgaaaaccagtag

SEQ ID NO: 245766 - DNA, 702 bp, Artificial Sequence
  Description of Artificial Sequence: Synthetic coding sequence
atggtggaatcaatgaagaaggtcgctggcatggatgtcgagttgacagttgaggagaggaatttactctcggtggcctataagaatgttattggcgcaagaagggctagctggcggattatttccagcatcgagcagaaggaggagaataagggcggtgaagataaactgaaaatgattagagagtatagacagatggtcgaaacagaactgaaactgatctgctgcgatatactcgacgttctggacaagcatctcatccccgctgcaaacacaggggagtctaaggtgttctattataagatgaaaggggactatcatcgttacttagccgagtttgctacagggaacgaccgcaaggaagcagccgagaatagtctggtggcctacaaggcagcctccgatattgcgatgactgagcttcccccaacacatcccatcaggcttggtctggcacttaattttagcgttttctattatgagattcttaacagtcccgatcgggcatgtcgcctggcgaaagctgccttcgatgacgcgattgcagagctggataccctgtccgaagagtcctacaaagacagcactctcatcatgcagctgttgagagataacctgacgctgtggaccagtgacatgcaaggcgacggcgaggaacagaataaagaggccctccaggatgtggaggatgagaatcagtag

SEQ ID NO: 245767 - DNA, 744 bp, Artificial Sequence
  Description of Artificial Sequence: Synthetic coding sequence
atggtggatagggagcaattggtccaaaaagccaggctggcggagcaggctgagcgctatgatgacatggcagccgctatgaaaaatgtgactgaactgaacgagccgctgagtaacgaggagcgaaacttgctgtccgttgcctataagaatgtggttggcgctcgtcgatcatcctggcgggttatctcatcaatcgagcagaagacttcggccgacgggaacgagaagaagattgaaatggtccgagcctaccgagaaaagatcgagaaagagctcgaggcggtctgccaggatgtcctatcactgctagacaattacctcattaagaattgctccgagacacagtacgagagtaaggttttctatctgaagatgaaaggcgactattatcgctacctcgccgaagtagctactggcgaaaagagagcgactgtcgtcgaatcatctgagaaggcctactcggaagctcatgagatcagcaaggaacacatgcagccaacgcacccaatcagacttggcttggccttgaattactctgtgttttattatgagattcagaatgcgccagaacaggcctgtcacctggcaaaaacggccttcgatgatgccattgctgaactcgacacgttaaacgaggactcctataaggattctaccctgatcatgcagctactgcgcgacaatcttactctttggacttccgatcaacaagatgacgacggcggtgaaggcaacaactag

SEQ ID NO: 245768 - DNA, 624 bp, Artificial Sequence
  Description of Artificial Sequence: Synthetic coding sequence
atggtcgaccgggagcagctggtgcagaaagctcgattggctgagcaggccgaacgatatgacgacatggccgcagctatgaagaatgtcacagagctcaacgaacctctgtcaaatgaagagcgtaacttgcttagcgtggcttacaagaacgtcgtcggggctaggcgcagttcatggcgcgtaatcagctctatagagcaaaagactagcgcagacggcaatgaaaaaaaaatcgagatggtgagggcgtaccgcgaaaagatcgagaaggagctggaggcggaagtcgctactggtgaaaagagagccactgttgtggaaagcagtgaaaaggcttactccgaagcacacgaaattagcaaagagcacatgcagccgacacatcctattaggctcggcctcgcactgaactacagcgttttctattacgagattcagaacgcccctgagcaggcatgtcatctcgccaagacagcgttcgacgatgcaatcgccgagctcgacactcttaacgaggacagctacaaggacagtacactgatcatgcagttgctgagagacaacctcacattatggacctccgaccagcaggatgacgacggaggagaggggaataactag

SEQ ID NO: 245769 - DNA, 678 bp, Artificial Sequence
  Description of Artificial Sequence: Synthetic coding sequence
atggctgcagcaatgaagaacgtaaccgagctgaacgagcctctcagcaatgaggagaggaatctactctcggtggcatataagaatgtggtaggcgcacgcaggtcaagctggagggtcattagctcaatagaacaaaaaacgagtgcggatggcaatgagaaaaagatcgaaatggtgcgagcttatcgggagaaaatcgaaaaagagctggaggctgtatgtcaggatgtgctgagcttactcgataactatctgattaagaactgttcagagacccagtacgaatccaaagtcttttacctgaaaatgaaaggagactactacaggtacctcgccgaggtcgcaaccggggagaagagggccaccgtcgtcgaatcctccgagaaggcttacagcgaggcccatgaaattagcaaggaacatatgcagcctacacaccccatcagactcggactggcgcttaactactccgttttctattatgaaatccagaacgctccagaacaggcctgtcacttggctaaaactgcctttgatgacgctatagctgaactagacacactgaacgaggattcatataaggattccacactgattatgcagctgttgagagataatctcactctctggacgagcgatcagcaggatgacgatggtggagagggtaataattag

SEQ ID NO: 245770 - DNA, 738 bp, Artificial Sequence
  Description of Artificial Sequence: Synthetic coding sequence
atggataagaacgagctggttcagaaggccaagttggctgagcaggcagagcgctacgacgatatggcagcctgcatgaaatctgtgaccgagcagggcgctgaactgtcaaacgaggaacggaatctcctctccgtcgcctacaaaaatgtggtgggtgcacgacgatccagctggagagtggttagttcgatcgagcagaaaaccgagggggcagagaagaagcagcaaatggctcgggaatatcgtgaaaaaatagaaacagagctaagagatatttgcaacgatgtcttgagtctgctggagaaatttttgatccccaacgccagccaagcagaatctaaagttttctatttgaagatgaagggcgactactataggtatctagcagaagttgcggcaggcgacgacaaaaagggcattgtggaccagtcacagcaggcttaccaagaagcattcgaaatcagcaagaaggaaatgcagcctactcatccaatccggctcggcctggctctaaacttttccgtgttttattacgagattctgaacagcccagaaaaagcctgttctctggcaaagaccgcgttcgatgaggccatagcagaactagacacccttagtgaagagagttataaggattctacacttataatgcagctgcttagagacaatctgaccctgtggacctcagatacccagggagatgaagctgaggccggagaagggggagaaaattag

SEQ ID NO: 245771 - DNA, 507 bp, Artificial Sequence
  Description of Artificial Sequence: Synthetic coding sequence
atggcacgcgaataccgagaaaagatcgagacagagctgagagatatctgtaacgatgttctgagcctgcttgaaaagttcctgattccaaatgccagtcaagctgaatctaaagtcttttacctgaaaatgaaaggagactattatagatacctagcagaggtggctgcaggcgacgataagaaaggtattgtggaccagagtcagcaagcttatcaggaagccttcgagatctcaaaaaaggaaatgcagcccactcaccccattcgactgggattggccttgaatttctctgtgttttattatgagatactgaatagccctgaaaaggcctgttcccttgctaaaactgccttcgatgaagctatcgcagagctggatactctatccgaggaaagctataaagacagcacattaatcatgcaactattgcgagacaatctcaccctgtggaccagcgacacacagggcgacgaggcggaagctggggagggtggtgaaaactag

SEQ ID NO: 245772 - DNA, 738 bp, Artificial Sequence
  Description of Artificial Sequence: Synthetic coding sequence
atggataagaacgaactcgttcagaaggcaaagttggctgagcaggccgagagatatgatgacatggcagcttgcatgaagagtgtgacagaacagggggcagagctgagcaatgaggaaaggaatctgctgagtgtcgcctacaagaacgtggtgggggcacggaggtcctcttggagggtggtgtctagcatcgagcagaagaccgagggagcagaaaagaaacagcaaatggctagggagtatcgcgagaagatagaaacagaacttagagacatctgtaatgatgtgctgagcttacttgagaagtttctgattccaaacgcctcacaagctgagtctaaggtcttctatttgaaaatgaagggtgattactatcggtatttggcagaggtcgcagcaggcgacgacaaaaaggggatcgtggatcaaagccaacaagcataccaagaagcgttcgagatttctaagaaggaaatgcagccgacgcaccctataaggctagggctggccctgaacttttcagttttttactacgagattctgaactcccccgagaaggcttgttccctagctaaaacagcttttgatgaagctattgctgaactcgatacattgagcgaggagtcgtacaaggactctactttaattatgcagcttcttagagacaatctcaccctctggacaagcgatacgcagggagacgaagccgaggctggggagggtggtgagaattag

SEQ ID NO: 245773 - DNA, 738 bp, Artificial Sequence
  Description of Artificial Sequence: Synthetic coding sequence
atggataagaatgaactcgtgcagaaagcgaagcttgcggagcaggctgaaagatatgatgatatggccgcttgcatgaaatcagtgacggagcagggtgccgagctgagtaatgaagaaagaaacctgctgtcggtggcctataagaatgtggtgggcgcaagacgctcatcatggcgagtcgtgagcagcatcgaacagaaaacagagggcgcagagaagaaacagcagatggccagagaatacagggaaaagatcgaaacagagctcagagacatatgcaacgatgtgctcagcctcctcgagaagtttctcatacccaatgcttcacaggcagagagtaaggtgttctatcttaaaatgaaaggagattattaccgatacctggcagaggtagccgcaggcgacgataagaagggtatcgtagaccaaagccagcaggcgtatcaggaagcttttgagatatctaaaaaagagatgcagcccacacacccaatcaggctggggcttgctctgaacttcagcgtgttttattacgagatccttaacagcccagagaaagcctgctctctggctaagactgcatttgacgaagccatcgccgagctggacacactctcggaagagtcttataaggactctaccctgatcatgcagctgcttagggacaaccttactttgtggacatctgatacacagggagacgaggccgaggcgggtgagggcggtgagaattag

SEQ ID NO: 245774 - DNA, 738 bp, Artificial Sequence
  Description of Artificial Sequence: Synthetic coding sequence
atggacaagaatgagttagtgcaaaaggctaagctggccgagcaggctgagcgctatgatgatatggccgcttgcatgaaatcggtgacagaacagggcgctgagctcagcaacgaagagcgaaatctcctgtccgtagcttacaagaacgttgttggcgcacggcgatctagttggcgcgtagtgtcctcaatcgagcagaagacagagggcgcagagaaaaagcagcagatggcacgtgagtatagggagaaaatcgaaacagagctgagggacatatgcaatgacgtgctctcgttgctagagaaattccttatacccaatgcctctcaagcagagtccaaggttttttatctcaagatgaaaggagactactaccgttacctagccgaggtggcggcaggagatgacaagaaaggaattgtggaccagagtcaacaggcgtaccaggaagcatttgagattagcaagaaagaaatgcagccaactcatcccatccgtctgggtcttgccctgaattttagcgtgttttattacgagattctgaactctcccgagaaggcctgttccctcgccaaaaccgcctttgacgaggcgatagctgaactggataccctgtcagaggaaagctacaaggactccacgctgattatgcagctgctgcgtgacaacctgacattgtggacatcagatacccagggtgacgaagctgaggctggagaaggcggtgagaactag

SEQ ID NO: 245775 - DNA, 738 bp, Artificial Sequence
  Description of Artificial Sequence: Synthetic coding sequence
atggacaaaaacgaactggtgcagaaggccaagctggcggaacaggctgagaggtacgacgatatggccgcttgtatgaagagtgtaaccgagcagggggctgagctgagcaacgaggagagaaacttactgagcgtcgcctacaagaatgtcgtgggcgctcgtcgcagcagttggcgggtggtgtcctccattgaacagaagactgagggggcagaaaagaagcaacagatggccagggagtacagagagaaaatcgaaacagaattgcgggatatctgcaatgacgtgctctctcttctggagaagttcttaattcctaacgcttcccaggccgagtctaaggtattttaccttaaaatgaaaggtgactactatcgctacctggctgaagtggcagctggagatgataagaagggaatagtcgatcagtctcagcaggcctatcaggaggcctttgaaatcagcaagaaagagatgcagcccactcaccccatccggctggggctggcacttaacttctccgtgttttattacgaaattctgaactctcctgagaaagcttgctcactcgcaaaaacagcattcgatgaggcgatagctgaactggatacgctctccgaggaatcatataaggattccacacttataatgcagttgttgagagacaacctcacattatggacctccgatacccagggggatgaggcggaagccggagagggtggagagaactag

SEQ ID NO: 245776 - DNA, 738 bp, Artificial Sequence
  Description of Artificial Sequence: Synthetic coding sequence
atggacaagaatgaactggtgcagaaggcaaaacttgccgagcaagcagagcgctacgatgacatggcagcctgcatgaagagcgtgaccgagcagggagccgagctcagcaatgaggaaaggaacctgctctctgttgcttacaaaaatgtggttggggctcgacggtcctcttggcgcgtggtctccagcatagaacagaagacagagggggcagaaaagaaacagcagatggcccgagagtaccgcgagaagatcgagacagagcttagagacatttgtaatgacgtcctttccctactggaaaagttcctgattcccaatgcctcccaagccgagagcaaagtgttctacctcaagatgaaaggggactattatagatatttggccgaggtggccgctggcgatgataaaaagggaattgtggaccagtctcaacaggcctaccaggaggccttcgaaatatcgaaaaaagaaatgcagcctacacatccaattagactgggactagccctgaacttttccgtcttctactacgaaatcctgaatagtcccgagaaggcatgttccctcgccaaaaccgctttcgacgaggcaatcgctgagctcgatactctcagcgaagaaagctataaggatagtacactgataatgcaacttctgagagataacctcaccttatggacatccgatactcaaggcgatgaagccgaagctggcgaaggtggagagaactag

SEQ ID NO: 245777 - DNA, 297 bp, Artificial Sequence
  Description of Artificial Sequence: Synthetic coding sequence
atggacaagaatgagctggtccagaaggctaagctcgcggagcaggcagagcggtacgatgatatggccgcatgcatgaagagtgtaaccgagcagggcgcagagctgtccaacgaagaacgaaatctgcttagcgtcgcttacaagaacgtggtcggggctcgcaggtcctcctggcgggtggtctcctcaatcgagcagaaaacagagggagccgaaaagaaacagcagatggccagggagtatcgtgagaagatcgagacagagttacgcgacatttgcaacgatgtgctatag

SEQ ID NO: 245778 - DNA, 738 bp, Artificial Sequence
  Description of Artificial Sequence: Synthetic coding sequence
atggacaaaaatgagctcgtgcaaaaagcaaaacttgccgagcaagctgagcggtatgacgatatggccgcttgtatgaagtccgtcactgagcaaggggcagaactctctaatgaagaacggaacttgctttctgtcgcgtataaaaacgtcgtcggcgctcgccgttccagctggagggtggtgtcaagtatcgagcaaaagacagaaggtgcagagaaaaagcagcagatggccagggaatatagagagaagattgagaccgagctacgggatatttgcaatgacgtgctgtctctcctggagaaattcctgattcccaacgcgagtcaggcagagtcaaaagtgttttacttgaagatgaaaggcgattattaccgctatctcgcagaggtggcggctggggacgacaagaagggaattgtggaccaatctcagcaggcgtatcaagaagctttcgaaatctcaaagaaggagatgcagcccacccatcccataaggttgggcctggctttgaacttctccgtattctactacgagatactaaactcaccggaaaaggcttgctcactggcaaagactgcgtttgacgaagctattgctgagctcgacaccttaagcgaagagtcctataaggactctacccttatcatgcagcttctccgcgataatctgacgctgtggaccagcgacacccaaggcgacgaggcagaagccggtgagggaggcgagaattag

SEQ ID NO: 245779 - DNA, 279 bp, Artificial Sequence
  Description of Artificial Sequence: Synthetic coding sequence
atggacaaaaacgagttggtgcaaaaggcgaagctggcagagcaggcggaacggtatgacgacatggctgcctgtatgaagtccgtgacagagcaaggtgcagagttgagtaatgaagaacgaaatttgttaagcgtggcttacaaaaatgtggtcggcgctcgtcgtagttcctggcgggtggtcagtagcattgagcaaaaaacagaaggagcagaaaagaagcagcagatggctcgggagtatagagaaaaaatagagacggagctacgggactag

SEQ ID NO: 245780 - DNA, 738 bp, Artificial Sequence
  Description of Artificial Sequence: Synthetic coding sequence
atggacaagaatgagctagtgcaaaaggccaaactagccgagcaggccgaaagatatgacgatatggccgcatgtatgaaaagtgtaacagagcagggtgccgaactctcaaatgaagaacgcaatctgctcagtgtcgcttacaagaacgtcgttggggcacgcaggagtagctggagagttgtctcttccatcgagcagaagaccgagggagccgagaagaaacagcagatggccagggagtacagagagaaaattgaaacagagctgcgtgacatctgtaacgatgtcctctccttattggagaaattcctgatcccaaacgccagtcaggccgaatcaaaggttttctacctgaagatgaaaggcgactattacaggtatctagctgaggtggccgcaggggacgataaaaaggggatagtggaccagtctcagcaggcataccaggaggcttttgagatctctaagaaggaaatgcagcccacgcatccaatccgacttgggctggccctgaatttcagtgtgttttactatgagatcctgaactcacctgagaaggcctgtagtctggcaaagaccgccttcgatgaagctatcgctgaactggacacactgagcgaggagtcttacaaagatagcacgttgatcatgcagctccttagagataatctcactttgtggacttctgatacacagggcgacgaggccgaggcaggggagggtggcgagaattag

SEQ ID NO: 245781 - DNA, 507 bp, Artificial Sequence
  Description of Artificial Sequence: Synthetic coding sequence
atggcaagggaatatcgcgaaaaaattgagaccgagctgagggacatttgtaacgacgttctgtctctgctggaaaagttcttgatccctaatgcaagccaggccgaaagcaaagtgttttatctgaagatgaagggcgactattaccgatatctggcagaggtggcagcaggagacgataaaaaaggcattgtggatcagagtcagcaagcctaccaggaagcatttgaaatctctaaaaaagagatgcaaccaactcaccccatccggttaggtttggccctgaacttctcggttttctactacgaaattctgaatagcccagagaaggcttgctccctcgccaaaaccgcatttgatgaagccatcgctgagcttgacacgctgagcgaagagagctacaaagatagtactctgattatgcagttacttcgcgacaatctgacactgtggacatcagatactcagggagacgaagccgaggcaggcgagggaggcgagaactag

SEQ ID NO: 245782 - DNA, 378 bp, Artificial Sequence
  Description of Artificial Sequence: Synthetic coding sequence
atgaagggcgattactatcgctaccttgcagaagtcgctgctggagatgacaagaagggtattgtggaccagtctcagcaggcctaccaggaagcgtttgaaatttctaagaaggaaatgcaacctactcatcctataaggcttggactggcattgaatttttcggtcttctactacgaaatcctcaactccccagagaaggcatgcagcctagccaagaccgctttcgacgaggccatcgctgagctagacacgctgtctgaggaaagctacaaggactccactctcatcatgcaactgctgagggacaaccttaccctatggacatccgacacacagggcgacgaggcggaggctggagagggcggagaaaattag

SEQ ID NO: 245783 - DNA, 414 bp, Artificial Sequence
  Description of Artificial Sequence: Synthetic coding sequence
atggacaagaatgagctggttcagaaagccaaattggctgaacaggccgaacgatacgatgatatggccgcatgcatgaaatccgttacagaacaaggtgcagagctcagcaatgaagagaggaatctgctgagcgttgcatataagaatgtggtgggagcccgacgcagttcatggcgcgtcgtcagcagtatcgaacagaagactgagggagcagagaaaaagcagcagatggcccgagaatatagagagaaaatcgagactgaacttcgcgatatttgcaatgacgtactgtctctcttggagaagtttcttatccccaacgcctcccaagccgagtcaaaggtattctacctgaaaatgaagggagactactaccgctatttggccgaggtcgccgcaggggatgactag

SEQ ID NO: 245784 - DNA, 741 bp, Artificial Sequence
  Description of Artificial Sequence: Synthetic coding sequence
atggacaaaaatgaactggtgcagaaggccaaacttgccgagcaagccgagcgttatgacgacatggcagcgtgcatgaagtctgtgaccgaacaaggagccgaactctcgaacgaggaacgcaatttactctcagtcgcgtataaaaacgtagtgggggcaaggagaagcagttggagagtggtgtccagtattgaacagaaaaccgaaggggctgaaaaaaaacaacagatggcccgagaatatagagagaaaatcgagaccgaactgagggacatttgcaacgacgtcctcagccttttagaaaaattccttattcctaacgcctcccaggctgagtccaaggtgttctacctgaagatgaaaggcgactactatcgctatctggcagaagttgccgcaggagatgacaagaaggtgcggtttggcgtatcctatcctgggatcgtggatcagagccagcaggcctaccaggaggcatttgaaatcagcaagaaagaaatgcagcctacgcatcccatccggctgggcctggctctgaatttcagcgttttctattacgagatccttaactcccccgaaaaagcttgttcattagcaaagacagccttcgacgaggccatcgcggaactggacacactttcggaagaatcatacaaagacagcacgctgataatgcagcttttgagagacaacctcacgctttggacatcagatacacagggcgatgaggccgagtag

SEQ ID NO: 245785 - DNA, 513 bp, Artificial Sequence
  Description of Artificial Sequence: Synthetic coding sequence
atgtctcaaccctgcagaaagttatggcgacacaattacgagacatcctcatgcatcgagtttttgaagagcctcttagagaagttcctcatccccaatgcgagtcaagctgaatctaaggtattctatttgaaaatgaaaggagattactacaggtacctggcagaggtagccgcaggagatgacaagaagggcattgttgatcagtctcagcaggcgtatcaggaggctttcgagataagcaaaaaagagatgcagccgactcacccaatcagactggggcttgcgctaaacttctccgtcttttattacgagatattgaatagtcctgaaaaagcttgctccctggcaaaaactgcttttgacgaagctattgcggaactggacacacttagcgaagaatcgtataaggactctactctcattatgcagttgctgagggataacctgacgctttggaccagcgacactcaaggggacgaggctgaagctggcgagggaggcgaaaactag

SEQ ID NO: 245786 - DNA, 378 bp, Artificial Sequence
  Description of Artificial Sequence: Synthetic coding sequence
atgaagggagattactatcgctatttggcggaagtggcagccggtgatgataaaaaagggatcgtagaccagagtcaacaggcttatcaggaagctttcgagatctccaaaaaagaaatgcagcctacacatcctatccggcttggccttgcccttaatttctctgttttttactacgaaattttgaactccccagagaaggcctgctctttggcgaaaaccgcctttgatgaagcgatagcagagctggacacgctgagcgaggagagctataaagatagcactctcatcatgcaactgctccgagataacctgaccctgtggacctccgacacccagggtgatgaggcggaggccggtgaaggtggagaaaactag

SEQ ID NO: 245787 - DNA, 228 bp, Artificial Sequence
  Description of Artificial Sequence: Synthetic coding sequence
atggataaaaacgaactcgtccaaaaagcaaaattggccgaacaggcggagcggtatgatgatatggctgcttgcatgaaaagtgtcacagaacagggagcagagttgtcaaacgaagagagaaatctgcttagcgtcgcatataagaacgttgtgggagccaggaggtcctcctggagagttgtctcatctattgagcagaagaccgaaggtgctgaaaaaaagtag

SEQ ID NO: 245788 - DNA, 393 bp, Artificial Sequence
  Description of Artificial Sequence: Synthetic coding sequence
gtattctacttgaaaatgaaaggcgactattatagatacctggcagaagtggctgccggagacgataaaaaagggattgtcgatcaaagccagcaagcctaccaggaagcttttgagatttctaagaaggagatgcaaccaacacaccccatcagattgggattggcactgaatttctcggtcttttactacgaaattctcaatagccctgagaaagcgtgttcgctggcaaagactgcattcgatgaggccatcgcagagctcgatacgctgtccgaagagtcttacaaagacagcactctgataatgcaattgcttagagacaacctgacgctttggacttcagatacacagggcgacgaagccgaggcgggtgaggggggagaaaattag

SEQ ID NO: 245789 - DNA, 159 bp, Artificial Sequence
  Description of Artificial Sequence: Synthetic coding sequence
atggataagaatgaattggtccagaaggccaaactggccgaacaggcagaaagatacgacgacatggctgcttgcatgaagagcgtcaccgaacagggtgctgaactgtccaatgaggagagaaaccttctgtcagttgcttacaagaacgtcgtgtag

SEQ ID NO: 245790 - DNA, 1224 bp, Artificial Sequence
  Description of Artificial Sequence: Synthetic coding sequence
atgccaacacccgatgccactactccacaagcgaaaggcttcagaagagccgtctccgagctagacgcaaaacaggccgaagctatcatggtgagaggtcagtcgccaaggttcattggacgacggcagagccttatcgaggacgctcgcaaggaaagagaggctgccgtggcggctgcagccgctgccgtcccttccgagccgggtgaccctcttgaggccgtcgcatttgaagagaaggagggcaaggctgtgctcaatctcctgttctcacccagagcgacaaaaccttccgccttgtcacgcgcagtcaaagtttttgaaacatttgaggccaagatccatcatcttgaaactcggccagcccagcgacccagagctggtgggccacacttagagtacttcgtacgcctcgaagtgcgcagaggagatttggccgcattgctttctggagtccgtcaggtgagtgaggatgttcgctctccagcaggtccaaaggtaccctggtttcctcggaaagtctccgaacttgataagtgtcatcatttggtcacgaaatttgaccccgatctggatctggaccaccctggattctccgatcaagtgtaccgccagagacggaagctgattgcagagattgcgttccagtacaggcacggggatcccatcccgagagtcgagtacacggcggaggagatcgccacatgggactgctgtcacgagctgttgggacacgtacctatgctcgcagatcggacatttgcacagttttcccaggacatcggccttgcctctctcggggcatctgatgaggagatagagaaattgtccacattatattggttcaccgtagagtttggactttgcaagcagaacggagaggtcaaggcctacggggcaggcttgcttagcagttatggcgaattgctgcactgcttatctgaggaaccagagatccgtgcgttcgacccggaggcggcagccgtgcaaccttaccaggatcaaacataccaatccgtgtacttcgtgtccgagtcttttagcgacgcaaaggataaactgcggtcatacgccagccgtatacaaaggcccttcagtgtgaagtttgatccatatacgctggccattgatgtgttggattcacctcaggccgtaaggcgttctcttgagggagtgcaagacgagctggacacccttgcccacgcgctgtcggcgattggatag

SEQ ID NO: 245791 - DNA, 1494 bp, Artificial Sequence
  Description of Artificial Sequence: Synthetic coding sequence
atgcctacacccgacgcaaccacaccacaagccaagggattccggagggcggtcagtgagctcgacgccaagcaggcagaggccatcatgtccccacggttcattggaaggcgtcaaagtctgatagaagacgctcgaaaggagagagaagccgctgttgcggcagccgctgcagcagttcctagtgaaccaggcgatcccctagaggcagtcgcctttgaggagaaagaaggaaaggcggtccttaacctgctcttttcccccagggcgacgaagcccagtgctctgtctagggcagtaaaggtgtttgagacattcgaggctaaaattcatcaccttgaaaccagaccggctcaaagaccgagggccggagggcctcaccttgaatacttcgttagacttgaggtgcgtcgaggtgatcttgccgctcttctgtctggtgtacgtcaggtatcagaagatgttcgctcgccagctggcccaaaggtcccctggtttccacgaaaggtgagtgagcttgacaaatgtcatcaccttgtgaccaagttcgaccctgatctcgacctggaccacccgggtttcagtgatcaggtgtatagacagcgcaggaagctgatcgctgagatcgcttttcagtacagacacggcgaccccatccctagagtggaatacaccgccgaagagatcgccacatggaaggaggtttacaccactcttaaaggcttatatgccacccacgcctgcggagaacatttggaggcctttgcattgcttgagaggttcagcggctatcgggaagataacattccacaacttgaggatgtctctagattcttgaaggagaggacaggattccagcttcgccctgtggcaggattactttccgctagggattttttagcctccctggccttccgggtgttccaatgcacccagtacatccgccatgcgtcctcaccaatgcactcccccgagcccgattgttgccacgagctactcggacatgtgcctatgctggccgaccgaacgttcgcccagtttagccaggatatcggccttgcttcactgggtgcgagtgacgaggaaatcgaaaagctgagtacactgtattggttcaccgtggaatttggcctgtgcaagcagaacggagaagtgaaagcttatggagccggtctactctccagctatggcgagctccttcactgtttgtcagaagaaccggagattcgcgcttttgaccctgaagctgccgctgttcagccctaccaagaccagacttatcaaagcgtgtatttcgtgtcggaaagcttcagtgacgcaaaggacaagttacgcagttacgcttcccgtattcagcgtcctttctccgttaagtttgacccatacacacttgccatagatgtcctggattctccccaagccgtgaggaggagcctggagggcgtgcaagatgagctagatacgcttgctcacgcgctgagtgcaatcggctag

SEQ ID NO: 245792 - DNA, 1575 bp, Artificial Sequence
  Description of Artificial Sequence: Synthetic coding sequence
atgcctacccctgacgccaccactccacaagctaaagggtttcgccgagctgtttcggagctcgatgctaagcaggcagaggccatcatgggcgcacctggcccatcacttaccggtagcccatggccaggcactgctgcccctgctgcatcttacacccctacccctaggtcccccagattcattggcagacggcagagcctaattgaggacgcccgaaaggaacgagaagcagctgtggctgccgcagctgcagccgtgccctctgagcctggtgatccactggaagctgtagccttcgaagagaaagaaggcaaagctgtgctaaatcttttgtttagccctagagctacaaagccctctgcactgagccgagctgtcaaagtgtttgagactttcgaggcaaagattcaccatctagagactagacctgcccaaagacctagggctggcggtccccatctggagtacttcgtccgacttgaagtgcgtaggggcgatttagctgcgctattatcgggcgtgcgccaggtttctgaagatgtcagaagccccgcaggacctaaggtgccgtggttccccagaaaagtgtccgagctagataagtgtcatcacctggtgaccaagtttgatcctgacctggatcttgatcaccctggattctcggaccaggtgtacagacagaggcggaagctgattgccgagatcgccttccaataccgccatggggaccctattccacgcgttgaatacactgctgaggaaatagctacatggaaggaagtatatactacccttaaagggctttacgccacccacgcttgtggcgagcatctggaagcctttgccctgcttgagcgcttcagtggataccgagaggataacattccacagctggaagatgtgtcgcggttccttaaagagaggaccggattccagctccgaccagtcgcaggacttctaagtgctagggactttttggccagtttagcattccgcgttttccagtgcacacagtatatacgccatgccagctctccaatgcactctcctgagcctgactgttgtcacgagctgttgggtcacgtgccaatgcttgctgataggacatttgcccagttctcccaagacatcggtctggcctctctaggggcttccgatgaggaaattgaaaagctctcaacactgtactggtttaccgtggagtttggactttgcaagcaaaacggggaagtaaaggcatatggcgctgggctgttatcctcttacggggaactgttacattgtctttcagaagaacccgagatccgggcatttgaccctgaagccgcagctgtgcaaccttaccaagatcaaacttaccagtctgtgtactttgtgagcgagagcttctctgatgctaaagacaagttgcggtcatatgccagtagaattcagaggcccttttccgtgaaattcgacccgtatacactggctatagacgtgctggactctccgcaagcagtccgcagaagtctcgaaggggtgcaggatgagttagacaccctcgcccatgctctctctgccatcgggtag

SEQ ID NO: 245793 - DNA, 1587 bp, Artificial Sequence
  Description of Artificial Sequence: Synthetic coding sequence
atgccaacaccggacgcaacgaccccacaggcgaaaggcttcaggcgtgctgtttcagagctagatgcgaagcaggcagaagcaatcatggtgcgagggcagggagcaccaggtcccagcctcactgggagtccctggccagggaccgccgctcctgcagcgagctacacacccacccctcggagcccaaggtttatcggtcgaaggcaatcacttatagaggacgccagaaaggagagagaagcagcagtcgcagctgctgcagccgctgtgcctagcgagcctggcgaccctctggaggccgtcgcctttgaagagaaggagggaaaagctgtgctgaacttgctcttttcacctcgggcaactaagccttcagctctcagtcgggctgtgaaggtgttcgaaaccttcgaagccaagatacaccatctcgagactcggcctgcacagcgcccacgggcaggagggcctcatctagaatatttcgtccggctagaagttaggcggggagatctggctgccctgctaagtggtgtgagacaggtgtcggaggatgtgagaagccctgcagggcctaaggtgccatggtttccacgcaaggtatcagaactcgataagtgccaccacctcgtgacgaagttcgatccagatttggatttggaccacccgggatttagtgatcaggtctatagacagcggaggaagctgatcgcggagatcgcctttcagtaccggcatggagatccaatccctagagttgagtacacagcagaagaaatcgccacttggaaggaggtgtacacaaccctgaaagggctgtatgcgacccacgcctgtggggagcatctggaagccttcgcactgttggagcgtttctccggataccgagaagataacatcccgcagctggaagatgtgagtaggtttcttaaggaacggacggggttccaacttcgtcccgtagcgggactcctaagcgcccgtgactttttggcgagcttagcttttagagtgttccagtgtacacagtacattaggcacgcctcctcaccaatgcatagccctgaaccggactgttgtcatgagcttctaggtcatgtgcctatgctggccgatcgcacctttgcccagttctcacaagatatcggcctagcgtcgttgggcgctagcgacgaagagattgagaaactctccactctgtactggtttaccgtagaatttgggctgtgtaagcaaaacggagaagtcaaagcatacggggctgggttgttgtctagctacggagagttactgcattgcctgtctgaggagcctgagatcagggctttcgaccccgaggcggcagcagttcaaccataccaggaccagacttatcagagtgtatattttgtctccgagtcttttagcgacgctaaggataagctccgatcttacgcaagcagaatacagaggcccttttctgtgaagttcgacccctatacactcgcaatcgatgtgctggactctccacaggctgtgcgccgtagccttgagggcgtgcaggacgaattggataccctagcacatgccctttcagctattggttag

SEQ ID NO: 245794 - DNA, 3564 bp, Artificial Sequence
  Description of Artificial Sequence: Synthetic coding sequence
atgcccctgagacattggggaatggccagagggtcaaaaccagtgggcgatggcgcacagcccatggcagccatgggtggcctcaaggtgctcctgcactgggccggacccggtggcggagaaccgtgggtcaccttctcagaaagttcactgaccgccgaagaggtttgcattcacatcgcacacaaggttggtataacccctccctgtttcaacctgtttgccctgtttgatgcccaagcccaggtgtggcttccccctaaccacatattggaaattccacgggacgcttccctgatgctctacttccggattagattctactttcggaactggcacggaatgaaccctagggagcccgcagtatacaggtgcggcccaccagggaccgaggcgtcctccgaccaaaccgcacaggggatgcagttactggatccagccagctttgagtatctgttcgagcagggaaaacacgagtttgttaacgacgtggcttcactctgggagctctctacggaagaggagattcaccattttaagaatgagagcctgggaatggcatttctgcacttatgtcacttggctctacggcacgggattccattggaggaagtggccaagaagacttcattcaaggactgcatccctcggtccttccggaggcacatcaggcagcacagtgccctgacaagactgagactgcgcaacgtgtttaggcggttccttagggactttcagcccggaaggttaagccagcagatggtgatggtgaaatacctggctactctggagcggttagcccctaggttcggcaccgaaagggtgccggtctgccatctaagacttcttgcccaggcagagggcgagccatgttacattcgggacagtggcgtcgcccctacagaccccggtcccgaatcagcggctggcccacccactcacgaggtactcgtgaccggaaccggtggcatccagtggtggcctgtcgaagaggaagttaacaaggaagaggggtcttcaggatcttctggccgtaacccccaggcttcccttttcggcaagaaagctaaagctcacaaggctgtggggcaacctgccgacagacctcgagaacccctctgggcgtatttctgtgactttagagacatcacacatgtagtgctgaaggagcactgtgtgagcatccaccgacaggataataagtgcttggagctgtcactacccagcagagctgccgctctgtcctttgtctctcttgtggatgggtactttaggctcactgcggatagttcgcattacctgtgccatgaagtcgcgccaccccgactggtgatgtcaataagagacggcatccatggaccattgctagagcctttcgtacaagcaaaattaaggcctgaagacggattgtatctgatccactggtcaactagccacccgtatcggctgattcttactgtggcacaacggtcccaggctcccgacggcatgcaaagcctccgattgaggaaattccccatagagcaacaagacggggcttttgtactggaaggctggggaaggagcttccccagcgtgcgggagctaggcgctgccctgcaggggtgcctgctgagggctggtgacgattgtttttctctgaggaggtgctgtctcccccaacctggcgaaacaagcaacctgataattatgaggggggctcgtgccagcccacgcacattgaacctatcacaactgtcctttcatcgggtggaccaaaaggagattacgcagcttagccacttgggacagggcactaggaccaatgtttatgaaggtaggctccgggtcgaggggtccggagaccctgaagagggcaagatggatgatgaggaccccctggttccagggagagataggggtcaggagctacgcgtcgtgcttaaagtgctggatccttcacaccacgacattgccctcgcattttacgaaacagcttctctcatgagtcaggtgtcccatactcacctagcgttcgtacacggtgtctgtgtcagaggccctgagaacatcatggtcacagagtatgtagagcatggcccactggacgtttggctcagaagggagcggggtcatgtgccgatggcctggaagatggtagtggcccagcagctggcctctgccctgagctatctagaaaataagaatctggtgcatgggaacgtctgtggcaggaatatcctgctcgcgaggctaggcctcgctgaaggaaccagtccatttattaagctctctgatccaggagtgggactcggagctttatctagagaggaaagagtggaacgtataccttggttggcccctgagtgcctgcccggtggcgctaacagcctttccactgcgatggacaagtggggattcggtgccacgctgttagaaatatgttttgatggagaagcaccactgcagagcaggtctcctagcgaaaaagaacatttctatcagcgtcagcatagactgcccgaaccctcctgtccacaattagccaccctcacatcccagtgtctcacatatgaaccaacacagcgtcctagcttcaggactattttacgcgatttgactaggctgcaaccacacaacctggcggatgttttgacagtgaatcccgactcacccgcttctgaccctacagtgttccacaaacgatatctcaaaaagatccgggacctgggcgagggccacttcggaaaggtttctctgtattgttatgacccaacaaacgacggaaccggtgagatggtggccgttaaagctttaaaggcagattgcggaccccaacaccgatctgggtggaaacaggaaatcgatatcttgagaacactgtaccatgagcacatcattaaatataagggatgttgcgaggatcagggagaaaagtcactccagctggtgatggaatatgtgcccttgggatcgctgagggattatcttccgcgacatagcatcggtctggcccagttgctgctcttcgcccaacagatttgcgagggaatggcatatctgcatgcccagcactatattcacagggacctcgctgcgcgaaacgttttgttggataacgataggctagttaagatcggggacttcggcctggccaaggcagttcccgaaggccatgaatattatcgagttagggaggatggggattcaccagtcttctggtacgcccctgagtgcctgaaagagtataaattctactatgcatcagacgtgtggtcatttggggtcacactgtacgaattgcttactcactgcgactccagtcaaagtcctccaactaaatttctggaactcatcggaattgcccagggccagatgaccgtcctcagactcactgaattgctggagaggggggaacgattaccacggccagacaagtgtccgtgtgaggtatatcatctaatgaagaattgctgggagaccgaagcatcgttccgcccaaccttcgaaaacctgatcccaatcctaaagaccgttcatgagaaataccaggggcaggcaccgtctgtatttagcgtgtgttag

SEQ ID NO: 245795 - DNA, 3564 bp, Artificial Sequence
  Description of Artificial Sequence: Synthetic coding sequence
atgcctctgcggcattggggcatggcaaggggatcaaaacccgtgggggacggggcacagcctatggcagcaatggggggtcttaaagtcctcctgcattgggcaggccctggagggggagagccatgggtgacattctccgaatctagtctaacagccgaagaggtctgcattcatatagctcataaggttggcataacacccccttgtttcaatctatttgcgttgtttgacgcccaggcccaggtgtggttgccacctaatcacattctcgagattcctcgtgatgctagcctgatgctctatttcaggatcagattttatttccggaattggcacgggatgaacccacgggaacccgctgtgtacaggtgtggccctcctggaactgaagctagctctgaccagaccgcccaggggatgcagctgttagatcccgcatcctttgagtacctttttgaacagggcaagcatgagttcgtaaacgatgttgcttcgctatgggaattgagtaccgaggaggagatacaccatttcaagaacgaatccttagggatggcctttctgcacctctgccatctggcacttagacacggcatacctcttgaggaggtggcaaaaaagactagctttaaggattgtattcctaggtccttccgtcgccacattcgccagcactcagctttgactcgactccggctacggaacgtgtttcggcgatttctccgagactttcagccgggaagactcagccagcagatggtgatggttaagtacctggcgacactggagcgcctggcccctaggtttgggacagaacgcgtccccgtgtgccatctgcgactgctggctcaagcagagggcgagccctgctacatcagggattccggggtggctccaacggatcctggcccagagtccgccgcaggtcctcctactcacgaggtgctggtaaccgggacagggggaatacaatggtggccagttgaggaagaggtgaataaggaggaaggatcatccggcagtagtggaagaaatccccaagctagcctattcggcaagaaggcaaaagcacataaggcagtgggtcagccagcagaccggccacgagagcccctttgggcttacttttgtgatttccgagacatcactcacgttgtgctgaaagaacactgtgtctccattcaccggcaggataataagtgtctcgagctgtcacttcccagcagggcagccgctctgagctttgtatctttggtggatggctatttcaggctgacagccgattcctctcactacctctgccatgaggtcgctcctcccagactggtgatgtctataagggacggtattcacggccctctgctcgaaccatttgtgcaggcaaagctcaggcccgaggacggactgtacttaatacattggagcacctcccatccataccgcctaatccttaccgttgcgcagcggtcccaggcacctgatggaatgcagtctctcagacttagaaaatttcctatagagcaacaagacggcgcattcgtgctcgaaggttggggtcggagcttcccatccgtgcgcgagctgggggcagctttacaggggtgtcttctgcgggctggggacgattgtttctctctcagaaggtgctgcctcccccagccaggtgaaacttccaatcttatcataatgcggggagctcgcgcatcacccagaaccctaaacctatcccagctgagtttccacagagtggaccaaaaggagattactcagttgtcccacctcggccagggcactcggacgaatgtttatgaggggaggctcagagtcgagggtagcggcgacccggaggaaggaaagatggatgacgaagacccgttggtgcccggtagagatagggggcaggagctccgcgtcgttctcaaggtcttggacccctcccaccacgatatcgccttagcattttatgaaaccgcttcacttatgtcccaggtgtcgcatacacaccttgcttttgttcatggggtgtgcgttcgcggtcctgagaatatcatggtgacagaatatgtggagcacggaccgcttgatgtgtggcttagaagagaacggggtcatgttcccatggcctggaaaatggtagtcgctcagcagttagcctcggctctttcctatctcgaaaataagaatctggtccatgggaatgtctgtgggagaaacatcctccttgcaaggctgggactggccgagggcacttcccctttcattaaactgtccgacccaggcgtgggactcggggctctcagtagggaagaacgggtggaacgcattccctggcttgccccagagtgtcttcccggaggcgcaaattccctgtccaccgcgatggataaatgggggttcggcgcaacgctcctcgagatctgcttcgatggcgaggccccactgcagtctagatcccccagcgaaaaggagcacttctatcagcggcaacaccggcttcccgaaccttcctgcccccagctggcaacgctcacttcccagtgccttacctacgagcctacccagcgcccatctttcagaacaattttaagggatctgactcgactgcagcctcataaccttgccgatgtccttactgtaaaccccgatagccctgccagtgatcctacagtttttcacaagaggtacctaaaaaagatccgggatctgggtgagggacactttggcaaagtatccttgtactgctacgatccgactaatgacggtaccggtgaaatggtggcagtcaaggccctaaaggccgattgtggcccacagcatcgctcaggatggaaacaggagatagacatccttcgcacactgtaccacgaacatattataaaatacaagggatgttgtgaagaccagggcgaaaagtcccttcagctagtgatggaatatgtccctcttgggtctcttcgggattacctgcccagacactcaatcggcctggcacagcttcttctttttgcacaacagatttgtgaggggatggcttaccttcacgcacagcactacatacacagagatctcgcagcgcgaaacgtcctcctggacaatgatagactggtgaagatcggagattttggactggcaaaggcggtgcctgagggacatgaatattaccgcgtgagagaggacggggattcacccgtgttctggtatgctccggaatgtctgaaagaatacaagttttactatgcttcagacgtctggtcctttggtgtgacactatacgagctactgacacactgtgactcctctcagtcccctccgacaaagtttctagagctgatagggattgcacagggccagatgactgtcttaagactcactgagttgctggagagaggagagagacttccccgtcccgataaatgtccatgtgaggtgtaccaccttatgaagaattgctgggaaacagaggccagcttcaggcctaccttcgagaacttaatccctattctgaagacagtccacgagaagtaccagggccaggccccatctgttttttctgtctgttag

SEQ ID NO: 245796 - DNA, 357 bp, Artificial Sequence
  Description of Artificial Sequence: Synthetic coding sequence
atgcctctccggcactggggaatggctcggggtagcaagcccgtgggcgacggggctcagccaatggccgcaatgggtggtctgaaggtactgttgcattgggccggacccggtggaggagaaccctgggttaccttttccgagtctagtctgaccgcagaagaggtgtgtattcacatagcacataaggtgggtattacaccaccctgttttaacttgttcgctttgttcgacgcacaggcccaggtgtggttacccccaaatcatattctcgaaattccaagagatgcctccttgatgctatacttcaggattcggttttacttcagaaactggcacgggatgaacccaagatag

SEQ ID NO: 245797 - DNA, 2805 bp, Artificial Sequence
  Description of Artificial Sequence: Synthetic coding sequence
atggtgatggttaagtacttggccacgctcgagcgacttgccccacggtttggcacggaacgcgtccccgtctgtcatcttaggctcctggcacaggccgaaggtgaaccctgttacataagagacagtggcgtcgctccaacggatcccggaccggaaagtgccgcaggaccgcctacgcacgaagtcctggtgactggtaccgggggaattcagtggtggcctgtcgaggaagaagtaaacaaagaggaggggtctagcggtagctcaggacggaatccccaggccagtctgtttggtaagaaggccaaagctcataaagcagtgggccaacccgctgaccgcccacgcgagcctctctgggcctatttctgcgacttccgcgatattacacatgtggtgctaaaagaacattgcgtatccatccacaggcaggataacaagtgcctggagctttccttaccatcacgcgcagccgcactgagctttgttagcctggtggatggttacttcaggcttaccgcggattcgtcacattacctgtgccacgaggttgcaccccctcgactcgtaatgtcaatccgagatggcatccacggtccactccttgaaccttttgttcaagccaaactgcggccagaagatggcttgtacctcatccattggtctacatctcacccctacaggctcatactgaccgtggcgcagaggtcacaggcacctgacggaatgcagtccctaagattgaggaaattccccattgaacagcaagatggggcttttgttctggagggctgggggagaagctttccctcagtgagagagcttggtgccgcattacagggatgtttgctgcgggcaggggatgattgcttctctcttagacgctgttgcctgccacagccgggagagacctctaacctgatcatcatgcgcggagctagggccagtccccgtacactgaatctgtctcaactgtcctttcatcgagtggatcaaaaagaaatcacccagctatcccacttgggacagggtacacggactaatgtgtacgagggtcgtctccgagtcgagggaagtggagacccggaagaaggcaagatggacgacgaagacccgctcgtcccgggtagagacagagggcaagaattgagggtggtactgaaggtgcttgaccccagccaccatgatatcgcccttgcgttctatgaaacagcgtccctgatgtcacaggtatcacacacgcacctggcctttgtgcacggggtgtgcgtgagggggccagagaacatcatggttaccgagtacgtcgagcacggacctctagatgtgtggctgcgaagggagaggggacatgtgccaatggcttggaagatggtggtggcgcagcagctggcatccgctctgtcatacttggaaaataagaacctggtgcacgggaatgtctgtggcaggaatatcttactggcccgattagggcttgccgaaggtactagcccattcattaaactctctgatccaggggtgggcctcggagcactgagccgggaggaacgcgtagaacgtattccttggctggccccagagtgcctccccggaggcgcaaactctctgtctactgcaatggataaatggggcttcggagccacactgttggaaatctgttttgatggtgaagcacctctacaaagcagatctcctagcgaaaaggaacacttttatcagagacagcatagactcccagagccatcttgtccgcagcttgccactctgacaagtcagtgtctaacatacgagccgactcagcgcccaagctttcggactattctgcgggacctaacgaggctccagccacacaatctggccgacgtgctgacagtaaaccctgattcacctgcatccgacccaacagtctttcataaaagatatctgaaaaagatcagagatctcggcgaaggacacttcgggaaggtgagtctttactgctacgatccaaccaatgatggaaccggcgagatggtggcagtgaaagcattaaaggccgactgcggcccacagcatcgcagcggttggaagcaggagatcgacatcctgcgcacgctgtaccatgagcacatcattaaatacaaaggctgttgcgaagaccagggcgagaagtcactccagcttgtgatggaatatgtgcccctggggtctctgagagactacctacccagacacagtatcggactggcacagctgctgctattcgcgcagcagatctgcgagggcatggcttacctacacgcacagcactacattcaccgtgacctagcggctaggaacgtattactggacaatgaccggctcgtgaagataggtgacttcgggcttgcgaaagctgtgcccgaggggcacgaatactaccgcgtcagggaagacggcgacagccctgtgttttggtatgcgccagaatgtcttaaggagtacaagttttattatgccagtgacgtctggtcttttggagtaactctctatgaactgctgacacactgcgatagctctcagagccccccaacgaagtttctggaattgataggaatagctcagggtcagatgacagttctgcgactgaccgagctgcttgaaagaggagaacggcttcctaggcccgacaagtgtccctgtgaggtgtaccacctgatgaaaaactgctgggagactgaagcgtccttcaggcctaccttcgaaaacctgatccctatcctcaagaccgtgcacgagaaatatcaaggacaggccccatctgtgtttagcgtgtgttag

SEQ ID NO: 245798 - DNA, 1986 bp, Artificial Sequence
  Description of Artificial Sequence: Synthetic coding sequence
atgctccccgaagcaggatctttatggctgcttaagttattaagggacattcagctcgcacagttctactggcccatcttggaagagctgaatgtgacccgtcccgagcattttgattttgtaaaacctgaggatctggacggcatcgggatggggcgaccagcacaaagacgcctctctgaagccctgaaaaggctgagaagtggcccaaagagtaagaattgggtatataagattctgggagggtttgcacctgagcacaaggagccaactctgccttccgacagccctagacacctgccagagccggaggggggactaaaatgtctcatccctgaaggagcagtttgtcgaggggagctgctggggtccggatgttttggtgtggtgcaccgcggactgtggacactacccagtggcaagtccgtccctgtggcagtgaaatctctgcgagtggggccagaggggccaatggggaccgagctgggcgacttccttagggaggtgtccgtgatgatgaacctcgagcacccgcacgttctgcgcctgcatgggctcgtgctcggtcagccactgcagatggtcatggaacttgcacctctgggttccctccacgcgcgtctaacagcaccagctcctaccccccctctgctggtcgcgctcttgtgcttgttcctgagacaactcgccggtgccatggcctacctgggggcaagaggcttggtgcatcgggatcttgctacacggaacctgttgctggcctcgccaaggaccataaaagtggcagacttcggtttggtgagaccgctggggggagctaggggtagatatgttatgggcggtccgaggcccatcccctatgcatggtgcgcacctgagtccctgcgccacggagctttttcatcagccagtgatgtctggatgttcggcgtgactctctgggaaatgttctcaggaggggaggaaccctgggctggggtgcctccatacttgatcttgcagcgtctggaagaccgcgcacgtctgcctcgtcctccactttgctcccgggctctgtactctctggctctgaggtgttgggcaccgcatccggctgaccgtccctcttttagccatctggaagggctcctgcaggaggccggtccttccgaggcgtgctgcgttcgtgatgtgaccgagcctggagcgctgcgcatggagactggcgaccctattacagtaatcgagggaagtcctgacagcaccatctggaagggccagaatggaagaaccttcaaagtaggctcctttcccgcttctgctgtaaccctggctgatgccggaggattaccggctacccgccctgtgcatagaggaaccccagcaagaggcgatcagcacccaggcagtatcgacggggatcgcaagaaagctaatctctgggacgctccgccagcacggggtcagcgtagaaatatgcccctggaacgaatgaaagggatctcgaggagcctggaatcggtgttaagtcttggacctcgaccgacagggggaggttcgtccccacctgaaatccgccaagcgagggcggttccgcagggaccaccgggactccctccaaggccccctctgtctagctcctccccgcaaccatcacagccctcaagagaaaggctgccttggcccaaacggaagccaccccacaatcaccccatgggcatgcctggtgcaagaaaggccgctgccctgagtgggggtctcctgtccgatccagagctacagaggaagatcatggaggtagagctttctgtgcatggcgttactcatcaggagtgtcagactgctctgggtgcaactggaggagacgtggtgtccgcgattcggaatctgaaagtggatcaactcttccaccttagtagtcggtccagggccgattgttggagaatcctggagcattaccagtgggacctgtccgccgcttctaggtacgtgctcgctcgcccttag

SEQ ID NO: 245799 - DNA, 1986 bp, Artificial Sequence
  Description of Artificial Sequence: Synthetic coding sequence
atgctgccggaagcgggatccctgtggctgctcaagttgttgcgggatatccagcttgcacagttttactggccgatcctggaggaattgaatgtgacccggccagagcacttcgattttgtcaagcccgaggacctcgatgggattgggatgggcagacctgctcagcggcgactttctgaagccctcaagcgccttcggtctggtccaaagtccaagaattgggtatacaagatcctgggcggattcgccccagagcataaagagcctaccctccccagcgatagcccgaggcacctacccgagcctgaaggcggtttgaagtgccttattcccgagggggctgtgtgtaggggggagctcctcggttctggatgctttggagttgtccaccgtggactttggactttgccctctgggaagtctgtgcctgtggctgttaagtcgctgagagtggggcctgagggccctatggggacagaactgggggatttcctgagggaagtgtctgtaatgatgaacctggagcatccacacgtcctgagacttcacggtctggttctggggcaacctctacagatggtcatggagcttgctcccttggggtccttacacgctcggcttaccgccccagccccaacccccccactgctggtggcgctgctgtgcctgttcttaagacagttagcgggtgccatggcttacctcggcgcaaggggcctcgtgcaccgtgatctggccactaggaatctactactggcctcacctcgcaccataaaagtcgcagacttcggccttgtccggccactgggtggagcgagaggccgatacgtgatggggggacccaggccaattccatacgcttggtgtgcaccagagtcactgagacatggcgctttttccagcgcttctgacgtgtggatgtttggtgtcacgctgtgggagatgttcagtgggggtgaagagccttgggctggagtgcctccatacctgatccttcagaggcttgaagacagggctagattaccacgtccaccgctctgtagccgcgcactgtattccttagctctgagatgttgggcccctcaccccgcagaccgccctagcttctcccacctggagggcctcttacaggaggcagggccatctgaggcctgctgtgtgcgagatgtgactgaaccaggcgcactgaggatggagaccggggaccctattacagtgattgaaggctccccagattccacgatttggaaggggcagaacggtagaacatttaaggttggttcttttccagccagtgccgtgacgcttgcagatgccggaggcttgcccgcaaccagacccgtgcaccgcggtaccccggctcgcggtgaccagcacccaggcagcatcgacggcgacaggaaaaaagccaacttgtgggatgccccacccgctcgtgggcaaaggcgcaacatgccactggagcgaatgaagggaatatcacgatccctggaaagcgtgctgtcgctgggccctcgtcctacggggggtggctcaagtccaccagaaattcgacaggcacgggctgtgccccagggtcctccagggctaccaccccgtcctccacttagcagctcatctcctcagccgagccagccaagtcgcgagcgcctcccctggcccaaaagaaagccacctcacaaccacccaatgggcatgccaggggctagaaaggctgccgcacttagtggcggtcttttatcagatcctgaacttcagagaaaaattatggaggtagagctgtccgtccacggcgttacacatcaggagtgtcagaccgcactcggtgccacgggaggcgacgtagtgtccgccattcgcaacctgaaagtggatcagctgttccatctgtctagtcgctctcgtgccgactgctggcgaattctggagcactaccagtgggacctgtcagcagcctcccgatatgttctggcgagaccctag

SEQ ID NO: 245800 - DNA, 1587 bp, Artificial Sequence
  Description of Artificial Sequence: Synthetic coding sequence
atgcagcccgaggaaggaactggatggctgttagaactcctcagcgaggtccaactgcagcaatactttctgaggctgagggacgatctcaacgtgacgcgtctctctcatttcgaatatgtcaagaacgaggatctcgagaagatcggtatgggcaggccaggccagcgtcgactttgggaagctgtaaaaagacgaaaggccctgtgtaaacgaaagtcctggatgtccaaggttttttccgggaaacggctggaagcagaatttccccctcaccactcacagtctacattccgaaaaaccagccccgctcctggcggaccagctggcgagggacccctgcagtccctcacatgtctgattggggagaaggatctgcgactgctagagaagctgggagacggaagcttcggggtcgtccgtcgaggagagtgggatgctccaagcggcaaaactgttagtgtcgcggtgaaatgcctcaagccagatgtgctgtcccaacctgaagcaatggacgacttcattcgagaggttaatgcaatgcactctctcgaccaccggaatcttattagattatatggggttgtcctaaccccaccaatgaaaatggtaaccgaattggcacctttgggtagcctgctcgaccggctgcggaagcaccaaggacatttcctattaggaactttatctaggtatgccgtgcaggtggccgaaggcatggggtacctcgaaagcaaaagattcatccatagggacttggccgcaaggaatctgttattggcaactcgggacctcgttaagattggagacttcggcctcatgcgggcactgcctcagaacgatgaccactacgtcatgcaagagcaccgcaaggtgccttttgcctggtgtgctcctgagtcactcaagacaaggaccttttcacatgcttctgacacttggatgttcggagtaaccttgtgggaaatgttcacctatggccaggaaccatggattggtttgaatggcagccagattctgcacaaaattgacaaggaaggcgaaaggctgcctcgccctgaagactgtccccaggacatatataatgtcatggtgcaatgttgggcgcacaaacccgaagatagaccaacgttcgtggctttacgtgatttcctcctagaggcccagccgactgatatgagggctttgcaggacttcgaggaacccgacaagttgcacattcaaatgaatgacgtgattactgtgatcgaaggacgggctgaaaactattggtggcgaggtcagaacactcgcactctgtgcgtgggcccatttccgaggaacgtggtaacgagcgtggccggactgtccgctcaggacatcagccaacccctgcaaaattcctttatccataccgggcacggagactccgatccacggcattgctggggctttccagacagaattgacgaatgccctttttctgccttttctcctggacatccccctgccgaaacctgcggccaagtcctgtggaccggacgcagagaggcttgcgcctctgaccccaggttgcatcccgtgagtagtaggacgaagggcctctag

SEQ ID NO: 245801 - DNA, 3117 bp, Artificial Sequence
  Description of Artificial Sequence: Synthetic coding sequence
atgcaacccgaagagggaacaggctggctcctggagctgctgtctgaagtgcagttgcagcagtactttctgaggcttcgtgatgacctgaacgtcacccgtctctcgcatttcgagtacgttaagaatgaggatcttgaaaagataggcatgggtagacccggacaacggaggttgtgggaggcagtcaaaaggcgaaaagcactttgtaaacgcaaatcctggatgagcaaggtgttctcaggcaaacgattggaggccgaattcccccctcatcattcccaaagcacattcagaaagaccagtcccgcacctggaggacccgcaggcgaagggcctttgcagagtctgacatgcctgatcggagaaaaagacctacgcctgcttgaaaaattaggggatggaagcttcggagtggtccgacgcggtgagtgggacgctccctctggcaagacagtcagcgtagcggtcaagtgcctgaagccagacgtgctaagccagcctgaggccatggacgacttcatcagggaggtaaacgctatgcattcactggatcatcggaacctcatacgcctatacggagtcgtacttactccaccaatgaaaatggtgacggagcttgcaccactggggtctctgctcgaccgcttgagaaaacaccaggggcacttcttattgggaactcttagccggtacgccgtgcaggtggcagaagggatgggatacttggagtcaaaacgatttattcaccgagatctggccgcacggaatcttctcctggcgactagagaccttgtaaaaattggcgatttcgggctcatgagggctctcccacagaacgacgaccattacgtcatgcaagaacatcggaaagttccttttgcttggtgtgcacccgagagcctcaagacccgtactttctcccacgccagcgatacctggatgtttggagtcaccctgtgggaaatgttcacctatggtcaggaaccttggataggcttgaatggatcccagattctccacaagatcgataaagagggggagaggctgcctcggcctgaagattgcccacaagatatctacaacgtcatggtccagtgctgggcccataaaccggaagatagaccaacgtttgtggcactccgcgattttttgctggaggctcagccaacagacatgagagctctccaagactttgaggagcccgacaagctacatatacagatgaatgacgttattacagttatcgagggccgagcagaaaattattggtggaggggccagaacactcgaacattgtgtgtgggccctttccctcgtaatgttgtaaccagcgttgccggactgagcgcccaggacattagtcagcccttacagaacagttttatacacaccggccacggagattccgatccacggcattgttggggatttcctgaccgcattgatgagttgtatctgggcaacccaatggacccaccggatctgctgtctgtggaactgagcaccagcagaccccctcagcacctagggggtgttaagaagcccacttacgacccagtgagcgaagaccaagaccctttgtcctccgacttcaaacgactaggtctgcgcaaaccagggctacctcggggtctgtggctggccaaaccctccgcccgtgtccccggaactaaagcatcaaggggcagcggtgcagaagttaccttgatcgactttggggaagaacccgtggtgccagccctgaggccatgcgcaccttcactcgcacagctcgctatggatgcctgtagcctgctggacgaaacaccgccacaaagtcccaccagagctctccccagaccactccatcctaccccagtggttgattgggatgcgcgacctctgcctccccctccggcatatgacgacgtggcccaggacgaagatgactttgagatatgtagtattaattccactttagtcggggcaggcgtgccagcagggccaagtcaaggccaaacaaattacgcctttgttccagagcaggcacggcctccaccgccacttgaggataacctgtttctcccaccccagggtggtggtaaaccacccagttcagcccagaccgctgagatttttcaagcgttacaacaggagtgtatgcgtcagctacaagcgcctgcgggtagccctgcccctagcccttcacccggaggggatgataagccccaggttcctcccagagtgcctattccccctcgcccaactcgccctcacgtgcagcttagtcccgctcctccaggggaagaagagacttcgcagtggccagggcctgcttctcctccgcgagttccaccacgagaaccgctgagcccgcagggcagtagaacaccatctccccttgtgccacccggatcctctccacttcctccccgactgtctagctcacctggtaagacgatgcccactacacaaagcttcgcttcagaccctaaatatgctacgcctcaagtaatccaggcaccaggtcctcgggcaggcccttgcatcctcccgattgtgagggacggcaaaaaagtgtccagcacacattactacttgttgccagaaaggccaagctatctagaacgctatcagaggttccttcgggaggctcagagtccagaagagcccaccccactccccgtcccattacttctgcctccccctagcacacccgcacctgccgctccgactgccaccgtaaggcccatgccacaagctgcgctggatccgaaggctaacttttcaaccaacaactccaatccaggagcaagaccccctccacccagggcaaccgcaaggctgccgcagcgcggatgtcctggggatggcccagaggcaggcaggcccgcagataaaattcagatggccatggtccatggcgtcaccaccgaggagtgccaggctgccctgcagtgtcacggctggagtgttcaaagggccgctcagtatttgaaggtcgaacagcttttcggcctggggttaaggcctaggggagagtgccacaaagtgctggagatgttcgattggaatctggagcaggcgggttgccacctgctgggaagctggggcccagcccatcacaaacgctag

SEQ ID NO: 245802 - DNA, 3261 bp, Artificial Sequence
  Description of Artificial Sequence: Synthetic coding sequence
atgctagaggctaggcctccacggactcaaggaagtgacgccgctggagctgcagctggccgtgggctacgagccctgcttctcagtcttaccgccgcagccggtatctggggtagtatgggagagcggagcgcctaccagcgcctggcgggaggagaggaaggacctcagagattgggcggagggagaatgcagcctgaggagggtacaggctggctgctagaacttttgtctgaagtgcagcttcagcagtattttctgcgattgcgcgacgacttaaacgtgactcggctgtctcattttgagtacgtgaaaaatgaggacctggaaaaaatcggaatggggaggcctggacagaggcgcctttgggaggcagtaaagcgcagaaaagccctctgcaagcggaaatcctggatgagcaaggtgttctcgggaaagcggttagaggccgaattccctccccaccacagtcaatctaccttcaggaagacttctcccgctcccggagggcctgcaggcgaaggtccactgcagagcctaacgtgcctgatcggtgaaaaggacctgcgcctgcttgaaaaactcggcgatggatcctttggcgtggtgaggaggggagagtgggacgcgccatctggtaaaactgtgagtgtcgccgtgaagtgtttaaagcctgacgtcctgtcccagcctgaggccatggacgacttcattcgtgaggtgaacgcaatgcattctctggatcacaggaacctgatccgcctatacggtgtggtactgaccccacctatgaagatggtcactgaactcgcccctctgggttcgcttctggaccgactgcgcaagcatcagggacattttctgcttggaaccctgtccagatacgcggtgcaggtggcggagggtatggggtacctcgaaagtaaacgctttattcatagggatctggccgcaagaaacttgctcctcgccacccgggatctcgtaaagataggagacttcgggcttatgcgcgctctcccacaaaacgatgaccactatgtgatgcaggagcacagaaaggtgcccttcgcttggtgtgccccagagagcctcaagacaagaacgttctcacatgcctcggatacctggatgtttggcgttactctgtgggaaatgttcacctatgggcaagagccatggataggcctcaatgggtctcagatcctccacaagatcgataaagaaggcgagagactgccccgtcctgaagactgcccgcaggatatttacaacgtgatggtacagtgttgggcccataagcctgaagatcgccctacatttgttgcactgagagatttcctgctggaggcgcaacccacagatatgcgagccctgcaggactttgaggaacctgacaaactgcatatccagatgaatgacgttattactgtaattgagggcagggccgaaaactattggtggcggggtcagaatacccgcacgctgtgtgtggggccttttcctcggaatgtggtgacgtccgtggcaggcctcagcgcccaggacatctcacagccactgcagaatagctttatccatacggggcatggagattccgatcctcggcattgttggggcttccctgacagaatcgacgagctgtatctgggtaatccaatggatcctccagacttgctgtcagtcgagctttctacaagcagaccccctcagcatctaggcggagttaagcgcgagccgcctcctcgaccgcctcagcctgccttctttactcagaagcctacttacgatcctgtctccgaggatcaagatcctttgagttccgattttaagagactgggcctccgcaagcctggactccctagaggcctgtggctggcaaagccatccgctagagtgccaggcacaaaggcatctcgtggatctggggcagaggtaactctgatagacttcggcgaggagccggttgtaccagccctcagaccttgtgccccatcccttgcacagctcgctatggacgcctgttccctactagacgagactcctcctcagagtccaacacgcgcattgcctaggccactgcacccgactcccgtagtggactgggatgcaaggcctctgccccctccacctgcatacgacgacgttgcccaggacgaggatgatttcgaaatctgcagcatcaattctacactcgtaggggctggtgtgccggcagggccaagccaggggcaaaccaattacgccttcgtacccgaacaggcccgtcctccacctccactggaggataatctcttccttccgccacagggagggggtaaaccgcctagctccgcccagactgcagagattttccaagccctgcagcaggagtgcatgagacagctgcaggcaccggcaggtagccccgcaccatctccctcccctggcggtgatgataagccccaagtgcccccacgcgtccctattcccccaaggcctactcggcctcatgttcaattatctcccgcaccacccggtgaagaggaaacctcacaatggcctggtccagcctctcccccaagagtgcctcccagagagcctctatcaccccagggatctcggacacccagccctctagtgcctcctgggagttctcctctaccaccccgactgagcagcagtcctggaaagacaatgccaacaacacagagcttcgcctccgaccctaagtacgccacccctcaggtcattcaagcacctggtccaagagcagggccttgtattctgcctatcgtgagggatgggaaaaaagtttcctctacccattattacctcctgcccgagcgtcctagctacctggagaggtaccagaggttcctaagggaagcccagtctcctgaggaacctacaccgctccccgtgcctctattgttgcctcccccttctacacccgctccagccgcacccaccgctaccgtcagacccatgcctcaggcagctctggatccaaaggccaacttctccactaacaacagcaatcccggagctaggcctccaccccctcgtgcaaccgcccgtctcccgcaacgcggatgtccaggcgatggtcctgaggccggacggccagccgataagatccagatggtcgaacaattgttcgggctgggactgcgtccacggggagaatgtcataaggtactagaaatgttcgattggaaccttgaacaggccggttgtcatctgctggggagctgggggccagcccaccacaagcggtag

SEQ ID NO: 245803 - DNA, 3117 bp, Artificial Sequence
  Description of Artificial Sequence: Synthetic coding sequence
atgcagcctgaagaaggtactggctggctacttgaactcctgtctgaggttcagctccagcaatacttcctcagactgagggatgacttaaatgtgacgcgattgtctcacttcgagtacgtgaaaaacgaagacctggagaagattgggatggggcgtcccggacagaggcgtctgtgggaggccgttaaaaggcgaaaggccctgtgtaaacgcaagagttggatgtcaaaggtgttcagtggaaagagacttgaagccgagtttcctccccaccatagccagtccacctttcgcaagacctcacctgcaccaggcggtccagccggagaggggccactccagtcactgacgtgcctgatcggtgagaaagaccttcgcctgttagagaagttgggggacgggagtttcggagtcgtaaggcgcggtgaatgggatgccccaagcgggaaaacagtctcagtggctgtcaagtgcctcaagcctgacgtccttagccagccggaggcaatggatgacttcatccgtgaggtgaacgctatgcacagcctggatcatagaaacctaatccggctgtacggggtggtgctgactcctcccatgaagatggtgacggagctggctccattagggagccttctggatagactgcgtaagcaccaggggcactttctcctcggcactctctctagatacgctgtgcaggtggctgaaggcatgggctacctggaatccaaacgatttattcatcgcgacctcgcagccagaaatctgcttcttgccacccgtgacttagtgaagataggggactttgggttgatgcgcgctctcccccagaatgatgaccactacgtgatgcaggaacatcgcaaagtgcccttcgcgtggtgtgcccctgaatctctgaaaacccggacatttagtcacgctagcgacacctggatgtttggagtaacactttgggaaatgtttacctacggtcaagagccatggattgggctgaatggctctcagatcctgcacaagattgataaggaaggggagcgactgccaagacccgaggactgtcctcaggacatatacaacgtgatggttcaatgttgggctcacaagcctgaggatagacctactttcgtcgccctccgggacttcctgctggaagcccagccgaccgatatgagagcattacaggactttgaggagccagacaaactgcatatacagatgaacgacgtgataactgtcattgaaggccgtgcggaaaattactggtggcgcggacagaatacccgcaccctctgtgtaggaccctttccaagaaacgtggtgaccagtgtcgcagggcttagcgcccaggacatctcacagcccctccagaactcttttattcatactggccacggtgatagcgaccccagacattgttggggatttcccgaccgcatcgatgagctgtacctcgggaaccctatggatccccctgacctgctttctgtagaactgtctacatcccgccctccccaacacctaggtggggtaaagaagccgacctacgaccctgtgtcagaagatcaggatcccttatccagcgatttcaagagactgggcctccgtaagcccggactgccacggggactgtggttggccaagccctccgcccgagtacccggtaccaaggctagccgaggaagtggtgcagaggttacactgatcgacttcggggaagaacccgttgtccccgcattacgcccatgtgcgccaagtcttgcccaacttgctatggatgcctgctccttattggacgagacaccaccacagagccctacacgggcacttcccagaccattacaccctaccccggtagtggattgggatgccagaccactcccccctccgccagcatatgacgacgtggcccaggatgaggatgattttgaaatttgctcgatcaattccacgctcgtgggggctggagtgccagccggaccttctcaaggccagaccaactatgcgtttgtgcctgagcaggccagacctccaccaccactggaagataacctgtttctcccacctcaagggggtggtaagccaccttcttcagcacagacagccgagatcttccaagcattgcaacaagagtgtatgcggcagttgcaggctccagccggtagtccagcaccctctccttcccccggaggagatgataaaccccaggtcccgccacgcgtccctattcctccgcgaccaacacggcctcatgttcagctatcccctgcacccccaggcgaggaggagaccagccaatggcccggacccgcaagccccccaagagtgccacctcgcgaaccactcagcccccagggaagcagaactcctagtcctttagtccccccagggagtagccctctgcctcctaggctcagctcttctcccggaaagactatgcctaccacacagtcctttgctagcgaccctaaatacgccacacctcaggttatccaggcgcctgggccacgagcgggaccctgcattctgcctattgtacgcgatggtaaaaaagtctcctctacgcattactacttgcttcctgaaaggcctagttacctcgagcgctaccaaaggttcctcagggaggctcagtctccggaagagccaacacctctgccagtcccgctgcttctgcccccacccagtacgcccgctcctgcggctcctaccgcaacagtccgtccaatgccacaagcagccttggaccctaaagccaacttcagcaccaataactccaatccaggggctcgcccacccccaccaagggccaccgccagattaccgcaaagggggtgtcccggagacgggcctgaggccggaaggccagccgacaagatacaaatggccatggtccacggggtgaccacagaagaatgtcaggcagcccttcagtgccatggctggtcagttcagcgcgcagcccagtacttgaaagtggagcaactctttggattaggacttcggccacgaggggaatgccataaggtcctggaaatgttcgactggaatctggagcaggctgggtgccacttgctggggagttgggggcctgcacaccataagcggtag

SEQ ID NO: 245804 - DNA, 294 bp, Artificial Sequence
  Description of Artificial Sequence: Synthetic coding sequence
atgcagcccgaagagggcactggatggttactggagctcctgtctgaagtgcaactgcaacagtactttctgaggctccgggacgatcttaacgttacaagactatctcattttgagtatgtgaaaaatgaggacctggagaaaattgggatgggtagacctggacagaggcgcctgtgggaagccgtcaagaggcggaaagctctgtgcaagaggaagagctggatgtcaaaagtattttccggaaagaggttggaggcggagtttccacctcatcattctcaatctacctag

SEQ ID NO: 245805 - DNA, 1827 bp, Artificial Sequence
  Description of Artificial Sequence: Synthetic coding sequence
atgagccaggaaggtgattatgggaggtggaccatctcatcatctgacgagagtgaagaggagaaacctaagccggataagccttcaacatcatcactattgtgtgctcggcagggcgctgccaatgaacctcggtatacttgctccgaggctcagaaagcggctcacaaacgcaaaatcagtccagtcaagttctcaaataccgactctgttctgccaccgaaaagacagaaatctggttcccaggaagatctggggtggtgtctgtccagctccgatgacgaacttcaacccgaaatgccccagaagcaggcggaaaaggtagttatcaaaaaggagaaagacatttcagctccaaacgatggtaccgcacagaggactgaaaatcatggagcccctgcttgccacagacttaaggaggaagaggatgaatacgagacctctggcgaaggtcaggacatctgggatatgctcgacaaaggcaaccctttccagttctatcttacccgggttagtggggttaaacccaaatataattcaggagcactgcacattaaggacattcttagcccactgttcgggaccctcgttagtagtgcccagttcaactattgttttgacgtggactggctggtgaaacagtatccccctgagtttagaaaaaaacctatcctgctggtgcacggcgataaaagggaagccaaagctcacctgcatgcacaggccaagccgtatgagaatatttcgctatgtcaagccaagcttgacattgcttttgggactcaccacaccaaaatgatgctgttgttatatgaagaaggcctacgggtggtaatccacactagcaatctaatccatgccgactggcaccaaaaaacccaggggatctggctgtcccccctttacccacgtattgccgacggtacacacaaatcaggggaatctcccacgcacttcaaggcagacctcatcagctacctgatggcttataacgctccgagcctgaaagagtggatcgatgtgattcacaagcacgacctgagcgaaaccaacgtatacctgatcggatccaccccagggagattccagggatctcagaaagataactggggacatttccggctgaagaagctgctgaaggatcacgctagttcgatgcccaatgccgaatcttggcccgtggtgggccagttttccagtgtaggctctctcggggcagatgaatccaagtggttgtgcagcgagttcaaggagagtatgctgactctggggaaagagtcaaagacacccggaaagtcttcagttccactgtatctcatataccctagtgtagaaaacgtgcggacatctctcgaggggtatccagccggaggttcgctgccatattccattcagacagccgaaaaacagaactggctacacagctatttccacaagtggtcggcggagacttccggaagatctaacgccatgcctcatatcaagacgtacatgcgcccttctccagatttttcaaaaatcgcgtggttccttgtgacatcagctaacctgagcaaagcggcatggggagcattagagaagaatggcacacagcttatgatccggtcatatgagctaggggtgctttttctcccatcggcatttggcctcgactcgtttaaagttaaacagaagttttttgccggatcccaggagcctatggccacattccctgtcccgtatgatttaccccctgaactgtatgggtccaaagatagaccatggatctggaatataccatacgtgaaggctcctgacacccacggtaacatgtgggtgccctcatag

SEQ ID NO: 245806 - DNA, 1110 bp, Artificial Sequence
  Description of Artificial Sequence: Synthetic coding sequence
atggtgatctctgagcggcttcggctaactagtatgccacgcccatcattaactcgcacttctctctcagcgagaaaaatgatgcttctcctgtacgaagagggccttcgcgtggtgatccatacttcaaacctgatacacgccgactggcatcagaaaacgcaaggcatttggctgtcgcccttgtaccccaggattgcagatggcacccacaagtcaggggagtcccctacccattttaaagcagacttgattagttatctgatggcctacaacgcgccatcccttaaggagtggattgacgtgattcacaagcacgatctgtccgagacgaatgtgtatcttattgggtctacaccgggtaggttccagggaagccaaaaagataattgggggcacttccgcttgaagaagctcctgaaagaccacgcctcttccatgcctaatgctgaatcttggcccgtcgtcggacagtttagttccgtcggatcactcggtgcggacgagtccaaatggttatgctcagagtttaaagaatctatgctcacgctgggcaaggagtccaaaacccctggcaaatcgtctgtgcctctgtacttgatttatcccagcgtggagaacgtgagaacctccctggaagggtaccctgcgggtggtagcctcccctattccatccaaacagccgaaaaacagaactggctgcattcgtatttccataagtggagcgcagagaccagcgggaggtctaatgctatgccacatatcaagacctatatgaggccaagtcccgatttttccaagatcgcctggttcttagttacgtccgcaaatttatctaaagccgcttggggggctctggagaagaacggcactcagttgatgatccgaagctatgaacttggggttctgtttcttcccagcgcattcggactcgatagtttcaaagtgaagcagaagttcttcgccggttcgcaagaaccaatggccaccttcccagttccctacgacttgcctccagagctttatgggtccaaggaccggccatggatatggaacatcccatatgtaaaagccccagacactcatggtaatatgtgggtcccttcatag

SEQ ID NO: 245807 - DNA, 1827 bp, Artificial Sequence
  Description of Artificial Sequence: Synthetic coding sequence
atgagccaggagggcgactatgggaggtggaccattagctctagtgacgagtctgaagaggagaaacccaaaccagataaaccctcaacctcgtccctgctatgtgctcggcagggcgcagctaatgaaccacggtatacctgctcagaagcacaaaaggccgctcacaagaggaaaatctctcctgtgaagttttctaacaccgatagcgttctaccccctaagaggcagaagagtggttcccaggaggacctgggatggtgcctttcttccagtgacgatgaactgcagccagagatgccccagaaacaggcagaaaaagttgtgatcaaaaaagagaaagatatctctgcccctaatgatggtaccgcccagcgcaccgaaaatcacggcgcacccgcatgccatcggctcaaagaagaagaagacgagtatgagacctcaggagagggtcaggatatctgggatatgctggacaagggtaaccccttccagttctatctgacgcgcgtaagcggcgtcaagccaaagtacaatagcggcgctctgcacattaaagacatcctgtccccactgttcgggacgttagtgagttctgcgcagttcaactactgctttgacgtggactggctcgtcaaacaatacccaccggagtttcggaagaaacccattctcctagtgcacggtgacaagcgcgaagctaaggcccacctgcacgcccaggcgaagccgtacgagaacattagcctctgtcaggctaaactcgacattgcattcggtacacaccatacaaagatgatgctgctcctgtacgaggaaggacttcgcgtggtgattcacacttcaaatctgatccatgctgactggcaccaaaagacccaggggatctggctatctccactataccccagaattgccgatggaacacacaaatcaggcgagtcccccactcacttcaaagccgacctcatctcttacctcatggcatacaacgctccctccctgaaggaatggatcgatgtgatccataagcacgacctctccgaaacaaacgtgtacttaataggatctacccccggaagattccaggggtcccagaaggataactggggtcacttcagattaaagaaactgctgaaagaccacgcgtcatctatgccaaatgctgagtcttggcccgtggtgggacagttcagtagcgtggggtctttaggggcagatgagagtaaatggctgtgttccgagttcaaggaaagcatgctcacactcggcaaagaatcaaaaactccaggaaaatctagcgtcccgctctatctgatttaccccagtgtggaaaacgttagaactagcctggaggggtatcctgctggagggtctctcccctactccatacagaccgcagagaaacagaactggctccactcctactttcacaagtggtcagccgaaacatcaggtcgttccaatgccatgccgcatatcaaaacgtatatgagaccttctcccgacttttccaagatcgcctggtttctggtgacctcagctaacctgtcaaaggctgcatggggggctttagaaaagaacggcactcagctgatgatacggtcctatgagctcggagtgctattcctcccttccgcgttcgggctggatagcttcaaggtcaagcagaagttcttcgctggaagccaggaaccaatggcaactttccctgtgccctacgacctgccgccagagttgtatggcagcaaggacagaccctggatatggaacatcccttatgtgaaagcacccgatacacatggcaatatgtgggtgccgtcctag

SEQ ID NO: 245808 - DNA, 897 bp, Artificial Sequence
  Description of Artificial Sequence: Synthetic coding sequence
atgtctcaggagggggattacggtcgctggactatcagctccagtgacgaatccgaagaagagaagcccaaaccagataagccgagtacatcgtcactgctgtgcgccagacagggcgctgccaacgagcccagatatacatgtagtgaagcacagaaagctgcccataaaagaaagatcagccctgttaagttttctaacacagatagtgtgcttccaccaaagagacagaagtctgggtcccaggaagaccttggctggtgcctctcctcctcagacgatgaattgcagccagagatgcctcagaagcaagctgagaaggtggttatcaagaaggagaaagacatctccgcccctaacgatggaacagcccaaagaactgaaaatcacggagcgcctgcatgccacaggttgaaagaagaagaggatgagtacgaaactagtggcgaaggacaggatatctgggacatgctcgataagggtaacccctttcagttctacctgacccgggtttcaggggtcaagccaaaatacaatagcggcgctctgcatatcaaggatatccttagcccactctttggtacactagtatccagcgctcagttcaattactgtttcgacgtagactggttggtaaaacagtacccccctgagtttaggaagaagccaatcctcctcgtccacggagataagcgagaggcgaaagctcacctgcatgcccaggcaaaaccctacgagaatatcagtctgtgccaagcgaaattggatatcgcgtttggtactcaccatactaagatgatgctgcttctgtacgaagagggattgcgggtggtgatccacacgtctaatttaatacacgcagactggcaccagaagacacagggcactcacctctag

SEQ ID NO: 245809 - DNA, 441 bp, Artificial Sequence
  Description of Artificial Sequence: Synthetic coding sequence
atgagccaggagggcgattacgggagatggactatctccagtagcgacgaatctgaagaggagaaaccgaaaccagacaaacccagcacatctagtctcctctgcgccaggcagggggctgcgaacgagcctcggtatacatgttccgaagcccagaaagcagctcacaagcgcaaaatcagccctgtaaagttcagtaatacagacagtgtcctgccgccaaagcggcagaagagtggctcacaggaggatctcggctggtgtctctcttcctccgatgacgagctgcagcctgaaatgccccagaagcaagctgaaaaagtcgtcattaagaaagaaaaggatatctctgcgcctaacgatggaactgcccagagaacagaaaaccatggagctcctgcctgccaccgactgaaagaggaggaagacgagtatgagtag

SEQ ID NO: 245810 - DNA, 447 bp, Artificial Sequence
  Description of Artificial Sequence: Synthetic coding sequence
atgtcccaggaaggtgactatggccgatggacaatctcatcctctgatgaatcagaggaggagaagccaaaaccagataaacccagcacatcatcccttctctgcgcccgtcaaggagccgctaatgagccacgctacacatgctcagaagcccagaaggcagcgcataagagaaagatttctccagtaaaattcagtaatactgatagtgttctcccccctaagcgacagaagtctgggtctcaagaagacttgggatggtgcctttcatcctccgacgacgaattgcagcccgagatgcctcagaagcaggcagaaaaggtggtcatcaagaaggaaaaggacattagcgcaccgaatgacgggaccgcccaacgtacagagaaccacggggcaccagcctgtcatcgcctcaaagaggaggaagacgagtatgagacgtcttag

SEQ ID NO: 245811 - DNA, 840 bp, Artificial Sequence
  Description of Artificial Sequence: Synthetic coding sequence
atgtcccaggagggggattatggccgatggaccatctccagctctgacgagagcgaggaggagaaaccaaagcccgacaaacccagtacttcatccttactttgcgcaaggcagggagccgctaacgagcccaggtacacctgtagtgaggcccagaaagcagcccacaaacgcaagataagcccagtgaagttttccaataccgattccgtcctgcctcctaagagacagaagagtggctctcaggaagacctaggatggtgcttaagtagtagcgacgacgaactgcagccggaaatgcctcagaaacaagcggagaaggttgtgataaaaaaggaaaaagatatttcagcacctaacgacggaactgcccagcgcactgaaaaccacggggctccagcatgtcatcgactgaaggaggaggaggatgagtatgaaacaagtggcgaaggacaggacatttgggacatgttggacaaagggaacccttttcagttctatttgacacgcgtgagtggcgtcaagcccaaatacaattccggcgcactccacattaaggacattctgtcgcctctcttcgggaccctcgttagtagcgcacagttcaactactgtttcgatgtcgattggttggtgaaacagtatccccctgagttccgcaagaaacccatactcctggtccacggtgacaaacgggaggccaaagcccatctgcacgcccaggctaagccttacgaaaatatctctttgtgccaggctaaactggatattgcatttgggacgcatcacactaagatgatgctgctgctctacgaggaggggttgcgagtggtgatttag

SEQ ID NO: 245812 - DNA, 486 bp, Artificial Sequence
  Description of Artificial Sequence: Synthetic coding sequence
atgtcacaggagggcgattacggcagatggaccatctccagctcggacgagtcagaggaagagaaacccaagcccgataagcctagcacttcctcgctcctgtgtgccaggcaaggggctgccaacgagcctcgctacacatgctcggaggcccagaaagctgcccataagaggaaaatatctccagtgaaattttccaacaccgattccgtcctaccaccaaagaggcagaagtccgggagtcaggaggatctagggtggtgtctttcaagctccgatgatgagctgcagcccgagatgccgcagaaacaggctgaaaaggtcgtcattaaaaaggagaaggatatctctgcgccaaacgacggcactgctcagcgtacagagaatcacggggctccggcttgccaccgtttgaaggaggaggaagatgaatatgaaacaagtggagaggggcaggacatatgggatatgctcgacaagggctag

SEQ ID NO: 245813 - DNA, 456 bp, Artificial Sequence
  Description of Artificial Sequence: Synthetic coding sequence
atgagtcaggagggcgactatggcaggtggactatcagtagtagcgatgagtcagaggaggagaagcccaaacccgataagccttccacctcctccctgctatgcgcccgacaaggagccgctaatgagcctcgatatacctgctcagaggcacagaaagcagctcacaaacgcaaaatctcccccgtgaaattttcgaacaccgattcggtcctgcccccaaaaagacaaaaatctggttcccaggaagacctcggctggtgtctctctagtagtgacgacgagctgcagccagagatgccccagaagcaagcagaaaaagtcgttattaaaaaagagaaagatatctccgctcctaatgatggaacggcccagaggaccgagaatcatggggctcctgcttgccaccggttgaaggaagaagaagatgaatatgagacatctggcgaaggttag

SEQ ID NO: 245814 - DNA, 1113 bp, Artificial Sequence
  Description of Artificial Sequence: Synthetic coding sequence
atggtcggcaagctgaaacaaaatcttcttctcgcatgcctcgttatttcgtccgttaccgtgttctacttaggccagcatgccatggaatgtcatcatagaattgaggaacgctcccaacctgtgaaactcgaatccacacgcacaactgtgaggactggccttgatcttaaggccaataaaacattcgcataccataaggatatgccccttatctttataggaggcgtgccgagatcagggacaacactcatgagggccatgctggacgctcatcctgacattcgctgcggcgaggagacaagggtgatccctcgcattctggctctcaaacaaatgtggagtaggtctagcaaggagaagattcgactagatgaggccggtgtgacagacgaggtgttggattcggccatgcaggcatttctgctagaaattatcgtcaaacatggagagcctgctccttacttatgtaataaggacccctttgccctaaagtctctgacatacctatctcgcctgttccccaatgccaagtttctgctgatggttcgcgatggcagagctagtgtccattctatgattagcaggaaggtcaccatagcagggttcgacttgaactcctaccgcgattgtctgactaagtggaacagagccatagagaccatgtataatcaatgtatggaagtgggatataagaagtgcatgcttgtacattacgaacagctggtgttgcacccagagagatggatgcgtacgctgctgaaattccttcagataccttggaatcattccgtcctccaccacgaagagatgatcgggaaagccggaggcgtctcccttagcaaagttgagcggagtaccgatcaggtcataaaaccggtcaatgtgggggctttgtcaaagtgggtggggaaaatcccacctgatgtcctccaggatatggccgtcattgctcccatgctggcgaagctgggatatgacccctatgcaaatccaccaaattacggaaagcctgatcctaaaatcattgaaaacaccagacgggtgtacaaaggtgagttccagctgccggacttcttaaaggagaaacctcagactgagcaggtggaatag

SEQ ID NO: 245815 - DNA, 129 bp, Artificial Sequence
  Description of Artificial Sequence: Synthetic coding sequence
atggtgggcaaactaaaacagaatctcctgttggcctgtttagttataagctctgttactgttttctatctcggtcaacacgctatggagtgtcaccacagaatcgaagagcgctctcagccagtctag

SEQ ID NO: 245816 - DNA, 423 bp, Artificial Sequence
  Description of Artificial Sequence: Synthetic coding sequence
atggtcggtaagctaaaacaaaacctgctgcttgcttgtttagtgatttccagcgtcactgtgttttatctggggcagcatgctatggagtgccatcataggattgaggagcggagtcaaccagttaaacttgagagcacaaggactacggtcagaacagggctggacctgaaagcaaacaaaacgtttgcataccacaaagacatgccattgatcttcatcggaggcgtgcctaggtccggcactaccctgatgcgggcaatgttggacgcccaccctgatatacggtgtggcgaagagactcgggtcattccaaggatcctggccttaaaacaaatgtggtcccgcagctcgaaggaaaaaatccggttggacgaagcgggagtcacggacgaggtgctggatagtgcaatgcaggcatag

SEQ ID NO: 245817 - DNA, 1083 bp, Artificial Sequence
  Description of Artificial Sequence: Synthetic coding sequence
atggttggaaagttgaagcagaacctcctgcttgcttgtcttgtgatctccagcgtgaccgtattctatctgggccagcatgccatggaatgccaccaccgcatagaagagcgaagccagcctgtgaagctggagagcaccagaacaacagtgagaacaggcctcgaccttaaagccaataagactttcgcctatcacaaggatatgcccctaatttttatcgggggagttcccagatctggaacgactcttatgcgcgctatgctagatgctcatcctgatatccggtgtggggaggaaaccagggttatcccgagaatactggccctgaaacagatgtggtcccgttcttctaaggagaagatccgactggacgaggctggagtgactgatgaggttctggactccgcaatgcaagccttcctgctcgagatcatcgtcaagcatggcgagccagcaccgtatttatgtaacaaagaccccttcgctcttaagtcccttacctacctatctcgactgttccctaacgccaaatttctcttaatggtaagagacggccgtgcctctgtgcactcaatgatctcacggaaagttaccattgcaggctttgatctgaatagctacagggattgtctaacaaaatggaatcgagctatcgagacgatgtacaaccagtgtatggaagtcgggtataagaagtgcatgctggtccactacgaacagctggttctgcaccccgaaagatggatgcgcactcttctaaaatttctgcagattccatggaaccactccgtgctgcatcacgaggaaatgatcggtaaagcaggcggagtgtccctcagtaaagttgaacggagtaccgaccaggtcattaagcccgtgaacgttggagctctctccaagtgggtgggcaagatcccacccgacgtcctgcaagacatggcggtgatcgcccctatgcttgcaaaactgggttacgacccttacgctaaccctcccaactatggcaaaccagaccccaagatcatagaaaacacaaggcgcgaaagactgctgccgtttcaacaaaagggcaacagctag

SEQ ID NO: 245818 - DNA, 1134 bp, Artificial Sequence
  Description of Artificial Sequence: Synthetic coding sequence
atgaggctgagtgtccggagggtactgctggctgctggctgcgccctggttctagtgctggctgtacagcttgggcagcaggtgctggagtgcagggccgtcctcgccggtctgagatcccccaggggggcaatgaggcccgagcaggaagagctcgtgatggtggggacgaatcacgttgaatatcggtacggcaaggctatgcctctgatattcgtgggtggcgtgcccaggagtgggaccacccttatgcgcgctatgttggatgctcaccctgaggttcgctgtggagaagagaccagaataattcctcgcgtactggccatgcgacaggcatggagcaaaagcgggcgtgaaaaactgcggctggatgaagctggtgttactgacgaggtcttagacgctgccatgcaggcctttattttagaagtgattgcaaaacatggggagcccgcacgggtcctgtgcaacaaggaccctttcacccttaaatcaagcgtgtacctgtcacgactgtttcccaattccaagtttctgctgatggtgagggacggccgtgcttcagttcatagcatgatcaccaggaaagtgaccattgcaggtttcgatttatcctcgtacagagattgcttgaccaagtggaataaagctattgaggtgatgtacgcacaatgcatggaggtgggcaaagaaaaatgtctccccgtctactatgaacaacttgtgttacatcccaggaggtctctgaagctgattctggactttctgggtatcgcatggtctgacgcggtgttacatcacgaggatctgatcggcaaacccggaggcgttagcctaagtaagattgaaagaagcacagatcaggtgataaaacccgtgaacctggaagctctgtctaagtggacggggcacattcccggtgatgttgttcgtgacatggcacagatcgccccaatgcttgctcagctgggctatgacccatatgccaaccctcccaactatggaaacccggaccctttcgtgatcaataatacccagcgtgtcctaaaaggggactataagactcctgccaacctgaagggttacttccaggtgaatcagaattctacatcctcccacctcggtagctcctag

SEQ ID NO: 245819 - DNA, 1134 bp, Artificial Sequence
  Description of Artificial Sequence: Synthetic coding sequence
atgaggctctcagtccgcagagtgctgctggcagctggctgtgcgctcgtgctggtccttgccgtgcagctgggccagcaggttttagaatgtagggccgtgctggccggattgaggtcaccaaggggcgcaatgaggcccgagcaggaagagttggttatggttgggactaaccacgtagagtacagatatgggaaagccatgccactgatttttgttggaggcgtgcccaggtcagggactacacttatgcgagccatgctggatgctcaccccgaggttcgttgcggagaggagacccgcatcatcccaagggtattggcgatgcgacaggcatggtccaagtctgggagagaaaagctgcgcctggacgaagccggagtgaccgatgaggtactcgacgcagctatgcaagccttcatcttggaggtgattgcaaagcacggggaacccgctcgcgtactctgtaacaaggaccctttcaccctgaaatccagcgtgtatctctcacgactcttccctaacagcaagttcctgttaatggtccgcgacgggcgagcaagcgttcattccatgataactcggaaagtgacgattgccggtttcgacctctcgtcctatcgagattgcctgaccaagtggaacaaagcgatcgaggttatgtacgcgcagtgtatggaggtgggtaaggaaaagtgtctacccgtctactacgaacaactcgtcctacaccctagacgcagtctgaaactgatacttgatttcctcggaattgcctggagcgatgcagtcttgcatcacgaagacctgattggcaaaccaggcggagtgtccctatctaagattgagcggagtacagaccaggtgataaagcctgttaacctcgaagcactttcaaagtggacaggacatatccctggcgacgtggtccgggatatggcccagattgcgccaatgctcgctcaactcgggtacgatccctacgccaatcccccaaactacggtaacccggacccgtttgtgattaacaatacgcaacgtgtgttgaagggcgactacaaaacacccgcaaatctcaagggatactttcaggtgaaccagaactcgactagttcccacctcgggagcagctag

SEQ ID NO: 245820 - DNA, 1134 bp, Artificial Sequence
  Description of Artificial Sequence: Synthetic coding sequence
atgagacttagtgtgaggcgggtgctgttggcggctgggtgcgctctggtcctggtcctcgccgtacagttggggcaacaggtgttggagtgcagagccgtcctcgccggactgaggagcccaaggggagctatgaggcctgagcaggaagagctggtgatggtcgggaccaatcacgtcgaataccgatacggcaaagctatgccactgatcttcgttgggggagtgccaagatctggcactaccctaatgcgtgccatgctggatgcacacccggaagtccgatgtggggaagagacacgcatcatcccaagagtgctggctatgaggcaagcatggtctaagagtggcagggagaaactgcgactcgatgaggctggcgtcaccgatgaagtgctggacgcagctatgcaagcattcattttggaggtcattgcgaagcatggtgagcccgctcgcgttctgtgtaacaaagacccgtttactcttaaaagctctgtctaccttagtcggttatttcccaactctaaattcctattaatggtaagggatggccgagccagcgtccattcaatgattactcgcaaggtcacaatagccggtttcgatttgagcagctatagggattgtctcactaagtggaacaaagctatagaggtgatgtacgcacagtgtatggaggtcgggaaggaaaagtgcctacccgtatattacgaacagctggtgctccacccacggcgttcgctgaagctgatactcgactttttaggcatcgcgtggtcagatgctgtcctgcaccacgaagacctcatcggtaagcccggaggggtgtctctaagcaagatagaacgttccactgaccaagttatcaagcctgtcaacctggaggcactgtcaaagtggaccggccacatccccggagatgtagtacgtgacatggcacaaatcgcaccgatgctggcacaacttggctacgatccttatgccaatccacccaactatgggaatcccgacccgtttgttatcaataatacccagcgcgtgctgaagggcgattacaagacccccgctaatctgaaggggtactttcaggtcaaccagaactccacttcctcccacctggggtcttcttag

SEQ ID NO: 245821 - DNA, 195 bp, Artificial Sequence
  Description of Artificial Sequence: Synthetic coding sequence
atgcgtctcagcgttcgccgtgtactgctggccgcaggttgtgcacttgttctagtccttgcggtccagctgggacagcaggttttggagtgcagagctgtgctcgcaggacttaggtccccacggggtgcaatgcgacctgaacaggaggagctcgtgatggtgggcacaaaccatgtggagtataggtattag

SEQ ID NO: 245822 - DNA, 429 bp, Artificial Sequence
  Description of Artificial Sequence: Synthetic coding sequence
atgcgactctcagtgaggagggtcctactcgccgcaggatgcgccctagttctggtgctcgctgtgcagctcggtcagcaggtgctggagtgtagagccgtgttggcgggtctgcggtcgcccagaggagccatgcgcccagagcaggaggagttagtaatggtgggtaccaaccacgtcgagtatcggtatggtaaagccatgcctctgatcttcgtgggcggagtacccagatctggcacgacccttatgcgggcaatgctggatgctcacccagaagtacggtgcggtgaggagactcgcatcatacccagggtgctcgcaatgagacaagcctggtcgaagagcggacgcgaaaaactgcgcctggacgaagcaggagtgactgacgaagtcctcgacgcggctatgcaggcttttatactgtag

SEQ ID NO: 245823 - DNA, 144 bp, Artificial Sequence
  Description of Artificial Sequence: Synthetic coding sequence
atgagactgtccgtgcgccgagtgttgctcgccgcaggctgcgctctggtcctagtcttggcagtgcagctaggtcagcaagtcctggagtgcagagcggtactggcaggtctacgatcccctcggggagctatgcgtccttag

SEQ ID NO: 245824 - DNA, 147 bp, Artificial Sequence
  Description of Artificial Sequence: Synthetic coding sequence
atgcgcttaagcgttcgacgagtactgctcgccgctggctgcgcgcttgttcttgtactcgccgtgcagcttggccagcaggtgctggagtgccgagccgttttagccggactgcggagccctcggggtgcgatgagacccgagtag

SEQ ID NO: 245825 - DNA, 363 bp, Artificial Sequence
  Description of Artificial Sequence: Synthetic coding sequence
atgcgattatccgtgcggagggttttgctggccgctggttgcgctctggtactagttctggccgtccagctaggtcaacaagttctggaatgtcgcgctgtcttggctggcctgagaagcccaagaggcgcaatgcggccagaacaggaggaattggtgatggtcggcactaatcatgtggagtataggtatggcaaagcaatgcctctcatcttcgtcggtggtgtgcctaggagcgggactactttaatgcgcgctatgctggatgcccatcccgaggtgagatgcggggaggaaacccgcattatccctagggttctggccatgcgccaagcctggtccaagtcgggcagagaaaagtag

SEQ ID NO: 245826 - DNA, 933 bp, Artificial Sequence
  Description of Artificial Sequence: Synthetic coding sequence
atgcctttaatttttgttggtggagtacctcggtcgggcacaactctgatgcgggctatgcttgacgctcacccagaagttcgttgcggagaggaaactaggataattcctagagtgctggcaatgcggcaggcatggtccaagagtggaagagaaaagttacgactggacgaggctggggtcacagatgaagtgcttgatgccgcaatgcaggcgtttattctggaggtgatcgcgaagcatggcgaacccgctcgcgtgttatgtaacaaagacccttttacactgaaatcctccgtgtacctgtctcggctctttcctaatagcaaattcctcctgatggttagggacgggagggcgtcagtgcactcgatgattacaagaaaggtaactatcgccggattcgatctgagtagttatcgtgattgtttaaccaaatggaataaagcaatagaagtgatgtatgcacagtgtatggaggtggggaaggagaaatgcctgcctgtgtactacgaacaattagtcctgcatcccagacgatccctgaaactcatcctggacttcttaggcattgcttggtcagacgccgtcctacaccatgaagatttaatcggaaagcctggtggcgtgagccttagcaaaattgagcgatccacagaccaagtcatcaaaccagtgaatctagaggctctttccaaatggacgggacatatccccggagatgtcgtccgcgatatggcacaaatcgccccaatgctggcacagctgggctacgatccctacgctaacccaccaaattacgggaatcctgatcccttcgtgatcaacaacacgcagcgggttctgaagggagactacaagactccggctaacctgaaagggtatttccaggtgaatcagaacagcaccagttcacatttaggttcctcatag

SEQ ID NO: 245827 - DNA, 1587 bp, Artificial Sequence
  Description of Artificial Sequence: Synthetic coding sequence
atgggtgatgccccaagcccggaggaaaagctccaccttattacaagaaacctccaggaggtgctgggagaggaaaaattaaaggagatcctcaaggagagagagttaaagatctattggggcaccgccacaacaggcaagccccatgtggcttacttcgttccaatgtccaaaatagcggatttcctgaaggcaggttgtgaggtcaccatcctgttcgccgatctgcatgcttacctagacaacatgaaggctccatgggagcttctagagctgcgcgtgtcctactacgagaacgtgattaaggccatgctggaaagcatcggagttccacttgaaaagctgaagtttataaaggggaccgactaccagttgagtaaagagtacaccctggatgtgtaccggctgtctagtgtcgttacacaacatgattctaaaaaagccggtgcagaagtggtgaagcaggtggaacatccccttttgagcggattactgtaccctggattgcaagcactcgatgaggaatatctcaaggtggacgcccagtttggtggaatcgatcagcggaaaatttttactttcgcagagaaatatttgccggctctgggttactccaaaagggttcatctgatgaacccgatggtacctgggttaaccggatccaagatgagctcctcagaagaggagagcaagattgatttattagatcggaaggaggacgttaaaaaaaaattgaagaaagctttttgcgagcctggcaatgtagaaaacaacggggtcctgagcttcataaagcatgttctgtttcccctgaagtcagagttcgtaatccttcgcgacgaaaagtggggcggaaataagacgtatacagcgtacgtcgatttggaaaaggactttgccgctgaagtagtccatcctggagatctgaagaacagcgtcgaggtcgccctgaacaagttactggacccaatccgcgagaaatttaacacaccagcactgaagaagctggcgtcggctgcctaccctgacccaagcaagcagaaaccaatggccaagggcccagcaaaaaacagtgaaccggaagaggtaatcccctccagactagatataagggtgggtaagatcattaccgtggaaaagcaccctgatgccgacagcctttatgtagagaaaattgacgttggcgaagctgagccccgaaccgtggtgtctgggctggtgcaattcgttcctaaagaggagttacaggacaggcttgtggtagtcctatgcaacctgaaaccccaaaaaatgcggggagtcgaatcacaggggatgttactgtgcgctagcatcgaaggcattaatcggcaggtcgagccattggatcctccagccggatccgcacctggggaacatgtgttcgtgaaaggctatgagaaaggtcaaccggatgaagagttgaagcccaagaaaaaggtcttcgagaagctgcaggcggatttcaagatctcagaggagtgtatagcacaatggaagcaaacaaacttcatgacgaagctcggctcaatcagctgcaagtccctgaaaggaggaaacatcagctag

SEQ ID NO: 245828 - DNA, 1434 bp, Artificial Sequence
  Description of Artificial Sequence: Synthetic coding sequence
atggcagcccctattctgaggtccttttcttggggcagatggtctgggaccttaaaccttagcgtactcctaccactcggcctgcgcaaggctcattccggcgctcaggggctgctggccgctcagaaagcacgcggtcttttcaaggatttcttccctgagactggcaccaagatcgagcttcccgagttgttcgacaggggtacggcgtcatttccacagaccatctactgtgggttcgaccctacagctgattcactgcacgtgggccatttactagctcttttaggactgtttcaccttcagagggctgggcacaatgtcattgccctggtgggtggggctacagcccgactcggagacccaagtgggagaactaaggaacgtgaagctctggaaaccgaaagagtcagggcaaatgccagagcccttcgcctcgggctcgaggcactggcagctaatcaccaacagttatttaccgacggtcgcagttgggggtcatttactgtgctggacaactccgcatggtaccaaaagcagcatctagtggactttctggccgctgtcggtgggcactttaggatggggaccctgctgagccgacagtccgtccagctccgactcaagtctccagagggtatgagcctggccgagtttttttaccaggtgctgcaggcctatgatttctactacttgtttcagcggtatggctgtcgggtgcaactgggtgggtcagaccaacttggtaatataatgagcggttacgaattcatcaacaagttgacgggagaggatgtctttggaatcacagtccctcttataacaagcactactggggcaaagctcggtaaatcagccggaaacgctgtctggctgaaccgcgacaagacatcaccatttgagctctaccagtttttcgttcgtcaaccggatgactccgtggaaagatacctgaaactgttcaccttccttccactgccggagatcgaccatataatgcagcttcacgtgaaagaacccgagcgcagaggaccgcagaaacggctggctgcagaagtgacaaaactggttcacgggcgtgagggactcgatagtgctaagcgttgcacacaagctttgtatcattcttccattgatgcactcgaggtcatgtcagaccaggagctcaaggagctcttcaaagaggcacctttcagtgaattttttctagaccctggaacctccgtgctcgacacatgtcgaaaggcgaacgccatccctgacggtccgagaggttaccgaatgataacagaagggggtgtgtccataaaccaccagcaggtcactaatcctgagagtgtcctgatcgtcggccagcacatcctgaaaaacgggctgagtctactcaaaattggcaaacgaaacttttacatcatcaaatggctgcagttatag

SEQ ID NO: 245829 - DNA, 723 bp, Artificial Sequence
  Description of Artificial Sequence: Synthetic coding sequence
atggcagaatacctggcttccatcttcgggacggagaaggacaaagtcaactgtagtttctatttcaagatcggcgcatgcaggcacggagacagatgctcacggctccacaataagcccacctttagccagactattgcgctgctgaatatctaccggaaccctcagaattcctcacaatcagctgatggacttaggtgcgcagtatctgatgtcgaaatgcaggagcattatgacgagttcttcgaggaggtatttactgagatggaagagaagtacggagaagtggaggagatgaacgtgtgtgacaatctgggagaccatctggtgggcaacgtgtatgttaagtttcgaagggaggaggacgccgagaaggcagtgatcgacttgaataatcgctggttcaatggccaacccatccatgcagagcttagtcctgttactgatttccgtgaagcctgctgcagacagtatgaaatgggggaatgcacgaggggagggttctgtaactttatgcacctgaaacccatctccagggaactccgccgtgagttatatggcaggcggcgtaagaagcaccgctcacgttcacgcagcagagagagacgatcaaggtcccgggaccgcggaaggggaggaggcggaggaggcggtgggggaggaggcggacgcgagagagaccggagacggagcagagacagggagcgttcgggacgcttttag

SEQ ID NO: 245830 - DNA, 723 bp, Artificial Sequence
  Description of Artificial Sequence: Synthetic coding sequence
atggccgagtatcttgcttccatcttcgggaccgagaaagacaaggtgaactgttcgttctacttcaagattggcgcttgccgccacggcgataggtgcagcaggctacacaacaagccaaccttcagtcagactattctgatccagaacatttaccgtaacccacagaattcagcacagaccgcagacggtagccattgtgcggtttctgatgtggaaatgcaggagcactacgacgagttttttgaagaggttttcactgagatggaagagaagtatggcgaggtggaagagatgaacgtgtgtgacaaccttggggaccatctggttggaaacgtgtacgtgaagtttcgccgagaggaggacgcggagaaggccgtgatcgacttgaataaccgttggtttaatggccagccaattcatgccgagctgtccccggtgactgacttccgcgaggcctgttgtcgccaatatgagatgggagagtgtacgagaggcggtttttgcaacttcatgcatctcaaaccaatctccagagagctacggcgagaactttacggacggagaagaaaaaagcaccgttcacgctctcgctccagagagcggagatctaggagccgggaccggggaagaggagggggaggaggaggtggtggaggaggcggtggacgagaaagggatagacgaaggagcagggacagggaacgctctggaaggttttag

SEQ ID NO: 245831 - DNA, 504 bp, Artificial Sequence
  Description of Artificial Sequence: Synthetic coding sequence
atgcaggagcattacgacgaattctttgaggaggtctttacagaaatggaggaaaagtatggggaagttgaagagatgaatgtatgcgataatctgggcgaccatctagtgggcaatgtgtatgtaaagtttcggagagaggaggatgctgaaaaggctgtgattgatttaaacaatcgctggttcaacggccagccaattcacgctgaactgtcaccagttactgacttccgcgaggcatgttgccggcagtatgagatgggagaatgtactcggggtggcttctgtaacttcatgcacttgaaaccaatttctagggagttaaggagagaactgtatggccgacggcgtaagaaacatcgatccagaagtcggtctcgagagcgcagaagcaggagcagagaccggggaaggggcggtggaggaggtggcggaggcggaggtgggggacgtgagcgggaccggagaaggtcacgcgaccgcgagcgatcaggccgattctag

SEQ ID NO: 245832 - DNA, 504 bp, Artificial Sequence
  Description of Artificial Sequence: Synthetic coding sequence
atgcaagaacactatgacgaattcttcgaggaggtgttcacagagatggaagagaaatacggtgaagtggaggagatgaacgtttgtgacaacctgggggatcatctggtcggtaacgtgtacgttaagttcaggcgcgaagaggacgctgagaaagccgtcatcgacttaaacaaccggtggtttaatggccaaccaatccacgccgagcttagccctgtcactgatttcagagaggcatgctgtaggcagtatgaaatgggggaatgtactagagggggattttgcaacttcatgcatctcaagccaatctccagggaattaagacgcgagctgtatggcaggagaaggaaaaagcaccgctcacgctcccggtcccgcgagagaagatcccggtctagagatagaggacgtggcggtgggggtggaggtggcggaggaggcggaggacgcgaacgagatagacggcgatcaagagaccgagaaagatcaggccgtttctag

SEQ ID NO: 245833 - DNA, 1218 bp, Artificial Sequence
  Description of Artificial Sequence: Synthetic coding sequence
atgttcgttcaagaggagaagatctttgcgggaaaggtgctgcgcttgcatatctgcgcctcggatggagcggaatggctcgaagaggctacggaagacacgagtgtggaaaagctaaaggagaggtgtctaaagcactgcgcccacggctctctggaagatccgaagtctattacacaccacaagctcattcatgcagcttcagagcgcgtgttgtccgacgctcgaaccatactagaggagaacattcaggatcaggatgtactactactgatcaaaaaacgcgctccatcaccgctcccaaagatggcagacgtgagcgctgaagagaagaaaaaacaagaccagaaagcaccagacaaagaagctattctgcgcgctacggctaacctaccatcttacaacatggacagagcagccgttcaaacaaacatgcgggacttccagacagaactgagaaaaatcctggtctctttgattgaggtagctcaaaagttgcttgccctgaacccggatgctgttgaactattcaaaaaggccaacgccatgttggacgaagatgaggatgagagggttgatgaggccgcactgcggcagttgacagaaatgggatttcccgagaatagagcaaccaaggcccttcagctaaaccacatgagcgtgcctcaagcaatggagtggcttattgagcatgctgaggaccccacaatcgacacccccctccctggacaggctccacccgaggcagagggcgcaacggctgccgcatctgaagccgctgccggagcctcagcgacagatgaggaagccagggatgagctgaccgagatcttcaaaaagatccgaaggaagcgggaatttcgtgccgacgctcgagcggttatttccctgatggagatggggttcgatgaaaaggaggtcatcgacgctctgcgcgtgaacaacaaccagcaaaacgctgcgtgcgaatggcttcttggcgaccgaaaaccatctcctgaggagctggacaaaggaatcgatccagactcacctctatttcaagccatactcgacaacccagtggtgcagctcgggttgaccaatccaaaaactctgctcgcatttgaggatatgctggaaaaccccttgaactccactcagtggatgaacgaccccgagaccggccctgtcatgctgcaaatcagtaggatctttcaaaccctgaatcgaacttag

SEQ ID NO: 245834 - DNA, 540 bp, Artificial Sequence
  Description of Artificial Sequence: Synthetic coding sequence
atggcagcctcacaagttctgggcgaaaagattaacatcctgtcaggcgagactgtgaaagcgggtgacagggacccactcgggaatgattgccctgagcaggataggctgccccagcggtcctggcgacagaaatgcgcgtcctacgttcttgctctgagaccttggagtttctccgcctcccttacacccgtcgccctcggtagcgccctggcttacagaagccacggcgtcctggatccacggttattggtgggatgcgcggtcgcggtattggccgttcacggcgcaggcaacttggtgaatacctattatgatttcagtaagggtatcgaccacaagaaaagcgatgaccgcactctggtggacaggatcctggaaccgcaggatgttgtccggttcggggtgttcttatatacactcggctgtgtgtgcgccgcttgcctttactatttgtccccgcttaagctagaacatttggcccttatttacttcgggggactatcaggttcctttctgtatacaggagtcctgatctag

SEQ ID NO: 245835 - DNA, 1017 bp, Artificial Sequence
  Description of Artificial Sequence: Synthetic coding sequence
atggctgcttcacaagtgttgggcgagaagatcaacattctgagcggtgagacagtgaaggcgggagatagagatcccttgggtaacgattgtccggagcaggacaggctcccccagagatcatggaggcagaagtgcgcctcttatgtgttagcccttaggccctggtctttttctgctagccttaccccggttgctctcgggagcgccctcgcttataggtcacacggtgtgctggaccctaggctgctggtcgggtgcgctgtggccgtcctggcggtgcatggagccggtaatctggtcaacacttattatgatttctccaaaggcatagaccataaaaagtctgatgaccgtaccttggtggatcgcatactcgaaccccaagatgtggttcgtttcggagtctttctctacactttaggatgcgtatgcgccgcatgcctatattatctctcccccctcaagctcgagcatctagccctgatctatttcggtggtctgagtggatctttcctatatacgggcggaattggctttaagtacgttgctcttggggacctaatcatactgattacctttggacctttggcagtgatgtttgcctatgccatccaggtcggttcgcttgccatcttcccacttgtctacgccataccactagccctaagcacagaggctattctccactctaacaataccagggacatggaatccgatcgggaagccggaatcgttactctcgcaattctcatcggccctacttttagctacatcctgtataatacacttttattcctcccgtatctagttttttctatcctcgccactcattgcactatcagcctggcattgcctctccttacaattccgatggcattcagtctggagaggcagttccggtctcaggcctttaataagctgcctcaacgaacagctaaactcaatctgcttctcggacttttctacgtgtttggcatcatcctggcgcctgccggatctctgccaaagatctag

SEQ ID NO: 245836 - DNA, 3405 bp, Artificial Sequence
  Description of Artificial Sequence: Synthetic coding sequence
atgtccgaaccccaccgagtgcaatttacttccctgccaggatctctcaaccccgcatttctgaaaaaaagcagaaaagaggaggccggtgcgggagagcagcatcaagactgcgagcctgcggctgctgccgtgaggatcactctcacactgttcgagcctgaccacaaaagatgccccgaatttttctatcccgaactggtcaagaacattagagggaaggtaaaggggctgcagcctggcgacaaaaagaaagacctgagcgatccctttaatgacgaagagaaagaacggcataaggtggaggccttagccagaaaattcgaggaaaagtacggcggaaagaagcgtagaaaagacaggatccaagatctgatcgacatgggttatggatatgatgaatccgactcctttatcgataactccgaggcgtacgatgagctcgtgcctgcaagtcttacaactaaatacggcggattctatatcaacagcggcacacttcaatttaggcaggctagcgaatcggaagatgattttatcaaagagaaaaaaaagaagtcccctaaaaagcgtaagctgaaagaagggggagaaaagattaagaagaaaaagaaggatgatacctacgacaaggaaaagaaatctaaaaagtcgaaatttagcaaggctgggtttacggccctgaatgctagcaaagaaaagaagaagaagaaatactccggcgctctgagcgtaaaggagatgctcaagaaatttcagaaggaaaaagaagcgcaaaaaaagcgcgaagaagaacacaagcctgttgcggtcccttcagcagaagctcagggtctcagagaactagaaggcgcttctgatccactcctgtcactgtttggctctacatcagacaatgatctgctacaggccgctacggccatggatagcctgaccgatctagacctggaacatcttctgtccgagagtcctgagggctctccattcagagacatggacgatggaagcgactcgcttggggtgggactcgatcaggagttccgccagccatctagcctgcccgaggggcttccagcgccactggagaagagggtcaaagagctggcccaggcggcaagggctgcagaaggtgagtcaaggcagaagttcttcacacaggatattaacggcatactgcttgatattgaagcccagactcgagagttgagcagccaggtgcgttctggtgtatacgcttacctggcgtcctttctgccgtgtagtaaagacgcgctgctaaaacgtgcgagaaaactacacctttatgaacaggggggtagacttaaggagccattgcagaagctgaaggaggctatcggtcgcgcaatgccagagcagatggctaagtatcaggacgagtgccaggcccacacccaggccaaggttgctaagatgttggaggaggagaaggacaaggaacagagggaccgaatctgtagcgatgaggaggaggatgaggagaagggaggcaggaggattatgggaccccgtaagaagttccagtggaacgatgagatcagggaattattgtgccaggtggtaaaaattaagctcgagtcacaggaccttgaacgtaacaataaggcgcaagcttgggaagactgtgtgaagggcttcctagacgcggaggtgaagccactctggccaaaagggtggatgcaggctcggacactattcaaggaatcccgcagaggacatggacacctgactagcatattagccaaaaaaaaggtgatggctcccagtaaaattaaggtaaaagagtctagcacgaagccagataagaaggtatccgtgccttccggtcagattggcggtccaatagcactgccttctgatcaccagacgggaggactctcgatcggagccagctctagagagctcccaagtcaggcctcaggcggtcttgctaatcctcctcctgtgaacctggaggattcgttggacgaggacctcattcgcaacccagcctcctcagtcgaggccgttagtaaggagctggccgcactaaactcaagggccgcaggaaatagcgagtttactcttcctgccccaagcaaagctccagcagagaaggtgggcggtgtcctctgcaccgaagagaagcgcaacttcgccaaaccaagcccatcagcgcctccacccgcttcaagtctccagtcgcccttgaactttcttgccgagcaggctctggctttagggcagtcctctcaagaaaagaagccagaatccagcggatataaggaacttagttgtcaggccccattgaataaaggtcttcccgaggtccaccagtctaaggccaagcaccactccctgcctcgcacctcacatggcccacaggtggctgtgcccgtgcctggccctcaggtcaaggtgtttcacgccggaacacagcagcagaagaatttcacgccaccttctccttttgccaataaactgcagggccctaaggcctcgcccacccagtgccataggagcctgctgcaacttgtgaagactgctgctaaagggcagggctttcatcccagcgccccagccacctctggaggtcttagtgcgtcttcatctagttcccataagaccccggcttcctccagctccgctctgtctcatccagccaagccgcattcagtaagcagcgccggatcaagttacaagaataacccgtttgcatcttcgatcagcaaacacggcgtgagtagtgggagctctagcagcggtggcacacccgtgcagtcatccgttagtggatcacttgtgccgggaatccagcctccaagcgtaggtcaagcaacaagcagaccagtgcccagttccgccggtaaaaagatgccagtgagccaaaagctgacccttgtcgcacccccagggggtcctaacggtgacagctcggggggtacacaaggagtcgcaaagctgctgacgtctccctctctgaaaccctctgctgtttcctccgtcactagttcaacttccctctccaagggggcatccggcacagtactcttggccggaagctcactcatggccagcccctacaaatcctctagcccaaaactctccggcgctatgagctctaacagcctgggtatcatcaccccggttccaattccggttcatgtgctttcttttagcgcagattcttccgcaaaggctggagtgagcaaagacgcaattgtcactggccctgctcctggaagttttcaccacggcctaggccactctctcttggccggtctgcatagtagtcccccacacgctgctccccttccacacgcagctgtccccactcacatcccccaatcactaccaggagccagtcagcttcacggtaagggcccagcggtcccacggaaactctag

SEQ ID NO: 245837 - DNA, 3405 bp, Artificial Sequence
  Description of Artificial Sequence: Synthetic coding sequence
atgtccgagccacatagggtgcagttcacaagcctcccaggtagcctgaaccctgcctttctgaagaagagccggaaagaggaggctggcgcaggggaacagcatcaggattgcgagcctgctgccgcagccgtgcgcatcactcttacactttttgagccagaccacaagaggtgtccagaatttttttatcccgaactggtgaagaacatacggggaaaggtaaaaggtcttcagcctggggacaaaaagaaggatcttagcgaccctttcaatgacgaagaaaaagaacgccacaaggtggaagccctagctagaaagttcgaggagaaatacggaggtaaaaagcggaggaaagaccgtatccaagacctcatcgacatgggctacgggtacgacgaaagcgacagctttatcgacaactctgaggcatacgacgagctggtgcctgcaagtctcaccaccaagtatggaggcttctatattaattctggcacgctgcaatttaggcaggcaagtgaatcagaggacgacttcatcaaggaaaaaaaaaaaaaatcccccaaaaaaagaaaactgaaggaaggtggagaaaagataaaaaagaaaaagaaggatgatacgtacgacaaggagaagaagtcgaagaaaagtaaattcagtaaggctggcttcacggccctgaacgcttccaaggagaagaaaaagaaaaagtactctggggcactgagtgtaaaggagatgctcaagaagttccagaaagaaaaggaagcccagaaaaaaagagaggaggaacataagcccgtcgcagttccatccgcagaagcccaggggctaagggagctcgagggagcgtcagatccactactgagcctgtttgggagcacaagcgacaatgaccttctgcaggcagcgactgccatggacagcttgacggacctagacctggagcacttactgtcagaatctcctgaagggtcaccattccgagatatggatgacggctctgactctttaggcgttggcctggaccaagagtttagacagccttcctctctgcccgaaggactgcctgccccactagaaaagcgcgtgaaagagttggcgcaggctgcacgagccgctgagggcgaaagccgccaaaaatttttcactcaagatataaatggaatcctccttgacatcgaggcccagaccagagaactcagctcccaggtgagaagcggggtgtacgcttatttggcctctttccttccctgcagcaaagatgctttactgaagcgggctcggaagcttcacctgtacgaacaggggggacgcctgaaggagccgctgcaaaagcttaaagaagccattggcagggctatgcctgagcagatggccaaataccaggacgagtgccaggcccatacacaggccaaggtcgctaagatgctggaggaggagaaagacaaggaacaaagggacagaatttgtagcgacgaggaggaggacgaagagaaaggtggcaggaggattatggggccacgaaaaaagtttcagtggaacgacgaaattcgagaactcctgtgccaggtggttaagatcaagctggaatcccaggacctcgaacggaataataaagctcaggcctgggaagattgcgtgaaagggtttctggatgccgaggtgaagcctctatggcccaaaggttggatgcaggctagaacactctttaaagaaagcagacggggacatggccatttaacatccattctcgccaagaaaaaagtaatggctccctctaaaatcaaagtgaaggagtcctcaactaaacccgacaagaaggtttccgtcccatcaggccagatcgggggaccgatcgccctgccatccgatcaccagactggtggactctctatcggcgcttctagtagggaactgcccagccaggcgtccgggggactcgctaatcctccacccgttaacctcgaggactccctggatgaggacctgattagaaaccctgctagctcagtggaggccgtgagcaaggaacttgcggctctgaactccagagctgcgggaaacagcgagttcaccttaccagctccgagcaaggctccagcagagaaagtgggtggtgtgctgtgtactgaagaaaagcgaaacttcgcgaagccttccccctccgcaccccctccagcaagctctctgcagagtcctctgaatttcttggccgaacaggccctagccctgggacagtcatcacaggaaaagaaacctgagtcctctgggtataaagaactgtcttgccaagcccctctgaataaggggctcccagaggtgcaccagtctaaagccaaacatcattctctccctcggacttcacacgggcctcaggttgcggttcccgtgcctggaccacaggtcaaagtatttcatgccggaacgcagcagcagaagaatttcaccccaccctccccattcgccaacaagctccagggccctaaagcaagccccacacagtgccaccgatcgctgctccaactagtaaaaacagccgcaaaagggcagggctttcatccttctgcgccagcaactagtgggggtctttccgctagttcttcctcctcacacaaaacaccagcaagttccagcagtgctctttcacaccccgctaaaccacattccgtgtcgagcgccggtagctcatataaaaacaaccctttcgcatccagcatatctaaacacggcgtctcttcaggatcttcatcctcagggggaaccccagtgcagagtagcgtttccggaagccttgtgcccggaatccagccaccctccgtgggtcaggcaaccagcaggccagttccgtcctccgctggcaaaaaaatgcccgtttcacaaaagctgacattggtggcaccgccaggcggtcccaatggggatagctctgggggtacccagggcgtggctaagctcctgacgagcccctccctcaaaccctccgcagtgagctcagtgacctctagcacttctctatctaagggcgcttccggaacggtgctgctggctggcagcagccttatggcctcaccttataaaagctcttctcccaagctcagtggggcaatgagcagcaactctctggggataatcacacccgtgcctattcctgtgcatgtgttaagtttttctgcagactcctcagcaaaggcgggtgtcagcaaagacgcgatcgtgactggaccagccccagggtcctttcatcacggcctcggacactcgctcctggcaggcttgcactcatctccccctcacgccgctccactcccccatgctgccgttcccacccacatcccgcagtccctccccggagcctctcagctccacggcaaaggacctgcagttcctaggaagctgtag

SEQ ID NO: 245838 - DNA, 3315 bp, Artificial Sequence
  Description of Artificial Sequence: Synthetic coding sequence
atgagcgagcctcatagggtacaattcaccagccttcctgggagcctgaatccagcattcctaaagaagagtagaaaggaggaggcaggcgctggggagcaacaccaagattgcgagcctgcagccgcagctgtccgcataacattgaccctattcgagccggaccacaaacgctgcccggaatttttctatccagaactggtgaagaatatccggggaaaagtgaagggcctccagccaggcgacaaaaagaaagacctgagcgaccctttcaatgacgaggaaaaagagcggcacaaagtggaggcattagcccgaaagtttgaagagaaatatggcggaaagaaaaggcggaaggataggattcaggatctgattgacatggggtacgggtatgatgagtctgactctttcatagacaattcggaggcatatgatgaattggttcctgcttctctgactacaaagtatggcggattctatatcaattctggcactcttcagttccgtcaggcctccgagtcggaggacgattttattaaagagaaaaaaaaaaaaagtcctaagaagcggaaactaaaggagggtggggagaagatcaaaaagaagaaaaaggacgacacatacgataaagagaaaaagtccaagaagagcaagtttagtaaggctggtttcaccgctcttaatgcttctaaggaaaagaaaaagaaaaaatattccggcgctctcagcgtcaaagagatgttgaagaagttccagaaggagaaagaggcacaaaagaaaagagaggaagagcacaagccagtcgcagtgccatcagcagaagcccagggactccgggagctggaaggagccagtgatccactgctatcgctgttcggctctacctcagacaacgatctactgcaggcggctaccgctatggactccctgaccgatctggacctggagcacctactgtcagaatcccccgagggctctccattccgcgatatggatgatgggagcgattcccttggtgtgggcctcgatcaggagtttagacagccttcatctctgccagaggggctgcctgcacctctcgagaaaagggtaaaggaactggcgcaggctgcaagggcagccgagggagagtcccgacagaagtttttcacacaagacatcaacggcattctgctagacatagaagcccagacacgggaactgagtagccaggtgaggagtggagtgtatgcctacctcgcctccttcctgccatgtagcaaagacgccttgttgaagagggccaggaaactacacctatatgagcagggaggcaggctgaaggagcccctccagaagttaaaggaagccataggccgagctatgcccgagcaaatggctaagtaccaagacgagtgccaggctcacacacaggccaaagtcgcgaagatgctggaggaggagaaggataaagaacagagggatcgaatctgcagtgacgaggaggaagatgaggaaaaggggggacggcgaatcatggggccacgcaaaaaattccagtggaacgacgagatacgtgagctcttgtgtcaggtggttaagattaagctggagagtcaagacctggaacgtaacaacaaggctcaggcttgggaggactgcgtcaagggctttttggatgcggaggtcaaacctctttggccaaagggctggatgcaggcacggacgttattcaaggagtcccgtcggggtcatggccatctgacatcaatcctcgctaagaaaaaggtcatggccccatccaaaattaaggtgaaagaatctagtactaaacctgataagaaggtgagcgtgccttcgggtcagattggcggaccgatcgcactgccatcagatcaccagaccggtggattaagcattggtgcctccagcagagaactcccaagccaagcatccggcggattggctaatcctccgcctgttaatctggaagattccctcgacgaggacctaatcaggaatcctgcaagtagcgtggaggccgtgagtaaggagctggccgctctcaatagtcgtgcagccggaaattctgaatttacgcttcctgccccaagtaaggccccagctgaaaaggtggggggagtgctgtgtacagaggagaaaagaaatttcgctaagcctagcccttcagcgccacccccagcttccagtcttcagagtccgctgaacttcctggctgaacaagctctggcgctcggacaaagctcacaggagaagaagcccgagagctccgggtataaagagctatcttgtcaggctcctttgaataagggcctgcctgaagttcatcagagcaaggcaaagcatcacagcctccctcggacgtcgcacggtccacaggtcgccgttccagttcctggccctcaggttaaagtgtttcacgccggtactcagcagcagaagaacttcactcccccatctccatttgcaaacaagctccagggcccaaaggcctctcccactcaatgtcacagatcccttctgcaactcgttaaaacagcagctaagggccaggggttccatccttccgctcccgctacctcggggggattaagcgcctcctcttcttcttcccacaaaaccccggcatcttctagcagtgccctctcacatcctgctaaaccccattccgtgtcgagcgccggaagctcatacaaaaataaccccttcgcaagtagcatctctaaacacggtgtttcgtcaggatcctctagttcaggcggaacccctgtacaatcaagcgtgtctggaagcttggtaccaggtatccagccaccctcagtgggacaggctacaagccggccagtgccaagttctgctggaaagaaaatgccagtgtcacagaagttaacacttgtggctcccccaggcggtccaaatggcgactcgagcgggggaacacaaggtgtggccaagttactaacgtcacctagcctgaagcctagtgccgtatcatcggttacatcctctaccagcctctcaaagggcgcaagcggaaccgtgcttctggctggatccagtctgatggcctccccttacaaaagttctagtccaaaactcagcggagcaatgtcaagcaacagtttgggcattatcaccccggtgcctatccctgtgcacgtgctctctttctcagcagactcatccgccaaggctggcgtcagcaaggacgctattgtgaccggcccagctccaggctctttccaccacgggctggggcattccgcttcccagctccacggaaagggccctgcggtcccacgcaagctgtag

SEQ ID NO: 245839 - DNA, 3795 bp, Artificial Sequence
  Description of Artificial Sequence: Synthetic coding sequence
atgtccctgcaaagggagcccccacgaccggagcccccaccaccatttcctcccctgcccttacagccaccccctcccagggaatcggcctcacgggctgaacagccccctaggccaccccgagagactgtcaggcttgagctggtgctcaaagaccccacagatgaatcatgcgtggagttcagctatcctgagcttcttctgtgtggcgaacagcggaaaaaactgattcacacagaggatccatttaacgacgagcatcaggaaaggcaggaagtcgaaatgctggctaaaaagtttgagatgaagtacggcggtaaaccgagaaagcacagaaaggaccggctgcaggacctgattgacattggtttcggatacgacgagactgaccccttcatcgacaattccgaggcctatgatgaactggtgcctgcatcccttacgacgaagtatggtgggttctacatcaataccgggactttgcagttcagacaagcctctgataccgaagaagatgacattaccgataatcaaaagcacaagccacccaaggtaccgaagatcaaagaggatgacatagaaatgaagaagaggaagagaaaggaggagggcgagaaagagaagaagccaagaaagaaggttcccaaacagttgggcgtggtggccttgaatagtcacaagtccgagaaaaagaagaagaggtacaaggatagcctttcgctcgctgccatgattcgcaagtttcagaaagaaaaagacgctctgaaaaaagaaagtaatcccaaagtacccgtgacactgtcaacaccatccctaaataagcccccatgcgcagctgcagcattagggaatgatgtccccgatctcaacctgagctccggggatcccgacctgccaatattcgtaagcactaatgaacatgagctctttcaggaagccgaaaatgccctggaaatgctcgatgacttcgactttgaccgcctcctggatgccgcatcggacggatcccctttaagcgagtctggcggtgagaacggtactaccactcaacccacatacactagccaagtgatgccaaaagtggttccaactttacctgaggggctgccagtgttgcttgaaaagcggatcgaggatcttcgagtggccgctaagctgtttgatgaggagggaaggaagaagttctttacgcaagatatgaacaatattctcctagacatcgagctgcagcttcaggaactgggcccagtaatcaggagtggcgtgtactcacacctggaggcgtttgtcccctgtaacaaagaaactctggtgaagcgactgaagaagctccacctcaacgtgcaggacgacagactccgcgaacctctgcagaaactgaaactcgcagtgtcgaacgtcatgcccgagcagttgtttaagtaccaggaagattgccaagccagatctcaggctaaatgcgctaagctacagactgatgaggaaagggaaaagaacggatcagaggaggacgatgatgagaagccgggaaaacgtgttatcggaccacgtaaaaagtttcactgggacgacacaatcaggacattactatgtaacctcgtcgaaatcaagctgggatgttatgagctggagcctaataagtcacagtctgctgaggattacctgaaatccttcatggagacagaggtgaagcctctgtggcctaaaggctggatgcaagcgaggatgttatttaaggaaagtaggagcgtgcacaaccacctcacttctgctccggcaaaaaaaaaggttatcccagctcctaaaccaaaggtcaaggaggtcatggttaagacacttcccctgcattcctttcctactatgttgaaagaatgctccccaaaaaaggaccagaagaccccaacatctctggttgcaagtgtttcagggccaccaacctcttcctctactgcagcgattgccgctgcgtcaagcagcagcgccccagcgcaggaaaccatctgccttgacgatagcctagatgaagacctgtcgttccacagcccttctctagacctggtctccgaggcactggccgtgatcaataacggaaacaagggcccacctgtagggagccggatcagtatgcctacaacaaagcccagacccggattacgggaggagaaactggcttctattatgtctaaattgcctctggcaacaccgaagaaactcgattcgacccagaccactcactcctcttctctaatcgctggacatacgggaccggtgccaaaaaagccccaggacctggcccataccggcatttcaagcggtttgatcgcgggaagttcaatacagaacccgaaggtctccctggagcccctgcccgctcgactgctgcagcagggattacagaggagctcccaaattcatacctcgagctcgagccagactcacgtgtcctcgtctagccaagctcaaatcgccgcatcgtcccatgcactgggtacctcagaagcccaggacgcctctagcctgacacaggtcaccaaagtgcaccaacattcagctgttcagcagaactacgtcagcccactgcaggccaccatcagcaaatcccagactaatccagtggtcaaactgtctaacaatccacagctgtcatgttcttcgagtctgatcaagacatccgataaacccttaatgtatcggctgcccctgagtactccatctcctggaaacggcagccaaggaagtcatcctctggttagtcgaaccgtgccctccaccacaacatcctcaaactacttagccaaggctatggtgagccagataagtactcaggggttcaagtcacccttcagcatggccgcaagccccaaactggccgcaagtcctaaacccgcaactagcccaaaaccgttgcccagccccaaaccaagcgcttcacctaaaccctcactgagtgctaaaccctccgtctccactaagttgatcagcaagagcaatcccacgccgaagccaactgtgtccccaagtagtagctcacctaacgctctcgtggctcaggggtcccactcatctacaaactcgccggtgcacaaacagccaagcggcatgaacatttcgagacaaagcccaaccttaaatttgcttccttcttctaggacctccggtctgccaccaacaaagaatctccaggcgccttccaagctgaccaacagttcgagtacggggacggtgggaaagaattccctgagtggcattgccatgaatgtccctgcctccagagggtccaacctgaattcaagtggagcaaataggacttctctgtcaggcggtactggatctggaactcagggggcaaccaaacctttaagcacaccacatcggccatccaccgcatccgggagctctgtagtaaccgcctctgtccagagtacggctggcgcatccctgctggctaatgctagtccgttaactctgatgaccagccccctaagcgtgaccaatcagaatgtgacaccctttgggatgctaggtggccttgtacccgtgactatgccgtttcaattcccgcttgaaatcttcggatttgggaccgacacagccggtgtgacaacaacaagtggatctacgtccgctgccttccatcattcccttacccagaatctgctgaaagggctccagccgggtggcgctcagcatgccgcaaccttgagccactcacctctgcccgctcacctccagcaggcctttcacgatggagggcagagtaaaggagataccaagcttccccgaaaaagccagtag

SEQ ID NO: 245840 - DNA, 4044 bp, Artificial Sequence
  Description of Artificial Sequence: Synthetic coding sequence
atggcagaacccaggcgagtcgccttcatctcactgtccccagttcgtcgtcgcgaggccgaataccccggaccagagagggaacccgaatatccccgtgagcctcctaggctggaaccccagccgtacagggaaccagctcgggctgagccccctgctccaagggaacccgcaccaaggtcagacgctcaaccaccaagtcgggagaaaccattgcctcagcgggaggtctcccgggctgagcctccgatgtcattacagcgggagcctccaaggccagagcccccaccgccatttcctccactccccttgcagccgcctccgcctcgcgaatcagccagccgggctgaacaaccccctaggccaccccgagagactgtcaggctggagttggttctgaaagaccctaccgatgagtcttgcgtggagttttcctaccctgagttgcttctgtgcggcgaacaaagaaaaaaactgattcataccgaggacccatttaacgatgagcaccaggagcgccaggaggtggagatgctagcaaagaagtttgagatgaaatacggagggaaacctcgcaaacaccgtaaagacagactgcaggatctcatcgacattgggttcggatatgacgagaccgaccctttcatagacaacagtgaggcgtacgatgaactggtaccagcgtctctgacaaccaagtacggaggattttatatcaacactgggacattacagtttcgacaagctagcgataccgaagaggatgatattactgataaccagaagcacaaaccaccaaaggttcccaagattaaggaggacgatatcgagatgaaaaaaaggaagaggaaggaggaaggagaaaaggagaaaaagcctcggaaaaaggttccaaagcagcttggggtggtcgccttgaactcacacaaatctgagaaaaaaaagaaacgctacaaggacagccttagtttggccgctatgattcgcaagtttcagaaagagaaagatgcgctgaagaaggagagcaatccaaaggtgcccgtcacactctccacaccctctctgaacaagcccccttgcgccgctgcggctctcggaaatgacgttccagatctgaacctatcaagcggcgatcctgatctgcctatttttgtaagtacgaatgagcacgaactattccaggaggccgagaacgccctggagatgttggacgatttcgatttcgacaggctgcttgatgctgcatcggatggcagtcctctgagcgaatctggtggtgagaatggcaccactacacagccaacttatacctctcaggtgatgcctaaggttgtgcctactctgcccgaagggttacctgttcttcttgagaagcggattgaggatttgagagtggctgctaagctcttcgacgaagaagggagaaagaaatttttcacacaggacatgaacaatatcttgctcgatattgagctgcagctgcaggagctggggccagtgattcgatcgggagtatatagtcatctcgaagcatttgtgccttgcaataaggaaacattagtgaagaggctaaaaaagctgcacctcaacgtgcaggatgaccgattaagagagcccctgcagaaactaaagttggctgtgtccaacgttatgccagagcaactgtttaagtaccaggaggactgtcaagcccgatctcaagctaaatgcgccaagttgcaaacagatgaggagcgagaaaagaatgggagtgaggaagacgacgacgaaaaacctggaaagcgagtcatcggtccccgtaaaaagtttcattgggacgacaccattaggacgttgttgtgcaacctggtggaaataaagctcggatgctatgaactggagccgaacaaaagccagtcagctgaggattatcttaagtcatttatggaaacggaggtgaagcctttgtggcccaagggttggatgcaggctagaatgttgttcaaggaatcgagatcggtgcacaaccatctgactagtgctccggctaaaaagaaagtcatccccgctcctaaaccaaaggttaaggaggtaatggtaaaaaccctgcctctgcatagcttcccaacgatgctgaaggaatgttctccaaaaaaggatcagaagactcccactagcttagtggcctccgtgagcggacctcccaccagttcctctacagctgccatcgcagcggcttcctcatcatcggccccagcccaggagacgatctgtctagatgactcactcgacgaagacttatcttttcactccccctctcttgacctggtgtccgaagccttagctgtgattaataatgggaacaagggtcccccagtgggttcacgtatcagcatgcccactacgaaacctagacccggactgcgggaggagaaactcgcgtcaatcatgtctaaacttccactggccaccccaaagaaactggatagcacacaaacgacgcacagctccagtctcatcgcaggtcacacaggccctgtaccgaagaagccccaagacctagcccatacgggaattagcagcggtctgattgccggatctagcatccagaatccgaaggtgagtctggagccactcccagctcggctgcttcagcagggcttgcagcgttcatcccagattcacacatctagttcgagccagactcacgttagttcctcttcacaagctcagatcgctgccagctcccatgccctaggcacctccgaagcccaggatgcctcatctctgacacaggtcacaaaggtgcaccaacatagcgccgttcagcagaactatgtttccccgcttcaggccaccatatcaaaatcccagactaacccggtggtgaagcttagtaataaccctcagctgagttgcagcagttctttaatcaagaccagcgataaacccctgatgtaccggctccctctttccacccctagccccggtaacggctctcagggctcacaccccctggtgtctcgaactgtgccctccaccactacttctagcaactacctggccaaagccatggtttcccagatttctacacagggttttaagtcgcctttttccatggccgcttcacccaaattggctgcctcccctaagccagccacgagccctaagcccttgccctcccctaaaccttcagctagtcccaaaccatctttgtcagccaagccaagtgttagcaccaaactaatctcaaaatcaaatccgacaccgaagcccacggtgtctccaagctctagctccccgaatgccttggtggctcaaggatcccactcttcgaccaacagccccgtgcataaacagccctccgggatgaacatcagtcgccagagccctacactaaacctcctcccaagttcccggacctcaggcctcccccctacgaagaacctgcaggccccttccaaactcacaaactcttctagcactggaactgtgggaaaaaactcactgtccggcatcgccatgaatgtgcctgctagtcgtgggtctaacctgaatagttctggagcaaacaggacctctctgtccggcggaaccgggagcggaacccagggggcaacaaagccactgagcactccccatcgcccttcaaccgccagcggctctagtgtcgtgacagcttctgtccaatcaaccgctggtgcttccctcctggcaaatgccagcccactgacactaatgacatctcccctgtcagtgacaaaccagaacgtgacccctttcggtatgcttggcggacttgtccctgtaacaatgccttttcaatttccactggagatcttcgggttcggcacagacacagcaggcgttacaaccaccagcggatcaacttcagcagcatttcatcacagtctgacacaaaaccttttgaaagggcttcagcctgggggagcccagcacgccgcaaccctctcacatagtcctctgccagcccatcttcagcaggcttttcacgacgggggacagtccaagggagacacgaaattgcctagaaagtcccaatag

SEQ ID NO: 245841 - DNA, 1686 bp, Artificial Sequence
  Description of Artificial Sequence: Synthetic coding sequence
atggcggagagtggtgaatcggggggtcctcctggatcccaagattccgctgcaggagctgaaggcgctggcgctcccgcagctgctgcatctgcagaacccaaaattatgaaggtcacagtcaaaactccaaaggagaaggaggagttcgccgttcctgaaaattctagcgttcagcagttcaaagaagaaattagcaaacgctttaagtcccacaccgatcagctcgttcttatttttgccggaaagatccttaaagatcaggataccttgtcacagcatggaatccacgatggcctgaccgtccacctcgtcatcaagacacagaacaggccccaggatcattctgcccagcagaccaacacagccggaagcaatgtcaccacttcaagcacacctaactccaactcaactagtgggtccgcaacctcaaatccatttggtctgggtggcctcgggggtctggcgggtctgtcctccttaggactcaatacaaccaactttagcgaactgcaatcacagatgcagcgtcagctgctgagcaacccggagatgatggtgcagatcatggagaatccatttgtgcagtccatgctctctaatccggatctgatgcgtcagcttatcatggccaacccacagatgcagcagcttatacagcgcaatcccgagattagtcacatgctgaataatccagacataatgaggcagacactggaactcgccagaaatccagcaatgatgcaggaaatgatgcgcaaccaggatagagccctcagcaatctggagtccattccaggtggatataacgcacttcggaggatgtacaccgacattcaggaaccgatgctatcggcagctcaggaacagtttggaggaaatccctttgcaagtctcgtctctaacacgtcgtccggcgaggggagccagccctctcgaaccgagaatagggaccctctgccgaacccgtgggcaccccagactagtcagtctagctcagcatctagcgggacagcatccaccgttggaggcacaactggctctaccgcctccggcacttccggtcagtcaacgacagctcctaatttggtgccaggcgtcggtgcatcaatgtttaataccccgggaatgcagtccctcctccagcagatcacagaaaacccacagctcatgcagaatatgctctccgccccatatatgcgatcaatgatgcagtctctttcacagaaccccgacctcgccgctcaaatgcagaaccctgacaccttgtccgctatgagcaatccgcgtgccatgcaggcactgctacaaattcagcagggcttacagacgctggctacagaagccccagggctcatacccggattcacacccggtttaggcgcattgggcagcactgggggaagttcaggcacgaatggatctaacgctaccccatccgagaataccagccctactgccggaacaacagaaccgggtcaccagcagttcatacagcaaatgcttcaggctctggccggagtgaacccacagctgcagaaccctgaagtgcggtttcagcagcagttggagcaactgtcagccatgggctttcttaacagagaggctaatctccaagcattgatagcaactggaggagatattaatgcagccatcgaacgcctccttggcagccaaccttcatag

SEQ ID NO: 245842 - DNA, 1770 bp, Artificial Sequence
  Description of Artificial Sequence: Synthetic coding sequence
atggctgagagtggagagtctggcggtccccctgggtcccaggacagcgccgcaggggcagaaggggctggtgcacctgcagctgctgcttccgccgagcccaagatcatgaaggtcaccgttaagacaccaaaggagaaggaggaattcgccgtgccagagaacagctccgttcagcaattcaaggaagagatctcaaagcggttcaagtcacataccgatcaactggtgcttatattcgccggtaaaatccttaaggaccaggatactctgtctcagcacgggatccatgacgggttgacagtacatctggtgataaagacccagaaccgaccacaggatcatagcgcccagcaaacgaatacggctggctctaacgtgaccacatcttctaccccaaactccaactcaactagcggcagcgctacctctaacccttttggcttgggaggacttggtggtctcgctgggctgagttctctaggactgaacaccaccaacttcagcgaactccagagccaaatgcagcgtcagctgttgtcaaatcctgagatgatggtccagattatggaaaatcccttcgtgcagtctatgctgtcaaaccccgacctcatgagacagctgatcatggcgaacccacaaatgcagcagctaattcagcgtaatccagaaatctcacacatgttaaacaatcccgacatcatgcgacaaacgctggagctggccagaaatccagcaatgatgcaagagatgatgcgcaaccaggacagagcgctttctaaccttgagtcaattcctgggggttacaacgcactccgacggatgtacaccgatattcaggagcccatgttatccgccgctcaagaacagttcggaggtaatccctttgcttcactcgtgagcaacactagctccggagagggttcccagccatcccgaaccgagaatagagatcccctccctaacccttgggccccacagacaagccagtcatccagcgcaagttctggtactgcctcaactgtcggagggacaaccggcagcacggcttccggtacatccgggcagagcacgacagcacctaatcttgtcccaggagtgggcgcaagcatgttcaatactccaggcatgcagtctctcttacaacagatcactgaaaatcctcaactgatgcaaaatatgttatcagccccatacatgcggtccatgatgcagagcctttcgcaaaacccagatctggccgctcagatgatgctcaataaccctttgtttgccggaaatccccagttgcaggagcagatgagacagcaactgcctaccttcctccagcaaatgcagaatcccgacaccctttccgcgatgtctaatcctagggccatgcaggcattgctgcagatccagcagggtctgcagacacttgccacagaggcgccaggcttgattcccggattcacccccggactcggagccctgggctcaacagggggttcgtccggaactaacggttcaaatgccactcccagcgaaaatacaagcccaaccgccggaaccacagaacctgggcatcaacaatttatacaacagatgctccaggcactggccggagtcaacccacagctgcagaacccagaggttcggtttcagcagcagttggagcagctttcagccatgggtttcttaaaccgagaagcaaatttgcaggctctgatcgcaactggcggtgacatcaacgcagcaattgaacgacttctcgggagccagccctcttag

SEQ ID NO: 245843 - DNA, 1875 bp, Artificial Sequence
  Description of Artificial Sequence: Synthetic coding sequence
atggcggagaacggggagagtagcggccctccacggcctagtcggggtcccgcagcagcccaaggcagtgccgctgcaccggcagaacccaaaattattaaagtgaccgtcaaaactcctaaagaaaaggaagagttcgcagtgccagagaattctagcgtccagcagtttaaagaggcaatcagtaaacggttcaagtcccagactgaccaacttgtattaatttttgctgggaaaatactgaaagaccaagatacgctgatccaacatgggatacatgacggactgaccgtgcacctggtgatcaaatcacaaaaccgaccccagggtcaatccacccagccctcgaacgccgctggaaccaacacaacctctgcatctacaccaagatccaactcgaccccaatctctaccaattccaatcccttcggactcggcagtctcggaggcctggctgggctgtcttccctgggcctttcctccacgaatttctcagaactacagtcccaaatgcagcagcagctgatggcctcccctgaaatgatgattcaaatcatggaaaaccccttcgtgcagtccatgttgagtaatcctgacctgatgcgccagctgattatggctaatccgcagatgcagcagcttattcagcgcaatccagagattagccatctgctgaacaaccccgacattatgcgccaaaccctagagatcgctcggaatccagccatgatgcaggagatgatgcgaaaccaagacctggctttatcaaacctcgaaagcattcccggaggctataacgccctgcgcagaatgtacaccgatatccaagagcccatgctcaatgctgcccaggagcagtttggcggaaatcccttcgcctcagtcggaagtagctcatccagtggtgagggcacacagcctagccgtactgagaatcgcgatcctcttcccaatccctgggctcctccccctgcgactcaaagcagcgccacaacgtctaccaccaccagtactggctccggctcagggaattcgtcctccaatgcaactggcaacactgtagccgcagcaaattatgtggcgagcatctttagtactcctggtatgcaatctctcctacagcaaatcacagaaaatccccagctcatccaaaacatgctgagcgccccatatatgcgctccatgatgcagagtctgagccagaacccagatctggccgctcagatgatgttgaactctcctttgtttaccgccaacccacagcttcaggagcagatgcggccacagctacctgcatttttgcaacaaatgcagaacccagatacccttagtgcaatgtccaaccccagggcgatgcaggctctgatgcaaatccagcaaggattgcaaacattggccaccgaagcaccaggcctgataccgtcctttactcccggtgtgggagtgggagtgctgggcacagcaatcgggcctgtaggtccagttactcctataggacccattgggccaatcgttcctttcacccccattgggcctatcgggcctatcggcccaactggtcctgcagcccctcctggctctactgggtccggaggccctaccggccctacggtgagcagtgccgcaccttctgagacaaccagccccacatctgaatccggccctaatcagcagttcatccagcagatggtccaggcattggccggtgcaaatgcaccgcagttacccaatcccgaggtgcgcttccagcaacagctggagcagctgaatgccatgggcttcttgaaccgcgaggctaacctccaggcactgatcgccacaggcggagacatcaatgctgcaattgaaaggctgctcgggagtcaaccttcgtag

SEQ ID NO: 245844 - DNA, 1467 bp, Artificial Sequence
  Description of Artificial Sequence: Synthetic coding sequence
atggccgagaacggtgagtcttccggcccacctcgcccttcacggggtcccgcagctgcccagggatcagctgcggctccagctgagccaaaaattattaaggttactgtgaaaacccccaaggagaaagaagaattcgcagtgcccgaaaatagttcggtgcagcagtttaaggaggccatcagcaaacgcttcaagtcacagactgaccagctggtgctgatttttgctggaaaaattctcaaagatcaggacacactgatccagcacggtattcacgacggcctcacagtccacctcgtgattaagagccaaaataggccccagggccagtctacgcaaccaagtaatgcagccggaaccaacaccacctccgcatctacccctaggtccaacagtacccctatctcaactaatagtaacccgttcggactgggaagtctgggtggtctggcgggtctgagctccctcggactctcttcaacgaacttcagcgaactccagtcccaaatgcagcagcagctcatggcgtcgccagagatgatgattcaaatcatggagaacccatttgttcagtcaatgctttctaacccagacctgatgaggcaactcataatggctaacccacaaatgcagcagctgattcagcggaacccagagatttctcatttattgaacaaccctgatattatgaggcagacccttgaaattgccagaaacccagcgatgatgcaagaaatgatgcgcaatcaggaccttgcactttctaatctggagtccattcccggagggtataatgctctgagacggatgtataccgacatccaagaaccaatgttgaacgcagcacaggagcagtttggcggaaatccgttcgcctccgtggggtcgtcatccagcagtggtgaaggaacacaacccagtaggaccgagaaccgtgacccattgcccaatccttgggctccaccccctgctacacagagttctgctaccacctccacaactacctcaacagggtctggaagcggtaatagttcttctaacgccactggcaataccgtggcggcagccaattatgtggcttctatcttcagtactcctggcatgcagagtcttttacagcagatcacagagaacccacaacttatacaaaacatgttatccgctccgtatatgcggagcatgatgcagagcctctcacaaaatcccgaccttgcagcacagatgatgttgaacagtcctttgtttacagccaatccacagctccaggagcagatgagaccacaactcccagcattcttgcaacagatgcagaatcctgataccctttccgccatgtccaaccctaccagttcatctttctctaaatggtgtaggccttggctggaacaaatgctccactcttgtcggatccagaaaagtgacttttcaaacaattggaacagtagcactcagtggggcagttag

SEQ ID NO: 245845 - DNA, 1968 bp, Artificial Sequence
  Description of Artificial Sequence: Synthetic coding sequence
atggccaagggcggagaggcacttccgcaaggttcccccgcacctgtgcaggaccctcacttaattaaagtgacagtcaaaactccaaaggacaaggaagattttagcgtgaccgacacctgtacaattcagcaactgaaggaagagatcagccagagattcaaagcacaccccgatcagttagtcctaatctttgccggtaaaatcctgaaggaccccgactcattagcacagtgtggcgtgcgggacggcttgacggtgcacctggtcatcaaacgtcagcatcgagccatgggcaatgagtgccccgctgcctccgtgccaacccaaggaccctcgcctggctctttgccccagccctctagcatatatcccgctgatggacctcctgctttttcattgggcctcctcacggggttaagcaggctgggcctagcgtatcgaggctttcctgaccagccatccagcttgatgcggcagcacgtgagtgtccccgagttcgtgacccagttaattgacgatccgttcattcctgggctgctatctaacactggattagtccgtcagttggtgctagataatccccacatgcagcagcttattcagcacaatccagagattggtcacatccttaataatcctgagatcatgcgccagacactcgagtttctaaggaatccggctatgatgcaggagatgatcagaagccaggatcgggtgctgtctaaccttgaaagcatacccggaggatataatgtgctttgcaccatgtacacagacataatggaccctatgctgaacgctgttcaggagcaatttggtggaaatcccttcgccaccgcgacaaccgacaacgcgaccaccacaacgtctcaaccctctaggatggagaattgcgaccccctgcccaacccgtggacttccacccacggtggcagcggatcccgccaagggagacaagacggcgaccaagatgctccggatatacgaaatcgtttcccaaattttctgggaattattcgtttgtatgactatttacagcagctccacgagaacccgcaaagcctggggacatatcttcagggaaccgcttccgctctttcacaatctcaggagcctcccccaagtgtgaacagggtccctccatcctcacccagctctcaggaaccaggatccggccaaccccttcctgaggaaagtgtcgcaatcaagggcaggagttcttgccccgcattcctcagataccccacggaaaatagcaccggtcagggcggtgaccaggacggcgcaggcaagtcttctactgggcacagcactaatctgcctgatctcgtctccggactgggtgactctgcgaatcgtgtgccctttgcaccactgtcattttcaccaactgccgcaattccaggcatccctgagcccccttggctgccgagccccgcttatccccgtagccttagacctgacggcatgaatcctgctccgcagttgcaggacgagattcaaccacagctgccactgctgatgcacttgcaggccgctatggccaacccaagagcactacaggccctgaggcagatcgagcaggggctccaggtgctcgccacggaggcccctcgcctgcttttatggtttatgccttgtttggctgggaccgggtccgtagcgggtgggattgagtccagggaagatcctctgatgtccgaggacccactgccaaacccgcctcctgaggttttccccgctcttgactcagccgagcttggttttctgagccctccattccttcacatgctgcaggacctggtgtctactaatcctcagcaactgcaaccggaagcgcattttcaggtacaactggagcaattacggtccatgggcttccttaatagggaggccaatctgcaggccttgatcgccactgggggagacgtggatgcagcggtagagaagctccgacagtcatag

SEQ ID NO: 245846 - DNA, 666 bp, Artificial Sequence
  Description of Artificial Sequence: Synthetic coding sequence
atggcaaagggaggagaagccttgcctcaagggagccccgctccggtccaagaccctcacctgatcaaagtgactgtgaaaaccccaaaggacaaagaggacttttcagtcaccgatacatgcaccatccaacagctcaaggaggaaattagtcagcgatttaaggctcatccagaccaacttgtgctgatcttcgccggtaagatcctcaaggaccccgacagcctggcacagtgtggggtccgagatgggctcaccgtccatctggtcattaagaggcagcatagggcaatgggtaatgaatgtcctgccgcaagcgtcccgacacaggggccaagccccggtagtctgccacagccatccagtatctacccagccgacggcccaccagctttttcactgggactgttgacagggctgtcacgtctggggctggcttatagaggctttcccgatcagccatcttcactcatgagacagcacgttagtgtccctgaattcgtcacccagcttatcgacgatccttttattccaggactcttgtccaacactggcctcgtgagacaacttgtgctggacaatccccatatgcaacagttaatacaacacaaccccgagattggccacatcttgaataacccagagatcatgcgtcaaaccttgtag

SEQ ID NO: 245847 - DNA, 681 bp, Artificial Sequence
  Description of Artificial Sequence: Synthetic coding sequence
atggccgaacctagtggagctgagacaaggcccccaattagagttacagtgaagacgcccaaagacaaagaagaaatcgtgatctgtgatcgtgcctccgttaaagagttcaaggaggagataagccgcaggttcaaagctcagcaggatcagctcgtgctaatcttcgccggtaagattctgaaggacggcgataccttgaaccagcacggaataaaggacggactgactgtccacctggtcatcaagactccacaaaaggcccaagatccagcccctccagcagctcctagcctgccggcagccgatgccgagcctagggttacccttcacccttaccagagtccttcccatgctggaattgccgcagaccccgctgggactactgacctggcagatagaggaccctgggctggcacacaaccgtggctcctttgggacataccagacccttccactctttcgagacagcagaggagggtttatgcgagaggcccacatttcctcacttcccatgcttcccacatcttttccaacagaggtttccagaggcccgcagcaacacatgccgctgacgaccccgcattcggatggaagtggaagctcacaggggctgatgctcgctcagagatcagcgccgctgccggagctgcgcagctgcacggcctccatcagtcctag

SEQ ID NO: 245848 - DNA, 1806 bp, Artificial Sequence
  Description of Artificial Sequence: Synthetic coding sequence
atggccgaaccatcaggagccgaaacccggccaccgattagggtgactgtgaagactcctaaagacaaagaagagatagtcatctgcgatcgagcatccgtcaaggagttcaaagaggaaatatctagacggttcaaggcccagcaggaccagctcgtattgattttcgcaggcaaaatactcaaggatggggatacattaaatcaacacggcattaaggacggattgactgtgcacctggtcatcaagacgcctcaaaaagctcaagatcctgcggcagccacggcctcatccccgtccacacctgacccagcttcagcccctagtaccacgcctgcaagtcccgcaacacctgcccagccctcaaccagcgggtccgcatcctcagacgccggatcaggcagtcggagaagttctggtggcggacctagtcccggagccggtgaggggtcgccttccgctacagccagtatcttgtccggtttcggtggaattctcggcctcggatctctgggtctcggcagtgctaatttcatggagctgcagcaacagatgcagagacagctgatgagcaatcccgaaatgctctcacagattatggagaacccactagtgcaggacatgatgagcaatccagatctcatgcgacatatgattatggcgaaccctcagatgcagcagctcatggagcgtaatcccgagatttcccacatgctcaacaaccctgaactcatgagacagacgatggagctggcgaggaacccagccatgatgcaggagatgatgaggaaccaggaccgggcacttagcaaccttgagtccattcctggcggatacaacgctctaaggagaatgtatacagacatccaagaaccgatgttctctgccgctagagaacagtttgggaacaaccccttcagctctcttgccggaaactccgatagcagctcaagtcagccactaaggactgagaaccgggaaccactgcccaacccctggagcccaagccctccaacctcccaggcccctggttctgggggagagggcacgggcggtagcggcacgtctcaagttcaccccactgttagtaaccccttcggcattaacgccgcttctctcgggtctgggatgttcaattcccccgaaatgcaggcactactgcagcaaattagcgagaatccccagctgatgcaaaacgtcatctccgccccttacatgagatctatgatgcagacccttgcccagaacccagatttcgccgctcaaatgatggtgaacgttcctttgttcgcagggaatccgcaactgcaggagcagctccggctgcagcttcctgtcttccttcagcagatgcagaatccagaaagtctctccatccttaccaaccctagagccatgcaagcccttctgcagattcaacagggcctccaaaccctgcagacagaggcaccagggctcgtgcccagcctcgggagctttggcataagccggacgcccgcacctagcgccggaagcaacgcaggctctacccccgaggccccaaccagtagtcccgcaactccagccacttcctccccgacaggggcttcatccgcgcagcagcagctcatgcaacagatgatccaactcttagccggttcagggaactcccaagttcagacacccgaggtgcgatttcaacagcagcttgagcagctgaacagcatggggtttattaaccgcgaggcaaacctgcaggccctgatcgctactgggggagatatcaacgccgctatcgaacgactcctcggaagccaattgtcctag

SEQ ID NO: 245849 - DNA, 336 bp, Artificial Sequence
  Description of Artificial Sequence: Synthetic coding sequence
atggctggaaaacaggccgtatctgctagcggtaagtggctggatggcatccggaagtggtattacaatgcagctggtttcaacaaactggggctcatgagagacgacaccatatacgaggatgaagatgtgaaagaggctatccggcgattgccggagaacctctacaatgataggatgttcaggattaaaagagcactggatctgaatctgaagcaccagatcctgccgaaggagcaatggaccaagtacgaggaagagaacttttatttagagccttatctcaaggaggtcatcagagagagaaaagaaagagaggaatgggccaagaaatag

SEQ ID NO: 245850 - DNA, 1443 bp, Artificial Sequence
  Description of Artificial Sequence: Synthetic coding sequence
atggctgccagcgtggtgtgccgggcagctacagcaggagcacaagtgctgctgagggccaggcgtagtcccgctctgcttagaactcctgctttgagatcaacagccacttttgcgcaggcactgcaattcgtgccagaaacccaggtatcactgttggacaacggattgagggtggcttccgaacagtcctcccaacctacctgcaccgttggtgtgtggattgatgtcggaagcagatttgaaacagagaagaataatggggcagggtactttctcgaacacctggccttcaaaggtactaagaaccgtcctggaagcgcccttgagaaggaagtggaatccatgggggcacacctgaacgcatattccacccgggagcacacagcttactatataaaagcgctgagcaaggaccttcccaaagccgtggagttacttggcgacatcgtgcagaactgctcgctcgaggattctcagatcgagaaagagagggacgtgattttacgtgagatgcaggagaatgatgcaagtatgcgggatgtggtctttaactacctgcatgccacagcctttcagggcacacctttggctcaggccgtggagggtccgagcgaaaacgtgcgcaagctctctcgcgcagacctgacggagtacctgagtacgcactacaaagctcctcggatggtgctggctgccgctggaggtgttgaacatcagcagctcctcgacctcgcccagaaacacctgggagggatcccttggacttatgccgaggatgccgttccgacgctgactccatgcaggtttacgggtagcgaaattcgccatcgggacgatgcccttccattcgcccacgtcgccatagctgtggagggtcctgggtgggcttcacccgataacgtagcccttcaggtcgctaatgccataatcgggcactatgattgtacatatggcggaggagtacatctctcctcccctctggcctctggggcagttgccaacaaactgtgtcagagctttcagaccttcagcatttgttatgcagaaacggggctcttaggggctcactttgtgtgtgatcggatgaaaatcgacgatatgatgtttgtgttgcagggccagtggatgaggttatgcacatccgcaacagagtcagaggtggcccgaggaaaaaatatattacgcaatgcgctggtcagccacctggatgggacaacgccagtctgcgaggacattggacgttcactgctaacatatggacgacgcattcctttagccgagtgggagtcacgaatcgccgaagtggacgctagcgtcgtcagggagatctgctccaaatatatttatgaccagtgtccagctgttgccggatatggtcccatagaacagctcccagactacaaccgaatccggtcaggcatgttctggctgcggttttag

SEQ ID NO: 245851 - DNA, 1362 bp, Artificial Sequence
  Description of Artificial Sequence: Synthetic coding sequence
atgaaattattaactcgcgcaggttcatttagcagattctactcgctgaaagtggctcccaaggtgaaggctactgctgcccctgctggggcaccaccacagcctcaggatttggaattcacgaaactgccaaatgggttagtgatcgcctccctggaaaattatagccctgtaagccgcattggattattcatcaaggcaggcagcagatacgaagacttttcgaacttaggcactactcatttattaaggctcacatcatctttaaccactaagggagctagctcatttaagattacaagaggaattgaagccgtcgggggtaagctgagcgttaccgctactcgggaaaatatggcctacacagttgaatgtctgagaggagatgtggatatactcatggaatttctgctgaatgtgaccactgcaccagaatttcgccgttgggaggtagccgatctgcaaccccaattgaaaatcgataaagcagtggcgttccagaacccccagactcatgtgatcgaaaacctccacgcggcagcgtatcggaacgccctggccaatccactgtactgccctgactatagaattggtaaagttacctctgaggaacttcactactttgttcagaatcacttcacttcagcaaggatggcgcttattgggttgggcgtatctcaccccgtgctcaagcaagtggcagaacagtttcttaatatgcggggtggacttgggctgtcaggtgccaaggccaactatagggggggagagatccgggagcaaaatggcgatagcctggtgcacgcggcattcgtcgctgagagtgctgttgcgggaagtgcagaggctaacgctttttcagtcctgcagcatgttctgggggcaggccctcacgttaagcggggttccaacaccactagccaccttcaccaggccgtggctaaagcgacgcaacagcccttcgacgtaagcgcttttaatgccagctattccgattctggcttgtttggaatttacacgataagtcaggcgacagccgctggagatgtgatcaaagctgcctataaccaggtgaagactattgcccaaggtaatctgagcaacactgacgtgcaggccgctaaaaataaactgaaggcaggttacctgatgtccgtggaatccagtgaatgcttcctggaagaggtgggcagtcaggccctagttgctggcagctatatgccaccttcaactgtgttgcagcaaatcgactccgttgcaaacgcggacatcattaacgcggcaaaaaaatttgtgtcaggccagaagtccatggctgcgtcaggaaaccttggacataccccttttgtggacgaattatag

SEQ ID NO: 245852 - DNA, 276 bp, Artificial Sequence
  Description of Artificial Sequence: Synthetic coding sequence
atggggctcgaagacgagcaaaaaatgctgaccgaatctggcgatccagaggaggaggaggaggaggaggaggagctagtggatcctcttacaaccgtgagagagcagtgcgagcagctagaaaaatgcgttaaggctcgggaacggttagaactctgcgacgagagagtgagctcccggtcacataccgaggaggattgtacagaagagctgtttgacttcttacacgcacgggatcactgtgtggctcataaactattcaataatctcaagtag

SEQ ID NO: 245853 - DNA, 249 bp, Artificial Sequence
  Description of Artificial Sequence: Synthetic coding sequence
atgggacgcgagttcggcaatttgacccggatgaggcacgtaatcagctacagtttaagccccttcgaacagcgggcatatccacacgtgttcaccaaggggattcccaatgtactgcggagaattcgggaatccttcttccgggtagttccccagtttgtggtgttttatctcatttatacttggggaacggaggagttcgagcgctctaagagaaaaaaccctgctgcttatgagaacgataagtag

SEQ ID NO: 245854 - DNA, 249 bp, Artificial Sequence
  Description of Artificial Sequence: Synthetic coding sequence
atggggagagaatttggaaaccttacaaggatgcggcatgtgatctcatactccctcagccccttcgagcagagggcgtatccacatgtgtttaccaagggcatacctaatgttttgcgcaggatcagggagtccttcttcagggtggttccacagttcgtcgtgttctacctgatttatacatgggggacagaggaatttgaacgttccaaaagaaaaaacccggcagcctacgaaaacgataagtag

SEQ ID NO: 245855 - DNA, 249 bp, Artificial Sequence
  Description of Artificial Sequence: Synthetic coding sequence
atgggtagggagttcggaaaccttaccaggatgagacacgtcattagctactccctatctccttttgaacaacgtgcttacccacacgtgtttaccaagggcattccaaacgttctcaggcgcatcagagagtcatttttcagagtcgtaccccagttcgtcgtgttctatttgatttacacgtggggcaccgaggagttcgaacgtagcaagcggaagaatcctgcagcctatgagaacgacaagtag

SEQ ID NO: 245856 - DNA, 387 bp, Artificial Sequence
  Description of Artificial Sequence: Synthetic coding sequence
atgcagatcttcgttaaaactttgacaggcaagacaatcactctcgaagtggagccatctgacaccatcgagaatgtaaaagccaaaatccaagacaaagagggaattccaccagatcagcagagattaatttttgccggtaaacaattagaagacggcagaacccttagcgactataacatacagaaggagagcaccttgcacctggtattgcgactgagagggggtatcattgagccatcactcaggcaattggctcagaaatataactgtgacaaaatgatatgtaggaaatgttacgctaggctacatccaagagcagtcaattgtagaaagaagaagtgtggccacacgaataacctccggcctaaaaagaaggtcaagtag

SEQ ID NO: 245857 - DNA, 387 bp, Artificial Sequence
  Description of Artificial Sequence: Synthetic coding sequence
atgcagattttcgtgaagactctaactggtaaaaccattacactggaggtggaaccctccgacaccattgagaatgtgaaggctaagatccaggataaggaaggtatccccccagaccagcagaggcttattttcgcaggaaaacaactcgaggacgggcgaacactctcggactataacattcaaaaggagagtacactgcatctggtgctcagattgagaggcggtataattgaaccatctttgaggcagttagcccagaaatacaactgtgataagatgatctgtaggaaatgctacgccaggctacaccctagggctgtcaactgcaggaaaaagaagtgcggccataccaataatctgagacccaagaagaaagtgaagtag

SEQ ID NO: 245858 - DNA, 1872 bp, Artificial Sequence
  Description of Artificial Sequence: Synthetic coding sequence
atggcagccggagagacacagctttacgccaaagtgagcaataaattaaagtctcgctcatcaccatccctgctggaaccccttctggctatgggcttccccgtgcacacggctctcaaggctctggcagctaccggacgtaaaactgctgaagaagccctggcatggctccatgaccactgcaatgatccaagtcttgatgacccgattccacaggaatacgccctctttctgtgtccaactggaccgctgctcgagaaactacaggaattttggagagagtcaaaacgccaatgcgcaaaaaatcgggctcacgaggtgttccctcatgttaccctttgcgattttttcacttgcgaagatcaaaaggtggagtgtttgtatgaagccctgaagagggccggtgacaggctgctggggtccttcccaaccgcagtcccactcgccctgcatagctctatttcctacctgggattttttgtgagcgggagtcctgctgacgtgattcgcgaattcgctatgacattcgccactgaggccagcctcctggccgactgctctgttaaaccttgtacaaaacaacttcatttgacactggctcacaaattttatccccatcaccagcggacgttggaacagctcgcccgtgctatcccgctcggacattcatgccagtggacagctgcattgtatagccgggacatgcggttcgtgcactaccaaacattgcgggcactgttccagtacaagccccaaaacgtcgacgagttaacgctctctccaggggattatatctttgtggacccgacccagcaggatgaagcttctgagggctgggtgatcggcattagccaacgaactgggtgtcggggatttctgcctgaaaactacactgatagggcttccgagagcgacacttgggtgaaacaccgaatgtacaccttctccctggccacagacctcaattccagaaaggacggggaagctagctctcgttgctctggcgagttcctcccgcagacagccaggagcctaagcagccttcaagctctacaggctacggtggcccgtaagtcagtgttggtagttaggcacggagagagggtggatcaaattttcggcaaagcatggctgcagcaatgtagcacgcccgatgggaagtactaccgaccggatctgaacttcccctgttcgctacctaggcggtccagaggtatcaaggacttcgaaaatgatccccctctcagttcttgtggaatctttcagagcagaattgctggcgacgccttactggattcagggattcgaattagcagcgtttttgcgagcccagctctgcgatgcgtccaaactgccaaacttatcctagaagaactcaagttagagaagaaaattaaaatcagggtggagccaggcatattcgagtggaccaagtgggaagcaggtaagacgaccccaaccctcatgtccttggaggaacttaaagaggcaaattttaatatcgacacagactaccgcccagcatttcccctgagcgccctgatgcccgctgagtcttaccaagaatacatggacagatgcaccgcttcaatggtgcagattgtaaacacttgccctcaggatacgggtgtaatactcattgtgtcacatgggtccactctggactcttgtacacgccctttgttaggcctcccaccccgagagtgcggcgattttgcccagttagttcgtaagatcccttccctcgggatgtgtttttgcgaagaaaataaagaagaagggaagtgggaactggtgaacccccctgtaaagactctcacccacggtgctaatgcagcttttaactggcgtaactggatctccggaaattag

SEQ ID NO: 245859 - DNA, 1986 bp, Artificial Sequence
  Description of Artificial Sequence: Synthetic coding sequence
atggcagcaggcgagactcagttatatgccaaggtgtctaacaagctgaaaagccggtctagtccgtcattactggagcccctgctagccatgggcttcccggtgcatactgctctcaaagcactcgccgctacaggccgaaagaccgctgaagaggcactggcctggctgcacgatcactgtaacgatccatccttggacgatccaataccccaggaatatgcactgttcctgtgccctaccggcccactcctggagaaacttcaggagttctggcgcgagtccaagcgccagtgcgcaaagaaccgggctcacgaggtttttccacacgttaccctttgtgacttcttcacatgtgaggaccaaaaagttgaatgcctctacgaggcactgaaacgggctggcgaccggctactagggtcctttcccacggccgtgcccttggcactgcattcatcaatttcctaccttggcttctttgtctctggttcccctgcggatgtcattagagaatttgccatgacctttgccaccgaggccagccttctggcaggcacaagcgtgagcaggttctggattttctcccaggtccccggacacggtcctaacttgagactaagtaacctgactcgagcgagcttcgtttcacattatatccttcagaaatactgttctgtgaagccatgtacaaaacaactgcacttgactttggcccacaaattctatcctcatcaccagcggactttagagcagttggctcgggcaatacccctcgggcactcctgccagtggaccgccgctctctactctcgtgatatgcgctttgtgcattaccagacactccgcgcactatttcagtacaagcctcaaaacgtcgatgaactgacgttatcccccggagactacatcttcgtggacccaacccagcaggacgaggccagtgaaggatgggtgataggtattagccagcgaacgggttgtagaggttttctgcccgagaattatacagatcgtgcctccgaatctgatacatgggtaaagcacagaatgtataccttcagtctagcaaccgatctcaatagccgtaaagatggagaagcctcatctagatgtagtggcgagttcctgccacagaccgctaggtcccttagctcattacaggctctgcaagcaacggtagcccgaaaatccgtgctggtcgtaaggcacggagaacgggtggatcagatcttcggcaaggcgtggctacagcagtgttccaccccagacggaaagtactatagacctgatctgaacttcccgtgtagtcttccaagacgtagccgtggcattaaagactttgagaatgatcctccactcagttcttgtggcatcttccaaagtcgtatagccggtgatgcccttctggactctgggattcgcatctccagtgttttcgcctctcctgcccttcggtgtgtacagacggcgaaattgatactggaggagctaaaattggaaaaaaaaatcaaaattagagttgagccagggatttttgagtggaccaagtgggaggccggaaaaactacgcctactctcatgtccctggaggagttgaaagaggctaacttcaacatcgacaccgactaccggcctgcctttcctttgtcagcactgatgccagccgagtcataccaggaatatatggaccgatgtacagcctcgatggttcaaattgtgaatacctgcccacaagatactggcgttatcctcattgtaagccatgggagcacgttggacagctgcacaaggcccctgctgggcctcccaccaagggagtgtggggatttcgcacaacttgtgcgcaaaattccaagccttggaatgtgtttctgcgaggagaacaaagaggagggcaaatgggaactggtgaacccaccagtgaaaactttaacacacggagcgaacgctgccttcaattggcggaattggatctctggtaattag

SEQ ID NO: 245860 - DNA, 369 bp, Artificial Sequence
  Description of Artificial Sequence: Synthetic coding sequence
atggcagccggagagacgcagctctatgcaaaggtctcaaacaagctgaagtctcggagctccccctctttgttagaacccctgttagccatggggttccccgtgcatactgcgctgaaagccctcgccgcaactggtcggaagacagccgaggaagctctggcctggcttcatgaccactgcaacgacccgagcctggatgaccctatcccacaggagtacgcactcttcctgtgccccactggcccattgctggagaagctgcaagaattttggcgggaatccaagcgccagtgcgccaagaatcgggcacatgaggtctttccccatgtaacattgtgcgactttttcaccggcccagcggtgtag

SEQ ID NO: 245861 - DNA, 1581 bp, Artificial Sequence
  Description of Artificial Sequence: Synthetic coding sequence
atggcagccggagaaacgcagctgtacgccaaggtgagcaacaagcttaaatctcgcagtagcccatctctcctggaaccgctgctggccatgggatttccggtgcacacggctctcaaggccctggccgctaccggaagaaaaactgccgaagaagccctggcctggcttcatgatcactgcaacgatccttctctggatgacccaattccccaggaatacgccctcttcttatgtcccactggcccattgctggagaaattacaggaattttggagagaaagcaagagacagtgcgcaaaaaatagagcccacgaggttttcccgcacgtgaccttgtgtgatttcttcacttgcgaggatcaaaaggtagaatgtctctatgaagctctgaaaagggcgggagatcgcttactggggtcattcccgaccgccgtgcccctggctttgcactcttccatctcctacctggggtttttcgtgagcggctcaccggctgatgtgatccgggagttcgcaatgacatttgccacagaagcttctctcctggcagactgttccgtgaaaccctgtacaaagcagttgcatctgactcttgctcacaaattttaccctcatcaccagcgaacgctggagcaattggcccgagcaataccccttggccactcttgtcagtggaccgccgctctgtactcacgggatatgcggttcgtgcactatcagaccctgcgcgctctgttccagtacaagccacagaacgtggatgaattgaccctcagtcccggagactacatcttcgttgatccaacacagcaggatgaggccagcgaaggctgggtgattggcatctctcagcgtaccggctgtagaggctttctgcccgaaaattatacagaccgggctagcgagagtgatacctgggttaagcatcgcatgtacaccttcagcctggccaccgatctgaacagtagaaaagatggggaggcttcctctaggtgtagtggtgagtttttgccccaaactgcacgctccttgagctcgctccaagccctgcaagcgacagtggctagaaaatcagtgctggttgttaggcacggcgaacgggttgatcagatttttggcaaggcctggcttcagcaatgtagtacgcctgatgggaaatactatcgcccagaccttaacttcccctgtagcctaccacgcaggtctagaggaataaaggatttcgaaaacgatcctcctctgagcagttgcggtatattccagtcccgcatcgcaggggacgccctcctggacagcgggattcggatcagttccgtattcgcctctcccgctcttcgctgcgtgcagacggccaagctcattttggaagagctgaaactagagaagaaaatcaaaatccgcgttgagccaggcatattcgaatggacgaagtgggaggcaggaaaaaccacgcccaccctcatgtccctggaggaacttaaagaggccaattttaatattgacacagactaccggtccctcccatgggcttgtgccagtgtcaaaaaaataaagagaaaggaaaacggctcatggtag

SEQ ID NO: 245862 - DNA, 1950 bp, Artificial Sequence
  Description of Artificial Sequence: Synthetic coding sequence
atggctcagtacggtcacccatcaccactcgggatggctgccagggaggaactgtattccaaagtgacccctaggagaaaccggcagcagagaccagggacaatcaaacacggttccgccttggacgtgctactgtcaatggggtttccgagagctcgtgctcagaaggccctcgccagtacaggcggtcgatccgtccaggccgcttgtgactggctgttttcacacgtgggagatccttttttggatgatcctctgccaagggaatacgtgctgtacctaagacctacgggcccactcgcccaaaaattatccgatttctggcagcagtctaagcagatatgtggaaagaataaggctcataatatttttccacacattacgttgtgccagttcttcatgtgcgaagactccaaggtcgacgctctgggcgaagcattgcagacgacggtttccagatggaaatgcaagttctcagctccccttcctctggaattgtacacttctagtaacttcattggccttttcgtcaaagaggattcagccgaggtcctgaaaaaattcgcagccgattttgctgctgaagccgctagcaagaccgaggtgcacgtggagcctcacaagaaacagctgcacgtgacccttgcgtatcattttcaggcttcccatctccctactcttgagaaactagcccagaacatagatgtgaaattgggttgcgattgggtggccaccatatttagccgcgatatccggtttgccaaccatgaaacccttcaagtgatctacccttatacaccccaaaacgatgacgaactcgagctcgttccgggtgacttcatctttatgtctcctatggaacagacatccacatcagagggctggatctatggcacctctttaactactggatgctcaggacttttaccagagaattatattaccaaggccgatgagtgcagcacctggatcttccatggaagctactctattttgaatacgtcttcctctaacagcttgacgtttggagacggggtgctcgagagacgcccatatgaagaccagggcttgggagaaacaacaccactgaccatcatctgtcagcctatgcagccactcagagttaattcacaacctgggccacagaagcgctgcctctttgtttgtagacacggggaaaggatggatgttgtgttcggcaagtactggttaagccaatgcttcgacgctaaaggcagatacatcaggaccaatctaaacatgcctcacagcctgccccagagatccggagggttcagggattatgagaaagacgcaccaataaccgtgttcggttgcatgcaggctcgcctggtgggagaggccctgctcgagagcaacacaatcatcgatcacgtgtactgtagtcccagcctgcgttgcgtacagacagcgcacaacatcctcaaaggcctgcagcaggagaaccacctcaaaataagggttgagccaggcttattcgagtggacgaaatgggtggccggttccacattgcccgcatggatccccccttctgaactggcagcggctaacttaagtgttgacacaacatacagaccgcacatccctatctctaaactggtagtgtccgagtcatacgatacttatatctctaggtcctttcaggtaacaaaagagatcatttccgaatgtaagtccaaaggcaacaatattctgatcgtcgcccatgcctcctcccttgaggcttgcacttgtcagctccaaggcctatcacctcagaattccaaggactttgtgcagatggtgaggaaaatcccgtacctgggcttctgctcttgcgaagagctgggcgagaccggtatttggcagctgaccgatccacctatcctccctctgacccatggccctaccggtggttttaattggagggagacccttctgcaagagtag

SEQ ID NO: 245863 - DNA, 1509 bp, Artificial Sequence
  Description of Artificial Sequence: Synthetic coding sequence
atggctagtaaaaagcttggagccgatttccatggaaccttctcctaccttgacgatgtgcctttcaaaacaggggacaagtttaagaccccggctaaggtcggactgccgatcggcttttcacttccggattgcctgcaggttgttcgcgaggtccaatatgacttttctttggagaaaaaaacaattgaatgggccgaagaaataaagaaaattgaggaagctgagcgagaggcggagtgtaagatcgctgaggccgaggccaaagtgaacagcaagtccggcccagagggagacagcaaaatgagcttttcgaaaacacactctaccgctaccatgcccccacctatcaaccctattctggcctccttgcagcataactcgatcctcactccgacaagagtgtcttcttctgcaacaaagcaaaaagtcctcagcccccctcatattaaagccgatttcaacctggccgattttgagtgcgaagaagaccccttcgacaacctggagcttaaaaccatagacgagaaagaggagctgcggaatatactggttggcacaacaggccctattatggcccaacttttggacaacaacctgcccagaggaggcagcggaagtgtgctgcaggatgaggaagtactcgcgtcgctggagcgggctaccctcgattttaagccgctccacaagcctaatggatttattacactacctcaactagggaattgcgaaaaaatgagcttatccagcaaagtgtctctgccaccaatccccgctgtctccaacatcaagtctctatccttccccaagctggattctgacgatagtaatcagaaaacagctaagctggcgagcacctttcactcaaccagttgccttcggaatgggacgttccaaaactccctgaagcctagtacccagtcttctgcctctgagctaaacggtcatcataccctaggtctatccgccctcaatctagattccgggactgaaatgccagctctcacgtcctcccagatgcctagcctgtcagtccttagcgtatgtactgaggagagctctccacccaacacaggcccaaccgttaccccgccaaacttcagcgtttctcaagtgccaaacatgcccagctgcccacaggcctactcagaactgcagatgctcagcccgtcggaaagacaatgcgtcgaaaccgtcgtgaatatgggctactcttatgagtgtgtgctgagggccatgaagaagaagggggagaatatcgagcagattctggactacctgttcgcacacggacagttatgtgaaaagggattcgatcccctgctggtcgaagaggctctggaaatgcaccagtgctctgaagaaaagatgatggaatttctccagctgatgtctaagttcaaggaaatgggattcgagctgaaggacattaaagaggtgctactgctgcacaacaacgatcaagacaacgcgttggaagatctcatggctagggctggcgcttcctag

SEQ ID NO: 245864 - DNA, 1509 bp, Artificial Sequence
  Description of Artificial Sequence: Synthetic coding sequence
atggccagtaagaaactgggcgcagatttccatgggacatttagctacttagacgatgtccccttcaaaaccggagacaaatttaagacaccagccaaagtgggtttacccattggcttctctttaccggattgcttgcaggttgtgagagaggtgcagtacgattttagcctggagaagaagacgatcgagtgggccgaagagataaaaaagatcgaagaggccgagcgggaagccgagtgtaagattgctgaagcggaggctaaagtcaactcaaagtctggtcccgagggagattccaagatgtctttcagcaagactcactctaccgctacaatgccccctccaatcaatccgattctggcaagccttcaacacaacagcatcctgacccctacccgagtgagtagttccgcaactaaacaaaaggtgctgagcccccctcacataaaagccgattttaatctggcagatttcgaatgcgaagaggatccgtttgacaacctcgagttaaagaccatcgatgagaaagaggaactgcggaacattctcgtaggcaccaccgggccaattatggcccaactactggacaacaatctcccccgtggcggaagtgggagcgtgctacaggatgaggaagtgttggcttccctagagcgtgcgaccttagacttcaagcccttgcacaagcccaatggtttcataaccctgcctcaactggggaactgtgagaagatgtctctgtcctccaaagtaagcctgccccctattcctgccgtatcgaacattaagagtctgtcctttccgaagctcgactcggacgattcaaatcagaagaccgccaaactggcctctacttttcatagtactagctgtctgaggaatggaacgtttcagaactcattaaagcctagtacacagagttcagcaagtgagctcaatgggcaccacacacttggattgagtgcacttaacttggattcgggcacggagatgcctgcgttgacttcatcccagatgccatcactttccgtgctttccgtgtgtaccgaagaatccagtccgcctaatacaggccctactgtcacaccaccaaacttctcagtcagccaggtgcccaatatgcccagttgtccacaggcctatagtgagctccaaatgttgtctccctccgagcggcagtgtgtggagacagtcgtgaacatggggtatagctatgaatgcgtgctgcgagccatgaagaagaagggggaaaacattgaacagatactggattatttgtttgcccatggtcagctctgcgagaagggattcgacccactcctggtggaagaagccctagagatgcaccagtgttctgaagaaaagatgatggagttccttcaactgatgtcaaagttcaaggaaatgggcttcgagcttaaggatatcaaagaggtcctgcttctccataacaacgatcaggataatgccttagaagatctgatggccagggccggtgcatcatag

SEQ ID NO: 245865 - DNA, 1326 bp, Artificial Sequence
  Description of Artificial Sequence: Synthetic coding sequence
atggctagtaaaaaactgggtgctgatttccatggcactttcagctatctcgatgacgttccctttaagaccggtgacaaatttaaaacccccgctaaggtgggacttcctatcggcttttctttgcctgactgtctgcaggtagttcgagaagtgcagtatgattttagcttggagaagaagaccatcgagtgggccgaggagatcaagaagattgaggaggcagaaagagaggcagagtgcaaaattgcggaagcagaagccaaagtgaactctaaaagcggacctgagggtgactccaaaatgagtttcagtaaaacccactccaccgccaccatgccaccccctatcaatcctatattagcaagcctccagcataattctatccttactccaactagagtatcatccagcgccactaaacaaaaagtcttgtctccaccccacattaaggccgacttcaacctagcagacttcgagtgcgaggaagacccattcgataacttagagctgaaaacaattgacgaaaaggaggaattgcgaaacatcctggtcggaaccacaggacctatcatggcacaactgctggacaataatttgcccagagggggatccggctccgttctgcaggacgaagaggtgctggcatcactcgaaagagctaccttggacttcaaaccacttcataagcccaacggatttatcaccctgccacagttaggaaattgtgagaaaatgtcactgagctcaaaagtcagtctgcctcccataccagctgtgtctaatattaaatccttatcctttcctaagttagatagtgatgattctaatcaaaaaaccgctaagctagcaagcacctttcactcaacttcatgccttagaaacgggacctttcagaactctctaaaacctagcacacagagttctgcgtccgaattaaacgggcatcatacactgggtctgtccgccctcaatctggattccggtaccgagatgccagccctcacaagctctcagatgccctcactgagcgtgctgtcagtctgcacggaagagagttccccccctaacacgggtcctactatcctcgattatctcttcgctcatggacagctctgcgagaaggggtttgaccccctcttggtggaggaggctttagagatgcaccagtgctctgaagagaagatgatggaattcctgcaattaatgtccaagttcaaggagatgggatttgagctgaaggatatcaaagaagtgttactcttacacaataatgatcaagacaacgcactggaagacctcatggcccgtgcaggagcctcgtag

SEQ ID NO: 245866 - DNA, 1509 bp, Artificial Sequence
  Description of Artificial Sequence: Synthetic coding sequence
atggctagcaagaaattgggggcagactttcatgggactttttcctaccttgacgatgtccctttcaagacaggggataaattcaaaaccccagcaaaagtggggttgcctatcggattcagtctgcccgactgcttacaggtggtgagggaagtgcagtatgatttttctctcgagaaaaagaccatagagtgggccgaggagattaaaaagatcgaagaggctgagcgagaggccgaatgtaagatagcagaagctgaggcaaaggtgaactcaaagtctggacctgagggggattccaaaatgagcttctcaaaaactcatagtactgcaactatgcctccgcctatcaaccccatactggcatctctgcagcacaattcaatcctgactcctactagggtttcctcttccgccacaaagcagaaggtgctctccccaccccacattaaggctgattttaacctcgcagattttgagtgtgaagaggaccccttcgacaatctggagctgaagaccatcgatgagaaggaagagctgagaaatattctagtgggcaccaccggcccaattatggctcagctgctagacaataacctgccacggggaggatccggaagcgtattgcaggacgaggaggtgttggcatccctcgaacgcgcaaccttagacttcaagcctctccacaagcccaatggattcattaccctgccacagttaggcaattgcgaaaaaatgtcattaagtagtaaggtcagcctgccaccaatccccgcagtctcgaacatcaaatcactgagctttcccaagcttgatagcgatgacagtaaccaaaaaacagcaaagctcgcctctacctttcactcaaccagctgcttgaggaatgggaccttccaaaacagtttgaaacctagtacacagagcagcgcctctgagttgaacggacaccatacgttggggctttcagctctgaatttggacagcgggaccgaaatgcccgctcttaccagctcccagatgccgtcccttagcgttctctcagtctgtaccgaggaatctagcccaccgaataccggacccaccgttactcccccaaacttcagcgtgtcacaggttccaaatatgccaagctgtccccaggcttacagcgagttgcagatgctttcgccatcagagaggcagtgcgtagaaacagtcgtgaacatgggttactcttatgagtgcgtgttacgggcaatgaagaaaaagggagagaacatcgagcagattctggactatctgtttgcacacgggcagctgtgcgaaaagggatttgatccacttctcgtggaggaggcactggagatgcaccaatgctccgaggagaaaatgatggaattcctgcagttgatgagtaagttcaaggagatgggattcgaactgaaagacatcaaggaggtgctgcttctgcataacaatgatcaggacaacgctctggaggaccttatggccagggctggtgcatcgtag

SEQ ID NO: 245867 - DNA, 1509 bp, Artificial Sequence
  Description of Artificial Sequence: Synthetic coding sequence
atggcgagtaaaaaactaggagccgactttcatgggacgttttcatatctcgacgatgtccccttcaagactggggataagtttaagacacctgctaaggtgggcttacccatcggctttagcctgcccgactgccttcaggtcgtgagagaggtgcagtatgacttttctctcgagaagaaaaccattgagtgggccgaagaaatcaaaaagattgaagaggctgagcgcgaagcagaatgcaagatcgccgaagccgaggcaaaggttaattccaaatccgggccagagggcgattccaaaatgtctttcagtaagacacatagtaccgccacaatgccgcctcccatcaacccgattctggctagtttgcagcataactcgatcttgacacccacacgagtgagcagttccgcgaccaaacagaaggtgctctcgccaccccacattaaggccgactttaaccttgccgacttcgaatgcgaggaggaccctttcgacaatctggagttgaaaactattgatgagaaagaggagctgagaaacatcctcgtgggcaccactgggccaatcatggctcaattgctcgacaacaacctgccaaggggcggtagcggaagcgttctacaagacgaggaagtcctggcatcattggagcgcgctaccctagattttaaaccacttcacaagcccaatggcttcattaccctgcctcaacttgggaattgtgaaaaaatgagcctgtcctcgaaagtctccctgcctcctattccagcagttagcaatatcaagtccctgtcctttccaaagctagatagcgatgactcgaatcaaaagaccgcgaagctcgcaagtacctttcactcaacaagctgcctccgaaacggcacatttcagaacagtcttaagccgtccactcaatcatcagccagcgaattgaatggccaccacacactaggactcagcgcgcttaatctggatagtggcaccgagatgcctgcactgaccagttcccagatgccttcactctcggtgttgtccgtgtgcactgaggaatctagccctccaaacacgggacccaccgtaacaccccctaacttctcagtgtctcaggtcccaaatatgccttcctgtccccaggcatatagcgagttgcaaatgctcagtccttcggaaagacagtgcgtggagacagttgtgaatatgggatatagttatgaatgtgtgctgcgcgcaatgaaaaagaaaggggagaacatcgagcagatcctggactacttgtttgctcatggccaactgtgcgagaagggctttgaccctctgctcgtcgaggaggccttggagatgcaccagtgcagcgaggagaaaatgatggaatttctccagctcatgtctaaatttaaagaaatgggctttgagctgaaggacataaaagaagtactcctactgcataacaatgaccaggataacgccctggaagacctgatggccagagccggtgcttcctag

SEQ ID NO: 245868 - DNA, 1617 bp, Artificial Sequence
  Description of Artificial Sequence: Synthetic coding sequence
atgagtggagccgtgagaggacgaagaagggaggttggtttgcagcacggaggctgtggaactggaggagggtatggagacggactggcaaggagcggccagtcctggcggtggtggaggtctctgtctcttggagccgtggggtcatctgccggtacggaaccgggacggcctgccggagcgtcaacttttcgactcctgcgcaggaggcagcagcgacatagcggctccaagtggctgctgcggtcatgggtgcagatcttcatgtatgacttcagtttggagaagaagaccatcgagtgggccgaggaaatcaagaagatcgaagaggccgagagagaggccgaatgcaaaattgcggaggccgaggcaaaggtgaactctaagtccggcccagagggcgacagtaaaatgagtttctctaaaactcattccacagctacaatgccacctcctatcaatccaatactggccagtctgcagcacaatagcatcctgacacctactagggtctccagctccgccactaaacagaaagttctttctcctcctcacataaaggcagattttaatttagctgattttgaatgtgaggaggacccttttgacaatttagaactaaaaaccatcgatgagaaggaggagttgaggaatatcctcgtcggcacgaccggacccatcatggctcagttgcttgacaacaacctgccacggggagggtcagggagcgtactgcaggatgaagaggtgttggcttcgctcgagcgcgctaccctagactttaagcccctgcacaagccaaacggctttattacgcttccacaattgggtaactgtgagaagatgtctctgtcctctaaggtgtcactgccgcctatccccgcagtgagcaacatcaagtctcttagctttcctaaactggacagcgacgattccaatcagaaaacggccaagctggcttcaacttttcactcaacctcctgcctccgcaatggcacgttccagaacagcctgaaaccatcaacccaaagttctgccagtgaattaaatggacaccataccctgggactgtcagctctcaacctggactcggggaccgaaatgcctgcgttaaccagtagccaaatgccctccctgagtgttctcagcgtgtgtactgaggagtcttctccacctaacactgggccaacagtgaccccacccaacttctcagtcagccaggtacccaacatgccaagctgccctcaagcctatagtgagctgcagatgctatccccgtcggagcggcagtgtgtggaaacagtcgttaatatgggttattcgtatgaatgtgtcctgagggccatgaagaaaaaaggcgaaaatatcgaacagattctagattatcttttcgcccacggacaactgtgcgaaaagggattcgaccccctgctcgttgaagaagcactggagatgcatcagtgctccgaagagaagatgatggaattcctccagttaatgtccaaatttaaagagatgggattcgagctcaaggacattaaggaggtgttgttgctccataacaacgatcaggataacgccctggaggacctgatggcacgtgcaggagccagctag

SEQ ID NO: 245869 - DNA, 1701 bp, Artificial Sequence
  Description of Artificial Sequence: Synthetic coding sequence
atgtccggggcagtccggggacgcagacgcgaagttgggctgcagcacggcggttgtggaaccgggggaggatacggtgatggtttggcaagatctggacagagctggcgttggtggagaagcctgtctctgggggcagtgggctccagcgctggtacagagccaggacgcccagcgggtgccagtactttcaggcttctgcgcaggcggcagcagaggcacagtggcacctttagttaccttgacgacgtccccttcaaaactggcgataaatttaaaaccccagccaaggtcggcctacccattggtttctccctgcctgattgtttgcaggtagtgcgcgaagtccaatacgacttctccctggaaaaaaagacaatcgaatgggcggaagagatcaagaagatcgaggaggcagagcgcgaagccgaatgcaaaattgccgaggccgaagccaaggtgaacagtaagtccggccctgagggtgacagcaaaatgagtttctcgaagacacattcgactgctactatgccccctcccatcaaccccattttggcgtctttacaacacaactcaatcctgaccccaacaagagtttcttcttctgccaccaagcagaaggtccttagcccaccgcacattaaagctgactttaacctcgccgatttcgagtgtgaggaggatccttttgacaatctggaactgaagaccatcgacgagaaagaggaactgaggaacattctcgtgggtaccaccggtcctatcatggcccagctcctggacaacaacctcccaaggggaggtagtggtagtgtattgcaggacgaagaggtccttgcttcgctcgaacgcgctacacttgactttaaaccattacacaaaccgaacggatttataacactaccccagctagggaactgtgaaaaaatgagtctgtcctccaaggtgtcccttcctcccatcccagccgtgagtaacatcaagagcctctcttttccaaaactggatagtgacgactcgaaccaaaagacagccaagctggctagcactttccattcaacatcttgcctgcggaacgggactttccagaactccctgaaaccaagtacacagagtagtgccagcgagctaaacggtcaccatactctcggattgtcagcccttaacctggactccggcactgagatgcctgctctgacgagcagtcagatgccctcactgagcgtcctgtctgtctgcacagaagagagcagcccccctaacactggtcccacagtgacacctccgaatttctctgtgagtcaagtccctaacatgccttcttgcccccaagcctattcagaactgcagatgttgagtcccagtgagcgccagtgtgtggagacagtcgtcaacatgggctactcatatgaatgcgtacttagggccatgaaaaagaagggtgagaacatcgagcagattctggactacctgtttgcgcatgggcaactctgcgagaaaggctttgatcccctactcgtcgaggaagctctagaaatgcaccagtgctccgaggagaaaatgatggagtttttgcagctcatgagcaaatttaaggagatggggttcgagctgaaggacatcaaggaagtgttactgctgcacaacaatgaccaagacaatgctctagaagacctgatggccagagcaggtgcttcatag

SEQ ID NO: 245870 - DNA, 690 bp, Artificial Sequence
  Description of Artificial Sequence: Synthetic coding sequence
atgcaaatctttgtgaaaacccttacaggaaagacaataaccctggaggtagaacctagtgacacaatcgaaaatgtgaaagcaaagattcaggacaaggaagggatcccacctgaccagcagcgtttaatcttcgcgggtaagcagcttgaggatggcaggactctctcagattacaatatccagaaggaaagcaccttgcatctggttcttcgcctccggggtgggatgcaaatttttgtgaaaacactcaccggcaagaccattacactggaggtggaaccttccgacactatcgaaaatgtcaaggctaagattcaggataaggaaggaattccgcctgatcagcagcggctgatttttgcgggtaaacagctggaggacggacgtactctgtcagattacaatatccaaaaggagtctacacttcacctcgtcctccgcctcagagggggaatgcaaatctttgtcaagacccttacaggtaagaccataactctggaggtggagccgagcgacactatcgaaaatgtgaaggctaagatccaggacaaggaaggcattccaccagatcaacagcgactgattttcgctggaaagcagctcgaagacggacgcactctgtcagactataatattcaaaaggaaagtacactccatctggttttgcgtctaaggggaggctgctag

SEQ ID NO: 245871 - DNA, 690 bp, Artificial Sequence
  Description of Artificial Sequence: Synthetic coding sequence
atgcagatatttgtcaagactctgacaggcaagactataacgctggaggtcgagccgtcggacaccattgaaaacgtcaaagctaaaatacaagacaaggagggtattcctccagaccagcaacgcctgatttttgccggaaagcagttggaagatggcaggaccttgagcgattataatatccagaaagaaagcacgctgcatctcgtcctcaggctcaggggcggtatgcaaatctttgtgaaaacactaactgggaagacaatcactctagaggttgaaccatcagacactattgagaatgtcaaagcgaagatacaagacaaagaaggcattccccctgaccaacagaggctgatcttcgccggaaagcagctggaggacggcagaactctcagcgactacaacattcagaaagagagcacgctgcacctggtgttgcgtttgcggggagggatgcagatctttgttaaaacactgacaggcaaaactattacccttgaggttgaacccagcgataccatagaaaacgtcaaggcaaagatacaagataaagaaggtatcccacccgatcaacagcgcctcatcttcgcagggaagcagctggaggacggcaggacactgtccgattataacatccaaaaagagtccacactgcacttagttctgagattgcgcggagggtgttag

SEQ ID NO: 245872 - DNA, 690 bp, Artificial Sequence
  Description of Artificial Sequence: Synthetic coding sequence
atgcaaatcttcgtgaagactctgacagggaaaactatcacactggaggtggaaccctctgacacaatagaaaacgttaaggctaagatccaggataaggaaggcatacccccagatcaacagcggctaatttttgccggaaagcagctcgaagacggtcgcaccctgtctgattacaacatacagaaagagagcacgctccacttagtattgcgtctacgtggaggaatgcaaattttcgtcaaaacactcaccggcaagacaatcacccttgaagtcgaaccttcagatacaatcgagaacgtcaaagccaaaatacaagacaaggagggaatcccaccagaccagcagaggctgatattcgccggaaagcaactcgaagacggacgaaccttgagcgattacaacatccagaaggaatccacattacacttggtcttgcgcctgcgaggtgggatgcagatttttgtcaagacactcactgggaagaccatcacccttgaagtggaaccgtcagacactatagagaatgtgaaagctaagattcaggacaaagaaggaattccacctgatcagcagcggttaatctttgctgggaaacagctggaagatggtcgaacactgagtgactacaatatacagaaggagagtactcttcatttagtgctgagattgcgaggcggttgctag

SEQ ID NO: 245873 - DNA, 462 bp, Artificial Sequence
  Description of Artificial Sequence: Synthetic coding sequence
atgcagatttttgtgaagaccttgactgggaagaccatcacgctcgaagtggagccctctgataccattgagaacgtgaaggccaagattcaagataaagaaggcataccccctgatcagcagcgtctaatttttgccggtaagcagctcgaagacgggaggactttaagtgactataatatccagaaggaaagcacacttcacctcgtcctcagactccggggaggcatgcagatatttgtaaaaacccttactggtaaaaccataactttggaggtggagccatctgacacgattgagaacgtgaaagccaagatccaagacaaggagggaatccctccagaccagcagcggctgatcttcgccggtaaacagcttgaggacggccgtactctgtcagattataacatacaaaaagagtcaaccctgcacctggtgctcaggctgcgaggcggatgttag

SEQ ID NO: 245874 - DNA, 2058 bp, Artificial Sequence
  Description of Artificial Sequence: Synthetic coding sequence
atgcagatttttgtgaaaacgctaactggcaagaccattacactcgaagttgaacctagcgataccatagaaaatgtgaaggcaaaaatccaagacaaagagggcatccccccagatcagcagcgtttgatttttgccggtaagcagctcgaagacggcagaaccctcagcgactacaacattcagaaggagagcaccttgcacctggttttgagactgaggggcggtatgcaaatttttgtgaagacactgacgggcaagaccattacactggaggttgagccaagcgataccattgagaatgtgaaagcaaagattcaggataaggaagggataccacccgaccaacagaggctgatcttcgccggaaagcaactggaagacggcagaaccttgtcagactataacatccagaaagagagcacgcttcacctggtgctcagactgcggggaggaatgcaaatatttgtgaaaactctcactggtaagactatcacactggaagtggaaccatccgatactattgagaacgtcaaagccaaaattcaggataaagagggaatcccaagcgaccagcagagactgatcttcgctggaaagcagctggaggacgggaggaccctatctgattataacatccagaaagagtccaccttgcatctggttctgagactccgaggaggtatgcaaatctttgtgaagactctgactgggaagacgatcaccctggaggtggaaccttctgacacaatcgagaatgtcaaggccaaaatccaggataaggaggggattcccccagatcaacagcgtcttatctttgctggaaaacaactggaggacggcaggaccctatccgattacaacattcaaaaggaatcaacgcttcacctcgtcctgcggctgcgcggagggatgcaaatcttcgtgaagacccttaccggaaaaaccatcaccttagaggtggagccatcagacacaattgagaacgtgaaagcaaagatacaggataaagaagggataccccctgatcaacaacgcctgatattcgccggtaagcaactggaagatggaagaaccctgtcggactataatattcagaaagagtcaaccctccatcttgttctgcgcttgaggggaggtatgcaaatctttgtgaaaacactcacgggaaagaccataaccctcgaggtagaaccctcagacaccattgaaaatgtgaaagccaagatccaggacaaagaaggtatcccacccgaccagcaacgactgatattcgcaggaaagcagctagaggatggtcggacgctcagcgactacaacatacagaaggagagcaccctgcatctagtgctgcgcttgagaggagggatgcagattttcgtaaagacactgactggtaaaaccattactttggaagtcgagccttctgacacaatcgagaacgtgaaagcaaaaattcaggataaggaggggatcccgccagaccagcagcggctcatcttcgctggaaagcaacttgaggatggcaggacgttgagcgattacaatattcaaaaagaatctactctgcacctcgtgctcagactccgcggaggtatgcagattttcgtgaaaacactgacaggcaaaacaattaccctcgaggtcgaaccaagcgacacaattgagaatgtgaaggccaagatccaggacaaggaggggattccgccagatcaacagcggttgatttttgccggaaagcagttggaggacgggcgtactctgtccgactacaacatccaaaaggaatctacactgcatttggttcttagactgcgtgggggtatgcagatattcgttaaaacccttaccggcaagacaatcaccttagaagtagagccatcagacacaatcgagaatgtgaaagctaagattcaggataaagaagggattcctccggatcagcaacgtctgattttcgctgggaaacagttggaggatggacggaccctgtcagattataatatccagaaagagagcacactgcaccttgtcttgaggttgcgcggaggcgtgtag

SEQ ID NO: 245875 - DNA, 450 bp, Artificial Sequence
  Description of Artificial Sequence: Synthetic coding sequence
atgcagatattcgtgaaaaccctgacaggtaaaacgatcacgctggaagtggagccaagcgacaccatcgagaatgtgaaggccaaaatccaagacaaggagggtatacctcccgaccagcaaagactcatctttgcgggtaaacagctcgaagatggcaggactttatccgattataacattcagaaggagtcaactttgcatctagtacttcgccttcgcggtgggatgcagatttttgtgaagaccctaacaggcaagaccataacacttgaggtggagcccagcgatactattgaaaatgtcaaagcaaagatccaggacaaagaaggaatccccccagaccaacagcggctgatcttcgccggaaagcagctggaggacggtcgaaccctgtccgactataatatccagaaggagagtaccctgcatcttgtgctcaggttgtag

SEQ ID NO: 245876 - DNA, 372 bp, Artificial Sequence
  Description of Artificial Sequence: Synthetic coding sequence
atgcagattttcgtgaaaactctaactgggaaaactattacactcgaggttgagccttccgatacaatcgaaaacgtcaaggccaagatacaggacaaggagggcataccccctgaccagcagcgcttgatttttgccggaaagcagcttgaggacggtagaactctatccgattataacatacagaaggagtccacactacacctagtcctccggttgcgcggagggatgcagattttcgtcaagacattgactggcaagacaatcaccctggaagtggaaccctcagacactatagaaaatgtgaaggctaaaatccaggacaaggagggaatcccaccagaccagcaaaggctgatattcgccggatag

SEQ ID NO: 245877 - DNA, 2058 bp, Artificial Sequence
  Description of Artificial Sequence: Synthetic coding sequence
atgcagatttttgtaaagaccttgacaggtaaaacaatcacattggaagtggaacctagcgatacaatcgaaaatgtgaaggcgaagattcaggacaaagagggaatcccaccagatcagcagcgcctgatttttgcagggaaacagctggaagatgggaggaccctttccgactacaatatccaaaaggaatctaccttgcacttagtgcttcgcctgagaggaggtatgcagatcttcgtcaagacactgaccggtaaaactattacactggaggtggagccttctgacaccatagagaatgttaaagcaaaaattcaagataaagagggcattccccctgaccagcagaggctcatcttcgccggaaaacagcttgaggatggccgaactctctctgactacaatattcagaaagagtccacactccatctcgtgttacgcctgaggggtgggatgcagatattcgtgaagacccttacaggaaagactattacactagaggttgaaccctcagacaccattgagaacgtcaaggccaaaatccaggacaaagaggggatccccagtgaccagcaaaggttgattttcgctgggaaacagctggaagatggaaggaccctgtcagactacaatatccagaaggaatcaacactacacctggttctccgcctgcgcggaggcatgcagatttttgtgaagactctgactggaaagacaatcacgttagaagtcgagccttccgataccattgagaacgtcaaggcaaagattcaggacaaggaagggattccaccagaccagcagcgactgatctttgcgggaaaacaattggaggacggcaggacattatccgactacaatatccagaaggagagcacactccatctggtgctgaggctgcgcggtggaatgcagatctttgtgaagacacttaccggtaagacaatcactctcgaggttgagcccagcgatacaattgagaacgtgaaagctaaaatacaagataaagagggcattccgccagatcagcagaggcttatctttgctggcaagcagttagaggatggtcggacattgagcgactacaacattcaaaaggagtccacattacacttggtgttgagactgaggggaggaatgcaaatcttcgttaaaaccctcaccggaaagacaatcacccttgaagtagagccaagtgatactatcgaaaacgtcaaggcaaagattcaggacaaagaaggcatccctcctgatcagcagagactgattttcgctggtaaacagctcgaggacggtcggacactgagtgactacaacatccaaaaagagtcaactttacacttggtcctacgcttgcgcggtggcatgcagatttttgtcaagactttgactggcaaaactattacactggaggttgaaccatctgacacaattgaaaacgtgaaggctaagatccaagacaaagaaggaatccccccagatcaacagagactgatatttgctggtaaacagcttgaagacggaagaaccttatccgattacaatattcagaaggagtccactctacatctggtgttgagactgagagggggaatgcagattttcgtgaagactctgacaggaaagacgattacactagaggttgaaccgtcagataccattgagaacgtcaaggctaagatccaggacaaagaagggatcccccctgatcagcaacggctcatattcgccggtaaacaacttgaagatggaagaacattgtctgattacaacattcagaaagagagcaccttgcacctggtcctccggcttagagggggtatgcagattttcgtaaagactttaacagggaagacaataaccttggaagttgagccgagtgacactatcgagaatgtgaaagccaagatccaagacaaagaaggcatccctcccgatcaacaaagactcatatttgccggtaagcaacttgaggacggcaggacactttcggactataacatacaaaaggagtccaccctgcatctggtcctcagactgcggggaggagtgtag

SEQ ID NO: 245878 - DNA, 486 bp, Artificial Sequence
  Description of Artificial Sequence: Synthetic coding sequence
atgcagatcttcgtaaagaccctgaccggcaaaactattacattagaagtcgaaccgtccgataccatcgaaaacgtcaaggccaagattcaagacaaagagggcattccacccgatcagcagaggctgatctttgccggtaagcagctcgaagatggcaggactctctcagattacaatatccagaaggaaagtactctccatttagtgctgaggcttcggggaggaatgcagatcttcgtcaaaacactaaccgggaaaactattacactggaggtggagccgtccgacactatcgagaatgtgaaagcgaaaatccaggacaaagaggggataccaccagaccagcagagattgatcttcgctggcaagcagctggaagacggaagaaccctgtctgactacaatatccaaaaagaatccaccttgcaccttgtcctgaggctgcggggtggcatgcagatttttgtgaaaaccctcacctag

SEQ ID NO: 245879 - DNA, 405 bp, Artificial Sequence
  Description of Artificial Sequence: Synthetic coding sequence
atgcagattttcgtcaagacgctaactggcaaaaccatcactttggaggttgagcctagtgataccatcgagaatgttaaagccaagatacaggacaaagaaggcatcccaccagatcagcaacggttaatcttcgccggtaagcagcttgaggacggcaggacactgtcagactacaatattcagaaagaatctactctccacctggtcttgagactgcgagggggtatgcagatcttcgttaagactctgacaggtaagaccattactctggaggttgagccatccgataccatcgaaaacgtcaaggctaagatccaggacaaggaagggatcccacctgaccagcagcggttaatattcgctgggaagcagctcgaggatggacgaacgctgtctgactag

SEQ ID NO: 245880 - DNA, 510 bp, Artificial Sequence
  Description of Artificial Sequence: Synthetic coding sequence
atgcagatcttcgtgaagactctcactggaaagaccataacccttgaagtggaaccctctgacacaattgagaatgtgaaagccaagatacaggataaagaagggatcccaccagatcagcagaggctgattttcgctggcaagcagttggaggacggtcgtaccctgtctgattacaatatccagaaggagagtactctgcatctcgtactgcgcctgagaggaggcatgcagatatttgtcaagacactgacaggcaaaacgatcaccctggaggtggaaccatctgacactatcgagaacgtgaaggccaagatccaggacaaggaaggtattccgagcgaccagcagcggttgatctttgctgggaaacaactcgaggacggtcgtaccctgtcggactataacattcagaaagaatcaacactgcacttggtcctgcggttaaggggtggaatgcagatcttcgtcaaaacattgaccggaaagacaatcaccctggaggtctag

SEQ ID NO: 245881 - DNA, 468 bp, Artificial Sequence
  Description of Artificial Sequence: Synthetic coding sequence
atgcagatcttcgttaagacactgacgggtaaaaccataactctggaggttgagccttctgacacaatcgaaaatgtgaaggcaaagatccaggacaaagaggggattccccctgaccaacagcgtctgatctttgccggtaagcagctggaagacggtcggacattgtccgactataatattcagaaggagtccactctccacctcgtgctgaggctgcgagggggaatgcagatcttcgtgaagacgctgaccggcaaaactatcactttggaggtcgaaccttccgacaccatcgaaaacgttaaagcaaagatccaggataaggaagggatcccacccgaccagcaacgacttatttttgccggaaagcagttggaagatggtcgtaccctgagcgattacaacatccagaaggaaagtaccctgcatctggtgctaaggttgcggggtggtatgcagatttag

SEQ ID NO: 245882 - DNA, 186 bp, Artificial Sequence
  Description of Artificial Sequence: Synthetic coding sequence
atgcagattttcgtcaagaccctgacggggaagactatcacactagaagtggaaccaagtgatacgatcgaaaatgtcaaagccaagattcaggacaaagaaggtattcctcccgatcagcagcgtctgatctttgctggaaaacagctcgaagacggtcgtaccctgtcggattacaacatctag

SEQ ID NO: 245883 - DNA, 1830 bp, Artificial Sequence
  Description of Artificial Sequence: Synthetic coding sequence
atgcagatttttgttaaaactctgaccggcaaaactattactctggaggtcgagcccagcgatactatagagaacgttaaggcaaaaatacaagacaaagagggcattccccctgaccaacagcggttgattttcgccggaaagcagttagaggatggaaggaccctgtctgactacaatatccagaaagagagcaccctgcacctggtactgcgcctacgcggtggcatgcagatcttcgtgaaaacgctgaccggcaaaaccatcaccctggaagtggaaccttcagacacaatcgagaacgtcaaggccaaaatccaggacaaggagggtatcccctctgaccaacaacgcctgattttcgctggaaagcagctcgaggatggaagaactctgtccgactacaacattcaaaaggaaagtactctccatttagtactgcggcttaggggagggatgcagatattcgtgaagaccctcacgggaaaaaccattacactggaagtcgaaccctccgacacaatagagaacgtgaaagccaagattcaggacaaagagggcatccccccagaccagcagcggctgatcttcgcaggaaagcagttagaggacggtagaactctgagcgactacaatatacagaaagagagtactttgcatttggtcctgagactccggggtggcatgcagattttcgtgaagaccttgacagggaaaacaatcactttggaggtggaacccagtgacaccattgaaaacgtaaaggctaagatccaggacaaagaaggcattcctccagatcagcaaaggctgatcttcgccggaaagcagctggaggacgggagaactctctctgactataatattcagaaggagtcgactctacatctggtactaagactgcgcggaggaatgcaaatttttgttaaaacgctcacagggaaaaccataaccctggaggttgaaccaagcgatacaatcgaaaacgtgaaggccaagattcaggataaagagggcatcccccctgatcaacagaggttgattttcgcagggaaacaactggaagacggaaggacccttagcgactataatatccagaaagagtcgactctgcaccttgtgctcaggttgaggggcggaatgcagatatttgttaaaactttgacagggaaaacaattaccctggaggtcgaaccatcagatactatagaaaacgtgaaggctaagatccaggataaagaaggcattccgccagaccagcaacgccttatctttgctggcaaacagctcgaagacggcaggacgctgagtgattataatatccagaaagaatccacgcttcatcttgtgctgaggttgaggggaggcatgcaaatctttgtgaagaccctcactggcaaaaccataactttagaagttgagccttctgatactattgaaaatgtgaaggcaaaaatccaggacaaagagggaatccctcctgatcagcagcgcctgatatttgcagggaaacagcttgaggacggcaggacactcagcgactacaatatccagaaagagagcactctacatctggtgctaaggctgagggggggtatgcaaatatttgtcaaaaccctgacagggaagacaattactttagaggtagagccctccgataccatcgaaaatgtaaaggctaagatccaggataaagaaggcattcctccggatcagcaaaggctgatctttgcaggcaaacagctggaagacggcagaaccctgtcagactacaacatccagaaagagtctactctgcatttagtcctgagactgcgcggtggagtgtag

SEQ ID NO: 245884 - DNA, 411 bp, Artificial Sequence
  Description of Artificial Sequence: Synthetic coding sequence
atgcaaatctttgtcaaaacactcacaggaaaaaccattacacttgaggtggagccctcggatacaatcgagaacgttaaggccaaaatccaggataaggagggtatcccacctgaccagcagcggctaattttcgctggaaaacaactggaggatgggaggacactctctgactacaacatccaaaaagaatccacgctgcacttggtgctgcggctgagaggcggtatgcagattttcgtgaaaacactaacggggaaaacaattactctggaggttgaaccaagtgatacaatcgagaatgtaaaggccaagatccaagataaagagggaatccctcctgaccagcagagactcattttcgccggtaagcagctggaagacggacgcaccttaagcgactataactag

SEQ ID NO: 245885 - DNA, 672 bp, Artificial Sequence
  Description of Artificial Sequence: Synthetic coding sequence
atgcagctgaagcctatggaaataaacccagagatgttgaacaaggtgcttagccggttgggggttgccggacaatggaggttcgtggatgtgctaggattggaggaggagtcactggggtctgtgcccgctcccgcatgtgctcttcttctgctatttcccctgacggcccagcacgaaaacttcagaaaaaagcagattgaggagctcaaagggcaggaagtgtcgcccaaggtgtacttcatgaagcagacaattgggaactcatgtggcacgatcgggctgatccatgcagttgccaacaaccaggacaaattgggctttgaggacggaagcgtcctgaaacagtttctgagcgagactgagaaaatgtcccccgaagatcgagcgaagtgctttgagaagaatgaagccattcaggccgctcatgatgccgttgcccaggagggccagtgccgggtggatgacaaggtcaattttcactttattctcttcaacaatgtggatgggcacctgtatgaactcgacggtaggatgcctttccctgttaatcatggggcaagtagcgaagacaccctcctgaaggatgccgcaaaggtgtgtcgggagttcacggaaagggagcagggcgaggtccgattttccgctgtcgccctctgcaaggctgcatag

SEQ ID NO: 245886 - DNA, 642 bp, Artificial Sequence
  Description of Artificial Sequence: Synthetic coding sequence
atgcagctgaagcccatggagatcaatcctgagatgctgaataaagtgctttcccgcctcggcgtggccggtcagtggagattcgttgacgttctcggactggaggaggaaagtttgggcagtgtgcccgctccagcctgcgcattgctattactgttccctctgactgcacagcatgagaatttccgaaaaaagcagattgaggagctaaaggggcaggaggttagcccaaaggtgtatttcatgaaacagaccattggcaacagctgcggtactataggcctgattcatgccgtggcaaataatcaggacaagttgggtttcgaagatggatctgtgctgaaacagtttttgtcggaaacggagaagatgtcacccgaagaccgggctaaatgcttcgagaaaaatgaagctatacaggctgcccacgatgccgtggcccaggaaggccaatgtagagtggacgacaaggttaatttccattttattctcttcaataatgtagatggacatctctacgagctagatgggaggatgcctttcccagttaatcacggggctagcagtgaggatactctgttgaaggacgcagcaaaggtatgcagggagtttacggagcgagaacaaggtgaagtgagatag

SEQ ID NO: 245887 - DNA, 177 bp, Artificial Sequence
  Description of Artificial Sequence: Synthetic coding sequence
atgcagctgaaaccaatggagatcaatccagaaatgctgaataaggtcctcagcagactgggagttgccggacagtggagatttgtggatgtcctcggcctagaggaggagtctcttggtagcgtgcctgccccagcctgcgcactactgctcttatttcctctcacagcgcaatag

SEQ ID NO: 245888 - DNA, 756 bp, Artificial Sequence
  Description of Artificial Sequence: Synthetic coding sequence
atggtcccacgccctgtctgtgcagttctgctgttattcccaatcacggaaaagtacgaggtgtttaggaccgaggaagaggagaaaataaaaagccaaggccaagatgtgaccagtagtgtgtactttatgaagcagacaatctcaaatgcttgcggcacaattggactgatccatgcaatagccaacaacaaagacaagatgcatttcgaatctggttcaacactgaagaaatttcttgaggaatctgtctctatgagcccagaggaacgagctaggtacctcgagaactacgatgccatccgggtgacccacgaaacctcagctcatgagggccagaccgagtcatcttcgccgtcgtctagccagccccactcctcacactgccgcaccaaggcatccagcctttgccatcacgcatccctgccttgggtcaagcgtaatcacgtgggtcctgccaaggccacgagtcctagtttgagactgcgccgatggcggccttttttgcgtctaccatccctaggtctgcattccgtagccccatccatcgacgagaaagttgatctacattttatcgccttagttcacgtcgacgggcacctgtacgagctggatggccgtaagcccttcccaatcaaccatggggagacaagcgatgagacacttctggaagatgctattgaggtttgtaaaaagttcatggagcgagatccagatgagctaagattcaatgccattgccttgtctgcagcctag

SEQ ID NO: 245889 - DNA, 693 bp, Artificial Sequence
  Description of Artificial Sequence: Synthetic coding sequence
atggaaggacagaggtggctgcctctggaagcaaaccctgaggtgaccaatcaatttcttaaacagttggggcttcatcccaactggcagttcgtggatgtttacggcatggacccagagctcctctctatggtcccccgacctgtgtgcgctgtcttgctgctgtttcccattacggaaaaatacgaggttttccggactgaagaggaggagaaaatcaaatcacaggggcaagacgttacttcctcagtatactttatgaagcagacaatctctaacgcgtgcgggaccattggactgatccatgccatcgccaataataaggataaaatgcactttgagagtggatcaacgctcaagaagtttctcgaggaatcagtgagcatgagtccggaagaaagggcacgctatctcgaaaactacgacgctattagagttacccacgagacaagcgctcatgagggccagaccgaggcaccttctattgatgaaaaagtcgacctccacttcatcgcgctagtgcatgttgacggccacctctacgagctggatgggcgaaagccatttcctattaaccacggcgaaacgtccgatgagactttgctagaagacgccattgaagtgtgtaagaaattcatggaacgggatccagacgagctaagattcaacgcgattgctttaagcgcagcatag

SEQ ID NO: 245890 - DNA, 687 bp, Artificial Sequence
  Description of Artificial Sequence: Synthetic coding sequence
acagaagaggaggagaagattaagagccaggggcaggacgtgacctcaagtgtttatttcatgaaacagactatctccaatgcttgcgggactattggcctgatacatgccatcgccaataacaaggacaagatgcacttcgaatcggggtcgacacttaaaaagttcctcgaagagtccgtgagcatgagtcccgaagaacgggctaggtatctcgaaaattacgacgcgattcgagtcacacacgagacaagcgctcacgaagggcagactgagtcttccagtccttcaagctcacagcctcactcctcccactgtaggaccaaagccagcagcctgtgtcatcatgccagcctaccttgggtgaaaagaaaccatgtaggacccgcaaaggcaaccagtccctccctacgactgcggcgatggcggccattccttcgtcttccatctttgggtctgcatagcgtcgcgccatctatcgacgagaaggttgacctccattttatcgccctggtgcacgttgatggccatctgtacgaactagacgggagaaaacctttccctataaaccatggggagacaagcgatgaaaccctgctggaggatgctattgaagtgtgtaagaagttcatggaacgtgatccagatgagctgcgctttaacgccatcgcactgagcgcggcttag

SEQ ID NO: 245891 - DNA, 981 bp, Artificial Sequence
  Description of Artificial Sequence: Synthetic coding sequence
atgacaggaaacgctggtgaatggtgcctcatggagagtgatccaggcgtgtttaccgaacttattaaaggattcggatgcaggggtgcacaggtggaagagatctggagcctggagccagaaaatttcgaaaaacttaaaccagtgcacggcctcatcttcctcttcaagtggcaacctggagaggaacctgccggtagtgtcgtgcaggacagtcggttggacaccatcttcttcgcgaagcaggtaattaacaatgcctgtgcaacgcaggctattgtgtccgtgctgctgaactgcacacatcaggacgtgcatctgggggaaactctgtccgaattcaaggaattctcccaaagtttcgatgctgctatgaagggtttagcgctctctaattcagatgttatacggcaggtgcataattcctttgccagacagcagatgttcgaatttgacacaaagacttccgctaaggaagaggatgcctttcacttcgtgtcttatgtgcccgtgaatggacgactgtatgagttagatggcctcagagaagggcctatcgatcttggcgcatgtaatcaggacgactggatctctgcggtgaggccagtaatagagaaaaggattcagaagtatagcgaaggagagatcagattcaatctgatggccatcgtcagcgatcgcaagatgatctacgaacaaaagatcgctgaactacaacgtcagctggcagaggagcctatggacacagaccaaggtaactccatgttaagcgccatacagtctgaggtggcaaaaaaccagatgctcattgaggaggaagtgcagaagttaaaaaggtacaaaatagaaaacatccgccgaaaacataactatctgccattcattatggaacttctcaaaacacttgcagagcaccaacaactcattccattggttgaaaaattcgagaaacacttcgaaaagacattgctgggtaaatag

SEQ ID NO: 245892 - DNA, 951 bp, Artificial Sequence
  Description of Artificial Sequence: Synthetic coding sequence
atgacggggaacgccggagagtggtgcctcatggagagtgatcccggtgtgttcaccgagctcatcaagggctttggctgccgcggagcccaggtggaagaaatttggtcccttgaaccggagaatttcgagaaactaaagcctgtgcatggcctgatattcctttttaagtggcagcctggagaggagcccgcagggtcagtggtgcaggattccaggctggataccatctttttcgccaaacaggtgattaataacgcgtgcgccactcaggctattgtcagcgtgctgttgaactgcacccatcaggatgtgcacctgggtgaaactctgagtgagttcaaggagttttcccagtcgttcgacgctgctatgaagggcctcgccctaagtaatagtgatgttattcgacaggtgcacaactccttcgcaaggcagcagatgttcgagttcgatacaaaaacaagcgctaaagaagaggacgcgttccatttcgtgtcttacgtgccggttaatggacggctttatgagctcgatggcctacgagagggcccaatagacttgggtgcctgcaaccaggacgactggatcagcgcggtacggcctgtcattgagaaacgaatacagaaatacagcgagggagagattaggttcaatttaatggcaattgtgtctgacagaaaaatgatttatgagcagaaaattgcggagcttcagcggcagttggctgaggaaccgatggacacagaccaaggcaattctatgttaagtgctatccaaagcgaagtggctaaaaatcagatgttaatcgaggaggaggtgcaaaagctgaagcggtacaaaatagagaacataagacggaagcataattacctgccctttatcatggagcttctgaaaaccttggctgagcatcagcagctcattcccttagttgaaaaaggcaagtag

SEQ ID NO: 245893 - DNA, 1107 bp, Artificial Sequence
  Description of Artificial Sequence: Synthetic coding sequence
gcacggggagggtccgggaggtgcgtggcgagagctatgactgggaacgctggagagtggtgcctcatggagtccgaccccggtgtcttcacagaactcattaagggttttgggtgtcggggagcacaggtcgaagagatttggagcctcgaaccggagaattttgaaaaattaaagccagtccatggcctcattttccttttcaaatggcagcccggtgaggagcctgctgggtccgtcgttcaggacagccgattagatactatcttctttgccaaacaggttatcaataacgcatgtgcaacacaagcgattgtcagtgtgctgttgaactgcacacaccaagacgtgcatctaggagagacactgagtgagttcaaggagttttctcagtctttcgatgctgcaatgaaaggcctggccctgtctaattctgatgtaatcagacaggtgcataactccttcgcacgacagcagatgtttgagtttgatactaagacaagtgccaaggaggaagatgccttccactttgtgtcttatgttcctgtcaacggtagactgtatgaacttgacggcctccgtgagggcccaatcgacctcggggcatgcaatcaagatgattggatcagcgccgtcagacctgtgatcgaaaagcggatccagaaagatgggttcagcccgtgttgtcctggctggagccaaacacctgaactcaaacctagcgcctgtctggacctcccaaaatggtactcggagggtgagatacggttcaatctgatggcaatcgtgtcggacaggaagatgatttacgagcagaagatagccgagctccaaagacagctggcagaagaggaacccatggacaccgaccagggtaattcgatgctcagtgccatccagagcgaagtcgccaagaaccagatgctgatcgaggaggaagtgcaaaagctgaagaggtacaagatagagaatataaggcgtaagcataactatctccccttcatcatggagctccttaagaccctcgccgagcaccaacagcttatccctctggtcgagaaagccaaggaaaagcaaaatgccaagaaagctcaggagaccaagtag

SEQ ID NO: 245894 - DNA, 1068 bp, Artificial Sequence
  Description of Artificial Sequence: Synthetic coding sequence
atgacaggcaatgccggagagtggtgcctgatggagtctgatcctggagttttcaccgagttgattaaagggttcggatgccggggtgctcaggtcgaagagatttggtcgcttgagccagaaaacttcgagaagcttaagcccgttcacggtctcatatttctgttcaaatggcagccaggggaggaaccggcaggatcagttgtgcaagactcacgattagataccattttcttcgcgaagcaggtgatcaataatgcatgtgccacccaagccatcgtgtccgtcttgctcaattgcacacatcaggacgtgcatctcggggagaccctgtcagaatttaaggaattctcccaatctttcgacgccgcaatgaagggcctcgctttgagcaatagtgatgtgataaggcaagtacacaattcttttgctcgacaacagatgtttgaatttgacacaaagacatccgcaaaagaggaggacgcctttcacttcgtgtcgtacgtaccagtcaatggcaggctatatgagctcgatgggcttagagaagggccaatcgatctaggcgcttgtaatcaggacgactggatatcagctgtgaggcctgtgatcgagaagcgcattcagaaagatgggttttctccctgctgtccaggctggtctcaaaccccagagctgaagccctctgcttgtctggatctgccaaaatggtattccgaaggcgaaataagatttaacctcatggccattgtgagcgacaggaagatgatatatgagcagaaaattgcagaactacagaggcagcttgccgaagagccaatggataccgaccagggtaacagcatgctgtcagcaattcagtccgaagtggctaagaaccaaatgctgatcgaggaggaagtacaaaagttgaagagatacaagattgaaaacatccgccgtaaacacaactatctccccttcatcatggagctgctcaagaccctagcagaacaccagcagctcatcccacttgtcgaaaaggccaaagagaaacagaatgccaagaaggcacaggaaaccaaatag

SEQ ID NO: 245895 - DNA, 579 bp, Artificial Sequence
  Description of Artificial Sequence: Synthetic coding sequence
atgaagggactggccctgtcaaatagtgatgtaatccggcaagtgcataatagcttcgctagacagcagatgttcgagttcgatactaagacttctgccaaggaggaggacgccttccacttcgtcagctatgtgcctgtcaatggtcgcctgtatgaactggacggcctgcgggaagggccaatcgacctgggggcatgtaaccaagatgactggataagtgcagtgcggcctgtgatcgaaaaaagaatccagaagtatagtgaaggtgagatccggtttaatctcatggctatagtttcggataggaaaatgatctacgaacaaaaaattgcggagctccagagacagctcgccgaggagcccatggatacggaccaaggcaatagcatgctgagcgccattcaatccgaggttgccaaaaatcagatgcttatcgaagaggaagtgcagaaacttaagcggtacaagattgagaatataaggcgaaagcacaattatctaccctttattatggagctcctcaaaactctagccgagcaccaacagcttattccactggtggaaaaaattttctag

SEQ ID NO: 245896 - DNA, 987 bp, Artificial Sequence
  Description of Artificial Sequence: Synthetic coding sequence
atgaccgggaatgctggcgaatggtgtctaatggagtctgatccaggagtgttcacggagctgataaaaggtttcggctgcaggggcgcacaagtcgaggagatatggtcactggagcccgagaatttcgaaaaattgaaacctgtgcatggattgatcttcctctttaaatggcaaccaggcgaggagcctgccggatctgtcgtgcaggattcccggctggacaccatctttttcgccaagcaagtgatcaataacgcatgcgccactcaggctatcgtgtcagtgctgctgaattgcacccaccaggacgtgcacctgggcgaaactttaagcgagttcaaagaattttcacaatccttcgacgcggcaatgaaaggattagccctcagtaactccgatgtgatcagacaggtgcataacagcttcgctaggcagcagatgttcgaattcgacacaaagacttcggcaaaagaggaagacgcattccatttcgttagctacgtgcccgtgaatggtcgattgtatgaactggacggtctgcgcgaggggcctatcgaccttggtgcttgtaatcaagacgactggattagtgccgtgcgaccggtcattgagaaacgaattcagaagtacagtgaaggggagattcggttcaatctgatggctatcgtctcagaccggaagatgatttatgagcaaaagatagctgaactacagaggcagttggcagaggaaccgatggatactgaccagggtaattctatgctgtcagccattcagtctgaggtggctaaaaaccagatgctgatcgaagaagaggtgcaaaagctgaagcggtacaaaatcgagaacatcaggcgaaagcacaattaccttccctttatcatggagctgctgaagacgctagccgaacatcaacagctgataccactggtggagaaggcaaaggagaagcagaatgcaaagaaagctcaggaaacaaaatag

SEQ ID NO: 245897 - DNA, 990 bp, Artificial Sequence
  Description of Artificial Sequence: Synthetic coding sequence
atgactgggaatgcgggagaatggtgcctgatggaatctgaccccggtgtgtttaccgagctcataaagggctttggatgtcgaggtgcacaagtggaagagatctggtccctcgaaccggagaattttgaaaagctcaaaccagttcatgggctgattttcttgttcaaatggcagccaggggaagagccagccggtagcgtggtacaagactctcggctagatactatctttttcgcaaaacaggtgatcaacaacgcctgcgccactcaggcgatagtgtctgttctcttaaattgcactcaccaggacgttcacctgggggaaaccttgagtgaatttaaggaattcagtcagtcatttgacgccgcaatgaagggtctggccctgagcaactccgacgtcatcaggcaggtccacaatagctttgccagacagcagatgttcgagttcgataccaaaactagcgctaaggaagaggacgcatttcacttcgtgagttacgtaccagtcaatggaaggctttatgagttagacggcctgagggagggtcccattgatctgggcgcatgtaaccaggacgactggatctccgctgtcaggcccgtgatcgagaagcgaatacaaaagtattctgaaggcgaaattcgattcaatctgatggcgattgtgtccgacaggaaaatgatttatgaacagaaaattgccgagcttcagaggcaactcgcggaagaggagcctatggacacggaccaaggcaacagcatgctgagcgctattcaaagcgaggttgcgaagaatcagatgctgatcgaggaagaagtgcagaaacttaaacgctataagatcgagaatatacgtcgaaaacacaactatctccctttcattatggagctcttgaaaaccctcgccgagcatcagcagctcattcctcttgtggagaaagcgaaagagaagcaaaacgcgaagaaggcgcaagaaaccaagtag

SEQ ID NO: 245898 - DNA, 954 bp, Artificial Sequence
  Description of Artificial Sequence: Synthetic coding sequence
atggaatcagacccaggagtgtttaccgagctgattaagggttttggctgtcgaggcgcacaagttgaagagatctggagtctggagccggagaatttcgagaagcttaaaccagtgcacggattaatttttctttttaagtggcagcctggcgaagagcccgcaggatcggttgtgcaggactcacgccttgatacaattttttttgctaagcaggtgatcaacaacgcctgtgcgacccaggccattgtgtccgtactactgaattgcacgcaccaggatgtgcacctaggagagacactctcggagttcaaagaattcagccagtcgttcgatgccgctatgaagggcttggccctctcaaatagcgatgtcatcagacaagtccacaacagtttcgcacggcagcagatgtttgagttcgacacaaaaaccagcgctaaggaagaagacgccttccactttgtttcctacgtgcctgtgaacggtcgtctatatgagcttgacggcttaagggaaggacccattgatctaggggcatgcaaccaggatgattggattagcgccgtgcgacctgtgatcgagaaaagaattcaaaagtatagcgagggtgagatccgctttaacctgatggcaatcgtcagcgatcgaaagatgatttatgaacagaaaatcgcggaattgcaacgacagctcgctgaagaggagccgatggataccgaccagggcaactctatgctgtccgccattcagagcgaggtcgcaaaaaaccagatgctgatcgaggaggaggtacagaaactgaagagatacaaaattgaaaacatacgacgcaagcataattacctcccctttattatggagctgcttaagactttggccgagcaccagcaactaattcccttggtggagaaatttgaaaaacactttgaaaaaactctgctcggcaagtag

SEQ ID NO: 245899 - DNA, 300 bp, Artificial Sequence
  Description of Artificial Sequence: Synthetic coding sequence
tagaacctgatggccattgtatctgaccggaagatgatttatgaacaaaaaatcgctgagctgcaaaggcagctggctgaggagcccatggacactgatcaagggaattcaatgctctccgccattcagtccgaagtcgctaagaatcagatgttgatcgaggaagaagtgcagaagctgaaacggtacaagatcgagaatataagacgcaagcataactatttaccattcattatggagttgttaaagaccctagcggagcaccaacaattaatcccactggtagaaaaaatattttag

SEQ ID NO: 245900 - DNA, 498 bp, Artificial Sequence
  Description of Artificial Sequence: Synthetic coding sequence
atggttaggcccggactggcaaggatgtccctgccaaggtgctggttccggtaccccggatggacaggcgctgaggctgggaggggccgtgcaattgtaagtagaagactcccttcccttaacccttgggatgccggagagaggcatggcggactcgtgagaatctgcgcgagcctaggccctcacaagcggctgccagctggtttgccacaatgtccacacctgtatttggcggctgatcccttggatccccagcgcagacaggaaaagagctgcgccgcactaggaaatgataagcggaggcagccggatggccagcggcagccccagcagcagcagcaaccacactgccgcaggggattccaggccccagcgttgcctaatcccctccgggtgctacagggacttggacgcgtgagtatgagcctcggctggctggagcgccctcccgctttgagccgggctgccggttgtcgaggcgcacaggttgaggaatag

SEQ ID NO: 245901 - DNA, 657 bp, Artificial Sequence
  Description of Artificial Sequence: Synthetic coding sequence
taactctctgagtttaaggagttcagtcagtcgtttgacgccgcaatgaagggcctcgcgctgagtaattctgacgtgattagacaggtccacaattcgtttgcccgtcagcagatgtttgaattcgatacaaagacttcagccaaagaggaagacgcattccattttgttagctatgttcctgtgaatggcagattatacgagcttgatggcttgagggaaggccctatcgacctgggagcctgtaatcaggacgactggatttccgctgtgaggcctgtcatcgagaagcggatccagaagtactccgagggggagatccgcttcaacctgatggctattgtgagcgataggaagatgatttacgagcaaaagatagcagaactgcaacgccagctcgccgaggaagagcctatggataccgatcagggcaatagcatgctgtccgccatccagagcgaagtagcaaaaaaccagatgttgatcgaagaggaggttcagaagctcaaaagatacaagatcgagaatatccgccgtaagcataactatctgccgtttataatggagttgctgaaaaccctggctgagcatcagcagctcatcccactggtggagaagtttgagaaacatttcgagaagactctcctcggcaaatag

SEQ ID NO: 245902 - DNA, 777 bp, Artificial Sequence
  Description of Artificial Sequence: Synthetic coding sequence
atgtcgctcggatggctagaaaggccccctgctctatcaagggccgcaggctgtcgcggtgctcaggttgaggaaatctggagcctggagcctgagaattttgaaaagctgaagcctgtacacggcctgatctttttgttcaagtggcagccaggagaagaacctgctgggagcgtggttcaggattctagacttgataccatattctttgctaaacaggtcataaataacgcttgtgccactcaggccattgtcagtgtgttgctgaattgtacccatcaggatgtccacctgggagagacgttatctgagtttaaagagttttcccagagttttgatgcagccatgaaggggctggcactgtccaactccgacgtaatcaggcaggtgcacaactccttcgctaggcaacaaatgtttgagtttgacaccaaaacaagcgccaaggaagaagacgcttttcattttgtctcctatgttccagtcaatggtcggctttatgaattggacggtttgcgtgaaggcccaatagatctgggagcttgcaaccaagacgactggattagcgccgtccggccagtcatcgagaagcggattcagaaatattcggaaggagaaatccgctttaacctcatggctatcgtgagcgaccggaagatgatctacgagcagaagatcgccgaactgcagcggcagcttgcggaagagcccatggacacggatcaaggcaacagcatgctgtctgcaatccagtctgaagtcgccaaaaaccagtag

SEQ ID NO: 245903 - DNA, 552 bp, Artificial Sequence
  Description of Artificial Sequence: Synthetic coding sequence
tagcagcagatgtttgagtttgacaccaagacttcagccaaggaggaggacgccttccacttcgtgtcttatgtgccagtgaacggcagactttacgagctggacggtttgcgcgagggccctatagatttgggcgcttgtaatcaggatgattggatctcagccgtcagacctgtcattgagaaacgcatccagaagtactctgagggcgagatccggttcaaccttatggccatcgtgtctgaccgcaagatgatttacgagcagaagatcgctgaacttcagaggcagttggcagaggaggagccaatggacaccgatcagggtaacagtatgttgtccgctatccagtccgaggtcgcaaagaatcagatgctgatagaggaggaggttcagaaattgaaaagatacaagatagagaatatccggcgaaaacacaattatctcccttttatcatggagttgcttaagacccttgccgagcatcagcaactgattccactggtcgagaaatttgagaaacattttgaaaaaaccctcctcgggaagtag

SEQ ID NO: 245904 - DNA, 348 bp, Artificial Sequence
  Description of Artificial Sequence: Synthetic coding sequence
tgagaaggcgagattaggttcaacctaatggcgatagtgagcgataggaagatgatctacgagcaaaagatcgccgaattacagaggcagctggccgaggagccaatggacacagaccaggggaacagcatgctctctgccatccagtcagaggtggccaagaatcagatgttaatcgaagaagaggttcagaaactgaagcgctataaaattgagaatatccgtcggaaacataattacttgccttttattatggaactgttgaaaaccttggcggagcatcagcagttaatccctcttgttgagaagttcgaaaagcactttgagaagacactgctgggtaagtag

SEQ ID NO: 245905 - DNA, 582 bp, Artificial Sequence
  Description of Artificial Sequence: Synthetic coding sequence
atgaaggggctggcattatctaattcggacgtcatccggcaggtgcacaattcattcgcccgtcagcagatgttcgaatttgacacgaaaacgagtgccaaagaggaggatgcctttcatttcgtaagctatgtcccagtgaatggtcgcctgtatgagctggatggacttagggaaggccctatcgatctcggggcatgcaaccaggacgactggatatcagcggtacggcctgtcatcgagaaacggatccaaaagtattcagaaggcgaaatccgctttaacctcatggccattgtcagcgaccgcaaaatgatctacgagcaaaagatcgctgaacttcagaggcagctagcagaagaggagccaatggacaccgatcaggggaacagcatgcttagcgctatccagagtgaagttgctaagaatcagatgctgattgaagaggaagtgcagaagctcaagaggtataaaattgaaaatatacgtcgtaagcacaactatctgcccttcattatggagttgctgaaaactttagctgagcatcagcagctgataccactcgtcgaaaaaatcttttag

SEQ ID NO: 245906 - DNA, 498 bp, Artificial Sequence
  Description of Artificial Sequence: Synthetic coding sequence
atggccccaaacgcaagctgcctttgtgtgcatgtgagaagtgaggaatgggacctgatgacattcgacgcaaatccgtacgattccgtgaagaaaattaaggaacacgtgaggtcaaaaacgaaggtgccagtacaggaccaggtcctgctactgggaagcaaaatcctcaagcctcggcgttcactgtcttcatacggcatcgacaaggaaaagactatccacctgactttaaaggtggtgaagccaagcgacgaagagttgcccctgtttctggttgaatcaggcgacgaggccaagcggcatcttctgcaggtcaggcgttcaagttctgtggctcaggtcaaggcaatgatcgagaccaagactgggatcattcctgaaacccagatcgtgacttgcaacgggaaacggctcgaagacggcaagatgatggccgattatggtatccgcaaagggaatctcctctttttggcgtgctactgtattggcggatag

SEQ ID NO: 245907 - DNA, 498 bp, Artificial Sequence
  Description of Artificial Sequence: Synthetic coding sequence
atggcacccaatgccagttgtctttgtgtgcacgtgaggtctgaagaatgggacctaatgacgttcgatgctaatccctatgactccgtcaagaaaatcaaagaacatgtgagaagtaagaccaaagtcccggtgcaggaccaggtcctgcttctgggatccaaaatccttaagcctcggaggtcactgtcatcatatggaatcgacaaggagaaaaccatccatctaactctgaaagtcgttaaaccgagcgatgaggaactgccattgttcctcgtggaatcaggggacgaggccaagcggcacctgctccaggttaggcgatcttcttctgtggcgcaagtcaaggcaatgattgagacaaaaactgggatcatccctgaaacacagatcgttacctgtaacggcaagcggttagaagatggaaaaatgatggccgactatggaatcagaaaggggaacttactatttctcgctagctactgtattgggggatag

SEQ ID NO: 245908 - DNA, 498 bp, Artificial Sequence
  Description of Artificial Sequence: Synthetic coding sequence
atggctccaaatgcctcgtgcctgtgcgtccatgtacggtcagaagagtgggatctgatgacctttgatgctaacccctacgattctgtgaaaaagatcaaggaacatgtgcggtcaaagaccaaagtccccgtgcaagaccaggtccttctcctgggctccaagatcctaaaacccagacgctcactgagctcatatggcacagacaaagaaaagactattcacctgactctcaaggtggtgaagccttctgacgaggaattgcccctctttcttgtggagagcggagatgaagcgaagcggcatctgctgcaagtgcggaggtcttcttctgtcgcccaagtgaaagctatgatcgaaacaaagacagggattatccctgagacccagatcgtcacttgcaacggtaaaagacttgaagatgggaagatgatggccgattatggtatccggaaaggaaacctgctcttcctggcatcctactgcatcgggggatag

SEQ ID NO: 245909 - DNA, 498 bp, Artificial Sequence
  Description of Artificial Sequence: Synthetic coding sequence
atggcgcctaatgcgagctgcctgtgtgtccacgttcggtctgaggaatgggatctgatgacctttgatgcaaacccctacgactcagtcaaaaagatcaaggagcacgtaaggagtaagaccaaagtaccagtgcaggaccaggtccttctactcgggtccaagattctgaagccccgaagatctctctcgtcctacggaactgataaagagaagacgatccacctgaccctgaaggtagtaaagcccagcgacgaggaattgcccttgtttctcgtagagagcggggatgaagccaagcgccacctcttacaggtgcggagatcttctagtgtagcgcaggtaaaagccatgatagagactaaaaccggtattatcccagaaacccagatagttacttgtaacggaaagcggctggaggatggcaagatgatggccgattacggcatcagaaagggtaatctactttttctcgcctcctactgcatcggcggatag

SEQ ID NO: 245910 - DNA, 498 bp, Artificial Sequence
  Description of Artificial Sequence: Synthetic coding sequence
atggcaccaaacgcaagctgtctctgtgtacacgtacgaagtgaggaatgggatctaatgacattcgacgctaacccatacgactccgttaaaaagatcaaggagcacgtccggtccaagacaaaggtgcccgttcaggaccaagtgttgctcctaggcagtaagattttgaaacccaggcgtagtctgagttcctacggcattgacaaggaaaagacaattcatcttacactgaaagtggttaagccttctgatgaagaactgcccttgttcctcgtcgaatcaggagatgaagctaaaaggcatctgctgcaggtgcggagatcttcctccgtggcgcaggttaaggcaatgatcgaaactaagacaggcattatacccgagactcaaattgtgacttgcaacggcaaaaggctcgaagatgggaagatgatggccgactatggaattaggaagggcaacctgctgttcttagcgtgttactgcattgggggatag

SEQ ID NO: 245911 - DNA, 498 bp, Artificial Sequence
  Description of Artificial Sequence: Synthetic coding sequence
atggcacccaatgcatcctgcctgtgtgtacatgtgcgcagcgaagaatgggatctgatgacatttgatgctaacccttatgattctgtcaagaaaattaaagaacatgtcaggagtaagaccaaggtgccggtccaggaccaggtgctcctccttgggtccaagatactaaaacccagacgaagcctgtcctcatacggtactgacaaggaaaagaccatccacctcacgctcaaagttgtgaagcccagcgacgaggagctgccactcttcctcgtggagtctggagacgaggccaagcgccatttactccaggttagacgctcatcttcagttgctcaggtgaaggcgatgatcgagaccaagacaggcattatccccgaaacccagatagtcacatgtaatgggaagcgcctggaagatggaaaaatgatggctgactacggtatccgcaaaggtaacctacttttcctcgcatcctactgcataggcggatag

SEQ ID NO: 245912 - DNA, 498 bp, Artificial Sequence
  Description of Artificial Sequence: Synthetic coding sequence
atggctcctaacgcaagctgcctttgcgtccatgtacgcagtgaggaatgggacctcatgactttcgatgctaacccctacgatagtgttaagaagattaaagaacatgtgagaagcaagacaaaagtgcccgtgcaggatcaggtgctactgttgggctccaagatcttaaagccacggagatcactgtctagttacggaattgacaaagagaaaacaatccacctgaccctgaaggtggtcaaacccagtgacgaggagctccccctcttccttgtggagagtggagatgaggccaaaagacatctgctccaggttaggagatcaagctcagtggctcaggttaaggccatgattgaaaccaagacgggcattattcccgaaacacagattgtgacttgtaacggcaagcgcctcgaggatgggaaaatgatggcggactatggaatcagaaaaggcaacctgttatttctggcttcttactgcattggtggctag

SEQ ID NO: 245913 - DNA, 705 bp, Artificial Sequence
  Description of Artificial Sequence: Synthetic coding sequence
atgggaggatgcgtgggcgcacaacacgactctagtggttccctgaacgaaaacagtgaggggactggggtagccttaggacggaatcagcccttgaaaaaagaaaagccaaaatggaaaagtgactaccccatgaccgatggccagcttcgatctaagagggatgagttttgggatacagccccagccttcgagggtagaaaggaaatatgggatgctttgaaagccgcagcccacgcctttgagagtaatgatcacgagctcgcccaggccattatagacggggcaaatatcactctccctcacggcgctttgactgagtgctatgacgagctggggaacaggtatcagctacctgtgtactgcttagctccccctattaatatgatcgaagaaaagagcgacatcgaaacgctggacatccccgaacccccacccaacagcggatacgagtgtcagctcagattgcgcctcagtacaggcaaggacctaaaactggtggtgcggtccaccgacacagtgtttcacatgaagcgaaggctgcatgcagctgaaggtgtggagccaggctcccagagatggtttttctccgggaggcctctgaccgacaagatgaaattcgaagagctgaaaattcctaaagactatgtggtgcaagttattgtgtcgcagccggtgcagaacccgacacccgtcgaaaattag

SEQ ID NO: 245914 - DNA, 924 bp, Artificial Sequence
  Description of Artificial Sequence: Synthetic coding sequence
atgttcagctttaatatgttcgaccatccgatccctcgggtgttccagaacaggttcagtacacagtacaggtgcttctcagtgtcaatgctggccggacctaacgatagaagcgatgttgaaaaaggcggaaagattatcatgccgcctagtgcgttggatcagttatcaaggcttaacattacttatcccatgttgttcaagctaacaaataaaaattctgaccgcatgacccattgcggggtattggaattcgttgcagacgagggaatctgttacttgcctcattggatgatgcaaaacctgttgcttgaggagggtggcctggtccaagttgaaagtgtaaatctgcaggtcgctacatactctaaatttcagcctcaatccccagattttctggacattaccaaccccaaagcagtcctggagaatgcccttcggaattttgcttgcctgacaaccggcgacgttatcgctatcaactataatgagaagatttatgaacttcgggtcatggagacaaagcccgataaagcagtgtcaatcatagaatgcgacatgaacgtagacttcgacgcgcctctgggttacaaggagccagaacgtcaggtgcagcacgaggagtccacagagggcgaagccgaccattcaggctatgctggggaactcggctttcgcgcattcagcggtagcggaaacagactggacggcaagaaaaaaggcgtcgagccgagccctagtccaattaaacccggagatattaaaaggggcatacctaattacgaatttaagctaggaaagatcacattcatacgcaactcccgtccgctagttaagaaggtcgaggaggatgaggctggtgggagattcgtcgctttttctggggagggccaatctctcaggaaaaaaggacggaagccgtag

SEQ ID NO: 245915 - DNA, 891 bp, Artificial Sequence
  Description of Artificial Sequence: Synthetic coding sequence
atgtttagcttcaacatgttcgaccatcctattccaagggtttttcagaacagattttccacccagtatcgatgcttttcagtgagcatgctggccggaccaaacgacagatctgacgtggaaaaaggcggaaagtcccgccttaatatcacatacccaatgctgttcaagctgaccaataagaattcggatcgcatgactcactgcggagtcctggaattcgtggccgacgaaggaatctgttacctgccgcattggatgatgcaaaatctactcctggaagagggagggctcgtccaggtagagagcgtgaacctgcaggtagccacttattccaagttccaaccgcagtctcccgactttctggatattactaatccaaaggctgtgttggagaatgcgctccgaaatttcgcctgtcttaccacaggtgacgttatcgccattaattacaatgagaaaatctacgaactgcgcgtgatggagacaaaacccgacaaggcagtgagtattatcgaatgtgatatgaacgtcgattttgatgcacctctcggatacaaggagccagaacggcaggtgcagcatgaagaatctactgagggtgaggccgaccacagcgggtacgccggagaacttgggtttcgagccttctccggtagtgggaatcgactcgatggtaaaaaaaagggcgtcgagccgtcccctagtcccataaagcctggggatatcaagcgcggaatccctaactacgagttcaagcttggaaaaattaccttcataagaaatagccggccactcgttaagaaggtggaggaagatgaagcaggcggacgcttcgtcgcattctctggcgagggccaatcacttcgaaagaaagggaggaaaccctag

SEQ ID NO: 245916 - DNA, 1032 bp, Artificial Sequence
  Description of Artificial Sequence: Synthetic coding sequence
atgttttcgttcaatatgttcgatcatcctattcctagggtattccaaaaccgattttctacacaatatcgatgcttcagtgttagcatgctcgctggtcccaatgatcgctcagacgtggagaagggcggtaagattattatgccaccatccgctctggaccagttgagcagacttaacatcacctatcccatgctctttaaattaactaataaaaatagcgaccgtatgacccattgcggggttctggagttcgtcgctgacgagggtatttgttatcttccacattgggtcgtgtaccgcctgtctctcgagagggatggccttaaatctctcgaagtggcagaggtgtcaggtagtgactactttccaagtccattctgcggcttagaagtatggatgatgcaaaacctgttgcttgaggagggcggtctggtgcaggtggagtctgtgaacctccaggtggcaacttattctaaattccagccccagagtcccgacttcctggatatcacgaatccaaaggcagtgctcgagaacgccttgcgtaattttgcgtgtctgactactggggatgtaatcgccatcaattacaatgagaagatttacgaacttcgggttatggagactaaaccggacaaagcagtctcaatcatcgaatgtgatatgaacgtcgacttcgatgcaccacttggatataaggaacctgaacggcaagttcagcacgaagagtcgaccgaaggcgaggccgaccatagcggctacgcaggagagcttgggttcagagcatttagcggctccgggaacagactggatgggaagaagaagggcgtcgagccgtccccctcaccgataaagcctggagatatcaagaggggcatacctaactacgaattcaaactcgggaaaatcaccttcatcaggaactcacggccactggtcaagaaggtggaagaggatgaagccggagggagattcgtagcattcagtggcgagggacagtcactgcggaagaagggacggaagccatag

SEQ ID NO: 245917 - DNA, 801 bp, Artificial Sequence
  Description of Artificial Sequence: Synthetic coding sequence
atgtttagtttcaacatgtttgaccaccccatacctagggtgttccagaatcgattttccacacagtaccgctgctttagcgtgagtatgctggccggacctaacgatcgaagtgatgtggagaagggtggcaagataatcatgccgccttcagccctggatcaactcagtagactgaatatcacctatcccatgctgtttaaactcactaacaaaaattctgaccggatgacacactgcggggtcttggagtttgtggcagatgaggggatttgctacctgccgcattggatgatgcaaaacctgcttctcgaagagggaggtctggtgcaggtggaaagtgtcaatctgcaggtcgcaacttactccaaatttcagccacagagcccagacttccttgacatcactaatccgaaggctgtgttagaaaacgcattgcgcaatttcgcttgtcttacaactggtgatgttatcgcaatcaactataatgaaaaaatctatgagcttagagtcatggagactaagcccgataaggccgtgtccattatcgaatgcgacatgaatgtggactttgacgctcccctcggctataaggaacctgaacggcaagtgcagcatgaagagtccacagagggtgaagccgatcactcgggctacgccggagaactgggcttcagagcgttctctgggagtggtaaccgattagacggcaaaaagaagggggttgaacctagcccttctccgatcaaacccggagatattaagcgaggaatacccaattacgagtttaaacttgggtag

SEQ ID NO: 245918 - DNA, 1053 bp, Artificial Sequence
  Description of Artificial Sequence: Synthetic coding sequence
atgctcccactccctgatctggacttatggcctctggaccgcctgccctctccgattaagcgcaaacctcaaacactagggtccctcaaatcatcccagggcatcgtggaggaaaccagcgaagaaggaaatagcgtgcccgcttcgcagtcagtagccgcactgacctccaagagaagcttagtgctgatgccagagtcaagcgccgaagagatcactgtgtgcccagaaacacaactcagctcgagcgaaacgttcgatctcgagagagaggtgtcccctgggtccagagatatattagacggagtgcgcatcattatggccgataaagaagtgggcaataaagaagatgccgagaaggaagtggccattagtaccttttcgtcgagcaaccaggtaagttgcccactctgcgaccagtgcttcccgcctacgaagatagagagacatgctatgtattgtaacggacttatggaagaggacaccgaagttttgacgcgaaggcaaaaggaagccaagacaaagagcgacagcggaaccgcagcacagaccagcttggatatcgacaaaaatgaaaaatgttacttgtgtaaatctctcgtccctttccgggagtaccagtgtcacgttgatagctgcctgcagcttgcaaaagcggatcagggggacgggcctgagggcagtggccgtgcatgtagcactgtggaggggaaatggcaacaaagactcaagaaccccaaagagaaggggcactctgaagggagattactctctttcctggagcagtctgagcataaaacgagcgatgcagatatcaagagctcagagaccggcgcatttagagtgccctcgccaggcatggaagaggcaggatgcagccgcgagatgcaaagttccttcactagaagagacctcaatgagagtcccgtgaaatcctttgtgtccatatccgaggctacagattgcctggtcgacttcaaaaagcaggtgactgttcagcccggatccaggacccgaacaaaggcaggcagggggagacggaggaagttttag

SEQ ID NO: 245919 - DNA, 2163 bp, Artificial Sequence
  Description of Artificial Sequence: Synthetic coding sequence
atgcccagacggaagaagaaagtgaaggaggtgagtgagagtcgtaatttggagaaaaaggacgtcgagacaacatcttcagtgtctgtgaagaggaaaaggaggctagaggacgcgttcatcgtgatatcagatagcgacggggaggagcctaaagaagaaaacggccttcagaaaaccaagactaagcagtctaacagagcaaaatgcctggcgaagcgaaaaatcgcccagatgacagaggaagagcaattcgctctggctctcaagatgtctgagcaggaggcgagagaggtaaatagccaggaagaagaggaggaggaactgctgaggaaggctatcgccgaatctctgaactcgtgccgtccttccgacgcttcagccaccagaagcaggccacttgccactggaccaagttcacaatcacaccaggaaaaaaccacggattctggcctgactgaaggcatctggcaactcgttcctcctagcctcttcaaagggtcacatatatctcaggggaatgaagctgaagagcgggaggagccctgggaccacacagagaagactgaagaggagcccgtcagcgggagcagtggatcttgggatcagtcctctcagccggtcttcgaaaacgttaacgtgaagtcttttgacagatgtaccggccactccgcggaacatacacagtgcggtaagcctcaggaatcgaccggacgcggatctgcttttctaaaagcagtacagggctccggcgatacgtctaggcactgcttgccgaccctcgccgatgccaaggggttgcaggatacaggcggtacagttaattatttttggggaatccctttctgtcccgatggggtggacccaaatcagtatactaaggtcatcctgtgtcagctggaggtttatcagaagtcactcaaaatggcacagaggcagctcctgaacaagaaaggctttggagagcccgtgctgcctcggccaccaagcctgatccagaatgaatgcggacagggcgagcaggcgagcgaaaaaaatgaatgtatctccgaggacatgggggatgaggacaaagaagaacgacaggaaagtcgggcaagcgattggcatagtaaaacaaaagattttcaagaaagtagtatcaagagcctgaaggagaaactgttgttagaggaggagcctaccacctcccatggccagtctagtcaggggatagtagaggaaacaagcgaggagggcaacagcgtgccagcaagtcagtctgtggcagccctaacctccaagaggtcactggtactcatgcccgagagtagcgctgaggagatcacggtctgcccggagacccagctcagctccagcgagaccttcgacttggaacgcgaggtgagtcctggaagccgcgatattcttgacggagtgcgaattatcatggccgataaggaagtgggtaataaagaggacgccgagaaagaggttgctatatctacgttctccagtagcaatcaagtgtcatgtcctctctgcgaccaatgctttccccctaccaagattgaacggcacgcaatgtactgcaatggactaatggaagaagatacagaggttctgactcgcaggcagaaagaagcgaaaactaagagcgattctggaactgcggctcaaacaagcttagatatcgataagaatgagaagtgttatttatgtaagtcgcttgtgcccttcagggagtaccagtgccatgttgattcatgcctccagcttgccaaggctgaccaaggtgatggtccagagggatccggaagggcatgtagcaccgtggaaggcaagtggcagcaacgtcttaagaatcctaaggaaaagggacactccgaagggaggctgctgtcctttttagagcagtccgagcacaagacgtcagatgcggatattaagtcttctgagactggggctttccgtgtgccaagccctggcatggaggaggcgggttgttccagagaaatgcaatcctctttcactcgcagagaccttaacgaatctcccgtcaaatcttttgtgagtatttctgaggcgacggactgcctggtcgatttcaagaaacaggtgaccgtacagcccggtagcagaacgcgcaccaaagcagggagaggcagaaggcggaagttctag

SEQ ID NO: 245920 - DNA, 1929 bp, Artificial Sequence
  Description of Artificial Sequence: Synthetic coding sequence
atgactgaggaggagcaatttgctttagctttgaaaatgagtgaacaagaggctagggaagtcaactctcaggaagaggaagaggaggagctccttcggaaagctatcgccgaatccctgaactcttgccgtccaagcgatgccagcgccacccgttctcgaccactcgctacagggccaagcagccaaagccaccaggagaaaactacggactccgggctgacagaggggatctggcagctagtgcctccgtcattatttaagggtagtcatataagccagggcaacgaggccgaagagagggaagagccatgggaccatacggagaagaccgaggaggaaccagtgtccgggagttccgggtcctgggatcagtccagccagccagtgtttgagaatgtcaacgttaaatcattcgacaggtgcaccggccattctgccgagcatacccagtgtggcaaacctcaggaaagtacagggcgtgggagcgccttcctgaaggccgtccaaggatccggtgataccagcaggcattgtctaccgacacttgcagacgcaaagggcctgcaagatactggcggaacagtgaactatttctggggcattccattctgccccgacggagtagacccgaaccagtataccaaggtgatcctgtgtcagttggaggtttatcagaaaagtctcaaaatggcccaacgtcagctgctgaacaagaagggcttcggagagcctgtgctgcccaggcccccttcactgatccagaacgagtgcgggcaaggcgagcaagctagcgaaaaaaatgagtgcatctctgaggatatgggggatgaagacaaagaggaacggcaggaaagccgagcttccgattggcattccaaaacaaaggattttcaggaatcatcaattaaaagcctcaaagagaagcttcttcttgaagaggaacccaccacgagccacggccagtcttctcaggggattgtggaagagacttcagaggagggaaactctgttcctgcctcccaatccgtggccgcattgacctccaaaagaagcctcgtcttgatgcccgagagcagtgccgaagagattactgtgtgcccggaaacgcagctttcatcaagtgaaacattcgatctagagagagaggtgagccctggaagtagagatattctggatggcgtacggataatcatggccgacaaggaggtcgggaataaagaggacgccgagaaggaagtagccatcagcaccttctcttcctccaatcaggtcagctgtcctctatgcgatcagtgcttccccccaacgaaaattgagcgccatgcaatgtattgcaacggattgatggaagaagatacagaggtgctcaccagacgccaaaaggaggcgaaaacgaagagcgactcagggaccgcggctcagacaagcctggacatcgacaagaatgaaaaatgctatctgtgcaaatcactggtgccctttagagaataccaatgccatgtcgactcgtgcttgcagcttgctaaagcagatcagggcgatggaccagaaggatccggacgggcttgttcaactgtggagggcaagtggcagcagaggctaaaaaaccccaaagagaaaggacactcggagggacggctactgtctttcctggaacagtctgaacacaaaacttcagatgctgatatcaaatctagcgaaacaggcgctttccgagtaccatctccaggaatggaggaggcgggttgcagccgggagatgcaaagtagcttcacaaggagagacctgaacgaatcccctgtcaagagcttcgtgagcatctccgaagcaaccgactgcttagtcgatttcaagaagcaggtgaccgtccagcccggatcacgcaccagaaccaaggcgggacggggtaggaggaggaagttctag

SEQ ID NO: 245921 - DNA, 2160 bp, Artificial Sequence
  Description of Artificial Sequence: Synthetic coding sequence
atgcctcgcagaaagaagaaagtgaaggaagtcagcgagtcgagaaacctggaaaagaaagacgtcgaaacgacctcgtcagtatcagtgaaacgtaaaaggcgactagaggatgcctttattgtgatttctgatagtgacggtgaagaacccaaggaggagaacgggctacagaaaaccaaaactaaacaatccaacagagccaagtgcttagctaagcgcaagatcgctcaaatgaccgaggaagagcagtttgcgctcgcgctcaagatgagtgagcaagaggctcgtgaggtaaatagtcaggaggaagaagaggaagaactcctcaggaaggccatagcagaatcccttaattcatgccgtccatctgacgcatccgcaactaggtctagaccactggcaaccggccctagcagccaaagccatcaggagaagactaccgattcgggactgaccgagggcatctggcagctggtgcccccaagcctgttcaaggggtcacatatcagccagggtaatgaggcagaagagagggaggagccatgggaccacacagagaagactgaggaggagcctgtgtctggaagcagcgggtcttgggaccagtcctcacaacctgtgttcgaaaacgtcaacgttaaaagcttcgatagatgtacaggacatagcgccgaacacacacagtgtgggaagccgcaggaatcaactgggagagggagcgctttcctgaaagctgtgcaaggatcaggagacacaagtcggcattgcctccccacactggctgatgccaaaggtctgcaggacactggaggaacggtgaattatttttggggaatacctttctgcccggatggggtggaccccaaccagtacaccaaggtcatcctgtgtcagctagaggtgtaccaaaagtcactgaagatggctcaacgccagctactaaacaagaaagggttcggagagccagtgctgcccagacccccatcacttatccagaacgaatgtgggcagggagaacaagcctcggaaaaaaacgaatgtatatccgaagacatgggcgacgaggataaagaagaacgccaggagagtcgagcaagtgactggcattcaaagactaaagactttcaagagtcctccatcaagtccctgaaggagaaattgttactggaagaggaacctactacctcacacggacagagctcccagggtatcgtggaggaaacttctgaggagggaaacagtgtccccgcatcgcaaagcgtggcagctctgacttctaaacgcagcctggtcctaatgccagaaagtagcgcagaagaaatcactgtgtgtcccgagacacagctatcgtcaagcgaaacgttcgaccttgaacgggaggtcagtccaggtagcagggacatactcgatggcgtgcgtatcattatggcagacaaggaagtggggaataaggaagacgctgagaaggaggtcgccatcagcaccttctcgagcagcaaccaggtctcatgtcctctgtgcgaccaatgttttcccccaactaaaattgagcggcacgccatgtactgtaatggtctaatggaggaggatactgtcctcaccagacgccagaaagaggccaagaccaaaagcgattctggcacggcagcacaaacttctctcgacatcgataaaaacgagaaatgctacctctgcaagtcccttgtgccattccgagagtaccaatgccatgtggactcctgtttgcagctggctaaggctgaccagggtgacggccctgagggtagcggcagagcatgttcaacagtagagggcaaatggcagcagcggctcaagaacccgaaagaaaagggtcacagcgaaggtcgcctactgtcctttctggagcagtccgagcataaaacttccgatgccgacataaagtcgtcagagactggcgctttcagagtcccgagtccgggtatggaggaggccggatgttctagggaaatgcagtctagcttcactaggcgggatttaaacgagtctcctgttaagagctttgtcagcattagtgaagccaccgactgtcttgtcgacttcaagaagcaggtgacagtgcaaccagggtcccgcaccagaaccaaggccggtcgaggccgacggaggaaattttag

SEQ ID NO: 245922 - DNA, 96 bp, Artificial Sequence
  Description of Artificial Sequence: Synthetic coding sequence
atgccgagacgaaaaaaaaaagttaaggaggtttcagaatctcgaaacctcgagaagaaagatgtggagactacgagctctgtgtccgttaagtag

SEQ ID NO: 245923 - DNA, 270 bp, Artificial Sequence
  Description of Artificial Sequence: Synthetic coding sequence
atgccacggagaaagaagaaggtcaaggaagtctctgagtccagaaatcttgaaaagaaagatgtcgaaaccacctcctcagtctccgttaagcgaaagaggcggctggaggatgcatttatagtgatttcagactcagacggcgaggaacccaaggaagagaatggtctacagaaaactaaaacaaagcaaagcaatagggctaagtgcctggctaaaaggaaaattgcccagatgacagaagaagaacagttcgccctggcgctgtag

SEQ ID NO: 245924 - DNA, 474 bp, Artificial Sequence
  Description of Artificial Sequence: Synthetic coding sequence
atgcccagacgcaagaagaaggttaaggaggtgagtgaatcgcggaacctcgaaaaaaaggacgttgaaactacatcatcagtctccgtgaagcgcaagaggcgactggaagacgcattcattgtgattagcgatagtgacggcgaggaaccaaaagaagaaaacggcctgcagaagacgaaaactaaacagagcaatcgggctaaatgtctggccaaaaggaaaattgcccagatgacggaagaagaacaatttgccctagccttgaaaatgtccgagcaagaagctcgcgaagtcaactcacaggaagaagaggaggaagagctgcttcgaaaggctatcgctgaatctctgaactcttgccggccatcagatgctagtgcgaccaggagccgacccctggccacaggcccttcaagccaaagccaccaggaaaaaactacagatagcggactaaccgaggggatttggtag

SEQ ID NO: 245925 - DNA, 2160 bp, Artificial Sequence
  Description of Artificial Sequence: Synthetic coding sequence
atgcccaggaggaaaaagaaagtgaaggaggtttctgagagccgcaatctcgaaaaaaaagacgtagagacaacgtccagtgtcagcgtcaaacgtaagcgacgcctggaggacgcctttatcgtcatttctgactctgatggagaggaacctaaagaagagaacggcctacagaaaacgaagaccaagcagtccaatcgcgcaaaatgcctcgccaaacgaaagattgcccagatgactgaggaggaacagttcgcacttgccctcaaaatgagcgaacaagaagcacgggaggtgaattcccaggaggaggaagaggaagagttgcttcgcaaagcaatcgcagagtcgctgaacagctgccggccaagcgacgcctccgctacgcgaagccgcccactggctaccgggccatcctcccagtcccaccaggaaaagaccactgactccgggctcactgaaggcatttggcaattggtgcctcccagcctgtttaaggggtcacacatttcacaaggtaacgaggctgaggaaagggaggaaccctgggatcatacagagaagacagaggaggagcctgttagcggatcatccggctcatgggaccagtcctctcaacctgtgttcgagaacgttaacgttaaaagtttcgatcggtgcacagggcactcagctgaacatacacagtgcggtaagcctcaggagtccacaggtaggggtagtgcttttctgaaagctgtgcaggggagtggagatacttcgaggcactgtctacccactcttgctgatgcaaaagggctgcaggacaccggagggactgtcaactatttctgggggatcccattctgccccgatggcgtcgatccaaaccagtataccaaggtgatcctatgtcaactggaagtctaccaaaagtctcttaaaatggcgcagcgccagctgctgaacaaaaaaggtttcggagagcccgtgctccccagacccccttctttgattcagaacgagtgcggacagggcgagcaggcatctgagaaaaatgagtgcattagcgaggatatgggcgatgaggacaaagaagagaggcaggaatcccgtgcatccgactggcactccaaaaccaaggatttccaggagtcctcgatcaagagtctaaaagaaaaactgctgctggaagaagaacccaccacatcacacggacagtccagccagggaatcgttgaggaaacttctgaggagggcaactcggtgcccgcaagccagagcgtcgccgcacttacctccaaaaggtctctggtgctcatgcctgagagttctgcagaagagatcacggtatgtccagaaacacagctgtcctcgtctgagaccttcgatctggagagagaggtgagccccggatctcgggacattctggacggcgtgaggattatcatggctgacaaggaggttggtaacaaagaagatgctgagaaggaggtggccataagcaccttttctagctcgaaccaggtttcctgccctctgtgtgatcagtgctttcctcccaccaaaatcgaacgtcatgctatgtactgcaacggcctcatggaagaggacacggtactcaccagaagacagaaggaagcgaagactaagagcgatagtggtacggctgcccagacctccctcgacatcgacaagaacgaaaaatgttatttgtgcaagagcctggtgcccttcagagaataccagtgtcatgtcgacagctgcctgcagctggcaaaggctgatcaaggggacggccctgagggaagtggtcgagcctgctctacagtggaaggcaagtggcagcagcgcctgaagaatccaaaagagaaggggcactcggaaggccgactgctgtcgtttttggaacagtcagaacataaaacgtctgatgctgatataaagtcctcagagacgggcgcattccgagtcccttcacccggtatggaggaagccggttgttccagagagatgcagtccagctttacccgtcgggatctgaatgagtcacccgtgaaaagttttgtgtcgatctccgaagctactgactgcctcgtggatttcaaaaagcaggttacggtgcagcctggatcacggactaggactaaggccggtcggggacggaggcgaaagttctag

SEQ ID NO: 245926 - DNA, 5250 bp, Artificial Sequence
  Description of Artificial Sequence: Synthetic coding sequence
atggccgatgaggaggctggcggaacagagagaatggaaatctctgcggaactgccacagacaccccaacgtctagcctcctggtgggaccagcaggtggacttctacacagcatttttgcatcaccttgcacagctggtccccgaaatctacttcgcagagatggatcctgatctggagaagcaggaggaatctgtacagatgagcatctttacgccgttggaatggtacttgttcggtgaggatcccgatatttgcctggaaaagctcaagcattccggagctttccagctctgtgggcgagtgttcaagtctggtgagactacctatagctgcagagactgtgcaatcgaccctacatgcgtgttgtgcatggattgtttccaagacagcgtgcataaaaaccacagatataagatgcacactagcactgggggaggcttttgcgattgcggagataccgaagcgtggaaaacaggacccttttgcgtgaatcatgagccaggtagagctggcacaattaaggaaaactcaaggtgccctctaaacgaggaggtaatcgtgcaggccaggaagatcttcccaagcgttataaagtatgtggtggagatgacaatctgggaagaagagaaggaactgccacctgagcttcaaataagagaaaaaaatgagagatactactgcgtgctttttaatgatgaacaccattcatacgatcacgtcatttactctttgcagcgggctctggactgtgagttggcagaggcgcaactgcacacaaccgctatagataaagagggacgccgagctgtcaaagcaggtgcatatgcagcctgccaagaagcaaaagaggatatcaaatctcacagcgaaaatgttagccagcaccctctacatgttgaagtgttgcatagcgagattatggcccaccaaaagtttgctcttaggttaggttcttggatgaacaagatcatgtcttattcttccgatttccgacagatcttctgccaggcatgcctgagggaagaaccggattctgagaatccctgtctcatcagccgcctaatgctgtgggatgctaagttgtataaaggagcacgcaaaatcctgcacgaactgatattttccagtttcttcatggagatggagtacaaaaagctcttcgcgatggaattcgtcaagtactataagcagttacagaaggagtacatatctgatgaccatgatcgcagcatcagcatcaccgcgttgtcagtgcagatgtttactgttcccacgctggcaaggcacctaattgaggaacagaatgtcatctctgtgattacagagacactcctagaggtgctacccgagtatctggatcgcaacaataaattcaatttccagggatatagtcaggataagctgggcagagtttacgccgtgatctgtgacttaaagtacatcctgatctcgaagcccaccatctggaccgagagactgcggatgcagttcttggagggtttcagatccttccttaagatcctgacatgtatgcagggaatggaggaaattaggcgtcaggttgggcagcatattgaggtcgatcccgactgggaggcagccatcgctatccaaatgcaactaaaaaatatcttactcatgttccaggaatggtgtgcttgtgatgaagagctgctcctggtcgcatacaaagaatgtcataaagccgtgatgcggtgctcaactagctttatctcgtcatccaagactgttgtgcagtcctgcggacatagcttagagacaaaatcttacagagtttccgaggatctcgtttccatccacctcccccttagcaggacactggcgggactgcacgtgagattatcaaggctcggggctgtgtctcgactgcacgaatttgttagtttcgaagatttccaggtggaggtgctggtcgaatacccactgcgttgtttggtgctggtggctcaagtcgtagccgagatgtggaggcgcaacggactgtctctgatttctcaggtgttctactatcaggatgttaagtgtagagaggaaatgtacgacaaggacattataatgctgcagattggcgcttccctgatggatcctaataaattcctgctgctcgttctacagcggtatgagctggctgaggcatttaataagacaatcagcaccaaagaccaggatctaattaagcagtataatactcttatagaagagatgctccaagttttaatctacatagtcggcgaacgttacgtaccaggggttggaaatgtgacgaaagaggaagttaccatgcgcgaaattatacatctcttatgtatcgaacctatgccacacagcgctatcgctaaaaatctccccgagaatgagaataacgagaccgggctcgaaaacgtgatcaataaggtggcaaccttcaaaaaaccaggcgtgagcggacatggtgtttatgagttaaaagacgaatccttgaaggactttaacatgtatttctatcactactcaaagacccagcactcaaaagccgaacacatgcagaagaagagacggaagcaagagaacaaggacgaggcgcttcccccaccgcctcccccagaattctgcccagctttctcaaaggttataaacctcctcaattgcgacattatgatgtatattctgcggaccgtattcgaaagagcaattgatacagactccaatctgtggaccgaaggcatgctccagatggctttccatattcttgccttggggctgctggaggaaaaacagcaactgcagaaagcacctgaggaggaggtcaccttcgacttttaccacaaagcctcacgtctgggatcgtccgccatgaacatccagatgctcctggagaagctgaagggcataccccagctcgaaggccaaaaagacatgatcacatggatacttcagatgtttgacactgtgaaaagactgcgcgaaaagtcttgccttatcgtcgctacaacaagcgggtcagagtccattaagaatgatgagatcacccacgataaggagaaggccgaaaggaagcggaaggccgaggctgctcggttgcatcgacaaaagatcatggcccaaatgtccgccctgcaaaaaaacttcattgagactcacaaactgatgtacgacaacacatccgaaatgcccggtaaagaagacagcatcatggaggaggaaagcacacccgctgtgtccgattacagtagaatagcgctgggaccaaaaagaggcccttccgtaacagagaaggaagtcttgacatgtatcctgtgccaggaagagcaggaagtgaagattgagaataatgcaatggttttgtccgcttgcgtgcagaagtctacggctttgacccagcatcgcggaaaacccatcgagctgtccggggaagcattagaccctctgttcatggatcctgacctggcctatggcacgtatactggctcctgcgggcacgtgatgcatgccgtctgctggcagaaatattttgaggctgttcaactcagttcacaacagcggatccacgtggatttgtttgacctggagtctggggagtatctttgtccattatgtaaatccctgtgtaataccgtcatccctattattcccctccagccccagaagattaattcggagaacgctgacgccctggcccagctgctcactctcgcgcgatggatccagactgtactcgccagaatatcaggatacaacatcagacacgcgaaaggagagaaccctattccgatattcttcaatcagggaatgggcgattcaaccctggagttccactctatcctctccttcggcgtggagtcaagtataaagtatagcaattccatcaaggaaatggtgatattgttcgctaccaccatatacaggatcgggcttaaagtgccgccagacgaaagagaccccagagttccaatgctcacatggagtacctgcgctttcaccattcaggccatcgagaacctgctaggggatgaaggcaagcccctgttcggggctctccagaatagacagcacaacggactgaaggcactgatgcagtttgcagtggcacagcgaataacatgtccacaagtgttgatacagaagcaccttgtccgattgctgagcgttgttctccctaatatcaaatctgaagacacaccttgcctcctgagcattgacctgttccacgttctcgtcggagccgttctggctttccctagcttgtactgggacgatccagttgacctacagccttcttcagtgagcagttcatataaccatctatatctgttccatctgattaccatggctcatatgctgcaaattttgctgaccgtagataccgggctccccttagcacaggttcaggaggactcggaagaggcccatagcgccagttctttctttgcagaaatttcccaatacacatctggaagtataggttgcgacatcccaggatggtacctctgggtgagtctgaagaacggcatcacaccctatcttcgctgcgcggctctgttttttcactacttgctgggagtgaccccccctgaggagttacacacaaattcagctgagggggaatattccgctctttgctcctacctgtccttgcctacaaacctcttcctgctcttccaggagtattgggatacagtccggccacttctacagcggtggtgcgctgatccggctttgctgaattgtctaaaacaaaaaaatacggtggtccggtatccacggaaaaggaactcgttgattgaactgcccgacgactacagctgcctgctgaatcaggcctcccactttcgatgcccccgatcagccgatgatgagagaaagcatcctgtgctttgtctgttctgcggcgctatcctgtgctctcagaacatttgttgccaagagattgtcaacggcgaagaggttggtgcatgtattttccacgcactgcactgtggtgcgggagtgtgtatctttctgaagatacgtgagtgtcgcgttgtactggtggaagggaaggcacggggttgcgcctaccctgctccttacctggatgaatacggcgagactgacccgggactcaagagaggtaaccctttgcacctgagtagggaaaggtacaggaaactgcatctcgtgtggcagcagcattgtatcattgaagagatcgcaagaagccaggaaacaaaccagatgctgttcgggttcaactggcaactcctttar

SEQ ID NO: 245927 - DNA, 2412 bp, Artificial Sequence
  Description of Artificial Sequence: Synthetic coding sequence
atggctgacgaggaggccggtggcacggagcgcatggaaatcagtgcggagctgccacaaacacctcagcgcttagctagttggtgggaccagcaagttgacttctatacagccttcttacaccatctcgcacagctagtacctgaaatctatttcgcggaaatggatcctgacctggaaaaacaggaagagagcgtccagatgtccatctttactcctctggaatggtacttattcggagaggatccagatatctgtctggagaaactcaaacattctggcgctttccagctttgcgggcgagttttcaaatctggggaaaccacatacagctgtagagattgcgccatcgacccgacctgcgtcttgtgtatggactgcttccaagacagcgtacacaagaatcacaggtacaaaatgcacacttcaaccggtgggggtttctgtgactgcggtgacactgaggcttggaaaacgggtcctttctgcgtgaaccacgagccaggacgtgccggaaccataaaggaaaacagtaggtgccccttgaatgaagaggtgatcgttcaggctcggaaaatctttcctagtgtgattaaatacgtcgttgagatgaccatttgggaggaagaaaaggagctcccccctgagctgcagatcagagaaaagaatgagaggtattactgcgtgctgtttaatgatgaacaccactcttatgaccatgtgatctacagcctgcaaagggccttggattgtgaactcgcagaggcacagctacacactacagcaatcgacaaggaggggaggagagccgtgaaagcgggagcttacgccgcttgccaagaggctaaagaggatataaaatcacactcggagaatgtatcacaacacccacttcatgtggaggtcctgcactcagagatcatggcccaccagaagtttgctctgaggctcgggtcttggatgaataaaatcatgagctattcttccgacttcaggcaaatcttttgccaggcatgtctgcgcgaagagccagactccgagaacccatgtctcatttcacgccttatgctgtgggacgccaaattatataagggagctcggaagatacttcacgagctgattttttccagttttttcatggagatggagtataagaagctgtttgcaatggagtttgtaaagtattacaagcagttgcagaaagagtacatctctgacgatcatgaccgcagcatttctattaccgctctgagcgtgcagatgttcacggtcccgactctcgcacggcatctcatcgaggaacagaatgtgataagcgtaatcactgaaaccctactcgaagttttgcctgagtatttggacagaaacaacaagtttaactttcaggggtattcccaagacaaattagggagggtgtacgccgtgatctgtgacctcaagtacatcctgatctcgaagcccactatctggaccgagaggctgcgcatgcaatttctcgagggattcaggagcttcttgaaaattttaacgtgtatgcagggtatggaggagatcagaagacaggttggccagcacatcgaagtcgatcccgactgggaagctgccatagccatacagatgcagcttaagaatattcttctcatgttccaggagtggtgcgcatgcgatgaggagcttctgctcgtagcgtacaaagagtgccataaagctgtgatgcgttgcagtaccagcttcatttcctctagcaaaactgtggtccagagctgcggccatagcctcgagacaaagagttatcgtgtctccgaggacctggtttccatccacttacccctgtcacgtactctagctgggttgcacgtgcgcttatccaggctcggcgcagtcagtcgtttacatgaattcgttagctttgaggactttcaggtcgaggtactggttgaatatcccctgcgatgtctggtccttgttgctcaggttgttgcagagatgtggcgccgaaatggattgagtctcatcagtcaagtgttttattatcaggacgtcaagtgccgagaagagatgtatgacaaggatatcataatgctccagatcggagcctctctgatggacccaaacaaattcctgctactggtcctccagagatacgaattggctgaagcctttaacaagaccatttccaccaaggaccaagacttgatcaaacagtataatactctcatcgaggaaatgctgcaagtactcatttacatcgtgggtgaaaggtatgtgccgggtgtgggaaacgtgaccaaagaagaggtaactatgagggagattatccatcttctgtgcattgagcccatgcctcatagcgcgatcgcaaaaaacctgcctgagaacgaaactagatgcatacggccatggtcgctgtag

SEQ ID NO: 245928 - DNA, 3042 bp, Artificial Sequence
  Description of Artificial Sequence: Synthetic coding sequence
atggccgacgaagaggctggcggtaccgagagaatggagatatctgcagagctgcctcagacacctcagagactggcctcctggtgggaccagcaggtggacttttatactgcattcttgcaccacctagcacagctggtgccggaaatctatttcgccgaaatggaccccgaccttgaaaagcaggaggagagcgttcagatgagtatttttacccccctggagtggtatcttttcggggaggatcccgacatttgcctggagaagctgaagcattctggagctttccagctgtgcggacgagtcttcaaaagtggggagactacttattcctgcagggactgtgctatcgaccccacctgtgtgctgtgcatggattgcttccaagattcagtacacaagaatcacaggtacaagatgcacacttccactggaggagggttctgcgattgcggggacactgaagcttggaaaaccggacctttttgcgtcaatcatgagcctgggagggctggcacaatcaaagagaactctaggtgccctctcaatgaagaggtcatcgtgcaggctcggaagatctttcccagcgtgattaaatacgtcgtggagatgaccatctgggaggaggagaaagaactaccccctgagttacagatccgggagaaaaacgaaaggtattactgcgtgctcttcaacgacgaacatcatagctatgaccacgtgatttactccctgcagcgagcactcgactgtgaactggcagaggcacagctgcatacaactgcaatcgacaaagagggccgtcgcgctgtcaaagcaggagcatacgcagcatgccaggaggccaaggaggacattaagtcacattccgagaacgtgtctcaacatcctctgcatgttgaagtcttacacagcgaaataatggcccaccagaagttcgcactccggctaggatcgtggatgaacaaaatcatgagttattcctccgacttccggcaaattttttgccaggcatgtctgagggaagagccagattccgagaacccttgtctgatctcaagactgatgctgtgggacgcaaaattatacaagggagcccgaaaaatcctccatgaactgatctttagcagcttctttatggagatggagtataaaaagttattcgctatggaattcgtgaagtactacaagcagttacagaaggagtatatttccgatgaccatgatcgatcaatcagtataacagccctcagcgtacagatgtttacagtcccgacactagctcggcacctgatcgaggaacagaacgtgatctcagtgatcactgaaacccttctggaagtactgcccgagtaccttgatcgaaacaacaaattcaatttccaaggctactcacaggacaagctcggaagagtatatgccgtcatctgtgatttgaaatacattttgatcagcaagcccacaatctggaccgagcggctcaggatgcagtttctcgagggctttaggtctttcctgaaaatattgacttgtatgcaaggaatggaggagatccggcgacaagtcggtcagcacatcgaggttgaccccgactgggaggctgcaatcgccatacagatgcaacttaaaaatatacttctgatgttccaggagtggtgtgcgtgcgatgaggagcttctgctggtggcttataaggagtgtcataaggctgtgatgcgctgctccacaagcttcattagctcttcaaagaccgtcgtacagtcatgcgggcacagccttgagacgaagagctaccgcgtgtctgaggacctggtatcgatccatttaccactcagccggaccctggccggtctgcacgtgcggctgagtcggctcggcgctgtctctcgcctgcatgagtttgtatcctttgaagatttccaggtagaagtactagtggaatatccactgagatgtctggtgctcgtggcacaggtcgtggccgagatgtggaggcggaatgggttgtcgctgatcagccaggtattctactatcaggacgtgaagtgccgagaagagatgtatgataaagatatcatcatgctccagattggggctagtttaatggaccctaataagttcctgctcttggtcctgcagcgatacgagctggctgaagcttttaacaaaactatctctactaaagatcaggatctgatcaagcagtacaacaccctgatcgaggaaatgttgcaggtcctcatttatatagtgggtgaacggtatgttcctggcgtggggaacgttaccaaggaggaagtcactatgagagagattattcacctgctgtgcatcgagccgatgcctcactccgccattgccaaaaatctgcctgaaaatgagaacaatgaaacaggcctggagaacgtgataaataaagtcgctaccttcaagaaacctggcgtatccgggcacggtgtttacgaattgaaggacgaatctttgaaggactttaatatgtatttttatcattatagcaagacccagcactctaaggccgaacatatgcagaagaaaagacggaagcaggaaaataaagatgaagctctgcccccacccccaccacccgagttctgccctgccttcagcaaggtgatcaacctgctaaattgcgatatcatgatgtatattttaagaacagtgtttgagagggcaatcgacaccgattcaaacttatggaccgaaggcatgctgcagatggcgtttcatattctggcactagggcttctggaggaaaaacagcagctacaaaaggccccagaagaggaggtgacctttgatttctatcataaggcctccaggttgggatcatctgcaatgaacatccaaatgctgctggagaaattaaaaggaatccctcagttagaagggcaaaaagacatgattacctggatcctccagatgttcgacacagtgaagaggttacgtgaaaagtcatgtctcattgtggcaacaacaagcggatctgagagcattaagaatgacgagatcctgcatcactag

SEQ ID NO: 245929 - DNA, 1728 bp, Artificial Sequence
  Description of Artificial Sequence: Synthetic coding sequence
atgtacgcgggtaatattcctatctataaaaccgaatcacgctcgcgtaacgaacagggcatggaccccattacacgacaggtgggacagcacattgagatggaaccagaatgggaggctgctttcacccttcagatgaaactcactcacgtaatatcgatgatgcaggattggtgcgcctctgacgagaaggttctgatagaagcctacaaaaaatgcttagccgtgctaatgcagtgccatgggggatacactgacggggagcagcctataacattatcaatctgtggacattcagtagaaaccattaggtactgcgtaagccaggaaaaggtctccatccatttacccgtgagtcgcctgctcgccggactacatgtgctgctctcgaagtccgaagttgcatacaagttcccggaactgctgccccttagcgagctttctcctccgatgttgatagaacacccccttaggtgcctggtgctgtgcgcccaggttcatgccggtatgtggcgaaggaatggcttcagcctggtcaaccaaatctactactatcacaatgtgaagtgtcggcgtgaaatgttcgacaaagacgtggtaatgctacagactggtgtctcaatgatggatcctaaccattttctgatgataatgctgagccggtttgagctatatcaaattttcagcacaccagattacggcaaacgattctcgtccgagattacacacaaagatgtggttcagcagaataacacattgatcgaagaaatgctgtatctcatcatcatgttagtgggggagcgcttctctcccggagtcggtcaggtcaacgccactgacgagattaagagggaaatcattcaccagctgtctatcaagccaatggcccatagcgagcttgtaaagtccctgccagaagacgagaacaaggagacaggcatggagtcagtcatcgaggcagtagctcacttcaaaaaacctggcctcacaggcagagggatgtacgaactcaagcctgagtgtgcaaaagagtttaacctgtacttctatcacttcagccgcgctgagcagagcaaagctgaggaggcacaacgtaaactcaagcgccaaaacagggaggatacggcgcttccgccaccagtgctgcccccattctgcccactgtttgcgtccttggttaacattctgcagagtgacgtgatgttatgtatcatggggaccatcctgcaatgggccgtagagcacaatggatatgcctggtcagagagtatgctccagcgcgtgcttcacttgatcgggatggccctgcaagaagagaaacagcacctagagaacgtgactgaagagcatgtcgtaacattcaccttcacccagaaaatatccaagcctggagaagcacctaagaactctccgtccattcttgccatgctcgagaccctgcagaatgccccatacctggaggtgcacaaagatatgattcgatggatacttaagaccttcaacgctgtcaaaaagatgcgcgaatcttcccccacatcgcctgtcgctgagaccgagggcacaattatggaagaacacaatttccgcgttcaaggcacaaagaccaagctgagaggcagagaaaagcagagactccccgactgtgctgagaaacgatcttggctgagatgccttaagtgctccgggattctgctcatgaagaccaaaaactcttttagcagacattag

SEQ ID NO: 245930 - DNA, 5267 bp, Artificial Sequence
  Description of Artificial Sequence: Synthetic coding sequence
atggcctccgagctggagccagaagtccaggccattgacaggagtttgcttgaatgttccgcagaagagatagctggcaaatggctgcaagctacggacctcactcgtgaagtgtaccagcacctcgcccactacgtgcctaagatctattgccggggtcctaatccctttccgcagaaagaagacatgttagcgcaacatgtgctgctggggccaatggagtggtacctctgcggagaagaccccgcattcggctttcctaaactcgagcaggcgaacaagccaagccatttgtgcggaagggtcttcaaggttggggagcctacttatagctgccgcgattgcgccgtggacccaacctgcgttttgtgcatggagtgctttcttggctccatccatagggaccaccgctaccgaatgacaactagcggcggaggaggattttgtgattgtggcgacactgaggcatggaaggagggcccatattgccagaaacatgaactcaatacttctgaaatcgaggaggaggaggaccctctggtgcatcttagcgaagatgtgattgcgcgaacttataatatcttcgcaatcacatttcgctacgctgttgaaatattgacttgggaaaaggaatccgagctgcccgctgatctggaaatggttgagaagtcagatacctattattgtatgctgttcaacgatgaggtccatacttatgagcaagtgatatacactctccagaaggccgttaactgtacgcagaaggaagctatcggatttgctaccacagtggacagagacgggcgtcggtccgtcaggtacggcgattttcagtactgcgagcaagccaagtcagttatcgttaggaacacctccaggcaaaccaaacccctgaaggtgcaggttatgcatagcagcattgtcgcgcatcagaactttggcctgaagcttctgtcttggctcggatccatcattggatatagtgacggcttgaggcgaattttgtgccaggtcgggctgcaagaaggaccagacggagagaatagcagcctggtagatagattaatgctaagcgacagcaagctctggaagggggcacgcagtgtttaccatcaactttttatgtctagcctcttaatggatctgaaatataagaagctgtttgcagtcagatttgccaaaaattatcagcaactgcagcgcgattttatggaggatgaccatgaaagagcagttagcgtgacagctctgtcagtgcagttcttcactgccccaacccttgcccgaatgttaataactgaggagaaccttatgtctattattatcaaaacatttatggatcacctccggcaccgcgatgcccagggacggtttcaatttgaacggtacactgccctgcaagctttcaaattcagacgggtccagtccctcattttggatctgaaatatgtcttgatttcgaagcccaccgaatggtcagacgagttgcgccaaaagtttctcgaaggcttcgacgcctttttagaactcttgaagtgcatgcagggcatggaccctattaccagacaggttgggcagcacattgagatggaaccagagtgggaggccgcttttactctgcaaatgaagcttacacatgtgatctcaatgatgcaggactggtgcgcatctgacgagaaggtgcttatcgaggcttataaaaagtgcttggccgtcctcatgcagtgccatggcggttacacagacggagagcaacccattactctctccatttgcggacatagcgtggaaaccatcaggtattgcgtctcgcaagaaaaagtcagcatccacctacccgtgagtcgcctgcttgcgggactgcatgtgctgctaagcaaatcagaggttgcttataaattccctgagctgctgcccttgagcgagctgagccccccaatgctgatcgaacatcccctgcgctgtctggttctgtgtgcccaggtacatgctgggatgtggagacgaaatggctttagtctggtgaaccagatctattattaccataatgtgaagtgtcgtcgagaaatgttcgacaaagatgtcgtgatgttacagaccggtgtgagcatgatggatcccaatcacttcctgatgattatgctgtcgcggtttgaactctaccagatcttttctacccctgactatgggaagaggttttcctctgaaattacacacaaagacgtggtgcagcagaataacacgctgatcgaagagatgctgtatctgatcataatgctggtcggagaacggttctctcctggtgtgggtcaggtgaacgccaccgacgagatcaagagagaaatcattcatcagctttccattaaacccatggctcattccgaacttgttaaatctctaccagaagatgagaataaagagactggcatggagtccgtcattgaggcggtggcccacttcaaaaaacctgggctgaccgggaggggcatgtatgagttgaaaccagaatgtgctaaggagtttaatctgtacttctaccatttctcacgagccgaacagagcaaggcggaggaagcccagcgtaaactgaagagacagaacagggaggacacagccttaccgccacccgtgttacccccattctgccctctgttcgctagcctggtgaatatattacagagcgacgtcatgctgtgcattatgggtaccatactgcagtgggctgtcgagcacaatggctacgcgtggagtgaatctatgctccagcgcgtgttgcatttgataggtatggccttgcaggaggaaaagcaacatctcgagaacgtgactgaagagcatgtagtcaccttcacattcacccagaagatcagcaagcccggagaggccccaaagaattctccatctatccttgctatgctggaaaccttgcaaaatgctccctacctcgaggtgcacaaagatatgattcgatggatacttaagacctttaacgctgtcaagaagatgagagaatcctccccaacctctcctgtcgcagagaccgaaggaaccattatggaagaaagctcacgagataaagacaaggccgaaagaaaaagaaaggccgagatcgctaggctccgcagggaaaaaatcatggcccagatgtccgagatgcaacgccattttatagatgagaataaggagctgttccagcagactttagagttagatgcttcgacatccgccgtactagatcattctcccgtggcctcagacatgactctcacagctttgggcccagcacaaacgcaggttcccgagcagaggcagttcgtcacatgtattctttgccaggaggagcaggaggtcaaggtggaaagcagggcgatggtgctcgctgcatttgtgcagcgatcaaccgttctgagcaagaaccgctccaagtttatacaagatcctgagaaatatgacccattattcatgcaccccgacctgagctgcggcacgcatacaagttcgtgcggccacattatgcacgcacactgctggcagaggtacttcgactccgtgcaggcgaaggaacagcggagacagcagcggttgcgcctgcacacatcttatgatgttgagaatggggagttcctctgcccattgtgcgaatgtcttagtaatacagtgattcccttgctgctgcctcccagaaacatatttaacaatcgactcaatttctctgatcagcctaaccttacgcagtggatcaggacgatatcacagcaaatcaaggctctgcagttcttaagaaaggaagagtcgactcccaataacgccagcacaaaaaatagcgaaaacgtagacgagctgcagcttccagagggatttcggcctgacttccggccaaaaatcccgtacagtgagagcatcaaggagatgttgacgacttttggaaccgccacttacaaggtaggcctgaaggtgcatcccaatgaggaagatcctcgagttccaattatgtgctgggggtcttgtgcatacaccatccagagcatcgagcgtattttgtccgacgaagacaagcctctcttcggtcccctgccttgtagactcgatgactgtttgcgttctctgactcgtttcgccgctgcccattggacggtggcttctgtgtccgtcgttcagggacacttttgtaaactctttgccagcctagttccgaacgattcgcacgaggagctgccttgtatactggacatagacatgttccaccttctggtggggttagtcttagcgtttcctgcactgcagtgccaggatttcagcggtataagcctcggtacaggcgacttacacatatttcacttagtgactatggctcacatcatccaaattctgttaacaagctgcacagaggaaaacgggatggaccaggagaaccctccctgcgaggaagagtctgcggtgcttgctttgtataaaactctgcaccagtacacagggtctgcactgaaagagatcccttccggctggcatctgtggagaagtgttagagctggtattatgccattccttaagtgtagtgcgctgttctttcattacttaaacggggtgcccagccccccagatatccaggtgccagggactagccactttgagcacctttgcagttatctgagcctgccgaacaaccttatatgtttgtttcaggaaaattccgagataatgaattcgctcatcgagtcctggtgtcggaattcagaagtgaaacgttacctggagggagagcgtgacgccatccgctaccccagggaaagcaataaactcatcaatctgccagaagactacagctctctcatcaaccaagcctcaaatttctcatgtccaaaaagtgggggagacaaatcaagagctcctaccctttgcctagtgtgcggttcgctgttgtgctcccagagctactgctgccaaactgagcttgagggagaggacgtcggcgcatgcaccgcacacacctactcctgtggcagcggggtcggcattttcctcagggtgagagaatgccaggtgttgttcctagccggaaagacaaaaggttgtttctacagcccaccctacctcgacgattatggcgagactgaccaaggactgaggcgcggtaatccccttcatttatgtaaagagaggttcaaaaaaatccagaaactgtggcaccagcattctgtgaccgaggaaataggacacgcccaggaggccaaccagacgttagtgggtattgactggcaacacctcta

SEQ ID NO: 245931 - DNA, 5267 bp, Artificial Sequence
  Description of Artificial Sequence: Synthetic coding sequence
atggcaagtgagctcgaacctgaagtacaagccatagaccgcagtctcctggagtgttcggctgaagaaatagcaggaaaatggctccaggctaccgatcttactagggaggtataccaacatctggcgcactacgtccccaaaatctattgtagaggacccaatccatttccccaaaaagaggacatgttggctcaacatgtgcttctcgggccaatggaatggtatttgtgtggggaggatccggcatttggcttcccaaaattagagcaagcaaacaagccctcccacttgtgcggtcgggtttttaaggtgggggaacccacttactcctgtagggactgcgcggtcgaccctacctgcgtgctgtgtatggagtgcttcttaggatctattcatagagaccaccggtaccgaatgactactagcgggggtgggggtttttgcgactgtggcgataccgaggcctggaaagagggaccttactgtcagaagcacgaactcaatactagcgagatagaggaagaggaagatccactagttcatttatccgaagacgtgatcgcgaggacgtacaacatattcgccatcacatttagatacgccgtggaaatcctgacgtgggagaaagaatccgagttgcctgccgacctagaaatggttgagaaatcagacacatattactgtatgctttttaacgacgaagtccacacatacgagcaggttatttatacgctccagaaggccgtaaactgtacgcaaaaggaggctatagggttcgctactacagttgatagggatgggagacggagcgtgcggtacggtgattttcagtattgtgagcaggccaagagcgttatcgtgcgaaatacttctaggcaaacaaagcccctcaaggtgcaggtgatgcactccagcatcgtcgcacaccagaacttcggcctgaaactcctgtcctggctggggagcatcattgggtatagcgacggcctgcgtaggattctctgccaggtcgggctgcaggagggtcctgacggggagaacagttctttagtcgaccgcctcatgctgtccgacagtaaactgtggaagggcgctcgaagtgtgtatcatcagctgttcatgtcttcccttttgatggacttgaaatataagaagttgttcgccgtgcggttcgccaaaaactacgagcgtcttcagtccgattacgtgacggacgaccatgaccgggaattcagcgtggcagatttgagcgtgcaaatatttaccgtcccaagccttgccaggatgcttatcacagaggaaaatcttatgtctattattataaaaacctttatggaccatcttcggcatcgggatgcacagggcagattccaatttgagcgctatactgccctacaggcctttaaatttcgccgagttcagagcctgatactggatttgaaatacgtgttgatcagcaagcctacagaatggtcagatgagctccggcagaaatttcttgagggattcgacgcatttcttgaactgctgaagtgcatgcaggggatggacccgatcaccagacaggtcggacagcacatcgaaatggaaccagagtgggaggccgcattcaccttacagatgaaactgacgcatgttataagcatgatgcaagactggtgcgcttctgacgaaaaagtgttgattgaagcttacaagaaatgcttggccgtactgatgcagtgtcatggaggctacactgatggcgagcagcctattactcttagcatctgcggacattcagtggaaaccatccggtattgcgtttcgcaggagaaggtgagcatccatttaccagtgtctagactcctggctggcctccatgtattgctgtcaaaatctgaggttgcttacaagtttcctgagcttttgccactgagcgaactttcccccccaatgttaatcgaacacccactgagatgcttggtgctgtgcgcccaggtgcacgccggaatgtggcgaagaaacggtttcagccttgtcaaccagatctactactatcacaatgtcaagtgccggagggagatgttcgacaaggatgtcgttatgctgcagacgggtgtgagcatgatggatccaaaccattttctgatgatcatgcttagcagatttgaactgtatcaaatcttcagcacacctgactacgggaagcggttctcctccgagatcacccataaagatgtcgtgcagcagaacaacactttgatcgaggagatgctgtacttgataattatgcttgttggagaacgcttctctccgggagtgggccaggtgaacgccactgatgaaatcaagcgggaaatcatccatcagttgtcaattaagccgatggcgcactctgagctcgttaaatctctgccagaagatgagaataaggagacaggcatggagagtgtcatagaagctgtggcccattttaaaaagcctgggctgaccggccgtggaatgtatgaactgaaaccagagtgcgctaaggaattcaacctgtacttttatcatttcagtagggccgagcagtccaaggctgaggaggctcagaggaagctgaagcgacaaaatcgggaggataccgctctgcccccacctgtcttaccccctttctgccccctgtttgccagccttgttaatatcttacaatcggacgtcatgctgtgtatcatgggcactattttgcaatgggcagtcgagcataacggttacgcatggtcagagagcatgctgcagcgcgttctgcacctaatcggaatggcgttgcaggaggagaagcagcacctcgaaaacgtgaccgaggaacacgttgtgacattcaccttcacccagaagatctcaaaacccggtgaggcaccgaagaactccccctccatcctcgctatgctggagacacttcagaatgctccatacctagaagttcacaaagacatgattcgatggatcctaaagacctttaatgcagtcaagaaaatgcgcgagagcagccccacatctccagtggccgaaacagaagggactatcatggaagagtcctcaagagacaaagataaggctgaaagaaagcgaaaggcagagattgctcgtctcaggcgtgaaaaaatcatggcacagatgagcgaaatgcagagacattttatcgatgaaaataaagaactgtttcaacaaacacttgagcttgatgcatccacctcagccgtgctggatcactctccagtcgctagcgacatgacccttactgcgctcggcccagcccagacacaggtacccgagcagcgtcagttcgtgacctgcattctgtgtcaagaagaacaggaggtcaaagtggagagccgggcaatggttctcgctgctttcgtccaaaggtctactgtgctttcaaagaatagatcaaagttcatccaggaccccgagaaatacgatcccttgttcatgcatccagatctgtcctgtggtactcatacttcttcatgtggccatatcatgcacgcccattgctggcagcggtactttgactctgtgcaagccaaagaacagcgcagacaacaacgattgagactccatacttcttacgacgttgaaaatggtgagttcttgtgcccactgtgcgagtgtttatctaacacagttatacccctattactcccccctcgtaatatttttaataatcgactgaactttagcgaccagcccaatttaactcaatggatccggacaatttcgcagcaaatcaaggctctgcagttcctgcgcaaggaggaatctaccccaaataatgcaagcactaagaattcagaaaatgtggacgaattgcagctgccagaggggttccggccagatttcaggcccaagattccttactctgagagtatcaaggagatgctcacaactttcgggacggccacctacaaagtagggctcaaagtgcatcctaatgaagaggaccctcgggttccaattatgtgttgggggtcatgcgcttacacgatccaatcaattgagaggatcctttccgatgaggataaacctctcttcgggccactcccgtgcagactggatgattgcctaaggagcctgacccggttcgccgcagcacactggactgttgccagtgtgtcagtggtccagggtcatttctgcaagctgtttgcctcactggtgcctaatgactcacacgaggagctgccatgtatcctagatatcgacatgtttcatctgcttgttggtctggtgcttgcatttcccgcactgcagtgtcaagactttagcggaatttctctcggaaccggggaccttcacatcttccatctggtgacgatggcccacataatccagattttgctcacttcctgtaccgaagaaaacggtatggatcaggaaaatcccccatgcgaggaagaaagtgccgtgttagctttatataaaaccctgcatcaatataccggttcagcactcaaagaaatcccctcaggatggcacctgtggagatctgtaagagccggaattatgccatttcttaagtgctctgcccttttcttccactacctgaacggtgtaccaagccctcctgacatacaggtgccaggcacctcacactttgagcacttgtgctcctatcttagtctacccaataatctgatctgcctattccaagaaaattctgaaattatgaacagcctgattgaatcatggtgtcgcaactcggaggtgaaacgttaccttgaaggcgagagagatgctataagatatccccgagaatctaataaattaataaacttacccgaagattacagttctctgattaatcaggcctcgaacttctcctgccccaagtctggaggggacaaatctcgcgcacctaccctctgcctcgtgtgcgggagtctcctctgcagtcagtcttactgttgtcagaccgagctggaaggagaggacgtaggggcatgcaccgcacacacttacagttgtggctccggagttgggatcttcctgcgcgttcgcgaatgtcaggtcctcttccttgccggtaaaacgaaaggctgcttctattccccaccatatcttgatgactacggtgagacagaccagggcctcagaagaggtaatcccctgcatctgtgtaaagagaggttcaagaagattcagaagctgtggcaccagcactcggtgactgaagagatcggtcacgcccaggaggcaaatcagaccttagtcggaatcgattggcagcatctgta

SEQ ID NO: 245932 - DNA, 1320 bp, Artificial Sequence
  Description of Artificial Sequence: Synthetic coding sequence
atggcctctgaactggaacccgaggtacaggccatcgatagaagtttactcgaatgttctgccgaagagattgccggaaaatggctgcaggccactgatttgaccagagaggtctaccaacatctggctcactacgtacccaagatttattgccggggacccaaccctttcccacagaaggaggacatgctggctcaacatgtattgctgggacctatggagtggtatttgtgtggggaagatcctgcatttgggttccccaagctggaacaagcaaacaagccaagccacttatgcgggagggtctttaaagttggcgagcctacctatagctgtagggactgtgcggtcgacccaacttgtgtgctttgtatggaatgtttcctggggagcatccaccgggatcacagataccgtatgacgacaagcggaggcggaggtttctgcgattgcggagatacagaagcatggaaggagggaccctactgtcagaagcatgagctcaatacctccgaaattgaagaagaggaagatccactcgtgcacctttccgaagacgtcatcgcgcgaacttataatattttcgccataactttccgctatgctgtggaaatactgacttgggaaaaggagagcgagctaccagcagacttggaaatggtggaaaaaagtgatacatactattgtatgctttttaacgatgaggttcatacttacgagcaggtcatttatacactgcagaaggcagtgaactgcacccaaaaggaagccattggctttgctaccaccgtggaccgggacggaaggcggtccgtcaggtacggcgacttccagtattgcgaacaagctaagagcgttatcgtgaggaatacctctcggcagaccaaacctcttaaggtgcaggtaatgcacagcagtatcgtggcccatcagaacttcggtctcaagcttctttcttggctcggatctatcatcgggtatagcgacggcctcaggcggattctgtgtcaagtgggattgcaggaaggccctgatggagaaaacagctcgttggtcgacagattgatgctgagcgactccaaattgtggaagggagctagaagcgtctaccaccagctgtttatgtcatctttattgatggatctaaagtacaaaaagctcttcgccgtcaggtttgccaagaattacgagcgacttcaaagtgattacgtcacagatgaccacgatcgcgagttcagcgtggcggaccttagcgttcagattttcaccgtgccaagcctttttagcatcagtgccggaagatctgggtcccccctgtag

SEQ ID NO: 245933 - DNA, 5667 bp, Artificial Sequence
  Description of Artificial Sequence: Synthetic coding sequence
atggcagccgcagcggctgccgcagttgggggacaacaaccctctcagcctgagttacctgcccctggcctggcactagataaagccgctaccgccgcacacctcaaggctgccctctctagacccgacaacagggccggagccgaagagctgcaagcactgttggagagagtgctctccgccgagaggcctttggcagcggcagctggtggggaggacgccgctgctgccggaggcggagggggtccaggtgcagctgaggaagaggcattagagtggtgtaagtgcctgctcgccggaggaggaggctatgacgagttctgcgccgctgttcgtgcatatgatcccgctgctctttgcggccttgtttggaccgctaatttcgtcgcctatcgctgcaggacttgtgggatctctccatgtatgtctctgtgcgccgagtgctttcaccaaggcgatcacactggacatgattttaacatgtttaggtcgcaggctggcggagcttgtgactgcggagacagcaatgtgatgagagagtccggcttttgcaagcgacatcagataaagtcatccagcaacatcccttgtgttccaaaggacctgctaatgatgtcagagtttgttctgcccagatttatcttctgcctgatccagtatctgcgcgagggatataatgagccagccgcagacggtccatctgaaaaggacctgaataaggtgctgcagcttctggagccccagatttcctttctggaggacctgaccaaaatgggcggagcgatgcgcagtgtcttaacacaggtgctcaccaaccaacagaactataaagacttaacctcaggactaggggagaatgcctgcgttaaaaaaagccatgaaaaatatctgattgctctgaagagtagcgggttgacctaccctgaggacaaattggtctatggtgtgcaggagcccagcgccggtacttcttcgctggctgtccagggtttcattggcgcaacaggaacactgggacaggtcgattctagcgatgaggacgaccaggacgggagtcaggggctgggtaagcggaagcgggtcaagctttccagcggcaccaaagatcagtccatcatggacgtcctgaaacataagtccttcctggaagagctgttgttctggaccataaagtacgaattcccccaaaagatggtaacgttcctgcttaatatgttgccggaccaggagtacaaagtcgcatttaccaagacatttgttcaacattacgcgtttataatgaagacactgaaaaagagtcatgagtcagatactatgagtaatcgcattgtgcatatctcagtgcaacttttctcaaacgaagaactggccaggcaggtgactgaagaatgtcaactgcttgatattatggtcaccgtccttctgtacatgatggagtcctgccttattaagtcagaactgcaggacgaagaaaatagcctgcatgtggtggtcaactgtggcgaggctctactgaaaaacaatacatattggccactggtgagtgattttattaacatcctcagccaccaatccgtcgctaaacgtttcctagaagatcatggactgctggtaacctggatgaactttgtgtcttttttccagggtatgaatctgaacaagagggagctcaacgagcacgtggagttcgagtcccagacttactacgcagccttcgccgctgaactggaagcatgtgctcagccaatgtggggacttctttcccactgtaaggtccgcgagacccaagagtatacacgaaacgttgtgcggtactgtcttgaagcgctgcaggactggtttgacgctataaattttgtggatgagcctgccccaaaccaggtcaccttccacctgccattgcatcgctactacgccatgttccttagcaaagcggtgaaatgccaggaactcgacctagacagcgtgctccctgaccaagagatgttgatgaaactgatgattcaccccctccagatccaagcttcactagcggagattcattctaatatgtgggtgagaaacggtttgcagatcaagggccaggccatgacgtatgtacagagccatttctgtaactcaatgatcgatccagatatatatctgctgcaagtttgcgcctcacgcctcgatccggactactttatcagttcggtctttgaacgcttcaaggtggtggatctgctcaccatggcatctcagcaccagaacactgttctggacgccgagcacgaacggtcgatgctcgagggggctctaacttttcttgtaatcctgttgtcactgcggctccacttaggcatgtccgacgacgagattctcagagccgagatggtggcacagctctgtatgaatgacagaacccactcaagtctgttagacctgataccagaaaatcccaaccctaaatcaggaattattccaggctcttatagtttcgagagcgtgctgagcgctgtagccgactttaaagctcctgtctttgagcctggcggaagcatgcagcaggggatgtatacccccaaggccgaagtttgggatcaggagttcgatcccgtcatggtgattctgaggaccgtgtatagaagggatgtgcagagtgctatggacaggtataccgccttcctcaaacagtccggaaaattccccggaaatccttggcctccatacaaaaaacgaacatcactgcacccctcttacaaggggttgatgaggcttctccattgtaagacacttcacatcgtcctgtttaccttgctttacaagatactcatggaccaccagaatctttctgagcacgtcctgtgcatggtattgtaccttatcgaacttggtttggagaattccgccgaagaagagtccgacgaggaagccagtgtgggaggacccgagcgatgccacgacagctggtttcctggatccaacttagtgtcgaacatgcggcacttcataaattatgtcagggtgcgcgttccagagacagcacccgaagtgaagcgtgacagccctgcctcaacatcaagcgacaatctgggctcccttcagaactccgggaccgcacaagtattctcattggtcgccgaacgacgtaagaagttccaggaaatcatcaataggtcttcctctgaagcaaatcaggttgtgaggccaaagacctcttctaagtggagtgctcctgggtctgccccacaattgacaacagccatcctcgagatcaaagagtcaattctgtccctgctgataaagctgcaccataagttgtctggaaaacagaattcatattatccaccatggctcgacgacatcgaaattcttatccagccagagattcccaaatactcccacggcgacggtattacagcggttgagcgcattctgctgaaagcagcttctcagtcccgcatgaacaaacgcataattgaggaaatatgtagaaaagtcacccctcccgtccccccaaaaaaggttacagcggctgagaagaagacccttgacaaagaagagcgacgacagaaagcaagggagcgacagcagaaattattggctgaattcgcttcccgccagaagagttttatggagaccgcaatggatgtggattctccagaaaatgacattcctatggaaataactaccgccgagccacaggtgagcgaggccgtctacgactgcgtcatatgcggccaatctggtccttcgagtgaagaccggccaaccggtttagtggtcctcctgcaggcatcctccgtgctcggacagtgccgtgataacgtcgagcccaagaaactacctattagcgaggaggagcaaatatacccctgggacacatgcgcggcagtgcacgacgtgcgtcttagtctgctccagcgctatttcaaagactccagctgcctgctcgctgtgtctataggctgggaagggggagtatacgtacagacctgtgggcacaccctccatatcgactgccacaagagctacatggaaagcctgagaaacgatcaggtgttgcaaggcttttccgtcgataagggagagttcacctgtcctctgtgccgacaattcgcaaactctgttcttccgtgttatcccggatctaatgtcgaaaataatccatggcaacggccatccaacaagagcatccaagatctcatcaaggaggtggaggagctccagggccgtcccggagccttcccatccgaaacaaatttgtctaaagagatggaatccgtgatgaaagacatcaaaaataccactcagaagaaataccgcgattactctaaaacacccggatcacccgacaacgacttcctcttcatgtatagtgtggcaagaactaacctggagctagagctgatccaccgcggtggcaacctgtgtagcggaggagcctcaaccgcgggtaagagatcgtgcctgaatcagctgtttcatgtgctggcactgcacatgcgcctgtactccattgattcagagtacaacccttggcgaaagctgactcagctggaggagatgaacccacagttgggctacgaggagcaacagcctgaagtgcccatcctgtatcacgatgtgacgtcgcttctgctgatccaaatcctgatgatgccgcagcctctccgtaaagatcacttcacctgcatagttaaagtcctgttcacgttactctacacacaggctctggcagcactgtccgtgaaatgcagcgaagaggaccgatcggcgtggaagcacgcaggagctctcaaaaagagcacttgcgacgctgagaaatcatacgaagtgttactgtcattcgtgatctcagagctgttcaagggcaagctataccatgaagagggtacacaggagtgtgccatggtgaaccctatcgcctggagtcctgagtcgatggaaaagtgtctgcaggacttttgtctcccgtttctccggattacatctctcttacagcaccacctttttggtgaggacctgccatcttgccaggaagaagaggagtttagtgtactggcttcatgtctcggcttgctacccactttttaccagacagaacatccttttatcagtgctagctgcctggattggcctgtgccagcctttgacattatcactcagtggtgcttcgaaataaaaagctttactgaacgccacgcagaacaaggcaaggccctgctgattcaggagagcaagtggaaactgccccaccttctgcaattgcctgaaaattataacaccatctttcagtattatcatagaaagacctgctccgtatgcaccaaagttcccaaggatcctgcggtctgcctggtgtgcgggacattcgtttgtttgaaaggcctgtgctgtaaacagcagtcttactgtgaatgcgtcctacactcccaaaactgtggtgccggaactggcattttcctgctgattaacgctagcgtgattataattatcagaggacatagattctgtttgtggggctcagtctacctggatgcccacggcgaagaagacagggatcttcggaggggcaagcccctgtacatctgcaaggagcgctacaaagttcttgagcagcagtggatatctcacactttcgatcacatcaacaaaagatgggggcctcattataatggcctttac

SEQ ID NO: 245934 - DNA, 2130 bp, Artificial Sequence
  Description of Artificial Sequence: Synthetic coding sequence
atgatcgcctctaaacaaaggcagtttactgaagtgtttaggatcatgagtagcaccttctcgcagagccgtttcctttacgcggcagtggtgacagacagtccagagaacgatattcccatggagatcaccacggccgagccccaggtttcagaagctgtgtatgactgcgtcatctgcggccaatctggacccagttctgaggacagacctactggcctggtcgttctgctacaagcctcttctgtgctgggtcaatgtcgggacaacgtggagccgaaaaaactccctatctccgaagaagagcaaatctatccatgggacacctgcgccgctgtgcatgatgtgcggctcagcttgctgcaacgctacttcaaagactcttcctgtctgctggccgtatcaatcggctgggagggtggcgtgtacgtacaaacgtgtgggcacactctgcacatcgactgtcataaatcttatatggagtcactacgaaatgatcaggtcttacaaggattctcagtggacaagggggagtttacatgcccactgtgtaggcagtttgcaaactctgtgctcccatgttatccgggaagtaacgtcgagaataatccatggcagagacccagcaataaatcaatccaggatctgatcaaagaagttgaagaactgcagggaagaccgggagccttcccctcggagacaaatctctctaaggagatggaatcagtgatgaaggatattaaaaacactacgcagaagaaataccgggattattccaagacacccggtagccctgacaacgacttcttattcatgtatagtgtcgcgaggaccaacttggaattggaactcatccacagaggtggaaacttgtgctctggaggcgcatctactgccggaaagagaagctgtctgaaccaactgtttcacgtgctggcactgcatatgaggctttacagcatcgactctgagtataatccttggcggaagctgacccagcttgaggaaatgaatccgcaactggggtacgaagagcaacagccagaagttccaatactgtaccacgacgtaacttctctactgctcatacaaattctaatgatgccgcagcctctgcgcaaagatcattttacctgcatcgtgaaagtcctgtttaccctcctatacacacaggcccttgccgctctaagtgttaaatgttccgaagaggacagaagcgcctggaaacacgccggtgctctgaagaaatccacatgtgatgcagaaaaaagctacgaggtcctgctctccttcgtgattagcgagctgttcaagggcaagctctaccacgaggaggggacacaagagtgcgctatggtgaatccaatagcttggtcccccgaatcgatggagaagtgtctgcaagatttttgcctgccttttctgcgaataacctccctgctgcagcatcatctctttggggaggaccttccgagttgccaagaggaagaggaattctcggtattagctagctgcctgggccttctgcccaccttctaccagacggagcatcccttcatcagcgcctcttgccttgactggcccgtgcctgcattcgacatcattactcagtggtgttttgagattaagtccttcaccgaacgtcacgccgagcagggcaaagctctactgattcaggaatctaaatggaaactgcctcacctgttgcagctgccagagaattataacacgatctttcagtattaccataggaaaacatgttcagtctgtacaaaggtcccgaaagatccagctgtttgtttagtctgcggcacctttgtgtgtctaaagggcctctgttgtaagcagcaatcctattgtgaatgcgttttgcatagtcagaactgcggagcagggaccgggatcttcctattgatcaacgcttccgttattattatcattcgcggacataggttctgtctgtgggggtctgtatacctggacgctcacggcgaggaggatagggacctaaggcgtgggaagccgctgtatatatgcaaagagagatacaaagttctggagcagcagtggatatcacacaccttcgaccatattaacaagaggtggggcccacactacaacgggctgtag

SEQ ID NO: 245935 - DNA, 5666 bp, Artificial Sequence
  Description of Artificial Sequence: Synthetic coding sequence
atggcagccgctgcagccgcagccgtggggggacagcaaccatcccagccagaactgccagcccctggtctcgccctggataaggctgcaacagcagcgcatctcaaagcggcactgtcgaggcctgataaccgtgccggagccgaggagttgcaggccctgttggagcgcgtgctgagcgcggagcggccattagccgcagccgctggaggggaggatgcagccgctgcagggggaggtggaggtccgggagctgctgaggaggaagctctggagtggtgcaaatgcctacttgctggcggagggggatacgatgaattttgcgccgcagttcgtgcttacgatcctgcagccttgtgtgggttggtatggacggctaattttgtggcctacaggtgtagaacttgcggcatttcgccctgcatgagcctgtgcgctgagtgtttccaccaaggcgaccacaccggtcacgactttaacatgtttagatcacaggccggtggtgcctgtgactgtggggactctaacgtgatgcgtgagtcggggttttgtaagcggcatcaaataaagtctagctctaacatcccatgcgtccccaaagacttgctgatgatgagcgagtttgtcctcccccgatttattttctgcctaatccagtatctgagagagggatataatgagcctgccgctgatgggccttctgaaaaagacctgaacaaagtcctccagctgttggagccgcagatttcatttttagaggaccttacaaagatgggcggagcaatgagaagtgtgctgacccaggtgctcacaaatcagcaaaattacaaagatttaaccagcgggttaggcgagaacgcctgcgtcaagaaaagccacgagaaataccttatcgcattaaaatcttccggtctgacttatcccgaagataagctagtgtacggtgtgcaggaaccaagtgccggaacatcttctctagctgtccagggattcatcggcgctaccgggaccctcggccaggtcgactccagcgatgaggatgaccaggacggtagccagggactcggcaagagaaaaagagtcaaactgagctctggcacaaaggatcaatctataatggatgtgttaaaacacaaaagtttcctggaggagctcctgttctggacaattaaatatgaattccctcaaaaaatggtaactttcctgctcaatatgctcccagatcaggagtataaggttgccttcactaagacattcgtccagcattatgccttcataatgaagaccctcaagaaaagccacgaaagtgacacgatgagcaatcgtatcgtacatatcagtgtccagctcttttccaacgaggaacttgcaagacaggtaacagaagaatgccagttactcgatattatggtgacagtgcttctgtatatgatggaaagctgcttgattaagtcagagctccaagacgaggaaaattcactgcacgtggtcgtgaattgcggggaagccctattgaaaaacaatacctattggccgcttgtatcagattttattaatattctctcacaccagtccgtggcaaaacgctttctggaagaccatggtctcctcgtgacctggatgaattttgtcagtttctttcagggtatgaatttgaacaagcgcgaactgaatgaacacgttgaattcgaatcacagacctactacgcagcatttgcagccgaattggaggcatgcgcacaacctatgtggggcttattatctcattgcaaagtgagggagacacaggaatacactcggaacgtggtgaggtattgtcttgaggctctgcaggactggttcgacgcgattaactttgtagatgaaccagcaccaaatcaggtgacctttcacttaccactccacaggtactacgccatgttcctgagtaaggctgtgaaatgccaggagctggatctggacagtgtgttaccagaccaggagatgctgatgaagctgatgattcacccgctgcagatacaggcttctctcgcagagatacactccaacatgtgggtgcgcaacggactgcagatcaagggacaggctatgacctacgtgcagtcgcatttttgtaacagcatgattgatcccgatatctatctgttacaagtgtgcgcctcgaggctggaccccgactactttatttcctctgtctttgagagattcaaggttgtggacctcttgacaatggctagccagcaccagaacactgtactcgacgcagagcatgagagatccatgttggaaggcgcactaacctttctggtaatactcctcagcctcagactgcacctggggatgtccgacgatgaaattcttcgcgcagaaatggtggcccagttatgtatgaacgatcggacacactcttccctacttgacttgattcctgagaaccccaaccccaaaagtggaattattcctggaagttactccttcgaatccgttctgtctgcggtggccgacttcaaagccccagtgtttgaacccggaggatctatgcaacaaggtatgtatacgccaaaagccgaagtctgggaccaggagttcgatccggtcatggttatattaagaacagtttacagacgggacgttcagtctgccatggatagatacacagcgttccttaagcagagcgggaagtttccagggaatccttggcccccatacaagaaacgcaccagcctccacccaagttacaagggactgatgagactgcttcactgcaaaactctgcatatcgtactgttcacgcttctgtataagattctgatggaccaccagaacctctcagagcacgtgttatgcatggttttgtatctaatcgaactaggccttgaaaactctgcagaagaggaaagcgacgaagaggcttctgtgggaggacccgagagatgtcacgacagttggttccccggaagcaatctcgttagtaacatgcgacacttcatcaattacgttcgggtacgtgtacctgaaaccgcgccagaggtgaaacgagacagccccgcttcgacctcctccgacaacttgggctctctccagaatagcggcactgcgcaagtcttctcactggtagcggaacgtaggaaaaaatttcaggagatcattaataggtcatcttcggaggcaaaccaggtagtgcggccaaaaacttcctcaaagtggtccgcgcctggatctgctccacagctcaccaccgccatactggagataaaggagagcatactgagccttctgatcaaactgcaccataagctttctggcaaacagaatagctattacccaccatggttggatgacatcgaaattctcatccagcctgagatacccaaatactcacatggggacggtatcaccgcggtggagcgcattctcctaaaggctgctagccagtcaaggatgaataaaagaattattgaagagatctgcagaaaggttaccccgccagtcccccctaagaaggtcactgctgccgagaagaagactctcgacaaggaagagcggcgacagaaagcacgcgaacggcaacaaaagttactcgcggagtttgcatctcgtcagaagtctttcatggagactgccatggatgtagactccccagagaacgacatcccaatggagattacaaccgctgagccccaagtatctgaagccgtctacgattgcgtaatctgcggacagagtggtccctcctctgaggatcggccaaccggcctcgttgttctgttacaggcatcttccgtgttaggccagtgccgagataatgtcgagccaaaaaagctgccaatatccgaggaggaacagatctatccatgggatacttgtgctgctgtccatgatgtgaggctgagccttttgcagcggtacttcaaggattcttcctgcctcctcgcagtctcgattggctgggaaggcggagtatacgtgcaaacctgtggtcataccttgcacattgactgccataagagttatatggaatccctcaggaatgaccaggtcctgcagggcttcagcgttgataagggtgaatttacatgccccctgtgcaggcaatttgcgaatagtgtattgccatgttacccgggatcaaatgtcgagaataatccatggcagcgacccagcaataaaagcatacaggacctgattaaggaagttgaagagttacaggggagacctggggcattcccttccgaaactaacctttcgaaggaaatggagtccgtgatgaaagacattaaaaacactacacaaaaaaagtatcgcgactattctaagactccagggagtccagataacgactttctgttcatgtattcggtggcccgaacaaacctagaactggaattgattcaccgaggagggaatctgtgcagtggcggtgctagcacagccggtaagcggtcttgcctcaaccagctgtttcacgttcttgctcttcacatgaggttgtactccatcgacagcgaatacaacccctggcggaagctaactcagctggaagaaatgaacccccagctggggtatgaggagcagcagcctgaggttcccatcctgtaccatgacgtgacatctttactgctcattcagatattgatgatgcctcaaccgctgagaaaggaccacttcacatgcatcgtcaaggtcttgtttaccctgctctatacccaggctctggccgcactgtcggtgaagtgctctgaagaagacagatccgcttggaagcacgccggtgccctgaagaaaagtacatgcgacgcggaaaaaagctacgaagtactgttatcgttcgtaatatctgaattgtttaagggtaagttgtatcacgaagaaggcacacaggagtgcgctatggtgaatcctatcgcatggtctccagaaagtatggaaaaatgtctccaggacttttgcctgccgttcctgcgaatcaccagccttctccagcaccatctgttcggggaagatttaccctcctgtcaagaagaggaagagttctcggttctggccagctgcctgggactcctgcctaccttttaccagaccgagcatccttttatcagcgcctcttgcctggactggccggttcctgcgttcgatatcattacgcagtggtgtttcgagatcaagtcattcacggaacgccacgcggagcagggaaaggcactcctgatacaagagtctaaatggaaactgccgcacctccttcagctgccagagaattataataccattttccagtactaccatcgcaagacctgtagcgtgtgcaccaaagtaccaaaggaccccgctgtttgccttgtatgcggtacgttcgtctgcctgaagggtctttgttgcaaacagcagtcctactgtgaatgcgtgctgcactcccagaactgcggcgctgggactggaatttttcttctcatcaacgcttcagtcatcattatcattcgagggcaccgcttctgtttatggggctccgtctacttggatgcccatggcgaagaggatcgggaccttcgacgcggaaagcctctttacatttgcaaagagcggtacaaagtccttgaacagcagtggatatctcacaccttcgaccacataaataagcgctggggaccgcactataacggactgta

SEQ ID NO: 245936 - DNA, 5753 bp, Artificial Sequence
  Description of Artificial Sequence: Synthetic coding sequence
atggccgctgcagccgcagcagcggtgggaggtcagcagccgtcgcagcccgaattgccagcacctggacttgcactggacaaagcagcaactgctgcccacttgaaagccgcactgtctcgccctgataatagagctggcgctgaggagttacaagcactgcttgagcgagtgctcagcgctgagaggccactggctgctgccgcaggcggtgaggatgccgctgctgctggcggaggagggggtcccggagccgctgaggaagaggccctggaatggtgcaaatgtctgctcgccggagggggagggtatgatgagttttgcgctgctgtgcgtgcctatgaccccgcagcactgtgtggtttggtttggaccgctaatttcgtcgcttacaggtgtcgtacatgtgggatcagcccatgtatgtcgctgtgcgctgagtgctttcatcagggagatcatactggtcatgactttaatatgttccggagtcaggccggtggggcttgtgattgcggagattctaacgtaatgcgcgaatccggattctgtaagaggcaccagattaaatcatctagcaatatcccttgcgtccccaaggatctcctgatgatgtcagagtttgtgctgccacggtttattttttgccttatacaataccttcgtgaggggtacaacgaacctgcagccgacggcccaagtgagaaagatcttaataaagtgttgcagctcttagagcctcaaatcagcttccttgaagacctgacgaagatggggggtgccatgagatcggttctcacgcaagtcctcactaaccagcagaactacaaggatttaacgtcaggactgggtgagaacgcttgtgtgaagaaatctcacgaaaaatacctgatcgccttgaagtcaagcggcctgacttatccggaggataaattagtgtatggcgtccaggaaccttcagctggcaccagtagcttggctgtccaagggttcattggcgctacgggcaccctgggtcaggtcgattcgtcggacgaggacgatcaggatgggtcacagggtcttgggaagcgcaagcgcgtgaagctgagctcaggcacaaaagaccagagcatcatggatgtccttaagcacaaatcttttctggaggaactgctcttctggactataaagtacgagttccctcaaaaaatggtgacctttctcttaaatatgctgcctgatcaggaatataaggtggccttcaccaagaccttcgtacagcactacgcctttatcatgaagactctcaaaaaatcacacgaatctgatacaatgagcaatagaatcgtgcacatatcagtacagctttttagcaatgaggagctggctagacaggtaactgaggaatgtcagctccttgacattatggtcacagtcctgctttacatgatggagagttgcctgatcaagagtgagttgcaggatgaggaaaatagcctacacgttgtagtaaattgcggggaggccctgctgaaaaataacacatactggcccttggtgtctgattttatcaatatcctgtcccaccagtctgtcgccaagcgcttcctagaagaccatggcctgcttgtcacatggatgaattttgtgtccttctttcaaggtatgaacctgaacaagcgcgagttgaacgaacatgtcgaattcgagagccagacatactacgccgctttcgctgccgaacttgaggcatgtgcccagcctatgtggggcctgctctcacattgcaaagtgagagaaacccaggaatacacccgcaacgtggtcaggtattgtctggaggccctgcaagactggttcgatgccatcaattttgtggacgaaccagcccctaaccaggtgacattccacctccctctccacagatactacgccatgttcctgtcaaaggcagtgaagtgccaggaactggatcttgactctgtactgccggatcaggagatgctgatgaagctgatgatccatcccctccagatccaggcctccttggccgagattcactcaaacatgtgggtgcgcaacggcctgcagataaagggtcaggccatgacgtatgtgcaaagtcacttctgcaatagcatgatcgacccggatatttacttgttacaggtgtgtgcctcaagactggaccccgattattttatcagcagtgtctttgagcgattcaaagtggtcgatcttttgacgatggcctcccaacaccaaaacacagtcctggacgccgaacacgaacgatccatgctggaaggggctctgaccttcttggttatactgttgtctctgcgcttacatctgggcatgagcgacgacgaaatcctccgcgcagaaatggtggctcaattatgcatgaatgaccggacgcactcctctttattggatctcatccccgagaacccaaatcctaaatctggcattatccccggtagctattccttcgagagcgtcttaagtgcggtcgcggatttcaaagcaccagtatttgagcccggtggaagtatgcagcaaggaatgtatacccccaaagccgaggtgtgggatcaagaattcgaccccgtgatggtgatactgcggaccgtatatagaagggatgtgcagtccgcgatggacaggtacacagcttttctaaagcagtccgggaaattcccaggaaatccgtggcccccatataagaaaaggacaagcctacaccctagttacaaagggctcatgcgcttgctgcattgtaagactttgcatatcgtgctcttcactcttctgtataaaatccttatggatcaccagaatctgtccgaacatgtgttatgcatggtgctctacttaatagagctggggctggaaaattccgcagaggaagaaagcgatgaggaggcaagcgtggggggaccagagaggtgtcatgacagttggttccccggttctaacctcgtctctaacatgagacattttatcaactatgttagagtgagggtgccggaaactgctcctgaagttaagcgcgatagtccagcctcgacctccagtgataatttaggctccctgcagaatagtggcaccgcgcaggtgttctccctggtcgccgagcgaagaaaaaagttccaagagatcatcaatcgttcatccagcgaggcaaaccaggtcgtgcggcctaaaacatcctctaagtggtccgccccaggctccgcgcctcaattaaccactgcgatcctcgaaattaaagaatcaatcttgtctctgcttataaaactgcaccataaactgtccggcaaacagaacagttattatcccccttggctggacgatattgagattttgatccagcccgaaatccctaaatactctcatggcgacgggatcacggccgtggagcgaatcttactgaaagcagccagtcagtccaggatgaataagcgcatcatcgaggagatatgccgaaaagtgactcccccagtgcccccaaaaaaagtaacagccgctgagaaaaaaaccctggacaaagaagagaggagacagaaggcccgagagagacagcagaaactcctggccgagtttgctagcaggcagaagtcctttatggaaactgctatggatgtcgattcaccggagaacgacatccctatggaaattactacagccgagccccaggtgtccgaggccgtgtacgattgcgtcatctgcggtcagagcggaccctcatctgaggatcgaccgactgggctggtggtgcttcttcaggcaagctccgttctcgggcaatgtagggataacgtggagcccaagaagttgcccatatccgaagaagagcagatctatccttgggacacatgcgctgccgttcacgatgttagattaagcttgttgcaacgctacttcaaggatagcagctgtctgctggcggtctcgatcggatgggagggcggtgtgtatgtccagacttgcggacataccctccacatcgactgtcacaagagttatatggaatctctacgcaacgaccaggttctccagggattcagcgttgacaaaggggagttcacctgtcctctctgtcggcagtttgcaaactcagtcctgccgtgttatcccggtagcaatgtcgagaataacccttggcaaagacccagtaataaaagcatccaggatctgattaaggaggtggaagagttgcagggtcgacccggagcgtttccttccgaaactaacctatctaaagaaatggaatctgtgatgaaagatattaaaaacacgacccagaagaagtatcgagactactctaagactcctgggtctcccgataatgactttttgttcatgtacagtgtcgcacggacaaaccttgaattagaattgatccaccggggtggaaacctgtgctcaggcggtgcttccaccgctgggaagaggtcgtgtctgaacttctgtttcatcatcttcccctttacaaagtctgaaataatattatgtcagtataggaagtcccacgacaaggtttatcccaagtaccagctgttccatgttctagcattgcacatgagactttattccatcgatagcgaatacaacccatggcgcaaacttactcagctagaggaaatgaaccctcagcttgggtatgaagaacagcagcccgaggttcctatcttgtatcatgatgtcacaagcttgctgctgatccagatccttatgatgccgcagccattaagaaaggaccatttcacctgcatcgtaaaagtacttttcacgctgctgtacacacaagcccttgctgctttgtctgtgaagtgcagtgaggaggatcgctctgcctggaagcacgcaggggctctcaagaaaagcacatgtgacgcagagaaaagttacgaggtgctgctgagctttgttatcagcgaattgttcaagggtaaattataccatgaggagggaacccaggagtgcgccatggtgaaccctatcgcctggtcacccgagagcatggaaaagtgtttacaagatttctgcttgccctttcttcgaatcactagcctgttgcagcatcacctgtttggcgaagatttgccgtcttgtcaggaggaggaagaatttagcgtgctggcaagttgtctgggcctcctccctacattttatcaaactgagcatccttttatctcggcttcatgcttagattggccagtgcctgcatttgacatcattacccaatggtgttttgagatcaaaagcttcacagagcgccatgctgagcagggcaaggccctcctgattcaggagtctaagtggaaactgccccacctgctgcagctgcccgagaactacaatactatctttcagtattatcatcgcaagacctgcagtgtgtgtactaaggtccccaaggatcccgcagtgtgcctggtttgtggtacatttgtctgcctgaaaggcctctgctgcaaacaacagtcttattgtgaatgcgtgctacacagtcagaattgcggtgctggcacaggtatttttctgcttattaatgcatcagtgataattatcataaggggacatcgtttttgcctctggggctcagtatatcttgacgctcacggggaggaggaccgcgacttgaggagaggaaaaccactgtatatctgtaaggagcgatataaagttctcgagcagcagtggatctctcacacgtttgatcatataaataaaaggtggggaccccattacaatgggttata

SEQ ID NO: 245937 - DNA, 1278 bp, Artificial Sequence
  Description of Artificial Sequence: Synthetic coding sequence
atggccggagctgaaggagcagccggaaggcagtcagaactggagccagtcgtctcactggtcgacgtgctagaggaggatgaagagcttgaaaacgaggcgtgcgccgttctgggaggcagcgattccgaaaaatgttcgtacagccagggctccgttaaacgccaggctctctatgcttgcagcacttgtacccccgagggtgaagagccagcgggaatttgcttggcctgcagctatgagtgccacggcagtcacaagctcttcgaactgtataccaagagaaatttccgatgcgactgtgggaattctaaattcaaaaacctcgagtgcaagctactgcccgacaaggctaaggtgaactccggtaataaatacaatgataacttctttgggctgtattgtatctgtaaacgaccgtaccctgatcctgaggacgagatacccgacgagatgatacagtgcgtggtgtgcgaggattggtttcacgggaggcatctaggtgccatacccccagaaagtggcgactttcaggagatggtctgccaggcctgtatgaagaggtgttcattcctgtgggcatatgctgcccagctggctgtgaccaaaatatccacagaggatgatggccttgtccgtaatatcgacgggatcggggaccaggaggtgataaaaccagagaacggagaacatcaggacagcacgcttaaagaggatgtaccagaacaaggaaaggatgatgtgcgcgaggtgaaggtagagcagaactccgaaccatgcgccggatccagttccgaatctgatttgcagaccgtgtttaagaatgaaagtctcaacgctgaatccaaatcgggttgcaaacttcaagaacttaaagcaaagcagcttattaaaaaggacaccgcgacttattggccgcttaactggcggagtaaactctgtacttgccaggattgcatgaagatgtacggagaccttgacgtgcttttcctgactgatgaatatgatacagtcctcgcctatgagaacaagggtaagattgctcaggccacggataggtctgaccctttgatggacactctttcttctatgaacagggtccagcaagtcgaactcatttgcgagtacaacgacctgaaaacggagctaaaagactacctgaaacgctttgccgacgaagggacagttgtgaagcgcgaagacattcagcagttcttcgaggaattccaatcaaaaaaacgtaggcgcgtagacggaatgcagtactactgctcctag

SEQ ID NO: 245938 - DNA, 1050 bp, Artificial Sequence
  Description of Artificial Sequence: Synthetic coding sequence
atgcgaagagctctcagctgggcagccgcaacacccagaagtgcgccaaccctccggaactttagatgtgactgtgggaattcgaagtttaagaatctggagtgcaagttactgcctgataaagccaaggtgaatagcgggaacaaatacaatgataatttcttcgggctgtactgcatttgtaagaggccctatcccgatcccgaagatgagatccccgatgagatgatccagtgcgtcgtgtgtgaagactggtttcatggcagacacttgggggcaatccctccagagagtggtgacttccaggagatggtctgccaggcttgtatgaaaaggtgcagctttctgtgggcctacgctgctcagctggctgtgacaaaaattagcactgaggacgatggtctggtgaggaatatagacgggataggcgatcaggaggttatcaagcccgaaaacggcgagcaccaagatagtaccttgaaggaagacgtaccagagcaaggaaaggacgacgtgcgcgaggtcaaggtcgagcagaactcagagccatgtgccggatcatcatctgagagcgatctgcagacagtattcaagaacgagtcccttaatgccgagtctaagtctggctgtaagctacaggagctgaaggcaaaacaactgatcaaaaaggacaccgcaacttattggcccctcaactggcgcagcaagctatgcacctgccaggactgcatgaaaatgtatggtgacctcgacgtgctgtttctgacggatgaatacgacactgtgttggcatacgaaaataaaggcaaaatcgctcaggctaccgaccgttcagatcctctgatggataccctctccagtatgaatagggtgcaacaagtggagctgatatgtgaatacaatgacctgaaaaccgaactgaaggactatctgaagagattcgccgacgagggcactgtcgttaagcgggaagatattcagcagtttttcgaagaatttcagtctaaaaagcggagacgagtcgacggtatgcaatactattgttcttag

SEQ ID NO: 245939 - DNA, 1083 bp, Artificial Sequence
  Description of Artificial Sequence: Synthetic coding sequence
atgcgacgcgctttatcctgggccgctgccacacccaggagcgcaccgacactgagaaacttcagatgtgactgcggcaactcaaagttcaaaaacttggagtgtaaactgttgccagataaagctaaagtgaactccgggaataagtacaacgacaacttctttggcctgtattgtatctgcaagcggccatatccggaccccgaggatgaaatccctgacgaaatgatccagtgcgtggtctgtgaagactggtttcacggccgacacctaggcgctattccacctgaatcaggcgatttccaggaaatggtctgtcaggcctgtatgaaacgctgcagctttctctgggcatatgctgcccagcttgccgtaaccaaaataagtactgaagatgatgggttggttcggaatattgacggtataggcgatcaagaagtgatcaagcccgaaaatggcgaacaccaggacagcacactcaaagaggacgtgcccgagcaaggcaaagatgacgtgcgcgaggttaaagtggagcagaattctgagccttgcgctggctcttcctctgagagcgatctgcagacagtattcaagaacgaatcattaaacgccgaatcaaagtctggatgtaagctccaggagctgaaggctaaacagttaatcaaaaaagatactgctacttattggcctttaaattggagatccaaactgtgcacatgccaggattgtatgaagatgtatggagaccttgatgtgctctttctgaccgacgagtatgatacggtgctcgcctacgagaacaagggaaagattgcacaagccacagatagatccgaccctcttatggataccctgtccagcatgaatcgcgtgcagcaggttgagctgatatgcgagtataacgacctgaagacagagttaaaagactacctgaaacgattcgccgacgaaggtaccgttgtcaagcgcgaggatattcagcagttcttcgaagaattccagaagaaggaaaaaaaatcagggtgggatgctgttctgctgcagctggagtggtccatgaaactgtcccacagctcccagtag

SEQ ID NO: 245940 - DNA, 2121 bp, Artificial Sequence
  Description of Artificial Sequence: Synthetic coding sequence
atggcctcacccgctgattcatgtattcagtttacacggcacgcctctgatgttcttttgaatttaaaccgcctgaggagtagggatatcctaacagacgtagtgatcgtcgtatctagggagcagtttagggcacacaagacagtactcatggcatgtagcggtctgttctactcgattttcacagatcagctgaaatgcaacctgtcagtgatcaatctggatccagagattaacccggaagggttctgcatactgttggatttcatgtacacatcccgtctgaatctccgcgaaggcaacatcatggctgtcatggcaacggccatgtatctgcagatggaacacgtagtggacacttgtcgtaaatttatcaaggctagtgaggcagaaatggtgagcgccatcaaacccccacgggaagagtttctgaactcacgcatgcttatgccccaggatatcatggcatatcgcggacgggaggttgtggagaataatctgcccttaagatctgcaccaggatgcgagagtagggcttttgcaccttccctctactccggtctttcgactccaccagcctcctatagcatgtattcccacctcccggtgtcctccctgctattcagcgatgaggaatttcgcgatgtgcggatgccggttgccaatccctttcctaaagaaagagcccttccgtgtgactctgctcggccagtgcctggcgagtattcaagaccaacgttggaagtgagccctaatgtctgtcactcaaacatttatagcccaaaggagaccataccggaagaggctcgctccgacatgcactatagcgttgctgagggcttgaaacctgccgctccttctgcaagaaacgccccatactttccctgcgacaaggcatccaaggaggaagaacgcccttcttctgaggatgagatcgccctgcattttgaacctccaaatgccccacttaacagaaaggggcttgtgtctccccagtctccccagaagagcgactgccaacctaactcccctactgagtcttgtagttctaagaacgcctgcatccttcaagcatccggcagcccccctgctaagagtcccactgaccctaaggcctgtaactggaaaaaatataagttcatcgtgctcaacagcctgaaccaaaacgccaagccagagggcccagagcaagccgagctcggcagactttccccccgagcctataccgcgccacccgcttgtcagccccctatggagcccgagaaccttgacctgcagagtcccactaaactcagtgcatctggagaagattctactattccgcaagctagcagattgaataatatcgtcaacaggagtatgacaggctcccccagaagtagcagcgagtcacattcgcccctgtacatgcacccacccaagtgtacatcatgtggtagtcagagtcctcaacacgctgaaatgtgtttacatacagccggaccgacctttcccgaagagatgggtgaaactcagagcgaatattccgactcttcctgtgagaacggcgcttttttttgcaatgaatgtgactgtagattctccgaagaggcttctcttaaaagacacacgcttcagactcatagcgataagccttacaaatgcgaccgatgtcaggccagttttcgatataaaggcaacctggcctcacataagacagtccacacgggtgaaaaaccctatcgttgtaacatctgcggggctcaatttaatagaccggcaaacctcaaaactcacacgagaatccattcaggggagaagccttacaagtgcgaaacctgtggagcgcgtttcgtgcaagttgcacacctccgggctcatgtgctgattcataccggggagaagccatatccctgcgaaatctgcgggacccgattcagacacctccagactcttaagtcacacctgcgcatccatacgggggaaaaaccctaccactgtgaaaagtgtaacttacactttagacataaatctcagctaaggcttcacctgaggcagaaacatggagcgattacaaataccaaggtgcagtatagggtttccgctacagacctaccaccggaactaccaaaggcctgttag

SEQ ID NO: 245941 - DNA, 2619 bp, Artificial Sequence
  Description of Artificial Sequence: Synthetic coding sequence
atgagatcagtgtgccatcggagtggcgaacctcagtctgacgatatcgaggcttcaagaatgaaaagggcagcagccaaacacctgattgaaaggtactaccatcagcttacagaaggttgtggaaacgaagcatgcactaacgagttctgcgcgagttgtccgacttttctacgcatggataataacgcagcggctataaaggcactggagctgtacaaaatcaatgccaaactctgcgacccacacccctcgaagaaaggtgcctcctccgcctatcttgagaatagcaaaggggctcctaacaattcctgcagtgaaattaaaatgaacaagaaaggcgctcgcatagactttaaggacgtgacttaccttacagaggaaaaggtttacgaaatcctggagctgtgtcgtgagcgcgaggattatagcccgctaattagagtcatcggaagggtcttcagctccgccgaagccctggtgcagagctttcgcaaggtgaagcaacacacgaaagaggagctcaaatctcttcaagcaaaggacgaggacaaagacgaggacgagaaggaaaaggccgcatgttccgccgcagcgatggaagaggactctgaagcaagcagtagcaggattggcgatagtagccaaggtgataataacctccagaaactgggccctgatgacgtgtctgtggatatcgacgccattagacgcgtgtatactaggttactgagtaacgaaaagattgaaacggcttttctgaacgccctggtatatctttcacctaatgtggagtgtgacctcacgtatcataacgtctacagtcgggaccctaactacttgaatctttttattatagtcatggagaatagaaatctgcactctccggagtaccttgaaatggccctcccactgttctgcaaagctatgtctaagttgcctctcgccgcacaagggaaactcataagactttggtcgaaatacaatgcagatcagatccgcagaatgatggaaacttttcagcagctcatcacctacaaggtgatatctaatgagttcaacagtcgaaatctggtcaatgacgacgacgcaatcgtcgccgcatccaagtgtctgaagatggtgtactatgccaatgtggtcggcggagaagtggacacaaatcataacgaggaggacgatgaggagcccattccggaatcatcagaactgacgcttcaagaactgctgggggaagaacgccgaaacaagaaaggacccagggtggatccattggagaccgagctgggggtcaaaacacttgattgcaggaaacctctgataccatttgaggaatttatcaatgagccccttaatgaggtactggagatggacaaagattacaccttcttcaaggtcgagaccgagaataagttcagtttcatgacctgcccctttatcctgaacgcagtgacgaaaaatttaggactttactacgacaatcgcatccggatgtattccgaaagacggatcaccgtgctgtacagccttgtccaaggacagcaactgaatccatatttgcggctgaaggtgcggagagatcacattatcgacgacgccctggtgcggctcgagatgattgcaatggaaaaccctgccgaccttaaaaagcaactgtatgtggaattcgaaggggaacagggcgtcgacgaagggggagtatcaaaagagttctttcagttggttgtcgaggagatctttaatcccgatatcggaatgttcacatatgacgaatccaccaagctcttttggttcaaccctagcagcttcgaaaccgaggggcaattcacactgattgggatcgtcctggggctcgcgatctacaacaactgtattttggatgttcactttccgatggtcgtataccgcaaactgatgggcaaaaagggaacctttcgcgacctgggggattcacaccccgtgctgtaccagtcactgaaagacttgctagaatatgaggggaatgtcgaggatgacatgatgatcacatttcagatcagtcagaccgacctgttcggcaatcctatgatgtatgatcttaaggagaatggcgataaaatcccaattaccaacgaaaacaggaaggagttcgtcaatttgtattctgattacatactcaacaaatccgtggagaagcagtttaaggccttccggaggggattccatatggtcacaaatgaatctcctttgaaatatttgttcagacccgaggagatcgagctactgatttgtggaagcagaaacctggacttccaggccctggaggagacgactgaatacgatggcggttatactagagattcggtcttaattcgagagttttgggagattgtgcattcctttactgatgagcagaagaggctttttttgcagtttacgacgggcacggaccgcgctccggtgggcggactgggtaagttgaagatgattatcgcaaaaaatggacccgacacagaaaggctgcctactagtcacacctgttttaatgtactgttgttacctgaatacagcagcaaagagaaactgaaggagcgattactgaaggcaatcacatatgccaagggctttggaatgctttag

SEQ ID NO: 245942 - DNA, 2628 bp, Artificial Sequence
  Description of Artificial Sequence: Synthetic coding sequence
atggaaaagctgcaccaatgctattggaagtctggagaaccacagagcgatgatattgaagcctctaggatgaagcgagcagcagcgaaacacttaatagagcgatattaccaccagctcactgaagggtgtggcaatgaagcttgtactaatgaattctgtgcaagctgccccacatttctgaggatggataataacgccgctgcgattaaggcacttgaattatacaagatcaacgctaagctttgtgaccctcaccctagcaagaaaggcgctagcagtgcctacctggagaattctaaaggcgctcctaacaacagttgcagtgagatcaaaatgaataagaagggggcaaggatcgactttaaagatgtgacctatctgactgaagagaaagtgtatgagattctggagctgtgtcgggaacgagaggattacagcccactaatacgggtgatcggccgagtattctccagcgccgaagctcttgttcaaagttttcgtaaggtgaagcagcatacgaaggaggaactgaagtccctgcaggcaaaggacgaagacaaggatgaagacgagaaggaaaaggccgcttgctctgctgcggctatggaggaggacagcgaagcaagtagctccagaatcggagatagttcccagggagacaacaacttgcagaagctggggccagatgatgtctctgtggatatcgacgccattaggagagtgtacactcggttactgtcaaatgaaaaaatcgaaacagcgtttctgaacgccctcgtgtaccttagcccaaacgtggaatgcgacctgacttatcataatgtttacagtcgggaccctaactatcttaacctctttatcatcgtaatggagaatcgcaatctccactcgcccgagtatctcgaaatggcattgccactgttttgcaaagcaatgtcgaagctccctctcgcagctcagggaaaactaatccgactttggagcaagtataatgccgatcagattcgccgaatgatggaaacgtttcagcagctgattacttacaaagttatcagtaacgaattcaatagcagaaacctggtcaatgatgacgatgcaatcgtcgccgcttcgaagtgtctcaaaatggtctactatgcaaacgtggttggcggagaagtggatactaatcataacgaggaggatgatgaggagccgattccagagtcttcagaactgacacttcaggaacttcttggggaagagagaaggaataaaaaagggccacgcgtggaccccctggaaacagagctgggcgtcaagaccctcgactgtcggaagcctctcatcccattcgaagaattcattaatgagcctctaaacgaggtcctagagatggataaggattatacattcttcaaggtagagactgagaataaatttagttttatgacctgtccgttcatcctgaacgccgtaacaaagaacctcggcctgtattacgataacaggattcgtatgtattccgagcggaggatcactgtcctctacagcctggttcagggccaacagcttaacccttatcttagattgaaagtgcgacgcgatcacatcattgacgacgctctagttaggctggaaatgatcgcaatggaaaatccggctgatctcaaaaagcagctgtacgtggagttcgagggagagcagggggttgacgaagggggagtgagcaaggagtttttccagcttgtggtggaagaaattttcaacccggatattggaatgtttacctatgacgagtccacaaaactgttctggtttaacccctcctcctttgaaacggagggtcaattcacactcatcggaatcgtattaggactggccatctacaacaactgtattctggatgtgcacttcccgatggtcgtgtacaggaagttgatgggaaagaaaggtacctttcgtgatcttggcgactcacaccctgtgctctaccagtccctgaaagatctcttagaatatgaaggaaacgtggaagatgacatgatgatcacctttcagatctcacagacagacctcttcggaaaccccatgatgtatgatttaaaggagaacggggataaaatacccattactaatgagaacagaaaagaattcgtcaacctgtacagtgattacatcctcaataaaagcgttgagaagcagttcaaggctttccgtaggggattccacatggttaccaacgaatctccactcaagtacctcttccggcctgaggaaattgaactcctgatatgtggctctaggaatctggactttcaggccctggaggagaccacagagtatgacggaggttacacaagagacagcgttctcattagggaattctgggagattgtgcattccttcaccgacgagcagaaaagactgttcttgcagttcactaccggcaccgatagggccccagtcggaggtctggggaagctgaagatgatcattgccaaaaacggcccagacactgagagattacccacgagccacacctgttttaatgtgctgcttttgcccgaatactctagtaaagaaaagctcaaagaacggctactcaaagccattacttatgccaaaggtttcggaatgctgtag

SEQ ID NO: 245943 - DNA, 2559 bp, Artificial Sequence
  Description of Artificial Sequence: Synthetic coding sequence
atgaagcgtgccgcagcgaagcacctgatagagcgttattatcaccagttaactgaaggctgtggcaatgaagcttgcaccaacgaattctgtgcgtcctgcccaacatttctgcgcatggataacaacgccgcagctataaaggccctagaactttacaaaataaatgcaaagctgtgcgatccgcacccttcaaaaaaaggtgcctcttcagcctatctcgagaattccaagggcgcaccaaacaacagctgctcggaaatcaagatgaacaaaaaaggggcaagaattgattttaaggatgtgacatacctgactgaggagaaggtttacgagatcttagagctgtgccgcgaacgggaagattactcccctcttatcagggtcatcggacgagtcttctcatcggcagaggcactggtacagtcattccggaaggtgaaacagcacaccaaggaggagctcaaatcgctgcaagctaaagatgaggataaagatgaagacgagaaagagaaagctgcgtgttccgctgctgcaatggaggaggatagtgaggcatcctccagccgaattggggactcctcacagggcgacaataacctgcaaaaactgggtcccgacgatgtgagcgttgacatagatgccatcagaagggtgtacactcggctgctgtctaacgaaaagatcgagaccgctttccttaatgcgctagtgtacctctcgccgaacgtcgagtgtgacttgacataccataacgtttacagtagggacccgaactacttgaatctgtttataatcgtgatggagaatcggaacctgcatagtcccgagtatttggaaatggccctccctctcttctgcaaggccatgtctaagttgcccctcgcagcgcagggtaaactaatccgcctttggagcaagtacaatgcagaccaaattcggaggatgatggagacttttcaacagctcatcacgtacaaggtcataagtaatgaatttaattcccgcaatctggttaacgacgacgacgcaattgtggccgcttccaaatgtctgaagatggtgtactacgccaacgtcgtagggggagaagttgatacgaatcacaacgaggaagacgatgaagagccgatacctgagagctcagagctgactctgcaggagctgctgggcgaagagcgtagaaataagaagggccctcgcgtagatccgttggaaaccgaactaggtgtgaaaacgctcgactgtcgaaagcccttgatcccatttgaggagttcatcaatgagccattgaatgaggtcctggagatggataaagattacacgtttttcaaagtggaaacagagaataaattctccttcatgacctgtccgttcatactgaatgccgttacgaaaaacttggggctgtattatgacaatagaatcagaatgtactctgagagaagaatcaccgtactgtactcactggtccagggacaacagttaaacccctatcttcggttaaaagttcgacgcgatcacatcatcgacgacgctctggtacggctggaaatgatcgctatggaaaatcctgccgatctcaagaagcaactgtacgtggaatttgaaggagaacagggggttgacgaaggtggtgtttcaaaggagttcttccagctggtcgttgaggaaattttcaatcccgatatcggaatgtttacctatgacgagagtacaaaacttttttggttcaacccctctagttttgaaaccgaaggccaatttacactcataggcatcgtgctgggtctggccatctacaataattgcattctggatgtgcactttcccatggttgtctatagaaaattgatggggaagaaggggacttttcgagacttgggcgatagccaccctgtgctttatcagtccctgaaagacttgctcgagtacgagggaaacgtggaggacgacatgatgataacttttcagatctctcaaactgatctgttcggaaaccccatgatgtacgacctgaaagaaaacggagacaaaattccgatcactaacgagaatcgtaaggaattcgttaatctgtattcggactacatcttaaacaagagcgtggagaagcagttcaaagcatttagacgtggctttcatatggttactaatgagagccccttgaagtatctatttcgaccagaggagattgaacttcttatctgtggttcacgcaacctcgattttcaggcactggaagagaccaccgaatatgacgggggatacacccgggactctgtgcttatccgagagttctgggaaatcgtgcactccttcaccgacgagcagaaaaggctctttcttcaatttacaaccgggactgaccgggctccagtggggggactaggcaagctgaaaatgattattgcgaaaaatggacctgacactgagcgccttcccacctctcacacatgcttcaacgtccttctgctccccgagtacagctcaaaggaaaagctgaaggaacgactgttgaaggctattacgtacgctaagggatttggcatgttatag

SEQ ID NO: 245944 - DNA, 2559 bp, Artificial Sequence
  Description of Artificial Sequence: Synthetic coding sequence
atgaaacgggctgctgccaagcatctgatcgaacgttactatcaccagttgactgaagggtgcgggaatgaagcttgtacaaacgagttttgcgccagctgcccaacattcctgagaatggataacaatgcagccgcaattaaggcccttgaattgtacaagatcaacgccaagctctgtgatccccacccctctaaaaagggggcttctagcgcttatttagagaatagtaagggcgcacctaacaactcttgctctgagatcaaaatgaacaagaagggagctaggatagatttcaaggacgtgacctaccttacagaggaaaaggtctacgagatcctggagctctgtagagagcgggaggactatagcccactaattcgcgtgatcggccgtgtgttcagcagcgctgaagctctagtgcagtcctttcgcaaagttaaacagcatactaaagaggagctcaaaagtctgcaggccaaagatgaggataaagacgaggatgagaaggagaaagcagcgtgcagtgctgcggctatggaggaagattcggaagcctcttcaagtcggattggcgattcaagccaaggggacaacaaccttcagaagcttggacctgacgatgtgtccgttgacatagacgcaatccgccgagtctacacgcggctcctttcgaacgagaagattgagacagccttcctaaacgccctggtgtacctcagtccaaacgtggaatgcgacctcacctatcacaatgtctactcgagggaccccaactatctcaacctatttatcattgtgatggagaacaggaacctgcacagtccagaataccttgagatggctttaccactgttctgtaaggctatgagtaagttgcccctggccgctcagggaaagctgattcggctgtggtcaaaatacaatgctgatcagattcgaaggatgatggaaacttttcaacagctaattacttacaaggttatcagtaacgagttcaacagcagaaaccttgttaacgatgacgacgcaatcgtggctgcatccaagtgcctgaagatggtgtattatgccaacgtagtcggcggagaagtcgatactaaccataatgaggaggacgacgaagagcccatcccagaaagctcagaattaaccctgcaggaactcttaggcgaagagcgcagaaacaagaaaggcccacgcgtggatcctctggagactgaactaggtgtcaaaacacttgactgccggaagcccctgatcccgttcgaagagttcatcaatgagcccctgaatgaagttctcgagatggacaaggattatacgttcttcaaggttgagaccgagaataagttctcatttatgacctgccccttcatcctcaatgcggtcaccaagaacttaggcctttattacgataacagaatcagaatgtattccgagcgacggatcactgtactgtactctctcgtgcagggtcagcaactcaacccatatcttaggctgaaggtcagacgggatcacattatcgatgatgcattagtgcgcctcgagatgatcgcgatggaaaatccggcagatctgaagaaacagctgtatgttgaatttgaaggtgaacagggagtagacgagggcggagtttccaaggagttctttcagcttgtagtggaggaaatcttcaatcccgacatcggaatgtttacttacgacgagtcaactaaactgttctggtttaacccttcttccttcgaaaccgaggggcagttcacgcttattggcattgtgttgggccttgctatctacaataactgcatcttagatgtacattttccaatggtggtctaccgcaaactgatgggaaagaagggcacatttagggacctgggggacagccaccctgtgctgtaccagtccctgaaggacttactcgagtacgaaggcaatgtcgaggacgatatgatgattacttttcagatcagccagactgatctgttcgggaaccccatgatgtatgacctgaaggaaaacggcgataaaatcccaatcaccaatgaaaaccgtaaggaatttgtgaatctgtatagtgattatatcctcaacaaaagtgtcgagaagcagtttaaagcgtttaggcgcggttttcacatggttactaatgaatcccccctgaagtatctgttccgacccgaagaaattgaactcctgatttgcggctctagaaacctcgattttcaagcgctcgaagagacgacagaatatgatggaggctacacccgggacagcgtgctgatccgcgaattttgggagatcgtccactcatttactgatgagcagaaaaggctgttcttacagtttaccactgggaccgaccgagctcctgtggggggactgggcaagctgaagatgatcatcgccaagaacgggcctgatacggaaaggcttcctacctcgcacacatgcttcaatgttctcctgctgcctgaatactcctcaaaggaaaaattaaaagaaagactacttaaggctatcacttatgcgaaaggcttcggtatgctgtag

SEQ ID NO: 245945 - DNA, 3252 bp, Artificial Sequence
  Description of Artificial Sequence: Synthetic coding sequence
atgttcagtttcgagggcgactttaagactagacctaaagtatcgctcgggggagctagccgcaaggaggagaaggcctcactgctgcaccgaacccaggaagaaaggagaaaacgcgaagaggagaggagacgcctgaagaatgcaatcattatccaatctttcattagggggtaccgagacagaaagcagcaatactccatccagaggtctgcctttgacaggtgtgccacactgagccagtccggaggggcttttcctattgccaatggaccaaatctgacactattggttagacagctcctgtttttttataaacagaacgaggacagcaagagactaatttggctctaccagaatctgatcaagcactcaagtctattcgttaagcaactggatggatccgaacgtttgacatgcttgttccagatcaaaaggctgatgtctttgtgttgtagactgctgcagaactgtaacgatgatagcctcaacgtggcactccccatgcgcatgttggaggtattttccagtgagaatacttacttgcccgtactccaggacgcctcatatgttgtgtctgtgattgaacagattctgcactatatgattcacaatggctactatcggagtctttatcttcttatcaactcgaaactcccatcatcaatcgagtactcagacctgagccgagttccgatagccaagattctgctggagaacgtgttgaaacccctccacttcacatataactcgtgccctgaaggtgcaagacagcaagtgtttacggcttttacggaagagtttctggccgctccattcacggaccagattttccatttcattattcctgctctcgcagacgcccagaccgtcttcccatatgaaccatttttgaatgcgctcctgctgatcgagtctcgatgtagccgcaagtcagggggtgccccatggctcttctacttcgtactgacagtcggcgagaactacctcggcgcattgtccgaagaaggactgctcgtgtaccttcgggttctgcagacgttcctgagtcagcttcccgtgtctcccgcatccgcaagctgtcacgactctgcgtccgacagcgaggaagagtcggaggaagcagataagcctagttcccccgaagatggtagattgagtgtttcttacatcactgaggagtgccttaaaaagcttgacaccaagcagcagacaaacacgctcctgaatctggtctggagggattcggctagcgaggaagtctttaccaccatggcatcagtgtgccacacactgatggtccaacacagaatgatggttccgaaagtacgcctgctgtattcgctggccttcaacgctagatttctgagacacctgtggttcctgatctctagtatgtctacgcgtatgatcacgggctccatggttcccctactacaggttatttctagaggctcacctatgtcatttgaagacagcagtcgcataatccccctgttctacctgttctcctcacttttcagccatagcctcatctccattcatgacaacgagtttttcggcgatccaattgaggtggttggacagagacaaagtagtatgatgccttttacacttgaagagctaatcatgctctcacggtgccttagggacgcttgtttgggaatcatcaaactggcttacccagaaaccaaacctgaggttcgggaggaatatatcaccgcgtttcagtccataggtgtgaccacatcttctgaaatgcagcaatgcatccagatggagcaaaaaagatggatacagttgttcaaagtgatcacgaaccttgtaaagatgctcaagagcagggatacaagaagaaacttctgtcccccaaaccattggctgtcagagcaggaggacatcaaagccgacaaggttacacagctgtatgtacctgccagcagacacgtgtggcgctttcggagaatgggtcgtattgggccattgcagagcactctcgatgttggtcttgagagtccccctctgtctgtgtctgaagagcggcagttggccgtcctcactgagttaccttttgtcgtgcctttcgaggagcgcgtcaaaatatttcagcgccttatttatgccgataagcaggaagtccagggtgacgggccatttttggacggtataaacgttacaatcaggcggaattacatctatgaagacgcctatgacaagctgtctccagagaatgagccagatctcaagaaacgcattcgtgtccacctgttaaacgctcatggcttggacgaggccggtatcgacggcggaggtatctttagggagttcctaaacgaattacttaaatccggattcaatcctaaccaggggttttttaaaaccacgaatgaagggctcctctatccaaatccagccgctcaaatgttggttggtgatagtttcgcaaggcactattatttcctggggaggatgctgggtaaggccctctacgagaacatgcttgttgagttgccgtttgcaggcttctttttgtctaagctcctcggaacttcagccgacgttgacatccaccaccttgcctctttagatcccgaagtatacaagaacttactgttcctcaaatcttatgaagatgatgtcgaggagctgggtcttaactttactgtggtgaacaatgatcttggcgaggcacaggtggttgagctgaagttcggcggaaaggacattcccgttacaagcgcgaaccggatcgcttacattcacctagtggcagactacagacttaataggcagataagacaacattgtctggcctttagacagggattggcaaacgtggtcagcttagagtggctccgcatgttcgatcaacaggagatccaggtactgattagcggtgcgcaagtaccaatatcactggaggatctgaagtctttcacgaattatagcggcggttattctgcggatcacccagtgatcaaagttttctggcgcgtcgtggaggggtttactgatgaggagaagcgcaaattgttaaagtttgtgaccagttgcagtcgcccacccctactgggatttaaagagctttatccagccttttgtatccacaacgggggttcagacttggagagattgcccacagccagcacttgcatgaacctcctgaagctgcccgagttttacgacgaaactctgcttagatctaaactgctctatgctatcgagtgcgctgcaggctttgaattgtcttag

SEQ ID NO: 245946 - DNA, 1215 bp, Artificial Sequence
  Description of Artificial Sequence: Synthetic coding sequence
atgttcagttttgagggggatttcaagacaagacccaaggtttccctgggcggagcaagcagaaagtattctattcagcgttccgctttcgatcggtgcgccacactgagtcagagtggcggagcctttccaatcgctaatggtccaaatcttacgctgctggtgagacagcttttgttcttttacaagcagaatgaagatagtaagcgactcatctggctgtatcagaacctgataaagcactcatccctgtttgtcaagcagttagacggatccgagcggttaacatgcttgttccagattaaacggcttatgagtctgtgctgtcgattgctccagaattgcaacgacgatagtctaaatgttgcacttcccatgagaatgttggaggtgttctctagcgaaaatacctacctacccgtcttacaggacgccagctatgtggtctcagtcatcgagcaaattctgcactacatgatccacaatgggtactaccgaagtctttaccttctaatcaattctaagctaccttcttccatcgagtatagcgaccttagtagagtgcccatcgcaaaaatcctactagaaaacgttcttaagcccctccactttacatataattcctgccctgagggtgcccgacaacaagttttcacagcgtttacagaggaatttctcgcggcaccatttacagaccagattttccacttcattattccagcccttgccgatgcccagacagtctttccatatgaaccattcctgaatgctctgctactcatcgaatcgcgctgtagtagaaagtctggtggtgctccgtggctgttctattttgttctgactgtgggcgaaaactatcttggcgcactatcagaagaagggctccttgtgtacctcagggttctccagacttttctttcccaactcccggtaagccccgcttccgctagctgccacgactcagcttccgactctgaggaggaatccgaggaggctgataaaccatcaagcccagaagatggcaggttgtcggttagttacataaccgaagagtgtttaaaaaagctcgacacaaagcagcagacgaatacattgctgaacctcgtgtggcgcgattcagcatccgaggaggttttcaccacaatggcctctgtgtgccacaccctgatggtccaacaccgcatgatggtgccgaaggttcgggtgtacaagtag

SEQ ID NO: 245947 - DNA, 192 bp, Artificial Sequence
  Description of Artificial Sequence: Synthetic coding sequence
atggctgcacccttgagcgtagaggtggaatttggaagttcgcccggttgcctgtttctctggtcttccttcgcggaagtcgttagatcttcttgcttaacagtcctgaggaatattgaatcactgtgtttagaccggcgtaatcccggtacgtcaggaacatgctcatctggatcccggaggatctgttag

SEQ ID NO: 245948 - DNA, 192 bp, Artificial Sequence
  Description of Artificial Sequence: Synthetic coding sequence
atggcagcccctctctctgtcgaagtggagtttgggggaggggctgagctgttattcgatggcatcaagaaacacagggtgaccctcccaggccaggaggagccttgggatatcagaaacctgctcatttggatcaaaaagaatcttctgaaggaacggcctgagctttttatacagggtgatagtgtgtag

SEQ ID NO: 245949 - DNA, 306 bp, Artificial Sequence
  Description of Artificial Sequence: Synthetic coding sequence
atggcagcccctctctctgtcgaagtagagttcggtggcggtgccgagcttctcttcgatggcatcaagaagcacagggtcacgcttccaggacaggaagagccctgggacattaggaatctgctgatttggatcaagaaaaacttgctaaaagagaggcccgaattgttcatccagggcgatagcgtgcgccctggaatcttggtcctaatcaacgacgccgattgggagttgctgggagaattagattatcagttgcaggatcaggatagcgtgctgttcatctccactcttcacggcggatag

SEQ ID NO: 245950 - DNA, 441 bp, Artificial Sequence
  Description of Artificial Sequence: Synthetic coding sequence
atggcggctcctctgtctgtggaagtcgaatttggaggcggagcagaacttctttttgacggcatcaagaaacatcgggtcacactgcccggtcaagaagagccctgggatatcaggaatctcctgatctggatcaaaaagaatttgctgaaggagagacccgagctctttattcaaggagatagcgtgcggcctgggatcctcgtgcttatcaacgacgcagactgggaattacttgtgagtactctgggggacatccctcctcctgcccctgctctagccgcatccgttgggaaaaggtgggcctcccctcaggcccatattgaatggctcggtaatcctccacctcacagcagccccacactacgcctgttggagagtcccacacccggtgaagagggaatggggtcatgggggcacggcagcactccacccagctag

SEQ ID NO: 245951 - DNA, 2358 bp, Artificial Sequence
  Description of Artificial Sequence: Synthetic coding sequence
atgccaggcgttatcccctctgaatccaacggactatcccggggttctccgtccaagaaaaatagattgtcactaaagttctttcagaagaaagaaactaaacgagccctggatttcactgattctcaggagaacgaagagaaagcatctgagtaccgggcaagcgagatcgaccaagttgttccggctgcacaaagcagtccgatcaattgtgaaaaaagggagaacctcctgccattcgtggggcttaacaacctgggcaacacctgctatctaaattccatcctgcaggtgctgtacttttgccctggtttcaaatctggagtcaagcatctatttaacattatctctagaaagaaagaggccctcaaagatgaggctaaccagaaggacaagggcaattgcaaggaggattcactcgcctcctacgaacttatctgttccttgcagtctctgataatatctgtggaacagctacaagcaagcttcctgcttaaccccgagaagtatactgacgagctggcaacccagccacgccgattgctgaacactttacgagagctgaatccaatgtacgagggatatttgcagcatgatgcacaggaagtgctacagtgtatattggggaacattcaagagacctgtcagttactcaagaaagaggaggttaagaatgttgctgaactgccgaccaaggtcgaagagattccccatcccaaggaggagatgaacgggatcaattctattgagatggacagcatgaggcacagtgaagattttaaggaaaaacttcctaagggtaatggaaagaggaagagcgatacagagtttggaaatatgaaaaagaaggtgaagttgtctaaggaacaccaatccttggaagagaaccagcgtcaaacccgatcaaaacgcaaagccaccagtgacactctcgaaagccctcccaagatcattcccaagtacataagcgaaaatgaatctccgcgtccaagtcagaaaaagtcccgggtgaaaattaactggctgaaaagtgcaactaagcagccttctatcctgtcaaaattctgtagcctcggcaagattaccacgaatcagggggtgaaaggccagtctaaggaaaatgagtgtgaccctgaggaagatttgggcaaatgcgagagtgacaacacgactaatggctgcgggctggagtcacccggaaataccgtgaccccagttaacgtgaacgaggtgaaacccattaacaagggtgaggagcagatcggattcgaattggtggaaaagctgtttcagggccagctggttctgcggacaagatgcctggagtgcgaatcactcactgagagacgagaggactttcaagatattagtgtccccgtccaggaagatgagctgtctaaggtagaggagagcagtgagatctctcccgaacccaagacggagatgaaaaccctccgttgggctattagccaattcgccagcgttgagcggattgtcggtgaggataagtatttctgcgagaactgtcaccactacaccgaggccgagcggtccctgctctttgacaagatgcccgaagtcataacgatccacctcaagtgctttgccgctagcggcctggaattcgactgctacggaggcggactgtccaagatcaatactcctttgctgacccctctgaaattaagtctggaagaatggagcactaagccgacgaacgattcctacggtttgtttgctgttgtgatgcactccggcatcaccatctcctcaggtcactacactgcttcggtgaaggtcacagacttgaatagcttagaacttgataaagggaattttgtggtggaccagatgtgcgagattggtaaacccgaacctcttaacgaagaagaagctcggggagtggttgaaaattataacgacgaggaggtgtcgatccgagtgggaggcaatacacagccatctaaagtgctgaataagaagaatgtggaagcaataggcctgctgggaggtcagaaatcaaaggctgactacgaactttataacaaggcgtctaacccagacaaagttgcatccaccgcatttgctgaaaatcgaaatagcgaaactagcgacactaccggcacccacgagtccgaccggaacaaagagagctcggaccaaaccggcatcaacatcagcggcttcgaaaacaagatttcttacgttgtgcaaagcctcaaagagtacgaaggcaaatggctattgtttgatgactcggaggtgaaggtgacagaggagaaagattttctgaactccctaagcccaagtacaagccccacttccacaccgtatctgctcttctacaaaaaactttag

SEQ ID NO: 245952 - DNA, 2358 bp, Artificial Sequence
  Description of Artificial Sequence: Synthetic coding sequence
atgcctggagtgatcccctccgagagcaatggactcagcagaggctccccttctaaaaaaaatcggctcagcctcaagttcttccagaaaaaagagactaaacgcgcactggattttacagacagccaagagaacgaggagaaggcttccgagtaccgggcttccgaaattgaccaggtggtgccagcggcacagagttcaccaatcaactgtgagaagagagaaaatctgcttcctttcgtgggcctcaacaatttgggtaatacatgttatctgaattctatcctccaggtcttatacttctgtcctggattcaagtccggagttaagcatctctttaacatcatcagtaggaagaaggaagcgctgaaggatgaagccaatcaaaaagataaggggaactgcaaggaggacagtctggcttcctacgagctcatctgtagcctgcaatctttaatcatctctgtggaacagttgcaagctagtttcttactgaacccagaaaagtatacagatgaactggcgacccagccgcgacggctgttgaatactctcagagagcttaacccaatgtatgaaggctacttgcaacacgatgcccaggaggtgttacagtgcattcttggtaatatccaggaaacttgtcaactccttaaaaaggaagaagtcaagaatgtcgctgagttgcccaccaaggtggaagagattcctcaccccaaagaagagatgaacggcatcaattctatcgaaatggattctatgcgccattcagaagatttcaaggagaagctgcctaaagggaacggtaaaagaaaatccgacactgaattcggtaatatgaaaaagaaggttaagctctccaaggaacaccaaagcctggaggaaaatcagagacagactcggtcaaaacgaaaggccacaagtgacacattggagtcgccacccaaaataatcccaaaatacatcagcgaaaacgagtcacctcgcccaagccagaagaaatcccgcgtcaagatcaactggctgaaaagtgccacaaagcagccctcgattctcagcaagttttgttccctgggcaaaatcacgacaaatcagggggtaaagggacaatccaaggagaatgagtgtgatccggaagaagatctgggtaagtgtgaatccgacaataccaccaacggctgcggactcgaatccccaggcaacaccgtgacgccagtcaatgtcaatgaggtgaaaccaatcaacaagggagaggagcaaattggatttgagcttgtcgagaagctttttcagggacagctggtactgcgcacgaggtgtttggaatgcgaaagtctgacagagcgtcgggaggatttccaggacatttctgtgcccgttcaggaagatgaattgagtaaggtcgaggaaagcagtgagatttcccccgagcccaagacagagatgaagacactcagatgggccatttcacaatttgctagcgtggagaggatcgtgggtgaagacaaatatttctgtgaaaattgccaccactacactgaggctgagcgatctctgttattcgataagatgcccgaagtgataacgatccacttaaagtgttttgccgcatccggcctcgagttcgattgttacggagggggactttctaaaatcaatactccgttgttgacgcccctgaaactgagcttggaggagtggtcaaccaaaccaacgaacgatagttacggactttttgctgtggtgatgcactcaggaatcactatatcatccggccattacacagccagcgtaaaagttacagaccttaactccctggagctggataagggtaattttgtcgtcgatcagatgtgcgaaataggaaaaccggaacctctgaacgaggaggaggccagaggagtcgtggagaactataatgacgaagaggtgagtatcagggtcggaggaaacacccagccttccaaggtgcttaacaagaagaacgtcgaagccatcggtctgctcgggggacagaagtctaaagccgattacgagttgtataataaggcctctaatccagataaggtggccagtactgcgttcgctgaaaacaggaacagcgaaacctcagataccacaggaacacatgagtctgaccgcaacaaagaaagcagcgaccaaacgggaataaatatctctgggttcgagaacaagatctcttacgtggtgcagtcactgaaagagtatgaagggaagtggctcttgtttgatgattccgaggtaaaagtcacggaagaaaaagacttcctaaactccctgtctcccagcacatcacccacaagcactccctatctgcttttctacaagaaactgtag

SEQ ID NO: 245953 - DNA, 264 bp, Artificial Sequence
  Description of Artificial Sequence: Synthetic coding sequence
atgcctggagttatcccttccgaatcaaacggtctctctaggggatcaccgagcaagaaaaatagactcagcctgaagttttttcaaaagaaagagactaaacgcgcactggactttacggactcgcaggagaatgaggaaaaggcctctgagtaccgcgcttctgaaattgaccaagttgtccccgcagctcagtcaagcccgataaactgcgaaaagcgagaaaacttgctaccatttgtgggcctgaacaacctggggtag

SEQ ID NO: 245954 - DNA, 561 bp, Artificial Sequence
  Description of Artificial Sequence: Synthetic coding sequence
atgccaggtgtcatcccttctgaatctaatggactctcaagaggcagtccaagcaaaaaaaataggctcagtttaaagttttttcagaagaaggagacaaaaagggccctggactttacagatagccaggagaatgaagagaaagcaagtgaatatcgcgcaagcgagattgaccaggttgttccagctgcccaatcctccccaatcaactgtgaaaagcgggagaatcttctgccctttgtgggactcaacaatttggggaacacttgttacctcaacagtatcttgcaagtcctgtatttctgccccggattcaaatcgggagttaaacacttattcaatataattagcagaaagaaggaggcactgaaggatgaggcaaatcagaaggataagggcaattgcaaagaagacagtctggcaagttatgagttgatttgcagcctgcagtcacttattatttctgtcgagcagctgcaggcaagcttcctgctcaatcccgaaaaatataccgacgagttagcaacccagcctcgcaggctgctgaacaccctgcggtag

SEQ ID NO: 245955 - DNA, 663 bp, Artificial Sequence
  Description of Artificial Sequence: Synthetic coding sequence
atgcccctgactggcgtcggccctggcagctgcagaagacagatcattcgagccctgtgcctattactgcttcttttacatgcgggatcagcaaaaaacatctggaagcgcgcacttcccgctcgcttagctgagaaaagccgggctgaagaagccggagcgccagggggaccccgacaacccagagccgatcgctgtcctccaccccctaggacgctccctcccggtgcgtgtcaggctgcccgatgtcaggcagacagcgaatgccccaggcacaggagatgttgctacaacggttgtgcatatgcttgtctggaggctgttcccccaccaccagttctggactggttggtacagccgaagccaaggtggcttggcggaaatggatggttgcttgacggcccagaggaggtgttgcaggcggaggcctgttccacaactgaggatggcgctgagcccctcctctgcccttcgggctacgagtgtcacattctctcccctggcgatgtggccgaaggcattcccaataggggccagtgtgtcaaacagcggagacaagcagatgggaggatattacgacacaaactgtacaaggaataccctgagggcgatagcaaaaatgttgccgaacctggcagaggacagcagaagcactttcagtag

SEQ ID NO: 245956 - DNA, 687 bp, Artificial Sequence
  Description of Artificial Sequence: Synthetic coding sequence
atgtaccatctaatgaagttcataccattatactccaaagtacagaggccttgtacctccacgcccatgatcgattcattcgtgcgactgatgaacgaatttaccaacatgccagtaccccctaaacctcgccaagccctaggcgataaaatcgttagggatatccgccctggtgccgctttcgagcccacctacatctacaggctgctcaccgtgaacaagtctagcctttcagagaagggcagacaggaggatgctgaagagtatctgggtttcattctcaacggccttcatgaagagatgctcaatctgaagaaattgctctcacctagcaacgagaagctcaccatctccaatggaccaaaaaaccactcagtcaatgaagaggaacaggaagagcagggcgagggctctgaggacgagtgggaacaggtgggccctcggaacaagacatccgtcaccaggcaggcagacttcgtacagacaccgatcaccggattttggtggacccatcaggtgtgcggcctgcctgccgaatttaaacgaatttgtcacttcgcagctatctttcacgtggccgtgggctatcctgtgaggcaggacacacattcacccggttgtaccggagagctggggggaaagcgcatctgccctcgcctgtaccataagaatcagactcgtggctag

SEQ ID NO: 245957 - DNA, 189 bp, Artificial Sequence
  Description of Artificial Sequence: Synthetic coding sequence
atggctctgcactcaccccagtacattttcggcgatttcagcccagatgaatttaaccagttcttcgtgacaccaaggagcagcgtagaggataagaacatcagagaactttctctggtaagcatgaaatcccttaatcctgttaccctctgtagagaaccccctgccactgttttccaggctcactag

SEQ ID NO: 245958 - DNA, 2472 bp, Artificial Sequence
  Description of Artificial Sequence: Synthetic coding sequence
atgaagagacaccgccctgttagctcatctgattcctcagacgagagcccctcaactagttttacttccggttcaatgtaccgcatcaagagtaagatccccaacgagcacaagaaaccggcagaggtcttcagaaaggacctgatctccgccatgaagctgcccgactcacatcatattaacccagactcctactatcttttcgccgatacgtggaaagaagagtgggaaaaaggggtgcaagtgccggctagcccagacactgtgccacaacccagcctccgcattatcgcagagaaggttaaagacgtgttatttatccgaccacgcaagtatatccattgtagttcccccgacaccaccgagcccggatatattaacatcatggaactggctgcctccgtatgtcgctatgacttggatgatatggatatattttggctccaggagctgaacgaggacctcgctgagatgggctgtggccctgtcgacgagaatctgatggaaaaaaccgtggaagtcctggaacgacattgccatgagaacatgaatcatgcaatcgaaacagaggagggcctgggtattgaatacgatgaggacgttatatgcgatgtgtgtcgctcgcctgacagcgaagaggggaacgacatggtattctgtgataaatgtaacgtttgtgtgcaccaggcttgctatgggattctcaaggtccccgaggggagctggctatgcaggagttgtgttttggggatctacccacagtgtgtgctctgccctaagaagggaggagcattaaagacaaccaaaacaggaaccaaatgggcccacgtgagctgcgccctttggatacccgaggtctcaatcgcctgcccagagagaatggaacctatcacaaagatttctcacatccccccaagtaggtgggccctggtgtgtaacctgtgcaagctgaagaccggagcctgtatccagtgcagcatcaagagctgcattaccgcattccatgtgacttgtgcattcgaacatggtctcgaaatgaagacaatcctggatgaaggggacgaagtgaagttcaagtcttattgtcttaaacattcacaaaacaggcagaaactgggtgaagcagagtacccccatcaccgggcaaaggaacaatcacaagccaagagcgagaagacgagcctgcgcgcacaaaagctgcgagagttggaggaggagttttactcactcgtgagggtagaggacgtggctgctgagctaggcatgcccacgcttgccgtggactttatctacaactactggaagctgaaacgcaagagtaactttaataaacccctctttcctcccaaggaagacgaagagaacgggctcgtgcagccgaaggaagagtcgatccacactaggatgcgcatgttcatgcacctccgccaggatctggaacgtgtgcgaaacttgtgctatatgataagcagacgcgaaaagctcaagctgagtcacaataagatccaggagcagatctttggcttacaggtacagttactcaaccaagagatcgatgccggtctgccactcaccaacgccctggagaactcactcttttaccctccccctcgaataactctgaaactgaaaatgcccaaatctacaccagaggatcaccgcaactcttctacggagacagaccaacaaccacattccccagattcgagttcaagcgtgcatagcataaggaacatgcaagtccctcaggaaagcctggagatgagaactaagtcgtacccacgatacccccttgaaagcaaaaacaaccgcctcctggcctccctctcccacagccgctctgaggccaaggaatcctcacctgcatggcgtaccccgtcatctgaatgttaccatggacaatcccttggcaaacccttggtgctgcaggccgcattacacggtcagagttcaataggaaacggcaaaagccagccgaattccaagttcgctaagtcaaatgggttggagggatcatggagcggtaacgtaacacagaaagatagctcgtctgaaatgttctgcgatcaggagcctgtcttttccccacaccttgtatctcaaggcagttttcgtaaatcgacagtggagcatttttccaggtccttcaaagagactactaataggtgggtcaagaacaccgaagatctccagtgttatgtgaaaccaactaagaacatgagtccgaaagaacagttttggggaaggcaggtacttcggcgatccgccggacgcgctccatatcaggaaaacgacggttactgccccgacttggagctgtctgactccgaggcggagtccgacggcaataaggaaaaggtacgagtgcgcaaggattcaagcgaccgcgagaatccaccccacgactccaggagggactgtcacggcaagtcaaagacacatcctttgagccatagctcaatgcagcgctag

SEQ ID NO: 245959 - DNA, 2763 bp, Artificial Sequence
  Description of Artificial Sequence: Synthetic coding sequence
atggcgactgtggccgcaaaccccgcagccgctgccgctgccgtggctgccgcagccgcagtcacagaggatagagaaccgcagcatgaagagttgcctggcctggattctcagtggagacaaattgagaatggggagtctggaagggagcgcccattgcgggctggcgagagttggttccttgtcgaaaaacactggtataaacaatgggaggcctacgtccaggggggagatcaagactcctctacctttcccggttgtatcaacaacgctacacttttccaggatgaaatcaactggcgactcaaggagggcctggtggagggagaagattatgtgctactgccagctgctgcttggcattacctggtcagctggtatggtcttgaacatggtcagcctcctattgaacgcaaggtaatcgagttgcctaacatccagaaggtggaagtctaccccgtggagctcctgctcgttcggcacaatgatctggggaagtctcatacagtccaatttagccataccgacagcattggtctcgtgcttagaactgcgagggagcgtttcctggtagagccacaagaggacactcgtctgtgggctaaaaattctgagggctccttggaccgtctgtacgacactcacattaccgtgctggatgccgctctggaaacaggacagttaatcatcatggagaccagaaagaaagacggcacctggccatctgcccaactccatgtcatgaacaataatatgagtgaagaagacgaggactttaaagggcagccaggcatatgtggactgacgaacctcgggaacacctgcttcatgaacagtgcccttcagtgcctcagcaacgtcccccagctgactgagtatttcctaaacaattgctatctcgaagagctaaattttcggaaccctctgggaatgaagggcgaaattgccgaggcctacgccgacctggtgaagcaggcttggtcggggcatcatcgtagtatagtcccccacgtgtttaagaacaaggttggccattttgccagtcagttcttaggataccaacagcacgactcgcaggaactactcagctttctgttggacggtctgcatgaggatctgaaccgagtgaaaaaaaaagagtacgtggagctctgcgacgccgcaggcagaccagaccaagaggtggcccaggaagcatggcaaaatcataaacggaggaatgatagcgtgattgtggataccttccacggactctttaagagtacactggtgtgtccagactgcggcaacgtgtcagtgacgtttgaccctttctgctacctgagtgttccactgcccatttcccataagagagtgcttgaggtgttcttcatccctatggatcccaggcgtaaacccgagcagcaccgcttggttgtccctaagaagggcaagatctctgacctttgcgtggccttgagcaagcacacagggatctctcccgaacgtatgatggtggccgacgtgttctctcatcggttctacaaactttaccagttagaagaaccacttagtagcatcctcgatagggacgacatatttgtgtatgaggtgagtggccgaatcgaagccatcgaagggtcccgggaggacatcgtagtgcctgtttacctgagggagcggacgcccgctagagattataacaatagctattacggcttgatgttgtttggccaccctttgctggtaagcgttcccagagacaggtttacctgggagggactgtacaacgtcttaatgtaccgtctgtcgcgctacgttaccaaacctaactcagacgacgaggatgacggcgacgagaaagaagatgacgaagaagacaaagacgacgtgcccggtccctctacggggggatcactccgcgatcctgaacctgaacaggctggacccagttccggggtgactaatcgctgtccgttcttgttggacaattgtctaggcacaagccagtggccgcctaggcgcaggcggaagcagctgttcacattacaaacggtgaatagcaatggaacctctgatcggaccaccagccctgaggaagtgcatgcccagccttatattgccatcgattgggaacccgaaatgaagaagcgctactacgatgaggtagaggcagaagggtacgtcaagcacgactgcgtcggttatgtgatgaagaaggccccagtgaggctgcaggaatgcatcgagctcttcaccaccgtagaaaccctggaaaaggaaaatccatggtattgccccagttgtaagcagcatcagctggccaccaagaagttagacttgtggatgctgccggagattctgatcatccatctaaagcggtttagctacacaaagttttctagagaaaagctcgataccctggtggagttccccatccgagatcttgatttcagcgagtttgtgattcagccccagaatgagtctaatccagagctgtacaagtatgatcttattgccgttagcaaccactatggagggatgcgcgatggtcattacaccactttcgcctgcaacaaggattccgggcagtggcactattttgacgacaactctgtcagccctgtaaatgagaaccagatcgaatctaaggctgcctacgttctcttctaccagaggcaggacgtggctcgaagattgctctctccggctggtagctccggtgcgccagcctcccctgcttgtagttcacccccatctagtgaatttatggacgtgaactag

SEQ ID NO: 245960 - DNA, 1113 bp, Artificial Sequence
  Description of Artificial Sequence: Synthetic coding sequence
atggaaattctcatgaccgtgagcaaattcgcatcaatttgtacaatgggtgctaatgcatccgccctggaaaaagagataggtcctgagcagtttcccgttaacgagcattattttggccttgtgaattttggaaatacttgctactgtaactctgtcctgcaggccttgtacttctgccgtccctttagggagaaagtgttggcctataagagccaacccaggaagaaggagtccctgcttacttgcctcgccgaccttttccacagtatagctacgcagaaaaaaaaagtcggcgtgatacccccaaagaaatttatcactcggctgcggaaagagaacgagctgtttgacaattacatgcagcaagacgcccatgaatttctcaactacttgttaaacaccattgctgatatcctgcaggaggaacgcaagcaggagaaacagaacggccgactgcctaatggtaacatcgacaacgaaaataacaactctactccagatcctacctgggtgcatgagatcttccaaggcacattaaccaacgaaacacggtgtttgacatgtgagaccatctccagcaaagacgaggactttctggatctgtccgtcgacgtggagcagaacacttctatcacccactgcctaagaggattttctaacacagaaacgctctgttcggaatataaatattactgcgaggagtgccgtagtaagcaggaagcacataagcgtatgaaagtgaaaaaactccccatgatcttagcccttcacctcaagcggttcaaatatatggaccagctgcacagatataccaagctgagctatagagtcgttttcccacttgaactacgactcttcaatacttccggagatgccacgaaccccgataggatgtatgatcttgttgccgttgtggtgcactgtgggagcgggcctaatcggggacactatatcgctattgttaaatcccacgacttctggttacttttcgacgacgatattgtggagaagattgatgcgcaagcgattgaagagttctatggcctgacctcagacatctctaaaaattccgagtccggctacattttattctaccagagccgcgactag

SEQ ID NO: 245961 - DNA, 2592 bp, Artificial Sequence
  Description of Artificial Sequence: Synthetic coding sequence
atgcaaaggagaggcgcacttttcgggatgcccggaggctccggcggtcgaaagatggcagctggagatattggcgaacttctggtgcctcacatgcccactatccgggtcccaagaagcggggatcgcgtctataagaacgagtgtgctttctcatatgactcccccaattccgaggggggactgtatgtgtgtatgaatactttcttagcttttggaagagagcacgtggagcgtcacttcagaaagactggacagtccgtgtacatgcatttgaagcgccatgtgcgggaaaaagtgcgtggcgcatcaggcggtgcactgcccaagagaaggaactcaaaaatctttctggacctcgatacagacgatgacctgaacagtgacgactacgaatatgaagatgaggccaagctcgtgatattcccagaccattacgagatagctctgccaaatatcgaagaactgccagctctcgtgaccattgcttgcgatgcagtgctcagttcaaaatctccatatcgaaaacaagacccagacacctgggaaaacgaacttccagtatcaaagtatgctaacaacctgacccagctggacaacggggttagaattcctcctagtgggtggaaatgcgcgaggtgtgacctgagagaaaatctttggttaaacctgaccgatggttccgtgctgtgtggcaagtggtttttcgattccagtggtggcaatggccatgctctggaacactacagggatatgggataccctcttgcagtgaagctgggtacgatcacacccgatggggctgacgtgtattctttccaagaggaagagcctgtactggatcctcacttggccaaacatctggctcatttcggcatagatatgctgcacatgcatggtactgaaaacggtttgcaagacaacgatataaagctcagagtgtccgagtgggaagtcatacaagagagcgggaccaagctcaagccgatgtacggccctggctacacaggccttaagaaccttgggaacagctgctacctgtcctcggtgatgcaagcaattttttccatacccgagtttcagcgagcttacgtcgggaatctgcctcgcatcttcgactacagtcccctggatcccacccaagatttcaacacccaaatgacaaagctgggacatggattactgtcaggccagtactccaaaccacccgtgaaatcagagctgattgaacaggtgatgaaggaagagcataagcctcagcagaacggcataagccctagaatgtttaaagctttcgtcagtaaaagccatcccgaattcagcagcaatcgacaacaagatgctcaggagttcttcctccacctggtcaacctggtggaacgtaatagaataggctctgaaaatcccagcgacgttttcagatttctggtggaggagagaatccagtgttgtcagaccaggaaagtgaggtacacagaacgcgttgattatttaatgcaactgcccgtagcaatggaagcagccacaaacaaggacgagctgatcgcctatgaactgacccgaagagaagcagaagccaataggcggcctttaccggagctcgtgcgcgcaaaaatcccttttagtgcttgcctgcaggccttttctgaaccagagaacgtggacgatttttggagcagcgctcttcaagcaaagagtgcgggagtgaagacatcccgcttcgctagcttccctgaatatcttgtggtgcaaattaagaagttcacatttggtctggattgggtgcccaagaagtttgatgtcagtatcgatatgcctgacctcctcgacatcaatcatctccgagctagggggctccaaccgggagaagaagagctgcctgatataagtccacccatcgtaatacctgacgattcaaaggatcgcttaatgaaccagcttatcgaccctagcgatatcgatgagtcaagcgttatgcagcttgccgagatgggattccccttggaagcctgccgtaaggctgtgtacttcaccggcaacatgggggctgaagtggctttcaattggatcattgtgcacatggaagaacctgatttcgctgagccattaactatgcccggttatggtggcgcagccagtgcaggggcttcagtgttcggagcaagcggactcgacaaccagccacccgaagaaattgtggccatcatcacttcaatgggattccagcgaaatcaggccattcaagctctaagagctacaaacaacaacttagaacgagccctggactggatcttctcccaccccgaattcgaagaggactccgattttgtgatcgagatggagaataacgcaaatgcaaacattatctcagaagctaagcctgaagggccacgggttaaggacggttcgggaacttatgaattgtttgcctttatcagtcatatgggtacatctaccatgagcggccattacatctgccacattaagaaagagggcagatgggtaatttataacgatcacaaggtctgcgcctcggagagacccccaaaagatctgggctatatgtatttctacaggcgtatccctagttag

SEQ ID NO: 245962 - DNA, 1485 bp, Artificial Sequence
  Description of Artificial Sequence: Synthetic coding sequence
atgcctttatactccgttaccgtgaagtggggcaaagagaagttcgaaggagtggagctgaatacagatgagccacctatggtgttcaaggcccagttgttcgcactaaccggtgtgcagcccgctcgccaaaaggttatggtcaagggcggaacactgaaagatgacgactggggtaacataaagattaaaaatggcatgaccctccttatgatgggaagtgccgacgctctgcccgaagaacccagcgccaagaccgtcttcgtggaagatatgacagaggagcagctggctagcgcaatggagctcccctgcgggctgaccaaccttggcaacacttgctacatgaacgccaccgttcagtgcatccgatcggtgccagagctgaaggatgccctcaaacggtacgcgggagccctaagggcatccggagagatggcaagtgcccagtatattaccgcagcccttagggacctgtttgactccatggataagacaagcagcagcatcccaccaattatactcctgcagtttctccacatggcttttcctcagtttgctgaaaagggcgagcaaggacaatacctccaacaggacgctaacgagtgctggatacagatgatgagggtgttacaacagaagctggaggccatcgaggacgactctgtgaaagagacggacagctctagcgcctccgctgccaccccctctaagaagaagagcctgattgaccaattctttggggtggagtttgagacaacaatgaagtgcaccgagagcgaggaggaagaggtgacaaaagggaaggaaaaccagctccagctgtcctgcttcatcaatcaggaggttaaataccttttcaccggcctgaaactcaggctccaagaggaaattaccaagcagagtcctacactgcaaaggaacgccctttatataaagtcctcaaagatttctcggcttcccgcttacttgaccatccaaatggtcagattcttctataaggaaaaggagagtgtgaacgcaaaagtcctgaaggatgtcaaattccctctaatgctggatatgtatgaattgtgtactcctgaacttcaagagaaaatggtgagcttcagatccaaattcaaagaccttgaggacaagaaggtgaatcaacagcctaatacctctgacaaaaaatcaagcccccaaaaagaggtgaagtacgagcccttcagtttcgcagatgacatcggaagcaacaattgcgggtactacgatctccaggcagtgctgactcaccaaggccgatcttcctccagcggccattatgtgtcatgggttaaacggaaacaggatgagtggattaagttcgacgacgacaaggtgtccattgtcactcctgaggacatattaagactgtcaggagggggagattggcacatcgcctatgtgcttctatacgggccacgaagagtcgagatcatggaggaagaatcagagcaatag

SEQ ID NO: 245963 - DNA, 1380 bp, Artificial Sequence
  Description of Artificial Sequence: Synthetic coding sequence
atgcccctctattcggtgactgtgaagtgggggaaagagaagtttgagggagtggaactaaacacagatgagcccccaatggtcttcaaggctcagttgtttgcactaaccggagtccagcctgccaggcagaaagtaatggtcaagggaggcactttgaaggatgatgactgggggaatattaagattaagaacatggagctgccttgcggattgactaatctcggtaacacctgttacatgaacgcaactgtacaatgtattcggtcagtgcccgaactgaaggatgcgctgaagcggtatgcgggagcgctgcgggcttctggcgaaatggcctctgcccagtacattaccgcggctctcagagatttgttcgactccatggacaagacaagtagtagtatccctccgatcatccttcttcagtttctccatatggctttcccacagttcgccgaaaagggtgagcagggacagtacctgcaacaggatgccaatgagtgttggattcagatgatgcgcgtgctgcaacagaagttggaagccatagaagatgattccgtaaaggagacagattcctccagcgcttctgccgctaccccctccaaaaaaaaatcgcttatagatcagttttttggtgttgaatttgagaccacaatgaagtgtactgaatctgaggaggaagaggttacaaaaggcaaggagaaccagctgcagctgagctgtttcataaatcaggaagtcaagtacctgttcactggactgaagctgcgcctccaggaagagataacaaagcagagtcccacactgcagcggaatgccctatacatcaagtcttccaaaattagtagactcccggcttatctcaccatccagatggtgcgattcttttataaggaaaaggagtcagtgaacgctaaggtactgaaggatgtgaagtttcccctaatgctggatatgtatgagctgtgcacgcccgaacttcaagagaaaatggtttcttttcgcagtaaattcaaggacctggaagataaaaaggtgaatcagcagccgaacacttccgataagaagagttcgccacaaaaagaggtcaaatatgaacccttctccttcgccgatgacattggatcaaataattgtggctattatgatctccaagctgttcttacgcaccagggccgatcttctagtagcgggcactatgtgtcatgggtgaaaaggaagcaagacgagtggattaagttcgatgatgataaggtgtccattgttacaccagaggacattttaagactcagcggcggtggtgactggcacatcgcttatgtgttgttgtatggccctcgccgagttgagataatggaagaggagagcgaacagtag

SEQ ID NO: 245964 - DNA, 1452 bp, Artificial Sequence
  Description of Artificial Sequence: Synthetic coding sequence
atgcctctgtactctgtgaccgtcaaatgggggaaagagaaatttgaaggagtcgaactcaacactgatgagcctccgatggtgtttaaggcccagttgttcgccctgactggcgtgcagcctgccagacagaaagtgatggtgaaagggggaaccctcaagggaatgaccctccttatgatgggcagtgccgatgctctgccagaggagccatccgctaagacagtcttcgtggaggacatgaccgaggaacaactagccagtgcaatggaactgccctgtggcctgaccaatttgggtaacacatgctatatgaatgccactgtgcagtgcattagatcagtgcctgagctgaaggacgccttgaaaagatacgctggcgcactgcgggcttccggagaaatggcctcagcacagtatattacagccgctttaagagacttgttcgattcgatggataagacatcatctagcatccctcccatcatccttcttcagttcctccacatggcatttcctcaattcgctgagaagggcgagcagggacagtacctgcagcaagacgctaacgagtgttggattcagatgatgcgtgtgttgcagcagaagttagaggccatcgaagacgatagtgttaaagagaccgattcctcatcggctagcgccgcaaccccatcgaagaaaaagtctctgatcgaccaattctttggagtggaatttgagaccactatgaaatgcacagagagcgaagaggaggaagtaaccaaaggcaaggagaaccagctgcagctgagttgttttattaaccaggaagtaaaatatctgttcacggggctgaagcttcgtttgcaagaggagatcacaaaacagagccctactctgcaacgtaatgcgctctacatcaagtcttctaaaatctcacgactgcccgcatatctgacaatccagatggttagattcttctataaagagaaggaatccgtgaatgcgaaagtcctgaaagatgtgaagtttcccctgatgttggatatgtatgaactatgcactcccgagctgcaggaaaagatggtcagctttcgttctaaattcaaggatctggaagacaagaaggtgaatcagcaacccaacacttcggataagaagagcagccctcagaaagaggtgaaatatgaaccattttcgtttgccgacgatataggctctaacaactgcggatactacgatttgcaggccgtgctgacccatcaggggagatccagctccagcggtcactatgtgtcgtgggtaaagcggaagcaagacgaatggatcaaattcgatgatgataaagtgtcaatagtgaccccagaagacattctgcggctgtcaggtggcggagattggcacatcgcttatgttctcctctacggccctagacgggtggaaattatggaggaggaatcagaacagtag

SEQ ID NO: 245965 - DNA, 1380 bp, Artificial Sequence
  Description of Artificial Sequence: Synthetic coding sequence
atgcctctttatagcgtgacggttaagtgggggaaggagaagttcgagggggtggagcttaatactgacgagccccctatggtgtttaaggcccagctgtttgccctgactggcgtccagcctgcccgtcaaaaagtaatggtgaaaggagggactctcaaggacgatgactgggggaacataaagattaaaaatatggagctaccctgtggcttaacaaacttgggaaatacctgttatatgaacgcaacagtccagtgtattcgctcagtgcctgagcttaaggacgccttgaaaagatacgccggtgcgctcagagcctccggcgagatggcatccgcacagtatatcacggctgccctgcgggacttatttgactcgatggataagacttctagttctatccctcctattatactactgcaattcctgcacatggccttcccccagtttgccgagaaaggagaacaaggacagtacctgcagcaggacgccaacgagtgctggatccaaatgatgcgcgtgctgcagcagaaactagaggctatagaggatgacagcgtgaaggaaaccgattcctctagcgcttcagctgctacccccagcaagaaaaaatcgctgatcgaccagtttttcggtgttgagttcgagacaacaatgaagtgtactgaatctgaggaagaggaagtgacaaagggcaaagaaaaccagcttcagctctcctgcttcattaatcaggaggtcaagtacctgttcaccggcctgaagctgcgcctgcaggaagagattaccaaacagagccccacactgcaacgcaacgccctgtatatcaaaagttctaagattagtaggctccctgcttatctaacgattcagatggtgagattcttctacaaagagaaggagtccgtaaacgctaaggtgctgaaggatgttaagttccctttgatgctcgatatgtatgagctttgcacgccagagctccaggagaagatggtcagttttcgctcaaagttcaaggacctggaggataagaaagtcaaccagcagcccaacaccagcgacaagaaaagctcccctcagaaggaggtcaaatatgagcccttttcgtttgccgatgatatcggctcaaacaactgcgggtactacgatctgcaggccgtgctcactcaccaggggaggagctcatctagcggacattacgtctcttgggtgaaaaggaagcaagacgagtggataaaattcgacgatgacaaggtgagcattgtgacccccgaggatatcctgagactctcaggcggaggggattggcatatagcgtatgtcttattgtatgggcctcggagggtggagattatggaggaagaatctgaacaatag

SEQ ID NO: 245966 - DNA, 2382 bp, Artificial Sequence
  Description of Artificial Sequence: Synthetic coding sequence
atgcctgccggacctgttcaggccgttccccctccccctccagtcccaacggagcccaaacagcctactgaagaggaggcttcatctaaggaggactccgccccaagcaaacccgtcgtggggatcatttacccccctccagaagtgcgcaacatcgtggataagaccgcatcgtttgttgcccgtaatgggcctgagttcgaagccagaattagacaaaatgaaatcaacaacccaaagttcaactttttgaacccaaacgatccgtaccatgcctactaccggcacaaagtgtcagagttcaaggaggggaaagctcaggagccgtcagccgctattcctaaagtgatgcaacagcagcagcagaccactcaacagcagctgccgcagaaagttcaagcccaagtcattcaggagaccatcgttcccaaagaaccacctcccgagtttgagtttattgctgatccaccatctatctctgcgttcgatctcgacgtggtcaaactgaccgcccagttcgttgctaggaacgggcgtcaatttctcacccaactgatgcagaaagagcagcgtaactaccagtttgattttctgcggcctcagcactcactgttcaactactttaccaagttggtcgaacagtatactaaaattcttattccaccaaagggtctgttctcaaagctcaaaaaggaggcagagaacccccgagaagtcctggaccaggtgtgttatagggtggagtgggcaaagttccaagagcgagaacggaaaaaggaggaagaagagaaggagaaggagcgcgttgcttacgctcagatcgattggcacgatttcgtagttgtcgaaaccgtggattttcagccaaatgagcagggcaactttccccctccaacaacacccgaagagcttggggctcgtatccttatccaggaacgatatgaaaaatttggggagagtgaggaggtggagatggaggtggaatccgatgaagaagatgacaagcaggagaaggccgaggaacctccttctcagcttgaccaagacacccaagtgcaggacatggatgaagggtccgacgacgaggaggaaggccagaaggtgcccccaccaccagaaaccccaatgcccccacctcttcctccaacgcctgaccaagttattgtcaggaaggattatgatccgaaggcctccaaacccctgcctcctgcgcctgctcccgacgaatatttggttagtcctatcactggcgaaaagatccctgcaagcaagatgcaggaacacatgagaatcggacttttggacccgaggtggctggaacagagggaccggtcaatccgcgaaaagcaatccgatgacgaagtatacgcacccggactggacattgagtcctcattaaagcaactggccgaacggcgtactgatatctttggcgtcgaggagacagcaatcggtaaaaaaattggcgaagaggagatccagaagccagaggagaaagtgacctgggacggccacagcgggtctatggcaagaacgcagcaggccgctcaggccaatattacgctgcaggagcaaatcgaggccattcacaaggccaagggccttgtacctgaagacgacacaaaggagaaaattgggccaagtaaaccgaatgaaattccgcagcagccaccccctccatccagcgcgactaacatcccctcatcagccccaccaatcaccagtgtgccaagacccccaaccatgccacctcccgtgcggactaccgttgtatctgcagtgcccgttatgccaaggccgcctatggcaagcgtggtcagactgccacctggttcggtaatagccccaatgcctcctatcattcatgctcctcgtattaacgtcgtgccaatgcccccaagtgcacctcctattatggcccctagaccgcctcccatgattgttcctaccgcctttgttccggctcctcctgtcgccccagtgcctgctcccgctcccatgccacctgtgcacccgccacctcccatggaggatgagccaacctcaaagaaattgaagactgaagactccttgatgcccgaggaagagttcttacgcagaaacaaagggcctgtgagtatcaaagtacaggtgcccaacatgcaagataagacagaatggaagctcaatgggcaggtgcttgtgttcaccctgcccctgaccgaccaagtctccgtgatcaaagtgaaaatacacgaggcaacaggcatgcctgccggaaagcagaagctccagtacgaaggcatcttcatcaaggacagcaacagccttgcctactacaacatggccaacggagcagtcatccatctggccctgaaggagagaggtgggagaaagaaatag

SEQ ID NO: 245967 - DNA, 732 bp, Artificial Sequence
  Description of Artificial Sequence: Synthetic coding sequence
accattcgcgttaaggacagcctgatttgcgtggattgcgctatggagagttctcggaattcatcgatgctgacgctaccgttaagcttgttcgacgtcgattccaagcctctcaaaacgctcgaggacgccctccactgcttcttccagcctcgagaactcagctctaaaagcaagtgtttctgcgagaattgtgggaaaaaaacccggggaaagcaagtactgaagctgacgcacctgccacagacccttactattcatttgatgcgcttctctattcgcaattcacagactcggaaaatttgccactccctctatttcccacagagtctagatttctcccagatcctgcccatgaaacgcgagagctgtgatgcggaggagcagtccgggggacagtatgagctctttgccgtcatcgcacacgtcggcatggctgattcaggccactattgtgtgtatatcaggaatgcggtggacggcaagtggttctgtttcaacgattcgaatatctgtctggtatcctgggaggacatccaatgcacttacggtaatcccaactaccattggcccccattcttgtgccacgcatgcattttaatcgaggacggtgaatacttgagactcttccggccagcaaacattcggcagttcacctcccgcgaggagacctgggtcgagtgttggtgtgtgctaaccctgcagtgcaagcagctgcaacaagtgtggtag

SEQ ID NO: 245968 - DNA, 1698 bp, Artificial Sequence
  Description of Artificial Sequence: Synthetic coding sequence
atgcctcaagcctccgagcatcgccttggtcggacacgagagcctcctgtgaatatccagcctagggtgggaagtaaacttccatttgccccacgagctcggagtaaagagcgacggaatcctgcctctggccctaatcccatgctgcggccactcccacccaggcccggtctgccagacgaacgcctgaagaaactagagctgggcagggggcgtacctccgggcctaggcctcgcggtccgctgcgggcagatcacggagtaccgcttcctggcagccccccaccaaccgtggcactgcccctgccttcacgtaccaatttggcccgatctaaatccgtcagctcaggagacctgcgccctatggggatcgcgctgggaggtcatcgcggaacgggagaacttggggcagcactttcccgtctggccttgagacccgagccccctactttacgccgttccacctcactacggagactgggtggcttccctggacctcccaccttgttttcgattaggaccgagccccctgccagccatgggagctttcacatgataagtgcgagatcatctgagccattctattcagacgacaaaatggcacatcatacattgctgctcgggtcaggccacgtggggttgagaaatctgggcaatacttgtttcctcaacgctgtgctgcagtgtctgtcttctactcggcctcttcgcgacttctgtctgcgacgcgattttagacaggaagtgcctgggggaggcagagcccaggaactgaccgaagcttttgctgatgtcatcggcgcactctggcacccggactcatgtgaggcagtgaatcctacaagattcagggccgtgttccagaaatatgtgcctagctttagcggatacagtcagcaggacgcccaggaattcctgaagctgctgatggagaggctgcatctggaaatcaacagacggggacgtcgcgcacccccaatactcgccaacggccctgtgcctagccccccaaggagaggcggtgctctgttggaggaaccggaattgtccgacgatgacagagcaaacctaatgtggaaacggtacctggagagggaagatagcaagatcgtcgatctgtttgtcggccaattgaagagctgcctcaaatgccaggcgtgcggctatcggagcaccaccttcgaggttttctgtgacctgtctctgcccattcccaaaaaaggattcgccggaggtaaggtctccttacgtgattgctttaatctgttcacaaaggaggaggaactcgagtcagaaaacgcccctgtgtgcgacagatgtaggcagaaaacccgctcaactaaaaaattaacagtgcagcggttccccaggattctagtattgcaccttaatcggttcagcgcaagtcgtggttctataaagaagtccagcgttggagtcgatttccccctgcaacgtttgtcgctgggcgattttgcttcggacaaagctggaagcccggtctaccagctgtacgccctgtgtaatcacagtggttctgtgcactacggccactatacagccctgtgtagatgccagaccggctggcacgtgtacaacgattctcgcgtaagtcctgtatccgagaatcaggtggcttccagcgagggatatgtgttattttaccagctcatgcaggaaccaccacgctgcctgtag

SEQ ID NO: 245969 - DNA, 1656 bp, Artificial Sequence
  Description of Artificial Sequence: Synthetic coding sequence
atgccacaggcctctgagcatcgcctcggcaggacacgcgaaccgccagttaatattcagccaagggttgggtcaaagctgcccttcgcaccccgagctcggtctaaggaaaggcgcaaccctgcgagtggcccaaatcccatgcttcgccctttgccgcctaggcctggcttgccagatgagaggttgaagaagttggaacttggaaggggtaggacctccggcccaagaccccgaggccctcttcgagccgatcacggggtgcctctgcctggttctcctccacctaccgtagccctgccactgccatccaggaccaacctggctaggagtaagtcggtaagcagtggggaccttcgcccaatgggtatcgctcttggtggccacagaggcacgggcgagcttggagcggcattatccagacttgccctgcgacctgagcccccaactcttcggaggtccacttcgctgcgaaggcttggaggatttcctgggccacctaccctcttcagtataagaaccgaacctccggctagtcacggatcctttcacatgatctctgcaagatcctcagaacctttttatagcgacgataagatggcacaccacaccctgttactgggatccgggcatgtaggactacgtaatctgggaaatacctgctttctcaacgcagtgttgcaatgtttaagctctacaagacctcttagggatttttgtctcaggagggattttcggcaagaggtgccgggtgggggacgggcacaggaactcaccgaagcatttgccgacgtgatcggagcgctgtggcatcctgactcttgtgaagccgtcaatcccactagattcagagccgtctttcagaaatatgtcccttctttcagcggctatagccagcaggatgcccaggaatttctcaagcttctgatggagcgactgcatctggaaattaatcgtagaggtcggagagctcccccaatactggccaatgggcctgtcccaagcccaccccgacggggtggtgcattgctggaagagcctgaactatctgacgacgacagggccaatctgatgtggaaaaggtacctcgagcgcgaggatagcaagatcgtggacctgttcgtcggtcaactgaagagttgtctaaaatgtcaggcctgtgggtaccggagcaccacatttgaggttttttgtgatttgtcccttcccatccctaaaaagggctttgccggtggcaaggtgtctttgcgggactgcttcaacctcttcaccaaagaggaagaacttgagtctgagaacgctcctgtgtgcgacagatgccgccagaaaacaagaagcaccaagaaattgacggtgcagagatttcctcggattttggtactccatctgaataggttctctgcgtcccgcggttcaatcaaaaagagttccgttggagtcgatttccctctgcagaggctgagcctgggggattttgcgtcagataaggcgggtagtgttcactacgggcattacacagctctgtgtcgttgccagaccgggtggcacgtatataacgactcacgggtttctcccgtatctgagaatcaggtagctagcagcgagggatacgtgctgttttaccagctgatgcaggagccaccacggtgcctgtag

SEQ ID NO: 245970 - DNA, 1698 bp, Artificial Sequence
  Description of Artificial Sequence: Synthetic coding sequence
atgccacaggcctctgaacatagactggggaggacacgcgagccaccagtgaacattcagccgagagtgggttccaagcttccctttgcccctagagctaggtcaaaagagcggagaaatcccgctagcggacctaaccccatgctgagaccgctacccccaagaccaggccttcctgatgagcgactgaaaaagctcgagctgggccgtggtagaacaagcggacccaggcctcggggacctttgcgggcagaccacggcgtgcccttacctggatctccaccccctacggtggccctgcccctgccatcacggaccaacttggcccgtagcaagtcagtgtcttcaggggacctaaggcccatggggattgcactgggagggcaccgaggcaccggtgaactgggggctgccttaagccgcctggccctcaggcccgaaccccctaccctacgtagatctaccagcctgcggcgactcggcggttttcctgggcctccgaccctgtttagcattagaaccgaacctccggcatcccatggttccttccacatgatttccgcccgtagcagtgagcctttttatagtgacgataaaatggctcatcataccttattgctgggctctggccatgtggggctgagaaatctgggaaacacctgcttccttaacgctgtgctgcagtgccttagttctacgcggcctctgagagatttttgccttcgacgcgatttcaggcaggaggtgcctggcggtgggagggcacaggaactgaccgaggcattcgccgatgtaatcggagccctgtggcatcccgatagctgcgaggccgtgaaccctacacgtttcagagctgtgtttcagaaatacgtgccgtccttttcgggctattcccaacaggacgcacaagagttcctcaagctgctgatggagcgactgcacctggaaatcaataggcgcggtcgaagagcccctcctattctggccaatgggccagttccaagccctcctcggaggggcggagcacttctcgaagaacccgagctcagcgacgatgatcgggctaatctcatgtggaaacgctatctggagagagaggactccaaaatcgtggacctgttcgtgggacagctgaagagttgcctcaagtgccaggcatgcggttacaggagtacaactttcgaagtcttctgcgatctctctctacctattccaaaaaaagggtttgctggtgggaaggtcagcctcagggactgcttcaatctttttacaaaagaagaggagctcgagagcgagaacgcccctgtgtgtgatcgatgccgacagaagaccagaagcaccaagaaactgaccgtgcagcggtttcccaggattctggtgctgcaccttaaccgattttccgcgtctagaggtagcattaaaaaatcctctgttggcgtggattttccattgcagagactgtcactcggtgattttgcctcagataaggccggatctcccgtgtaccagttatacgcactctgtaatcactccggaagcgtccactatggacactatacagctttatgtcgctgccaaactggctggcatgtgtacaatgactccagggtatccccagtgtctgagaaccaggtcgccagcagtgaggggtatgtgctattttaccagctgatgcaggagcctccaagatgcctgtag

SEQ ID NO: 245971 - DNA, 1578 bp, Artificial Sequence
  Description of Artificial Sequence: Synthetic coding sequence
atggtcagtagacccgagcccgaaggcgaagccatggatgctgagctcgccgtggccccaccgggttgctcacatttaggatctttcaaagtggataattggaagcaaaatctgcgggcaatctaccagtgttttgtctggtctggtaccgctgaggcaagaaagagaaaggctaagtcttgcatctgccacgtctgtggggtacacttgaatcgactgcactcatgtttgtattgcgttttttttgggtgtttcactaagaaacatattcacgaacacgctaaagccaaaaggcacaatttagccatagacctcatgtacggtggaatttattgctttctgtgccaggactacatctacgacaaagatatggaaattatagccaaggaggaacagaggaaggcgtggaagatgcagggcgtgggagagaagttttcaacgtgggagcccacaaaacgcgaactggagttattgaagcataaccctaaacgcagaaagataaccagtaattgtacgatcggactgcgcggactgattaacctgggcaacacatgttttatgaactgcatagtccaagcgctgacacatacaccgctgttgagggatttcttcctgagcgatcgacacaggtgcgagatgcaatccccttccagctgtcttgtgtgcgaaatgtcgtcattgttccaggagttttattctggccaccgttcaccccatattccctataaactgcttcacttagtgtggacacatgcacgacacctggccggatacgaacaacaggacgctcacgagtttcttattgctgcgcttgatgttctccacaggcattgcaaaggagatgataatggtaagaaggccaacaatcccaatcactgtaactgtataattgatcagatatttactggtggcctccagtcagatgtcacgtgccaagtctgtcatggtgtgagcacgacaatagaccctttttgggacatttccctggacttgcctggatcatccactcctttctggcccctttccccaggatccgaaggcaacgtggtcaatggtgagagtcacgtgagcggtacaaccacactgactgactgtctcaggaggtttaccagacctgagcacctgggttcttctgccaagatcaagtgttcaggatgccatagttatcaggaatcgacaaaacaactaaccatgaagaagcttccgatcgtggcctgtttccatctgaagaggttcgaacattccgctaaacttcggaggaaaataaccacctacgtatcctttccactcgaacttgacatgacacctttcatggcttccagtaaggagagtagaatgaacggacagtatcaacagccaacagattcccttaataatgacaataagtatagtctgttcgcagtggtgaatcaccaggggacacttgaaagtgggcattacactagctttatcagacaacacaaggaccagtggtttaagtgcgacgatgccatcatcaccaaagcctccatcaaggacgtcctggattcagagggctacttgttgttctaccataagcaattcttggagtacgagtag

SEQ ID NO: 245972 - DNA, 1782 bp, Artificial Sequence
  Description of Artificial Sequence: Synthetic coding sequence
gcagcggcagccagaggtaggtgtcttccctgctcgttgccatcagcgatcgcacagcctcacttatgcccagcctccgccttgtgtagcaggaggcccggacttggacaaccaggccaaccgcctagctcaccacacgctgccctggcttcctcttctcctcccagcccccctcctcccgcaagaggcagggctctgccaccaatggtgtcccgacccgaacctgaaggtgaggctatggatgcagagctagcagtcgctcctccaggatgttctcacctgggtagtttcaaagtggataactggaagcagaacctgagagctatctaccagtgctttgtctggtcaggaacagcggaggcacggaagagaaaagccaaaagttgcatttgccacgtgtgtggcgtgcacctgaatcgcctgcactcttgtttgtattgtgttttttttgggtgttttacaaaaaaacacattcatgagcacgcaaaagccaagaggcataatcttgccattgacctgatgtacggcggtatatactgttttctgtgtcaggattatatttatgataaggacatggaaataattgccaaggaggaacagaggaaagcctggaaaatgcagggcgtgggagagaaattctctacctgggagcccacgaaacgcgagctggagctgttgaaacacaaccccaaaaggagaaaaatcaccagcaattgcaccattggacttaggggcttgatcaacctcggtaacacctgcttcatgaattgcatcgtgcaggccctgactcacacacctttgttgcgtgacttttttttaagcgaccgccaccggtgtgagatgcagtcccctagctcctgtctggtgtgtgaaatgtctagcctgtttcaagaattctacagtggccacagaagtccccatattccatataaactgctgcacctggtgtggactcatgctcggcacttggctggctatgaacaacaggacgctcatgagtttctgatcgccgcactcgatgttctgcacaggcattgcaagggcgatgataacggaaagaaagccaacaatcctaatcattgcaactgcatcattgatcagatattcacgggaggtctacagtcggatgtcacatgccaagtgtgccatggggtcagtaccacgatcgacccattttgggacatctcactagacttacccggtagcagtacccccttttggcctctgagtccaggttccgaggggaacgtcgttaatggtgagagccatgtcagcggcacgacgaccctgaccgactgtctcaggcgctttacacggccagaacatcttggatcaagcgccaaaataaaatgcagcggctgccactcttaccaggagtccactaagcagttgaccatgaagaagttgccaattgttgcatgctttcacctgaaaaggttcgagcatagtgccaagttacggcgaaagattacaacttacgtgagcttccctcttgaactcgatatgacccctttcatggcctcttccaaggagtcccgaatgaacgggcaatatcagcagcccaccgacagtctcaacaatgacaacaaatatagcttatttgctgtggttaaccatcaggggacacttgagtccgggcactacacttccttcattagacaacacaaggaccaatggtttaagtgcgatgacgccatcattaccaaagccagtattaaggacgtactcgacagtgaagggtatctccttttctaccacaaacagttcttggaatacgagtag

SEQ ID NO: 245973 - DNA, 1542 bp, Artificial Sequence
  Description of Artificial Sequence: Synthetic coding sequence
atggcaccaggctggccctccctgagtgcaggttccaggcaggaggctccccaactcgcagcaggaggctcagcctaccaggcggtcggcagacagtttcaacccagggccaccgctctgcagggcccatcccaggccaagtcctgtatttgtcacgtgtgtggggtccatttaaatcgcttgcatagttgtctctactgtgttttctttggttgcttcactaagaagcacatccatgaacacgccaaggctaaaaggcacaacctcgccatcgacctcatgtacgggggaatctattgtttcctgtgccaggattacatctatgacaaggatatggaaattatcgctaaagaagaacagaggaaagcgtggaagatgcaaggcgtaggagaaaagtttagcacttgggaacccactaagcgggagctcgaactgctcaaacacaatcccaagcggagaaagatcactagcaactgcacgatcggcctcagaggcctaatcaatttgggaaatacatgctttatgaattgtattgttcaagccctcacccatacaccgctccttcgtgactttttcttgtccgaccgccaccgctgtgaaatgcaatctccatcctcttgcctagtctgcgaaatgtcctctctctttcaagagttctactccggccatagatcaccgcacattccctataaactgctgcacttagtttggacccatgccagacacctcgcaggctacgaacagcaggatgcgcacgaatttctaatagctgcactggacgttcttcacaggcattgtaagggggacgacaacgggaagaaggcgaataacccaaatcactgtaattgcattatcgaccagatcttcactggcggtttacagtccgatgtgacctgccaggtgtgtcacggggttagtacaacaatcgatcccttttgggacatcagcctcgatcttccgggatctagcactcccttctggcccctgtccccagggtctgagggcaacgttgtcaacggggagtctcacgtgtctgggactaccacattgactgattgtctcagacggttcacgaggcctgagcatctcggcagtagcgctaaaatcaaatgttccggctgtcattcctaccaagagtctaccaagcagcttaccatgaagaaattgcctatcgtcgcttgcttccacctgaagagatttgaacatagtgccaagctcagacggaaaattacaacctatgtgagttttccacttgagttagacatgactcccttcatggccagctccaaggagtctcgcatgaatgggcagtatcagcaacctacagatagtctgaacaacgacaacaagtacagcctgtttgcggtcgtcaatcatcagggcactctcgagtccggtcactacacttctttcatcagacagcacaaggatcaatggttcaagtgtgacgatgcgatcatcacgaaggcctctatcaaggatgtattggattccgagggttatctcttgttttaccacaaacaattcctggaatatgagtag

SEQ ID NO: 245974 - DNA, 7863 bp, Artificial Sequence
  Description of Artificial Sequence: Synthetic coding sequence
atggaatccgaggaagagcagcacatgacgacgctcctatgtatgggctttagcgacccggcaaccatcagaaaggcccttcggctggcaaagaacgatattaacgaggccgtagctctgttgaccaacgaaaggccaggtctggactacggtgggtatgagccgatggactccggaggcggaccgagccccggacccggtggcggacctcgcggagacggaggcggagatggaggcggtggcggaccttcccggggaggctccacagggggtggcggaggatttgatcctcctcccgcataccacgaggtggtcgacgccgagaagaacgatgagaacgggaattgttcaggtgagggcatcgagttcccaaccacaaacctctatgaactggagtctcgcgtgctgacagatcattggtctattccgtacaaaagggaggaaagtcttggtaagtgccttctggcttctacctaccttgctcggttgggcttaagtgaatccgatgagaattgccgtcgatttatggaccgctgcatgcccgaggccttcaaaaagctattgactagctctgccgtccataagtggggcaccgagatccacgaggggatttacaatatgttgatgctgctaattgaacttgttgccgaaaggattaaacaagatccaattcctacgggtcttttaggggtgctgactatggcattcaatcctgacaatgagtatcacttcaaaaatcgaatgaaggtgagccagaggaactgggcagaagtattcggcgagggcaatatgtttgcagtatctccagtcagtacctttcagaaagaaccgcacggttgggttgtggacttggtgaacaaatttggcgagctagggggattcgcagcgattcaggccaaactccattctgaagacatcgagctcggcgctgtgtcagcattgattcagccacttggagtgtgcgcagaatatctgaatagtagcgtcgtgcaaccgatgttggacccagtgattctaaccacaattcaagacgtgcggtctgtggaagaaaaagatttgaaggacaagcgcctggtctctatccccgaacttctgtcagcagtcaaattgctgtgcatgcgctttcagccggacctcgtaacgatagtggacgatctccgcttggatatcctactcagaatgcttaagagcccgcattttagtgcgaagatgaactcgctgaaggaggttaccaaactgattgaagatagcacactcagcaagagcgtcaagaatgcaatcgacacagacagactgctcgattggctggtcgagaatagcgtattatccatcgctctggaaggtaatatcgatcaagcccagtattgtgaccgcatcaaggggattattgagctgcttgggtcgaaactatccctggatgagttgaccaagatttggaagattcaatccgggcaaagctctacggtgatcgaaaacatccatactatcattgccgctgcagctgtgaaattcaatagcgaccaactgaaccatctgtttgtgcttattcagaaatcttgggagacagaatccgaccgcgtccgccaaaagctcttgtcattaatcggacgtataggccgtgaggcgaggttcgagacgacctccggcaaagtgctcgacgtgctgtgggaactggctcaccttcctactctgccttccagtctcattcagcaggctctggaagaacacctgactatcctcagtgacgcctacgccgtgaaggaggccataaaaaggagctacatcataaagtgcatagaagacatcaagaggccgggagagtggtctggcctggagaagaacaaaaaagatggattcaaaagctcacagctgaacaacccacaatttgtgtgggtggtccctgcattacgacagttacatgagatcactcggtcgtttattaagcagacgtaccagaaacaggacaagtccatcatacaggatctgaaaaagaactttgagatcgtgaaactggtgaccggatcgctgattgcttgccatcggctcgcggcagcagtcgccggtccaggcggactgtctggtagtaccctagttgatggacgatacacttatcgcgagtatctcgaggcccatctgaagttcctagcctttttcctccaggaggccacactctacctgggctggaaccgagccaaggaaatctgggagtgcctagtcacagggcaggacgtgtgcgagcttgaccgagaaatgtgcttcgagtggttcaccaagggacaacacgacctcgagagcgacgtgcagcaacagctatttaaggagaagatcctcaagctcgagtcatatgagatcactatgaatggcttcaatctgtttaagaccttctttgagaacgttaacctgtgtgatcacagactgaaaagacagggtgctcaactgtatgtggagaagctggaactgatagggatggactttatctggaaaatagcaatggaatcccccgatgaagaaatcgccaacgaggccattcagttgattatcaattattcttacatcaacctgaacccccgactgaagaaagattccgtgagcctccacaagaaattcatagccgactgttacacgcgtctagaggccgcatctagtgcactggggggacctaccctgacccatgccgtcactagagctaccaaaatgttaacagccacagctatgcccacagtagccacctctgtgcagtccccctacagatcaaccaaacttgttatcatcgaacgcttgttgttacttgcagagcgatacgttattaccattgaggatttttacagcgtccctcgcaccattcttccccacggggcttcctttcacgggcacctgctaaccttgaatgtgacctacgagtccactaaggacacgttcactgtggaggcccattctaacgagacaatcggttcggttcgctggaagatcgccaagcagctgtgcagtccagtggacaatatccaaatttttactaacgattcactactgacggtgaataaggaccagaaactcctccatcaactgggcttctcggatgaacaaatcttgacggtgaagacatccggatccggaactccgagcgggtcctctgcagactcgagcacctccagcagctcatcctcctccggcgtgtttagctcttcatacgcaatggaacaggagaagtcattgcccggagtcgtgatggccctggtgtgcaatgttttcgatatgctataccagttggccaatctcgaagagccacgtatcactctgcgggtccgcaagctcttgctgctcataccaactgaccctgccatccaggaggcgctggaccagctcgattcattagggaggaaaaagactcttctttctgagtcgtctagccagtcttccaagtctcccagtctgtccagcaagcaacagcaccagccgtctgccagcagtatcctggagtcactctttcgcagcttcgcgccaggaatgagtacattccgcgtgctctacaatctagaagtactgagcagcaagctgatgccgacagccgacgacgatatggctaggtcatgtgccaagtccttttgtgagaatttcttaaaggcaggcggactctccctggtagtgaatgtgatgcagcgggattcaatcccaagcgaggtggactacgaaactcggcaaggggtgtactccatatgcctgcagcttgccagatttctcctggttggccagacgatgcctaccctgctggacgaagaccttaccaaggatgggattgaggccctgagttccaggccttttaggaatgtgagcagacaaacaagcagacaaatgtccctgtgcggaactcccgagaagtcaagctatcgtcaactctccgtgagcgacagaagcagcattagagtggaggagatcatccctgcagctagggtggccatacagaccatggaagtttcggattttacttccactgtcgcatgttttatgagattgagttgggccgcagccgcaggtaggctggacctagtaggcagctcacaacctattaaggaaagcaactcactgtgccctgccggtatccgcaatcgcctctcctcaagcgggtccaactgttcatccggttccgaaggagagccagtcgcactccacgcaggcatttgcgtgagacaacagagtgtgtccacgaaggactctttaattgcaggcgaggctctgtctctactggttacctgtcttcagttacgaagtcagcagctggccagcttttacaatctcccatgcgtggctgactttatcattgatatcctgctcggctctcccagcgctgagatccgaagggtggcttgcgaccagctatacaccttgtctcagactgacacatcagctcacccagatgtccaaaaacccaaccaatttctgctcggcgtaatactcacggctcagttacctttgtggagcccgacgtccatcatgaggggagtcaatcagagactgctgtcccagtgcatggaatacttcgacctgcgttgccagctgctcgacgatctcactacctccgaaatggaacagctgaggataagtccggcaaccatgctggaggacgagatcacttggctggataattttgaacccaatcggaccgccgaatgcgagacttcagaggccgataacatactactcgctgggcatctgaggctgatcaaaacgttgctctccttatgtggagcagagaaagagatgttagggtcatctctgattaagcccctgttggacgacttcctgtttcgggctagccgaattatactgaattcgcacagccctgctggcagcgccgctatatctcagcaggattttcacccaaagtgcagcacagccaacagccgattggctgcctatgaagtgctcgttatgttggctgattccagcccatccaacctccaaatcattatcaaagagcttctgagcatgcaccatcaacccgatcccgcactgacaaaagagtttgattatttgccacccgtagattctaggtctagttcagggtttgtaggactgaggaatggcggagccacttgttatatgaacgcagttttccagcagctgtatatgcagcccggactacctgaatctcttctctctgtggacgacgatactgacaatccagatgacagcgtgttctatcaggtccaatctctgtttggacacctgatggaatcaaagctgcagtattatgtgccagaaaatttctggaaaatatttaagatgtggaataaagagctgtatgtcagagaacaacaagacgcgtatgaatttttcacttccctgatcgaccagatggacgaatacctgaagaagatgggccgagaccaaatattcaaaaacacttttcagggcatctatagcgatcagaagatctgcaaggattgcccccataggtacgaacgcgaggaggcatttatggccttaaatttaggagtaacgagctgccagtcgctcgaaatctctttggaccagttcgtgagaggcgaggttttggaaggcagtaatgcttactattgcgagaaatgtaaggaaaagcgaatcaccgtcaaacgaacgtgcatcaagtccctaccatccgttctggtgattcatcttatgaggtttggctttgactgggagagcgggagatccatcaaatatgacgaacagatcagattcccctggatgctcaatatggagccttatactgtctctggaatggcacgacaggatagcagttctgaggtgggcgagaacggccgaagcgtggatcagggaggcggaggttctccgagaaaaaaggtggccctcactgagaactacgaacttgtaggggtgatcgttcactccggccaggcgcatgctggtcactactatagctttattaaagataggagaggctgcggtaaaggcaaatggtacaagttcaacgacaccgttatagaggagttcgaccttaatgacgagacactcgaatatgagtgctttgggggtgaatatagacccaaggtgtacgaccagacgaacccttacacggacgtgagacgtcggtactggaacgcctatatgctgttctatcagcgcgtgtcggatcaaaactctccagtcctgcccaaaaaatccagagtgtcagtggtacgccaggaagccgaggatctatctctgtctgctccgagttcacctgaaatcagccctcaatcatcacctagaccgcatcgcccaaataatgacagactttccatcctcaccaaacttgtgaagaagggcgaaaagaaggggctgttcgtagagaaaatgcctgcgaggatttatcagatggtgcgcgacgagaaccttaagtttatgaaaaatagggacgtgtattcaagtgactacttcagctttgtcctctctctagccagtttgaacgcaaccaagttaaaacacccatattacccgtgtatggcaaaggtgtctctccagctggccattcagtttctctttcagacctacctgaggacaaagaaaaagctgcgcgtcgacacagaggagtggattgctacgatcgaggctctactcagcaaaagcttcgacgcgtgccagtggctggtggaatacttcatctcttccgagggcagggaattaataaaaattttccttcttgagtgcaatgtgagagaggtgagggtggcggtcgctaccatcctggaaaagacgcttgactcagctctcttttatcaagacaagctgaaaagcctccatcagctcctggaggtccttctggctttgctggacaaagatgtgcccgagaattgtaaaaactgtgcgcaatatttctttttgtttaacaccttcgtccagaagcaagggatccgggcaggggatctgctcctccggcatagcgcactgcgccacatgattagcttccttttgggcgcttcaaggcagaacaatcagattcgcagatggagctccgctcaggctagggaattcgggaatctacataacaccgtagcgctgttagtgctgcactctgacgtttcctcccaacgcaatgtcgctcctggcatcttcaaacagcgtccacctatctctattgccccaagctcccctctcctgcccttgcacgaggaagttgaagccttactttttatgagtgagggaaaaccgtatctgctggaggtcatgttcgctttaagagaattaaccgggtcattgcttgctctgatcgaaatggttgtgtattgctgcttctgtaacgaacatttcagctttacgatgctgcatttcattaaaaatcagctggagaccgcaccacctcacgagctgaagaacacattccagctgttgcatgaaatcctggttatagaagatccgatccaggtcgaaagggtgaagtttgtattcgagaccgaaaatggcctactagcactgatgcaccacagcaaccacgtggatagtagcagatgttaccagtgcgtgaagtttcttgtgacccttgctcagaaatgtccagctgccaaggaatatttcaaggaaaacagccaccattggtcatgggccgtgcagtggctgcaaaaaaagatgtcagaacattactggaccccgcagtctaacgtgtccaacgaaacttcgactggtaaaacctttcagcggacaatcagtgcacaagatacacttgcttacgcaaccgcgctgctcaacgaaaaagagcagtccgggtccagcaacggttcggagtcttcacctgccaacgaaaacggcgatcgacacctgcagcagggcagcgagtcccctatgatgatcggtgaactgagatctgatctggacgatgtcgacccctat

SEQ ID NO: 245975 - DNA, 7382 bp, Artificial Sequence
  Description of Artificial Sequence: Synthetic coding sequence
atgaccactctgctgtgtatggggtttagtgaccccgctacgatccgcaaggccttgcggcttgccaagaacgatataaatgaggccgtagcattactcactaacgaaagaccgggtctggactatgggggttatgagcccatggattccgggggactttcagaatccgatgagaattgtaggagattcatggataggtgcatgcctgaagcctttaagaagctgttaactagcagcgccgtgcataaatggggcactgaaattcatgaaggcatctataacatgctcatgttgcttatcgagctggtggccgagcgcattaaacaagaccccattcccacggggctcctcggtgttctgaccatggccttcaatcctgacaacgagtatcatttcaagaacaggatgaaggttagccagaggaattgggcagaagtctttggcgaagggaatatgttcgcagtgagccccgtctccacgtttcaaaaggaaccccatgggtgggttgttgatctcgtgaacaagttcggggaactgggcggttttgcagcaattcaggccaagctgcactctgaggacatagagctgggggctgtcagcgccctgatacaaccactgggtgtgtgcgcagagtatctcaacagcagtgtggtccagcctatgttagacccagtgatcctgacaacaatccaagacgtaagaagcgttgaggaaaaagacctcaaggataaacggcttgtgtccattcctgaactgctgagcgcggtgaagcttctgtgtatgcggtttcagccggacctagtcaccatagtggacgacctgcggttggacatcttgttgcgaatgctgaagagcccacattttagtgccaagatgaattctcttaaggaggtaacgaagctgatcgaggatagtaccctgtcaaagtcggtaaaaaacgccattgatacagatcgattgctagactggctggtcgagaatagcgtcctatctatcgcattagagggcaatatagaccaagcccagtactgcgaccggataaaaggaataatagagctgttaggatctaagcttagccttgacgagttgacaaagatctggaaaatccaatccggccagagttccacagtgatagaaaatatccataccatcattgcggcagccgctgtgaagtttaattccgaccagctcaatcacctgttcgtgcttatccaaaaggtgttagatgtgctgtgggagctcgcccatcttcctacccttccttccagtctgattcagcaggccctggaggagcatctgaccattctgtccgacgcatatgcggtgaaagaagcaattaaacgcagttatattatcaaatgcattgaggacatcaaaagaagttcccagctcaacaatccacaattcgtttgggtagtgcctgctttaaggcagctccacgaaatcacacgctcattcattaagcaaacctaccagaaacaggataaaagcatcatccaggatcttaagaaaaactttgaaattgtgaaattggtcacgggatccctcatcgcatgtcataggcttgccgcagctgtcgccggacccggtggcttgtctggtagtaccctcgtcgatggcaggtatacctaccgggagtacttggaagcacacttgaagtttcttgcctttttcctgcaagaggctaccctgtacttaggctggaaccgggctaaggagatatgggaatgtttagtgactggtcaagatgtgtgtgagctggatagggagatgtgctttgagtggtttacaaagggacagcatgatctcgaatcggacgtgcagcagcagctgttcaaggagaagattctgaagctggagagttatgaaattactatgaatggctttaacctgttcaagactttctttgagaatgtcaacctatgtgaccatcgcttaaagaggcaaggagcccagctgtatgtggagaagctggaactcatcggcatggacttcatctggaaaattgctatggaatcacccgacgaagaaattgccaatgaggccatccaactgataatcaactatagttacatcaatttaaacccaagacttaaaaaagatagtgtttcgctccacaaaaagtttatcgcagactgctacacaagattggaggcggcttccagtgccctcgggggtccaacactgactcacgccgttacgagagctacaaaaatgctcaccgcaaccgcgatgcctacagtagctacgtcggtgcagtctccatataggagcacaaaactcgtgatcatcgaacggttactcctgctggccgagaggtacgttatcacaatagaggacttttactctgtgccacgcactatactgcctcatggggctagctttcacggccatcttttgactcttaatgtgacgtatgaaagcaccaaagataccttcactgtagaagcccattctaacgagacgatcggaagcgttaggtggaaaatcgcgaagcaactgtgctcaccagtcgataatatccagatctttactaacgactcactgctgaccgtaaataaggatcagaagcttttgcatcagctcggattcagtgacgaacagatcctcaccgtgaagaccagcggctcggggactccaagtggttcatcagccgacagtagcactagctcgtcttcgtcctcctctggcgtgtttagctcaagttacgcaatggagcaggagaagtctctgcccggtgtcgtgatggctctggtctgcaacgtattcgacatgctgtatcagctggcgaatctggaggaacctaggattactctacgggtgagaaagctgttgctgctgatccccacagatccagccatacaggaggctcttgatcagttggattctctgggccgaaagaaaaccctcctgtctgaatcttcaagtcaatcatctaagtcgccaagtctcagttctaaacagcaacaccagccaagcgcctccagcatacttgagtcactttttagatcctttgcacccggtatgagtacttttcgagtactgtacaatttggaggtcttgagttctaagctgatgccgaccgcagatgacgacatggccagatcatgcgccaagtccttttgcgaaaacttcttgaaagccggaggcctcagcctggtcgtgaacgtgatgcagcgagatagcattccaagcgaagtagactatgagactcgccaaggcgtctactctatctgtctgcaacttgccagatttcttttagtagggcagacgatgccaacactccttgacgaggatcttaccaaggacgggattgaggctcttagttccaggccatttcgtaatgtaagcaggcaaacttcccgccagatgtccctctgcggcacccccgagaaatccagctatagacagctgtccgtgtctgacaggtccagtatccgagtggaagagataattcctgccgctagagttgccatccaaactatggaggtctccgatttcacttcaaccgtcgcttgttttatgcgcttgagctgggccgcagcagctggcagactggatctggtgggatcttctcagcctattaaggaatctaacagtttgtgtcccgctggtatccggaatcgactatcatcctccggctctaattgtagttctggatctgagggagaaccagtggccctccacgcaggaatctgcgttaggcagcagtcggtctcgacaaaagactccctcattgccggagaagccttgagtctgttggtgacttgcctgcagctccggagccagcagctagcaagtttttataatcttccctgcgtggcggacttcattatcgatattctgctgggaagccccagcgctgagattcggagggtggcctgtgaccaactatataccttgagccagacggataccagcgcccatccagatgtgcaaaaaccaaaccagttcttattgggagtgatactgaccgcgcaactgcccctctggtcccccacttctattatgcggggtgtgaatcaacggcttctgtcacagtgtatggagtactttgacctccgctgccagctacttgatgacctcaccacaagcgagatggaacagctgagaatctcccccgctaccatgttagaagacgaaatcacttggttggacaactttgagccaaaccgcactgccgaatgtgaaaccagcgaggccgacaatatcctgctagccggacatctgcgcctcattaagaccttactgtctctgtgtggggctgagaaagagatgttaggctctagtctcattaagccattgctggacgacttcctgttccgagcctccaggattatcctcaattcccattcaccagccggttccgcagccatcagccagcaggactttcatcctaagtgttcaacagccaactctcggcttgcagcatatgaagtgctggtcatgctggctgactcctctccatctaacctccaaataattattaaggagcttctgagtatgcaccaccagccagatcccgctctaacaaaagagttcgactatttgcctccggtagattccagatcctcgtctggcttcgtgggccttaggaacggaggcgctacctgttatatgaacgcagtgtttcaacagctgtatatgcaaccaggcctgccagagagtcttctgagtgtggatgacgacacagataatccggatgatagcgttttctatcaggtccagtccctgtttggacacctcatggagtcaaagctgcagtactacgtccctgagaatttttggaagatctttaaaatgtggaataaggagttgtatgttcgcgaacagcaggacgcctacgagttttttacttcgcttatagatcagatggacgagtacctgaagaaaatggggagggaccaaatttttaagaacactttccaggggatatactccgaccaaaaaatctgcaaagattgtcctcacaggtacgagcgggaagaagcattcatggctctgaatttaggggtgacctcttgtcagagccttgaaatcagtctggaccaatttgtgaggggcgaagtgcttgaaggttctaacgcatactactgtgaaaagtgcaaggagaagcgtattaccgttaaaaggacttgcatcaaatcactcccttcagtgcttgtgatccatctgatgcggtttggattcgactgggaaagcggtaggtctatcaaatacgacgagcagatacgcttcccctggatgctgaacatggaaccctataccgtctcagggatggccaggcaggactctagcagcgaggttggggaaaacggaaggtctgttgaccagggaggaggcggtagcccaaggaaaaaggtggccttgacagagaactacgaactggtgggggttatcgtgcattccgggcaggcacacgcaggtcattactactctttcatcaaagataggagaggatgtggaaaaggaaagtggtacaagttcaacgacaccgtaatcgaggaattcgatctgaatgacgagacattggaatacgagtgttttggcggtgagtatcgcccaaaggtctacgatcagacaaatccctacaccgacgtgagacgcagatattggaatgcctatatgctattctaccagagggtatcagatcaaaactcccctgtgctcccaaaaaagagtcgggttagcgtcgtgaggcaggaagccgaggatctctctctcagcgcgccaagctctcctgaaatctctcctcagtcatctcctaggcctcatcggccaaataatgatcggctgtcaatcctcactaagttggtgaaaaagggcgagaagaaggggctgttcgtggagaagatgcccgcacgtatctatcaaatggtaagggatgagaacctgaagtttatgaagaatagggacgtctatagctctgactatttctcgtttgtgcttagcctggcttcactgaatgcaacaaaactaaagcacccttactacccatgcatggccaaggtgtctctgcagctggcaatccagtttctcttccagacatatctgcgtacaaagaagaagctgcgagtagatacagaggaatggattgcgaccatcgaggccctcctgagcaagtcgttcgatgcttgccagtggctggtggaatacttcatcagcagcgagggacgggagttgatcaaaatttttctcctagaatgtaacgtgcgggaagtccgcgtcgcagtggcgactattcttgagaagactctggacagtgccctgttctaccaggacaagttaaagagccttcatcagctcctggaggtcctgctggctctcctggataaggatgtccccgagaactgcaaaaactgtgcccagtactttttcttatttaacacatttgtgcaaaaacagggtatccgcgcaggagatctcctcctgcgtcactccgcgttacgtcacatgatcagcttccttctgggggcttcgcgccagaacaatcagatccgtcggtggagtagtgctcaagccagggagtttgggaacctgcacaacacagtcgcactgctggtgttacattcagatgtgagtagccagcggaacgtggcccctggaatcttcaagcagcgtccgcctatctccatcgccccaagcagccctcttttgcccctgcacgaggaggtggaagctttactgtttatgtcagagggcaagccttacctacttgaggttatgttcgcactcagagagcttaccggaagtctcctggcccttatagaaatggttgtgtattgttgcttctgtaatgagcactttagcttcacaatgcttcatttcatcaaaaaccagcttgagactgcccctccacatgaactgaagaataccttccagttattacacgaaatcctcgtgattgaggatccaattcaggtcgaaagagttaagtttgtattcgagacagaaaacggactgctggcccttatgcatcatagtaatcacgtagactcctccaggtgctatcagtgcgtcaagttcctggtcaccctcgctcaaaagtgccctgccgctaaggaatactttaaggagaatagtcatcattggagctgggcagtccagtggcttcagaaaaagatgtccgagcactactggactccacaaagtaacgtatcaaacgagacaagcactggtaaaacgttccaaagaacgatttccgcacaggacaccttggcatacgctaccgctctcttgaacgagaaagaacagtcagggtccagtaatggctctgagtcgtcacccgcaaacgaaaatggggacaggcatctgcagcagggttctgaatctcccatgatgataggcgagctgcgctcagacctggacgatgtagatcccta

SEQ ID NO: 245976 - DNA, 2742 bp, Artificial Sequence
  Description of Artificial Sequence: Synthetic coding sequence
atggctgcgctctttttgcgcggattcgtccagattgggaactgcaaaacaggaatcagtaaatcaaaggaagcattcatcgaagccgtggaacggaagaagaaggacagattagtgctgtacttcaagtctgggaagtactctacctttcgcttgtccgataacatccaaaatgttgtgctgaagagctaccggggtaaccagaatcacctacatctaaccttgcagaacaacaacgggctctttatcgagggactgtctagcacagacgccgaacagctgaagatcttcctcgaccgcgtgcaccagaacgaggttcagcctccagtgagaccagggaagggcggtagcgtgttttccagcacgacccagaaagaaattaacaagacttcattccacaaggtggatgagaagtccagttccaaatcatttgagatagctaagggctctggaaccggcgtgctgcagcgcatgccgctcttaacatcaaaactgactttgacatgtggagaacttagcgaaaaccagcataagaaaaggaagagaatgttatcctcctcatccgagatgaatgaagagttcctgaaagaaaacaattccgtggaatacaagaagagcaaagctgactgttcacggtgcgtaagctataaccgagagaaacagctgaagttaaaagagctggaagagaacaaaaaactggagtgcgagtcctcctgtatcatgaatgcaactggtaacccctacctggatgacattggtttgctccaggccctgactgaaaagatggtactggtctttcttctgcagcagggatacagcgatgggtacaccaagtgggataaacttaaactcttctttgagctgtttcctgaaaagatttgccatggattgcccaaccttggcaacacatgctacatgaatgccgtcctgcaatctttgcttagcataccaagcttcgctgacgatcttctcaatcagtcttttccttgggggaaaatccccttgaacgctctgaccatgtgcctggccaggttactgttctttaaggacacatacaacatcgagattaaggaaatgttacttctcaatctaaagaaggcaattagcgccgctgcggaaatatttcatggcaacgctcaaaacgacgctcatgaattcctggcccactgcctggatcaactgaaagataacatggaaaagctgaatactatctggaagcctaagtctgagttcggggaggataattttccgaagcaagtttttgcagacgaccccgatacttccgggttttcctgccccgtgatcacgaattttgagctggagcttctccactcaatcgcatgcaaagcctgtggacaggttattttgaagaccgagctgaataattaccttagcataaacttgccccagaggataaaagcccatccctcgagcatccaatccacttttgatttgttttttggggctgaggagctagagtataagtgtgcaaaatgcgaacacaagacaagcgtgggtgtccacagcttttcaagactgccacgaatactgatcgtacatctcaaaagatacagtctcaatgagttttgcgccttaaagaaaaatgatcaggaggttatcatcagtaagtatctgaaggtgtcctcacactgcaatgagggcacacgcccacccctccctctaagtgaagatggggagattacagatttccagctgctgaaggtcatccgcaagatgacaagcggtaatattagcgtgtcatggcccgcaactaaagagtcaaaggatatcctagcaccgcatatcggctccgacaaggagagtgaacaaaaaaaggggcaaaccgtgttcaaaggggcaagtagaagacagcagcagaaatatctcggaaagaacagcaagcccaacgaactggaatctgtgtacagcggcgacagggcgtttattgagaaagagcctttggctcacctcatgacatatttagaagatacatccctgtgccaattccataaagccggtggtaagcccgctagttcaccagggactccccttagcaaggtggatttccagaccgtgcctgagaaccctaaacgcaagaaatacgtgaagacaagtaagtttgtggcatttgatcgcattattaaccccacaaaggatctctacgaggacaagaatattcgaattccggaaagatttcagaaagtttctgagcagacacaacaatgtgacggcatgcgtatctgcgaacaggcaccacagcaggctctgcctcagtcattccctaaaccaggaactcagggtcataccaaaaacctgctgagacccactaagctgaacctgcagaagtcaaaccggaactccctgctcgcactgggttccaacaaaaacccacggaataaggatatcctggacaagatcaagtcaaaggccaaagagaccaaaaggaatgacgacaagggcgatcacacgtacaggctcatctctgtcgtgagtcacttgggcaagactctgaagtctgggcattatatctgtgacgcctacgactttgagaagcaaatttggtttacatatgacgatatgagagtgctcggtatccaagaggcgcagatgcaagaagacagaagatgcacaggatatatatttttttacatgcacaacgagatattcgaagaaatgctcaagcgcgaggaaaacgctcagctgaattccaaggaggtcgaggagaccctacaaaaagagtag

SEQ ID NO: 245977 - DNA, 2742 bp, Artificial Sequence
  Description of Artificial Sequence: Synthetic coding sequence
atggcggcattgtttttgaggggatttgtacaaatcggaaactgtaaaaccgggatatctaagagcaaagaagctttcattgaagccgttgaaaggaagaaaaaggatcggctagtgctgtacttcaaaagcggcaaatatagcacgtttcggctaagcgacaatatccaaaacgtggtcctgaagagttatcgaggaaatcagaaccacttgcatctgaccctgcagaataacaatggcctcttcatcgagggtctgagctctacagatgcagagcaactgaaaatcttcctggaccgggtgcaccagaatgaagtgcagccaccggtcaggccaggtaagggtggtagcgtgttctctagcactacccaaaaagaaattaacaaaacatcctttcataaggtggacgagaagtcatcgagcaagtcattcgagatcgccaaaggctctggaacgggggtcttacagaggatgcctctgctaacatctaagcttaccctcacgtgtggcgagctgagcgagaaccagcataagaaacgcaagcgcatgcttagctcttcaagcgaaatgaatgaggagtttctcaaagagaataacagtgtcgaatacaaaaaatccaaggcagattgttcccgatgtgtatcctataatagggagaagcagcttaaactcaaggaacttgaagagaataaaaaactggagtgcgagagcagttgtattatgaacgccacaggaaatccgtatcttgatgatattgggctgctgcaagcactgaccgaaaaaatggtgctggtgtttctcctccagcaaggctactctgatggatacactaaatgggacaagctaaaactcttttttgagctgttccctgagaagatctgccatgggcttcccaatctgggcaatacttgctatatgaatgccgtgctgcaatccttactgagtatcccttcattcgctgatgatctgctcaaccagagtttcccttggggaaaaatccccttaaatgcccttacgatgtgcctggcgagactcttattctttaaagatacctacaatatagaaattaaggagatgcttctgttgaatttgaagaaggctataagtgctgcagccgaaatcttccatggaaacgcgcagaatgatgcacatgaattcctggcccactgcttagaccagttgaaggataacatggagaaacttaacaccatctggaaaccaaagagcgaattcggcgaagacaactttcccaagcaagtttttgccgacgaccccgacacaagtgggtttagttgtcctgtcatcaccaactttgagctggaactgttgcacagcattgcatgcaaggcttgcgggcaagtcatactaaagaccgagctgaataattacctgtccattaatttgccacagagaattaaggctcacccctcaagcattcagtctacattcgacctctttttcggggctgaagagttggaatacaaatgcgcgaaatgcgaacataaaacaagtgtgggggttcattcatttagtaggctgccccgtattctgatcgtgcatctgaaacgctattcactcaatgagttctgcgccctgaaaaaaaacgatcaagaggtcattatcagcaagtacctcaaggtgtcaagtcattgcaacgagggcacaagacccccactacccctaagcgaggatggagaaatcaccgatttccagctccttaaggtgatccgcaaaatgacctctggtaacatctccgtgagctggcccgctaccaaggaatcgaaagatatcctggctcctcacattggttccgacaaggagagtgaacagaaaaagggccaaactgtgtttaaaggcgcttccaggagacagcagcaaaagtacctggggaagaactctaagcccaacgaattggagtctgtatacagcggggacagagccttcattgagaaagagcctcttgcacacctaatgacttatttagaggatactagcctgtgccagtttcacaaagccggaggcaaaccagcttcaagtcccggaacccccctgagtaaagtggatttccagacggtgccagaaaaccctaaacgaaaaaagtacgtcaaaacatctaagttcgtagctttcgataggatcattaatccaacgaaggatctctacgaggataagaatataaggatccctgagaggtttcagaaggtaagcgagcagactcagcagtgcgacggcatgaggatttgcgagcaagccccacagcaggctctcccacaatcttttcctaagcctggtacccaaggccacactaaaaacctcctcagaccaaccaaattaaacctgcaaaagagtaacagaaactccctgctcgctctcggaagcaacaaaaaccccaggaacaaagacatcctggataaaattaagtctaaagccaaggaaaccaaaagaaacgatgataaaggggatcatacttacagactaattagcgtggtgtcacatctgggtaagacccttaaatcagggcattacatttgcgacgcatatgatttcgagaagcagatctggttcacctatgatgatatgagagttctgggcatccaggaggcccagatgcaggaggacaggcggtgtacagggtacatattcttctatatgcacaatgaaatcttcgaagaaatgctcaagagagaagaaaatgcacaactgaacagtaaagaagtggaggagacactgcagaaagagtag

SEQ ID NO: 245978 - DNA, 3234 bp, Artificial Sequence
  Description of Artificial Sequence: Synthetic coding sequence
atgacagccgagctccagcaggacgatgccgctggggctgccgacggtcacggaagtagctgccaaatgctgctgaatcaactccgcgaaatcactggcatacaggacccatctttcttgcatgaagctctgaaagcttctaatggagacatcacacaggccgtgtcactgctgacggacgagagagtgaaggaaccatctcaagataccgtggctactgaaccctccgaggttgagggaagtgctgcgaacaaagaggtgcttgcaaaagtgatcgatttaacccacgacaataaagatgatctacaagcagctatcgcactttccctcctggagtccccaaagatccaggccgatgggcgagatctgaatcgcatgcacgaggccacttccgctgaaacaaagcggtcgaagaggaaacggtgcgaggtatggggggaaaacccaaaccctaacgactggagacgagttgatggatggcccgttggactgaagaacgttggcaacacctgttggttctccgcagtcatccagtcattgttccagctgcctgaatttcggagactggtgctctcatactctctcccccagaatgtgctggagaattgtaggtcacataccgaaaagaggaacatcatgtttatgcaggaattgcagtacctatttgccctgatgatgggtagtaacagaaaattcgtcgatccctccgccgctctggacctgctcaagggcgcattccgcagttccgaggagcaacagcaggatgtctcagagttcacacacaaacttttggattggctggaggatgcattccagctggccgtgaatgttaattctcctcgcaacaagtccgaaaatccaatggtccagttgttctatggaacgttcttgaccgaaggcgtgcgggaaggcaaaccgttttgcaataacgagacatttggtcaataccctctgcaagtgaatgggtacagaaatctggatgagtgcctggaaggcgctatggtcgaaggtgatgtagagctgttacctagtgaccatagcgtgaagtacggacaggaacgttggtttacgaagctgcctccagtgctgaccttcgagttgtcaagattcgagtttaatcagtccctggggcagcccgaaaaaatacacaacaagttggaattccctcaaattatctacatggacaggtatatgtacagatcgaaagagctgattaggaacaaacgcgaatgtatcagaaagctgaaagaagaaatcaaaatcttgcagcagaagctcgaaagatatgtgaagtacggtagcggccctgcacggttccccttgccagatatgctcaaatacgtgatagaatttgctagcactaagcctgcttccgagtcttgtccacctgaatccgatacccacatgacacttcctctttcctccgtacattgctcggtgagtgaccagaccagcaaggaatccacctcgactgaatcgagcagccaggatgtggagtcgacctttagctcacccgaggactccctgcctaagtcaaagccccttacgtccagtcgcagcagcatggagatgcctagccaaccagcgccaagaaccgtcacggacgaggaaattaatttcgtaaagacatgcctgcagagatggaggagcgagattgaacaggatatccaggatctcaaaacatgcatcgctagtacgacgcaaacaattgagcagatgtattgcgatcccttgctgaggcaagtcccataccgcctgcacgccgtactggttcacgaagggcaggccaatgctgggcactactgggcctatatctacaaccagccacggcaatcgtggctgaaatacaatgacatatctgtaaccgaatcatcatgggaggaagtggagagagactcctacgggggactacgcaacgttagcgcatactgtttgatgtacattaacgacaagctcccctatttcaatgccgaggcagcaccaaccgagtccgaccagatgagcgaagtggaggccctctcagtggaacttaaacactacatccaggaggacaactggcggttcgagcaggaagtggaagagtgggaagaagaacagtcctgcaagatccctcaaatggagtcaagcaccaactcaagctctcaagactactcaactagccaggaaccgagcgtggctagcagtcacggggttcgatgtcttagttctgagcacgcagttatagtgaaagaacagacagctcaagcaatcgccaatactgccagagcatacgagaagagcggggtggaagccgcacttagcgaggtcatgctctcaccagcaatgcagggggtcatcctggcaattgccaaggctcggcaaacttttgaccgggatggatccgaggctgggttgatcaaagctttccatgaagaatacagccggctgtatcagttggcaaaagaaacaccgacctcccacagcgacccccgactgcagcacgtcctcgtctatttcttccagaacgaggctccaaaaagagtagtcgaacgcaccttacttgagcaatttgctgataagaacttaagttacgacgagagaagtatatccataatgaaggtggctcaagcaaagttgaaagagattggacccgatgatatgaatatggaggaatataagaagtggcatgaagattacagcctgttccggaaggtttcagtgtatctgctgacggggctggaactatatcagaagggaaagtaccaggaagctctttcttatttggtgtatgcttaccaatcaaacgcagcgctgctgatgaagggaccgaggcgcggtgtgaaagagagcgtcatcgccctctaccggagaaaatgccttctggagctgaatgcgaaggctgcgagtcttttcgagaccaacgacgatcattctgtcacagagggcatcaatgtaatgaacgaactcatcataccatgtatccacctcatcattaacaatgatatcagcaaggacgacctggatgcaatcgaggtgatgcgcaatcattggtgttcctacctgggacaggacattgcagagaacctacagttatgtcttggcgagttcttgccccgtctgttggatccttccgccgagatcattgtactgaaggagcctccgaccatacgtccaaactcaccctatgacctgtgttctcgttttgccgcagtcatggagagtattcagggcgtgagtaccgtaaccgttaagtag

SEQ ID NO: 245979 - DNA, 3138 bp, Artificial Sequence
  Description of Artificial Sequence: Synthetic coding sequence
atgactgcggaacttcaacaggatgatgccgctggggctgctgatgggcacggcagctcttgccagatgcttctcaaccagctgcgcgagatcaccggcatccaggaccctagcttcctgcacgaagccctaaaggcatctaacggagacatcacccaggccgtatcactgcttacagacgaaagggtgaaagagccgtcccaggatactgtggccacagagccgtcagaggtggaaggatccgcggcaaataaagaggttctcgccaaggtcattgaccttacacatgacaataaggacgacttgcaagccgctatagccttatcattgttggagagtcctaaaattcaggccgatggccgagatctaaataggatgcacgaggccacgtcagcagagactaagcgctcgaaaaggaagcggtgtgaggtatggggtgaaaatcccaatccaaacgactggagacgcgtggatggatggcctgttgggttgaagaatgtcggcaacacttgctggtttagcgcagtcattcagtcgctattccaactgcccgagtttaggagactagttttgtcttattccctgcctcaaaacgtgctcgagaactgtaggtcccacactgagaagcgcaacataatgttcatgcaagagctacaatacttatttgccctcatgatgggttcaaaccggaaatttgtagacccctccgccgctttggatctgttgaaaggggcatttcgttccagtgaagagcagcaacaagacgtgagtgagtttactcacaaattactcgattggctggaggacgccttccaactagctgtcaacgtaaactctcctagaaataagtctgagaaccccatggtacagctattctacggaacctttctcaccgagggagtgagagaggggaaacctttttgtaataatgagaccttcggccaataccctctgcaggtgaatggttacagaaatttagatgagtgccttgagggtgctatggtcgagggtgatgttgagcttctgccttctgaccatagtgtcaagtacggtcaggagcggtggtttactaagctccctccggtgttaacgttcgagctttcgcgtttcgagtttaatcagagtctaggacagcccgaaaagattcacaataagctggagttcccacaaatcatttacatggatcgttatatgtatagaagtaaagaactgatcaggaataagagagagtgcattagaaaactcaaggaggaaatcaagattctgcagcagaagttggagcggtacgtaaagtacgggtctggtccagcccgatttcccttgcccgatatgctcaaatacgtgatcgaatttgcgagtaccaaacctgccagcgaatcgtgtccacccgaaagcgatacccacatgaccttacccctcagctccgtccactgctctgtgtctgaccagactagcaaggagagtacctccaccgagtcgtcctctcaggacgtggaaagtacatttagctctcctgaggattcactgcctaagtccaaacctttgacttctagtcgcagctcaatggaaatgccatcacagccggctccacgaaccgtgactgacgaggaaatcaattttgtgaaaacatgcctacaacgttggagaagtgaaattgaacaggacattcaagatctcaagacgtgcattgcttcaacaacgcagactatcgaacagatgtactgtgatcctctcctccgtcaagttccctataggcttcacgctgtactggttcatgaaggacaggccaacgccggacactattgggcctatatctataatcagcctagacagagctggttgaagtacaatgacatttcggtgacagaaagcagttgggaagaggtggaaagggattcctatggtggattgcgtaatgtctcagcttactgtttgatgtatataaacgataagctgccttactttaatgcggaagcagcccctacagaaagtgatcaaatgagcgaggttgaagccctgagtgtcgagttgaagcactacatacaggaggacaactggcggttcgagcaagaagtggaggagtgggaagaagagcagtcctgcaaaattccacagatggaatcatcaacgaattctagcagccaggactacagcaccagccaggaaccatccgtggcgtcaagtcatggggtccggtgcttgagcagtgagcacgctgtgattgtgaaggagcagacagcacaggcaattgccaataccgctcgcgcttacgagaaatctggggtggaggcagctctgagcgaggcttttcacgaggagtattccagactgtaccagttggccaaggaaacacctacctcccattcagaccctagattacagcacgtccttgtctatttcttccagaatgaagcgcctaagagagtggtagaacgcactctgctggaacagtttgcagataaaaacctgtcttacgatgagcggtcgatatctattatgaaggtcgcccaggccaagctgaaagaaattgggcctgatgatatgaacatggaggaatataagaagtggcacgaagactattctctcttcagaaaagtcagcgtgtatctgctgacaggcctggagctgtatcagaagggcaaataccaagaggcactcagctatcttgtttatgcttaccagtccaacgccgctctgcttatgaaggggccaaggcggggtgtgaaggagtcggtaatcgcattatataggcgaaagtgtctgttggagctcaatgcgaaggcagccagcctgtttgaaacaaatgacgaccatagcgttacagaaggcatcaacgttatgaatgagctgattatcccctgcattcacctgatcattaataatgacatcagcaaggatgacctggatgcaatcgaagtgatgcgcaatcattggtgctcttatctgggccaggacatcgccgaaaacttacagctgtgtctgggtgagttcctccctaggctgttggacccatcagctgagattattgtactgaaggagccacccaccatcagacccaacagtccatacgacttatgcagcagattcgcagctgtgatggaaagcattcaaggtgtctctactgtcaccgtaaaatag

SEQ ID NO: 245980 - DNA, 1497 bp, Artificial Sequence
  Description of Artificial Sequence: Synthetic coding sequence
atgcaaagccccccacacctggccgtatgtcgctccaataaatcaccctgggtctgcttaacctgtagctccgtgcattgtggcagatacgttaatggacatgccaagaagcactacgaggacgcacaggtgcccctcacaaatcacaaaaagagcgaaaaacaggacaaagtgcaacataccgtttgcatggattgttcttcctacagcacgtattgctatcgatgtgacgatttcgtggtgaatgatactaaattgggcctggtgcagaaggttagagagcatcttcaaaacctcgaaaatagcgccttcaccgccgatcggcacaagaagcgaaaactactggagaacagtacgctcaactcaaaactgttaaaggtgaacggtagtactacagccatatgcgccacgggacttcgcaatctcgggaatacatgctttatgaatgccattctgcagtctctatctaacattgagcagttctgctgttacttcaaagagctcccggctgtagaactgaggaatggcaaaacagcgggaaggcgaacctaccataccagatctcaaggggacaataacgtctctctggtagaagagttccgcaaaacgctttgtgcactctggcagggcagtcaaacagctttcagtcccgagtctctgttttatgtggtgtggaagattatgccaaattttcgcggttaccaacaacaggatgctcacgaatttatgcgatatctgttagaccatttgcacctggaactccaggggggttttaatggagtttcaagatccgcgatccttcaggagaatagtaccttgtccgccagtaataaatgctgtattaacggtgcgtcgactgtggtcaccgctatatttggtggaattctgcagaatgaggtcaactgccttatctgcgggaccgagtcaaggaagttcgatcccttccttgatttgtcactagatatcccgtcccagtttcgcagcaagaggtccaagaatcaggaaaatggtcctgtttgctcccttagggattgcctgcggagtttcacggatttggaggagctggatgagaccgagctgtacatgtgtcacaagtgtaagaaaaaacagaagtcaaccaaaaagttctggattcagaagctgccaaaagtactgtgcctgcaccttaagaggttccactggacagcctatctgaggaacaaggtcgacacctacgtcgagttcccacttagaggactggatatgaagtgctaccttttagagccggagaactctgggccagagagctgtttatatgatttggcagctgtcgttgtccatcacggaagcggggtgggaagcggacattacacagcttatgccacccacgaggggagatggttccactttaatgacagcacagtgactctgaccgatgaggagacagtcgtgaaggcaaaggcctatattctgttctatgtggagcatcaagcaaaagcaggcagtgacaaattatag

SEQ ID NO: 245981 - DNA, 1563 bp, Artificial Sequence
  Description of Artificial Sequence: Synthetic coding sequence
atggagtgcccccacctatcctcaagcgtgtgcatcgccccagattcggccaagtttccaaacggatcacccagttcctggtgttgttccgtgtgcagatcaaataaaagcccctgggtctgtcttacttgctcctcagtgcactgtggcagatatgtaaatggccatgctaagaagcattatgaagatgcacaggtgccactaaccaaccacaaaaagagcgaaaagcaggataaggtgcaacacaccgtgtgcatggactgcagcagttactccacctattgctatagatgcgatgacttcgtcgtgaacgacaccaagctgggattagtacagaaggtaagggagcacttacaaaacctggaaaattctgcatttacagccgaccgacacaagaagaggaaactgcttgagaactccactctcaactcaaagctgctgaaagtaaacggcagtactaccgccatttgtgctacagggctgcgaaacttggggaacacttgcttcatgaatgccatcttgcagtcactgtccaatatcgagcaattctgctgctacttcaaggaattgcctgccgtggagctgcggaacggtaaaactgcgggtcgcagaacttaccatacaaggtcccagggggataataatgtcagtctggtggaggagtttcgcaaaacactatgtgccctatggcaagggagtcagacagccttcagcccggagtctctattttacgtcgtgtggaaaatcatgcccaacttcagaggctaccagcaacaggatgctcacgaatttatgcggtacctccttgaccacttacacctggagcttcaggggggatttaacggcgtgagccgttcggctatcttgcaagagaatagtactctatcggcatccaataaatgttgtatcaacggggcttctacggtggttactgcaatatttggtggtatcctgcagaatgaagtgaactgcctgatttgcgggaccgaatcacgcaaatttgacccgtttctggatttatctctcgatatacctagtcagttccgttcaaaaagatccaaaaatcaagaaaacgggccagtttgtagcctgcgtgattgcctgcgctcatttaccgatttggaggagctggatgagaccgagctctacatgtgtcataaatgcaaaaaaaagcagaaatctaccaagaagttttggatccagaagctgcccaaagtcctgtgcttgcatctaaaacgcttccattggacagcttacctgcgcaataaggtagacacctacgtcgagttcccactgcggggtctcgatatgaaatgttatttgttagaacccgaaaattcaggccctgaaagttgcttgtacgatttggctgccgtggtggtgcaccacggaagtggagtgggtagcgggcactatacagcctacgccacccacgagggacgctggtttcattttaatgacagcaccgttacgctcacagacgaggagaccgttgtgaaagccaaagcttatatcctattctatgtggagcaccaggcaaaggccggttccgataagctttag

SEQ ID NO: 245982 - DNA, 471 bp, Artificial Sequence
  Description of Artificial Sequence: Synthetic coding sequence
atggaatgcccacacctgtcttccagcgtttgcatcgcacctgatagcgcgaagttcccaaatggctccccaagttcatggtgttgctccgtctgccgtagcaataagagcccctgggtctgcttaacctgtagcagtgtgcactgtggcaggtatgtcaacggccatgcaaagaagcattatgaagacgctcaagtgccgctcaccaatcataagaaatctgagaagcaggataaagttcagcacacagtgtgtatggactgtagttcttactcaacatactgctatcgatgtgacgatttcgtggtgaatgacactaagcttgggctcgtgcagaaggttcgtgagcatcttcagaatctggagaatagcgctttcacagccgaccggcacaagaagcgaaagctcctcgagaattctacactcaacagtaagctcctgaaggtgaacgtatttgggagacgagtgtag

SEQ ID NO: 245983 - DNA, 1071 bp, Artificial Sequence
  Description of Artificial Sequence: Synthetic coding sequence
atggactgctcttcttactctacatattgctataggtgtgatgactttgtggtcaatgatacgaaactgggtctcgtccagaaagttagagaacacctccagaatctggaaaacagcgccttcaccgccgatagacacaagaagcggaaactgcttgagaattcgaccttaaactcgaaactcctgaaagtcaatgggtcgacgaccgctatatgtgcgactggcctgcgcaatctgggcaacacttgcttcatgaacgccattctccaaagtctctctaacattgagcagttttgctgctattttaaagagctgcccgctgttgagctgcggaatggtaaaactgctgggaggagaacataccacacaagaagccaaggggataataacgtttcactggtggaggagtttagaaagactctatgtgccctatggcagggatcacaaacagctttcagtccggagagcctattttacgtggtgtggaagatcatgccgaatttcagaggatatcagcagcaagatgcacacgaatttatgaggtatttgctggatcacctgcaccttgagctgcagggtggctttaatggcgtgtcccgctcagctatcttgcaggaaaacagcaccctgagtgccagcaacaaatgttgcattaacggggctagcacagttgtgacagccatttttggtgggatactgcagaacgaagtgaattgcctgatttgtggcaccgagagtcgcaaattcgatccttttctggaccttagtctggatatcccttcacaattcagatccaagaggagtaaaaatcaggaaaatggccctgtctgctctctgagagactgcctgcgcagtttcaccgatctcgaggagctagatgaaaccgagttatacatgtgccacaagtgtaaaaagaaacaaaaatcgactaagaaattctggatccagaaactgccgaaagtcctatgcctacatttgaagagatttcattggactgcctatttgcggaataaagtggacacatatgtggaatttccacttcggggtctggatatgaaatgctattattag

SEQ ID NO: 245984 - DNA, 816 bp, Artificial Sequence
  Description of Artificial Sequence: Synthetic coding sequence
atgcccaactttagaggataccaacagcaggacgcccacgagttcatgagatacctattggaccatctgcacctggaacttcagggtggatttaacggggtatccaggtccgctatcctccaggagaactcaacattatcagcttccaacaaatgctgtattaatggcgcttcgaccgtggtgactgctatcttcgggggtattctccagaacgaagttaattgtctcatctgcgggaccgaaagcaggaagttcgatcccttcttggatctaagcctggacatcccttcccagttccgctctaagaggtcaaagaaccaggaaaatggtcccgtgtgctccttgagggactgtttgagatcctttacagaccttgaggaactggatgaaaccgagctgtacatgtgtcataaatgcaagaaaaagcaaaaatctacaaagaaattctggattcaaaagctgcccaaagttttgtgcctgcacttgaagcgcttccattggacagcctatttgcgtaataaagtggatacctacgtagagttccctctaaggggcttggatatgaaatgttacctgctcgaaccagagaactcaggcccagagagttgtctatatgatctcgccgctgtggttgtgcatcatgggtccggggtcgggtctggccattatacagcctatgcaactcacgaaggacggtggttccatttcaatgattccactgtgaccctgactgatgaggagactgtggtgaaagcaaaagcctacatcttgttttacgtggagcaccaggctaaggccggatccgataaactgtag

SEQ ID NO: 245985 - DNA, 1431 bp, Artificial Sequence
  Description of Artificial Sequence: Synthetic coding sequence
atggaatgtccccacctgtctagctccgtgtgtatagcccctgattcagctaagtttcctaatgggagtccgagctcctggtgttgttcagtgtgccgatccaataagtccccctgggtgtgcctgacttgtagctccgttcactgtggatcctacagatgtgatgacttcgtggtgaacgacaccaagcttggcctggtacagaaagtgcgagaacatctccagaacctcgagaattccgcctttaccgccgatcggcacaagaagcgaaaactcctggagaattcaactctgaatagcaaactactgaaagtgaatggctccactaccgctatctgtgctactgggctccgcaaccttgggaacacctgctttatgaacgctatcctgcagtctctgtccaacatcgaacagttctgttgttatttcaaggaactgcccgctgtggaactgcggaatggaaagactgcaggacgtaggacatatcacacccgttctcagggcgataataacgtcagcttagttgaggaattccgcaagaccttatgtgctctctggcaaggctcgcaaacagctttctctccagagtctttattttatgtggtctggaaaattatgccaaatttcagggggtaccagcagcaggatgcccacgaattcatgaggtatttgctggatcatctgcacctggagctgcaaggcggatttaacggagtgtctcgttccgccatcctgcaggagaactcgacattgagtgctagcaacaaatgttgcattaacggggcaagtaccgtggtcacagcaattttcggtgggattctgcagaacgaggtaaattgtctgatctgcggaactgagtccagaaagtttgacccctttctggatttatcactcgacattccgagtcagttcaggagtaaacgctctaaaaaccaagaaaacggccctgtgtgttctctcagagattgcctccgatcattcactgatctggaagagctggatgaaacggagctttacatgtgccacaagtgtaaaaaaaaacaaaaaagcaccaaaaaattctggattcagaagctccccaaagtcttatgcctacatttgaagcggttccactggaccgcttacttgaggaataaggtcgacacgtacgtagagtttccgctgagaggcctggacatgaagtgttacctgctagaacctgagaacagcggccctgagtcttgtctttatgatctggcagcagtagttgtgcaccacggaagtggtgtgggctccgggcattacactgcgtacgctacgcatgaaggaagatggttccacttcaacgactccaccgtcaccctaaccgatgaggaaacagttgtgaaggcaaaggcatacatcctgttctacgtagaacatcaggctaaggccggttctgataaattgtag

SEQ ID NO: 245986 - DNA, 168 bp, Artificial Sequence
  Description of Artificial Sequence: Synthetic coding sequence
atggagtgtcctcatctatcatcttcggtgtgcattgcccctgattctgccaagttccctaacggaagtccctcctcctggtgctgttcagtgtgcagatcaaataaatctccttgggtctgtctcacctgtagctccgtacattgtggacggatttggggtacctag

SEQ ID NO: 245987 - DNA, 1554 bp, Artificial Sequence
  Description of Artificial Sequence: Synthetic coding sequence
atgctatcgtccagagccgaggccgctatgaccgccgctgatagagccattcagcgctttcttcggactggtgccgctgtccggtacaaagtgatgaagaattggggagttatcggaggaatcgccgctgcactagccgcaggcatatacgtgatctggggcccaatcacggagagaaaaaagcgaagaaagggactggttccagggctcgtcaatctggggaatacctgctttatgaactccctactgcagggtttgagcgcatgcccagcatttatccggtggcttgaggaattcacaagccagtattctagggaccagaaagagccaccttcgcaccagtatttgagtctaactcttctccacctactgaaggcccttagctgccaggaagtgacagatgacgaagtgctggacgcgagttgtctattagatgttctgcgtatgtataggtggcagatttcatctttcgaagaacaggacgcccacgaactgtttcatgtgataaccagtagcctggaggatgagcgggaccgccagccacgcgtaacacatctcttcgacgtgcatagcctggaacaacagagtgaaataaccccgaagcagatcacatgcagaacccgcggatcgccccatcccacctctaaccactggaagtcacagcaccctttccacggcaggctgaccagcaatatggtctgcaagcactgcgagcaccagtcgccggtcaggttcgatacattcgatagcctgagcttgtctatacctgctgctacctggggccaccccctgacgctggaccattgcttacaccattttataagctccgaatcggtgcgggacgttgtgtgcgacaactgtacaaagatcgaggccaaaggcaccctgaatggcgagaaggtggagcatcagaggacgacgtttgtgaaacagctaaaactgggaaagctgcctcagtgtctgtgcatccacttgcagcgactaagctggtcatctcacggaacaccgttgaagagacacgagcacgtgcagtttaatgagtttctgatgatggacatttataaatatcatttgctgggtcacaagcctagtcagcataacccgaaactgaacaaaaatccagggcctactttagaactgcaagatggccctggagcccctacccctgttcttaaccagcctggggcaccaaagacacagatcttcatgaacggggcatgttcacccagcttactgcccacgttaagtgctcctatgccctttcctcttcccgtggtccctgactacagcagctctacctatctttttagactgatggccgtggtcgtgcaccacggagatatgcactcagggcacttcgtgacctacaggcgctccccacccagcgcccgaaaccccctgtccacctctaaccagtggctctgggtgtcggatgatactgtgcggaaggcgtctctccaggaagtgcttagttcctccgcctacctcctcttctatgagcgggtgcttagtcgcatgcagcaccaaagccaagaatgcaagtcagaagagtag

SEQ ID NO: 245988 - DNA, 4814 bp, Artificial Sequence
  Description of Artificial Sequence: Synthetic coding sequence
atgggagccaaggaatcgcgtattggttttctgtcttacgaagaagcattgcgcagggtcaccgatgtggagcttaaacgtctgaaagacgctttcaagagaacatgcgggctgagttattatatgggtcagcactgcttcattagggaggtgctgggggacggagtcccaccgaaggtcgctgaagtgatctactgtagtttcgggggaacaagtaaaggccttcacttcaacaacctgatcgtaggactcgtgctcttaaccagagggaaggacgaggagaaagcgaaatacatctttagcctgttttcctccgagagcggtaactacgtgatcagggaggagatggagagaatgctgcatgtcgtagacggcaaggtccctgacaccttgaggaaatgtttctcggaaggggaaaaggtaaattatgaaaagttccggaattggttgtttctgaataaggatgcctttaccttctctcgttggctcctttctgggggtgtctatgtaactctgactgacgactccgacactcccaccttttaccaaaccctggccggagtaacccatctcgaggaatcagacatcatagacctagagaagaggtactggcttctgaaggcacagagtaggaccggtcgcttcgacttagaaaccttcggcccacttgtcagtccccctatcaggccatctctctcagaggggcttttcaacgcctttgatgaaaatcgggacaaccacatcgactttaaagagatttcctgcggtctgtccgcatgttgcagaggaccactagcagaaaggcagaagttttgctttaaggtattcgacgtcgatcgtgatggagtgctgtcccgcgttgagcttagggacatggttgtggccctgcttgaagtatggaaagacaacaggacagacgacatcccagaactgcatatggatctttctgacatcgtcgagggcatcctgaatgctcatgacactacaaaaatgggccacctgaccctcgaagattaccaaatctggtccgtcaagaacgtgctcgccaatgagtttctgaatcttctcttccaagtttgccacatcgtgctgggactccgcccagcaactccagaagaggaagggcaaataattagaggctggctggagcgagagagcaggtacggccttcaagctggccacaactggttcatcatttctatgcagtggtggcagcagtggaaagaatacgtcaagtacgatgccaaccccgtggtgattgaaccttcgtccgttcttaatggtggcaaatatagtttcggaaccgcagcccatcccatggagcaggtagaagatcggattggctcctctctcagttacgtcaacacaacagaagaaaaattttctgacaacatcagcaccgcaagtgaggcatctgaaaccgccggtagcggcttcctgtatagtgctactcccggtgccgacgtgtgcttcgcccgacagcataacacttcagataacaataaccagtgccttctgggcgcaaatggcaacattttgttacacctgaacccgcagaaacccggtgctatcgacaaccagccgcttgttacccaagagccggtgaaggcaacatctctgacactggaaggaggcaggcttaaaagaaccccccagcttatacatggcagagattacgagatggtgcccgagcccgtgtggcgagcattatatcattggtacggcgctaatcttgcccttccccgacctgtcattaaaaactcaaagacagacattcctgagctggaattgttccctcgctatctgctctttctgagacagcagcctgcaacgcgaacccaacagtcaaatatctgggtgaacatggggaacgtcccctcacctaatgctccactgaaacgcgtactcgcctacactggttgctttagtcgaatgcagactatcaaagagatccacgaatacctgtcacagagattaagaatcaaagaagaagatatgaggctttggctctacaatagtgagaattatctcacactgctggacgatgaagaccacaaactggaatatctgaaaattcaggacgagcagcatctggtaatcgaggtgcgaaacaaagacatgtcctggcccgaggaaatgtccttcattgcaaatagctctaagatcgacaggcacaaggtccctacggagaagggtgcgaccgggctttctaacctgggcaacacctgttttatgaacagctctattcagtgtgtctcaaatacccagccattaacacagtatttcatctctgggcgacatctgtatgagctcaaccgcacaaatccgatagggatgaaaggtcatatggctaaatgttacggagacctcgtgcaggaactttggagtggaacgcagaagaacgtggctcccctgaagctgagatggacaattgctaagtatgctcctcgtttcaatggcttccaacagcaggatagccaggagcttctagcatttctcctcgacggcttacacgaagaccttaatagagtgcatgaaaaaccctacgttgagctcaaagattctgacgggcgacccgattgggaagttgccgcagaggcctgggataaccatctccgacgaaaccggagtattgtggtagatctgttccacggccagctgagatcacaggtgaagtgcaagacgtgcggacatatctcagttcgcttcgatcctttcaatttcttgtcactgcctttgcctatggactcttacatgcatcttgagatcaccgttatcaagcttgatggcactacaccggtaagatacggcttgcgtttaaacatggatgaaaaatataccgggctcaaaaagcagctttccgacctttgcgggctgaatagcgaacaaatcctcttggcagaggtgcatggcagtaatataaaaaatttcccccaggacaaccagaaagtcaggctgtccgtttctggctttctatgtgccttcgagatccctgtgccagtcagccctatttccgcatcatcccctactcagactgacttctcctcttcaccctccactaatgaaatgttcaccctgactaccaacggagatctgccacggccaatctttataccaaatgggatgccaaatactgtggttccttgtggcacggagaagaacttcacaaacggcatggtaaatggccatatgccttccctgccagacagcccattcaccggttatattatcgctgtccaccgcaagatgatgaggaccgagctgtattttctgtccagccagaaaaaccgaccctctttatttggaatgcccttaatcgtaccttgcacagtccacacccgcaagaaggacttgtacgatgccgtgtggatacaggtttctagacttgcctcgccactccccccacaggaagcctccaaccatgcccaggattgtgatgattcaatgggctatcagtaccctttcaccctgcgcgtcgtgcaaaaggacggtaatagttgcgcctggtgcccttggtaccggttctgcagagggtgcaaaatcgattgcggagaagatcgggcttttatcggcaacgcctatatcgctgtggattgggatccaactgcattgcatctgcgctaccagacttcccaggagcgggtagtggacgaacacgagtccgtggagcagtccaggcgggcacaagccgaaccaatcaatctcgacagctgtctaagggcctttacatcagaggaggagcttggggaaaatgagatgtactattgctcgaagtgtaagacccactgcctcgcaacaaaaaagctggacctctggcgtcttcctccgatcctgatcatacatctcaagcgcttccagtttgttaatggtagatggattaagagtcagaagattgtaaagttccccagggaaagttttgatccaagcgcttttctcgtgccacgagacccagccctttgccaacacaaaccgctcaccccccaaggcgacgagttgtccgaaccgagaatcctggccagagaggtgaagaaggtcgacgctcagagtagcgcaggcgaagaggatgttcttttgagcaagtctccctctagtttgtccgccaacatcatcagctcaccgaaaggctcccccagttcatcacgcaagtctggaacgtcttgtccatcttcaaaaaactcatccccgaacagttcccccagaaccctcgggcgttcaaaaggaaggctcaggctgccacagatcggatccaaaaacaagctcagttcctccaaagaaaatctggacgcctctaaagaaaatggcgcagggcagatttgcgagctggccgacgcgctttcacgcggtcatgtcctgggaggcagccagcctgagcttgtgaccccacaggaccacgaagtggctttagctaatggtttcctatacgagcatgaggcttgcggcaacggttattcaaacggtcagctgggtaaccattctgaggaagactcaacagacgaccagagggaggacacccggatcaagccaatatacaacctttacgcgatttcttgccacagtggtatcctgggcggtggccattacgttacctacgctaagaatccgaattgcaagtggtactgttacaacgactcaagctgtaaggaactgcatccagacgagatcgatacagactccgcttacatactgttctatgaacaacagggaatcgattatgcgcagttccttccaaagaccgacggaaagaaaatggctgacacaagctccatggacgaggattttgagtctgactataaaaaatactgcgtacttcagta

SEQ ID NO: 245989 - DNA, 1173 bp, Artificial Sequence
  Description of Artificial Sequence: Synthetic coding sequence
atgggagccaaagagagtcggatcgggttcttgtcatatgaggaagcactgcggagggtcactgatgtggaactgaagcggctaaaggatgcatttaagcgaacctgcggcctttcatactacatgggtcagcattgcttcatacgcgaagtgctaggagacggggtgccccctaaggtcgccgaggtcatttactgttctttcggaggcacgagtaagggcctccacttcaacaacctgatagtcgggctcgtgcttctgacaaggggcaaagatgaggagaaggccaaatacatctttagtttgttcagctctgaaagtggcaactacgtgatcagagaggagatggagcgtatgctgcacgtcgtggacggcaaagtaccggacacgctgcggaagtgtttcagtgagggcgagaaggtgaattacgaaaaattcagaaattggctgtttctcaataaggacgccttcaccttttcccggtggctactgagcggtggtgtgtacgtgaccctgaccgatgacagtgatacaccaacgttttatcagaccctggctggggtgacgcatctagaggagtctgatatcatcgaccttgagaagcggtactggttgctgaaggctcagtcacggactggccgattcgatcttgagaccttcggccctcttgtgtcaccaccaatcaggccaagcttaagtgaggggctgttcaatgcatttgacgaaaaccgagacaaccatatcgactttaaggaaatatcatgcggactgtcggcatgctgtcggggacccctggcagagcgccagaagttttgctttaaggtgtttgacgtggacagagatggcgtcctgagcagggttgagctgagagacatggttgtggctctgctggaggtatggaaggataaccgaacggatgatattccagaactccacatggatctgagcgatatcgtcgagggaatcctgaacgcacatgatacaaccaaaatgggccaccttacgcttgaagactaccagatttggtcagtcaagaatgtattggccaatgaattcctgaatctgctatttcaggtctgccacatcgttttgggcctgcgtcctgccacaccagaagaggaaggtcagattattaggaccttagaaactgaccaaatctacactaggaactag

SEQ ID NO: 245990 - DNA, 3372 bp, Artificial Sequence
  Description of Artificial Sequence: Synthetic coding sequence
atgccaatagtggataaactcaaggaggcactaaagccgggaaggaaagacagcgcggacgacggggagctggggaagctgttggcctcctctgcgaagaaagtactactgcaaaaaattgagtttgaaccagcctccaagtcattcagttatcagcttgaggcgctgaagtccaaatatgtcctccttaaccccaaaaccgaaggggcatctcgtcacaaatctggcgacgaccctccggcaagacgtcaggggtccgaacatacttacgagagttgtggggacggagtacctgctccacagaaagttttgttccccacggagagattgagcctcaggtgggaaagggtcttcagagtgggcgcaggtttgcacaacctgggtaatacttgttttctcaacgctaccatccagtgcctgacctacactccaccccttgcaaattatctgctcagcaaagaacatgctagatcgtgccaccagggatccttttgcatgctctgcgtgatgcagaaccatatcgtacaggcttttgcaaattcgggaaacgccatcaagcccgtgagttttatacgcgatctcaaaaagatcgctagacacttccgatttggaaatcaggaggatgctcacgagttcctgcgttacacaattgatgcaatgcagaaggcttgtctgaatggctgtgctaaactggaccgccagacccaggccactaccttagtccaccagatttttggcggataccttcggtcgcgcgtgaagtgtagcgtgtgcaagtcagtctcagacacatacgatccctacctggacgtcgcactggagattagacaagcggctaacatcgtgcgggcacttgaactttttgtaaaggccgacgttcttagcggagaaaacgcatatatgtgtgccaagtgcaagaagaaagtgccagccagcaagcggtttacgatccaccggacgagcaatgtgctcactctgtccctcaagagattcgccaattttagtggcggaaagattacaaaggatgtcggttatccagagttcctgaacatccgtccttacatgtctcagaacaatggagatccagtaatgtacgggctttacgcagttcttgtgcacagcggttactcatgccatgctggtcactactactgttacgttaaagcctccaacggccagtggtatcaaatgaatgacagtctagtacattccagcaacgttaaagtggtcctgaaccagcaggcttatgtcctcttctacctgcgcatacctggatccaaaaagtccccagaagggttgatctctcggaccgggagttcttcacttccagggagaccaagtgtgattcccgaccactctaaaaagaacattgggaatggcatcatttctagccccctgacgggaaaaagacaggacagtgggacaatgaagaaaccacacactacagaagaaataggcgtgcccatctcccggaacggctcgacgctgggtttgaaaagccagaatggttgcatcccccctaagctgccctcaggttcgccatctcctaaactcagccagacaccaacacacatgccgacaatcttggacgacccaggaaaaaaggtcaagaaaccagcaccccctcagcatttttcaccgcgaaccgcccagggtctccctggcactagcaactccaattcctcccgttctggtagccaaagacagggcagttgggactccagagatgtggtcctgtcgaccagtccaaagctccttgctaccgcaacagccaacgggcacggactgaagggcaacgatgagtctgctggcctcgaccgccgagggtcgagctctagctctcctgaacattcagcgtcctccgactccactaaggcacctcagacccctcgatccggggctgctcacctatgtgactctcaggaaaccaattgctctactgcaggccacagcaaaaccccgcctagtggtgccgatagtaagaccgtgaagctgaagtctcctgtcttgtcaaatacaactaccgagcccgctagcacaatgtccccaccaccagctaagaaattggccttgtccgcgaagaaagccagcactctgtggcgcgcaaccggcaacgacctcaggcctcctccaccaagccctagtagtgatctcacccaccccatgaagacctcacacccagtcgtggccagtacctggccagttcatcgggctcgggcagtgtcccctgctccacagagtagttccaggcttcagcccccattttccccccatcctactttgctgagctcaacccctaagcccccagggacatcagagccgcgttcttgtagctcaattagtaccgccctcccgcaggtgaacgaggacttggtctctctcccccaccagctcccagaagcttctgagccaccccagagcccctctgaaaaaagaaagaagacttttgttggggaaccccagagacttgggtccgagacacgtctcccccagcacatcagagaagccacggcagcccctcatggtaaacgaaaacgtaaaaagaagaagagacccgaagacaccgcagcaagcgccctacaggaaggacaaactcagaggcagccagggtctccaatgtataggcgagaagggcaggctcaattgccagctgtcaggaggcaggaagatggtacacaaccacaggtgaacggacagcaggttggctgcgtgaccgacgggcatcatgccagtagcaggaaacggcgacgtaaaggcgcagaaggtttgggagaggaaggcggtctccatcaggacccgttgcgacatagctgttcccctatgggagacggcgacccggaggcgatggaagagagcccccgtaagaagaagaaaaaaaagcgaaaacaggagacgcaaagggcagttgaggaggacgggcaccttaaatgtcccaggtcagccaaacctcaggatgccgtggttcctgaatcgtcatcatgtgcaccgagtgctaatggctggtgccccggagatagaatggggctgtcgcaagcaccacccgtatcatggaatggtgagcgtgagagtgacgtggtccaggaacttctcaagtattccagcgataaggcctatggcagaaaggttcttacctgggacggaaagatgtctgcggttagccaagacgccattgaggactcgcggcaggccaggacggagaccgtggttgacgactgggatgaggaatttgacagaggcaaggagaaaaaaataaaaaagttcaagcgggagaagagacggaacttcaatgccttccaaaaactgcagacccgacgcaacttttggagcgtcactcacccagccaaagcagcttcactgtcatatcgccgatag

SEQ ID NO: 245991 - DNA, 1647 bp, Artificial Sequence
  Description of Artificial Sequence: Synthetic coding sequence
atgccaatcgtggataaactcaaagaggcattgaaacccggtaggaaggactccgctgacgacggcgaacttgggaagctgctggcttcaagcgccaagaaggttctgctgcagaagatcgaattcgaacccgcatccaagtcgttctcctaccagctcgaggcgctgaaatcaaaatatgtcctcttgaacccaaagacagaaggtgcaagccgacacaagagtggcgacgaccctcccgcacgtcgccagggatcagagcatacctatgagtcatgtggagacggggttcccgctcctcaaaaagtgctgttccctactgaacgcttatcccttcgatgggaaagagtttttcgcgtgggagccggactccacaacttaggaaacacatgttttttaaacgctactatacagtgcctcacttatactcctccgctcgctaactatctcttaagtaaagagcatgctcgatcgtgtcaccaggggtcgttttgtatgctttgcgttatgcaaaaccacatagtgcaagcattcgccaatagtggaaacgcaatcaagccggtcagtttcatcagagacttgaaaaagatcgcgagacactttcgattcgggaatcaggaagacgcccacgagttcctccggtatacaatcgacgctatgcagaaggcatgtctgaacgggtgtgcgaaattagacaggcaaacccaggccacaaccctagttcaccagatctttggagggtaccttaggtctagggtgaagtgtagcgtgtgcaagtccgtgtccgacacgtacgatccatatttggatgtagccctcgaaattcgacaagcagcaaatattgtgagggcacttgaactcttcgtcaaggccgacgtgctctccggcgagaacgcctacatgtgcgccaaatgcaaaaaaaaagtcccagcaagcaaacgtttcaccatccatagaacctccaatgtgctgacactctctctgaaacggttcgcgaactttagtggcggaaagattacgaaggacgttggctatcccgaatttcttaacatcagaccctacatgtcccagaataatggcgaccctgtcatgtatgggctctatgctgtcctcgtgcacagcggctatagttgccacgccggacactattattgttatgttaaagcgagtaacggacagtggtaccagatgaatgattcattagtgcactctagtaacgtcaaggtggtccttaatcagcaggcttacgtgctattctacctgagaattccgggttcaaaaaaatcacccgaaggcctgatttctagaacaggaagctctagtctccctggacgcccatctgtaattcctgaccattccaagaagaacatcggcaatggcatcattagctctccgctgacgggaaaaagacaagactccgggactatgaagaagccccacaccaccgaagagatcggggtcccaatcagtcggaatggatccactctggggctaaaatcacagaacggttgcatacctccaaaacttccatccgggtcacccagtcccaaactcagccaaacgccaacccatatgcctactatactcgatgatccaggtaaaaaagtaaaaaaaccggctccccctctgcccacaggaatggggtag

SEQ ID NO: 245992 - DNA, 2187 bp, Artificial Sequence
  Description of Artificial Sequence: Synthetic coding sequence
atgtgcgcaaaatgcaagaagaaggtgccggcaagcaaaaggttcacgattcacagaacatcaaacgtcctgacccttagcttaaagagatttgctaatttctctggcggaaaaataaccaaagatgtggggtatccggagttcctcaacatacgaccctatatgagtcagaataatggcgaccccgtcatgtatggtctgtatgcagttctggttcactcaggctactcctgccacgctggacactactattgctacgtgaaggccagcaatgggcagtggtatcaaatgaatgatagtctcgttcactcatctaatgttaaggtcgtgttaaatcaacaggcatatgtactgttttatctgaggattccaggtagcaaaaagagcccagaaggcctcatttctcgcaccggtagctctagcttaccaggcagaccgtccgtcattccagaccattctaaaaagaatataggaaacggaataatttcctctccactgacaggcaagcgtcaggacagcggaaccatgaagaaaccccatacaaccgaggaaattggtgtgccaatttcacgtaacggatctaccctgggactgaagtcacagaacggatgtatcccaccgaaattgccctccggatcccccagccccaaactgtcacagacacctacccatatgcccactatcctcgatgaccccggaaagaaagtgaaaaaaccagctcccccacaacacttttcacctaggacagcccagggcttgcccggtacatcaaactcgaactcatctcgaagtggctcacagcgccagggatcctgggattccagagacgtagtactgagcacatccccaaagctgttggcaacggcaacagccaacggacatggcctgaaaggaaacgatgagagcgcgggattggacagaaggggcagctcgtcttcaagcccagaacatagtgcctcttccgattcgaccaaggcccctcagaccccaagatctggggcagcccacctgtgtgattcccaggagaccaactgtagcacagctggtcactcaaagaccccgccatcaggcgcagattctaagacagttaaattaaagtcacccgttcttagcaatacaactacagagcctgcttcgacaatgagtccaccgcctgccaagaagctggcattatctgccaaaaaagcttctaccctttggcgagccacagggaatgatttgaggccacctcctccttcaccctcgtcagatttgactcaccccatgaagacttcacatccagtggtcgcttcaacgtggcccgtccaccgcgctcgagctgtgagccccgctccccaaagttcctcccgattgcagccccctttcagcccacaccccaccgcggcttctgcactgcaagaaggtcagacccagaggcagcccggaagccccatgtatcgcagagaaggacaagcgcaactccccgcagtccggagacaggaagatggaacccagccccaggtgaatggacagcaggtgggatgcgtgaccgacggacaccatgcgagtagcaggaagcgcaggaggaagggcgctgaggggctaggggaagagggaggactgcaccaggatcctctgcgccactcttgctcccccatgggcgatggcgaccctgaagctatggaagagtcaccacggaagaaaaagaagaaaaaacgcaaacaagagactcaaagggcagtggaagaagatggccatttgaaatgcccacgctccgccaagccgcaagatgccgtggtccctgagtcctcctcctgtgcccctagtgctaacgggtggtgtcctggggatcggatgggcttatcccaggctccccctgttagctggaacggggagcgagaatccgatgtggttcaagagcttttgaagtactcctctgataaggcgtacggtaggaaggtactcacctgggacggaaaaatgagcgccgttagccaggatgctattgaggattcacgacaagcacggaccgagactgtggttgacgattgggatgaggagttcgacagaggtaaagagaagaagataaaaaagttcaaaagagaaaagcgcaggaacttcaatgcctttcagaaactgcagactaggaggaacttctggagcgtgacccaccctgccaaagccgctagcctttcctatcgaagatag

SEQ ID NO: 245993 - DNA, 3372 bp, Artificial Sequence
  Description of Artificial Sequence: Synthetic coding sequence
atgcctatagtcgacaagttgaaggaagcactgaaaccgggaaggaaggattctgctgacgatggagagctgggcaagcttctagcttcctccgccaagaaggtgctgttacaaaagatcgaatttgagcctgcctccaaaagtttttcgtaccagctggaagctctaaagtcgaagtacgtgctgctaaatcccaaaactgagggtgcgtcacggcacaaatcaggcgacgatccacccgcacgcagacagggctccgagcatacctacgagagctgcggcgatggtgtgccagcgccacagaaggttttgtttcctacagagcggttgtcccttcgatgggaacgggtgttcagagtgggagcagggctgcacaatttaggtaatacttgctttctcaacgctaccatacaatgtctcacctatacaccccctctggctaactatctgctgagcaaagagcatgccaggtcctgccatcagggctcattttgcatgctttgcgtgatgcagaaccacattgtgcaggcatttgccaacagtggaaatgcaatcaagccagtgtcctttattcgggatctgaagaagattgctcggcactttcgatttggaaatcaggaggacgctcacgagtttctccggtatacaatcgatgcaatgcagaaagcctgccttaatggctgcgctaaactggaccgacagacgcaggccaccaccctagtacatcagatttttggaggttatttgcgctcccgcgtgaaatgtagcgtgtgcaagtcggtgtcagatacctacgatccgtatctggacgtggccctggaaatccggcaggcagccaacatcgtgcgagccctcgagctgttcgtgaaggctgatgtactctccggggagaacgcgtatatgtgtgccaagtgtaagaagaaggtccccgctagcaagagattcacgattcacaggacaagcaatgtgctgacactgtcactgaagcgattcgctaatttcagcggtggaaaaattaccaaggacgtgggataccctgagttcttaaacatcaggccgtacatgtcgcaaaacaatggtgaccccgtgatgtacggtctctatgctgtcctcgttcactctggctatagttgccatgccggtcattattactgttacgtgaaagcgagcaacgggcagtggtatcagatgaatgactctctagtgcatagttcaaacgtcaaagttgtgctcaaccaacaggcatatgtgttgttctacttgaggatcccaggtagtaagaaatcccctgagggccttattagcagaactggttcgtcaagcctccctgggcgtccgtcggttatccccgatcatagcaaaaaaaacatcggaaacggtatcatttctagcccgctaaccggcaagcggcaggactcgggcaccatgaagaagccacacacaacagaggagatcggcgtgcccatctcaaggaacgggagtactttgggactgaaaagtcagaacgggtgtatccctcccaaactgccgagcgggagcccaagccccaaactctcacagacacccacccatatgcccacaatcctagacgaccctgggaaaaaagtcaagaagccagcccctccacaacactttagccccagaacggcacagggactcccgggaacttccaacagtaattcttcaagatctggtagtcagcgacagggttcctgggactcccgtgatgtggtcttaagtaccagtccgaagctgcttgcaaccgccactgctaacggccacggtttaaagggtaacgacgagtccgccggtttggaccgtagaggctctagctcttcgtctccagaacattccgctagttcagactcaacaaaggccccacagacacccaggagtggcgcagcccatttgtgcgactctcaggaaacgaactgttctaccgcaggacacagcaaaacccctcccagcggtgccgactccaagaccgttaagttaaagtcccccgtgctgtctaatacaacaaccgaaccagcttccaccatgtcacctcctccagccaaaaaactcgcactgagtgcgaaaaaagcttccactctgtggagggccaccggcaacgaccttagacctcccccacccagtccttcatccgacctgactcaccctatgaagacatcccatccagtggtggctagcacctggcccgtacaccgggctcgggcagtatcgcccgcaccccagagttcaagcaggttgcagccgccattcagcccccaccccacactgttaagctcgacacctaagcccccaggcacctccgaacctaggagttgcagctcaatctcaaccgcgctgccccaggttaatgaagaccttgtatccctgccccaccagctgcctgaggcctcggagccaccccagagtccctccgaaaagaggaagaagacctttgtcggcgagccgcagcgattgggcagcgagactaggctcccacagcatataagagaagccaccgctgccccacacggaaaaagaaagcgaaaaaagaagaaacggccagaggacaccgcagcatccgcactgcaggagggccagacacagcgtcagcccggatctcccatgtatcggagagagggccaggctcagctccccgctgtgaggcgccaagaggacgggacacagccccaggtcaacggacagcaggtgggatgcgttaccgacgggcaccatgctagtagtcgaaaacgcagaaggaagggagcggaagggctcggggaggagggtggactgcaccaagaccccctccgacattcgtgctcccccatgggagacggggatcccgaggcgatggaggagtctccaaggaagaaaaagaagaaaaagagaaaacaggagacccagcgcgcagttgaagaggacggacacttgaagtgcccccgttctgccaagcctcaggacgcagtggttccggaatcctcctcatgtgcaccctccgcgaatgggtggtgcccaggggacagaatggggctgtcacaagctccgcctgttagttggaacggggaacgagagagcgatgtggtccaggagttgctcaagtatagctcggacaaggcttacggacgcaaagtgctgacctgggacggcaagatgtccgccgtcagtcaagatgccattgaggattccagacaagctagaacagaaacggtggtggatgattgggacgaggaattcgatagagggaaagagaaaaagatcaaaaagttcaagcgggaaaagcggagaaacttcaacgcattccaaaagcttcagacccgcagaaacttctggagtgtaacacaccccgctaaagccgcatctctgagctacagacggtag

SEQ ID NO: 245994 - DNA, 1698 bp, Artificial Sequence
  Description of Artificial Sequence: Synthetic coding sequence
atgtctgggagaagtaagcgtgagagcaggggcagtacaagggggaaacgcgaatctgaatcccgcggtagtagcggccgagtgaagagggagcgcgacagggaaagagaacccgaagccgcttcaagcaggggtagtccagtacgggtcaagcgcgaattcgaaccggcaagcgctagggaagcacctgcatctgtggtaccctttgttcgggttaagcgtgagcgtgaggtagatgaagactccgagccagaaagagaggtccgcgcaaagaacggcagagttgatagcgaagaccggagatcgcggcactgtccatacctggatactattaaccgatctgttcttgacttcgattttgaaaagctgtgtagcatctccctctctcacattaacgcctatgcttgcttggtctgtgggaagtattttcagggtagaggacttaagtcccacgcgtacatccatagcgtgcagttcagtcaccatgtgttcctcaacctacataccctgaaattctattgtctgcctgataattacgagatcatagatagctctctggaggatattacctacgttctaaagccaacattcaccaagcagcagattgcaaatcttgacaaacaggcgaaactcagccgagcctacgacggaaccacctacctgcctggaatagtgggcctgaacaatataaaggccaatgactatgccaatgctgtcttacaggccctgtcgaacgttccaccccttcgtaattactttcttgaagaggacaactacaagaacatcaaacgcccacctggagatatcatgttcctgctggtgcagcggtttggcgagctcatgcgcaaactgtggaatcccagaaacttcaaagctcatgtgagtccgcatgaaatgttgcaggctgtggtcctttgtagcaagaagacgttccaaatcacaaagcagggggacggcgtagactttctatcatggttcttgaacgcactgcactccgccctcgggggtacgaaaaaaaagaagaagactattgtgacggacgtgttccagggaagtatgagaatcttcaccaaaaagctgccccatccagatcttcccgctgaagagaaggaacagctgctgcacaacgacgaatatcaagagactatggtagaaagcacattcatgtatctaacgctggatctccctacagctcccctctacaaggatgagaaagagcagctcatcattccccaggtgccgctgttcaacatactagccaaattcaacggcattactgagaaagagtacaagacctacaaagaaaacttcctaaagcgctttcagctgacaaaattacctccatacctgatcttttgtattaaaagatttaccaagaataactttttcgtggaaaaaaatcccaccatagtgaacttcccaatcacgaacgtcgatctgcgtgagtacctcagcgaagaggtacaggcggtccataagaataccacttatgacctcattgccaatatcgtccacgacggaaagccgagtgaggggtcttatagaatacacgttctgcaccacggcactggcaaatggtatgagctgcaggatctgcaagtaaccgatatcctaccccagatgattactttgtctgaagcatatatccagatctggaagcgacgagacaatgatgagacaaatcaacaaggagcctag

SEQ ID NO: 245995 - DNA, 1698 bp, Artificial Sequence
  Description of Artificial Sequence: Synthetic coding sequence
atgagcggccgatccaagagagaatctagaggttccacccggggaaaacgcgagagcgaaagcagaggctcatctggcagggtgaagcgggagcgggatcgagaacgggaacccgaggccgcttctagcaggggaagccccgtgcgagttaagcgcgagtttgagcctgcatccgcacgggaagctccagcatcagtggtccctttcgtgcgcgtcaagagagaaagagaggtggacgaagattctgaaccggaacgggaagttagggccaaaaacggaagggtggacagcgaagatagacgatcaagacattgtccttatctcgacacgattaacagatccgttctcgattttgactttgaaaagctgtgttccatttcactgtcacatatcaacgcttatgcatgcttggtgtgcggaaagtactttcagggcagaggcttaaaatcacacgcttacatccacagcgtgcagtttagccatcacgtcttcttaaatcttcacacccttaagttttattgcctgccagacaattacgagataatcgattctagccttgaggacatcacctacgtcttgaaaccaactttcaccaagcagcaaatcgccaacttggataaacaggcaaaactcagtcgcgcttatgacgggaccacttaccttccagggattgtgggactcaataatattaaggcaaacgactacgcaaatgcagtgctgcaggcactctccaacgtgccaccgttacgcaactactttctagaagaggataattataagaatattaaacgaccacctggcgacattatgtttctgctggttcagcggttcggggagctgatgcgtaagctctggaatcccaggaatttcaaggcacatgtatctcctcatgagatgctgcaagcggttgttctgtgttctaaaaagacttttcaaatcacaaaacagggagatggggttgacttcctgtcctggttccttaacgctctgcacagcgctctgggcggaacaaaaaagaaaaaaaagaccattgttactgatgtatttcaggggtccatgcgcatatttactaagaagttgcctcatcccgatctccctgccgaggagaaagagcagctcctgcacaatgacgagtaccaggagaccatggtggagtctactttcatgtacttaactttggacctcccaaccgcccctctgtacaaagacgaaaaggaacagctgatcatcccacaggtgccgctattcaacatcttagctaagttcaacggcattaccgaaaaagaatacaagacttataaagagaactttctaaagagattccaactaacaaagttgccgccttacctgatcttttgtattaaacgattcaccaagaacaattttttcgtagaaaagaaccctaccatcgtgaatttcccaattactaatgttgacctgcgggagtacctgtccgaggaggttcaggccgtgcacaagaatacaacttacgatctgatcgccaatattgtccacgacggtaagcccagcgagggatcttataggatccacgtgctgcatcatgggaccgggaaatggtatgagctgcaggatttacaggtgacagatatccttccccaaatgataacacttagcgaagcgtacatacagatctggaaacgcagagacaacgatgagactaatcaacagggagcatag

SEQ ID NO: 245996 - DNA, 1389 bp, Artificial Sequence
  Description of Artificial Sequence: Synthetic coding sequence
atgttgaccgctgtgccctctcatctttttagcgccaaaaacgggagggtcgatagtgaagacagaagatctagacactgtccatatctggacacaattaacagtttttctcccttcccaaccgggcgtggcctgaagtcccatgcctacattcactccgttcaattttcccatcacgtcttcctgaacctacacaccctgaaattctattgtctgcctgacaattacgagatcattgactctagcctagaagacattacgtatgtgttaaagccaacttttactaagcagcagattgcaaacttggataaacaggccaaattgtcgagagcatacgatggtactacctatctgcccggtattgtgggtcttaataacatcaaagcaaatgactacgctaacgcggtccttcaggcactgagcaatgtgcccccactcaggaattacttcctcgaagaagataattacaagaatatcaagcggcctccaggcgatattatgttcctgctcgtccagagattcggagaactgatgcggaaactgtggaatcccagaaattttaaagcccatgtttcccctcacgaaatgctgcaagctgtagtcctgtgcagtaagaagacgtttcagatcacaaagcaaggggacggggttgattttctgtcatggttcctgaatgccttacacagtgccctggggggtacaaagaagaaaaaaaaaaccatcgtcacagatgtgttccaggggtccatgcgcatatttacaaagaagttgccgcaccccgatttaccagcggaggaaaaagaacagctgcttcacaacgacgagtatcaggaaaccatggtcgaaagtacttttatgtatttgaccttggatttgcctaccgcccctttatataaagatgagaaggagcaactgattattccccaggtccccctgttcaacatactggcgaaatttaacggaattaccgaaaaagagtataagacttacaaggagaattttctaaaaagatttcagctcactaaactacctccctatcttatcttttgcattaagcgattcaccaagaataatttttttgtggaaaagaatccaaccattgtgaactttccgataactaatgtcgacctccgggaatacttgtccgaggaggtgcaggccgtccataagaatacaacatacgaccttattgccaacattgtgcatgacgggaagcccagtgaaggatcctataggattcacgtgctccaccatggcaccggcaagtggtacgaactgcaggacctccaagtgacagatatcctgccccagatgatcaccctgagcgaagcctatatccagatatggaaacggcgtgacaatgacgaaacgaatcagcagggtgcctag

SEQ ID NO: 245997 - DNA, 1467 bp, Artificial Sequence
  Description of Artificial Sequence: Synthetic coding sequence
atgagcggaagatctaaacgggagtcacgaggttcaaccaggggtaaacgggagtctgagtctagaggatcctccggaagggtcaaacgggagcgtgacagggagagagaacctgaggctgctagttctagaggatctccagtgcgcgtgaaaagggagttcgagccagcgtcagcgcgagaggctccagcctctgtggtgcctttcgtgagggtgaaacgcgagcgtgaggtggacgaagacagcgagccagaacgggaagtgagagccaagaatgggagggtggacagcgaggacaggagatcacgccattgcccttacctggatacaatcaaccgcagtgtattagatttcgactttgaaaaactttgctccatatctctcagtcatattaacgcctacgcgtgtctggtgtgtggcaagtacttccagggacgcggtctgaaaagccatgcctacatacactccgttcaattcagtcaccacgtttttctgaacctccatacgctgaaattttattgcttgcccgacaactatgagattatcgacagtagtctggaggatataacctacgtcctaaaacccacttttacgaagcagcagattgcaaatctggacaagcaggccaagctgagtcgcgcttacgacggcacgacatatctcccagggatcgtaggtcttaacaacatcaaggccaacgattacgccaacgccgttctccaggcgctgtcaaacgtcccaccacttagaaattattttttggaagaagataattataagaacattaaacgacccccaggtgacataatgttccttcttgttcagaggttcggagagttgatgcggaaactgtggaacccacggaattttaaagcccatgtgagtccccacgagatgctgcaggcagtggttctctgtagtaagaaaacctttcaaatcacaaagcaaggggacggagttgattttctgtcttggtttctgaacgccctccactctgccctgggaggcacgaaaaaaaagaaaaaaactattgttacagacgtgtttcaaggatccatgagaatcttcactaagaaacttccacaccctgatctaccagcagaagagaaagagcagctgctgcacaatgacgagtatcaggagactatggtcgagtccacatttatgtaccttacattggatctgccaacggcgccactgtataaagatgagaaggagcagcttatcatcccacaggtgcctttgtttaacatcctggccaaattcaatggcattactgagaaagagtacaagacttataaagagaactttctcaagcgattccagctgacaaaactacccccttaccttattttttgtattaagagatttaccaaaaataacttctttgtcgagaaaaatcctacaatagtcaattttccaatcaccggccaagcaaacgggatgaattataagacttcacgctag

SEQ ID NO: 245998 - DNA, 2892 bp, Artificial Sequence
  Description of Artificial Sequence: Synthetic coding sequence
atggcagaagggggtggctgccgcgagaggccagatgcagaaactcagaaaagcgagttagggccacttatgagaaccacgctgcagcggggagctcagtggtatctgatcgattctcgctggttcaaacagtggaaaaagtatgtcggatttgatagttgggatatgtacaacgtgggcgagcacaacctattccctggcccaatcgataactcgggcctgttttctgacccagagtcccagactttaaaagagcatctcatcgatgaactcgactatgttctcgttcctaccgaggcttggaacaaactcctgaactggtacggttgcgttgaggggcagcaacccatcgtgaggaaagttgttgagcatggtctgtttgtgaaacactgcaaggtggaagtgtatctactggaactcaaactctgcgagaactcagaccccaccaatgttttatcctgccatttctcaaaggccgacaccattgctactattgagaaggagatgcggaagctgtttaacatccctgcggaacgagagacccggctgtggaacaaatacatgtcaaacacatacgagcagctatctaaactggataatacagtccaagacgctggcttatatcagggtcaggtactggtcatcgagccgcagaatgaggatggcacatggcccagacagaccctccagagtaaatcctccacagctcctagccgaaacttcactactagtcccaagtcttccgctagtccttacagctctgtctccgcttcattgatcgctaacggcgattccacctcaacatgcggcatgcatagctctggggtctcgcgcggtgggtcaggcttctcagcttcctataactgccaggagcccccaagctcgcacattcagcctggactgtgcgggctgggcaatttaggcaacacctgtttcatgaacagcgctctgcaatgcctcagtaacaccgcacctctgacggattactttttaaaggacgaatatgaggcagagatcaaccgcgataatcctctgggaatgaagggtgaaatagcggaggcttatgccgagctcatcaagcaaatgtggtccgggagggatgcacacgtggccccaaggatgttcaagacacaggtggggcgttttgcgcctcagtttagcggctaccagcagcaggactcgcaagagcttctggctttcctgttggacggcctgcacgaagacctgaaccgcgtcaagaagaaaccctatctcgagttaaaggacgccaacggcaggccagacgctgtggtcgccaaagaggcatgggaaaaccaccgcctcaggaacgattcggtgattgtggatacatttcatggattattcaagtcaactctggtttgcccggagtgtgctaaagtgagcgtcacctttgaccctttctgctatttgacgctgccactcccactgaaaaaggatagggtgatggaagtgtttcttgtgcctgccgatccccactgtaggcctacccagtacagagtgacagtgcccctaatgggggctgtttctgacctgtgcgaggcgctctccaggctgtctggcattgcagctgagaatatggtcgtggctgatgtgtacaaccaccggttccataaaatcttccaaatggatgagggcctgaatcatatcatgcctagggacgatattttcgtgtatgaggtttgctcaaccagcgtagacggctctgagtgcgtaactttgccggtgtattttagggagcggaagagccgcccttctagcacgtcaagcgcttccgccctttacgggcagcccctcctcttgtccgtacccaagcataaactgactctggagagcctgtaccaagccgtctgtgatcgcatcagccgatacgtcaagcaacctctgcccgatgagttcggcagttccccgctggagcccggtgcttgcaatggaagtaggaacagctgtgaaggtgaagacgaggaagaaatggagcatcaggaggaagggaaggaacaactcagtgaaacagagggctccggggaggacgaacccggtaatgacccctcagagacaactcaaaagaaaattaagggccaaccctgccccaagcgactgtttacctttagtctagttaattcatacgggaccgccgacatcaactccctggccgcagatggtaagctgttgaagctcaacagccgcagtactctggcgatggactgggactctgagactcggagactctattacgacgagcaggagagcgaagcgtacgaaaaacatgtctcgatgcttcaacctcagaagaagaagaagacaaccgtcgccctgcgggattgcatcgaactgttcactactatggaaacgctcggtgaacacgacccatggtactgtcccaattgtaagaagcatcagcaagcgactaaaaagtttgatctctggtcactacctaagatactggtagtgcacctcaaacggttctcttacaaccgttattggcgcgacaagctggacactgtggttgagtttcccataaggggcctgaacatgagcgaattcgtctgtaatctcagcgcccgtccctatgtctacgacctaatcgctgtatctaaccattacggagctatgggggtgggccactacaccgcgtacgccaaaaataaattaaacggtaaatggtactacttcgacgacagcaacgtgagcctggcctccgaagatcagatcgttacaaaagcagcatacgtcctgttttatcagaggcgggacgatgaattctataagactccatccctgagtagcagtggctcaagcgacggaggaacgcgtcctagctcatcacagcaagggttcggggacgatgaagcctgcagtatggacactaactag

SEQ ID NO: 245999 - DNA, 2751 bp, Artificial Sequence
  Description of Artificial Sequence: Synthetic coding sequence
atggctgagggagggggatgcagagagaggcccgacgccgagacacaaaagtctgagctgggtccactgatgcgcactaccctccagagaggggcacaatggtatctgatcgattctagatggtttaagcagtggaagaaatacgtgggctttgactcatgggacatgtataacgtgggggaacacaacctttttcctggccctatcgataactcaggtctgtttagtgaccccgaaagtcagacgctgaaggagcatcttatcgacgagctggattacgtacttgttccaaccgaggcttggaataaattgctaaactggtatggctgcgtggagggacagcagcccatcgtaagaaaggtggtcgagcacggactttttgtcaagcattgcaaggtcgaggtttatctcctggaactcaagctgtgtgaaaactctgaccctacgaacgtattaagctgccacttttcgaaggcagacaccattgcaacaattgagaaggagatgaggaaactcttcaatattcctgccgagcgcgagactagactatggaataaatatatgtcaaacacttatgaacagctatccaaactggacaacactgtccaggacgcaggcctgtaccagggacaagttctcgtcattgagccccagaacgaggatggcacctggccccgacagaccctccagtccaacggatccggcttttctgcaagctataattgccaagagcccccatctagccacatccagcctgggctctgcggcctgggtaacttgggcaacacttgtttcatgaattccgctctccagtgcctcagcaatactgccccactcacagactattttctgaaggatgaatacgaagccgagataaacagagataaccctctgggtatgaagggcgagattgctgaagcctatgcagaacttatcaagcaaatgtggagcgggagagacgcccatgttgctccacgcatgtttaagactcaggttggccgttttgctcctcagttctctggataccagcaacaggattcccaggagctgctggcattcctgcttgatggtctgcacgaggatctgaacagggttaaaaaaaaaccatatctcgagctgaaggatgcaaatgggagaccagatgcagtcgtggccaaagaagcttgggagaaccacaggctgcgcaacgactccgtgatagtggatacctttcacggtctgttcaaatctactctcgtctgtcccgagtgcgcaaaggtgagtgtgaccttcgatcctttctgttacctcactctaccactgcccctcaagaaggacagggttatggaggtctttctggtgccggctgacccacattgtagaccgacccagtatcgtgtgaccgtcccactaatgggggcagtgagtgatctgtgtgaggctctgtcccggttgtccggcattgcagcagagaacatggtggttgccgatgtgtacaaccatagatttcacaagatttttcagatggacgaggggctgaatcacatcatgcccagggacgatatttttgtctacgaagtgtgtagtacaagtgtcgatgggagcgaatgtgtgacactcccagtctattttcgggaacgcaagtctaggccttctagtacgagctccgcaagcgccctctacggacagcccctgctgctcagcgtgccaaagcataaattaacattagaatctctataccaggccgtatgcgataggatctctcggtacgtgaagcagccgcttccggatgaattcgggagtagccctctggagcccggagcttgcaacggttcaagaaattcatgtgagggggaggacgaagaggaaatggagcaccaggaggagggtaaggaacaactatctgaaactgagggcagcggtgaggatgagcccggtaatgacccatccgagaccacacagaaaaagatcaaaggtcagccctgccccaagcgcctcttcacgttctccctggtcaattcgtatggcacagcagacattaattcccttgctgccgacggcaagctgttaaaactgaattctaggagtacacttgcaatggattgggatagcgaaacgagacgcctctattacgacgaacaagagtcagaagcttatgaaaagcacgtttcaatgctacagcctcagaaaaagaaaaagacaacagtagcactgcgcgattgtattgagctctttactaccatggaaactctcggtgaacatgacccttggtattgtccaaattgtaaaaaacaccagcaggccacaaagaaattcgatctctggagcctgccgaagattctcgtggtgcatctcaagcgattttcctataacagatactggagggacaaattggatactgttgtcgagttcccgattagaggtctgaacatgtctgagtttgtgtgcaatctttcagcccgaccgtacgtctatgatttgattgccgtatcaaatcactacggagcaatgggcgtgggccattatacagcctacgcaaaaaacaaactcaacgggaaatggtattattttgatgattcaaacgtctccctggcttctgaggaccagattgtgacaaaggcagcgtacgttcttttttaccagagaagggatgatgagttttacaaaactccatccttatccagtagtgggagctcggacggaggaacacggccatccagctcacaacagggttttggtgacgatgaagcctgtagcatggacactaactag

SEQ ID NO: 246000 - DNA, 942 bp, Artificial Sequence
  Description of Artificial Sequence: Synthetic coding sequence
atggcggagggcggtgggtgtcgcgaacgtccagatgcagaaacccagaagtccgagctgggacctttaatgaggacaaccttacagagaggcgcacagtggtacctgattgacagtcgttggttcaagcagtggaaaaagtacgttggctttgactcctgggatatgtacaacgtaggcgaacacaacctttttccaggcccaatcgacaattctggccttttctctgaccccgagtcccagacactgaaagagcacttaatagacgagttggactacgtactggtgccaaccgaagcttggaataaacttctgaattggtatggctgcgtggaaggccagcagccaatcgtcaggaaggtagtcgaacatggtctattcgtcaaacactgcaaagtagaagtttacttactcgaacttaagctctgtgaaaatagtgatccaactaatgtcctgtcttgccacttctcaaaagcggataccatcgccactatcgagaaagagatgaggaagcttttcaacatcccagctgaaagagaaacccgcttgtggaacaagtacatgagcaacacttacgaacagctctccaaactggataatacagtccaggacgccggactgtatcaagggcaggtactagtcatagaacctcagaacgaagatggaacatggcccagacagactcttcagtctaaggtgagctttttcttgcccagactggagtgtaatggagcgatactggcacattgtaatttctgcctacctggaagcagtaattcgcctgcatctgcttctagggtcgccccatcccatttggcaaactttttcttcttcgaaatggagtcacacagcgtcactaagctggagtgtgggggagcagtctccgcttactctcgcgtgcaagtcatgctactccctcagcccccagagtggttggggtag

SEQ ID NO: 246001 - DNA, 2139 bp, Artificial Sequence
  Description of Artificial Sequence: Synthetic coding sequence
atgctggcaatggatacttgcaaacacgttggacagctgcaattggcccaggaccatagctccctcaatccacagaagtggcattgcgtggattgtaacacaacggaaagtatatgggcttgtctctcctgttcccacgtggcgtgtgggaggtatatcgaggagcacgcactcaagcatttccaggaatcgagccaccccgtggccctggaggttaacgagatgtatgtcttctgttacctctgtgacgactacgtccttaacgataatacaactggtgatctgaaattactccggaggactctgagtgccataaaaagtcagaactaccactgcaccactagatccggaaggttcctgcggtccatgggcacaggggatgacagttattttctccacgacggtgcacagtccttgcttcaaagcgaggatcagctctatacagcactctggcatcgcagacggattctgatgggcaaaattttcaggacgtggttcgagcagtcccctattggcagaaagaaacaagaagagcccttccaggaaaaaattgtggtcaaacgggaggttaagaaacgcagacaggaactggaatatcaggtgaaagcagagctggagtctatgccacccagaaaatcccttcggttgcagggtttagcacaaagcactatcatagagatcgtgtctgttcaggttcccgcacagacacctgcctcccctgccaaggacaaggtgctgtcaaccagtgagaatgaaatttcccaaaaggtgtcagatagctcagtcaagaggcgtccaatcgtcacacccggagtgaccggcctgcggaatctgggcaatacttgctacatgaattctgttctccaggtgttgagccacttgttgatcttcaggcagtgtttccttaaactagatttgaatcagtggctggccatgacagcctctgagaagacgaggtcttgcaagcacccccctgtcacagatactgtggtgtatcagatgaatgagtgccaagagaaggacacaggatttgtctgtagtaggcagtcttccctgagctctggtctaagtggcggagccagcaagggcagaaagatggagcttattcagcccaaggaacctacctcacaatacataagcctctgtcatgaacttcataccctgttccaggtcatgtggtcagggaaatgggcgctggtgtccccctttgccatgctgcactctgtctggcggttaatacctgccttccggggatacgcccagcaggacgcccaggagttcctgtgcgagctgctggataagatccaacgggaactggagaccactggcactagcctccctgccctcatacccacctcccaacggaaactgataaagcaggtcttaaacgtggtcaataacatttttcacggtcagctgctgtctcaggtcacctgtttggcctgtgacaacaagagcaacaccatagagccattttgggacctgtccctggagtttcctgaacgttatcagtgctccgggaaggatattgcaagccagccttgcctggtgacagagatgctggccaagtttaccgaaaccgaagcgctggaaggaaagatttacgtctgtgaccagtgcaattcgaagcggaggagattctcgtcgaaacccgtggtgctgacagaagcccagaaacagctcatgatctgtcatctgccccaagttctgcgcctacacctcaaacgctttcgttggtctggacgaaataatagagagaaaatcggggtgcacgtgggatttgaagagatccttaacatggagccatactgttgccgcgagactttgaagtccctccgcccagaatgctttatatacgatctgtctgctgtggtaatgcaccatggcaagggatttggaagcggtcattatacagcatactgctacaacagcgagggcggattctgggtgcactgcaatgactccaaacttagtatgtgcacaatggatgaggtgtgcaaggcccaggcttacatcctgttctacacccagagagtaacagaaaacggccactccaaactgctcccaccagaactgctgctaggctctcagcaccctaatgaagacgcagacactagctctaatgagatcctctcgtag

SEQ ID NO: 246002 - DNA, 2139 bp, Artificial Sequence
  Description of Artificial Sequence: Synthetic coding sequence
atgttagctatggatacctgtaaacacgttggccagctgcaattggctcaggatcattccagtctcaatccccaaaagtggcactgtgtcgactgtaatactaccgaaagcatctgggcctgcctgagctgcagccacgtcgcctgcggaagatacatcgaggagcacgctctgaagcatttccaggagagctcacatcccgttgctctggaggtgaacgaaatgtatgttttttgctatctgtgcgatgactacgtcctcaatgataacactaccggggacctcaaattgctgcgaagaaccctgtcggccataaagtctcaaaattaccattgcacgacccgcagtggtcgatttctcaggtcaatgggcactggagacgactcctactttctgcacgacggcgcacagagtttactgcaatccgaggaccaactatataccgctttgtggcaccgacgcaggattttgatgggcaagatttttaggacatggttcgagcagtcccccataggaaggaagaagcaggaagagccattccaggaaaagatcgtcgtaaagcgagaggtgaagaaacggcgtcaggagctggagtatcaggtcaaagcggagctcgaatctatgcctcccaggaagtccctgaggttgcaaggccttgctcagtcaaccatcatcgaaattgtctccgtccaggtacctgctcagacccccgcttctccagcaaaagacaaggtcctctccacgagcgagaacgagatatctcagaaggtatctgattcgagtgtcaaaaggcgccctattgttaccccaggggtcactggtctgcgcaatttggggaatacgtgctatatgaattcggtgctacaggttctgtctcacctcctcatcttccgccagtgctttttaaagctggatctaaatcagtggctggccatgacggcaagtgaaaaaaccagaagttgcaaacacccgcctgtgaccgatactgtcgtgtaccagatgaatgaatgccaagaaaaagacaccggtttcgtgtgctccagacaatcctccctgtcttccggacttagcggtggcgcatccaaaggcagaaagatggaactgatccagcctaaggagcctaccagccaatacatctcactgtgccacgagctccacacgcttttccaggtgatgtggtctggcaaatgggcactcgtgtcacctttcgctatgctgcactcagtttggaggttgattccagcttttcgcggttacgctcagcaggatgcccaggagtttctctgtgagttgcttgataagatccagagagagctggagaccacaggtacctcactccccgcactgatccccacgagccagaggaagctcatcaaacaagtgttgaacgtggtcaataacatttttcatgggcagcttctctcgcaggtgacttgtttagcatgtgacaataagagcaacactattgagcctttctgggatctgtccctcgagtttccggagaggtatcagtgtagcggcaaggatattgctagccagccatgtcttgtcacggaaatgttggccaagttcaccgagactgaagctctggagggcaaaatctacgtgtgcgaccagtgtaatagcaagagacggcgtttctcctcgaaacccgtagtgcttactgaggcacagaaacagctgatgatctgccatctgccccaggttcttcggctgcacctgaaacgctttcgttggtctggaaggaataatcgagaaaagatcggcgtacacgtaggtttcgaagaaatcctgaacatggagccctactgctgtagggaaacactcaagagcctccgacctgagtgcttcatttacgatctgtccgccgttgtgatgcaccatggtaaggggttcggtagcggccactatactgcgtactgttataattcggagggcggattttgggtgcactgtaacgattctaagttgagtatgtgcactatggatgaagtgtgtaaagcacaggcatacattttgttctacacacaaagggttacggaaaacggacactccaagctgctccccccagagcttcttctgggatcacagcatcccaacgaggacgcagacacctccagtaatgagatactgtcctag

SEQ ID NO: 246003 - DNA, 2139 bp, Artificial Sequence
  Description of Artificial Sequence: Synthetic coding sequence
atgttagcgatggacacctgtaagcacgtgggtcagttgcaactcgcacaggaccactccagtctgaacccacaaaaatggcattgcgtggactgtaataccactgaatccatttgggcttgcctgtcctgcagccatgtggcttgtggcagatatattgaagagcatgccctaaagcattttcaggaatcctcgcatcccgtggctctggaagtcaacgagatgtacgttttttgttacctctgtgacgactatgtgctcaacgataataccaccggagacctcaaattactgcgtcgtactctttcagccatcaagagccagaactatcactgcacaaccaggtccggaaggtttcttaggtctatgggtacaggcgatgactcatactttctgcatgacggagcacagtccctcctgcagtcagaggaccagttgtatactgccttatggcaccgtcgtcgcatcctgatgggcaagatattccgaacgtggtttgaacagagtcccattggacgtaagaaacaagaggaaccattccaggagaaaatagtggtgaaaagggaggtgaagaagagaagacaggaactggagtatcaagtcaaagcagagcttgagtccatgcctccacggaagtcactccggctgcagggtctcgctcagagtaccataatagagattgtgtccgtgcaggtacccgctcagacacccgcatcaccagcgaaggacaaggtcctctcgacgtccgagaatgagatttcccagaaagtgtccgatagctctgtgaagaggcgtcctatcgttacaccaggcgtgacgggtttgcgcaacttgggcaatacttgctatatgaatagcgttctacaggtgctttcccacctgttgatctttaggcagtgcttcctgaagctcgacttgaatcagtggttggccatgacagcgagcgaaaagacccggtcgtgcaagcaccctccggtcacggacaccgtggtgtatcagatgaacgagtgccaagagaaagacacaggctttgtgtgctctagacagtccagcctttcaagcggactgtctgggggagcttccaaagggcgaaaaatggagcttatccagcccaaggagccgaccagccagtacatctctttatgccatgaactccatacactgtttcaagttatgtggtccggtaagtgggccctggtttctcccttcgccatgttacattccgtgtggcgtcttattcccgcattcagaggttacgcccagcaggacgctcaggagttcctttgtgagctgctcgacaagatccagcgggaactggagactacgggcactagcctgcctgcgttaatcccaacctcccagcggaagctgatcaaacaggtgctaaatgttgtaaacaacatctttcatggccagctgttgagtcaagtcacttgcctggcctgcgataataagagcaatactatcgaaccgttctgggacttatccctcgaattccctgagaggtatcagtgcagcgggaaggacatcgcgtcacagccgtgccttgttactgagatgctggcaaagttcacggagactgaggctctggagggcaagatttacgtgtgcgaccagtgtaactccaagcggagaaggttcagctccaaacctgtcgtactgactgaagcgcaaaagcagctaatgatctgtcacctcccgcaggttttaaggcttcacttgaaaagatttcgctggtcaggcagaaacaacagggagaaaattggcgtgcacgttgggttcgaagagattttaaatatggaaccttactgttgtagagaaacactgaagagccttaggcccgaatgttttatttacgatctgtcagcagtggtgatgcaccacggtaagggcttcgggtcaggtcactacaccgcatactgctataacagcgagggtggtttttgggtacattgtaacgactccaaactgtctatgtgtaccatggatgaggtatgcaaggcccaggcctatatcctgttctacacccagagagttactgagaatggacactctaagctgctgccccctgagctgctgctgggaagtcagcatcccaacgaggatgccgatacctcttctaacgagattctaagttag

SEQ ID NO: 246004 - DNA, 336 bp, Artificial Sequence
  Description of Artificial Sequence: Synthetic coding sequence
atgctcgcaatggacacgtgcaaacacgtcggtcaactacaacttgctcaggatcactccagcttgaaccctcagaagtggcactgtgtggattgtaacacaaccgagtccatctgggcctgtctgtcttgttcccacgttgcttgtgggcgatatatcgaggagcatgcacttaaacacttccaggagtcttctcacccagtagccttagaggtgaacgaaatgtatgttttctgctatctctgcgacgactacgttcttaacgataataccacaggtgacttaaaactcctccggagaacactgtccgctatcaagagccagaactatcattag

SEQ ID NO: 246005 - DNA, 495 bp, Artificial Sequence
  Description of Artificial Sequence: Synthetic coding sequence
atgctcgccatggacacgtgcaaacacgtgggccagttgcagttggcccaggatcacagttccctgaatccccaaaaatggcactgtgtggactgcaatactactgagtcaatctgggcctgtctgagttgctcccatgtggcttgcgggagatatatcgaagagcacgccctgaagcattttcaggaatcctcccacccagtggccctcgaggttaatgaaatgtacgtcttctgttacctctgcgatgattatgttctgaatgataatacaaccggcgatttaaaactgctaaggaggactttgagtgcgattaagtcacaaaattatcactgtaccactcgaagcggaaggtttctgagatctatgggaacaggcgatgatagctactttctgcatgatggcgcacagtcattgcttcaaagcgaagaccagctatacactgcactctggcaccggagacgcattctgatgggcaagatcttccgaacttag

SEQ ID NO: 246006 - DNA, 1101 bp, Artificial Sequence
  Description of Artificial Sequence: Synthetic coding sequence
atgactgtgagaaatatcgcatcgatttgcaacatgggaaccaacgccagcgccctcgagaaagacatcggcccagaacagtttccaataaacgagcattacttcgggcttgtgaacttcggaaacacatgttactgtaatagcgtcttgcaggctttatacttttgcagacctttcagggagaacgttctggcatacaaagctcagcagaaaaagaaggaaaatctgctaacctgtttagccgaccttttccatagcatagccactcagaaaaaaaaagtgggggtgatcccgccaaagaaattcatcagcagactgaggaaggagaacgatctgttcgacaactacatgcaacaggatgcccacgagttcctgaattatctgctgaatacaattgccgatatactacaggaggaaaagaagcaggagaaacagaacggaaagctgaagaacggaaatatgaacgagccagctgagaacaacaagcctgaattaacatgggtgcacgagatctttcagggaacgttgactaacgagacaaggtgcctgaactgcgagacagtgtctagcaaggatgaggacttccttgatctctccgttgacgttgagcagaatacatccataacgcactgccttcgcgactttagtaataccgaaaccctatgttccgagcagaagtattattgcgagacctgttgcagcaaacaggaagcgcagaaaagaatgcgcgtgaagaagctgcccatgatccttgctctccacctcaaacgcttcaaatacatggagcagctccatcgctataccaagctcagctacagggttgtattcccactggagttgaggctattcaacacctcaagtgacgcggtcaatttggaccgcatgtatgacctcgttgcagtggtagttcactgtgggtctggcccaaatagaggccactacataactatcgtaaaatcacatggattctggctgctcttcgacgacgacatcgttgaaaagattgatgcccaggccattgaagaattttacgggctgacctctgatattagtaagaattccgagagtggctacatactgttctaccagagtagggagtag

SEQ ID NO: 246007 - DNA, 1080 bp, Artificial Sequence
  Description of Artificial Sequence: Synthetic coding sequence
atgaattgtttccagggcaccaacgcgagcgcattggagaaagatataggtcccgagcagttcccaatcaatgagcactactttggattggtgaattttgggaatacttgctactgtaactctgtgctgcaggctctatacttttgccgaccctttcgggaaaacgtgcttgcatataaggcacaacaaaagaaaaaggagaacctattaacctgcttggctgacctgtttcattctattgcaacccaaaagaaaaaagtcggggtgattccacccaagaagttcatttcaagactcagaaaagagaacgacctgtttgataactatatgcaacaggacgctcatgagttcctcaattacttgctgaacaccatcgcagatattctgcaggaagagaaaaagcaggagaagcagaacggaaagctgaagaatggcaatatgaacgaaccagccgaaaacaacaagcctgagctcacctgggtgcacgaaatttttcagggcacgttgaccaacgaaaccagatgcctcaattgtgaaacggtctcttctaaggacgaggactttctcgacctcagcgttgacgttgaacagaacaccagcataactcattgcctgcgcgatttcagtaacacagaaacactatgttctgagcagaaatactactgcgagacctgctgctcaaagcaggaggctcaaaaacgaatgagggttaaaaaactgcccatgattttggcacttcacctgaaacggttcaagtacatggagcagcttcatcgctataccaaactctcctatcgtgtcgtcttcccgctggagctgagactttttaatactagttctgacgccgtcaacctggacagaatgtacgatttagtggccgtggttgtgcactgtggatctgggccaaatcggggacattacataacaatcgtgaaatctcatggcttttggctcctgttcgatgacgacattgtcgaaaaaatcgatgctcaggctatcgaggagttttatggtctcacctcagacatctcgaagaatagcgaatcaggttatatccttttttaccagtcacgcgaatag

SEQ ID NO: 246008 - DNA, 4221 bp, Artificial Sequence
  Description of Artificial Sequence: Synthetic coding sequence
atggacatggtggagaacgctgattccctccaggcacaagagcgcaaggatatactcatgaagtacgataagggccatagggccggattgcctgaggacaaaggaccggaacctgtgggaatcaacagttcaatcgacaggttcggcatcctgcacgagactgagcttcctccggtgacagcccgtgaagctaagaaaatacgcagggaaatgacacggacatccaagtggatggaaatgcttggggaatgggagacatacaagcatagctctaaactgatcgatcgagtgtacaaaggaatccccatgaatatccgcggacctgtctggagcgtactcctcaatatccaggagattaagttgaagaacccgggtcgctatcaaattatgaaggagcgcggaaaacgatcctcagaacatattcaccacattgacctagatgtccgaacaactctgagaaaccacgtgttctttagggaccgttatggggcaaagcagcgggagttattctatattctcctcgcgtacagcgaatataatcctgaagtaggctactgcagggacttatcccacataaccgcgctttttctcctgtatctgcccgaggaggatgctttctgggcgctggttcagctcctggccagcgagcgccactcccttcccggtttccacagccctaatggaggcactgttcaggggctgcaggatcaacaggagcacgtcgttcctaaatctcagccgaagaccatgtggcatcaggacaaggagggcctgtgcgggcagtgcgccagcctcggctgcctcctacgcaatctgatagatgggatctccttggggcttacacttagactttgggatgtgtacttagtcgagggagagcaggttttaatgccgatcacttccattgctcttaaggtccagcagaagaggctcatgaagacatcacgatgcggcttgtgggcccgactgcgaaatcagttttttgacacttgggctatgaacgacgatacagtacttaagcacctgcgagccagcacaaaaaaactcacaaggaaacagggcgatctgcccccaccggctaaacgggaacagggtagcctggcccctcgcccagtacctgccagcagaggtggcaagactctgtgtaaaggctacagacaggcccctcctgggccacctgctcagttccagcgcccaatctgtagtgcttctcccccatgggcaagccgattttccactccatgtccaggcggagcagtcagggaggacacctacccggtgggtacacagggtgtaccctcactggcgctcgcccagggcggaccccagggaagctggcgtttcctggaatggaagagcatgccaaggctccccactgatctggacatcggcggtccctggtttccgcactatgactttgaatggtcatgctgggttcgggctatctcacaggaagaccaattggccacctgttggcaggctgagcattgtggcgaagtgcataataaggatatgtcatggcccgaggaaatgtccttcacagccaactcatccaaaattgatcgccagaaggttccgacggagaaaggggcaaccggtctgagtaatttaggaaacacctgttttatgaactctagcattcagtgcgtgtcaaatacacagccactgacgcagtattttatttctgggagacatttgtatgaattgaatagaacaaatccaattggaatgaaggggcacatggccaagtgttacggggatcttgtgcaagagctgtggtccggcactcagaaaagtgtggcgcctcttaaactgaggagaacgatcgctaagtacgctcccaaattcgatggtttccagcagcaggacagccaggaactcttagctttcctcttggacggtttgcatgaagatttaaaccgcgtgcacgagaagccctatgtggaactcaaagactctgacggcaggccagactgggaggtagccgcagaagcctgggacaaccacttgagacggaatcgtagcattattgtggacctctttcacgggcagttacggtcacaggtgaaatgtaagacgtgtggccacatttctgtacggtttgacccctttaactttctgtcattgcccttgcccatggacagctacatggacctagagattacagttataaaactggatggtacgacccccgtgcgatacggtctccgcttaaacatggacgaaaagtacactggactgaaaaaacagctgcgagacctttgtggcctaaactccgagcagatcctgctggccgaagttcacgactccaacatcaaaaactttccccaggacaatcaaaaagtacaactgtccgtgagcggcttcctgtgcgcctttgagattccagtgccctcgtccccaatttctgcctcgtcaccaactcagatcgattttagctcatcgccaagcacgaacggcatgtttacactgacaaccaacggagatctacccaagcctattttcattcctaacggcatgcctaacactgtagttccgtgcggcacagaaaagaactttacaaacggcatggtgaacggtcacatgccttcactgcccgattcaccttttacgggatacatcattgccgtgcatagaaagatgatgcggacagagttgtattttctctcaccacaggaaaaccgacccagtctcttcgggatgcctttgatcgtgccctgcacggtgcacaccagaaagaaggacctctatgacgccgtatggattcaggtgtcctggctggccaggccattacccccacaggaagcttccattcatgcccaggacagagataactgcatgggctaccaatatccattcaccctgagagtggtgcagaaagatggcaactcgtgtgcctggtgccctcagtatcgtttttgccggggttgtaaaattgactgtggcgaggacagagcttttattggaaatgcttatatcgcagtggattggcatcccacggcattacatctacgttatcagacctcacaagaaagagtggtagacaagcacgaatctgttgagcagagtcgcagggcccaagcggaacccattaatcttgatagttgtctgagagctttcacttcggaggaagaattaggcgaatcggaaatgtattattgctcaaaatgcaaaacacattgtctggctaccaaaaaactggatttatggagacttcctccgtttctgatcatacacctgaagagatttcagttcgtgaatgaccagtggattaaaagtcagaagatcgttaggtttctccgagaatcatttgacccatccgcttttctggtgccaagggacccagccttgtgccagcacaaaccactgaccccgcagggggatgaactcagcaagccgaggatcctggctagagaggtcaagaaagtcgatgcccagtcaagtgccggaaaggaagacatgctgttgtccaagtcccctagcagcctctctgccaatatcagctcctcaccaaaaggctccccaagcagctcacggaaatctgggacaagctgtcccagcagcaagaatagcagccccaattcctcccctagaactctcggcagaagtaaggggcgtctgagactgccgcagatcggatcgaagaacaagccaagttcctctaaaaagaacctggatgcctcaaaagaaaatggggcagggcagatctgcgaactcgccgatgccctcagccgaggacacatgcgcggtggctctcagccagaattggtaaccccccaagaccatgaggttgcgctggcaaacggttttctatacgagcatgaagcatgcggaaacggctgtggcgatggctattcaaatggccaactcgggaaccactctgaagaagattcaacagatgaccagagagaggatacccatattaaaccaatctataatttgtacgccatttcatgccacagcggcatcctgagcgggggtcactacatcacctatgcaaagaatccgaactgcaaatggtactgctacaacgactcgtcttgcgaagagctgcaccccgatgagatagataccgacagcgcctatatcttattttacgaacagcagggcattgactatgcacaattccttcctaaaattgacggcaagaagatggccgatacctcttcaaccgacgaagacagcgagagtgattacgagaagtatagcatgctccagtag

SEQ ID NO: 246009 - DNA, 3270 bp, Artificial Sequence
  Description of Artificial Sequence: Synthetic coding sequence
atgccccagcgactcccccacgcgcgacagcatactcctttacccttgggctcggccgactacagaagagtggtgtctgttaggccccaagggcctcaccgggatccgaaagacagccgtgatgctgctaagagagagcagggctctcttgcccctcgtccggttcccgcaagcagaggaggaaagacgctgtgtaagggttacaggcaggcgccacctggtcccccagcccaattccagagacccatatgcagcgccagccccccttgggcctctagattttcaacaccctgtccgggtggcgctgtgagggaggacacgtatccagtggggacccagggcgtgccatcactcgcattggctcaaggaggtcctcaaggttcttggaggtttctggagtggaagagtatgcccaggctgccgaccgatctggatattggcggaccatggttccctcattacgattttgaatggtcatgttgggtgagggcaatcagtcaggaagatcagctggcaacgtgctggcaggctgaacactgcggagaggtccataataaagatatgtcgtggcctgaagagatgtcattcacggcaaacagctccaagatcgacagacaaaaggtccccacagagaagggcgcaaccggcctgtctaatttgggcaatacgtgttttatgaattcatccatacagtgcgtgagtaacacccagcctctgacccagtattttatatcgggaaggcacttatatgagcttaacagaacaaatcctattgggatgaaagggcatatggccaaatgctatggggatctggtgcaagagctgtggtccggaacgcaaaagagcgtagcccctctgaaactgcgacgcaccattgccaaatacgctccgaagtttgatggatttcagcagcaggattcccaggaattattggcctttctgttggatggattgcacgaggatctaaacagggtgcacgagaaaccgtatgttgagctgaaggactccgatgggcgtcccgattgggaagtcgcagccgaagcttgggacaaccacctccgcaggaacagatcgattattgtggacctgtttcacggccagctgaggtcccaagtgaagtgtaaaacgtgcggacacatcagcgttagattcgatccattcaacttcctcagtctgcctttgcctatggactcctatatggacctcgaaataactgttatcaagttggacggtactactcccgttcggtatggattgaggctaaacatggatgagaagtacaccgggctgaaaaagcagctccgcgatctgtgcggactcaattccgagcagatcctcctcgcggaggtacatgactcaaacatcaaaaactttccccaggacaaccagaaggtgcagctgtcagtttcaggattcttatgtgctttcgaaattccagtgccgtccagtcccattagcgccagttcccctactcagatcgatttctctagcagcccctcgaccaacggaatgtttacactgactactaatggagacctgccaaagcccatctttatccctaatggaatgcctaacaccgtagtgccctgcggtacagagaagaatttcacaaatggtatggtgaatggtcacatgccttctttgcccgacagtccttttaccggctatattatagccgtacatcgcaagatgatgcgaaccgagctatacttcctgagtccccaggaaaaccggcctagtctgtttggcatgcctttaatcgtaccctgtacagttcatacacgcaagaaagatttgtatgatgctgtttggatccaggtgtcctggttggccagacctctgccccctcaggaagcctctatccatgcccaggatcgagacaattgtatgggatatcaatacccatttacgctccgagtggtacaaaaagatgggaacagctgcgcatggtgcccgcaataccgattctgtcgcggatgcaaaattgattgcggagaggatagggcattcatcggcaatgcctatatcgccgtcgactggcacccaaccgccctccacctcagatatcagactagtcaagagagggtggtggacaagcacgagtcagtagagcagtctaggagagcacaggccgaacccatcaacttggactcctgcctcagggcttttaccagcgaggaggagcttggcgaaagtgagatgtactactgttccaaatgtaaaactcactgtctggccactaagaagttggacctgtggagattgcctccattcttgatcattcaccttaaacggtttcagttcgtcaacgaccagtggattaagagtcagaaaatcgtccgcttcctcagggaatccttcgatccgtcagctttcctggtcccacgcgatcccgcactctgccaacataagcccctcacgccacagggtgatgagctcagtaagcctagaatcctcgctcgcgaagtgaagaaggtggacgcccaatcctctgcagggaaggaggacatgctcctttctaaatcaccatcctccttatccgctaacatttcctcaagcccgaaaggaagtccttcgtctagccgcaagtcaggaacttcttgcccgtctagtaaaaattcgagtcccaattcctctccgaggactcttggcagatcgaagggacgactgagattgccccagataggctctaaaaacaagcctagctctagcaaaaagaacctcgacgcctctaaggagaacggagccggacaaatttgcgagcttgctgatgccctgagcagaggccacatgaggggtggatcacagccagagctggtgactccacaggaccatgaagtggctctggcaaacgggtttctctacgagcatgaggcatgtggtaatggttgcggagacggatactccaacggacaactaggtaaccactccgaggaggattccacagacgatcagagagaggatactcatattaaacctatctataatctgtatgccatatcttgccattctggcatactgtccggtggccactatataacttatgcaaagaacccgaattgcaagtggtactgctacaatgattcctcatgtgaggaactgcatcccgacgagatcgatacggactcagcctatatactgttctatgagcagcaggggatcgattatgcccagtttttaccgaagatagatggtaagaaaatggccgatacaagtagtacagacgaggacagcgaatctgattacgagaagtattcgatgctgcagtag

SEQ ID NO: 246010 - DNA, 2361 bp, Artificial Sequence
  Description of Artificial Sequence: Synthetic coding sequence
atggatatggttgaaaatgctgactctctgcaggctcaggagcggaaagatatacttatgaaatatgacaaagggcaccgcgcaggactccctgaggacaaaggacctgagccggttggtattaactcctccattgaccgattcggcatattgcacgaaacagaactaccgccagtcaccgcacgcgaagccaagaagatacgcagggaaatgaccaggacatctaagtggatggaaatgttgggcgagtgggaaacatacaagcacagcagtaagttgatcgatcgtgtgtacaaggggatcccaatgaacattcgcggaccggtctggtctgtcttacttaacatccaggagatcaaactgaaaaaccccggaagataccaaatcatgaaagagcgcggtaaacgatcttccgaacacattcaccacatcgacctggacgtccggactacccttagaaatcacgtatttttccgggacagatacggtgccaagcagcgcgaactgttttacattctgttggcatactctgagtataaccccgaagtggggtactgcagggacctttctcacattactgctctgtttctactttatttgcctgaggaggacgccttctgggccttagtgcagctcctagccagcgagcgccattcccttccagggtttcactctccgaacggtggcactgtgcaggggttgcaagatcagcaggagcatgtcgtgccaaagagtcaaccaaaaacgatgtggcatcaggataaagaggggctgtgcggccagtgtgccagcctgggctgtcttctacggaaccttattgatggtatcagcctggggctgacactccggctgtgggatgtataccttgtcgagggtgaacaggtactgatgccgatcacgtccatcgccctgaaagtgcagcagaagaggctgatgaagacgtctcgatgtggcctttgggctcgtcttagaaaccaattttttgacacttgggccatgaatgatgacaccgtgttgaagcacctgcgggcttccaccaaaaaattaacccgcaaacagggagatctaccgccacctgcaaagagagagcagggctccctggcccctcgtcccgtacccgctagccggggaggtaagaccctgtgtaaaggataccgccaggctccacccggaccacccgctcagttccagcggcctatctgtagcgcgtcccccccatgggcatccagattctccacaccatgcccagggggtgccgttagagaggatacatatcctgtagggactcagggcgtgccttccctcgcacttgctcagggcggacctcagggcagttggcggttcttagagtggaaaagtatgccaaggttgcctacagatctggatatcggaggaccatggttcccccattatgatttcgagtggagttgctgggttcgggctatcagccaggaggaccagctcgccacatgctggcaggccgaacactgcggggaggtgcacaacaaagacatgtcttggcccgaagagatgtcctttactgcgaacagctctaagatcgaccggcaaaaggtaccaacagagaagggggctacaggactgagtaatctgggtaatacatgctttatgaattcctccatccagtgtgtctctaacactcaaccactgactcaatatttcatctcagggagacatctctatgagctgaaccggactaatcctatcggaatgaaagggcatatggctaagtgctacggtgatctggtgcaggaactatggagcggtacacagaagtctgtggccccactcaagctccgacgcactattgcgaaatatgcccctaaattcgacggcttccagcaacaagactcgcaggaactgttagctttcttgcttgatggcctccatgaagatctgaatcgcgtacacgaaaagccttatgtcgagctcaaggactctgacgggagacctgactgggaagtggccgctgaggcttgggataaccaccttaggcgcaataggtctattattgttgatctcttccatgggcagttaagaagtcaagtcaaatgcaaaacatgtggacatatctctgtgcggttcgatcctttcaattttctgagcttgcctctacccatggatagttatatggatctggagattacagttatcaagctggatgggacgacccccgtgcggtatggcttgcgcctaaatatggatgaaaagtacactggtctcaagaagcagctcagagacctgtgcggcctgaactctgagcaaatcctgctggctgaagttcatgactctaacataaagatcagtcctctgcatcacctacagatggagtgtagcccatag

SEQ ID NO: 246011 - DNA, 84 bp, Artificial Sequence
  Description of Artificial Sequence: Synthetic coding sequence
atggacatggtggagaacgccgactcattacaggcccaggagagaaaggatattttaatgaagtacgataaagggcaccgctag

SEQ ID NO: 246012 - DNA, 174 bp, Artificial Sequence
  Description of Artificial Sequence: Synthetic coding sequence
atggatatggtggaaaacgccgactctttgcaagctcaagagaggaaggacatcctgatgaaatatgacaaaggacatcgcgcaggcctgcccgaggacaaaggatccccactggagagcacagctgcgctgatcgtgctcgctttctgcatgaggcgaagttgtctgctgtag

SEQ ID NO: 246013 - DNA, 3309 bp, Artificial Sequence
  Description of Artificial Sequence: Synthetic coding sequence
atgaatcatcagcagcagcaacagcagcagaaggccggagaacagcagcttagcgagccagaagatatggaaatggaagccggagacacagatgacccccctaggatcacccaaaaccctgtgatcaacggcaatgtggcactgtcagacgggcataatacggccgaggaagatatggaggacgacacttcttggaggtcagaggcaacttttcagtttactgtggagaggttttctagactgtccgagtcagtgctgtctcccccatgttttgtccgcaaccttccatggaaaattatggtgatgcccagattttatcccgacaggccccaccaaaagtctgtgggcttctttttacagtgtaacgccgagagcgacagtactagctggtcttgccatgcgcaggcagtgttaaagatcataaactatagagacgatgagaagtctttttctaggagaatctctcaccttttttttcataaggagaacgattggggttttagcaactttatggcctggtccgaagttaccgatcccgagaaggggttcattgatgatgacaaggttacctttgaagtcttcgtgcaggccgatgcaccgcacggtgtggcttgggacagcaagaaacacactggctacgtgggactgaagaaccagggcgctacctgttacatgaacagtcttttgcagactctgttcttcacaaaccagttacgcaaggcagtctacatgatgcccacagaaggcgacgactcctccaaatctgtaccgctagctctgcagagagtgttctacgaacttcagcacagcgataaacctgtggggactaaaaaattgaccaaaagcttcggatgggaaaccctcgatagctttatgcagcacgacgttcaggagctgtgccgagtgttgttagacaacgttgaaaacaagatgaagggaacctgtgtggaggggacgatccctaagttattcagaggcaagatggtgtcatatatccagtgcaaggaggtggactataggagcgacaggagggaagattactatgacatccagctaagcataaaggggaagaaaaacatcttcgagtcgttcgtggattacgtcgctgtagaacagttagacggcgataacaaatatgacgcaggcgaacacggcctgcaggaggcagagaaaggtgtgaagttcctcacgcttcctcctgtcctgcaccttcagctgatgcgattcatgtacgacccgcagactgaccagaacattaaaatcaatgaccgcttcgagttccccgaacagctccctctcgatgagtttctgcagaaaacagatcctaaggaccctgccaactatatattgcacgctgttctagtccattccggagataatcatggcggacattatgtcgtgtacctgaacccaaaaggcgacggcaagtggtgcaagttcgacgatgatgtggtaagtaggtgtactaaggaggaagctatcgaacacaattacggcggtcacgacgacgacctgagcgtgcgacactgcacaaatgcatacatgctcgtctatattcgcgagtcaaagttatccgaggtgctgcaagccgtgacagatcatgacatcccacagcagctggttgaacggttgcaagaggaaaaaagaatagaggcccaaaagcgaaaggagaggcaagaagcacatctgtacatgcaggtccagatcgtggccgaggaccaattctgcggtcaccaaggcaacgacatgtatgatgaggagaaggtaaagtatactgtatttaaggtcctgaagaacagctcacttgctgaattcgttcaatcactctctcagacaatgggcttcccacaggaccagatccgtctatggccaatgcaggctaggtctaacggcacgaaacgaccagcgatgctggataacgaggctgatgggaacaagaccatgatcgaattgagcgacaacgagaacccatggactatctttctggaaacagtagatcccgagctggcggcatcgggcgcaacactccccaagtttgacaaggatcacgacgtgatgctgttcctaaaaatgtacgaccccaagacacgatccctcaattactgcggacatatctacacacctatctcctgcaagattcgggacctgctgcccgtcatgtgcgaccgcgcaggatttattcaggatacgagcctgatactctacgaggaggtaaagcccaacctcaccgaaaggatccaggactatgatgttagtctggataaggctcttgatgaactcatggacggtgatatcatcgtgttccagaaagacgatccagaaaacgataactccgaactgcctacagcgaaagaatattttagggacctgtaccatcgggtggatgtgatcttctgcgacaagaccatccctaacgacccaggctttgtcgtgactctgtccaatcgtatgaattactttcaagtcgctaaaacggtggctcagcgactgaacacggaccctatgctgctccagttcttcaaatctcaagggtatcgtgacggtccaggaaacccactgagacacaattacgaaggcaccctccgagacttgttgcagttctttaaacctaggcagccaaaaaaactgtactaccagcaactgaaaatgaaaatcactgactttgagaatcgaaggtcctttaagtgtatctggttgaactcccaattccgcgaagaggagataacgctgtacccggacaagcacggttgtgtgagggatttgcttgaagagtgtaagaaggccgttgaattgggggagaaagccagcggtaaactgagactactcgaaattgtgagctataagatcatcggagtacatcaggaggacgagcttctggagtgtctgagccctgcaaccagccggacatttcgaattgaagagatccccctggaccaggtcgatatcgacaaagagaatgagatgctggtcaccgtggcacacttccacaaggaggtgttcgggacattcggcatcccgtttctcctgaggatccatcagggcgagcactttagagaggtgatgaaaagaatacagagtttgctggatattcaagagaaagagtttgagaagtttaaatttgctatagtgatgatgggacggcatcagtacatcaacgaggatgaatatgaggttaatctgaaagactttgaaccccagcctggaaatatgagccacccgaggccctggctgggtctcgatcatttcaacaaagcgccaaagcggtctcgctacacctatttagaaaaagcaattaaaatacataattag

SEQ ID NO: 246014 - DNA, 3333 bp, Artificial Sequence
  Description of Artificial Sequence: Synthetic coding sequence
tgcagccattcagacgtcggcgagcgcacctcccctatcccacagcagcggcctctgcaatcccacgcggagatggccggaaatcacagactcggcctcgaggcaggcgatacagatgaccccccacggattacacagaatcccgtgatcaatggaaacgtggctttgtctgatggacacaataccgccgaggaggacatggaagacgacacctcatggcgtagcgaagctaccttccagttcaccgttgagaggttttcaaggctgagtgaatcagttctctctccgccttgttttgtgaggaacctgccctggaaaataatggtgatgccacgattctatcccgacaggcctcaccaaaagtccgttgggtttttcctgcagtgtaacgctgaatccgattctacaagctggtcttgccacgcccaggcggtcctgaaaatcatcaattacagggacgacgagaaatctttttccagaagaatctcccacttgttcttccataaagagaatgactggggtttctccaattttatggcatggtcagaggtgacagatccagagaagggcttcatcgatgacgataaggtgacattcgaggtctttgtccaggccgacgctcctcacggcgtggcatgggacagcaagaaacacacaggttatgtgggcctgaagaaccagggtgccacgtgctatatgaatagcctactgcaaacactcttctttaccaaccagctgagaaaggctgtgtatatgatgccgacagagggcgacgattcatccaaaagtgtacctcttgccctccagcgagtattttacgagttgcagcattccgataagcctgttggtaccaagaagctgaccaagtccttcgggtgggaaactctggacagcttcatgcagcacgacgttcaggagttgtgccgtgtcctgttagataatgtcgaaaacaagatgaagggaacctgcgtggaagggactattcctaaattattcaggggtaaaatggtgagctacatccagtgcaaggaggtggattatagaagcgaccgccgagaggactattatgacatccagctcagtatcaaaggaaaaaaaaatattttcgaatctttcgtggactatgtcgcggtcgaacagcttgacggcgataataagtatgacgccggtgaacacggcctgcaagaggccgagaagggtgtcaaatttctaacactgccccctgtgctgcatttgcagctaatgcgcttcatgtacgacccacagacagaccaaaatataaaaattaatgaccgcttcgagtttcccgaacaactcccgctggacgaatttctccagaagaccgaccctaaggatcccgctaactatatccttcacgccgtcctggtgcatagtggtgataatcatgggggacactatgtggtctacttaaacccaaagggcgatgggaagtggtgcaaatttgacgatgatgtggtgtcccgctgtaccaaggaggaggccattgaacacaattatggaggtcatgacgacgatctgagtgtaaggcactgtactaacgcatacatgctggtttacatccgggagtctaagttgtccgaagttctgcaagccgtcacagaccatgatattccccagcagctcgtagaaaggttgcaagaggaaaagcgcatcgaagcccagaagaggaaggaacgtcaagaggctcacctgtacatgcaggtgcaaattgtcgctgaggatcagttttgtgggcaccagggaaatgatatgtacgacgaggagaaagtcaagtacaccgtgtttaaggtgctgaaaaactcgtcccttgcagagttcgtccaatcgctgagccagaccatgggctttcctcaggaccagattagactgtggccgatgcaagcacggtccaacggaacgaagcgtcccgctatgctggataatgaagccgacggaaacaagacaatgatcgagttgagtgataacgaaaacccctggacaatcttcctcgagacagttgatcccgaactggccgcttcaggtgccactttaccgaaatttgataaagaccacgacgtgatgctgttcctgaagatgtatgatccgaagaccaggtcactgaactactgcggacatatctacactcccatttcttgcaagattcgtgatctcctccctgttatgtgtgatagggctggcttcatccaggatacatcccttatactgtacgaagaagtgaagccgaatctgactgaaagaattcaggactacgacgtctccctcgacaaggctttagatgagttgatggatggggatataattgtttttcaaaaggacgaccccgagaacgacaattctgagctgccaacggcaaaggagtacttccgggacctctaccatcgggtagatgtgatcttctgtgacaagacaatcccgaatgatcctggcttcgttgttacactcagcaatcggatgaactattttcaggtggcgaagaccgttgctcagagactgaataccgacccgatgctgttgcaattcttcaaatcccaggggtaccgagacggccctggtaatccattgcgccataattatgaaggtacactacgggatctgcttcagttcttcaaacctcggcagcccaagaagctctattaccagcagctgaagatgaaaattactgactttgagaatagacgcagcttcaagtgcatttggctcaattctcagtttagagaggaagagataacgctctacccagataaacatggatgcgtccgggaccttctcgaggagtgtaaaaaggcagtcgaactgggcgagaaggccagtggcaagctacgtttactcgagatcgtttcttacaagatcataggtgttcaccaggaggatgaactgctggaatgcttgtcccccgctacaagtcggactttccggattgaagaaatacccctggatcaggttgatatcgacaaggaaaatgaaatgttggtcacagttgctcactttcacaaggaagtttttggaacatttggtattccatttctattacgaattcatcagggcgaacattttagggaagttatgaaaaggatccagagcctgttggacatccaagaaaaagaatttgaaaaattcaaattcgccattgtgatgatgggccgacaccaatacatcaatgaagacgagtatgaggtcaacctaaaggatttcgagccacaaccaggcaatatgtcccacccccgtccctggttggggctggatcactttaataaggcccctaagcggtcaagatatacctatctggagaaggcaattaagatacacaattag

SEQ ID NO: 246015 - DNA, 3012 bp, Artificial Sequence
  Description of Artificial Sequence: Synthetic coding sequence
atggttatgcctagattttaccctgatagacctcatcagaaatctgttggcttcttccttcagtgtaatgccgagtctgactctaccagctggtcttgccatgctcaggccgtattgaaaattatcaattacagagacgatgagaaaagtttctccagacgtatctcgcacttgttctttcataaagaaaatgattggggcttctccaacttcatggcatggagcgaagtcacagatccagagaaaggtttcatagatgatgataaggtcacattcgaggtctttgtgcaggctgatgcgcctcatggcgtggcgtgggacagcaaaaagcataccgggtacgttggccttaaaaaccaaggagccacgtgctacatgaatagcctccttcagacactgttttttaccaatcagttaagaaaggcagtttatatgatgccgacagagggagacgatagtagcaaaagtgtccccttggccttgcagagggtcttttacgaactgcagcattctgataagccagtaggtacaaaaaaactaactaagagctttggctgggagacacttgattcatttatgcagcacgacgtacaagaattgtgccgcgtgcttttagataatgttgaaaataaaatgaaaggcacgtgtgtggaaggcacaatccctaagttgttcaggggaaagatggtgtcatatatccaatgcaaagaggtggactatcgaagcgacaggcgggaagattattacgacatacagttaagtattaaaggtaaaaaaaatattttcgagtctttcgtcgactacgttgcagtcgagcagctggatggggataacaaatacgatgcaggcgagcatggtttacaggaggcggaaaagggcgtgaaatttttgacgctcccccctgttcttcacctccagctgatgcgcttcatgtacgatccacagaccgaccagaatatcaagatcaacgataggttcgagttcccagaacaactgccacttgatgaatttctgcagaagacggatccaaaagacccggcaaactatattcttcatgcggtcctggttcattcaggcgacaaccatggaggtcattacgttgtgtacttgaatccaaagggagatggcaaatggtgtaagtttgacgatgatgtcgtgagcagatgcaccaaagaagaagcaatcgagcataattatggcggacacgatgatgaccttagcgtgcgtcattgtacaaatgcctacatgcttgtgtatattcgtgagagtaaactgtctgaggtcctccaggcggtcaccgatcacgatatcccgcagcagctggtggagcggttgcaggaagaaaaacggatcgaggctcagaaacggaaggagaggcaggaggcgcacctctacatgcaagtacagatcgtcgctgaagatcagttttgtggccaccaggggaatgacatgtatgacgaggaaaaagttaagtatacagttttcaaagtgttgaagaactcaagcctggcagaatttgtgcagtctttatcacagacaatgggttttccccaggaccagattcgtctctggccaatgcaagccagaagtaatggcacaaagaggcctgcaatgttagacaatgaagcagatggaaataaaacaatgatcgagttgtctgataatgagaacccttggacaatctttctggaaactgttgatcctgaactcgcagcgtctggtgcaaccctgcctaaatttgataaggaccacgatgtgatgctgttcctcaagatgtacgatcccaagacccggtctctcaactattgcgggcacatctatacccccatatcctgtaagataagggacttgctgcccgtgatgtgtgatagggcaggatttatccaggacacctccctgattctatatgaggaagttaaacccaatcttacagagcggattcaggattacgatgttagcctcgataaggctctcgacgagttgatggacggcgacatcatcgtttttcagaaagacgatcctgaaaacgacaatagcgagctgcccactgccaaggagtacttcagggacctgtaccacagagttgacgtaattttctgcgataagacgatcccgaacgaccccggttttgtggtcactctcagtaaccggatgaattacttccaggttgccaaaaccgtggcccaacggctgaataccgatcctatgctgctccagttcttcaagtcacaggggtatagagatggcccaggtaacccgctgcgtcacaactatgagggcacactgcgcgacttgctgcagttcttcaaacctcggcagccaaagaaactttattaccagcagttaaagatgaaaattactgactttgagaataggcggtctttcaagtgcatttggttgaattctcagtttcgcgaggaggagatcactctttatcccgataaacatggctgtgtgagggatctgctcgaggagtgcaagaaggctgtggaactaggcgaaaaagccagtggcaagctgaggttgctcgaaattgtcagctacaagatcattggcgttcatcaggaggatgaactcctcgaatgcctgagcccagctacttcacgcacctttcgcatcgaagagatccccctggatcaggtcgatatagacaaagagaacgaaatgcttgtaaccgtggcccactttcacaaagaggtgtttggcacatttggaatccctttcctcctgagaattcaccagggcgagcactttcgggaagtgatgaaaaggattcagagcctgctcgatatccaggagaaggaattcgaaaaattcaaatttgcgatcgtgatgatgggaagacaccagtacattaatgaggatgaatatgaagtgaacctgaaggatttcgagccgcagccaggcaacatgagccatccgagaccttggttaggccttgaccattttaataaggccccaaagcggtcccggtacacgtaccttgaaaaggcgatcaaaatccacaattag

SEQ ID NO: 246016 - DNA, 1530 bp, Artificial Sequence
  Description of Artificial Sequence: Synthetic coding sequence
atggaggacgacacttcttggcgcagtgaagccaccttccaattcactgtggagcggtttagccggctttccgagtcagtcctttcccctccttgcttcgtcagaaacttaccttggaaaatcatggtcatgccaaggttttaccctgacagacctcaccagaaaagtgtcggcttttttctgcagtgtaacgccgagagtgactccactagctggtcctgtcatgcgcaggccgtactgaaaatcattaactaccgtgacgatgaaaagtcattctcacggaggatatcccacctgttctttcacaaagaaaatgactgggggttctctaactttatggcctggagcgaagtgacagaccctgaaaaaggctttatagatgatgataaagtcactttcgaggtgtttgttcaggccgacgcccctcacggtgttgcgtgggatagtaagaaacatacgggttatgtcggcctgaaaaaccaaggcgctacatgttatatgaatagcctcctccaaacccttttttttacaaatcagttgaggaaggctgtctatatgatgccaacagaaggtgacgattcctccaagtctgtgcccctcgccttacagcgcgtcttctacgagctgcagcattctgacaaaccagttggtactaaaaagctcacaaagagcttcgggtgggaaaccctggattctttcatgcagcacgatgttcaggagctctgtcgggtgttacttgataacgtagaaaacaagatgaaaggcacctgtgttgaaggaacgatccccaagctgtttaggggtaagatggtgagctatatccagtgcaaagaagtggactataggagcgacaggcgggaagactactacgatatccagctatccattaaggggaagaagaacatcttcgagtcctttgtcgactacgtggccgttgaacaactggatggagataacaagtacgatgcaggcgagcacgggcttcaggaagccgagaaaggagtgaaatttctcacattgcccccagtgctacacctgcagctgatgagattcatgtatgacccacagacagaccagaacatcaagattaacgacagatttgaattccctgaacagctaccactggacgagttcctgcagaagaccgaccctaaagatcctgccaattacatcttgcatgcggtgctcgtacacagcggcgataatcacggagggcactacgtcgtgtatttgaatcctaaaggggacggtaagtggtgcaagtttgatgacgacgtcgtgtctcggtgtacaaaagaggaggcgattgagcataattatggcggtcatgacgatgacttgtctgttcgacattgcacaaacgcatatatgttggtctacatccgagagtcaaaactgaccgtggggggtgccattacccggagagagaaggacagagggtctgaagcagagggggctgcagggtcgcccagtctgtacgcctctgcagattctagacgtgggccagtcctctggcctccccgagagtag

SEQ ID NO: 246017 - DNA, 7712 bp, Artificial Sequence
  Description of Artificial Sequence: Synthetic coding sequence
atgactgccacaacaaggggcagtcccgtgggaggaaatgacaaccaaggccaggccccagacggccagtcccagcctccgttacagcagaatcaaacgtctagccccgattcctctaacgagaatagccctgctactccgccagatgagcaaggccagggcgacgcgccaccccagctcgaggatgaggagcctgcgtttccccacacagatctcgccaagttagatgacatgattaataggccacgatgggttgtgcccgtgctcccgaagggagaacttgaggtcctcctggaggctgctatcgatctgtccaaaaagggcctagatgtcaagtctgaagcatgtcagagattttttcgggacgggctgactatctcctttaccaagatcctgacagacgaggcggtatccggttggaagttcgagatccaccggtgtatcataaacaatactcaccgcctcgtggagctgtgcgtggccaagctaagccaggactggtttcccttactcgagttgttggcaatggctcttaacccgcattgtaaatttcacatttataatgggaccagaccatgtgagagcgtcagttcgtcagtgcagctccccgaagacgaacttttcgcgaggagcccagatccgaggagtccaaagggctggctggtggacctactcaacaaatttgggaccctgaatggatttcagattctgcacgatcggttcatcaacgggtccgcactcaatgttcagatcatagccgctctaatcaagccgtttggacagtgctatgaatttctgacattgcacacagttaaaaagtacttcctaccaataattgaaatggtgccccagttcctggaaaacctcacggatgaagaattgaaaaaggaggctaagaatgaagcaaaaaacgacgcattgagcatgattataaaaagcctcaaaaatctggctagcagagtgcctgggcaggaggaaacagtgaagaatctagaaatctttagacttaagatgatcctgcgcctcctgcaaatatcctccttcaatggcaagatgaatgccctgaatgaggtgaataaagtgatttcttcagtgagttactacacgcatcgccacggcaatcccgaggaggaggagtggctcacagctgagcgtatggccgaatggatccagcagaacaacattctgtccattgtgctgcgagactcactgcaccaacctcaatatgtggagaaactcgaaaaaatcttgaggttcgtgatcaaggagaaggctttaaccctccaagatctggataacatctgggccgcacaagccggtaagcatgaggccatcgtcaagaacgtgcatgacctactggccaagctggcctgggatttctcaccagagcagctggatcacctttttgattgcttcaaagccagctggactaacgcctccaagaagcagagggagaagttattggaactgatcaggaggctggccgaagacgacaaggacggagtcatggcccacaaagtgttgaatctcttgtggaatctagctcactccgacgatgtgcctgtggacataatggatcttgccctgtctgctcacataaagattctcgattacagctgttcccaggatagagatacccaaaagattcaatggatcgaccgctttattgaagaacttcggaccaatgacaaatgggtcataccagctctaaaacagatcagggaaatctgttcactgtttggcgaagcgcctcagaatctctcacagactcagcgctcacctcatgtattctacagacacgatttgatcaaccaactgcagcataaccacgcactggtcacattggtggcagagaatctcgccacctatatggagagcatgaggctctatgccagagaccacgaggattacgatccccagaccgtgagactggggtctaggtactcacatgtgcaggaggtacaggaacgtctaaatttcttgaggttcctacttaaagacggccagctgtggctgtgtgctcctcaggcgaaacagatttggaagtgccttgcagagaatgcagtgtatctctgtgaccgcgaggcgtgctttaagtggtactcaaagttgatgggcgacgagcccgacctggatccagacatcaacaaagactttttcgaatccaacgtgctccaactggatccaagcctgctcacagagaacgggatgaaatgcttcgagcgcttttttaaggccgttaactgcagggaggggaagctggtggccaaacggagagcctatatgatggatgacctcgagctcataggactcgactacctgtggagagtggtgatacaatcgaacgacgacattgccagtagagctatcgatttgctaaaggagatatacacaaatctcgggcctagactgcaggtgaatcaagtggtgatccacgaagattttattcagtcctgtttcgatcggctgaaggccagttatgacactttgtgcgtcctggacggtgacaaggattctgtcaactgcgcacgacaggaggccgttagaatggtgcgagtcctgacggtcctccgggagtacattaacgagtgtgatagcgattatcatgaggagaggactatcctgcctatgagccgcgcttttcggggtaaacatctttcttttgttgttcgctttccgaaccaggggaggcaggtagatgatctggaagtttggagtcacacaaatgatacgatcggttcggtacgacgatgtatactcaacagaattaaagctaatgtggcccatacgaagatagaattgttcgtaggtggggagctgattgatcccgcagatgaccggaagctcattggccagttaaacctcaaagataaaagcctcattaccgccaaattaacccaaatcagcagcaatatgccaagctccccagatagcagttctgacagttccaccggatcacccggaaaccacggcaatcattactccgatggcccaaaccctgaggtggagagctgcctgcccggagttataatgtcgctccacccccgatacatctcgttcttatggcaggtagctgatctcggttcgagtctgaacatgccgccactccgtgacggtgctagggttctaatgaagctaatgcctcccgactccacaactattgaaaagctccgtgccatttgcttagatcatgctaaactgggcgaatccagcttgtcaccaagcttagacagcctgttcttcgggccatccgccagtcaggtcctatacctgacagaagtggtgtatgctctcctgatgcctgcaggggctccactggcagacgacagcagtgacttccagttccactttctgaaatcaggaggcttacccttggtcctcagtatgctgacccggaataactttctaccaaacgccgatatggagaccagacggggagcctacctgaacgctctgaagattgctaagctgcttctgaccgccatagggtacggacacgtgagggcggttgcagaagcttgccagcccggtgtagagggcgtcaatcctatgacgcagattaaccaggtaactcacgatcaggccgtggtactgcaatcggctctacaatccatacctaaccctagtagtgaatgtatgctgcggaatgtgtcagtgcggctggcacagcaaatttccgacgaagccagcagatatatgccggacatctgcgtcatcagagctatccaaaagatcatctgggcatccgggtgcggaagccttcagctggtcttctcccccaatgaggagattactaaaatctatgagaaaactaacgcaggcaacgaacctgacctcgaagacgagcaggtgtgctgcgaggctctggaggtcatgaccctgtgcttcgccttaattcctacggcactggacgcactcagcaaagagaaagcctggcagactttcatcatcgatctgctgttgcactgtcacagtaagactgtcaggcaggtcgctcaagaacagttttttctgatgtgcactagatgttgtatggggcaccggccactcctcttcttcattacacttctgtttacagtgctaggctccacagctcgagaaagggcgaagcatagtggagactactttacacttctaagacacctgctcaattacgcctataactctaacataaatgtgccgaatgccgaagtactacttaataacgagattgactggctgaagagaatccgggacgacgttaagcggaccggggagaccgggattgaggaaacaatcttggaaggccatctcggcgtgaccaaggaattgctggccttccagacgagcgagaaaaaatttcatattgggtgcgaaaaggggggagccaatttgatcaaagaactgatcgacgactttatattcccagcttccaatgtctacttgcagtacatgagaaatggtgagctgcccgcagagcaggctatcccggtgtgtgggagtcctcccaccatcaatgctgggttcgagcttctggttgcgctcgcagtgggctgtgtacggaacctgaaacagattgtggattccctgacagagatgtactatattggcacagccataacaacgtgcgaagcactgaccgagtgggaatacctgccccctgtaggcccacgcccacccaagggcttcgtgggcctcaagaacgcaggcgctacctgttacatgaattcagttatacaacagctgtatatgatacccagcatcaggaacggaattctcgccattgagggaactggctctgatgtggatgacgacatgtccggcgatgagaaacaagataatgagtcgaatgtggatccacgggatgacgtcttcgggtatccacagcaatttgaggataagcccgctctgtccaaaactgaggataggaaggagtataatattggggtgttgcggcaccttcaggtgatttttggacacctggccgcaagtagactccagtattatgtcccacgcggattctggaagcagttcaggctatggggtgaacccgtaaacctgagggaacagcacgacgcgcttgagttcttcaattccctggtcgattctttagatgaggcccttaaagcccttggtcatccggcaatgctctcaaaggtgttggggggaagctttgctgaccagaagatatgtcaagggtgccctcatagatatgagtgtgaggaatctttcaccacacttaacgtggatattcgaaatcaccagaatctgttagacagtctagagcagtatgtgaagggcgaccttctggaaggggctaacgcctatcactgtgaaaagtgtaataaaaaggtggacacagtgaaaaggttgctaataaagaagttgccacctgtcttggccatacaactcaagcgttttgattatgactgggagagagagtgtgccataaaatttaatgactactttgagtttccgagagaattggacatggaaccttacacggtggctggagtcgccaagcttgagggcgacaacgtgaaccccgaaagccagttgatccaacagagcgagcagtccgagtccgagacagccggatcaactaagtaccggcttgtgggcgtactggtgcacagcgggcaggcatctggcggacactattactcttatattatccagaggaacggcggagacggagagagaaaccgctggtacaaattcgacgatggagatgtgaccgagtgtaagatggatgacgacgaggaaatgaagaaccagtgcttcggtggagagtacatgggtgaagtgttcgaccatatgatgaaacggatgtcataccgccgacagaaacgctggtggaatgcttatatcttgttttacgagagaatggatactattgatcaagatgatgagctgataaggtatattagcgagttagctattaccactcggcctcaccaaatcatcatgccttctgccattgagcgctccgtccggaagcagaacgtgcagttcatgcacaatcgcatgcaatacagtatggaatatttccaattcatgaagaaactgctgacctgcaatggtgtgtacctgaatcctcccccaggccaggatcacttacttcctgaggccgaggaaattaccatgattagtatacaactcgcagcaaggtttctcttcactacaggctttcacaccaaaaaggttgttaggggaagcgcctcagactggtacgacgcactgtgcattctgctgcgccactctaagaacgtacggttctggttcgcccataacgtactctttaacgtgtccaacagattctctgaatatcttctggagtgccctagtgcagaagtgaggggggcattcgcaaagctgatagtgttcatcgcccacttcagtcttcaggacggcccttgcccctccccatttgcaagcccaggccctagctcccaggcgtacgacaatcttagcctctctgaccatcttctccgtgccgttctgaacctcttaaggcgcgaggtcagtgagcacggaaggcacctgcagcagtacttcaatttatttgtgatgtacgccaatctgggagtggcagaaaagacacagctcctcaagctgtccgtgccagcaacctttatgctcgtaagtctggatgaggggcctgggcctcctattaagtatcaatacgcagagttgggcaagctgtacagtgtagtgagccaattgatccgctgttgtaatgtgtcatccagaatgcaatctagtatcaatggaaacccacccttgcctaatccctttggcgatcccaatctgtcccagccaattatgccaattcaacagaatgtggccgatatcctgttcgtgaggacaagttatgttaagaaaatcattgaggattgcagcaactccgaagagactgtgaaactcctgagattctgttgctgggaaaaccctcagttttcttccacagtgctatcagagctgctgtggcaggtagcctacagttacacttacgaactccgtccatatcttgatctcctgttacagatcctgttaatcgaagacagctggcagacacaccgcatccacaacgccttgaaagggattcccgacgatcgagatgggctgttcgatactatccagagatctaaaaaccactaccagaaaagggcatatcagtgcatcaagtgtatggtggccttgttttccaactgccccgttgcttaccagattctgcagggaaacggcgacctgaagagaaaatggacatgggcagtagaatggctgggcgacgagttggaaaggagaccttatactggaaatcctcagtatacctacaataactggagtcccccagtgcagagcaatgagacgtccaacggttactttttggagcgctctcacagtgctcgcatgacgttggctaaggcctgtgaactctgccccgaggaagttaagaaggctacctctgtgcagcaaatcgaaatggaagaaagtaaggagccagacgaccaggatgctcctgacgagcatgaatcccctccccctgaagacgcccctctgtacccacactctcctggatcacagtatcaacaaaataaccacgtgcatggccagccctacactggacccgctgcccaccacatgaacaatccccagcgcacaggacagcgcgctcaggagaattacgagggatcagaggaagtctcccctcctcagacaaaagatcagta
